United States Patent 8,999,380 (MODIFIED POLYNUCLEOTIDES FOR THE PRODUCTION OF BIOLOGICS AND PROTEINS ASSOCIATED WITH HUMAN DISEASE) - sequence listing, part 6

SEQ ID NO: 8049 - DNA, 4500 bp, Artificial Sequence
  Description of Artificial Sequence: Synthetic coding sequence
atgacgcggatactgaccgctttcaaagtcgtccggacacttaagaccgggtttggcttcaccaatgtcaccgcccaccaaaagtggaaattctctcggcctggaatcaggttgttatctgtgaaggcgcagactgcccatatcgttctagaggatggcaccaagatgaagggatacagcttcggccaccccagcagcgtggctggagaggtggtgtttaatacagggttggggggctaccctgaagcgatcactgaccctgcgtacaagggtcagattcttaccatggccaaccctattatagggaacgggggcgcgcccgatacgactgcacttgacgagctgggcttgtccaaatatctggaatccaacggcatcaaggtgtctgggctgctagtactggattactcaaaggattataatcattggctggcaacgaaaagtctgggccagtggctacaggaagagaaggtgcccgccatttacggggtcgatacgcgcatgctgacaaaaataatcagggataaaggcactatgctgggaaaaatcgagttcgaagggcagcccgtggacttcgtggaccctaacaagcaaaatctgattgcagaggtgtccaccaaggatgtgaaggtgtatggtaagggtaatccgacaaaagtggtggctgtggattgcgggattaagaacaatgtcatccgtctgttggtgaaacggggcgctgaggtacacctcgtcccttggaaccacgactttacaaagatggagtacgatgggattcttatcgctgggggccccggcaaccccgcgctcgcagaaccgctgatacagaacgtgcgcaaaatattggaaagcgatcggaaggaaccactgtttggcatctccacgggaaacctgatcacaggtctggcggccggagccaaaacctacaagatgtccatggcaaatcgggggcagaaccagccagtcctgaacattacaaacaagcaggccttcattaccgctcagaaccatggttatgcattggacaacactctgcccgccggctggaagcccttgttcgtgaatgtgaacgatcagacaaacgagggaattatgcatgagagcaagccttttttcgctgttcagtttcatccagaagtcactcctggtccaatcgacaccgaatatcttttcgactcctttttcagcttgattaagaaaggcaaggcaacgactatcacatccgtgctgccaaagccagccctcgtggccagtagggtcgaagtgagcaaggtccttattctggggagcggtggattgtccatagggcaggccggcgaatttgactactccggctcacaggccgtgaaagcgatgaaagaggagaacgtgaagactgtgcttatgaacccgaacattgcaagcgtgcagaccaacgaagtgggtttgaaacaagccgacacagtttactttctgcccattactccgcagtttgtgacagaggtgatcaaggccgaacagccggacgggttaatccttggcatgggaggacagacagcactaaactgcggcgtggagctgtttaagcggggagtactcaaagagtatggggtcaaggtgctgggcacgagtgtagaatccatcatggcaacagaagatcggcagctgttttcagacaaactgaacgagatcaatgagaagattgctcccagcttcgcagtggagtcaattgaggacgcgctgaaggccgccgacacgattggctatcccgtgatgataagatcggcctatgctttggggggcctggggagcggtatctgtcccaatagggaaacgctgatggatctatccaccaaggccttcgctatgacaaaccaaatactggtggagaaaagcgtaactggatggaaagaaattgaatatgaagtggtgagggatgccgacgacaattgcgtgaccgtatgtaacatggagaatgttgacgctatgggagtccacacgggagatagcgtggttgtggcgcctgcccagaccttaagtaacgctgagtttcagatgttacgaaggacctccatcaatgtggtgcgacacttggggattgtgggagaatgtaacattcaattcgctctacaccccacatccatggagtattgtattattgaggtaaatgctcgcctgtctcggagctccgcactggcctcgaaggccacgggctatccgttagctttcatcgcagcaaagatcgcgctcggcatcccactccccgaaatcaaaaacgtggtgagcggtaaaacttccgcatgtttcgaaccttccctggactatatggtaaccaagataccccgctgggacctcgaccggttccacgggacgtcgagtcgtatcgggagctctatgaagtccgtgggggaggtgatggctataggccggacgttcgaagaatcatttcagaaagcactccggatgtgccacccctcaattgagggtttcacacccaggttgccaatgaacaaggaatggccctcaaacctggacctgagaaaagaactgagtgaaccaagtagtacaagaatatacgccatagctaaagccattgatgacaacatgagcctcgacgagatcgaaaagctcacatatattgacaagtggtttctgtacaaaatgagggatatcctgaatatggagaaaacactcaagggcctgaactctgagtctatgaccgaggagactttgaagcgggccaaggagatcggctttagcgacaagcaaatctcaaagtgccttggcctgaccgaggcacagactagggaactcagactgaagaaaaacatccacccatgggtgaaacaaatcgacaccttggcggcagagtacccttcagttacaaactatctgtacgtgacctataacggacaggagcacgatgtgaattttgacgatcatggcatgatggtgcttggttgtggcccatatcatatcggcagctcggtcgaatttgattggtgcgctgtgagctccatccgaaccctgagacagctgggcaagaagactgttgtggtgaattgcaatcccgagacagtgtccaccgacttcgatgaatgcgataagttgtatttcgaagagctgagtttagaacgtatattagacatctaccatcaggaggcgtgcggaggttgcataatcagcgtcggcggtcaaataccaaacaatcttgctgtgcccctatacaagaatggagttaagataatgggtacctcacctttgcagatcgaccgggctgaggaccgctccatcttctcagccgttctagatgagctgaaggtggcgcaggccccgtggaaagcggtcaatactctgaacgaggcactggaattcgccaagagcgtggactacccttgtcttctaaggccgtcttatgttttaagcgggtccgccatgaacgtcgtgttttctgaagacgaaatgaagaagttcctggaggaagcaactagggtctcacaggaacatcccgtagtcctcactaaatttgtggagggagccagagaagtcgagatggatgcagtgggtaaggatggaagggtgatcagccacgccatcagcgaacatgtcgaagacgcgggggtccactcaggggatgccactctgatgcttccaacccagacgatcagccagggcgcgatagagaaggttaaagatgctactcgcaagatcgctaaggccttcgccatttccgggccctttaatgtgcagtttctggtcaagggcaacgacgtactcgtgatcgagtgcaacctccgtgcatcacgttccttccctttcgtatctaaaaccctgggggtggacttcattgacgtcgctaccaaagtgatgattggcgaaaacgttgatgagaaacatcttcctacattggatcaccctatcattcctgccgattatgtggccataaaggcccccatgttttcctggcctagactgcgtgacgccgacccaatccttcgctgcgagatggcatcgactggcgaggtggcctgtttcggggaggggatacataccgcttttctcaaggccatgttgagtacagggttcaagattccgcagaagggcatcctgatcggtatacagcagagcttcaggccaaggttccttggagtggccgaacagctgcacaacgagggctttaaactcttcgcaacagaagccaccagcgattggctgaatgctaataatgtacctgcaactccagtcgcttggcccagccaggaagggcagaacccatcactcagcagcatcaggaaattaatccgagatggatcgatcgacctagtaatcaacctacccaacaacaataccaagttcgtacatgacaattacgttattaggagaacagccgtggacagcggtatccccctgctgacaaattttcaggtgacaaagctcttcgctgaagccgtccagaagtccaggaaggttgattctaagagcctgttccactataggcaatattcggccgggaaggccgct

SEQ ID NO: 8050 - DNA, 4500 bp, Artificial Sequence
  Description of Artificial Sequence: Synthetic coding sequence
atgacgagaatactcaccgctttcaaagtggtgaggaccctgaaaactggattcggtttcacgaacgtgactgcccatcaaaaatggaagttcagccgcccggggatccgactgctgtcggtcaaggcgcaaacggcccacatcgtcctcgaagatggaactaaaatgaagggatacagcttcggacacccgtcctccgtggctggagaagtggtgttcaacaccggactgggaggctatccggaggcgatcaccgatcccgcttacaaaggacagatcctcacgatggcaaacccgatcatcggaaacggaggagccccggacaccaccgcccttgacgagctcggtctttccaagtacctcgaaagcaatggcatcaaggtgtccggtctgctcgtcttggattactcgaaggactacaatcattggctggccactaagtctctgggacaatggcttcaggaggagaaagtgccggcaatttacggagtggatacgagaatgctgacgaagattatccgcgataagggcactatgcttggaaaaatcgagttcgagggacagccggtggacttcgtggacccgaataagcagaacctcatcgcggaggtgagcactaaggacgtgaaggtctacggtaagggtaacccgaccaaagtcgtcgccgttgactgtggtatcaaaaacaatgtgattcgcctgctggtgaaacggggagcagaggtgcatctcgtcccgtggaatcatgactttactaagatggaatacgatgggatccttatcgccggcggaccaggaaatcctgcactggccgagccacttatccaaaacgtgcgcaagattctggaatcagataggaaagagcccctgttcggaatcagcaccggtaacctgatcactggactcgcagccggtgctaagacttataagatgagcatggcaaaccgcggacaaaaccagccggtcctgaacatcaccaacaagcaggcgttcatcaccgctcaaaaccacggatacgcactggacaacactctcccggccggatggaagccgctttttgtgaatgtgaatgatcagacgaacgaagggatcatgcacgaaagcaagcctttcttcgctgtacaattccacccagaagtgactcccggaccgatcgacaccgaatacctgtttgactcgtttttctccctgatcaaaaaaggcaaggccacgacgatcacttcggtgctgccgaagccggctctggtggcctcgcgcgtggaagtgtccaaagtgttgatccttggctcgggagggttgtcgatcggccaggcgggagaattcgactacagcggcagccaggcggtcaaggccatgaaagaggaaaacgtgaaaactgtcttgatgaacccgaacatcgcctccgtgcaaactaacgaagtcggactcaagcaggcggatactgtgtacttcctgcctatcactcctcagttcgtgactgaagtgatcaaggctgagcagccagacggcctgattcttggaatgggcggtcagactgctctgaactgcggagtcgaactcttcaagcgcggcgtgcttaaagaatacggtgtgaaggtcctgggcacttcggtcgagtcaattatggctactgaggaccgccaacttttctcggacaagttgaacgaaatcaacgagaagatagcaccgtcctttgccgtggagtccatcgaagatgcactcaaagcagcagacaccattggctacccggtgatgatccgctcagcgtacgctctgggaggcctgggatccgggatctgtccaaacagggaaaccctgatggacctcagcaccaaggcgttcgcaatgactaatcagatcctggtggagaagtcagttaccggatggaaagaaatcgagtacgaggtggtgcgcgatgcagatgataattgcgtgaccgtctgcaacatggagaacgtggacgccatgggcgtccacaccggtgactccgttgtggtggcccccgcccagactctttcaaatgccgaattccagatgcttaggcggacttcgatcaacgtggtccggcatctgggaattgtgggagagtgcaacatccaattcgcgctccaccctacttcgatggaatactgcatcatcgaagtgaatgcgcggctgtctcggagcagcgccctcgcctccaaagcaaccggatacccgctggctttcatcgcagccaaaatcgccctgggaattcctcttccggaaatcaagaacgtggtgtcaggaaagactagtgcctgcttcgagccctccttggactacatggtcacgaagatcccacgctgggacctggacagatttcacggaacctcttcgcgcatcggctcgagcatgaagtcggtaggggaggtgatggccattggccgcactttcgaagagagctttcagaaagcactgcgcatgtgccatccgtcaatcgaaggatttactccgagacttcccatgaacaaggagtggccgagcaatctcgatctgagaaaagagctctcagaaccgtccagcacgcgcatttacgcaatcgcaaaagccattgatgacaatatgtcccttgacgagatcgaaaaactgacttacatcgacaagtggttcctctataagatgcgcgacattctgaacatggaaaagacgctgaagggactgaactccgagtcgatgaccgaagagactctgaagcgcgctaaagaaatcggtttctccgataagcagatctcgaaatgcctgggactcactgaggcgcagacccgcgaactgcgcctcaagaaaaacatccacccgtgggttaagcagatcgacaccctggccgctgagtacccatccgtgaccaactacctctacgtgacctacaacgggcaggaacatgatgtcaatttcgacgatcatggaatgatggtgctcggttgtggaccgtaccacatcggatcgtcggtcgagttcgattggtgtgcggtgtcgtcaatccggaccctgagacaactgggaaagaaaaccgtggtcgtgaactgcaaccctgaaaccgtctcgaccgatttcgatgaatgcgataagctgtacttcgaggaactgagcttggaacgaatcctggacatctaccatcaggaagcgtgtgggggctgcatcatctccgtgggcggacagattcctaataacctggctgtccctctgtacaagaacggcgtgaagattatgggcacctcgccacttcagatcgacagggctgaagatagatcgatcttctccgccgtgcttgacgaactgaaggtggcgcaggcgccgtggaaagcggtcaacaccctcaatgaagcactcgagttcgcgaagtctgtggactacccctgcctcttgcgcccgtcatacgtgctctcgggctcggccatgaacgtggtattctcggaggatgaaatgaaaaagttcctcgaggaggcgactagagtgtcacaggaacacccggtggtgttgactaaattcgtggaaggcgcgcgggaagtggagatggacgcggtcggcaaagatggacgggtgatcagccatgccatctccgaacacgtcgaagatgccggtgtccactcgggggacgcgactcttatgctcccaactcagacgatcagccagggtgcaatcgaaaaggtgaaggacgccactcgtaagatcgccaaggcttttgccattagcggtccgttcaacgtccaattcttggtcaagggaaatgacgtcctggtgatcgagtgcaacctgcgggcttcccgttcatttccctttgtgagcaagactctgggtgtggactttatcgacgtcgccaccaaggtcatgatcggggaaaacgtggatgagaaacatctcccgacgctcgaccacccaatcatcccagctgactacgtggcgatcaaggcgccgatgttctcctggccgcgactgagggatgctgacccgatcttgagatgtgagatggccagcactggcgaagtcgcgtgcttcggagagggaattcatactgcgtttctgaaggcgatgctgtcaacgggattcaagatcccgcagaaaggaatcctgatcggcatccagcaatcgttcagaccacgcttcctcggagtggccgaacaactgcacaacgaaggattcaagttgttcgcgaccgaggctactagcgattggctcaacgcgaacaatgtgcctgcgaccccggtggcgtggccgagccaggaaggacagaacccatcactcagcagcatccggaaacttatccgcgacggatccatcgacctggtgatcaatctgcctaacaacaatactaagttcgttcacgataactatgtgatccgccggaccgcggtggattcaggaattccactgcttactaactttcaggtgaccaaactgtttgccgaagcagtccagaagtctcggaaggtggactccaaaagcctgttccattatcggcagtactcggcgggtaaagcagct

SEQ ID NO: 8051 - DNA, 4500 bp, Artificial Sequence
  Description of Artificial Sequence: Synthetic coding sequence
atgacgcgaatattaacggcgtttaaagtagtacgtacgttaaaaacgggttttggttttacgaatgttacggcgcatcaaaaatggaaattttcgcgtccgggtatacgtctattatcggtaaaagcgcaaacggcgcatatagtattagaagatggtacgaaaatgaaaggttattcgtttggtcatccgtcgtcggtagcgggtgaagtagtttttaatacgggtctaggtggttatccggaagcgataacggatccggcgtataaaggtcaaatactaacgatggcgaatccgataataggtaatggtggtgcgccggatacgacggcgttagatgaattaggtctatcgaaatatttagaatcgaatggtataaaagtatcgggtctattagttttagattattcgaaagattataatcattggttagcgacgaaatcgttaggtcaatggctacaagaagaaaaagttccggcgatatatggtgtagatacgcgaatgttaacgaaaataatacgtgataaaggtacgatgctaggtaaaatagaatttgaaggtcaaccggttgattttgtagatccgaataaacaaaatctaatagcggaagtatcgacgaaagatgtaaaagtatatggtaaaggtaatccgacgaaagttgttgcggtagattgtggtataaaaaataatgttatacgtctactagtaaaacgaggtgcggaagttcatttagtaccgtggaatcatgattttacgaaaatggaatatgatggtatactaatagcgggtggtccgggtaatccggcgctagcggaaccgttaatacaaaatgttcgtaaaatactagaatcggatcgtaaagaaccgttatttggtatatcgacgggtaatctaataacgggtctagcggcgggtgcgaaaacgtataaaatgtcgatggcgaatcgtggtcaaaatcaaccggtattaaatataacgaataaacaagcgtttataacggcgcaaaatcatggttatgcgctagataatacgttaccggcgggttggaaaccgttatttgtaaatgttaatgatcaaacgaatgaaggtataatgcatgaatcgaaaccgttttttgcggttcaatttcatccggaagtaacgccgggtccgatagatacggaatatctatttgattcgtttttttcgttaataaaaaaaggtaaagcgacgacgataacgtcggtactaccgaaaccggcgctagtagcgtcgcgtgtagaagtatcgaaagtattaatattaggttcgggtggtctatcgataggtcaagcgggtgaatttgattattcgggttcgcaagcggttaaagcgatgaaagaagaaaatgtaaaaacggttttaatgaatccgaatatagcgtcggtacaaacgaatgaagttggtttaaaacaagcggatacggtatattttctaccgataacgccgcaatttgtaacggaagttataaaagcggaacaaccggatggtttaatattaggtatgggtggtcaaacggcgttaaattgtggtgtagaattatttaaacgaggtgtactaaaagaatatggtgttaaagttttaggtacgtcggtagaatcgataatggcgacggaagatcgacaattattttcggataaactaaatgaaataaatgaaaaaatagcgccgtcgtttgcggtagaatcgatagaagatgcgttaaaagcggcggatacgataggttatccggttatgatacgttcggcgtatgcgctaggtggtttaggttcgggtatatgtccgaatcgtgaaacgttaatggatctatcgacgaaagcgtttgcgatgacgaatcaaatactagtagaaaaatcggtaacgggttggaaagaaatagaatatgaagtagtacgtgatgcggatgataattgtgtaacggtttgtaatatggaaaatgttgatgcgatgggtgttcatacgggtgattcggtagtagtagcgccggcgcaaacgttatcgaatgcggaatttcaaatgttacgacgaacgtcgataaatgtagtacgacatctaggtatagtaggtgaatgtaatatacaatttgcgttacatccgacgtcgatggaatattgtataatagaagtaaatgcgcgtctatcgcgatcgtcggcgctagcgtcgaaagcgacgggttatccgctagcgtttatagcggcgaaaatagcgttaggtataccgctaccggaaataaaaaatgtagtatcgggtaaaacgtcggcgtgttttgaaccgtcgctagattatatggtaacgaaaataccgcgttgggatttagatcgttttcatggtacgtcgtcgcgaataggttcgtcgatgaaatcggtaggtgaagttatggcgataggtcgtacgtttgaagaatcgtttcaaaaagcgctacgtatgtgtcatccgtcgatagaaggttttacgccgcgactaccgatgaataaagaatggccgtcgaatttagatttacgaaaagaattatcggaaccgtcgtcgacgcgtatatatgcgatagcgaaagcgatagatgataatatgtcgctagatgaaatagaaaaactaacgtatatagataaatggtttctatataaaatgcgagatatattaaatatggaaaaaacgctaaaaggtctaaattcggaatcgatgacggaagaaacgctaaaacgtgcgaaagaaataggtttttcggataaacaaatatcgaaatgtttaggtttaacggaagcgcaaacgcgtgaattacgtctaaaaaaaaatatacatccgtgggtaaaacaaatagatacgttagcggcggaatatccgtcggttacgaattatttatatgtaacgtataatggtcaagaacatgatgttaattttgatgatcatggtatgatggttctaggttgtggtccgtatcatataggttcgtcggtagaatttgattggtgtgcggtttcgtcgatacgtacgttacgtcaattaggtaaaaaaacggtagttgttaattgtaatccggaaacggtttcgacggattttgatgaatgtgataaattatattttgaagaactatcgctagaacgtatattagatatatatcatcaagaagcgtgtggtggttgtataatatcggtaggtggtcaaataccgaataatctagcggtaccgctatataaaaatggtgtaaaaataatgggtacgtcgccgttacaaatagatcgtgcggaagatcgatcgatattttcggcggttttagatgaactaaaagttgcgcaagcgccgtggaaagcggtaaatacgttaaatgaagcgctagaatttgcgaaatcggtagattatccgtgtctattacgtccgtcgtatgttctatcgggttcggcgatgaatgtagttttttcggaagatgaaatgaaaaaatttctagaagaagcgacgcgtgtttcgcaagaacatccggtagttttaacgaaatttgttgaaggtgcgcgagaagttgaaatggatgcggttggtaaagatggtcgagtaatatcgcatgcgatatcggaacatgtagaagatgcgggtgttcattcgggtgatgcgacgttaatgttaccgacgcaaacgatatcgcaaggtgcgatagaaaaagttaaagatgcgacgcgtaaaatagcgaaagcgtttgcgatatcgggtccgtttaatgttcaatttttagtaaaaggtaatgatgttctagttatagaatgtaatttacgagcgtcgcgatcgtttccgtttgtatcgaaaacgttaggtgtagattttatagatgttgcgacgaaagtaatgataggtgaaaatgtagatgaaaaacatttaccgacgttagatcatccgataataccggcggattatgttgcgataaaagcgccgatgttttcgtggccgcgtttacgtgatgcggatccgatactacgttgtgaaatggcgtcgacgggtgaagttgcgtgttttggtgaaggtatacatacggcgtttttaaaagcgatgttatcgacgggttttaaaataccgcaaaaaggtatattaataggtatacaacaatcgtttcgtccgcgatttctaggtgttgcggaacaactacataatgaaggttttaaactatttgcgacggaagcgacgtcggattggctaaatgcgaataatgttccggcgacgccggtagcgtggccgtcgcaagaaggtcaaaatccgtcgttatcgtcgatacgtaaattaatacgtgatggttcgatagatttagttataaatctaccgaataataatacgaaatttgttcatgataattatgttatacgtcgaacggcggtagattcgggtataccgttactaacgaattttcaagttacgaaattatttgcggaagcggttcaaaaatcgcgaaaagtagattcgaaatcgctatttcattatcgtcaatattcggcgggtaaagcggcg

SEQ ID NO: 8052 - DNA, 4500 bp, Artificial Sequence
  Description of Artificial Sequence: Synthetic coding sequence
atgactcgcatcctcactgccttcaaggttgtgcgcacccttaagacgggcttcggatttactaatgtgacggcgcaccagaagtggaagttttcccgcccgggtatccggctgctgagcgtgaaggcgcagaccgcacacatcgtactcgaggacggaactaagatgaagggctactccttcggccacccgtcctcggtcgcgggggaggtggtgttcaacactggactgggagggtacccagaggctatcaccgatccggcctataaaggccaaatcttgaccatggccaaccctatcatcggaaacggcggagccccagacactacggcactcgacgagctcgggctctccaagtacctggagtcgaatggtatcaaagtgtcaggactcctggtgctggattacagcaaggactataaccactggctggcaactaaatcgctcggacagtggctgcaagaggagaaggtgccagccatctacggtgtggacactcggatgctgaccaaaatcatccgggacaaaggcactatgctgggcaaaatagaattcgaaggccaacccgtggatttcgtcgatccgaataagcaaaacctgatcgctgaggtgtccactaaggacgtgaaggtctacggcaaagggaatccgacgaaggtcgtcgcggtggactgcggaatcaagaacaacgtcattcggctcctggtcaagaggggagcagaagtgcatctcgtcccgtggaatcatgactttaccaagatggagtacgacggaatcctgatcgctggcggaccaggcaacccagccctcgccgaaccgttgatccagaacgtgaggaagatcctggagtcagatcgcaaggaaccgctttttggaatctcgactgggaatctgatcactggactggccgccggagctaagacttacaagatgtcgatggcgaaccgcgggcaaaaccaaccggttctgaacatcaccaataagcaggcctttatcaccgcacagaaccatggatacgctctggacaacaccctgcccgcagggtggaagccgctgttcgtgaatgtgaacgaccaaaccaacgaaggaatcatgcacgaatcgaagccgtttttcgccgtccaatttcatcctgaagtcacgccgggacctatcgataccgagtacctgtttgactcgttcttcagcctgatcaagaagggaaaggcgaccactatcacctccgtgctgcctaagccggcgctggtcgcgtcacgggttgaagtgtcgaaggtgctgattctgggatcaggcgggctgtccatcggacaagccggagaattcgattactccggatcgcaggctgtgaaggcaatgaaggaggagaatgttaagaccgtgctgatgaacccgaacatcgcaagcgtgcaaactaatgaagtgggactgaagcaggcagatactgtctacttcctgccgattacgccgcagtttgtgaccgaggtgatcaaggcagagcagccggatggtttgattctgggaatgggcggacaaaccgctctcaactgcggagtggagttgttcaagcggggcgtgctgaaggagtacggagtcaaggtgctgggaacttccgtggaaagcatcatggccactgaagataggcagcttttctccgacaaactgaacgagattaacgaaaagatcgccccctccttcgctgtcgaatcaatcgaagatgctctcaaggccgcggacactatcggataccctgtgatgatcaggtcagcgtacgcactgggagggctgggatcgggaatctgcccgaaccgagaaactctgatggacttgagcaccaaggccttcgcgatgaccaaccagattctggtggagaagtcggtcactggctggaaagaaatcgagtacgaggtagtgagagacgctgatgacaactgtgtgaccgtctgcaatatggaaaacgtggatgccatgggagtgcacactggagacagcgttgtggtggcgccggcgcagaccctctccaacgctgaattccagatgctccgcagaacctcgatcaacgtcgtgcggcacctggggatcgtcggagagtgcaacatccagttcgctctccacccaacctcgatggagtactgcatcatcgaggtgaatgcccgcctgtcaagatcgagcgcgctggcttcaaaggcaaccggatacccgttggccttcatcgcggctaaaatcgccctgggcatcccgctgcctgaaatcaagaatgtagtctcaggaaagacgtcagcttgtttcgagccgtcactggattacatggtgacgaagatcccgcggtgggacctggacagatttcacggaacttccagccgcatcggatcgtcgatgaagagcgtgggtgaagtgatggcaatcggccgcacctttgaagagtctttccagaaggcccttcggatgtgccacccctcgatagaaggcttcacgccgcgccttccgatgaacaaggagtggccttcgaacctcgatctgcggaaggaactttccgaaccgtcatctaccaggatttacgctatcgccaaggcgatcgacgacaatatgagtcttgacgaaatcgagaaactgacctatatcgataaatggttcctgtacaagatgcgcgacattcttaacatggagaaaactctgaagggtcttaacagtgagtccatgactgaagaaactctgaagagagcaaaggagattggtttctcagataagcaaatttcgaagtgtctcggactgaccgaggcacagactcgcgagctccgactgaagaagaacatccatccctgggtgaagcaaatcgacaccctggcggctgaatacccaagcgtcaccaactacctgtacgtgacgtacaacggacaagagcacgacgtgaacttcgacgatcacggcatgatggtgctgggatgtggaccgtaccacatcgggtcgtcggtcgagttcgactggtgtgccgtgtcctcgatccgcactctgcggcaactcggtaaaaagaccgtggtcgtgaactgcaacccggaaactgtttccaccgacttcgacgagtgcgataaactgtactttgaagaactgagcctggaaagaatcctcgatatctaccatcaggaagcctgcgggggatgtattatctccgtcggaggccagatccccaacaacctggcagtgccgttgtacaaaaacggagtcaagattatgggaacgtccccgctccagattgacagggcggaggaccgcagcatcttctccgcagtgctcgacgaactgaaggtcgcccaagcaccttggaaagccgtgaacaccctcaacgaagctcttgagttcgcgaaatcagtggactacccgtgcctccttcggccgagctacgttctgtccgggtcggccatgaacgttgtcttttcggaagatgaaatgaagaagtttctcgaagaggccacccgggtgagtcaggaacacccggttgtcctgaccaaattcgtggaaggggccagagaggtggaaatggacgccgtgggaaaggacggacgcgtgatctcgcacgccatttcagaacacgtggaggacgcaggagtccactccggagacgctaccctcatgctgccgactcagactattagccagggcgccatcgaaaaggtgaaggacgcaactcgcaaaatcgcgaaggcgttcgccatcagcggaccgttcaacgtgcagtttctcgtgaagggtaatgacgtgctcgtcattgaatgtaacctgagagcatcacgctcgttcccattcgtctcaaaaacccttggagtggactttatcgacgtcgcgactaaagtgatgatcggcgagaacgtcgacgaaaaacatttgcccaccctcgatcatccaatcatcccagctgactacgttgccatcaaagcgccgatgttcagctggccacggctgcgagatgctgatcccatcctgcgctgtgaaatggcttccactggtgaggtggcgtgtttcggagaggggatccataccgccttcctgaaggctatgctgagcactgggttcaagatcccgcaaaaggggatcctgatagggattcagcaatcgtttcggccgagatttctcggcgttgctgaacagttgcacaacgaaggtttcaaactcttcgccaccgaagcaacctcggattggctgaatgccaataatgtcccagctaccccggtggcatggccttcccaggaaggacaaaatccatcactgtcgtccatcagaaagctcatccgcgatggatccattgatctggtcataaacctgccgaataacaacactaaattcgtgcacgacaattacgtcatcagaaggaccgccgtggacagcggaatccctctgctcactaacttccaggtcactaagctcttcgccgaagccgtgcagaagagtcggaaagtcgattcgaagtcactgtttcattaccgccaatactcggcgggaaaggcggca

SEQ ID NO: 8053 - DNA, 4500 bp, Artificial Sequence
  Description of Artificial Sequence: Synthetic coding sequence
atgacgcgcatacttactgcatttaaggtggtgaggactcttaagaccgggtttggattcacgaacgttaccgcccaccagaaatggaagtttagtagacctggcattaggctgctctcggtgaaggctcagaccgcccacatcgtactcgaggacggtaccaaaatgaagggatacagcttcggacacccttcatccgtggcaggtgaggtcgtgttcaataccggattgggaggataccctgaagcaattactgaccctgcctataaagggcaaattcttactatggcaaacccgattattggaaatgggggtgcacccgacactacggcgctggacgaactgggactctccaagtacctggaatcaaacggaattaaggtgagcggacttcttgttctggattactccaaggattacaaccattggctcgcaaccaagtcgctgggtcaatggctccaggaagaaaaggtgcccgcaatttacggggtggataccagaatgcttactaagattattcgtgacaagggaactatgcttggtaagattgaattcgaaggtcagcccgtggactttgtggaccctaataagcaaaacctcatagccgaagtgtcaaccaaagacgtgaaggtgtacggtaaaggcaaccctacgaaagtggtggccgtggactgcggtattaagaacaatgttatacgccttctcgtgaaacgaggagcagaagtgcaccttgtgccctggaaccatgattttactaaaatggaatacgatggaatcctgattgcaggaggacctggaaaccccgcgttggcagaacctctgattcaaaatgtcagaaagatcctggaatccgacagaaaggaacctctgttcgggataagcactggtaaccttattacgggactggccgcgggtgctaagacttacaagatgtccatggcaaacagaggccaaaaccagcctgtccttaacattactaataagcaggccttcataacggcccagaaccatggatacgcactcgacaacacccttccagcgggatggaagccactctttgtgaacgtcaacgaccaaactaacgagggaatcatgcatgagtcaaagccattcttcgcagtccagtttcatcccgaagtgactccaggtcctattgataccgaatacttgttcgattcgtttttctccctcataaagaaaggtaaagcaactaccatcacctcggtgctgcccaagcctgcccttgtggcatcccgagtggaagtgagtaaggtgctgatccttggttccggagggcttagtattggacaagcaggagaatttgattactccggatcacaagcagtgaaagcaatgaaggaggaaaatgtgaaaacggtgctgatgaatcccaacatcgcatcagtgcagacgaacgaggtgggcctcaagcaagccgatacggtgtacttcctcccaattaccccacagttcgtcaccgaagtgatcaaggcagaacagcctgacggccttatacttggaatgggtgggcaaaccgcccttaattgtggagtcgaattgttcaagagaggagtccttaaggaatacggggtcaaggtcctgggtacctctgtcgaatccatcatggccaccgaggatcgccaactgttttcggataagctgaacgagattaacgaaaagatcgccccttcctttgcggtggagtcgattgaagatgcgcttaaggcagcggataccattggctaccccgtgatgattagaagcgcttacgcacttggtggtcttggatccggtatctgtcccaacagagaaactctgatggatctgtcgaccaaggcattcgcgatgaccaaccaaatactggtggaaaagtcagtgactgggtggaaggaaatagagtacgaagtggtgagggatgcggacgacaactgtgtcacggtgtgtaatatggagaatgtcgacgcgatgggggtccacactggagattccgtggtggtggcaccagcccagactctctctaatgcagaattccagatgctgcggagaacctctattaacgtggtcagacatcttggaattgtgggtgagtgtaacatccagttcgcactgcatccaacctcgatggaatactgtattatcgaagtgaatgcaagactgagccgctcctcggccctggcatcgaaggccactggttacccactcgcgttcattgctgcaaagattgccctcgggatcccactccctgaaatcaaaaacgtggtgtcgggtaagacttcagcatgcttcgagccgtcccttgactacatggtcaccaagattcctagatgggaccttgataggttccatggtactagctcaagaataggttcaagcatgaagtcggtgggggaagtcatggccattggccgaacttttgaagagtcgtttcagaaggcgttgcgaatgtgtcatcctagcatcgaaggttttacccccagacttcccatgaacaaggagtggccatcgaacctcgaccttcggaaggaactgtccgaacctagctcaactaggatttacgccattgcaaaagcgatcgacgacaatatgtcgctggatgaaattgaaaaacttacgtacattgacaagtggtttctttacaagatgcgggatatcctgaacatggaaaaaactctcaagggacttaactcagagagcatgaccgaagagactctcaaaagggccaaggaaatcgggttctccgataagcagatatcgaagtgtcttggcttgacggaagcccagactcgcgaactgcggctcaagaaaaacattcacccctgggtcaagcagattgataccctggccgccgagtacccgtctgtgaccaactatctctacgttacttacaatggtcaggagcatgacgtcaactttgatgaccatggaatgatggtgctgggatgcggaccgtaccacatcggatcaagcgtggagtttgactggtgtgccgtctccagcatccgaactctgcgccagcttggaaagaaaaccgtggtggtgaactgtaacccagaaactgtgtcgactgattttgatgaatgtgataaactttactttgaagaattgagcctggaacgaatcctggacatttaccaccaggaagcatgcggaggctgcatcatttccgtgggtggacagattccaaataacctggcggtcccactctacaagaacggggtcaagatcatgggtactagcccacttcaaattgatagggcagaggacaggtcaatcttttcggcagtgcttgatgaactcaaagttgcacaagcaccttggaaagcagtgaacactcttaacgaagcactggagttcgccaagtcagtcgattacccgtgcctgctgaggccttcatatgtgctttcgggatcggcaatgaacgtggtgttttcggaagatgaaatgaagaagtttcttgaagaggcgactcgggtgtcgcaggaacaccctgtggtgcttacgaagtttgttgaaggagcccgcgaagtcgaaatggacgcagtgggaaaggacggacgcgtcatttcccatgcaatcagcgagcatgtcgaagatgcaggtgtgcactccggagacgcgactctcatgctccctactcagaccatctcacaaggggccatcgaaaaggtgaaggatgccacccggaagattgcaaaggctttcgcaattagcggtccgtttaatgtgcaattcctggtgaaaggaaacgacgtcctggtgatagaatgtaaccttagggcatcgcgctcctttccttttgtcagcaagacccttggggttgactttattgatgtcgcaactaaagtcatgattggagagaatgtcgatgaaaaacatctgcctaccctggaccatcccatcatccctgctgattacgtggcaatcaaggcacctatgttttcctggccgcgtctgcgcgacgcagacccaatactgagatgtgagatggcatccactggagaggtggcctgctttggtgagggaattcacactgcatttctcaaggcgatgctgtcaaccggcttcaagattccacaaaaggggatcctgatcggcatacaacagtcttttcgcccacgctttctgggagtggcagaacaactgcataacgagggtttcaaactttttgcaaccgaagcaacttccgactggttgaatgcaaacaacgtgcctgcaaccccagtggcttggccttcccaggagggtcagaatccatccctttcttcgatccggaaacttatccgggatggcagcattgatctggtgattaaccttcctaacaacaacactaagtttgtgcatgataactacgtgattagacgcactgccgtggatagcgggattcctctgcttactaatttccaagtgaccaaactgtttgccgaggcggtgcaaaaatcccgtaaggtggattccaagagcttgtttcattacaggcaatatagcgcggggaaggccgca

SEQ ID NO: 8054 - DNA, 4500 bp, Artificial Sequence
  Description of Artificial Sequence: Synthetic coding sequence
atgacccgcatcctgactgcgttcaaagtcgtgagaacgctgaaaactggcttcggttttactaatgtcaccgctcatcaaaagtggaaattcagccgacctggaattcgattgctgtcggtcaaggctcagactgcacatattgtcttggaggacggtacgaagatgaaaggatactcgtttggtcacccgtcgtctgtggccggcgaagtcgtctttaacactggtcttggggggtacccagaagccattaccgatcctgcctacaaaggccagatcctcacgatggccaacccgattattggaaacgggggtgcaccagacaccaccgccttggacgaacttggactgagcaagtatctcgagtccaatggtataaaggtgtccggactgcttgtgctggattactcgaaggattacaaccactggctcgcaaccaagtcccttggccaatggctgcaggaagagaaggtgcccgcgatttacggagtggatactagaatgctcacgaagattatcagggacaagggtaccatgctggggaaaattgaattcgaggggcagccagttgattttgtggaccccaataagcaaaaccttatcgcagaggtgtctactaaggacgttaaggtgtatggaaaaggtaaccccactaaggttgtcgctgtcgattgtggtattaagaataatgtgatcagactgctcgtgaagcgtggagccgaagtccatctggtgccttggaaccatgactttaccaagatggagtacgatggaattctgatcgcaggaggaccaggcaatcctgcactggcagaacctttgatccaaaatgtgcgtaagatactcgaatcggaccgcaaagaacctcttttcggcatatcaactggtaatctgattactggtcttgcagcaggagcaaagacctataagatgagcatggctaacagaggacaaaaccagcccgtgcttaacataactaacaagcaagcgttcataaccgcacaaaaccacggttatgcgcttgataacactcttcctgccggatggaagcccctttttgtcaatgttaacgaccaaaccaatgagggaatcatgcatgaatctaagccgtttttcgctgtgcaattccatccagaagtcacccctggccctatcgataccgagtacctgtttgatagctttttctcactgataaagaagggcaaggccactaccatcacttcagtgctgccaaagcctgcacttgtggcctcccgagtggaagtctccaaggtgcttatccttggatcgggaggactgtcgatcggacaggcaggagaattcgactactctggatctcaagctgtgaaagccatgaaagaggaaaacgttaagaccgtccttatgaacccgaatatcgcatcagtccaaacgaacgaggtgggactgaaacaggcagataccgtttacttcctgccaattactcctcagtttgttaccgaagtgatcaaggcagagcaacccgacggactgattcttgggatggggggtcagactgcactcaactgtggagtggaacttttcaagcgcggtgttttgaaggaatacggtgtcaaggtgcttggtacttccgtggaatcaataatggccaccgaagatagacaattgttctcagataaactcaacgagattaacgaaaagattgcaccgtcatttgcagtggagtctattgaagatgcactgaaggctgcagacaccatcggttaccctgtgatgattcggtcggcctacgcactcggaggattgggttcgggaatatgtcccaaccgcgaaacccttatggatttgagcacgaaagcatttgcaatgactaaccaaatcctggtcgagaaatctgtcaccggttggaaggaaattgagtatgaagtggtgcgagatgcggatgacaattgcgtcaccgtgtgtaacatggagaatgtggacgcaatgggcgtgcacactggcgattcggtcgtggtggcacctgcacaaaccctctccaacgccgagtttcaaatgctgcgccggacctcgatcaatgtcgtgaggcatctgggaattgtgggcgaatgcaatattcagtttgcacttcatcctacctcgatggagtactgcattattgaggtgaatgcaagactgtcgagatcgtccgcactcgcgtcaaaggcaaccggctaccctctcgcttttatcgcagcaaaaatcgcccttggtattccacttcccgagataaagaatgtggtgtcaggcaaaaccagcgcttgttttgagccttcactggattacatggtgacgaaaattcctcgttgggacctggataggtttcacggaaccagctcccgaatagggagctcgatgaagtcggtgggagaggtgatggcgattggtcgaacctttgaggagagctttcagaaggcacttcggatgtgtcacccgtcgattgaaggattcaccccccggcttcctatgaacaaggagtggccgagcaacctggaccttagaaaagaactgtccgaaccctcctcgactaggatttacgccattgcaaaagcgattgatgacaacatgagcttggacgagatcgaaaagctgacctacattgataagtggtttttgtacaagatgagagatattctgaatatggagaaaacccttaagggccttaactcagaatcaatgactgaagaaactcttaagagagccaaggaaatcggattttcggataagcaaatatcgaaatgtctgggacttactgaggcccagactcgggaactgaggctgaagaaaaacattcatccttgggtgaagcaaattgatactctggccgccgaataccccagcgttaccaattacctgtacgtgacttacaacgggcaggaacatgatgtgaactttgatgaccacggaatgatggtgcttggatgcggaccataccatattgggagcagcgtggagtttgattggtgtgccgtgagctccattaggactcttagacagctgggaaagaaaaccgtggtggtcaattgtaatcctgaaactgtgtcgaccgacttcgatgaatgtgataaactttacttcgaagaactgagcctggaacgcattctcgacatctaccaccaagaagcctgcggtggttgcatcatatccgtgggcgggcagatcccaaacaacctcgcggttcctctttacaagaatggagttaagatcatggggacttcaccgctgcagattgacagagccgaagatcgttctattttctccgcagtgctggatgaactcaaagtcgcacaggcgccgtggaaggcggtgaatacgcttaacgaagcccttgagttcgcaaagtcagtggattacccgtgtctcctccggccctcctacgtgctgtcaggctcagcgatgaacgtggtgttctccgaagatgagatgaagaagtttctggaggaggcaactagagtgtcccaggagcaccctgttgtcctgaccaagttcgtggaaggagcacgggaagtggagatggatgcagtcggaaaagatggacgtgtcatctcacacgccatctcagagcatgtggaagatgcaggtgtccatagcggcgacgcaaccctgatgctcccgacgcagaccatcagccaaggggcaattgaaaaggtcaaagatgccacccgtaaaatcgctaaggcatttgcaatttcgggacctttcaatgtgcagtttcttgtgaaaggaaacgacgtcctggtgattgaatgcaacctgcgtgcctcgcgctcatttccattcgtgtcgaaaacccttggagtcgatttcatcgatgtggcgaccaaggttatgatcggtgaaaacgtggatgaaaagcatctgcctactcttgaccacccgattataccagcagactacgtcgcgatcaaggcacccatgttttcctggccaaggcttcgagacgcagaccctatcctccgatgcgagatggcgtccactggggaggtggcatgttttggcgaggggatacatactgcatttcttaaggcaatgctctcgacgggatttaagattcctcaaaaaggaatccttatcggtatacagcaatcctttagaccaaggttccttggtgtcgcagaacaactgcataacgaaggttttaagctgtttgcaaccgaagcaacctctgattggcttaatgcaaataacgtgccagcgaccccagtcgcgtggccttcacaagaaggacagaatccaagcctgagctcaattcgcaagctgattcgcgacggttccatcgatctggtgatcaatctcccaaacaacaacactaaattcgtgcacgataactacgtcattagacggaccgctgttgatagcggtattccattgctgacgaatttccaagtcacgaaactgtttgcagaagcggtgcagaagagcagaaaggtcgattctaagtcgctcttccattacagacaatactcagccggcaaggccgct

SEQ ID NO: 8055 - DNA, 4500 bp, Artificial Sequence
  Description of Artificial Sequence: Synthetic coding sequence
atgacaagaattttaacagcatttaaggtagttagaacattaaagactggatttggttttactaatgttactgcacatcaaaaatggaaattttctagaccaggtattagattattaagtgttaaagcacaaactgcccatattgttttagaagatggaactaaaatgaaaggttattcatttggacatccatcttcagttgcaggagaagttgttttcaatacaggattaggtggatacccagaagctattactgatcctgcttacaagggacaaattttaactatggcaaatccaattattggaaatggaggagctccagatacaactgctctcgatgaactcggactttctaagtaccttgaatcaaatggaattaaagttagtggacttctcgttcttgattattcaaaagattataatcattggcttgcaacaaaatcattaggacaatggcttcaagaagaaaaagttccagcaatttatggagttgacactagaatgttaactaaaattattagagataaaggtacaatgttgggaaaaattgaattcgaaggtcaaccagttgattttgtagatccaaataaacaaaatcttattgccgaggtttctactaaagatgttaaagtctacggaaaaggtaatccaactaaagttgttgctgtcgattgtggtattaaaaataatgtcattagacttttagttaaaagaggagcagaagtacatttagttccatggaatcatgattttacaaaaatggaatatgatggaattttaattgctggagggccaggaaatccagctttagcagaacctttgattcaaaatgttagaaaaattcttgaatctgacagaaaagaaccattatttggtatttcaacaggaaatttaattactggtcttgcagcaggagctaaaacatataaaatgagtatggctaatagagggcaaaatcaaccagttcttaatattacaaataaacaagcttttattactgctcaaaatcatggatatgctttggataatactctaccagcaggatggaaacctttatttgttaatgttaatgaccaaactaatgaaggaataatgcatgaatcaaaaccattctttgctgtacaatttcatccagaagtaactccaggacctatagataccgaatatttatttgattcatttttttctttaattaaaaagggtaaggcaactactattacatcagtattaccaaaaccagcattagttgcttcaagggttgaagtttctaaagttttaattttagggagtggtggactttctataggacaagctggagaatttgattattctggttcacaagctgtaaaagcaatgaaagaagaaaatgttaagactgttttaatgaatccaaatattgcaagtgttcaaacaaacgaagttggattgaagcaagcagatactgtttattttttaccaattactccacaatttgttactgaagttattaaagctgaacaacctgatggtttaattttaggaatgggtggacaaacagcacttaattgtggagttgaattatttaaacgaggtgttcttaaggaatatggagttaaagttcttggaacttctgttgaatctataatggctacagaagatagacaattgttttcagataaattaaatgaaattaatgaaaaaattgcaccaagttttgcagttgagagtattgaagatgctttaaaagctgctgacacaattggatatccagttatgattagaagtgcttatgcattaggtggacttggtagtggaatttgtccaaatagggaaactttaatggatttatcaactaaggcttttgctatgacaaatcaaattctcgttgaaaaatcagttacaggatggaaggaaattgaatatgaagttgttagagatgctgatgataattgtgttacagtgtgcaatatggaaaatgttgatgccatgggagttcatacaggagattcagtagttgttgcaccagcacaaactttaagtaatgcagaattccaaatgttaagaagaacatcaattaatgttgttcgacatttaggaatagtaggtgaatgtaatattcaatttgctttacatccaacatcaatggaatattgtattattgaagttaatgcaagattgtctcgaagttcagctctagcctcaaaagcaacaggatatccacttgcttttattgcagctaagattgctctaggtattccattgcctgaaataaaaaatgttgtttcaggtaaaacttctgcatgctttgaaccttcattagactatatggtaactaaaataccaagatgggatttagatagatttcatggaacatcatctagaattggatcttcaatgaaaagtgttggagaagtaatggctattggtagaacatttgaagaatcttttcaaaaagcacttcgtatgtgtcatccaagtattgaaggttttactccaagattaccaatgaataaagaatggccatcaaatcttgatttaagaaaagaattatcagaaccaagtagtactcgaatttatgctatagctaaagctattgatgataatatgtctcttgacgaaattgagaagcttacatatattgataaatggtttttatataaaatgagagatattttaaatatggaaaagacacttaaaggtttaaattcagaatcaatgactgaagaaactctaaagagagctaaagagattggatttagtgataaacaaatttctaaatgtttaggtttaacagaagctcaaactagagaattacgattaaaaaaaaatattcatccatgggtcaaacaaattgatacattagctgctgaatatccatcagtcacaaattatctttatgttacttataatggtcaagaacatgatgttaatttcgatgatcatggaatgatggttttaggatgtggaccttatcatattggttctagtgttgaatttgattggtgtgctgtttcctcaatacgtacattgcgacaacttggaaagaaaacagtagtagttaattgtaatccagagacagttagtactgatttcgatgaatgtgataaattatattttgaagaattatctttggaaagaattttagacatttatcatcaagaggcatgtggaggatgtataatttctgttggaggacaaataccaaataatctcgctgttccattgtataaaaatggtgttaaaattatgggaacttcaccattgcaaattgacagggcagaagatagatcaatcttttctgccgttctagacgaacttaaagtagcacaagctccatggaaagctgttaatactcttaatgaagcattagaatttgctaaatcagtagattacccatgtctacttagaccatcatatgttttatctggatcagctatgaatgtggttttctctgaagatgaaatgaagaaatttttagaagaagcaacaagagtttctcaagaacatccagtcgttttaacaaaattcgtagaaggagctagagaagtagaaatggatgctgtaggaaaagatggtagagttattagtcatgctataagtgaacatgtagaagatgctggtgtacattcaggagatgcaacattaatgcttcctactcaaactatttctcaaggtgctattgagaaagttaaagatgcaactaggaaaattgcaaaagcttttgctatttctggtcctttcaatgttcaatttttagtaaaaggaaatgatgttcttgttattgaatgtaatttacgagcttcaagatctttcccatttgtttcaaaaacattaggagttgattttattgatgtggctacaaaagtaatgattggtgaaaatgtcgatgaaaaacatcttcctactttagatcatccaattattccagcagattatgttgctattaaagctcctatgttttcttggcctcgtttacgagatgctgaccctattttaagatgtgaaatggctagtacaggagaagttgcatgttttggtgaaggaattcataccgcttttttaaaggctatgctttctactggttttaaaattccacaaaaaggtatattaattggaattcaacaaagttttagaccaagatttttgggagttgcagaacaattacataatgaaggtttcaaactttttgcaactgaagctacaagtgattggcttaacgctaataatgttccagcaaccccagttgcatggccaagtcaagaaggtcaaaatccttcattatcttcaattagaaaattaattagagatggatccattgatcttgttataaatttaccaaataataatacaaagttcgttcatgataattatgttattagaagaacagctgttgattcaggtattccattgttaactaatttccaagttactaaattatttgctgaagcagtacaaaagtcaagaaaagttgatagtaaatctctttttcattatagacaatatagtgctggaaaggcagct

SEQ ID NO: 8056 - DNA, 4500 bp, Artificial Sequence
  Description of Artificial Sequence: Synthetic coding sequence
atgacccggatcttgaccgcgttcaaagtggtgagaactctcaagactggttttggatttactaatgtgactgcccaccagaagtggaagttcagcagaccagggatccgacttctgagcgtcaaggctcagactgctcacatcgtgcttgaggacggtaccaagatgaagggctattcgttcggccacccgtcaagtgtcgccggagaagtggtgtttaacacgggactgggaggctacccggaagcaatcaccgacccggcctacaagggccaaatcctgactatggccaatcccattatcggaaacggaggagcgccggatactaccgccttggacgaattgggactgagcaaataccttgaatcaaacggaatcaaagtgtcaggactcctggtgttggattacagcaaggactacaaccattggctggccaccaagagcctgggtcaatggctgcaggaagaaaaagtgccagctatctacggagtggacactagaatgctgactaagatcatccgcgataagggcactatgttgggcaaaatcgagttcgagggccagccggtggattttgtggatccaaacaaacagaacctgatcgcggaggtgtcgaccaaggacgtcaaggtctacggaaagggtaatcccaccaaggtggtggcggtcgattgtggaatcaaaaacaatgtgattagacttctggttaaacggggagcagaggtgcatctggtgccgtggaatcacgacttcactaaaatggagtacgatgggattctgattgccggaggcccgggaaatccggcgctcgcggagccactgattcaaaatgtgcggaaaatcttggaaagcgataggaaagaaccactgttcgggatttcgactggaaacctgattaccggactcgcagcaggagcgaaaacctacaagatgtctatggctaaccgcggccagaatcagccggtcctcaacattaccaataagcaggccttcatcaccgcgcagaaccacggctacgcactcgacaacacgctgccagcgggatggaagcctctgttcgtgaacgtgaatgatcagactaatgaggggatcatgcatgaatcgaagccgtttttcgccgttcaattccatcccgaggttacgcccgggccgatcgacaccgaatacctgtttgacagtttcttctccttgataaagaaaggaaaagccactaccatcacttcggtgttgccgaagcctgccctggtcgctagccgcgtcgaagtcagcaaggtgctcatcctcggcagcggcggactgtcaattgggcaggccggcgaattcgactacagcggatcacaagcagtcaaggccatgaaggaggaaaacgtgaaaactgtgcttatgaaccccaatatcgcctcggtccagacgaatgaggttggactcaagcaggcagatacggtttacttcctgccaataacccctcagtttgtcacggaggtcattaaggcagagcagccagatggactcatccttggaatggggggacagaccgcgctgaattgcggagtggaattgttcaagagaggagtactcaaggagtacggcgtcaaggttttgggaacctcagtggaaagcatcatggcgaccgaggacagacagctcttctcagacaagctgaatgagatcaatgaaaagattgccccgagcttcgccgtggaaagcattgaggacgccctcaaagccgcggacaccatcggataccctgtgatgatccgctccgcctacgccctgggcggcctgggatccggtatctgtcctaatagggaaacgctgatggaccttagcaccaaggcgttcgcaatgactaatcaaatccttgtagaaaagtcggtgaccggatggaaggaaatcgaatacgaagttgtccgggacgcggatgacaactgcgtgaccgtgtgcaatatggagaacgtggacgccatgggagtccacaccggagatagcgtggttgtggcgcctgcccagaccctctccaatgccgagttccagatgctccggcgcacttcgattaatgtggtccggcaccttggcatcgtgggtgaatgtaacatccaattcgcgctccaccccacgtcaatggagtattgcatcattgaagtcaacgcaaggctctctcggtcatccgccctcgcctcaaaagccaccggatacccactcgcattcatcgccgccaagatcgcacttggaatcccccttccggaaatcaagaatgtggtgagcggtaagacttcggcctgcttcgaaccctccctggactatatggtcactaagatcccaagatgggatctcgacagattccatgggacttccagtcggattgggagctcgatgaagagcgtgggggaggtgatggcaattggacgcactttcgaagaatcattccagaaggctctgagaatgtgccacccgtctatcgaagggtttaccccacggctcccgatgaacaaggagtggccaagcaacctcgatctgcgcaaggagctcagcgaaccatcatccacgcgaatatacgcgatcgctaaggccatcgacgataacatgtcgctggacgagatcgaaaaactgacttacatcgataagtggttcctgtacaaaatgcgggatatcctgaacatggaaaaaactctgaaaggactgaacagcgaaagcatgactgaggagactctgaagagggccaaggagatcggattctcggacaagcaaatctcaaagtgccttggattgaccgaagcgcagaccagagaactgcgcctcaaaaagaacatccatccgtgggtcaaacaaatcgacactttggcggccgagtatccatccgtgaccaactatttgtacgtgacttacaacggccaggaacacgatgtgaacttcgatgaccatggtatgatggtgcttggatgcggaccataccacatcggttcttccgtcgaattcgattggtgcgctgtgagctccatccggacccttcgccaacttggaaagaaaaccgtagtggtgaactgcaatccggaaactgtgtccaccgacttcgacgaatgtgacaaactgtacttcgaagaattgtccctggaacgcatcctcgacatttaccaccaggaggcatgtggaggatgcatcatctcagttggtgggcagatacctaacaatctcgccgtcccgctctataagaatggagtgaagatcatgggaacgtcgcccttgcagattgaccgcgccgaggatagatcaatcttctccgccgtgttggacgagctgaaagtggcacaggcgccatggaaggcagtgaacaccctcaatgaggcgctcgagttcgcaaagagcgtggactacccatgcctgctgcgcccatcatacgtgctgtcaggaagcgctatgaacgtggttttcagcgaggatgagatgaagaaattcctggaagaggcaaccagggtgagccaagaacatccggtggtcctgacgaaattcgtggagggggccagagaggtcgaaatggacgcagtgggtaaggatggccgggtgatctctcatgcgatctcggagcatgttgaagatgccggagtccactcaggagacgccaccctcatgctgccgacgcaaactatctcccagggagccatcgagaaggtgaaggatgcgacccggaagattgctaaagcgtttgcaatctcgggaccttttaacgtgcagtttttggtgaagggcaatgacgtgctggtgattgaatgcaacctccgcgcctcgcggtccttcccctttgtgagcaagactttgggggtggacttcatcgacgtggcaaccaaggtgatgattggagagaacgtcgacgaaaagcacctcccgaccctggaccaccctatcattccggcagactacgtggcgatcaaggctccgatgttcagctggcctagactgagggacgcggatccgattctgagatgcgagatggccagcactggcgaagtcgcctgttttggggagggtatccacactgcgtttttgaaggcaatgctctccacgggatttaagatcccccagaaagggatcctgatcggaatccagcagagctttcggccgaggttcctcggcgtggctgaacaactgcacaacgagggcttcaagctgttcgcaaccgaggccacctccgattggctcaacgcgaacaacgtgccagcgactccggtcgcttggccttcgcaggagggccaaaacccgtcgctgagctcgatcagaaagttgattcgggacggctcaatcgacctcgtcatcaacctgccaaacaacaatactaaattcgtgcatgataactacgtgatccgcagaactgctgtggactcgggaatcccgctgcttactaacttccaggttactaagctgttcgccgaagccgtccaaaaatccagaaaagtggacagcaagtcactgtttcattaccgacaatactccgcggggaaagccgca

SEQ ID NO: 8057 - DNA, 4500 bp, Artificial Sequence
  Description of Artificial Sequence: Synthetic coding sequence
atgacccggatactcacagcttttaaggtggtgagaactttaaaaacaggatttggtttcacaaacgtgaccgcccaccagaagtggaagttctcccgcccgggcattcggttactgtccgtaaaagctcagacagcccatattgttctggaagacggcacaaaaatgaaggggtactccttcgggcatccctcctccgttgctggcgaggtggttttcaatactggtctggggggctatcctgaagctataacagatccagcttataagggccaaatccttaccatggcaaacccaatcatcgggaacggcggcgccccagacacaaccgccctggacgagctgggtttgtcaaaatatctggagagtaacggcataaaagtttcagggctgctggtgctggactacagtaaggactataatcattggctggctaccaaatccctggggcagtggctccaagaagagaaggtgcctgctatctatggggtggatacacggatgctgactaagataattagagataaaggcacaatgttaggcaaaatcgaatttgagggacagccggtcgattttgtggatcctaacaagcagaacttgatcgcagaggtgagcacaaaggatgtcaaggtttatggaaagggcaatccaactaaggtagttgccgtcgactgcggcattaagaataatgttatccgtctgctggtcaaaaggggtgccgaagttcacttagtgccatggaatcatgatttcaccaagatggagtacgacggcatactcatcgccggaggcccaggtaatcccgcactggctgagcccctgatacagaatgttagaaaaatcctggaaagcgacagaaaggaacccctcttcggcatatccaccggtaatttgatcactggcttagcagccggggccaagacctacaagatgagtatggctaatcgggggcagaaccaaccagttctaaacataaccaataaacaggcctttattacagctcagaaccacggctatgcactcgacaacactctgcctgccggctggaagcccttattcgttaacgtgaatgaccagaccaacgaggggataatgcatgaaagcaaacctttttttgccgttcagtttcaccccgaggtgacacctgggccaatagacactgaatatctttttgactcttttttttctctcatcaagaaaggaaaagcaactaccataaccagtgtcctgccaaaacccgctttagttgcctccagggtggaagtgagcaaggttttaattttagggtcaggcggcctttccatcggccaggcaggcgagttcgactacagtggtagtcaagccgtcaaggccatgaaggaagagaatgttaaaaccgtgctgatgaatccaaacatcgcaagcgttcagaccaacgaggtggggctcaagcaggcagatacagtgtattttctgccaatcaccccacagttcgtgaccgaggtgatcaaggccgagcagcccgatgggctgattctgggcatgggggggcagaccgctttgaactgcggtgttgagctgttcaaacgcggggtcctgaaggagtatggggtgaaggtgctgggcacctctgttgagtccattatggcaacagaagaccgccagctattctctgataagcttaacgaaattaacgaaaaaattgctccctctttcgcagttgagtctatagaagacgctctgaaagcagcagataccatcggatatccagttatgatcagaagtgcttatgctctgggcggtctcgggtccggtatctgcccaaatagagagactctgatggacctttccaccaaggccttcgccatgacaaatcaaatcctggtggaaaagtccgtcaccgggtggaaagagattgagtacgaggtggtgagagacgctgacgataactgcgtgactgtgtgtaatatggagaatgttgacgctatgggcgtgcacacaggggacagcgtggtggtcgcccccgcccaaacactgagtaatgctgagtttcaaatgttacgaaggacttcaataaacgttgtgcgccatctggggatcgtgggggagtgcaatatccagttcgcccttcaccccacctcaatggaatattgtatcattgaagtcaatgctcgactgtctcggtccagtgcactggccagtaaggccaccggatatccactcgcatttatcgctgctaagatcgccttagggatacccctgcccgaaatcaagaacgttgtcagcgggaagacaagcgcctgctttgagccatctctggactatatggtgaccaagataccccgctgggatctcgaccgcttccatgggaccagcagtaggatcggctcctcaatgaagagtgttggggaggtgatggcaatcggccgcacatttgaggagtcctttcagaaggccctcagaatgtgccacccaagcatagagggctttactcctcgcttgcccatgaacaaggagtggccctcaaacctggatttacgcaaagaactaagcgagccaagcagcacaaggatctatgctattgctaaagctatcgatgataacatgagccttgacgagatagagaaactgacctacattgacaagtggttcctgtacaaaatgcgggacatcttaaacatggagaagaccctaaagggtctaaactcagaaagcatgaccgaagagacactgaagcgagccaaggaaataggcttctctgacaagcagatttccaagtgtctcggactcacagaggcccaaacaagagagctgcgtctgaaaaaaaatatacatccctgggtgaagcagatcgatacactggccgcagaataccctagcgtgacaaactacctctacgttacctataacggtcaggaacatgatgtgaatttcgacgaccacgggatgatggtgctgggttgtggcccttatcatatcggctctagcgtggaatttgattggtgtgccgtgtcttccattcggaccctccgccaactcggaaagaaaaccgtcgtggttaattgcaacccagagacagtcagtacagactttgatgagtgtgacaaactgtacttcgaggagttatctttagagaggatcctggacatctatcaccaagaagcatgtggagggtgcattatcagtgtgggcgggcagatccccaataatttggccgtgccactgtacaagaatggggtgaagattatgggaacaagcccactgcaaatcgatagggctgaggatagaagcatttttagtgccgtgctggatgagctgaaagtggcccaggccccatggaaagctgtgaatacccttaacgaagctttagaattcgccaagagtgtggactacccatgcctgttaaggccatcttatgtcctctcaggttctgccatgaacgtggtcttctccgaggacgagatgaagaagttcctggaggaggccacccgtgtgagtcaggaacaccccgtcgtgctaaccaaattcgtggaaggggctcgcgaagtagagatggacgccgttggaaaggatggccgagtgatatctcacgccatcagcgaacacgtggaggatgccggggtgcattccggcgacgccacactcatgctccctacccagacaataagtcagggcgccatcgagaaggtgaaagatgctacacggaagatcgcaaaggcttttgctatctctggaccattcaatgtccaatttctggtgaaggggaacgatgtgctcgttattgagtgcaacttacgggccagcaggtcctttccatttgtcagcaagacactgggggtggactttatagacgttgcaaccaaggtgatgattggcgaaaatgtcgacgagaaacatctcccgaccctggaccatccaatcatacccgcagattatgtggccataaaagctcctatgttctcttggccacgcctgagagacgctgaccctatattgcggtgtgagatggcatctacaggggaggtggcatgttttggggagggcatccataccgctttcctaaaagctatgctgagcaccggcttcaaaatcccccagaagggaattctgattgggatacagcagtccttccgtcccagattcctgggcgttgccgaacaactgcacaatgagggatttaaactgtttgccacagaggcaacatctgactggctgaatgctaataatgtgcccgccacccctgtggcatggccttctcaagagggccagaatccttccttatctagcataaggaaacttattcgtgacggctcaattgatctggtgattaatctacccaacaataatacaaaatttgtccacgataattatgttatcagacggacagcagtggattctgggattcctctgttaaccaatttccaggtgactaagctttttgccgaggcagttcagaaaagtcgtaaggtggactccaaaagcctatttcactatcgacagtatagcgctgggaaggccgcc

SEQ ID NO: 8058 - DNA, 4500 bp, Artificial Sequence
  Description of Artificial Sequence: Synthetic coding sequence
atgactcgcatccttaccgcattcaaggtggtgcgtacgctcaagaccggattcggattcactaacgtcactgcgcatcaaaagtggaagttctcaaggcctggcattcggttactgtccgtcaaagcccagacggcacatatcgttctcgaagatgggactaaaatgaaaggctactcttttggacacccatcctctgtagccggggaagttgtcttcaacactgggctgggaggatatccggaagccatcactgaccccgcctacaaaggtcagatactcaccatggcaaatccaataatcggaaacggaggcgctcccgacacgacagccctggacgaattagggctgagcaaatacctggaaagcaacggcataaaagtcagcggcctgcttgttctggactactcaaaggattataatcattggcttgcgactaagagcctgggtcagtggctgcaggaagaaaaagtacccgccatttacggggtggacacacgcatgctgaccaagatcattcgagataagggtacaatgttaggtaaaatcgaattcgagggacagcccgtggacttcgtggatccaaacaagcaaaacctgattgctgaggtttctactaaggatgtaaaggtctacggaaagggtaacccaacaaaggtcgtcgccgtagactgtgggatcaagaataatgtgatcaggttattggtgaagcggggggctgaggtacacctggtaccttggaaccatgatttcacaaaaatggaatacgatggaatcctgatagccggcgggcctggtaatccagccctcgcagagccgttgatacagaatgtacgcaagatcctggaaagtgaccgcaaggagcccctatttgggataagcactggcaatcttatcacaggacttgccgctggggcaaaaacatacaaaatgtcgatggcgaataggggccaaaaccagcccgtgctgaacattaccaacaaacaggcttttattaccgcccagaatcacggatacgcactcgacaacacactgccagccggttggaaacctctgttcgtcaacgtcaatgaccagacaaacgagggcattatgcatgaatcgaagccatttttcgccgttcagtttcaccccgaggtcaccccgggccctattgacaccgaatacttgttcgacagctttttctcactcattaagaagggtaaggcaaccaccattaccagcgttttgcccaagcccgcgctggtggcttcccgggtggaggttagcaaagtactgattcttggatctgggggtctgagtattggacaggctggtgagttcgattatagcggaagtcaagcagttaaagctatgaaagaggaaaatgtgaagactgttctgatgaatccaaatattgcatccgttcagaccaatgaggtgggcctgaagcaggccgacactgtctatttcctccctattactccccagttcgtgactgaagtaattaaggctgagcaaccagatggactgatcctgggaatgggcgggcagaccgctcttaactgcggcgtggagctgttcaagcggggagtgttaaaggagtatggcgtgaaagtcttggggacctctgtcgagagtataatggccactgaggacagacagctgttttccgacaagctcaacgagattaatgaaaaaatcgctccatcctttgcagtcgaatccatcgaggatgcccttaaggccgctgacaccatcggctaccctgtcatgattaggagcgcttacgccctcggagggctcggcagcggcatatgtccaaacagggaaactctgatggacttgtctaccaaagcattcgccatgaccaaccagatactggtggagaagagtgttaccggttggaaagaaatcgagtacgaggtggtgagggatgccgatgacaactgcgttacagtgtgcaatatggagaacgttgacgctatgggtgtgcatacaggggattccgtcgtggttgcccccgctcagacactctccaatgccgagttccaaatgttacgcagaacctccataaacgtagttagacacctgggaatcgtgggcgagtgcaatatccagttcgcgctgcaccccacgagtatggagtattgcattatagaagtcaacgcccgcctgtctcgatcctcagcgctggcttccaaggcgactggctatcctttagccttcatcgcagctaaaatcgccctcgggatacccctgccggagataaagaacgtggtgtcaggtaagaccagcgcgtgcttcgagccgtcattagattatatggtcactaagatccctcgatgggacctcgatagatttcacgggacttcctccaggattggatcatcaatgaagtccgtgggcgaagtgatggcgatcggcaggacattcgaggagtcatttcagaaagcactgagaatgtgtcatccaagcattgaaggcttcacaccaaggcttccaatgaataaagagtggccaagcaaccttgatcttcggaaagagctgagcgagcccagctccaccaggatttacgccatagctaaggccatcgatgataatatgtccctcgatgaaattgagaagctcacatacatagataaatggtttttgtacaaaatgcgagacatccttaacatggaaaaaactctgaagggtttgaacagcgagtccatgacagaggagactcttaaacgagccaaagagatagggttctcagacaaacaaataagcaaatgcctggggctaacggaagcccagacacgcgagctccgtctgaaaaagaatatccatccctgggtgaaacaaatcgacaccctggccgctgagtacccctccgtgactaattacctctacgtgacctataacggccaggagcacgacgtcaattttgatgatcatggtatgatggtgctcggatgtggcccttaccacataggcagtagcgtcgaatttgattggtgtgcagtgtcatcaatcaggactcttagacaactgggaaaaaagactgtcgtcgtaaattgcaaccctgagactgtcagtaccgatttcgacgaatgcgacaagctgtacttcgaggagctgtcattagagcgcattcttgatatctatcatcaggaggcttgtgggggctgcatcattagcgttggcgggcagatcccgaataacctggccgtcccactctataagaacggagtaaaaatcatgggcaccagccctctccagatcgaccgtgcagaggatagatcgatattctctgcggtgctggatgagctgaaggtggctcaggccccatggaaggccgtgaacaccctgaatgaggctctggagttcgccaagtctgtggactacccatgtttgttacggcctagctacgttttgtctgggtcagctatgaacgtagtcttttccgaagatgaaatgaagaagttcctggaagaggctactcgagttagtcaggaacatccagtcgtccttacaaaattcgtagagggtgcccgggaggtcgaaatggacgctgttggaaaggatggtcgcgtcatctcacacgccatctcggagcacgtggaggatgctggggttcattccggggacgctacacttatgctgcccacacagaccatctctcagggagctatcgaaaaggttaaggatgcaacccgcaaaattgcgaaggcatttgcaatttcaggcccgtttaacgtacagttcctggtgaaggggaatgatgtgctggtgatcgaatgtaatctgagggcatcacggagcttcccttttgtctctaagactctcggcgtagacttcattgatgtggccacaaaggtgatgatcggggagaatgtggatgaaaagcacctgcctacgttggatcatccaatcatccctgccgactatgtagctatcaaagcacccatgttttcctggcctcggctccgggatgctgatcctattctgcgctgcgagatggcatccacgggagaagtcgcttgtttcggtgagggaatacatactgctttcctcaaagctatgttgagcactggcttcaagattcctcagaaaggcatcctcatcggaatccagcagagttttcgcccacggttcctgggtgtggccgaacagctccataatgaggggttcaaactgttcgcgactgaagccacgagcgattggctcaacgccaataacgtgcccgctacccctgtggcatggccctcacaggagggccaaaatcctagtctctcttctatccgcaagctcatccgggacggaagtatcgacctcgtcatcaatcttcctaacaataataccaaattcgttcacgacaactacgtgatcaggagaaccgctgttgattcaggaatccctctcctcacgaactttcaggtcacaaaactgttcgctgaggctgtgcagaaatcacgcaaggtggattcaaagtcactgttccactataggcagtactcagccggcaaagctgcg

SEQ ID NO: 8059 - DNA, 4500 bp, Artificial Sequence
  Description of Artificial Sequence: Synthetic coding sequence
atgacccgtatacttaccgctttcaaagtcgtgcgcactctgaaaactggtttcggctttaccaacgtgaccgcacatcagaagtggaagttcagcagaccaggtatacgcctgctttccgtgaaggcgcagaccgcacatattgtacttgaagatgggactaagatgaagggatattcttttggacatccgagctccgtggcaggggaggttgtgttcaatactggcctcggaggataccccgaggcgatcactgacccagcatacaagggacagattctcactatggccaatccaatcattggcaacggaggtgctccggatactactgccttggacgaacttggtctttcgaaatacttggagtcgaatggaataaaggtgtcaggactgctcgtgctcgattactcaaaagattacaaccattggttggcaaccaagtccttgggacagtggctgcaagaagagaaggtccctgcaatttacggcgtcgatactcgcatgttgactaagattattcgcgacaaaggtaccatgctgggaaagatcgagtttgaagggcagcctgttgactttgtggatcctaataagcaaaatctgattgcagaagtgtcgaccaaggacgttaaagtctacggaaagggaaaccctactaaggtggtcgctgtcgattgcggcatcaaaaacaatgtgatcaggctcctggtgaaaaggggggcggaagtgcatctggtcccatggaaccacgattttaccaaaatggagtacgacggtattctcatagcaggaggacccgggaaccctgccctggcggagccacttattcaaaacgtccgcaagattcttgaaagtgaccgaaaggagccactctttggaattagcaccggaaatctgattactgggctcgcagcaggcgcaaagacttacaagatgagcatggcaaacagaggccaaaaccaaccggtgcttaacatcacgaataaacaggccttcattactgcgcagaaccatggttacgccctcgacaacactcttcccgcaggttggaagccactttttgtgaatgtcaacgaccaaaccaacgaaggtattatgcatgagagcaaaccctttttcgctgtccaatttcatccggaagtgactccaggccccatcgacactgaatacctgttcgacagtttcttttcgctgatcaaaaagggtaaggcaaccacgattacctcagtactgccgaaaccggcccttgtcgcatcccgggtggaagtatcgaaggtgctgattctcggatcaggcgggctcagcattggacaagcaggagaattcgattattctggatcgcaggcagtgaaggcaatgaaggaagaaaacgtcaaaactgtgttgatgaaccctaacatcgcttccgtccaaaccaatgaagtcggcctcaagcaggcagatactgtctactttcttcccatcaccccccagtttgtgaccgaagtgattaaagcagagcaacctgatggactcatcctgggtatggggggccaaaccgcgttgaattgcggcgtcgaattgtttaagcgcggggtccttaaggaatacggagtgaaggttcttggaacctccgtagaatcgattatggccaccgaagatcggcagcttttttcggataaacttaatgagataaacgaaaagattgcacctagcttcgctgtggagagcattgaagatgcactgaaggcagccgacaccatcggataccccgtgatgattcgttctgcctacgcacttggcgggctcggtagcggcatttgtcctaaccgcgagacgctgatggatctgtcgactaaggcctttgctatgactaaccaaatactcgtcgagaagtcggtcacgggttggaaggaaatcgagtacgaagtggtgagagatgcagacgataattgtgtgaccgtgtgtaacatggaaaacgtggatgccatgggtgtgcatactggagatagcgtggtggtggcgcctgcacagaccttgtcgaatgcagagtttcaaatgctgcggagaacttccataaatgtcgtgcgtcatctgggtatagtgggagaatgtaacattcaatttgcgctgcatcctacttccatggaatattgcattattgaggtgaatgcaaggctttccagatcctccgcccttgcctctaaagcaaccgggtacccgctggcattcattgcagccaagattgcacttggtatcccactgcctgaaatcaagaacgtggtcagcgggaaaacgagcgcgtgttttgaaccctcattggattacatggtcactaagattccaaggtgggacctggaccggttccatggcacttcctcgagaataggcagcagcatgaagtcagtgggcgaagtgatggcaattggaagaacttttgaagagagcttccaaaaggcacttcggatgtgtcaccctagcatcgagggctttaccccccgacttcctatgaacaaggaatggccatccaatttggatctccggaaggaactgagcgaaccttcatcaacccgcatatacgccattgccaaggctatcgatgataacatgtcgttggacgaaatcgaaaagctgacttacattgataaatggtttctgtacaagatgagagacattttgaacatggaaaagactcttaagggtctgaactcggagagtatgaccgaagaaacccttaagcgagcaaaggagattggtttttccgacaaacagattagcaaatgtctgggactgaccgaagcacaaacccgtgagcttcgacttaagaagaatattcatccgtgggtgaaacaaattgatacgctcgccgcagaatacccctcagtgaccaattacctgtacgtgacttacaatggacaggagcacgacgtgaacttcgacgatcatggaatgatggtgctgggatgcggaccataccacatcggaagttcggtggaatttgactggtgcgcagtctcatccattcgtacccttcgccagctgggaaagaaaactgtcgtggtgaactgcaatccagaaacggtttcgactgattttgatgaatgtgataaactgtactttgaagaacttagcctggagcgcatcctcgatatctatcatcaggaagcatgtggaggttgtatcatatcagtggggggtcaaattccaaacaatctggcagtcccattgtacaagaacggagttaagataatgggcacctcacctctccaaattgatcgagccgaggataggtccatctttagcgcagtgttggacgagctgaaagtggcacaggcgccttggaaggcggtgaacactctcaacgaggcactggagttcgctaagtccgtggattacccatgtctcctccgcccatcatacgtcctttcgggaagcgcaatgaacgtggtgttctcggaggacgagatgaaaaagtttctggaagaagcaactagagtgtcccaggaacatccagtcgtgcttaccaagttcgtggaaggggcaagagaagtggagatggatgcggtcggtaaagatggaagagtcatcagccacgccatcagtgaacacgtcgaagatgcaggagtccactccggtgacgccaccctcatgcttccgacgcagaccataagccagggggcaattgagaaagtgaaggacgcgacccgaaagattgcaaaggccttcgccatctccgggccttttaacgtgcaattccttgtgaagggcaacgatgtgctggtcatcgaatgtaaccttagagcgtcgcggtccttccctttcgtgtccaagacgcttggtgtggactttatcgacgttgccactaaggttatgatcggagaaaatgtcgatgaaaagcacctgcctaccttggatcatccaattatcccagctgactacgtggccattaaggcacctatgttctcatggcctcgacttagagatgcagatccaatcctgcggtgcgaaatggcatctacgggtgaagtggcttgctttggtgaaggaatccacaccgctttcctgaaggcgatgctttcaaccgggtttaagattccacaaaaaggtatcctgatcggaattcagcaatcatttcgccctcgctttctgggcgtggccgagcaacttcataatgaaggttttaagctctttgctaccgaggcgacctcggactggcttaatgctaacaatgtcccggccacccctgttgcttggccttcgcaagagggccagaaccccagtctgtcctcaattagaaaactcattagggatggatcgatagatctggttatcaaccttcccaacaataacactaagtttgttcacgacaactacgtgatcagaagaactgcagtagattccggtatacctctgcttactaacttccaagtcacgaaactgtttgctgaggcagtgcaaaagtcgcggaaagtggattccaagtcgctcttccactaccgtcagtattcagcaggcaaggcagcc

SEQ ID NO: 8060 - DNA, 4500 bp, Artificial Sequence
  Description of Artificial Sequence: Synthetic coding sequence
atgaccagaatcctgaccgccttcaaggtggtgcgcactctcaagaccgggttcggattcacaaatgtcacggcccaccagaagtggaaatttagcaggcccggaatccggctgctttccgtaaaggcacaaaccgctcacattgtattggaggacggcacaaaaatgaaaggctattcattcgggcacccttcctctgtggcaggcgaggttgttttcaatactggactgggtggttatccagaggcgatcactgacccagcatacaagggccagattttgaccatggcaaaccccatcatcgggaacggcggcgcaccggacactacagcactcgacgagcttggcctgtccaaatatctagaatctaacggcatcaaagtctctggcctgcttgtgcttgattactccaaggactataaccactggcttgctactaaatccctcggacaatggttgcaggaggagaaggtgcccgcaatctacggtgttgatactcgcatgctcacgaagattatacgggacaagggcacaatgctcggtaaaatcgaatttgaagggcagcctgtagactttgttgatcccaataaacagaatctcatcgccgaagtgtccactaaagacgtcaaggtctatggaaaaggaaacccgacgaaagtcgtggccgtcgattgcgggataaaaaacaatgtcatccggctgctcgtgaaaaggggtgctgaagtccatctcgtgccttggaatcacgattttacaaagatggaatacgacggaatcctgatcgcgggaggccctggcaacccagctctagcggagccactgattcagaacgttcgcaaaattctggagtcagataggaaggagcctctgttcggcatctccaccggtaacctgatcactggactggcagccggggccaagacctataagatgagtatggcgaatcggggtcaaaatcagccggtgctcaatataaccaacaagcaggcatttatcacagcgcagaatcatggctatgcactggacaacacgttaccagcgggttggaaaccactcttcgtcaatgtgaatgatcagacaaacgaaggaattatgcacgaaagtaaacctttcttcgcggttcagttccacccggaagtaacccctgggcctatcgatacagaatacctctttgacagtttcttttcgctcattaagaagggcaaggctaccactatcacctccgtgcttcccaaacccgctttggtcgctagtcgcgtggaggtgagcaaagttctgattctgggctccggagggctatcgatcggtcaggctggcgagttcgactacagcggctctcaagcagtcaaagcgatgaaggaggaaaacgttaagacagtgctgatgaacccgaacatagccagcgtgcaaactaacgaagtgggactcaagcaggccgacactgtctactttctgccaattaccccccaatttgtgactgaggtaattaaagctgagcaacctgatggcctgatactcggcatgggaggtcagactgccctcaactgcggagtggagctgttcaagagaggcgtgctcaaggaatacggtgtcaaagtgcttggcacttctgtcgaatctattatggccactgaggacagacagctcttctcagacaaattaaatgagattaatgagaagattgcaccctcgtttgccgtggaaagcattgaggacgcactgaaagccgctgacactattggatacccagtgatgattaggtctgcctacgccctggggggtctcggcagtgggatttgcccaaatcgcgagacgttgatggacctgagcaccaaggccttcgcgatgactaatcagatactcgttgagaaaagtgtgacgggatggaaagaaattgagtatgaggtcgttagagacgctgacgataattgtgttactgtctgtaacatggaaaacgtcgacgcaatgggcgtccacacaggggattcggttgtggtggcccccgctcagacgctctctaatgcagaattccagatgctgaggagaacctctattaatgtggtacggcaccttggaatagtcggggaatgtaacattcaatttgccctgcaccctacatcaatggaatactgcatcatcgaagtgaacgccaggttgagccggtccagcgctctggccagcaaggcaactggatacccccttgcattcattgccgccaaaatcgctcttggcatccccctgccagagattaaaaacgtggtgagtggtaaaaccagcgcatgtttcgagcccagtttggactatatggtgactaaaatcccgcgatgggacctagacaggtttcatggcacatcctctcgcattggcagttccatgaagtctgtgggcgaagtaatggccattggcagaacattcgaagagagctttcaaaaagcattgcggatgtgccaccccagtatagaagggttcaccccaaggcttccaatgaacaaggagtggcctagcaacctggacctgagaaaggaactgtccgaaccgtcatcaacacgaatttacgcaatcgctaaagcaattgacgataacatgtctctcgacgagatcgagaaattgacctacatcgacaagtggttcctctataagatgcgggacattttgaatatggaaaaaactcttaaaggactgaattcagagagcatgacggaagaaactctgaagagagccaaggaaattggttttagcgacaagcagatttccaaatgcctcggattgacagaggcccagactcgcgagcttcggctcaagaagaacattcatccttgggtcaaacagatagacactctggccgccgaatacccaagtgtcacgaattatttgtatgtgacatacaatgggcaagaacacgacgtgaacttcgatgaccatggtatgatggttttgggatgtggcccataccatatcggcagctctgtagagtttgattggtgcgcagtgtcctctatccgcactttgcgccaactcggtaagaagacagtggtggtcaattgtaatccggaaacggtatctaccgacttcgatgagtgcgataaactttatttcgaggagctgtcactcgagaggattttggatatctatcaccaagaggcgtgcggagggtgtatcatatctgtgggtggtcaaatccctaacaacttggcggtgcccttgtataaaaacggtgtcaagattatgggcacaagcccactgcaaatcgaccgggccgaggaccgctctatttttagcgccgtgctggatgagctcaaggttgcgcaggccccctggaaggccgtgaatacactaaacgaagcactagagtttgcaaagtccgtggattatccttgcctgctgaggccctcatatgtcctctctggcagcgcgatgaatgttgtgttttcagaagatgagatgaaaaagttcctggaagaagcaactagagtgagccaggagcaccccgtggtcctaaccaaattcgtcgagggcgccagggaagtcgagatggatgccgtggggaaggacggacgcgtgatctcacacgcgatttccgagcacgtggaagatgctggtgtgcactctggggatgctacactgatgcttcccacacagaccatatcccagggagccattgaaaaggtgaaggatgcgacgcgaaagatcgccaaagcattcgccattagcggccctttcaacgtccagttcctggtgaagggcaacgacgtccttgtaatcgagtgtaatctgagagcctcccgtagtttcccgtttgtttcaaaaactctgggagtcgatttcattgacgtggcaacaaaagtgatgattggtgaaaatgtagatgagaaacaccttcccactttagatcaccccatcatcccggccgactacgtggctatcaaggcacctatgtttagctggccgagactacgagacgcagatccaattctccggtgtgagatggcatccacgggtgaagttgcatgcttcggcgaagggattcacactgcctttctcaaagcgatgttgtccactggcttcaagatccctcaaaagggcatattgattggcatccagcagagctttcggccccggtttctgggagtggctgagcagctgcataacgagggcttcaagctattcgccacggaggcaacctcagattggcttaacgcaaacaatgtcccggccacacccgtggcttggcccagtcaagaagggcagaacccgtccttgagttcaattcgcaaactgatccgggacgggagcattgacctcgtgatcaatttgcctaacaacaataccaagtttgtgcatgacaactacgttattagacggacagcagtggacagcggaatacctctgctaacgaacttccaggtgacgaagctgttcgctgaggcagtgcagaaaagccgcaaggttgattccaagtccttattccattaccggcagtactccgccgggaaagccgca

SEQ ID NO: 8061 - DNA, 4500 bp, Artificial Sequence
  Description of Artificial Sequence: Synthetic coding sequence
atgacgcgtatcctgactgcatttaaagtagtgcgcacgctgaaaaccggcttcggttttactaacgtcactgcccaccagaagtggaagttctcccggccgggcattcgcctcctgtcggtaaaggcccagacggcacacatagttttggaagacggtacgaagatgaagggttattcgttcgggcacccgtcaagcgtggccggagaagttgttttcaacaccggattgggaggatacccggaggctatcaccgaccctgcttacaaaggccagatcttaactatggctaatccaatcatcggcaacggaggcgcacctgataccaccgctctagatgaattagggcttagtaagtatctcgagtcgaacgggataaaggtgagcggacttctcgtgttagattacagcaaagattataatcattggcttgcgacaaagtccttgggtcaatggcttcaggaagagaaggttccggcaatctatggggtcgacacccgcatgcttaccaagatcattcgtgacaaggggaccatgttaggaaaaatcgagtttgaggggcagccggtggattttgttgatccgaacaagcagaatctcatcgctgaagtctctaccaaggacgttaaggtttatggcaagggaaaccccaccaaagtggtagcagttgattgtggaatcaagaacaacgtcattcgtttgctagtcaaacgcggcgccgaagtgcacctggtcccctggaaccatgactttactaaaatggaatacgacggcattttgattgccggcgggccgggaaatccagcattggcggagcctctgattcaaaacgttcgcaagatcctggagagcgatcgaaaggagccattgtttggtattagcacgggcaatctgatcacaggcttggccgctggcgctaaaacctataagatgtcgatggcaaaccgaggtcagaatcagcccgttctgaacataactaacaagcaagcttttatcacagcccagaaccatggatacgctctagacaacacgttgccagcagggtggaagcctcttttcgtcaacgttaatgatcagacaaacgaaggtatcatgcatgagtccaagcccttcttcgccgtccagttccatccagaagttacccctggccccatcgataccgaatatctcttcgacagcttttttagtctgattaagaagggtaaggcgacgacaattacttcggtcctgcccaaacccgccctggtggccagtcgcgtagaggtctctaaggtcttgatcttgggcagtgggggactctcaatcgggcaggcgggtgaattcgattacagtggctcccaagcggtcaaagcgatgaaggaggaaaacgtgaagaccgttctaatgaatccgaacatcgcatctgttcagaccaacgaagttggtctaaagcaggcagatactgtgtatttcctacccattaccccgcaatttgtcacggaggttattaaggctgagcaacccgatggtctcatcctgggaatggggggacagactgctcttaattgcggagtggagttgtttaagcggggtgtgctcaaagaatacggagtcaaagtcctcggtactagtgtcgagtccatcatggccacagaggatcgccagttgtttagcgacaagctgaatgagatcaatgagaagatcgccccttcgtttgccgtggagtcgattgaggacgctctcaaagccgcggacacgattggttatcccgtcatgattcggtccgcgtacgcactcggcggcttgggcagtgggatctgtcctaatcgagaaactctcatggacctgtccactaaggccttcgcgatgaccaaccagatcttggtcgagaaaagtgtaacaggttggaaggaaatcgagtatgaggtggtgcgggatgcagacgacaattgcgttacagtttgtaatatggagaacgttgacgctatgggggtccatactggtgattcggttgtagtagcccctgcccaaaccctgtccaacgcagaattccagatgctgcgccgaactagcattaatgtggtccgccacttaggcatagtcggcgaatgtaatatccagtttgctttgcacccgaccagcatggaatattgcatcatagaggttaatgcaagactttctcggtctagcgcattggcctcgaaggccaccggctacccactcgcttttattgccgccaaaatagcgctgggaatcccactccccgagatcaaaaacgtcgtttcgggaaagacaagtgcatgcttcgagccttcccttgactacatggtgacaaagatacctcgctgggatctcgatcgattccatggtacgtcgtcacgcatcgggagttccatgaaatcggttggggaggtgatggccatcggcaggacattcgaggaatccttccaaaaggcgctccggatgtgccacccctcaatcgagggattcacgcctcgactccccatgaacaaagaatggccatcaaatttggatctcagaaaggagctctcggaaccctcgtccacacgcatctacgctatcgccaaggctattgacgataacatgagccttgatgagatcgaaaagctgacctatatcgacaagtggttcctatacaaaatgcgcgatatcctcaatatggaaaaaactctcaaggggctgaattcggagtcgatgacggaggaaactctgaagcgcgctaaggagataggattcagcgacaaacagatttcaaaatgcctcggtctaactgaggcacagacacgcgagttgcgtttgaaaaagaacatccacccttgggtcaaacaaatcgatacactcgcggctgagtacccgtcggtcacaaattatttgtatgtgacgtacaatggccaggaacacgatgttaatttcgacgaccacggtatgatggtcttgggttgtggtccgtaccacatcggctctagtgttgaattcgactggtgcgctgtgtcgtccattcgcacactgcgccagctggggaaaaagacagttgtcgtcaattgtaatccggagaccgtgagtaccgatttcgacgagtgtgataagttatacttcgaggaactgagcttagaaaggatcttggacatttaccatcaggaggcctgtggagggtgtataatctctgttggaggccagattccaaacaacctggccgtccctctatataagaatggggtcaagataatgggcacttccccactgcagatcgatcgcgctgaggatagaagtatttttagcgcggtccttgatgaactaaaggtagcacaggcgccatggaaggcagttaatacactgaatgaggctctggaattcgccaaaagcgtggattatccatgcttgctccgcccgagttacgttctgtcagggtctgcaatgaatgtagtattctcagaagacgagatgaagaagttcttggaggaagcgactcgggtttcacaggagcacccggttgtccttactaagttcgtggagggggcccgtgaggttgaaatggacgcagtcgggaaagatggccgcgttatttcccatgccatctctgaacatgtggaggacgcaggagttcactcgggcgatgccaccctaatgctgccaacacagacaattagccagggggccatagaaaaagttaaggatgcgaccaggaaaattgcgaaggcctttgctatttcgggtccgttcaacgtacagttcctggtcaagggcaatgatgtgctggtaatcgaatgcaacctgcgagcttcccgttctttcccattcgtctcgaaaaccctgggggttgatttcatcgacgtggcgactaaagtgatgatcggtgagaacgttgatgagaaacatttgccaacgctagatcacccgataattcctgccgattatgtagccatcaaagcgcccatgttttcatggcctcggctgagagatgcagatccgatcctgcggtgcgagatggcctccacaggggaagttgcctgctttggggaagggattcatacagcttttctgaaggcgatgttgagcacgggatttaagatccctcaaaagggaattctgattggcattcaacagtcgtttagaccccgtttcttgggtgtagcagaacagttacacaacgaaggcttcaagcttttcgcaaccgaagccacctcggattggctcaatgctaacaatgtccccgccactcctgtcgcctggccctcacaggaggggcagaacccatcgttgtcttctatccgcaagttgatccgtgacgggtcaatagatttggttatcaacttgccgaacaacaacaccaaattcgttcatgacaactatgtaattcgtagaaccgcggtggactcaggcatcccgcttttgaccaacttccaggtcacaaagctatttgccgaggctgttcagaaatcgcgcaaagtagacagtaaaagcctctttcattatagacagtattcagccggtaaggctgca

SEQ ID NO: 8062 - DNA, 4500 bp, Artificial Sequence
  Description of Artificial Sequence: Synthetic coding sequence
atgactcgaatcctcactgcttttaaggtcgtgagaacgctcaaaacaggttttggattcacgaatgtcaccgcccaccaaaagtggaagttctcgcgtccaggcatccgcctgctgagtgtaaaggcacaaaccgctcacatagtgcttgaggacggcaccaagatgaaggggtactctttcggacacccatcatccgtagcgggggaggtcgtctttaacaccggcttgggtggctatccagaggccatcaccgaccctgcctataaaggtcagattctgactatggccaaccctatcatcgggaatgggggggctcccgacaccaccgcattggatgaactaggattgagtaagtacctggaatccaatggaatcaaggtttccggccttctggtgctggactacagcaaggactacaaccactggctggcaacaaaatccctgggccaatggctacaggaggaaaaggtcccagctatatatggagtcgatacccgcatgctgacaaagatcatccgcgacaaaggaactatgctgggaaagatagagtttgagggtcaacctgtggactttgttgaccctaacaaacagaatctcatcgcagaagtgtccacaaaagacgttaaagtgtacggcaaaggaaatcctaccaaggtggtcgccgtggactgcggtatcaaaaacaatgtcattcgcctcctggtcaagcgtggagcagaggttcacctggtgccctggaatcatgattttaccaaaatggagtatgacggcattttaatcgccgggggcccaggaaacccggccctcgcagagccattaattcagaatgtccggaaaatcctggaaagtgatcgaaaggagcctttgtttggaataagcacggggaatctcatcacagggctcgctgcaggagctaagacatacaagatgtcaatggctaaccgcggtcaaaaccaacctgtgttaaatattactaataagcaagctttcattaccgcacagaaccatggttatgcactagataatactttacctgccgggtggaaaccgctgtttgtgaacgtcaatgatcagaccaatgaaggtatcatgcacgagtccaagccctttttcgccgtccagtttcatcccgaagtaactcccggacctattgacaccgagtatctgttcgactccttcttcagcttgataaaaaaaggaaaagccacaactatcacatccgtgctcccaaaacctgctcttgtggcgtctagggtggaggtttccaaagttcttatcctgggctccggtggactctccattggacaggccggggaattcgattactccgggagtcaagccgtgaaagccatgaaggaagagaatgtgaagaccgtgctcatgaaccccaacatcgccagtgtgcagacaaacgaggtgggacttaaacaggcggacacagtttacttcctgcccataacccctcagtttgtgacagaagtaatcaaggctgagcagccagacggcctgattctgggcatggggggtcagaccgctttaaactgcggggtggaattgttcaagaggggtgtgctcaaggaatacggcgtcaaagtgctcgggacaagcgtggagtcaatcatggctaccgaagaccgccagctgttcagcgataagctgaacgagatcaatgaaaaaatcgcaccttcctttgccgtggagtctatcgaggatgcgctcaaggcggccgataccatagggtatcccgtgatgatcaggagcgcgtatgcactggggggcctgggttcaggcatctgtccgaaccgcgagaccctcatggacctatctacgaaggcattcgccatgactaaccagattcttgtggaaaaatccgtgactggatggaaggagatcgagtacgaggtcgtgagagacgctgatgacaactgcgtcaccgtctgcaacatggagaatgtagatgcgatgggagttcacactggcgacagtgtcgtcgtggccccggctcagaccctgtcgaacgccgagttccagatgctgcgcaggactagtatcaacgtcgtgaggcacttgggcattgtcggtgagtgtaatatccagttcgcactccatcctacatctatggaatattgcatcattgaagtcaatgccagactcagtaggagtagcgccctggctagtaaggctactggctaccccctcgcctttatcgctgctaaaatcgctctgggtatcccacttcccgaaatcaagaacgtggtttcaggtaagaccagtgcctgcttcgaaccttcccttgactatatggtgacaaagatcccacggtgggacttagacaggttccacgggacatcatcacgcattgggtccagtatgaagagcgtcggagaagtcatggcaatcggcaggacctttgaggagtcctttcagaaggccctaagaatgtgtcacccaagcatcgaggggttcaccccacggcttcctatgaacaaggagtggccatccaatctcgacctgcgaaaagagttgagcgaaccaagttccaccaggatttacgcgattgcgaaagccatagatgacaatatgtcattggacgagattgagaagctcacatacatcgataagtggttcctgtacaaaatgcgtgacattctgaatatggagaagacactgaagggtctgaattccgaatctatgacagaggaaactctgaaacgggcaaaagagattgggttctccgataaacagattagtaagtgcctggggctcaccgaggcccagactcgggaactgcggctgaaaaaaaacattcacccttgggtgaaacagattgacaccctggccgccgaatacccatcagtgaccaattacctttacgtgacttataatggtcaggagcacgacgttaattttgatgaccacgggatgatggtcctcgggtgtggaccataccatatagggagttccgtggaattcgactggtgcgccgtgtcttctatccgcactctcagacagttaggcaagaagactgttgtggtgaactgtaacccggagacagtctctacagattttgacgagtgcgacaagctatatttcgaggaattaagcctggagaggatactcgacatctaccaccaggaagcctgcggtggctgtattatttcagtgggcgggcagataccgaataacttggcagtgcccctgtataagaatggagttaaaatcatggggacaagccccctccagatcgatcgcgcagaagacagatctatcttttctgccgtgctggatgaactgaaggtagcccaagccccatggaaggctgtgaacactctgaacgaagccctggaattcgcaaagtcagtcgactacccctgtctccttcgccccagttatgtgttgtccggctctgcgatgaacgtggtcttctctgaggatgaaatgaagaaattcctcgaagaggcaacgagggtcagccaagagcaccccgttgttctcactaagtttgttgagggggcacgagaagtggagatggacgccgtcggcaaagatggcagggtcatttcacacgcaatttccgaacacgtagaggacgccggggtccactcaggtgacgctacgctgatgctgcccacccagaccatcagtcagggcgctatcgaaaaggtgaaggacgcaacgagaaaaatagccaaggcattcgccatctcaggaccgttcaacgtgcaattcttggtgaagggtaatgacgtgctggtcattgaatgcaacttgagagcgtctagatcattccccttcgtaagcaaaaccctgggagttgactttatcgacgtggcaactaaggtaatgataggtgaaaacgtagatgaaaagcacctgcccacactagaccatccaatcattccagcagactatgtagccatcaaggccccaatgttcagctggcccaggctgagggacgcggatcccattttgcggtgtgaaatggcaagcacgggggaagtggcctgcttcggagagggaatccatacagcttttctcaaagcaatgttgtctacaggctttaagattccccagaagggcatcctgatcggaatacagcagagctttcgcccaagattcctgggcgtggctgaacagctgcacaacgaagggttcaaactcttcgcgaccgaggctaccagcgactggctaaacgccaacaatgtgccagctaccccagtcgcatggccatcccaggaggggcaaaacccatccctgtcctcgattcgcaagctgattcgagatggttcaatcgatttagtgatcaacttgcccaataacaacacaaaatttgttcatgataattatgtgatccggaggacggccgtggactcagggatccctctgttgaccaatttccaggtgaccaagctgtttgccgaggcggtacaaaaaagtcgcaaggttgatagtaagagcttgtttcattataggcaatacagtgctggtaaggcagcc

SEQ ID NO: 8063 - DNA, 4500 bp, Artificial Sequence
  Description of Artificial Sequence: Synthetic coding sequence
atgactcggattctgactgcatttaaggtcgtccggacccttaagaccgggtttgggttcacgaacgtaactgcgcatcaaaagtggaagttttcgcggcccggcattcgtctgctgagcgtcaaggcacagactgcacacatcgtacttgaagatggcactaaaatgaagggctacagtttcggacatccaagcagcgtggcgggcgaggtggtgttcaacaccggacttggtggataccctgaggcaattactgatcctgcgtacaaggggcagattcttactatggcaaacccaattatcggtaatggcggagcacccgacactactgcccttgatgaacttggcctctcaaagtacctggaatccaacggcatcaaagtctcgggacttcttgtcctggattactccaaggactacaaccattggcttgctactaagtccctgggacaatggcttcaggaagaaaaagtgcccgcaatttacggagttgatacccgcatgctcactaagattatccgtgataagggaaccatgctgggaaagatcgaatttgaagggcaaccagtcgattttgtggatcccaataaacaaaacttgattgccgaagtaagcactaaggacgtgaaagtgtatggtaagggtaaccctacgaaggtggttgctgtggattgtggaattaagaacaatgtcatcaggctgcttgtgaaacgaggtgcagaggtccacctggtgccatggaaccacgatttcaccaaaatggaatacgatggaatactcatcgcgggtggtcccgggaaccctgcacttgcagagccactcatccagaacgtgaggaagatccttgaatccgatagaaaggagcctttgtttggtatatcgaccggaaatctcattaccgggcttgccgccggagcgaaaacctacaagatgagcatggcaaatagagggcaaaaccaaccagtgctgaacatcaccaacaagcaggctttcattactgcccagaatcatggatatgcactcgataatactctgcctgccggatggaagcccctctttgtcaacgtgaacgaccaaactaacgaaggcattatgcatgaatcaaaacctttctttgccgtgcaatttcatcccgaggtgactccgggaccaatcgacaccgagtatctgtttgactcgttcttttccctgattaagaaaggcaaagccaccaccattacgtcggtgctgccaaaaccggcactggtggcttcgagagtggaggtgtctaaggtgctgatattgggcagtggtggtttgtcgattggccaggcaggtgaatttgattattcaggaagccaggctgtgaaggccatgaaagaggaaaacgtgaaaaccgtcctcatgaaccctaatatcgcatccgtgcaaaccaacgaagtgggacttaagcaggcggacactgtgtactttcttcctataaccccgcaatttgtgaccgaagtgatcaaggccgaacaacctgacggtcttatcctgggaatgggagggcaaaccgcacttaattgtggggtggagttgtttaagagaggagttctgaaagaatacggagtcaaagtgctggggacgtccgtggaatcaattatggccacggaggacagacaactgttctcggacaagctgaatgagattaatgaaaagattgctccatcattcgcagttgagtcgatcgaagatgcactcaaggcagcagatactatcggttaccctgtgatgatccggtccgcttacgcactcggcggacttggctccggaatctgtcccaaccgcgaaactctgatggatttgagcaccaaggcgtttgccatgaccaatcaaatacttgtcgaaaagtcagttaccggatggaaggaaatagaatacgaagtggtgagagacgcagacgacaactgtgtgaccgtgtgcaatatggagaacgtcgacgcaatgggagtccataccggagacagcgtggtggtggcaccggcacaaaccctttcaaacgccgaatttcagatgctgcggcggacctccatcaatgtggtacgccatctgggtatagtgggcgagtgcaacatacagtttgccttgcatccaaccagcatggagtactgtatcattgaagtgaacgcacggctgtcgcgctcctccgctctggcatcgaaagccactggttaccctcttgcattcattgcagcgaagattgcactggggattccacttcccgaaatcaaaaatgtcgtttccggtaagacctccgcatgttttgaaccatcacttgattacatggtgaccaagataccacgttgggatcttgatagattccacggaactagctcgagaataggctcgtcaatgaagagcgtgggagaagtgatggcaattggaaggacgtttgaggaatcgtttcaaaaagcgttgcgaatgtgtcatccctccatcgaaggctttacccctagacttccaatgaacaaagaatggccttctaacctggatcttcgtaaggaactgagcgaaccatcgagcactaggatttacgctatagcaaaagcaattgacgataacatgtcgcttgacgagattgagaagctcacttacatagacaagtggtttctgtacaagatgagagatattcttaacatggagaaaactctcaaaggtcttaactcggagtcaatgacggaagagactctgaaacgtgcaaaagaaattggattcagcgataagcaaatttcaaaatgtttgggactgaccgaagcacaaactagagaacttaggctgaagaagaacatccatccttgggttaaacaaatcgatactctcgctgccgagtacccatccgtcactaactatctttacgttacctacaatggacaagaacacgatgtcaacttcgacgatcacggcatgatggtgctcgggtgcggcccttaccatattggctcctccgtggagtttgattggtgcgccgtgtcctccatccgtacgctgcggcagctgggaaaaaagacggtggttgtcaattgtaaccctgagactgtgtcgaccgattttgatgaatgcgataagttgtacttcgaagaactcagcctcgaaagaatcctggacatctaccatcaggaagcctgtggagggtgcatcatctcagtcggtggacaaattccaaataaccttgcggtccctttgtacaaaaatggcgtcaagatcatgggaaccagccctcttcagattgatcgggcagaagatagatcaatcttttccgcagtgttggatgaactgaaagtggcacaggcaccctggaaagcagtcaatacgctcaatgaggcactcgaatttgctaagtcagttgactacccatgcctgcttaggccttcatacgtgctgtcgggcagcgctatgaatgtcgttttttcggaggatgaaatgaagaagtttctcgaagaggcgactcgcgtctcccaagaacacccagtagtcctgaccaagtttgtcgagggggcgagggaagtggagatggatgccgtgggcaaggatggtcgagtgatttcccatgcaatttccgaacatgtggaggacgcaggggtgcacagcggcgacgcaaccctgatgctgcctacccaaactatcagccagggtgcaatcgagaaggtgaaggatgcgactcgtaagattgccaaggcatttgcaatctcaggtcccttcaacgtgcagtttctggtgaaaggaaatgatgtgcttgtgatcgaatgcaaccttcgggcctcgaggtccttcccgttcgtgtcaaagaccctcggggtggacttcatcgatgtggccaccaaggtgatgattggggagaacgtggatgagaaacacctgcctactctggatcatcccatcattcctgcagactacgtggcaataaaggctcctatgttctcgtggccgcggctgcgagacgcggacccaattcttcggtgtgagatggcgtcgacgggggaagtcgcatgtttcggagaagggattcacacggcttttctcaaagcaatgttgtcaactggctttaagattccgcagaagggaattctcatcggaattcagcaatcgttcagaccaaggtttcttggtgtggcagaacagcttcacaatgaaggttttaagctgttcgcaaccgaagcgacctcggattggctgaacgcaaacaacgtgccggccacgcccgtcgcttggcctagccaagaaggtcaaaacccttccctctcctctataagaaagctcataagggatggatcgattgatctcgtgatcaatttgcccaataacaacactaagtttgtccatgataactacgtgatcaggaggactgccgtagactctggtattcctctgctcaccaatttccaagtgaccaaactgttcgcagaagcagttcagaagtccagaaaggtcgacagtaaatccctttttcattacaggcagtactccgcaggaaaggccgcc

SEQ ID NO: 8064 - DNA, 4500 bp, Artificial Sequence
  Description of Artificial Sequence: Synthetic coding sequence
atgactaggatactgacggccttcaaggtggtgcgcaccctgaaaaccggctttggatttaccaacgtgacggcgcatcaaaagtggaagttttcaagaccaggaataaggctgctgagcgtcaaggcgcaaactgcacatatcgttctggaggacgggaccaaaatgaaaggctattccttcggccatccttcctcggtggcgggagaggtcgtattcaataccggactgggaggatacccggaagcgatcaccgatccggcgtacaagggtcagattctgacgatggccaacccgatcatcggcaacggaggggcgccagacaccacggcccttgatgagctgggtctttcgaagtacctggagagcaatgggattaaggtttcagggctcctggtccttgactacagcaaggattacaaccattggctcgccaccaagtcgctgggtcagtggctgcaggaagaaaaggtcccagccatctacggagtggatacccggatgcttactaagatcatccgcgataagggcactatgctgggaaagattgaattcgagggacaacccgtcgacttcgttgacccgaacaagcaaaacctcattgcggaggtcagcaccaaggacgtcaaagtctacggaaagggtaatccaaccaaagtggtcgccgtggactgtggaatcaaaaacaatgtcatcaggctcctggtgaagcgcggagctgaggtgcatctggtgccgtggaaccatgacttcaccaagatggagtacgacggcatccttatcgcaggtgggccagggaacccagcgctggcagaaccccttatccagaacgtgaggaagatcctggaatccgacaggaaagagccgctgttcggaatcagcaccggaaaccttatcaccggactggccgcgggggctaaaacttacaagatgtcaatggcaaaccggggacagaatcaaccagtgttgaacattaccaacaaacaggcgttcatcaccgctcagaaccatgggtacgctttggacaacaccctgccggccggatggaagcctctgttcgtcaatgtgaacgatcaaaccaacgagggcatcatgcatgaatcaaagcccttttttgccgtgcagttccacccggaggtgactcccggcccgattgacaccgaatacctcttcgattcgttcttttccctgatcaaaaaaggaaaggccacgactatcacgtccgtgctgccaaagccggcattggtcgcgtcgcgcgtggaagtgtcaaaggtcctgatcctgggatccggcggactgagcatcgggcaggctggcgagttcgactactcaggatcgcaggctgtcaaggccatgaaggaggagaatgtcaaaaccgtcctcatgaaccccaatattgcgtccgttcagactaacgaggtgggactgaagcaagccgacaccgtgtacttcctgcctatcactccacagttcgtgactgaagtcattaaagcggaacagccggatggactgatccttgggatgggtggtcagactgccctcaattgcggagtggaactgttcaaacgcggcgtgctgaaggagtacggcgtgaaggtgcttggaacttccgtggaatcaatcatggctaccgaggacagacaactgttctcagacaaactcaatgagatcaacgagaaaatcgccccatcgttcgcggtcgagtcgatcgaagatgcgctgaaggccgccgacactatcggttacccagtgatgatccgcagcgcttacgctcttggcggcctgggaagcggaatctgtccgaaccgcgaaaccttgatggacctctcgacgaaggcattcgcgatgaccaaccagattctggtggaaaaatcagtcactggatggaaggaaattgaatacgaagtggtccgggacgcagacgataactgcgtgaccgtgtgcaacatggaaaatgtcgacgcaatgggggtccacactggagatagcgtcgtggtggctccagcacagaccttgtcgaatgcagaatttcagatgcttagacgcacttcgatcaatgtggtgagacacctcggcatcgtcggagagtgcaacatccagttcgctttgcacccgacctccatggagtactgcatcatcgaagtgaacgccagactctccaggagttcggctctcgcctccaaggctactggatacccactggcatttatcgccgcaaagatcgccctgggaatcccgctgcctgaaatcaagaatgtggtttcgggtaagaccagcgcatgtttcgaaccgtcactggactatatggtgactaagatcccgagatgggaccttgatagatttcacggaacttcgtcacgaatcggttcgtcgatgaaatcagtgggagaagttatggcaatcggcaggaccttcgaagaatcgttccaaaaggctctgcggatgtgtcacccgagcatcgagggatttacccctcgactcccgatgaataaggaatggccgagcaaccttgatttgcggaaggaattgtcggaaccgtcgtccactaggatctacgctatcgcaaaggcgatcgacgacaacatgtcgctggacgagattgagaaactgacttacatcgataaatggttcctttacaagatgcgggatatcctgaacatggaaaaaaccctgaagggccttaattccgagtcgatgactgaggagactttgaagcgcgctaaggagatcggcttctccgataagcagatctccaaatgtctgggcctcacggaagcccaaacccgggaactgagactgaagaagaacatccacccgtgggttaaacaaatcgacaccctggcggctgagtacccgagcgtgactaactacctctacgtcacctacaatggccaagaacacgacgtgaacttcgatgaccatggcatgatggtgctgggctgcggaccttatcacatcggaagctccgtggaattcgactggtgcgccgtgtcctcgatcagaaccctgcgccagctgggaaaaaagacggtggtggtgaattgcaacccagaaactgtctccactgacttcgacgaatgtgacaagctgtattttgaggaactgtccctggagcggatcttggatatctaccaccaagaggcttgcggcggctgcatcatctcggtcggtggccagattccgaacaaccttgcggtgcccctttacaaaaatggcgttaagattatgggaacctccccgctccagatcgatcgcgccgaggaccgctcgatcttttccgcggtgctcgacgaactgaaagtggctcaggccccgtggaaagccgtgaacaccctgaacgaggccctggagttcgctaagagtgtagactacccatgcctgttgcggccatcgtacgtgctctcgggatccgcgatgaatgtcgtgttcagcgaagatgaaatgaagaagtttctcgaggaggcgacccgggtgtcccaagaacaccctgtggtgctcaccaaatttgtggaaggcgcccgggaggtcgagatggacgccgtgggaaaggacggaagggtgatctcacacgcgatctccgagcacgtggaagatgccggagtccactcaggtgacgcgaccctgatgctgccgacgcaaaccatcagccagggagcgattgagaaagtgaaggacgcaacccgcaagattgctaaggctttcgctatctcgggaccattcaatgtccaattcctcgtgaagggaaacgacgtgctggtgatcgaatgtaacctgcgagcgtcccgctcattcccgttcgtctccaaaaccctgggagtggatttcatagacgtcgcaaccaaagtgatgatcggagaaaacgtggatgagaagcatctgcccaccctcgatcaccccatcatcccggctgattacgtcgccattaaggctccgatgttctcctggccgaggctgcgggatgcagatcccattctgcgctgcgaaatggcatcgaccggcgaagtggcatgctttggggaaggcatccacactgccttcctcaaggccatgctttcaaccggcttcaagatcccccagaagggcatcctgattggaattcagcaatcgttccgcccacgattcctgggagtggccgaacaactccacaacgagggctttaaacttttcgcgactgaagcaactagcgactggctgaacgcaaacaatgttccggccactccagtggcgtggccgtcgcaagagggacagaatccgagcctgagctccatcaggaagctgatcagggacggaagcatcgatttggtgatcaacttgccgaacaataacaccaaattcgtgcatgacaattacgtgatccgccggacggccgtggattcggggatcccgctcctgaccaatttccaggtgactaaactcttcgcagaggcagtgcagaagagccgaaaggtggattcgaagtcgttgttccactaccgtcagtactctgccggcaaggccgca

SEQ ID NO: 8065 - DNA, 4500 bp, Artificial Sequence
  Description of Artificial Sequence: Synthetic coding sequence
atgactaggattcttaccgcatttaaggtggtgcgtacccttaagaccggcttcggctttaccaatgtcaccgcccatcaaaagtggaagttctcgcggcctggaatccggctgctttcggtgaaggcccaaaccgcacacattgtgttggaggacgggactaaaatgaaagggtatagcttcggacatccatcatcggtcgccggagaagtcgtgttcaatactggtttgggcggctacccggaggcaattaccgacccggcatacaagggccaaatactgactatggccaaccccatcattggtaacggtggggcacctgataccaccgcgctcgatgagttgggactgtcaaagtacctggagtcaaacggaattaaggtatcgggccttctcgtgctcgactactcgaaggactataaccattggcttgcaaccaagtcacttggacagtggttgcaggaagaaaaggtgcccgcaatctacggagtggatactagaatgctgaccaagattattcgagacaaaggcactatgctcggtaaaatcgagtttgagggacagcctgtggactttgtcgatccaaacaagcagaaccttattgcagaagtgtctaccaaggatgtcaaggtgtacgggaaaggcaacccgaccaaggtggtcgcagttgactgcgggattaagaacaatgtcattcggttgctggtgaaacgaggagccgaagtgcatctcgtgccttggaatcacgattttaccaagatggaatacgatggcattctgatcgcgggtggaccagggaacccagcactcgcagaacctctgattcagaatgtcagaaagattctggagtccgatagaaaggaacctcttttcgggattagtaccgggaacctgatcaccggactggcggcaggggccaagacttacaagatgtcgatggcgaacagaggtcagaaccaacctgtccttaacataactaataagcaggccttcattaccgcacaaaatcacggatacgcacttgataacactcttcctgcaggatggaagcccttgttcgtgaacgtgaatgatcagacgaacgaaggaataatgcatgagtcaaaaccatttttcgcggtccagtttcaccctgaagtcaccccgggtcccattgatactgaatacttgttcgactctttcttttcgctgatcaaaaagggaaaagcaaccactattacttcagtgctgccgaaaccagcccttgtggcgagccgcgtcgaagtgtccaaagtcctgattctcgggagcggtgggctctcgattggacaggcaggagaattcgattactcgggttcacaggccgtgaaggcaatgaaggaagaaaatgtcaagaccgtccttatgaacccaaacatcgccagcgtccaaacgaacgaggtgggacttaagcaagctgatactgtgtacttccttcctatcaccccccagtttgtgactgaagtcattaaggcagaacaacccgatggacttattctgggtatgggagggcaaaccgccctcaactgtggcgtggagctgttcaagaggggggtgctgaaggaatacggggtcaaggtgctgggaacttccgtggagtcgattatggcaacggaagatagacagctcttttcggacaaattgaacgagatcaacgagaaaattgcaccgagctttgcagtggagtcaattgaagatgcactcaaggccgccgataccataggttaccccgtgatgattagatccgcgtatgcactgggcggcctgggatcaggaatatgccctaacagggaaaccctgatggatctttcgaccaaggccttcgccatgaccaaccagatcctcgtggaaaaaagcgtgactgggtggaaggagatcgagtacgaggtggtccgggatgccgatgataactgtgtcaccgtctgtaacatggagaatgtggacgcaatgggcgttcataccggtgattctgtggtcgtggcccctgcccaaaccttgtcgaacgcagagtttcagatgcttaggcggacgtccatcaacgtggtgcgccacctgggtattgtgggtgagtgtaacatccaattcgcactgcatcctaccagcatggaatactgtattatcgaagtcaatgcccgcctgagccggagcagcgcactggcatcaaaggcaaccggatacccccttgcatttatcgctgcaaagattgctcttggaattccactgccagagattaagaacgtggtgtcaggcaagacctcggcttgctttgagccatccctggactacatggtgaccaagatacctcgctgggatctcgaccgcttccatggtacctccagccgtattggctcctccatgaaaagcgttggtgaggttatggctattggtagaacctttgaggaatcgtttcaaaaggcactccggatgtgtcacccatcgattgaaggttttactccaagacttcctatgaacaaggaatggccgtcgaatctggatctccgaaaagaactctcagagccatcgtcgaccaggatatatgcaattgccaaggcaattgatgataacatgtcacttgacgagatcgagaagctcacctacatcgataagtggtttctctacaagatgcgggatattctgaatatggaaaagacccttaagggactcaattccgaaagcatgaccgaagaaaccctgaagagagcgaaggaaatcggattttcggacaagcagatcagcaagtgtttgggtcttactgaggcacaaacccgcgaacttaggcttaagaaaaacatacatccttgggtgaagcaaattgataccctcgcagcagagtatccttcggtcacgaattacctctacgtcacgtacaatggacaggaacacgatgtgaactttgacgaccatggtatgatggtgctgggctgtggaccgtaccatataggctcatctgtggagttcgattggtgtgcagtctcctccatacggactctgcgccaacttggtaaaaagacggtggtcgtcaactgcaaccctgaaaccgtgtcaacggactttgatgaatgcgataaactgtactttgaagaactcagcctggaacgcattctggacatataccaccaggaagcatgtggaggttgcattatctccgtgggaggtcagattccaaacaatttggcagtcccgttgtacaagaacggggtgaagatcatgggaacttccccgctccaaatcgatcgggcggaagatagatccatcttcagcgcggtgctggatgaactgaaggtcgcgcaggcgccatggaaggctgtgaatactcttaacgaggccctggagtttgcaaagtcagtcgattacccttgtctgctccgcccttcctacgtcctctcaggatccgccatgaatgtggtcttttcggaagatgaaatgaagaagtttctcgaggaagcaactcgagtgtcgcaagagcatccggtcgtccttaccaagttcgtcgaaggtgcccgggaagtggaaatggacgctgttggtaaggatggccgcgtgatttcccatgcaattagcgaacacgtggaggacgcgggggtccattctggagatgcaacgctgatgcttcccacccaaaccattagccaaggtgccatagaaaaggtgaaagacgcaacgcggaaaatcgccaaggcgtttgctatatctggcccttttaacgtccagtttcttgtgaagggtaacgacgttctggttattgaatgtaatctccgagcgagccgctcgtttccctttgtgtccaaaacgctgggagtggactttatagacgtggcaaccaaggtgatgattggggagaatgtcgacgagaagcatctccctactcttgaccatcccattatacctgccgactacgtcgcaatcaaagcaccgatgttttcgtggccacggctcagggacgccgaccctatcctgcgatgtgaaatggcatccaccggtgaagtggcttgttttggcgaaggtattcatactgcctttctgaaagccatgctgtcgacggggtttaagattccgcaaaagggaattcttatcggaattcagcaatcgtttcgtcctagatttctgggtgtcgctgaacaactgcataacgaagggtttaagctgtttgccactgaagcaacctcggactggctgaatgcaaacaacgtgcctgccactccggtcgcgtggccgtctcaagaaggtcaaaatcccagcttgtccagcattcgcaaacttatccgggacggcagcatcgatctcgtgatcaacctgcctaacaacaacaccaagttcgtgcacgataactacgtgatcagacggaccgccgtcgattcaggtatcccactccttactaacttccaggtcactaagctgttcgcagaagcagtccagaagtcgcgcaaggtggatagcaagtcgctttttcactacagacagtactcggccgggaaggcagcc

SEQ ID NO: 8066 - DNA, 4500 bp, Artificial Sequence
  Description of Artificial Sequence: Synthetic coding sequence
atgacacgcatcttgacggccttcaaggtagtccggactttaaaaacaggttttggcttcaccaacgtaactgcccatcagaagtggaagttcagccgcccagggattcgattactgtccgtgaaagcccagacagcccatattgtactggaagatgggacaaaaatgaaaggctactctttcggccacccctcctctgtggctggggaggtggtcttcaatacgggactcggcggatatcccgaagccatcaccgatccagcatataaagggcagatcctcacaatggcaaatccaatcattggtaacggtggcgcacctgatacaaccgcactggatgagctcggtctcagtaaatatctggagagtaacggaatcaaggtttctggcctgctggtgttggattatagcaaagactacaaccactggctcgctaccaagtccctggggcagtggttgcaggaggagaaagttccagcaatttatggagtagatactcgcatgctgacgaagataatcagggataaggggaccatgctcggtaagatagagttcgaaggtcagcccgtggacttcgtcgaccccaacaaacagaatcttatcgccgaagtctctacgaaggacgttaaggtgtacggcaaaggcaacccaactaaagtcgtggcagtggattgcgggatcaagaataacgtcattcgactcctagtcaagcggggtgctgaagtgcatctggtcccctggaaccacgactttacgaaaatggagtatgatgggattctgatcgccgggggaccaggcaatcctgctctggctgagcccctcatccaaaacgtgcgaaaaattctcgaatctgacagaaaggaacctttattcgggataagcacagggaacttgatcactgggctggccgctggcgcgaaaacctataagatgtccatggccaatcgcggacagaaccagcccgttcttaacattaccaataaacaggcatttattaccgcccagaaccacggctatgccctggataatacactgccagccggctggaaaccgttgttcgtgaacgtcaatgaccagactaacgagggcatcatgcacgaatccaagcccttcttcgcggtgcagtttcatcccgaagtcactcctggcccaatagataccgaatacttgttcgacagctttttttcactgatcaagaaggggaaggcgacgaccattaccagtgtgttgcctaagcccgctctggtagcctcgagggttgaggtgtctaaggtcctaattctgggctctggtgggttaagcatcggccaggccggggaatttgattatagcggatctcaggccgtgaaggccatgaaagaagagaacgtaaagactgtcctaatgaacccaaatatcgcttccgtacagactaacgaagtcggcctaaagcaggctgatacagtgtatttcttgccaattacaccccagttcgtgacagaagttattaaagctgagcagcccgacggcttaattctggggatggggggccaaactgccttgaactgcggagtcgagctgttcaagagaggagtcctgaaggagtacggcgtgaaggtcttgggcacgtcagtcgaatccattatggcaacagaagaccgtcagctgtttagcgacaaactgaatgagatcaacgaaaaaatagcaccatcttttgcagtggagagtattgaagatgctcttaaagctgcggacacaatcggctatccagtcatgatccgcagtgcctacgcccttggtggtctggggagcgggatatgtccaaacagggagactctaatggatttgtcgactaaagctttcgccatgacaaaccaaatcttagtggaaaaatccgtgaccggatggaaggaaattgaatatgaggtggtccgggacgccgatgacaactgcgtgacggtgtgcaacatggagaatgtcgatgctatgggggtgcataccggggatagtgtggtggtcgcccctgctcaaaccctgtctaacgccgagtttcaaatgctcaggcgaacaagtattaacgtggtgagacatctgggaattgtaggagaatgtaatatccagtttgctctgcaccctacatctatggaatactgcattatcgaagtaaacgcaaggctgagtcgatcttctgcattagcctccaaggccactggctatccactggcctttatcgcagcgaaaatcgccctagggattccccttcctgagatcaagaacgtcgtgtctggaaagacttctgcttgtttcgaaccttccctcgattatatggtgactaagatacctcggtgggacctggatcggttccacggcacaagctcacgcatcggatctagcatgaagtcagtgggtgaggtgatggccatcgggagaacttttgaggagtcttttcagaaggctctgcgaatgtgccacccatccatcgagggattcaccccgcggctgcccatgaataaggaatggccctcaaacctggacttaaggaaggaactaagcgaaccctccagtacgcggatatacgccatagccaaggcgattgatgataacatgtccctggatgaaatagagaagttgacatatatcgataagtggtttctctataagatgcgtgatattctgaacatggagaaaacccttaaaggcctgaacagcgagagcatgactgaagagacgctgaagcgagccaaggagatcggtttctccgataagcagatctccaaatgtctcggcctgacagaagcacagacacgggaacttagattaaaaaagaatattcatccatgggtcaaacagatagacacattagctgcggagtatccctcagttactaattacctctacgtgacttacaacggacaagagcacgacgtgaactttgacgatcacggcatgatggtgctcggatgtggcccttatcacattgggagctcagtggaatttgactggtgtgctgtttcatcaatccgcaccctgcgccaactggggaaaaaaaccgttgtggtgaattgtaatcccgagaccgtgtcaacagattttgacgagtgtgacaaattgtactttgaggagttaagtctggaacggatcctcgacatataccatcaagaggcttgtggagggtgtatcatcagcgtgggaggccagatccccaacaatctagctgtacccctgtataaaaatggggtcaaaatcatgggcacctctcctttgcaaatcgatcgcgcagaggaccgcagcatttttagtgccgtattggacgaactgaaggtggcccaggccccatggaaggcggtcaacacattgaacgaggccctagagtttgctaagagtgtcgactatccatgtctcctgcgtccttcatatgtgttgagcggctccgcaatgaacgtagtgtttagtgaagatgagatgaagaaattcctggaggaggccaccagggtaagccaggagcatccggttgtgctgaccaaatttgtggaaggtgcgcgggaggtggagatggatgcagtgggcaaggatgggcgggtcatttctcacgctatatctgaacacgtggaggacgcaggagttcactccggggatgcaacccttatgctgcccacgcagactatcagtcagggggccatcgaaaaggtgaaagacgccacgcgtaagatcgcaaaagcgtttgcaataagcggcccattcaatgtgcaattcctggtcaaagggaatgacgttctcgtcatcgagtgtaatttgcgagcctcacgctccttcccattcgtttcaaagaccctgggagttgatttcatcgacgtggcaactaaggtaatgatcggcgaaaatgtggacgagaagcacctgccaactctggaccatcctattatccctgctgactatgttgcaataaaggctcctatgttcagctggcccaggttgagagatgctgaccccatattgagatgtgagatggcctcgacaggggaagtggcatgcttcggggaaggcattcacacagcatttcttaaggcaatgttgtcaactggcttcaagatacctcagaaggggatcctgatagggatccaacaaagtttccgaccacgatttctgggggttgctgagcaactccacaatgaaggctttaaattattcgcaaccgaggctacctccgactggctgaatgcaaataatgttccggcaaccccagttgcctggccctctcaagagggtcagaatccgagcctttcgtccatccgaaaactgatccgggacggctccatagacctagtgataaacctacccaataataacaccaagttcgtgcatgataattatgttataaggaggacagccgtggacagtggaattccgttgcttaccaattttcaggtgaccaagctgttcgctgaagctgtccaaaaatcacggaaagtggattctaagagtttattccattacaggcagtatagtgccggcaaggctgca

SEQ ID NO: 8067 - DNA, 4500 bp, Artificial Sequence
  Description of Artificial Sequence: Synthetic coding sequence
atgacacgcattttgacggcttttaaagttgtccggacactcaagacgggatttggtttcactaacgtgactgcacaccaaaagtggaagttttctcgccccggcattcgactgttgtcggtgaaggcacaaactgcacatatcgttcttgaggatggcactaaaatgaaaggatactcttttggacacccatcgtctgttgctggagaagttgtgtttaacacaggcctaggaggttaccccgaggcgattactgaccccgcctacaagggacaaatcttaacaatggctaatcctattattggcaacggaggagctccagacacgactgcacttgatgaacttggactctctaaatacctggaatcaaacggtattaaagttagtggcttacttgtcttggactacagtaaggactataaccattggctcgctacaaagtcccttggacagtggcttcaagaagagaaagttccagccatatatggagtcgataccagaatgcttactaaaattatcagagataaaggaactatgctcggaaaaattgaatttgaaggacaacctgttgattttgtagatccgaacaaacagaaccttatcgcggaggtatctacaaaggatgtaaaagtatatggtaagggaaatccgaccaaggtcgtcgccgttgattgtggcattaagaacaatgtcattcgacttcttgttaaacgtggcgcagaagtgcatctggtgccatggaatcatgacttcactaagatggaatacgatggcatactgattgccggagggccaggtaacccagctttggctgaaccacttatccaaaacgtaagaaaaattttggaatctgatcgtaaagaacccctctttggaatctccactggaaatctaattactgggctagccgcaggcgctaaaacttataagatgtcaatggccaatcgaggacagaatcaaccggttttgaacattactaataagcaggcttttatcactgctcaaaaccatggatatgcgttggacaatacattaccagctggatggaaaccactttttgtgaatgttaatgatcaaactaacgaaggaattatgcacgaatcaaagcctttctttgcagtacagttccatccggaagtcacaccgggcccaattgatactgagtacttattcgacagtttcttctcgctaattaagaaaggtaaggcgacaaccattacgagtgttttgccaaaaccggcgctagtggcgtcacgtgtggaagtttctaaagtccttatactcggatctggcggtttgtccattggacaagcaggagagtttgattacagcggatctcaagcagtaaaggccatgaaggaggaaaatgttaaaacagtgctgatgaacccaaacattgcatctgtgcaaacaaatgaagttggactcaaacaagcagataccgtctattttttaccgatcaccccacaattcgtaacagaggtcatcaaagcagaacaaccagatggactcattctaggaatgggaggccaaacagctttgaattgcggagtggaactcttcaaacgtggagttctaaaagagtacggagtgaaagtattaggaacttcagttgaaagcataatggctactgaagatcgccaactctttagcgacaagcttaatgagatcaatgagaaaatagcaccaagtttcgcagtcgagagcattgaagacgctctgaaagcggctgataccatcgggtatccagtaatgatacgatcagcctatgccttaggaggtctcggaagtggaatatgtccaaaccgtgagacgctaatggatttatctacaaaagcttttgcaatgaccaatcaaattctggtggagaaatcagtcactggttggaaggaaatcgaatacgaagttgtccgtgatgctgatgataattgtgttacagtttgcaacatggaaaacgttgacgcaatgggagttcatacaggtgactctgtcgttgttgctcctgcacagactctgtctaacgcagagttccagatgttgcgacgtacaagcataaatgttgtccgacacttgggcatcgttggagagtgcaatattcagtttgccttgcatcccacgtctatggagtactgcattatagaagttaacgcgcgtctgagccgatctagtgctttagcctccaaagctactggatatccactggccttcattgcagctaaaattgcactaggaattcctctcccggaaattaaaaacgttgtttcaggtaagacatccgcttgtttcgagccctcgctagactacatggttactaagattccgcgttgggatctggacagattccatggaacatcaagtcgtatagggtcatcaatgaaatcagtaggagaagttatggctatcggaagaacttttgaggaatcatttcaaaaagccttgcgtatgtgccatccatcgattgaaggatttactccaaggctgcctatgaacaaagaatggccaagtaatctggatttgagaaaagaacttagcgagccaagcagtacgcgaatctatgctattgccaaagcaatcgatgataatatgagtttggacgaaattgaaaagctaacttatatagataaatggtttttatataagatgagagatatacttaatatggaaaagactcttaaaggattgaatagtgagtcaatgactgaggagacactgaaacgggctaaagaaattggattctccgacaagcaaatttcaaagtgtctgggactcacggaggctcagacaagagaacttcggctaaagaaaaatatacatccatgggtcaagcaaatagacacacttgctgccgaatatccatcagtaacaaattacttgtatgttacctacaatggacaagaacacgatgttaacttcgacgatcatggaatgatggtcctgggttgtggaccataccacatcggatcctctgttgagtttgattggtgtgccgtgagttccattagaacattgcggcaacttggaaaaaaaacagtggtcgttaactgtaatcctgagacagtctcgacagattttgatgagtgtgataagttgtactttgaggaactttctctggaacgaatccttgacatttaccaccaggaagcatgtggagggtgtattatttctgttggtggacaaatcccaaacaatctcgctgttccgttgtataaaaatggagtcaaaataatgggtacctcaccactgcagatcgatcgtgctgaagacagatctatattttcggcagtgctggatgaattgaaagtcgcgcaggccccatggaaggccgtgaatactttgaatgaggcactcgaattcgccaagtctgttgattatccgtgcttgctccgcccatcatatgtcctctcgggatcggctatgaacgttgttttttcagaagatgagatgaaaaagttcttggaagaggcaacaagagtttctcaggagcatccagtcgtcctaacgaaatttgttgaaggtgccagagaagttgaaatggacgctgtcggaaaagatgggcgggttatcagtcatgctatctcggaacatgttgaggatgcgggtgttcattcaggtgacgccacccttatgttgcccactcagacgattagccagggagcgatagaaaaggtcaaagacgccacaaggaaaatagcaaaagctttcgcgatctctgggccattcaatgtccaattcctggtgaaaggcaatgatgtcttggtcattgaatgtaatcttagagcttctcgttcatttccattcgtctctaagactttaggtgtggacttcattgatgttgccactaaagtgatgattggagagaacgtagatgaaaagcatctcccaacactggatcatccgataattcctgcggattacgttgcaatcaaagcaccaatgttttcatggccgagacttcgggatgcagatcctatcttgagatgtgaaatggcatctacaggcgaagtggcatgtttcggtgaaggtattcacaccgcattccttaaggcgatgctttcaacgggatttaagattccgcaaaaaggaattctaattggaattcagcagtcctttcggccgcgtttcctgggtgtggctgagcagctccataacgagggcttcaaactgtttgctaccgaagctacatcagattggttgaatgcgaataatgtaccagccacaccagtggcgtggccgtcacaggagggacaaaatccttccttgtcgagtattcgaaaactcattcgtgacggatcgatagaccttgtcataaatttgccgaataacaatacaaagtttgtccatgataactacgttattcgacgaacagctgtcgattccgggattccgttgttgaccaacttccaggttacaaaattgttcgcagaggctgtgcagaagtccagaaaagtcgactcaaagtctctgttccattatcgccaatactcggcgggaaaggctgct

SEQ ID NO: 8068 - DNA, 4500 bp, Artificial Sequence
  Description of Artificial Sequence: Synthetic coding sequence
atgacgaggatcctcactgcatttaaggtggttaggaccctgaagacgggcttcggatttaccaacgtcacagcacaccagaagtggaagtttagccgccccggcatcaggttgctgtctgtgaaggcgcagaccgctcacattgtgcttgaagatgggaccaagatgaaaggatactcttttgggcacccaagctccgttgcaggagaggtcgtgttcaatactggcttgggtggctatcccgaagctatcaccgaccctgcctataaaggacagatcctgacaatggcaaacccaattattgggaacgggggagcacctgatactactgccttagacgagttagggctgtctaaatacctcgaaagcaacgggattaaggtgagcggtctcttagtcctcgactactccaaggattacaatcactggttggccacaaaaagcttgggacaatggcttcaggaagaaaaagtgcctgccatttacggagtggacacgcgaatgttgaccaagatcatcagagacaagggcaccatgctgggaaaaatcgagtttgaaggccagccggtagacttcgtagatcccaataagcagaacctgattgcagaagtttctacgaaagacgtgaaagtctatgggaagggcaacccgacaaaggtcgtcgctgtagactgcggcataaagaataacgtgatcagactgctggtgaaacgaggggccgaggtgcacctggtcccatggaatcatgacttcactaagatggagtatgatggtattctgattgcaggcggccccggtaaccccgctctggctgagccacttatccagaatgtgcggaagatactggagtcagatcggaaggaacctcttttcggtatatccacaggcaatttaattacgggcctagcggcaggagctaaaacctataaaatgagcatggcgaacaggggtcagaaccagcctgtgcttaatatcaccaataagcaggcattcatcactgcccagaatcacggatatgctctggacaacaccctgccagcaggctggaaaccattgtttgtcaacgtgaacgaccaaactaatgaaggtatcatgcacgagagtaaacctttctttgctgttcagtttcacccagaggttactccaggtccgattgacacagagtacctgttcgattcattcttctcgctcataaagaaaggtaaggccaccactataacctcagtgctcccaaaaccggccctggtggccagccgcgtggaagtctcgaaggttttgatcctcggatccggaggcctcagcattggtcaggctggcgagttcgactactcaggctctcaggctgtgaaggcaatgaaggaagagaacgttaagacagtgttaatgaatcccaatatagcgagcgtacagacaaatgaggtgggtctgaagcaggccgatacagtttacttcttgccaatcactccacagtttgtgaccgaagtgattaaggctgagcagcctgatggactcatactcgggatgggaggccagactgcactgaactgcggcgtcgaactattcaagcggggcgtgctgaaggaatacggggtgaaagtcctgggaacttcagtcgagtcaattatggccaccgaagacaggcagttgttttctgacaagttaaacgagattaatgagaagatcgcaccgtcattcgccgtggagtcaatcgaagacgctcttaaggctgccgataccatcggatacccggttatgatacgttctgcatacgcactgggaggcctgggctctggcatctgccctaaccgcgaaaccctgatggacctgtcaacaaaggcttttgccatgaccaaccagatccttgtcgagaaatcagtcaccggctggaaggaaattgagtatgaggtagtgagagatgctgacgacaactgcgtgaccgtgtgtaacatggaaaatgtcgacgccatgggggttcacaccggtgacagtgtagttgtcgctcctgcgcagactctttcaaacgcagaattccagatgctccgtaggacctctatcaacgtggtacgccatctgggtattgtgggcgaatgtaacattcagttcgctttgcatccaactagcatggagtactgtatcattgaggtgaatgcacgcctgagccgatctagcgcgctcgcctctaaagctaccggatatccactcgcattcattgccgccaaaattgcgttgggcattccactgcctgaaatcaaaaacgtggtttcaggcaagacatccgcttgttttgagcctagtctggactatatggttactaagattccccgctgggacctggaccgctttcacggcaccagtagcaggattggttctagcatgaagtcagtgggcgaagtcatggcaattggcagaaccttcgaggagagtttccagaaagcccttcggatgtgccatccgagcattgagggatttaccccgagattgccaatgaacaaggagtggccaagcaacttagatctgcggaaagaactgtctgaaccgtcctccactcgcatctacgctatcgctaaagctatcgatgataatatgtctctcgatgaaatcgaaaagttaacttatatcgacaagtggtttttatacaaaatgcgcgatatccttaacatggagaaaacgctaaaggggctaaacagtgaaagcatgactgaggagacacttaagcgggctaaggaaataggtttttccgacaaacaaatttctaagtgcctggggctgacagaagcccagactagggaactgaggctgaagaagaacattcatccttgggtcaaacagatagacacccttgccgcggaatatcccagtgtcacaaactatttgtacgtcacctacaacggtcaggagcacgacgttaacttcgatgatcatggcatgatggtgcttggctgtggaccttatcatatcggatcctctgtggagttcgattggtgcgccgtttccagcattaggactttgcggcagttgggaaagaagactgtggtggtgaactgtaatccagaaacagtgagcaccgactttgatgagtgtgataaactgtattttgaagagctcagcctggagcgtatcctggacatctatcatcaggaagcctgcggaggctgcattatcagcgtgggcggacaaatccccaataatctcgctgttcctttgtataaaaacggtgtgaaaatcatggggacctctcccctgcaaattgacagggctgaggacaggagcatctttagcgctgtgctagatgagctcaaggtggcccaggctccatggaaggctgttaatactcttaacgaagctctggaatttgccaagagcgtcgactatccttgtctgctaaggcccagctacgtactctccggatccgcaatgaatgtggtcttttctgaggacgagatgaaaaagttcttggaggaagctacccgggtgtcgcaggagcaccccgtggtgctaacgaagtttgtagaaggagcaagggaagttgaaatggacgctgtcggcaaggatgggcgcgtgatcagccacgcgatctctgagcatgtggaagatgcgggcgtgcactcaggtgacgctaccttgatgctcccaacccagaccatcagccagggcgctatcgagaaagtgaaagatgctacaagaaagatcgcaaaagcgtttgccatttcagggccattcaacgtccagtttcttgttaagggcaacgacgttctggtgattgaatgcaatctgcgcgcttcaagaagcttccccttcgtgagcaagaccttgggagtggatttcatcgatgtggccacaaaggtaatgatcggagaaaacgtggacgagaagcatctgcctaccttggatcacccgatcattccagctgattacgtggctataaaggccccaatgttcagttggccccggttaagggacgccgaccctatcttgaggtgcgaaatggcgtctacaggggaggtcgcatgttttggggaaggaattcatacagccttcttgaaggccatgctgtcaacaggatttaagatcccccagaaaggaatactcattggcattcagcagagctttcggcctcgcttcctgggggtcgcggaacagctgcacaatgagggtttcaagctttttgctaccgaagcaacaagtgactggctgaatgccaacaacgtgcccgccacgcccgtggcctggcccagccaggaaggacagaatcccagcctgagttctatcagaaaactgattagagatggctcgattgatctcgtgattaacctgcctaataataataccaagtttgtgcatgataactacgtcatcagaaggacggccgtggatagtggaattccgctcttgactaacttccaagtcaccaagctgttcgccgaggccgtccagaaaagcaggaaagttgattccaaatccctgttccactacagacagtatagcgctgggaaggccgct

SEQ ID NO: 8069 - DNA, 4500 bp, Artificial Sequence
  Description of Artificial Sequence: Synthetic coding sequence
atgactagaatcctgaccgccttcaaggtggtccgtactctcaagacggggttcggattcacgaacgtcactgcacaccagaagtggaaattcagccgcccggggatcaggctgctctctgtcaaggcccagactgcgcacatcgtgctcgaagatggaactaagatgaaaggatactctttcggacatccctcatcggtggcgggggaggtggtgtttaacaccggcctcgggggctatcctgaagccatcactgatccggcgtacaagggacaaatcctgactatggcaaaccccatcatcggaaatggtggagccccagacaccaccgcattggatgagctcggactttctaagtacctggagtcaaacggaattaaggtatccggcctgttggtgcttgactactccaaggattacaaccattggctggccaccaaatcgctgggacagtggttgcaggaagaaaaagtgccggcaatctacggcgttgatacgcgcatgctcactaagattattcgcgataaaggaactatgctcgggaagatagagtttgagggccagccagtcgacttcgttgatccaaacaagcagaatctcatcgcagaagtgtcaaccaaggacgtcaaggtgtatggcaagggtaatccaactaaagtggtcgctgttgactgtggtatcaagaataacgtgatcagacttctggtcaagaggggcgcggaagtacacttggtgccttggaatcacgacttcaccaagatggagtacgatggaatcttgatcgctggtggaccaggaaacccagcgctggcagaacctctgatccagaatgttcgcaaaatcctcgaaagcgatcggaaggagccccttttcggtatctccacgggaaatctgatcactggacttgcagcaggagctaagacttacaagatgtcgatggctaaccgaggccagaatcagccggtcttgaatatcactaataagcaagcgttcattaccgcacaaaatcatgggtacgctctggacaatacgctgcctgcgggatggaaaccactcttcgtgaacgtgaacgaccagaccaacgaaggaatcatgcacgaatcaaagccgtttttcgcagtgcagttccacccggaggtgaccccgggaccgatcgacaccgaataccttttcgactcgtttttcagcctcatcaagaagggtaaagccaccaccatcacgagtgtgctgccgaagccggcgctcgtggcctcacgcgtggaagtgtccaaagtgcttatcctgggaagtggcggactcagcattggacaagccggcgaattcgattactcggggtcccaagcggtgaaggcgatgaaagaggaaaacgtgaaaaccgtgctgatgaaccccaatattgcctcggtccagaccaatgaggtggggctgaagcaagcggacaccgtgtacttcttgcccatcactccgcaattcgtgaccgaggtgatcaaggccgaacaacctgatggtcttatcctcggaatgggaggacagacggcactgaattgtggagtagagctgttcaagcgtggcgtcctcaaggaatacggagtcaaagtgctgggcacgtccgtggaatcgatcatggctaccgaggaccggcaactgttttccgacaaactgaacgaaatcaacgagaaaatcgcaccgtccttcgccgtcgagtcgatagaagatgctctgaaggccgccgataccatcggatacccagtgatgatcagatcggcatacgcactcggaggactcggaagtggaatctgcccgaaccgcgaaacgctgatggacctgtcaactaaggcgtttgccatgaccaaccagatcctcgtggagaaatcggtcactggctggaaggaaattgagtatgaggtggtcagagatgcagatgataactgcgtgaccgtgtgcaatatggagaacgtggatgccatgggtgtgcatactggagacagcgtagttgttgccccggctcagaccctgtctaacgcagagttccaaatgcttcgcaggacttcaatcaacgtcgtgcgccacctcggtattgtgggggaatgtaatatccaattcgccctgcaccctacttccatggagtactgtatcatcgaggtgaatgcccgcctctcaaggtcatccgctctggcatcgaaggcaacgggatacccgctggcgttcatcgccgccaagattgcgctcggaattccgcttccagagatcaagaatgtagtctccggaaaaacgagcgcctgctttgagccttcgttggactacatggtcactaagattccgcgatgggaccttgacagatttcatggaacttccagccgcatcggtagcagcatgaagtcagtcggcgaagtgatggccatcggacgcacctttgaagagtcctttcagaaagccctgcggatgtgccacccgtccatcgaggggttcaccccccgcctcccaatgaacaaggaatggccctcgaacctcgacctgagaaaagaactgtcagaaccaagctcaacccgaatctacgctatcgcaaaggccatcgacgacaacatgtcactcgatgagatcgaaaagctgacttacatcgacaaatggtttctctacaagatgcgggacatcctcaacatggaaaagactctcaagggcttgaactccgagagcatgactgaagagactcttaagcgggccaaggaaatcggattcagcgacaagcagatcagcaagtgtctcgggctgaccgaagcgcagacccgggaactccggctgaagaaaaacatccatccctgggtgaagcagatcgatacccttgcagccgagtatccctccgtcacgaactacttgtacgtgacctacaatggacaagagcatgacgtgaatttcgatgatcatggaatgatggtgctgggctgcggtccgtaccacataggttcctcggtggagttcgattggtgtgccgtgagctcgatacggactttgcggcagctcggaaaaaagacggtggtggttaattgcaaccctgaaactgtcagcaccgactttgacgaatgcgacaagctgtacttcgaggagctttccctggaacggatcctggacatttaccaccaggaagcgtgcggagggtgcatcatcagtgtgggcgggcagatcccgaacaatctggccgtcccgctctacaagaacggcgtgaaaatcatggggactagcccactccaaattgatcgggcggaagataggtccatcttttccgccgtgctggacgaattgaaagttgcgcaggcgccctggaaggcagttaacaccttgaacgaagcactcgaattcgcaaagagcgtggactacccgtgcctgctgcgcccatcctatgtgctctcaggctcggcaatgaatgtagtgttctcggaggacgagatgaagaaattcctggaagaggccacccgagtgtcccaagagcatcctgtggtgctgactaagttcgtcgaaggggcccgcgaggtcgagatggacgccgtgggaaaggatggtagagtgatcagccacgcaatctcggaacacgtggaggatgccggtgtccactcgggcgatgcaaccctgatgctgcctacccagaccatctcgcagggagcgattgaaaaggtcaaagacgccaccagaaagattgccaaggcgttcgctatatcgggccctttcaacgtccagtttctggtcaagggaaacgatgtcctcgtcatcgaatgcaatctgcgggcgtcacggtcattcccgttcgtctccaagactctgggagtggacttcatcgatgtggccaccaaggtgatgattggggaaaacgtggacgagaagcacctcccgacgctggaccacccgattatccccgccgattacgtggcaatcaaagcccctatgttttcctggccgaggctgagagacgcggacccaatcctgcgctgcgagatggcgagcactggagaagtggcctgtttcggggaaggcatccataccgcgttcctcaaggcgatgctttcgactggattcaagatcccacaaaaaggaatcctgatcggaatccagcagtcttttcggccacggttcctgggcgtggccgaacaactgcataacgagggcttcaaactgtttgcgaccgaagctacttcggactggctgaacgctaataacgtccctgctaccccggtggcttggccgagtcaagagggccagaatccttcgttgtcctcaattcgcaaactgattagggacggtagcattgacctggtcatcaacctgccgaacaataacacgaaattcgtgcacgacaactacgtgatccgccggactgccgttgactcgggcatccccctgttgaccaacttccaagtgaccaaattgttcgctgaagccgtccagaaaagcagaaaagttgacagcaagtcattgttccactatagacaatattccgccggcaaggccgct

SEQ ID NO: 8070 - DNA, 4500 bp, Artificial Sequence
  Description of Artificial Sequence: Synthetic coding sequence
atgacacgcatacttacagctttcaaagtcgtacgcacattaaaaactgggttcgggttcacaaacgtgactgcacaccagaaatggaaattttcccggcctgggatacgcctcctcagtgtgaaagctcagactgctcatatagtgctcgaagatggaactaagatgaaaggatattcgtttggacacccttcttccgtcgccggggaggtagtgtttaacacagggctcggggggtatcctgaagccattacagatcctgcctataaagggcagatcctcacaatggctaatcccataatcggaaatggaggggccccagatacaacagccttagacgaactaggattgtctaagtatctggaatctaatggaattaaagtgtcaggactccttgttttagactactctaaagactataaccattggctcgccacaaaatctttagggcagtggctccaggaagaaaaggtccccgctatatatggagttgatactcgcatgctcacaaagataatccgggataaagggacgatgctagggaaaatcgagttcgaagggcagcccgtagatttcgtggatcctaataaacagaacctcatcgctgaagtgtccacaaaagatgtcaaggtgtatgggaaggggaatccaactaaggtggtggcagtggattgcggaattaaaaataatgtaataaggctgttggtgaaacggggggccgaagtccaccttgtgccttggaatcacgatttcactaaaatggaatatgatggaatactgatcgccgggggacctgggaatccagcccttgcagaacccttgatccagaatgtgaggaagatactagagtctgatcgcaaggagcctcttttcgggatatctacagggaatctcatcactggactcgctgcaggggccaaaacatacaaaatgtccatggccaaccggggacagaaccagcctgtgcttaacataacaaacaaacaggccttcataacagcccagaaccatggatacgctctcgataatactctgcctgctgggtggaaaccactcttcgttaatgtgaatgatcaaacaaacgagggaatcatgcacgagtcaaagcccttttttgcggttcagttccaccccgaagtcacaccaggaccaatagatacagaatatctgtttgactccttcttttctctgataaaaaagggaaaagccactacaattacaagtgttctgcctaaaccagctcttgtggcttctagggtcgaagtgtctaaagtgcttatacttggatctggagggcttagtatcgggcaggccggggagtttgactatagtggatcccaggcagtgaaagccatgaaagaagagaacgtcaagacagtcctcatgaaccctaacatcgcctccgttcagacaaatgaagttggattaaaacaggctgatactgtgtacttcttacctatcacaccccagttcgtgactgaggtgataaaagctgaacagcccgatgggctcatactggggatgggggggcagacagctctgaactgtggagtcgaactgttcaagagaggagttctcaaagaatatggggttaaagttctgggaacttctgttgaatctatcatggctactgaagataggcagcttttttctgataaactcaacgaaattaatgaaaaaattgctccttcctttgctgtcgagtccatagaagatgccttgaaggccgcagatacaattggataccctgtgatgataaggtccgcatacgcactggggggacttgggtcaggaatctgtcctaatagggagactttaatggatctctctacaaaagctttcgccatgactaaccagatattagtggaaaaatctgtcactggatggaaagaaatcgagtacgaagtcgtgcgcgatgcagatgataactgtgtgacagtgtgtaatatggagaatgtcgatgctatgggagtccatacaggagattctgtggtggtagcaccagctcagactttgtctaacgcggaatttcagatgttgagaaggacttccatcaatgtggtacgacatttggggatcgtaggagaatgtaatattcagtttgcattgcatcctacttctatggaatactgtattatcgaagtgaatgctcgcctctcccgtagtagtgcgctagcttctaaagccactggatatcctctcgcattcatcgctgctaaaatagcactcgggatacccctgcctgaaatcaaaaacgtggtgtctggaaaaacgtcggcttgttttgaaccgtcattagactacatggtaacaaaaatccctcggtgggatctggataggttccatgggacaagttcacggatcgggagttctatgaaatcggtgggggaagtaatggccattgggaggacatttgaagagtctttccagaaggcccttaggatgtgccacccctctatcgaagggttcactcctaggctccccatgaataaagagtggccttctaacctcgatctcaggaaagaactctccgaaccatccagtactcgaatttatgccatcgccaaagccattgatgataacatgtctctagatgaaatagagaaacttacttatatagataaatggtttctatataaaatgcgggatatccttaatatggaaaaaacattaaaaggactgaactccgaatctatgacagaagaaacacttaagcgagccaaagaaataggattctccgataaacagatctccaaatgcctcgggctgacggaagctcagacaagggagttgcggcttaaaaaaaatatacatccttgggtaaaacagatcgatacacttgcggccgagtacccatctgtcacaaattacctttatgtcacttacaatggacaggaacatgacgtcaactttgatgatcacgggatgatggtactgggatgtgggccatatcatatcggaagttctgttgagtttgattggtgtgctgtcagttccatacgcactctcaggcagctcgggaaaaaaactgttgttgtcaattgtaaccctgaaactgtaagtactgatttcgatgaatgtgataaactctacttcgaagaactgagtcttgaaaggatccttgatatttaccatcaggaggcctgtggaggatgtatcataagtgttggagggcagatccccaacaacttagctgtcccattatataaaaacggggtcaaaatcatggggacttcccccctgcagatcgatagggcagaggatagaagtatcttttctgctgtcttagatgagctgaaagtcgcacaggcaccttggaaagccgtgaacacgttgaatgaagctctggagttcgcaaaatctgttgattatccctgtctccttagaccctcttatgttttgagtgggtcagcaatgaatgtcgtattctccgaagatgaaatgaaaaaatttctggaagaagccacgagggtctcccaggaacatccagtggtgctcactaagttcgtcgaaggggcccgagaagttgaaatggatgccgtgggaaaagatggaagagtgatttctcatgcaataagtgaacatgtggaagacgcaggggtacatagtggggatgccactctcatgctccctactcagactatctcacagggagctatcgaaaaagttaaagatgctactagaaagatagccaaagcatttgcaattagtggaccttttaatgttcagttcctcgtcaagggaaatgatgtacttgtgattgaatgtaacttgagggcttccagatcatttcccttcgtatctaaaactttaggggtggacttcatcgatgtggccacaaaagtcatgatcggagaaaacgttgatgaaaaacatctccctactcttgatcaccctattatacccgcagattacgttgctatcaaagcacctatgttttcctggcctcggttgcgggacgctgatcccatcctgaggtgcgaaatggcttccactggagaggtagcatgtttcggagaaggaattcacactgccttcttgaaagccatgctttcaacaggattcaaaataccacagaaagggatattaatcgggatacagcagagttttagacccaggttccttggagtggcagaacagctccataatgaagggttcaaacttttcgccactgaagccacatctgactggttgaacgccaataacgtgcctgcaactcctgtggcctggccttcccaggaagggcaaaatccctccctctcttctatccgcaaattaatcagagacggatctatagatctggttatcaacctccctaacaataacacaaaattcgtgcacgataactatgtgatccggaggacagctgtggattccggaatacccctcctgactaacttccaggttacaaaactatttgcagaagccgtgcagaaaagtcggaaagttgatagtaaatctcttttccactatcggcagtactctgcgggaaaagccgcc

SEQ ID NO: 8071 - DNA, 4500 bp, Artificial Sequence
  Description of Artificial Sequence: Synthetic coding sequence
atgacaaggattctcacggccttcaaggtggtccggactctcaagacaggcttcggcttcaccaacgtcaccgctcaccagaaatggaaattttccaggcctgggattaggcttttgagcgttaaggcccagacagcccatatcgtgctggaggacggcactaagatgaagggatactctttcggacaccccagcagcgtggccggagaggtagtttttaacaccggcctgggaggctaccctgaagctattaccgatccagcgtataaaggccagattctgacaatggcaaatcctatcataggaaatggcggtgctccagatacaactgcccttgatgagctcggcctttccaagtacctggagtctaatggtatcaaggtgagtggtctcttggtccttgattactcaaaagattacaatcactggctcgccaccaaatctctgggtcagtggttgcaggaggaaaaagtgcccgcaatttatggagtcgacacaaggatgttgacaaagattatcagagacaagggtactatgttggggaagattgagtttgagggccaacccgtggattttgttgaccctaacaagcagaatctgattgcagaggtatcaaccaaagacgttaaggtgtacggaaagggcaatcctaccaaagtggtggcggtggattgcggcatcaaaaacaatgtgattaggctgctggtcaaacggggagccgaagtgcacctcgtcccttggaatcatgacttcaccaaaatggagtatgacggtatccttattgccggcgggcctggtaatccagcattggccgagcccctgatccaaaatgtgcggaagattctggaatccgaccgcaaggagccactcttcggtattagcaccggaaatcttattacaggactcgccgccggcgctaagacttataaaatgtccatggctaatcggggacaaaatcagcccgtgctgaatattactaataagcaggcgtttatcactgcacaaaaccacggctacgctttggacaatactctgccagctgggtggaagcctctgtttgtgaatgtaaatgaccaaacaaacgagggcatcatgcatgaaagcaaaccattttttgccgtgcagttccacccggaggttacaccagggcccattgacaccgagtacttgttcgattcctttttcagcctgataaagaagggaaaggccactaccatcaccagtgtgctgcctaaaccggctctcgtggcatctcgagtggaggtgtccaaagtattgatcctgggatccgggggtctcagcataggccaagctggagagttcgactacagcggctcacaggcagtcaaggcgatgaaagaagaaaacgtcaagaccgtcctgatgaaccctaacattgccagcgtgcagacaaacgaagtgggcctcaaacaggccgacacagtgtatttcctgcccattacacctcagttcgtgacggaagttataaaagcagagcaacccgatggtttgatactgggaatgggtgggcagaccgcacttaattgtggcgtggagctctttaagcggggagtgttgaaggaatatggagtgaaggttcttggtacctctgtggagagcataatggccactgaagacagacagctgttttctgacaagctgaacgagattaatgagaagatagctccttctttcgctgtggaatcaatcgaagacgccctgaaggctgcagacaccataggataccccgtaatgattcgatccgcctacgctctgggcgggctgggatctggaatctgtccaaatagggagactctgatggacttgtccacgaaggctttcgctatgacgaaccagattttggtagagaaaagcgtcactgggtggaaggagatcgagtatgaggtggtgcgggatgcggacgacaactgcgtgacagtctgcaacatggagaatgtggacgccatgggcgtccacaccggcgactctgtggtggtggcaccagcccagacactgagcaatgctgaatttcagatgctgagacgcacttccatcaacgtggtccggcatctgggtattgtcggagagtgcaatatccagtttgcactccatcccacgagcatggaatactgtataatcgaggtgaatgctagactgtcacgatcttctgcgctggcgtccaaggctacaggctacccattggcattcattgctgccaagattgcacttgggatccccctccccgagatcaagaacgtggtgtctgggaagacttctgcctgcttcgagccttctctcgactacatggtcactaaaatacctagatgggacctcgatcggttccacggtacctccagccggatcggttcaagcatgaaaagtgtgggtgaagtcatggccatcggcagaaccttcgaggaatcctttcagaaggccctgaggatgtgtcaccccagtatcgagggatttacacccagactgcccatgaataaggaatggcccagcaaccttgatctgagaaaggagctttccgaaccaagcagcacccggatatatgccatagccaaggccattgatgacaacatgtctctggatgaaattgagaaattgacttatattgacaagtggttcttgtataagatgagagacattctcaacatggaaaaaaccctgaaggggctcaacagcgagagcatgacagaggagaccttgaagagagccaaggagatagggttcagtgacaagcagataagtaaatgccttggtttgaccgaggcccagacacgggagctgaggttgaagaagaatattcacccgtgggtgaaacagatagataccctggcagccgagtatccctccgtcaccaattacctttacgtgacatataatggtcaggaacatgatgtcaatttcgatgaccacggcatgatggtgctgggctgcggtccttaccacatcggctcatccgtcgagttcgactggtgtgctgtcagctccattagaaccctgaggcagctgggaaagaagaccgtggtagtaaactgcaaccctgagacagtgagcaccgactttgacgagtgcgacaagctgtatttcgaggagctttccctggaacggatcctggacatctaccatcaagaggcctgcggaggttgtatcatttccgtggggggccaaatcccaaataatctcgcagtccctctgtacaagaatggggtaaaaattatgggaacctctcctctccagattgatagggccgaggatcggagcatcttctcagcagtgctggacgagctgaaggtggcgcaggccccctggaaggccgttaacacgttgaacgaagccctcgaattcgctaagtccgtggattatccctgtttgctgcgccctagttatgtactgagtggatctgccatgaacgtggtattttccgaggacgagatgaagaagttcctggaagaggcaacgagagttagtcaggaacacccagtcgtgctgacaaaatttgtcgaaggtgcaagagaagtggagatggacgctgtgggaaaggacggtagagtgattagtcacgcgatctcagaacacgtagaggacgcaggagtgcactcaggcgacgcgactctgatgctgccaacacagactatcagccagggagccatcgagaaagtgaaggacgcgactagaaaaatcgcaaaagcattcgctatctcaggcccgtttaacgtacagttcctggttaaagggaacgatgtactggtaattgagtgcaatctgcgcgccagtcgcagcttcccatttgtgtctaagacactcggggtggacttcatcgatgtagcaaccaaggtcatgatcggggagaacgtggacgagaagcacctcccaaccctcgatcatccgataatacctgcggactatgtggctatcaaagcccctatgttctcttggcccagactccgggacgccgacccaatcctcagatgtgaaatggccagtaccggagaggttgcctgctttggagaaggtattcacaccgcctttctgaaggcaatgctctctaccggattcaagatcccacagaaagggatcctgattggtatccagcagagcttcaggcctaggttcctgggagttgcagagcaactgcacaacgaagggttcaagctcttcgcgacagaagccacatccgattggttgaacgccaacaatgtccccgccacccctgtagcctggccttcccaggaggggcaaaatccatcactgtcttctatccggaagcttatcagagacggctccattgacttggtcatcaatttgcccaataacaacactaagtttgtccacgacaattacgttattaggcgaacagcggtagactcaggaatccctctgctgaccaatttccaggttaccaagctgtttgcagaggccgtacaaaaaagtcgaaaagtggattctaaaagtcttttccactacagacagtattctgctggcaaggcagcc

SEQ ID NO: 8072 - DNA, 4500 bp, Artificial Sequence
  Description of Artificial Sequence: Synthetic coding sequence
atgactcgcattttgaccgctttcaaggtggtgcgtacgctgaagactggatttggatttacaaacgtgacggctcatcagaagtggaagtttagccggccgggcatccgattgttgtcagttaaagcccagactgcacacatcgtccttgaagatggtaccaagatgaagggatacagttttggacaccctagcagcgtagccggagaggtcgttttcaatactggcttaggggggtaccccgaagcgatcacagacccagcttataaggggcagatacttactatggctaatcccataatcggcaacggcggggccccggatactaccgctttggacgaactgggcttatcgaagtacctggagtccaacgggataaaggtcagtggacttctggtgctggattactcaaaagattacaatcactggctcgcaacaaagagtctaggtcagtggctgcaggaggaaaaagtacctgccatatacggggtggatactagaatgctgacaaaaatcatacgggataagggtaccatgctcggaaagatcgaatttgaggggcagccagtcgacttcgtggatcccaataagcaaaacctgatcgcagaggtgagcacaaaagatgtcaaggtgtacgggaagggcaatcccacaaaggtggtggctgtagactgtggaattaagaataatgtcattcggctgctggtcaaacggggcgctgaggttcacttggtgccctggaatcacgattttacaaaaatggagtacgatgggatcctgattgccggcgggcctggaaatcccgctctcgccgagcctctgatacagaatgtgcggaaaatattggagagtgacaggaaggagcccttgttcgggataagcacaggtaacctgatcacagggctggcagctggggctaaaacttataaaatgtctatggccaaccggggacaaaatcagcctgtccttaatatcacaaataagcaagccttcattaccgcgcagaaccacggatatgcactggacaacacattacctgccgggtggaaacctcttttcgtcaacgtgaacgatcagaccaatgaaggcattatgcatgaaagtaaacctttttttgctgtccagttccaccctgaagtgacgccgggtcccatcgatacagagtacctgttcgactctttcttctctctgatcaaaaagggaaaggctacgacaatcacttcagttcttcccaaacccgctctcgttgcctcccgcgtggaagtgagcaaggtgcttattctcggatcggggggcctctcaataggtcaggctggcgaatttgattactctggcagtcaggcagtaaaggccatgaaagaagaaaatgttaaaaccgtactaatgaaccccaatatcgcctccgtgcagaccaatgaagtcggtctgaagcaagctgatacggtttatttcttgccgatcacacctcagtttgtcacagaggtgatcaaggccgagcagcccgatggcctcatcttagggatgggaggtcagactgctctaaattgcggcgtcgagctgttcaagcggggtgtgctgaaggagtacggagtgaaggtgcttgggaccagcgtggagagcataatggctactgaagatcgccagcttttcagcgataagctgaacgagataaacgaaaagattgcaccttcattcgctgttgagagtatcgaagacgccctcaaggccgccgatacaataggctaccctgtgatgatacgcagtgcctatgccctggggggcctgggatctggcatctgcccaaacagagagaccctgatggatctgagtacgaaagcattcgctatgacaaatcagatcctcgtagagaaaagtgtgacaggctggaaagagatcgagtatgaagtagtccgggacgcagacgataattgcgttactgtttgtaacatggagaacgtggatgccatgggagtccatacgggagactccgttgtcgttgcacctgcacagaccctgtcaaatgcagaatttcagatgctgaggcgcacttccataaatgtggtgagacacttgggtatcgtcggagaatgcaacattcagttcgctttacatcccacaagcatggagtattgtatcatcgaagtcaatgcaaggctgagccgatcttcagcactggcttcgaaggccaccggatatcctcttgcctttattgctgcaaaaatagccttgggcatcccactccccgagattaagaacgtggtgtcaggaaagacatcagcgtgcttcgagccaagcctcgattacatggtcaccaaaatcccccgatgggacctggaccgctttcacggcacctcctcccgaatagggtcttcaatgaagtccgttggagaggtcatggctattggccgcacctttgaagaaagttttcagaaagcactgagaatgtgccatccctcaatcgagggtttcaccccgagattgcccatgaacaaggaatggccttccaacctcgatcttcgtaaagaactctccgagccatcttccacacgcatatatgccatcgcgaaggctatcgacgacaatatgtctttggacgagattgagaagctgacgtacatcgacaaatggtttctctataaaatgcgtgacatactcaacatggagaagacccttaagggtctgaattctgagtcaatgacggaggagacgttgaaaagagccaaagaaattggattctcagataagcagatttccaagtgtctgggcctgaccgaggcgcagacacgcgagctccgcctcaagaaaaacattcatccctgggttaaacagattgatactttggccgctgaatatcctagcgtgaccaactacttgtatgtgacctacaatggacaggagcacgacgtgaatttcgacgaccacggcatgatggttctcggatgcggtccgtatcatatcgggtcctcagtagagttcgattggtgcgccgtcagctccatcaggacactgcgccagcttggaaagaagactgtcgtagtgaactgcaacccggagaccgtgtctacagatttcgacgagtgcgacaagctgtattttgaggagctgagcttggagaggatccttgacatctaccaccaagaagcatgtgggggttgtatcatctccgtgggagggcaaatccctaataatctggccgtcccactgtataagaacggggtaaagatcatgggtactagccctcttcagattgatcgggctgaagaccgaagcattttttccgctgtgctcgatgagctgaaggtggctcaagccccctggaaggcagtgaacaccctcaacgaagctctcgagtttgctaaatccgtcgactatccatgcttactgaggccgtcgtacgtactttccggttcagccatgaacgttgttttcagcgaggacgaaatgaagaagttcctcgaggaggctacaagggtgtcccaggaacacccagtagttctcactaagttcgtcgaaggagccagagaagtggagatggatgccgtgggcaaagatgggagggtgatctcccatgctatttcggagcatgttgaggatgccggcgtccacagcggtgatgccaccctcatgctacctacacaaaccatctcacaaggggcaatcgagaaggtaaaggacgctactagaaagattgctaaagcatttgccatttccgggccctttaatgtccagttcttagtcaaagggaatgatgtgctggtgatcgagtgcaatttgcgggcatcaagatcctttcctttcgtctccaaaacattgggcgtggacttcatcgatgtagccacaaaggttatgattggagagaatgtggatgaaaaacacctgccgacattggaccatccgatcattccagccgattatgtagccattaaggcccctatgttcagttggcccaggctccgggatgctgaccccatcttgaggtgcgagatggcctcgacgggtgaggttgcttgcttcggtgaaggcatccacaccgcattcctgaaggcaatgctgtcaacaggtttcaaaataccacagaagggcatcttgattggtattcagcagtccttccggccgcgcttcctgggagtagccgaacaactccataatgagggctttaaactgtttgctaccgaagccacctccgactggttgaacgccaataatgtgcctgcgactccggtagcctggccaagccaggaaggacaaaatcctagcctcagcagtattaggaagttaatccgcgatggaagcatcgatctagttattaacctgcctaataacaatacaaaattcgtgcacgataactatgttatcaggaggactgcagttgattccgggatccccttgttgaccaacttccaggtgaccaagctgtttgcagaggccgtgcagaaatcaaggaaggttgattccaagtccttattccactataggcaatattcggcgggcaaggctgcc

SEQ ID NO: 8073 - DNA, 4500 bp, Artificial Sequence
  Description of Artificial Sequence: Synthetic coding sequence
atgactaggatccttactgccttcaaggtcgtcagaaccctgaaaactggatttggatttaccaatgttactgcccaccagaaatggaagttcagccgccctggcatacgactgctgtctgtgaaggcacagaccgcgcacatcgtgcttgaggacgggactaagatgaagggctactcttttggacatccgtcgtcagtggctggcgaagtcgtctttaacactggtctgggcggataccctgaagcgattaccgacccggcatacaaaggacaaatcctgaccatggcgaaccctatcatcgggaatggaggagctcctgacaccactgctctcgatgagcttggattgtcgaagtacctggagtctaacggcattaaggtgtccggactcctggttctggactactcgaaggactacaatcactggctggccaccaaatcactgggacaatggctccaggaagaaaaggtgcccgcgatctacggagtcgacacccgcatgctcactaagattatccgcgacaaaggtactatgctcggtaagatcgaattcgagggacagccggtcgacttcgtggatccgaacaagcagaacctgatcgcggaagtgtcaactaaggacgttaaggtgtacgggaagggtaatccaactaaggtggttgccgtggactgtggcatcaagaacaacgtcatcaggctgctcgtcaaacgcggcgccgaagtgcacctcgtcccgtggaaccatgattttaccaagatggagtacgacggaatcctcatcgcgggcggaccgggcaatccagccctggccgaaccactgatccaaaacgtaagaaagatccttgagtcggatcgcaaggagccacttttcggcatctccaccgggaacctcattaccggcctggctgctggcgccaagacgtacaagatgtcgatggccaatagaggacagaaccagccggtgctgaatatcactaataagcaagcatttatcactgcccagaatcatggatacgcactggacaacaccctcccagcaggatggaagcctctcttcgtaaacgtgaacgaccaaaccaatgaaggaattatgcacgaatcgaagccgttcttcgcggtgcaattccaccctgaagtgaccccggggcctatcgatacggaatacttgttcgacagcttcttctcgctgatcaagaagggaaaagccaccaccatcacctcggtgctgcctaaaccggccttggtggcttcaagagtcgaagtcagcaaggtcctcatccttggaagcgggggactttcaatcggacaggcaggggagtttgactactcgggatcgcaagccgtgaaggcaatgaaggaggaaaacgtaaaaaccgtcctgatgaacccgaatatcgcttcggtgcaaactaacgaagtaggattgaaacaggcggacacggtgtatttcctgccgatcaccccacagttcgtaactgaagtgatcaaggcagagcagcctgacggactcatcctcggcatgggtgggcaaaccgccctcaactgcggagtggagctcttcaagcggggggtgttgaaggagtacggggtcaaggtgctgggaactagcgtggaatcgattatggccaccgaagatcggcagctcttttccgacaagttgaacgaaatcaacgaaaagattgcaccatcattcgctgtggagtctatcgaagatgctctcaaggcagcggacacgatcggatatccggtgatgattcgcagcgcttacgccctgggaggactgggatcaggcatctgccccaatcgcgagactctgatggacctgtctaccaaagcgttcgcgatgacgaaccagatcttggtagagaagtcggtgacgggatggaaggagatcgaatacgaggtggtgcgcgacgcagatgataattgcgttactgtctgtaatatggaaaacgtggacgccatgggggttcatactggggattccgtggtcgtcgctccagcgcaaaccctgagtaacgctgagttccaaatgctccgccggacctccatcaacgtcgtccggcacctcggcatagtgggagaatgcaacatccaatttgccctgcacccgactagcatggaatattgcatcatcgaggtcaacgcgagactctcccggtcatccgcgctcgcctccaaggccaccggataccctttggctttcatcgctgccaaaatagctctgggcattccgctgcccgaaatcaagaacgtggtgtccggcaaaacctccgcatgcttcgaaccttccctggattacatggtcaccaaaatcccacggtgggacctggacagattccacggcacttcctcacgcatcggatcctcgatgaaatcagtgggagaggtcatggcgataggtaggactttcgaggaatcctttcagaaggcgctgcggatgtgccacccgagcatcgaaggatttacgccgcgtctcccaatgaataaagaatggcctagcaatctggacctgcggaaagagctgagcgaacccagctcgacgcgcatctacgctatcgccaaggccatcgacgacaacatgtccctcgatgagatcgagaaactgacctacattgacaagtggttcctttacaagatgcgggatattctcaacatggaaaagactctgaaaggacttaactccgaaagcatgactgaggagactctgaagcgggcgaaggaaatcggattttcagataagcagatcagcaagtgcctgggactcaccgaggcgcagacgcgcgagctgaggctgaagaaaaacatacacccgtgggtgaaacagattgacacccttgccgccgaatacccgtcggtgactaactacctgtacgtgacctataatggtcaggaacacgatgtcaacttcgatgaccatggcatgatggttctcggatgtggaccgtaccatatcggaagctcagtcgaatttgattggtgcgccgtgagctccatccggactctcaggcagctggggaagaaaaccgttgttgtcaactgtaatccggaaaccgtctccaccgacttcgatgagtgcgataagctgtacttcgaggagctcagcctcgagagaatcctggacatctaccatcaggaggcctgtggaggctgcatcatctccgtaggaggtcagatccccaacaacctggccgtgccattgtacaagaatggagtcaagattatggggacttcgccgctccagatcgacagggccgaagatcgctccatctttagtgcggtgcttgacgaactgaaggtcgcacaagcaccgtggaaagcggtgaacaccctcaatgaagcactggaattcgccaaatcggtggactacccgtgcttgttgcgaccgtcttacgtcctgtctgggtccgcaatgaatgtggtgttcagcgaggacgagatgaaaaagtttctggaagaagccacccgggtttcgcaggagcatccagtggtcctgactaaattcgtggagggagcaagagaggtggagatggacgctgtgggaaaagacgggagagtgatcagccacgccattagcgagcatgtcgaagatgctggcgtgcactcgggcgatgccaccttgatgctgccgacccaaaccatttcgcaaggtgcgattgaaaaagtgaaggatgcgacccggaaaatcgctaaggccttcgccatcagcggacccttcaatgtgcagttcctggtgaagggaaacgacgtgctggtcatcgaatgtaatctgcgggcatcccgctctttcccattcgtgtcgaaaacgttgggcgtggacttcatcgatgtggctactaaggtgatgattggtgaaaacgtggatgagaagcatctgcctactctcgaccacccgatcatcccggctgactatgtcgcaattaaggcaccaatgttttcgtggccgagactgcgagacgccgacccaatcctcagatgcgaaatggccagcactggggaggtggcctgcttcggggaaggcatccacacggccttcctgaaggcgatgctttctaccggttttaagattccacagaagggtattctgatcggcatccaacaatcgtttcgcccgagattcctcggagtcgctgaacagctgcacaatgaaggattcaagctcttcgccaccgaggccactagcgattggctgaacgcaaacaatgtccctgccaccccagtggcctggccctcgcaggagggacaaaacccctcgctgtcgtcaattcggaaactgatcagagacggcagcatcgatctggtgatcaacctccccaataacaacaccaagttcgtgcatgacaattacgttatccgccgcactgcggtcgattccggcatcccgctgttgaccaatttccaggtgactaagttgttcgcggaagcggtgcaaaagtccaggaaggtggactcgaaatcactgttccactatagacagtactcagcaggaaaggcggcc

SEQ ID NO: 8074 - DNA, 4500 bp, Artificial Sequence
  Description of Artificial Sequence: Synthetic coding sequence
atgactagaattttgactgcattcaaggtggtgcgcaccctaaaaacaggatttggcttcaccaatgtgaccgcccatcagaagtggaagttctctaggcccggtatccggcttttgtccgtcaaggcacagactgcccatatcgttctggaggatggaactaagatgaaaggctacagcttcggacacccatctagtgtcgctggtgaggtcgtcttcaacactggactcgggggttaccctgaggccatcactgacccagcatataagggacaaatcctcacaatggcgaaccccattatagggaacggcggcgccccagacactaccgctctggacgaattgggcctgagcaaatacctcgagtctaatggcatcaaagtgagcggactgctcgttttggactacagtaaggattacaaccattggttagccaccaagtccctcggccagtggctccaagaggagaaagtgcccgcaatttacggagtcgatactagaatgctcactaagatcattcgagataaaggcaccatgctggggaagattgagttcgaaggacagcctgttgattttgtggaccctaataagcagaacttaatcgcagaggtctctacaaaggatgtgaaagtttacggcaagggaaaccctaccaaggtggtggccgtggactgcggaatcaagaataacgtgatccggctcctcgttaaacgcggcgcagaagtccacctcgtaccatggaaccatgattttacaaaaatggagtatgacggtattttgatcgcgggcggacccggcaatcccgcgctcgctgaaccgttgatacagaacgtgcgcaaaatcctggagtcagacaggaaggagcccctctttgggatctcaaccgggaatttaattacaggcttggccgcaggagctaagacatacaagatgtcaatggccaatcggggacaaaaccaacctgttctgaacattaccaacaagcaggcctttataaccgctcagaatcatgggtatgcactagataacacccttcctgcagggtggaagccactcttcgttaacgtcaacgatcagacaaatgaaggtatcatgcacgaaagtaaacccttttttgccgtgcagttccacccagaagtcacccctgggccaatagacaccgaatatctgttcgactcgttcttcagtctcattaaaaagggaaaagccacaaccattacctccgtcttgcccaaaccagccctcgtcgcgtctagggtggaggtgtctaaggtccttatattaggatctggagggctctccataggtcaggccggggagttcgactactccggcagccaggcggtgaaagctatgaaagaggagaatgtcaaaacagtgcttatgaaccccaacatcgccagtgtgcaaacaaacgaggtggggctcaagcaggcagataccgtctatttcttacctattactcctcagtttgtaacagaggtgattaaagctgagcagccggacggactgatcttgggcatgggtgggcagacggcacttaattgtggcgtggagctctttaagcgtggagtgctgaaggagtacggagtgaaggttctggggaccagcgtggagtcaatcatggccaccgaggaccgccagttgtttagcgataagctgaatgagattaatgaaaaaatagcaccatcctttgctgtggaaagcatagaggacgccctaaaggccgccgacacaatagggtatccagttatgataagatccgcgtatgcattaggaggattaggcagcggaatctgcccgaaccgcgagactttgatggacctctcgacaaaagcatttgctatgaccaatcagatcctggtggagaagtcagtgaccgggtggaaagaaattgagtatgaagtagtccgggatgccgacgacaattgcgttacagtctgcaacatggagaacgtagacgcaatgggcgtacacactggcgacagcgtggtggtggcgcccgcccagacattgtccaacgccgaattccaaatgctgaggcggacaagcattaacgtggtcaggcacttgggaattgtgggagagtgcaatatccaattcgcactccacccaaccagtatggagtactgtattattgaagttaatgcccggctctcccgtagctcagctctggcctctaaagccacgggctatccactggcattcattgctgctaaaatagctctgggcatacccctgccggagatcaagaatgtcgtctccgggaagacttctgcgtgctttgaaccgagtctggattacatggttactaaaatcccgcgatgggacctcgataggtttcacggcacttcttcgagaatcggatcttcaatgaaatcggttggagaggtgatggcaatcggacgtacttttgaagagtcctttcagaaggccctgaggatgtgccatccatctatcgagggctttacccccaggctgccaatgaataaggagtggccgagcaatctcgacctccgaaaagagctctccgagccttcttcgaccaggatctacgctatagcaaaagcaattgacgacaatatgagcttggacgagatcgagaaattgacttatatagacaagtggtttctttataagatgcgcgatatactcaacatggagaaaacactcaagggattgaacagcgagtctatgacagaggaaactctcaagcgggctaaggagattggattttctgataaacagatcagcaaatgtctcgggctcaccgaagctcagacaagagagctaaggttgaagaagaacattcacccctgggtgaaacagatcgataccctcgctgccgagtatccttctgtgaccaactatctctatgtgacttacaatgggcaggagcacgacgttaattttgacgaccatggcatgatggtcctcgggtgtggcccatatcacataggctcctccgtggagtttgattggtgtgccgtgtccagtattcggaccctgcggcagctgggcaaaaagactgtggtcgtgaattgcaaccccgagactgtgtcaaccgatttcgatgaatgcgataaattgtatttcgaagaactgagcttggagagaattctagatatataccaccaggaagcttgcggggggtgtatcatctctgtgggcggccagattcctaataatctggcagtgccactgtacaaaaatggagtaaagatcatgggcacttcacctttacagattgatcgtgctgaggacagaagcatattttctgcagttctcgacgagctgaaggtcgctcaggcaccatggaaagcagtgaacaccctgaatgaggccctggaatttgcgaagtcggtggactacccctgtcttctcaggccgagttacgtgttaagtggctccgcaatgaatgtggtgtttagcgaggatgagatgaagaaattcctggaagaggccacgagggtttcacaggaacatccggtggtgctcaccaaatttgtggagggggctagggaggtggaaatggatgcggtgggaaaggatggccgggtgatctcacatgcaatttcggaacatgtggaggacgctggggtgcatagtggggacgcaacccttatgctgccaacccagacaataagccaaggcgccattgaaaaagtgaaagatgcaactcgcaagattgcgaaggcgttcgcaatttccgggccttttaatgtccagttcttagtaaaggggaacgatgtgctagtaatagaatgcaacttgcgggcctctcggagctttccatttgtatcaaagaccctcggagtggactttattgacgtggcaacaaaagtgatgataggcgagaatgtcgatgaaaaacatctgccaacactggaccatcctatcatacctgctgattacgtagcgattaaagctccaatgttcagttggcctcgccttcgcgatgcggatcccatactccgctgtgagatggcatctacaggggaggtggcgtgcttcggagaggggatacacaccgcctttctgaaggccatgctatctaccgggttcaaaattccccaaaagggtatccttatcggcatccaacagtcatttcggcccaggtttctgggcgtggcagaacagctacataatgaaggatttaagctcttcgccaccgaagctacctctgattggctgaacgccaataacgtacctgccacccccgtggcctggccttctcaggaggggcagaatccatctttatctagtatcaggaaattaatccgggatggctcgatcgatctggtgatcaacctgcctaacaataataccaaatttgtccacgacaattatgtcattcggcggaccgccgtggattccggtatccccctcctcaccaatttccaggtcacaaaattgtttgccgaagccgtgcagaagtcacgaaaggttgactccaagtcactgtttcactaccggcagtactctgcaggaaaggccgct

SEQ ID NO: 8075 - DNA, 4500 bp, Artificial Sequence
  Description of Artificial Sequence: Synthetic coding sequence
atgaccagaatactgacggcctttaaggtcgtgaggacgctgaagaccggcttcggattcaccaatgtcacagcccaccaaaaatggaagttctctcgccctggtataaggctgctgtcagtgaaagcccagacggcccacatcgtgttggaggacggaactaagatgaagggctactccttcggccacccctcatctgtggctggcgaggtggtctttaacaccggtctcggaggttacccggaggctatcactgaccccgcctataagggacaaatcctgacgatggctaatccgatcattggtaacggaggagctcctgatacaactgctctggatgaactgggtctgagtaaatacctcgaatctaacggcatcaaggtctctggtctgctggtgctcgactacagtaaagattataaccattggctggcgacaaaatccctcggtcagtggctccaagaggagaaagtccctgcaatctacggcgttgatactagaatgctgactaagattatccgcgataagggcacgatgctgggcaagatcgagtttgagggccaacctgtcgacttcgtcgatccaaacaagcagaatctcatagcagaggtgtccacaaaggacgtgaaggtctacggcaagggtaaccccaccaaggtcgtggcggtagactgcggcatcaagaacaacgttatcaggctcctggtgaaacgcggtgccgaggtccacctggtgccgtggaatcacgacttcactaagatggaatacgatggcatacttatcgcaggcggtccaggaaacccggcactcgctgagcccctgatacagaacgttagaaaaatcttggaaagtgaccgcaaggaaccactgtttggaatcagcaccggaaacttgattacaggccttgctgccggtgcaaagacgtataagatgagcatggccaacagaggacagaaccagcccgtcctgaatataacaaacaagcaggcattcatcaccgctcagaaccacggttacgccctggacaataccttgcctgcgggttggaagccacttttcgtcaacgtgaatgatcagaccaatgaaggcattatgcacgaatccaagccttttttcgctgttcagttccatccagaagttacccctggccctatcgataccgagtatttgttcgacagctttttcagtctcataaaaaagggcaaagctaccactataacctccgtgcttccgaaacctgcgctcgtggcaagcagagttgaggtcagcaaggtgctgattcttggcagtggtggtctctccattggccaggcaggcgagttcgactactcaggaagccaggcggtgaaggctatgaaggaggagaacgtgaagacggtcctgatgaatcccaacatcgcatcagtccaaacgaacgaagtcggactcaaacaggcagacacagtctatttcctgccaataacaccacagtttgtgacagaagtgattaaggccgaacagcccgacggcctgattctgggaatgggtggtcaaaccgctcttaactgcggcgttgagctgttcaagaggggagttctcaaggagtatggagtaaaagtgctgggcacttccgttgagagtatcatggctaccgaggacagacaattgttctcagacaaacttaacgagatcaacgaaaaaattgcaccatccttcgccgtggaatctattgaggacgctctcaaagcagccgataccattggctatcctgtcatgatccgcagtgcctacgccttgggcggcctgggaagtggcatttgtccaaatcgcgaaaccctgatggacctgtccaccaaagctttcgctatgactaatcagattctggtggagaagagcgtgaccggctggaaggaaatcgaatacgaagtcgttagggacgcagatgataactgcgttacggtttgtaacatggaaaatgtagatgcgatgggtgtgcacacaggtgattctgtggtggtcgcccccgcacagactttgtctaacgcagagtttcagatgctgagaaggaccagtataaacgttgtccgccacctgggaatagttggagagtgtaacatccagtttgctcttcaccctacttcaatggaatactgtatcatcgaggtgaatgcaaggctttcccgcagcagtgcactcgcttccaaggcaactggttatccccttgctttcatcgctgctaaaattgcgctcggcattcctctgcccgaaatcaagaacgtggtatccggtaagaccagcgcttgcttcgagccttcactggactacatggtcacaaaaataccccgctgggatttggatcgcttccatggcacttccagcagaatcggaagcagtatgaaaagcgttggtgaagtgatggcgataggaaggacctttgaggagagctttcaaaaagccctgcgcatgtgccacccatctattgaaggtttcacgccaaggctgcccatgaataaagaatggccgtctaatctcgatttgaggaaggagctgtcagagcctagttccaccagaatctacgccatcgctaaggccattgacgataacatgagtctggacgagatagaaaagctgacatacatcgacaagtggttcctttataaaatgcgcgacattctcaatatggagaaaaccctcaagggtctgaattcagaaagcatgacagaggagacactgaaaagggccaaggagattggctttagcgataagcaaatttccaaatgcttgggattgacggaagcccagacccgcgaattgcgcctcaagaagaacattcacccgtgggtaaaacagatcgacactctcgcggctgagtacccgagcgtgacaaattatctgtacgtgacctataatggtcaggagcatgacgtcaactttgacgatcatggtatgatggtcttgggatgtggtccttatcatatcggaagctcagtcgagttcgattggtgcgccgttagctccatcagaacgctccgccaactgggtaagaagactgttgtggtcaactgcaacccagaaacagtgtccacggacttcgacgaatgcgacaagttgtatttcgaggagctgtccctcgaacgcatcctggatatctaccaccaagaggcgtgtggcggctgcatcatttcagtgggcggtcagatcccgaataatctcgcggtccctctgtacaaaaatggcgttaaaataatgggtactagtccccttcagatcgatcgcgcggaagacaggtcaatcttctccgccgttttggatgagctgaaggttgcacaagctccgtggaaggcagtcaacaccctgaacgaggcgctggagttcgcaaagtctgtcgactatccgtgcttgctccgcccctcttacgtattgtcaggttcagctatgaacgtggtctttagcgaggatgagatgaagaaattcctggaggaggcaacaagagtctcccaggaacatccggtagtcctcactaagtttgtggaaggagctcgcgaggtggagatggacgcagtgggcaaggacggaagggttatctcccatgcaatctctgagcacgttgaggatgcgggagtccattctggcgacgcgacactgatgttgccgacccagacgatctcccaaggtgcgatcgaaaaggttaaggacgccactaggaaaatcgccaaagcttttgcaatatccggacccttcaacgttcagtttctggtaaagggtaatgacgtactggttatcgaatgtaatctccgcgcttctagatccttccctttcgtctccaaaactctgggagtcgatttcatcgacgtagccactaaggttatgatcggtgagaacgtggacgagaaacatctgcctactctcgaccatccaattatacccgctgattacgtggctatcaaggccccaatgttctcctggcctagactcagagatgctgacccgatactgaggtgtgaaatggctagtacgggtgaggttgcttgcttcggagagggcatccacacggcttttctcaaggccatgctctctactggctttaaaattccccagaagggcatcctgatcggaatccagcaatctttcaggccaagatttttgggtgtagccgaacagctgcacaatgagggtttcaagctcttcgcaactgaagctactagcgactggcttaatgctaataacgtccccgccactcccgtcgcctggccttctcaggagggacagaatccctcactttcctcaatccgcaagttgatccgcgacggctccatcgatctggtgatcaacctccctaacaataacacaaagttcgtgcatgacaattatgtgatccgcaggactgcagtggacagcggcatccctctcctgactaactttcaggtcacaaagctcttcgccgaggctgtccagaaaagccgcaaagttgactctaaaagtcttttccactatcgccaatacagcgccggtaaagcagcc

SEQ ID NO: 8076 - DNA, 4500 bp, Artificial Sequence
  Description of Artificial Sequence: Synthetic coding sequence
atgactaggattctgactgcattcaaagtcgtgcggaccctcaagacaggtttcggcttcaccaacgtcactgcccaccagaagtggaaattttctcgtcccggaattcgcctgctttcggttaaggcacagaccgcccacattgttttggaagatgggacaaagatgaaggggtacagctttgggcacccctcgagtgttgctggggaggtggtgtttaatactggcttggggggctatccagaggccattacggatccggcatataaaggtcagatcctgaccatggccaatcccataattgggaacgggggggcccctgatactacggccttagacgaactgggcttgtctaagtatctggaatctaacggtatcaaggtttccggactgctggtgcttgactactccaaggattacaaccactggctggctaccaagtctctcggacaatggctgcaggaagagaaggtcccagctatctacggtgtcgacacccggatgttaactaagataattagggacaaggggacaatgttaggcaagatcgagttcgagggacagcctgtcgattttgtcgacccgaacaagcagaatctgattgcagaagtatccactaaagatgtgaaggtttacgggaaggggaatcccactaaggtggtcgcagtagactgtggtattaaaaataatgtgattcggctgctggtcaaacggggggcagaggtgcaccttgtgccttggaaccacgattttactaagatggaatacgacggcatcctgatcgccggcggacctggtaatcctgccctcgccgagcctctgatccagaatgtccgtaagatcctcgaatcagaccgcaaagagcccctgttcgggattagtacgggaaacctcattaccgggttagccgcaggtgccaagacatacaaaatgtctatggccaacagagggcagaaccagcccgtgctgaacatcacaaacaaacaggcctttattacggcacagaaccacggttatgccctggacaacacactgcccgccggttggaagcccttgtttgtgaatgtcaacgaccagactaacgaggggattatgcacgaatcaaaaccattcttcgcagtccagtttcacccagaagttacccccgggcccatcgataccgagtatctattcgatagtttctttagtctgattaagaaaggcaaggcaactaccatcacctcagtattacccaagcccgcacttgtggcctcacgggtcgaggtgtcaaaagtgttaatcctcggttctggtggactgtcgatcggccaagccggcgagttcgattatagtggatcgcaggctgtcaaggctatgaaggaagagaatgtgaagaccgtgctgatgaacccgaatatagccagcgtgcagaccaatgaggtaggtttaaagcaagccgataccgtgtactttctgcccatcacaccacaattcgtcacagaggttatcaaggccgagcagcccgatggtttaatcctgggcatgggaggacagaccgcactgaactgcggggtggagcttttcaagcgaggcgtactgaaagagtatggcgtgaaggttcttggcacctctgttgagagtataatggccactgaggatcgccagctgttttctgacaagctgaacgaaatcaatgaaaagattgcaccaagctttgcggtcgaatccatcgaagacgctttaaaggctgccgacactataggctacccggtgatgatcagatccgcctacgctctaggggggctcgggtcggggatatgtcctaacagagagacactgatggacctctcaacgaaagcgttcgccatgaccaatcagatcctggtagagaagtcggtcacagggtggaaagagattgaatatgaggttgtgagagatgctgatgacaactgcgtcaccgtctgcaacatggagaatgtggacgccatgggagtgcataccggtgactccgtggtggtcgctcctgcacagactttaagtaacgccgagtttcaaatgttacggcggactagcatcaatgtggtgcgccacctgggtattgtcggggagtgtaacattcagtttgcattgcaccctacatctatggagtattgcattatcgaagtaaacgccagactctcccgatcatcagccttagcttcaaaggcgacaggttaccccctggccttcatagcagcaaaaatcgccctgggcatacctctgcccgagatcaagaacgtcgtaagtgggaaaacaagcgcgtgttttgagccctcactggactacatggtcactaaaattccaagatgggacctggatcggttccacggtacaagtagcaggattggtagctccatgaagtccgttggggaggtcatggccatcgggaggacctttgaagaatccttccaaaaggcactgcgcatgtgccatcccagcatagagggctttacaccgcgtctgccaatgaacaaggagtggccaagcaacctcgatctgcgcaaagagctcagtgaaccttccagtacaagaatctacgccattgcaaaagcaattgatgataacatgtcacttgatgagatagagaagctgacttacattgacaagtggttcctgtacaagatgcgggatattttgaacatggagaagacactcaaggggttgaactctgagagcatgacagaagagaccctcaagcgcgccaaggagataggtttctctgacaagcaaatctccaaatgtcttggtttgactgaggcccagacacgcgagcttaggttaaagaagaacattcacccgtgggtcaagcaaatcgatacgttggccgccgaatatccatctgtgactaactatttgtatgtaacatacaacggccaggagcacgacgttaacttcgatgaccacggcatgatggttctcggctgcggtccctaccacattgggtcaagtgttgagttcgactggtgtgccgtgtcgagcatccgcacactccgccaactgggaaaaaaaacagtcgtggtgaactgcaatcccgaaacagtctctaccgacttcgatgagtgcgataaactgtacttcgaagaactctcattggaacgtattctggacatctatcaccaggaagcatgcgggggatgtataataagcgtaggagggcagatccctaacaatctcgcagtaccgctgtataagaatggggtcaagataatgggcacgtccccgctccagatagaccgtgccgaagacaggtcaattttctctgcggtgctggatgaacttaaagtagcacaggctccgtggaaggcagtcaatacactcaacgaggcactcgagttcgccaaatcagtcgattatccctgcctcctacgccccagctatgtacttagtgggtccgctatgaacgtggtgttttccgaagacgagatgaagaagttccttgaggaagcgacaagagtgtcccaagagcaccctgtggttctcaccaaattcgtggagggtgcgagggaggtggagatggatgcagtgggaaaggacggacgcgtgatctctcatgctatcagtgaacacgtcgaggacgccggggtccatagcggggacgctaccctgatgcttccaacacagacaatttcccaaggcgccattgaaaaagtaaaagacgccactaggaagatcgcaaaagcgtttgccatatcaggaccatttaatgtgcagttcttagtgaagggcaacgatgtgctggtgattgagtgcaatctgcgtgcctcccgcagttttcccttcgtctccaagacactaggagtcgactttattgatgtagctaccaaagtcatgatcggcgagaacgtggatgaaaagcatctgcctaccttagaccacccaattattcctgcagactatgttgccatcaaagcccctatgttttcgtggcccaggctgagagatgccgaccccattttgagatgcgaaatggcctccacgggcgaggtggcttgttttggagaaggtatccacacagcgtttctgaaagccatgcttagcacgggttttaagattccgcagaaaggcatcttaattggcatacagcaatcctttagacctagatttctgggcgtagctgagcagctgcataacgaggggtttaagttgtttgccacggaagccacgagcgactggctcaacgccaacaacgtgcccgccaccccagtagcgtggccttctcaagaaggacagaacccctctctttctagtatacggaagctcatcagggacggtagtatcgaccttgtgattaatctgccaaataacaatactaaattcgtccacgataactatgtgatccgcagaaccgccgttgactcgggtataccacttctcacaaacttccaggtgacaaagctttttgcggaggccgtacaaaagtcccggaaggtcgattctaagtcactgttccattaccgccagtatagtgcaggaaaagccgcc

SEQ ID NO: 8077 - DNA, 4500 bp, Artificial Sequence
  Description of Artificial Sequence: Synthetic coding sequence
atgactcgaatactgacagcctttaaagtggtaagaacactgaagactggattcggattcacaaacgtgacagcccaccagaaatggaaattttctagacccggaatcagattattaagtgtaaaagctcagacagctcatatagtgttggaagatgggacgaaaatgaaaggatactccttcgggcatccttcttccgttgcaggagaggtggttttcaatactggactaggagggtatccagaagctataacagatcctgcttataaagggcagatcctaacaatggctaaccccattataggaaatgggggagcccccgatactacagccttggatgaactaggactaagtaaatatctggaatctaacgggattaaagtatctggactccttgtgctagactactctaaagattataaccattggttggctacaaaaagtctgggacagtggctccaggaagaaaaggtgcccgccatttacggggttgatacacgaatgctaactaaaatcattagggataaagggacgatgctaggaaaaatcgaatttgagggacagcccgtggactttgtagatccaaataagcagaatctgatcgctgaagtttctacaaaggatgtaaaagtgtatggaaaagggaaccccacaaaagtggtggccgttgattgcgggattaaaaataacgtcatccggctcctagtaaagcggggagctgaggttcacctcgtaccctggaaccatgattttactaaaatggaatatgatgggatcctcatagccgggggaccaggaaatcctgcccttgccgagcctctgatccagaatgtgcggaaaatcctggagtccgatcgaaaagaacccctctttggaatctccacagggaatctaatcactggactcgccgcaggagctaagacttataaaatgtcaatggctaacagaggacagaaccagcccgtactgaatatcacaaacaaacaggcctttataactgcccagaaccatgggtatgccctcgataacacactccctgccggatggaaacctcttttcgttaatgttaacgatcaaactaatgaaggaataatgcatgagtctaaaccattttttgccgttcagtttcacccagaagtcacaccagggcctattgatactgaatatctttttgactcattcttcagtttaataaaaaaagggaaggctactactataacaagtgtcttacccaaacctgccctcgtggccagtcgggtagaagtctccaaggtgctaatactgggaagtggaggattgtccatagggcaggcaggagaatttgattatagtgggtcacaggccgtgaaggctatgaaagaggagaacgtaaaaactgttctaatgaatcccaatatagcgtctgtgcagacaaacgaagtaggactgaaacaggcagatacggtgtatttcctccctatcacaccccagtttgttacagaggtgatcaaagctgaacagccagacggactgattcttggaatggggggacagactgcattaaactgtggggtagaattattcaaacgcggggtgctcaaagagtatggggttaaagttctaggaacatccgtcgagtctataatggctacagaagataggcagctcttctctgataaactgaacgaaataaatgaaaaaatagcccccagttttgctgttgaatctattgaagatgcactgaaagctgccgacacaataggatatcctgtgatgatcaggtctgcatatgccctggggggactagggtccggaatttgccctaacagagaaactctgatggatctctcaacaaaggcgtttgctatgacaaaccagatcctcgttgaaaagtctgttacagggtggaaggaaatagaatatgaagtagtacgtgacgctgatgacaattgtgtgactgtgtgcaacatggaaaatgtggatgccatgggagttcatacaggggattctgtggtagtggcgcccgctcagacactctctaacgctgaatttcaaatgctaaggagaacttctatcaacgtagtcagacatcttgggatagtgggggagtgcaatatacagtttgctctacaccccacatccatggagtattgtataatcgaagtaaacgctagactgtcgagatcttctgcattggcttctaaagcaacaggatatcctctggcctttattgcggccaaaatcgcactgggaataccactaccagaaataaagaatgtggtttctgggaaaacttccgcatgcttcgaaccttccctggattatatggtaacaaagatacctagatgggacctcgacaggttccacggaacgtcttctaggatcggaagttccatgaaatccgtaggagaagtgatggctatagggcgcacttttgaggagtcttttcagaaggctctgcggatgtgccatccttccatcgaggggtttacacccagattacccatgaacaaagagtggccctccaacctggatttgcggaaagaactgtctgaaccttcctctacacggatttatgctatcgctaaagcaatagatgataatatgtctcttgatgaaatcgaaaaactgacatatatcgataaatggttcttatataaaatgcgagatatcctcaatatggagaaaacactaaaagggttgaattctgagtcaatgacagaggaaacactcaaacgggctaaagaaattggattttcagataaacagatatctaagtgccttggacttactgaagcacagacaagagaactgcgccttaaaaaaaatatccacccttgggtgaaacaaatcgacactctcgcagccgagtatccctctgtgacaaactatctgtatgtcacatacaacggacaggaacatgatgtgaacttcgatgatcatggaatgatggtgctggggtgtggaccatatcacataggatcctcagtggaattcgattggtgtgcagttagtagtattcggacactgagacagctcggaaagaaaactgttgtcgtgaattgcaacccagaaactgtttcgacagatttcgatgaatgcgataaattatatttcgaagagctttctctggagcggatcctcgatatctaccatcaggaggcatgtggggggtgtataatctcagtgggggggcagatccccaataatttggcggtgcctctatacaaaaatggggtgaaaataatggggacatcgccattgcagatcgatcgggcagaggatcggagtatcttttcggctgttctggatgaactgaaagttgcacaggcgccatggaaagccgtcaatacacttaatgaggccctggaattcgctaaatccgtggattacccctgcttgctcaggccgtcatatgtcctttcaggatcagctatgaacgtagtcttttcagaagatgaaatgaaaaaattcctagaggaagccacacgggtttctcaggaacaccccgtggtcctgacaaaattcgtggaaggggctcgtgaggtcgaaatggatgctgttgggaaagatgggagggtgatctcacacgctatatctgagcatgtggaagatgcaggagtacatagtggagatgccacactcatgctcccaacacagacaatatctcagggggctatcgaaaaagtcaaggatgccacaaggaagatagccaaagcttttgcaatctctggaccattcaatgtgcagtttctagtcaaaggaaacgatgtgctagtgatagaatgtaatctacgcgcttccagaagtttccctttcgtaagtaagacactcggggtggattttatcgacgtcgctactaaagttatgataggagaaaatgtggacgaaaaacaccttcctactttggatcacccaataatccctgctgattatgtggctataaaagctccaatgttctcttggccccgattacgggatgctgatccgatacttaggtgtgaaatggccagtactggggaagtcgcctgtttcggagagggaatacacacggcctttctgaaagccatgctaagtactgggtttaaaattcctcagaaaggaattcttatcgggattcaacagtctttcaggcccagattcctcggagtggctgaacagctccacaatgaaggatttaaactgttcgcaacagaagcaacaagtgattggttaaatgccaacaatgtacctgcaactcccgtagcttggccttcacaggaagggcagaacccctcacttagttccatccggaaacttatcagggatgggagtatagatttagttatcaatctacctaataacaacacaaaattcgtgcatgacaattatgtaatacgcagaactgccgtggattctgggatccccctgctgacaaatttccaggtaacaaaacttttcgctgaagccgtgcaaaaatctaggaaggtggatagtaaatcactttttcactatagacagtattctgcaggaaaagctgcg

SEQ ID NO: 8078 - DNA, 4500 bp, Artificial Sequence
  Description of Artificial Sequence: Synthetic coding sequence
atgacgcggatcctcaccgcttttaaggtcgtgcgaactctcaagacgggattcggtttcaccaacgtgaccgcgcaccaaaagtggaagttttcgcgccccggaatccggctgctttcggtgaaggcccaaaccgcccatatagtgctggaggacgggaccaagatgaagggctactcgttcggacacccgtcctcggtcgcaggggaggtcgtctttaacaccggcctggggggatacccagaagcgatcactgacccggcctacaagggacagatcctgaccatggctaaccctatcatcggaaatggaggtgccccggatacgacggcccttgatgaattgggactgagcaagtatttggaatcaaacggcatcaaggtgagcggacttcttgtgctcgattactccaaagactacaatcattggctcgctaccaagtcgctgggccagtggcttcaagaagagaaagtgccggccatctacggcgtggatactcggatgctgaccaagatcatccgcgacaagggcacgatgctggggaagatcgaattcgaggggcaaccagtggactttgtggacccgaacaagcagaatctgatcgccgaggtgtcgaccaaggatgtgaaggtctacggaaagggaaaccctaccaaggtcgtggcagtggactgcggcataaagaacaacgtcattaggctcctggtgaaacgcggtgccgaagtgcacctggtcccgtggaaccacgacttcactaagatggaatacgacgggattctcattgccggcggacctggaaaccctgccttggcagagcccctgattcaaaacgtgcggaaaatcctcgaaagcgatcggaaggaacccctcttcggaatctcgacgggaaacctgattaccgggctggcagcgggagcgaaaacttataagatgtcgatggcgaacaggggacagaaccagcccgtgctgaacatcaccaataagcaagcgttcatcaccgcccaaaaccacggatacgcccttgacaatactctccccgcaggttggaagcctctgtttgttaacgtgaacgaccagactaatgagggcattatgcacgaatctaaaccgttcttcgcagtgcaatttcatccagaggtgacgccgggtcccatcgacaccgaatacctcttcgattcattcttcagtctcatcaaaaaaggtaaggccacgaccatcacttccgtgctgccgaaacctgcactcgtggcatcgcgcgtcgaggtgtcgaaggtcctgatcctcggctcggggggcctctcgatcgggcaggccggtgaattcgactactccggaagccaggctgtcaaggctatgaaggaagagaatgtgaaaactgtcctcatgaacccgaacatcgcgtccgtgcagactaacgaagtggggctcaaacaggcggataccgtttacttccttcctatcacccctcagttcgtgactgaagtcatcaaagccgagcagccggacggactgatcttggggatgggtggtcagaccgccctgaactgcggagtggagctgttcaagagaggtgttctgaaggaatacggggtgaaggtgctgggtacctcggtggagtccattatggctaccgaggaccgccagctgttctcagacaaacttaacgaaatcaacgaaaagattgccccgtccttcgctgtggagtccatcgaggatgcactcaaggctgcggacacgatcggataccccgtgatgatccgaagcgcgtacgcactgggtgggctcggatccggcatctgcccgaaccgggaaactctgatggatctgagcaccaaggccttcgctatgactaaccagatcctcgttgaaaagtcggtgactggatggaaggagattgaatacgaggtggtgcgcgacgctgacgacaattgcgttaccgtctgcaacatggagaatgtggatgcgatgggggtgcatactggtgatagcgtcgtggtggccccggcacaaacgctgtcgaatgccgaatttcagatgcttagacgcacttcgatcaacgtggtgcggcacctggggatcgtgggtgaatgtaacatacagtttgcgctgcatccaacctccatggaatattgcattatcgaagtcaatgcgcgccttagccgtagctccgcgctggcatcaaaagccaccggatacccccttgccttcatcgccgcgaaaatcgcgctcggaatcccgcttccggaaatcaagaatgtcgtgagcggaaaaacctcagcctgcttcgaaccgtccctggactacatggtgactaagatcccgcggtgggacctggatcgctttcacgggacgtcgtcacggatcggctcaagcatgaagtcagtgggagaagtgatggccatcggccggactttcgaagagagcttccagaaggcgctgcggatgtgccatccgagcatcgaaggattcaccccgcgccttccaatgaataaggagtggccatcaaacctggacctccgtaaggagctgtcggagccgtcatcgaccaggatctacgcgatcgctaaggccatcgatgataacatgtcgttggatgaaatagaaaagctgacttacattgacaagtggttcctgtacaagatgcgggatatcctcaatatggaaaagacgctgaagggccttaactcggaatcgatgaccgaggaaactctcaagcgcgcaaaggagatcggtttctccgacaaacaaattagcaagtgcctgggattgacggaggcacagacccgggagctgcgcctgaagaaaaacatccatccttgggtcaagcaaatcgacactcttgcagccgaatacccgagcgtgaccaattacttgtacgtgacttacaatggccaagagcacgacgtgaatttcgatgatcatggaatgatggtcctgggatgcggtccgtaccatatcggctcatcagtggaattcgactggtgtgccgtctcgtcgatccgcactctgcgccagcttggaaagaaaactgtggtggtgaactgcaaccccgagactgtgtcaaccgacttcgatgaatgtgataaactgtacttcgaagaactctcgctggagagaattctggacatttatcaccaggaggcctgtggcgggtgtatcatttcggtcggaggacagatcccaaacaaccttgccgtcccgctctacaagaacggagtgaagatcatgggcacctccccgctgcaaatcgatagagcagaggaccgttcaatcttttccgccgtcctcgatgaacttaaggtggctcaggccccttggaaagctgtcaataccctcaacgaagccctcgagtttgcaaagtccgtcgattacccgtgtctcctgcgtccatcatacgtgctgtccggatcggccatgaacgtcgtgttctcagaagatgagatgaaaaagttcttggaggaagccactagagtttctcaggaacaccccgtcgtcctgaccaaattcgtggaaggagctcgggaggtggaaatggacgcggtgggaaaagacggaagagtcattagccatgcgatctcggaacatgtcgaggacgccggagtgcacagcggtgatgcaaccctgatgctccccacccagaccatcagccagggcgccatcgaaaaggtgaaagacgccacccgcaagatcgccaaagcgttcgcgatcagcggcccgttcaatgtccagttcctggtgaaggggaacgacgtgttggtaattgagtgcaatctgcgggcatcgaggtcgtttcctttcgtttcgaaaaccctgggagtggacttcatcgacgtggctaccaaggtcatgatcggagaaaacgtggatgagaaacatctcccgactctggaccatccaatcattcctgccgattacgtggcgattaaggcacccatgttctcctggccacgccttcgtgacgcagacccgatcctcagatgcgagatggcgtccacgggcgaggtggcatgcttcggagaggggatccacactgccttcttgaaagccatgctttcaaccggcttcaagataccacaaaaggggatcctgatcggaatccaacagtccttcaggccacggttcctcggagtcgctgagcaactgcacaacgaaggcttcaagctgttcgccaccgaagcgacctccgactggctcaacgctaacaatgtcccggcgactccggtggcctggccttcccaagaaggacagaatccatccctgtcgtccatcagaaagctcatcagggatggctcgattgacctggtgatcaacttgccgaacaacaacaccaagttcgtgcacgacaactatgtgattcggcggaccgctgtggactctggcatcccacttctgacgaacttccaagtgaccaaactgttcgcagaggccgtccaaaagagccgcaaagtggactcgaagtctttgtttcactaccggcagtatagcgcgggaaaggctgct

SEQ ID NO: 8079 - DNA, 4500 bp, Artificial Sequence
  Description of Artificial Sequence: Synthetic coding sequence
atgacgaggatcctcaccgcctttaaggtcgtgcggaccctcaagactggattcgggtttactaatgtgactgcccatcaaaaatggaagtttagccgcccagggatccgactgctgtccgtgaaggcccagactgcgcacatcgtgcttgaagatggtacgaagatgaagggctactcgttcgggcacccctcctcagtcgccggagaagtggtgttcaacactggactggggggctacccagaggcaatcaccgatcctgcctacaagggacagatcctgacgatggcgaacccaatcattgggaacggaggagctccggataccacggctcttgacgaactcggcctcagcaagtacctcgagtccaacgggatcaaagtctcaggacttctcgtgctggattactcaaaagactacaatcattggctggcaaccaagtcgcttggtcaatggctgcaggaagaaaaggtgcccgccatctacggagtcgacactagaatgttgaccaaaatcatcagggacaaaggcaccatgcttggaaaaatcgagttcgagggccaaccggtggatttcgtcgaccctaataagcagaatctcatcgcggaggtcagtaccaaggatgtgaaggtgtacggaaaggggaatccaactaaggttgttgccgtggactgtggtatcaaaaacaacgtcatccggcttctggttaagcgcggcgccgaagtgcaccttgtcccgtggaatcacgacttcaccaagatggagtacgacggaatcctgatcgccggaggtccgggaaatccagccctggcggaacctcttattcaaaatgtcagaaaaatccttgaatccgacaggaaagaacctcttttcggaatctccactgggaacctgatcactggcctggcggcgggagccaaaacctacaagatgagcatggccaacaggggccagaaccagcctgtcttgaacattactaacaagcaagcatttatcactgcccaaaaccacggatacgcgctggataatactcttccggccggctggaagccgctgtttgtcaacgtcaacgaccagaccaacgaaggcatcatgcacgagtcgaaaccgttctttgccgttcaattccacccggaggtgacgcccggacccatcgacacggaatacctgtttgattcatttttctctctcatcaaaaagggcaaggcgacgaccatcacttccgtgctgcctaagcctgcccttgtcgcctcgcgcgtggaagtctcaaaagtcctgattctcggctccggaggcctgtcgatcggacaagccggtgagttcgactactcagggtcccaggcggtgaaggccatgaaggaggaaaacgtaaagaccgtcctgatgaatcccaatatcgcgtccgtgcagaccaacgaggtgggcctgaagcaagccgacacggtgtactttctgccgatcaccccgcagttcgtgaccgaagtgatcaaggcagaacaaccggacggactcatcttgggaatgggaggacagaccgcactgaactgcggagtcgagcttttcaagcgaggggtgctcaaggaatacggagtgaaggtgctcggaacgagcgtggaatcgattatggcgaccgaggatagacagctcttcagcgataagttgaacgagatcaacgagaagatcgccccgtcgttcgcggtagaatcaatcgaagatgccctgaaggccgccgacaccattggttaccctgtgatgatccgctcggcctacgcgctcggcggactgggaagcggtatctgccctaaccgcgagactctgatggatctgtcaacgaaggcgttcgcgatgactaaccagatactcgtggagaaatccgtgaccggttggaaggaaatcgagtacgaggtcgtccgcgatgcagatgacaattgcgttaccgtgtgcaacatggagaacgtggacgcaatgggggtccacactggagactcggtcgtcgtggcgcccgcccagactctctcgaacgcggaattccaaatgctcaggagaaccagcatcaatgtggtgcggcacctgggaattgtgggcgaatgcaatatacagttcgccttgcacccgacttccatggaatactgcatcatcgaggtgaacgcccggctgtccaggtcgagcgctctggcttcaaaggctaccggctatccgctggcgttcattgccgccaagattgctctcggaatccctctgccggagattaagaacgtcgtgtcaggaaaaacctcggcctgcttcgagccgagcctggattacatggtgaccaaaattcctcggtgggacttggatcggttccacggaaccagcagccgcatcggcagctcgatgaagagcgtgggggaagtgatggcgatcgggcgcacttttgaagaatccttccagaaggctctcaggatgtgccatccatccatcgagggattcaccccgagactcccaatgaataaggaatggccgtcgaacctggatctgcggaaggaactgagcgaacccagctccacccgcatttacgccatcgccaaggccatcgacgataacatgtcgctggacgagatcgagaaacttacctacatcgataaatggtttctgtacaagatgcgcgacatcttgaatatggaaaagactctcaagggcttgaacagcgagtcaatgactgaagagactctcaaaagggcaaaagaaatcggattttccgataagcagatctcgaagtgcctcggactgactgaagctcaaacccgggaactgcgactgaaaaagaacatccatccatgggtcaaacagattgacacccttgcagcggagtacccgtcagtgactaactatctgtacgttacctacaacggccaggaacacgacgtgaacttcgacgaccacggaatgatggtgcttggctgcggcccgtatcacatcgggagctccgtcgaatttgactggtgcgccgtttcgagcatccgcaccctgcggcaactcggtaagaaaactgtggtggtgaactgcaacccagaaaccgtttcgaccgatttcgacgagtgcgacaagttgtacttcgaagaactgtcactcgaacggatcctggatatctaccaccaggaagcatgcggtggatgcatcatctccgtcgggggacagatcccgaacaatctggcagtgcctctgtacaagaacggagtcaagatcatgggaacctcaccgttgcaaatcgatcgggccgaggaccgctcgattttctcggctgttctggatgaacttaaggtggctcaggccccatggaaggctgtgaataccctcaatgaagcgctggaatttgccaagtccgttgactacccgtgtctgctgcgcccctcgtacgttctcagcggatccgcaatgaatgtagtgttctcggaggatgagatgaagaagtttctggaagaggccacccgagtgtcccaggagcatccagtggtgttgaccaaattcgtggaaggagcccgagaagttgagatggacgccgtcggaaaggacggaagagtgatcagccacgcgatctcggagcacgtggaagatgctggagtgcacagcggagatgccacgctgatgcttccaactcaaaccatcagccaaggagcaatcgagaaggtcaaggacgcaacccggaagatcgcgaaggcgtttgctatctcgggccctttcaatgtgcagttcctcgtcaaaggtaatgacgtgctggtcatcgagtgtaatttgcgggcttccagatcgttcccattcgtgtcgaaaacgctgggagtggactttattgacgtggcgaccaaggtgatgatcggagagaatgtggatgaaaaacatctgccgactctggaccacccgatcattcccgccgactacgtggcgattaaggcgccaatgttttcgtggccgagattgcgcgacgccgatccaatcctgagatgtgaaatggcctccactggggaagttgcatgcttcggagaaggaatccacaccgcctttctgaaagccatgttgtccactggcttcaagatcccccagaagggaatcctcatcggcatccaacagtcatttaggccccgcttcctcggcgttgcagaacagcttcacaacgaaggattcaagctgtttgctactgaggccacctctgactggcttaatgccaacaatgtgccggcaaccccggtggcgtggccatcgcaggaggggcagaacccgtccctgtcctcaatccggaagctcatccgggatggaagcatcgatctcgtcatcaatctcccgaacaacaacaccaagtttgtccatgacaactacgtgatccggcggaccgccgtcgactcgggaatcccccttctcaccaacttccaagtgaccaaacttttcgccgaagcagtgcaaaagtcacgcaaggtggactcgaagtcgctgttccactaccgccagtattccgcgggcaaggccgcc

SEQ ID NO: 8080 - DNA, 4500 bp, Artificial Sequence
  Description of Artificial Sequence: Synthetic coding sequence
atgacgagaattctgaccgcttttaaggtggtccggacccttaagacgggcttcggattcactaatgtgacagctcatcaaaagtggaagttttctcgcccaggcattcgcctgctgagtgtgaaggcacaaaccgcccacatagtcttggaagatggcaccaagatgaaaggatatagcttcggacatcccagtagcgtggcaggcgaggtggttttcaacaccggactgggcggttacccagaggccataactgatccggcttacaagggccagattctcactatggcgaaccctataattggaaatggtggcgcccccgataccactgccctggatgagctcggcctgagcaagtatctggagagcaacggcatcaaggtttccggtcttttggtactggattactcaaaggactataatcactggctcgccaccaaaagtctgggccagtggctgcaggaagagaaggtacccgccatttacggagtggatacgcgaatgctgacgaagataatccgcgataaaggcaccatgctaggaaagatagaattcgagggacagccggtcgatttcgtggaccctaataaacaaaacctgatagcggaggtttcgaccaaagacgttaaagtctatggcaaaggcaacccaacgaaggtcgtggctgtagattgcggaataaagaacaacgtcattcgcctcctcgtgaaacggggagccgaggtccacctggtgccgtggaaccatgatttcaccaagatggaatacgacggcatacttatcgccggcggccccggcaaccccgccctggccgaaccgcttatacaaaacgttcggaagatactggaatctgaccggaaggagccgctgtttggcatatccacaggcaaccttataacaggtcttgccgctggcgccaagacgtataagatgtcaatggccaatcgcggccaaaatcagccggttttgaatattactaacaagcaggcctttattactgcccaaaatcacgggtatgcactggacaacaccctgccggctggctggaagccattatttgttaacgtgaatgatcagaccaacgagggaattatgcacgagtcgaagccgtttttcgccgtgcaatttcacccggaagtcaccccgggcccgatagatacggagtacctatttgacagtttcttttctttgataaagaagggtaaggccacaaccattacctccgtcctcccaaaaccggctttggtggccagccgagtcgaggtcagcaaagtcctcatcctgggcagcggcggcctgtccataggacaggccggcgagtttgactacagcggatcccaggcggtgaaggctatgaaggaggagaatgtgaaaaccgtattgatgaatcccaatattgcgagtgtacagaccaacgaggttggcctaaaacaggcggacacggtgtacttcctgccgatcacaccgcaattcgtcaccgaggtgatcaaagccgagcagcccgacggattgatcctgggcatgggcggacagacggccctcaattgtggcgtggagctgttcaagcgtggagtgctgaaagagtacggagtcaaggtgctaggcacgagtgtggagtccattatggccactgaggacagacagctgttctcggacaagctgaatgagatcaacgagaaaatcgctccgagcttcgccgtagagtccatagaggacgccttgaaggctgccgatactattggctatccggttatgattagaagtgcatatgcccttgggggactgggcagcggaatttgcccgaaccgcgagacactcatggacctttcaacgaaggcattcgccatgacgaaccagatcttggtcgaaaagtcggtgacaggctggaaggagatagagtatgaggtggtgagggatgccgatgataactgcgtgactgtctgcaatatggaaaatgtcgatgccatgggagtccacaccggggactcagtcgtcgtggcccctgcccaaaccttgagcaacgctgagttccagatgcttaggcgtacgtccataaacgtggtgcgccatctgggcatcgtaggcgagtgtaatatacagttcgcactgcaccctaccagtatggaatactgtatcatcgaggtaaacgcacgactgtcgcgctcctcagcgctggcctcaaaggctacaggctacccgttggctttcatcgcggccaagattgccttgggcatacctctccccgaaattaagaatgtagtgagcggtaaaacgtcggcctgcttcgaacccagcttggattacatggtcacgaagatacccagatgggatctcgatcgcttccacgggacaagctcgcgaataggttcatcgatgaagagtgttggggaagtgatggcgattggccgcacctttgaggagagcttccagaaggcgctgcgtatgtgccacccgagtatcgagggcttcacaccccgcctgcccatgaataaggaatggccgtctaatttggatctgcgtaaagaactgtctgagccgtccagcacgcggatttacgctattgctaaggcaattgatgataacatgtcccttgatgaaattgagaaactgacatacatcgataagtggttcctttataagatgagagatattctgaatatggagaagacgttgaagggacttaattccgagtcaatgactgaggagacgcttaaacgcgccaaggaaattggctttagcgataaacagatcagcaagtgcctgggcctgactgaagcccagacaagagaactgaggctgaagaagaacattcatccgtgggtgaagcaaattgacacactggccgccgagtacccatccgtgacgaactacctctacgtgacgtataatggacaagaacatgatgttaacttcgatgaccatggcatgatggtgctgggttgtggcccgtaccatattggtagctcggtggaatttgattggtgtgccgtgtcgtcgatccgcacgctacgccagcttggcaaaaagacggttgttgtcaactgtaatccagagactgtatcgaccgactttgacgaatgcgacaagctgtacttcgaggaattgtcccttgagcgcatcctcgatatttaccaccaggaggcatgcggtggatgcatcatatcggttggaggtcagatccccaacaatctggcagtgccgttgtacaagaatggcgttaagataatgggaacctcgcctctgcagatcgatcgagccgaggatcgatccattttttccgccgttctggacgaattgaaagtcgcgcaggccccatggaaggcggttaatacccttaatgaggccctggagtttgcgaagtcggtcgactacccttgtctgctgcgcccctcatatgtcctgtcgggttcagctatgaacgttgtcttctccgaggacgaaatgaaaaaattcctggaggaagccacccgggtctcccaagagcacccagtcgtcctcactaagttcgtcgaaggtgctcgagaggtggagatggatgctgttggtaaggacggccgagtaatcagtcatgctatcagcgagcatgtcgaggacgccggagtccatagcggagacgccaccctgatgctgccgacacagaccatcagtcaaggagccatcgagaaggtgaaggacgccacccgtaagattgcaaaggccttcgcgatatcaggaccatttaacgtgcagttcctggtgaaaggcaatgatgtgttggtcatcgaatgtaatctacgcgccagccggagctttccgttcgtctctaaaacactgggcgtagatttcattgatgttgctacaaaggtgatgattggcgagaatgtcgatgagaagcacttgcctacgctggaccacccgataattccggccgactacgttgccattaaagccccgatgttctcttggccccgcctacgcgatgccgatccaatactgcgatgcgagatggcgagcacaggagaagtggcctgctttggcgagggcatccacacggcgttcctgaaggctatgctgtccaccggctttaagataccgcaaaagggcattctgatcggaattcaacagtccttccgccctcggttcttgggggtggcggagcagcttcacaacgagggattcaaactgttcgcaacggaggccacgtcggattggctgaatgccaataacgtcccggcaactcctgtggcttggccgtcccaagaaggtcagaacccatccttgtcgagcattcgaaaactgattagagacggatccatagatttggtgattaacctgccgaacaataacaccaaattcgtccatgataattacgtcatccgccgcacggcagtcgactccggtatcccgctgctgactaatttccaagtgactaagctcttcgctgaggctgtccaaaagtcgaggaaggtagattcgaagtcactattccactatcgacaatactccgcgggtaaggcggcc

SEQ ID NO: 8081 - DNA, 4500 bp, Artificial Sequence
  Description of Artificial Sequence: Synthetic coding sequence
atgacccgaatccttactgcattcaaagtggtgcgcactctgaaaactgggttcggcttcaccaatgtgacagcccatcagaaatggaaatttagtcgtcctggaatccgtctgctttccgtcaaagcgcagaccgcccatatcgtgcttgaggatggaacaaaaatgaagggatactcatttgggcatccctcctccgtcgcaggcgaagtggtctttaatacagggttaggcggatacccggaagctattacagatcccgcctataaagggcagatccttactatggccaacccgataattggtaatgggggtgccccagacactaccgccctggatgagcttgggcttagcaaatatctagagagtaatggaatcaaggtgtccgggttactggtgctggactactcaaaagactataaccattggctagccactaaaagcctcgggcaatggttacaggaggagaaagttcccgccatatacggagtcgatacaaggatgctgacaaagattataagggacaaaggaacaatgctggggaaaatagaattcgagggccaaccagtggatttcgtggaccccaacaaacagaacctgatcgctgaggtttccactaaagacgttaaggtctacggaaaaggcaacccaacgaaggtggtcgcggtcgattgcggcatcaaaaacaacgtaatcagactcctagtgaagcggggcgccgaggttcaccttgtaccttggaatcacgacttcacgaaaatggaatacgatggaatcttgattgcaggcgggcccggaaatcctgcgctggccgagccactcatacaaaacgtccgaaagattcttgaaagcgacaggaaggagcccttattcggaatatccacaggtaatctcatcactgggctcgccgcgggcgccaagacctacaagatgtctatggctaatcgaggccaaaaccagccagtgttgaacattacgaacaagcaggcattcattactgcacagaatcacggttacgctctcgataatactcttccggctggctggaagccactgttcgtaaacgtaaatgaccagactaatgagggcattatgcacgaatctaagccctttttcgcagtgcagttccatcccgaggtgacacccggccccatcgataccgagtatttatttgactcttttttctcactcatcaaaaaaggaaaggcaacgaccattactagcgtgttacctaagccagctctggtcgccagccgggtggaggtgagtaaggtgttgatattgggctctggcggactctctattggccaagccggtgagttcgactatagcggtagccaagctgtgaaggctatgaaagaggaaaacgttaaaaccgttctcatgaatcctaacatcgcctctgtccaaaccaacgaagtggggctcaaacaggctgataccgtttacttcctgccaattactcctcagttcgtgacagaggtcattaaggcagagcagcctgatgggctgatcctgggaatgggtggccagactgcgctgaattgcggagtggagctgttcaagagaggtgttctgaaagaatatggggttaaggtgctggggacatcagtggagtctatcatggctacagaagaccggcagctcttcagtgataagctgaacgagattaatgaaaagattgctccttctttcgccgtggaatctatcgaagatgcgctcaaagctgctgataccattggctatcccgtcatgattcgatcagcgtatgccctgggaggcctgggctccgggatctgtccaaatagagaaaccctgatggatctaagcaccaaagcttttgccatgaccaaccagatactggtggagaagtctgtgaccggttggaaggaaatagagtacgaggtcgtgcgggacgccgatgacaattgcgtgaccgtctgcaacatggaaaatgttgatgccatgggcgtccacaccggcgactcagtcgtcgtagctcctgcccagaccctcagcaacgcagaatttcaaatgctgcgaagaacaagtatcaatgtggttagacacctgggaatcgttggcgaatgcaacatccagttcgccctgcacccgacctcaatggagtactgcatcatcgaagtgaatgcccgcctgagccggtcttctgcactggctagcaaggcgacgggctaccctttagcttttatagcagcgaaaattgccttgggcatccccctacctgagatcaagaatgttgtgagcggaaaaacaagtgcgtgtttcgagccatctctagactatatggtcacaaagatccctcggtgggaccttgacagattccacggtaccagttcaaggatcggaagttcaatgaagtctgtgggcgaagtgatggctattggacggaccttcgaagagtccttccagaaggctctgcggatgtgccatccgtcaattgaagggttcacccctcgactccctatgaataaagagtggccaagcaacctggatcttaggaaggaattgagcgagccctccagcactagaatttatgcgatcgccaaggctatcgatgacaatatgtcactggacgagatcgagaagctaacctatattgacaagtggttcctatataaaatgagggacatacttaatatggagaaaacactcaaaggtctgaattctgaatccatgaccgaagagactttgaagagagcaaaggagatcggctttagcgacaagcagatcagcaaatgcctggggttgaccgaagcccaaaccagagagttacggctgaagaaaaatatccacccctgggtgaaacagatcgacacgttagcggctgaatatccaagcgtgactaactacctgtacgtgacctataacggacaggagcacgatgtcaattttgacgatcacggtatgatggtgctgggctgcggcccctaccatatcggctcatcagtggaatttgattggtgcgccgtgtcgtctatccggactctgcgccagctagggaagaagaccgtggtggtgaattgtaacccagaaaccgtttcaacagacttcgacgagtgcgataaactttacttcgaagaactgagtctcgaacggatcctagacatctatcaccaggaagcctgcggcggatgtattatctcggtgggtggtcagattccaaataatctggctgtcccactctacaagaatggggttaaaatcatggggacttcccctctccaaatcgacagggctgaagaccggtcgatattcagcgcagtattagacgagttaaaggtggctcaggccccctggaaggccgtaaataccctgaatgaagcccttgaattcgccaagtctgtggactacccctgcctgcttcgtccctcctatgtactgagtggctccgcaatgaatgtggtgtttagtgaagacgaaatgaagaagtttcttgaagaggcaacgcgtgtgagtcaggagcaccccgtagtgctcaccaagttcgtggaaggcgccagggaagtcgaaatggacgcggttggcaaagacggaagagtgatctctcacgccatttcagaacacgtagaggacgccggagtgcattccggagacgccaccctcatgcttcctacacaaacaatatctcagggtgcaatcgaaaaggtgaaggacgcaacgagaaagatagccaaggctttcgctatcagcggtccttttaacgtgcagtttctggttaaagggaatgacgtgctggtgatcgagtgtaacttgagggcttctagatcctttcctttcgtcagtaaaacacttggcgtcgacttcatcgatgtggccaccaaggtcatgatcggagaaaatgtggatgaaaagcacctgcctactctggaccatccaattatacctgccgactatgttgcgattaaagcgcccatgttttcatggcctagacttcgggatgcagacccaatattgcgctgtgaaatggcctccacgggcgaagtcgcttgtttcggcgaagggatccatacggcctttctcaaagcaatgctttcgaccggcttcaaaatccctcaaaaggggatcttgatcggtattcagcaaagctttcgtccccggttcttaggcgtggcagaacaactccacaacgaaggcttcaagttgtttgccaccgaagcgaccagcgactggttgaacgcaaacaacgtaccggccacaccagtggcgtggccctcccaggagggccagaatcccagccttagcagcattagaaagctcatccgcgacggtagcattgacctggtgataaatttgcctaacaacaacactaagtttgtgcatgataactatgtaattagaaggaccgccgtagatagtggtatacccctgctgaccaacttccaggtcactaagttgtttgcggaagcggtgcagaagtctcgcaaagtggactctaagtctctctttcactaccgccagtattcggctgggaaagccgcg

SEQ ID NO: 8082 - DNA, 4500 bp, Artificial Sequence
  Description of Artificial Sequence: Synthetic coding sequence
atgaccagaatcctgaccgcattcaaggtggtccggaccctgaaaacaggctttggcttcacaaacgtcaccgctcatcagaaatggaaatttagcagaccagggatcagactcctcagcgtgaaagcccagactgcacacattgttctagaagatgggactaaaatgaaagggtatagctttgggcatccatctagtgtggctggtgaagtcgtatttaataccggcctgggcgggtacccagaggccattacagatcccgcatacaaggggcaaattctgaccatggctaaccccatcatcggaaacggtggagctccagataccacagcattagatgagcttggactttccaagtacctagagtccaatggtataaaagtgtccggtctgcttgtgctggattattcaaaggactataaccattggctagccacgaagtctctcggacagtggttgcaggaggagaaggtgcctgccatatatggagttgatacccgcatgttaacgaagattattagggataaaggcacgatgctgggaaagattgaatttgaggggcagccggtggactttgtcgatccaaataaacagaacctcattgccgaggtgtcgactaaagatgtgaaggtgtatggaaaggggaatcctacgaaggttgtggccgtagactgcggtatcaagaataacgtgatccggttgctagtgaagagaggagccgaggtccaccttgttccgtggaaccacgactttacaaaaatggagtatgatggtattctgatcgccggagggcctggtaacccagccctcgcagagcctctgatacagaacgtgaggaagatcctcgaatctgatcgcaaggagcctttatttggtatttcaaccggcaatctgattacaggcctggcggccggggccaagacctataaaatgagtatggcaaacagagggcaaaaccagcccgtgcttaatattacgaacaagcaggctttcatcactgcacagaaccacgggtatgctctcgataataccctccccgctggttggaaacctctgttcgttaacgtgaatgatcagactaacgaggggatcatgcacgaaagtaaaccattcttcgccgtccagttccatcctgaagttacaccggggccgatagataccgaatatctgtttgatagttttttttctctgatcaaaaagggcaaggcaaccaccattaccagtgtgctaccaaagcccgccctggtggcatcccgagtggaagttagcaaagtgctgattctgggctctggggggctctccatcgggcaagctggagaattcgattattcgggctcacaggccgtgaaggccatgaaagaagaaaacgttaagacggtcctgatgaatccgaacatagcatccgtgcaaactaacgaggtgggactaaagcaggcggatacagtgtatttcctgcctataacaccacaatttgttaccgaggttattaaggccgaacaaccggatgggctgatcttaggtatgggaggccagactgctctaaactgtggagtggaactgttcaagcggggggtcctgaaggagtatggggttaaggtattaggaacatccgtggaaagcattatggcaaccgaggataggcaactgttcagtgacaaactgaacgaaattaacgaaaaaatcgcaccctcatttgctgtggagtcaatcgaagacgcactgaaagccgccgatacaatcggttatcctgtgatgattcgcagcgcctatgcgttaggcgggctgggctccggcatctgccctaacagggaaaccctgatggatctttccactaaagccttcgcaatgacgaatcagatcttggtcgaaaaaagtgtaactggctggaaggagatcgaatatgaggtggtgagggacgctgacgacaattgcgtgaccgtgtgcaatatggagaacgtggacgctatgggagtacacacaggtgattcagttgtggtggctcccgcccagaccctttcaaacgcagagttccagatgctgaggaggacgagtatcaacgtcgtacgtcacttgggcattgtgggtgaatgcaacatccagtttgcattacatcctactagtatggagtactgcattatcgaggtgaacgctcgcctgagtcgctcttcagcactggcctccaaggctacaggatacccactggcattcatcgccgcaaaaatcgctttaggaattcccctgcccgagatcaagaatgtggtctccgggaaaacatccgcttgttttgagccttctctggactacatggtaaccaagatcccacggtgggacctcgacagattccacggtactagttctagaatcggcagttctatgaagtccgtcggcgaagtcatggcgatcggcaggacatttgaggagtcgttccagaaagccctgagaatgtgtcacccctcaatagaaggcttcacgcctaggctgccgatgaataaggagtggccttcaaatcttgatctgaggaaggaattgagcgagcccagttccactagaatatacgcaattgctaaggccatcgacgacaacatgagtcttgacgagatcgaaaaactcacctatattgacaaatggtttctttataaaatgcgggatatactcaacatggagaagacacttaagggcctcaacagtgagagcatgacagaggagaccttgaagagagcaaaagagattggtttttcggacaagcagatcagcaagtgcctcgggcttacggaggcacagactcgtgagctgagactaaagaagaacattcatccgtgggtgaaacagatcgatactctggctgccgaatatccttctgtgaccaattacctgtacgtgacatacaacggacaggaacatgatgtcaacttcgatgatcacggcatgatggtgctcgggtgtggcccttaccacatagggagttccgttgaattcgactggtgtgccgtgtccagtattaggacactgcggcagttggggaaaaaaacagtagtagttaattgtaaccccgagacagtgtccacagactttgatgaatgcgacaagctatactttgaggaattatcgttagagcgcattctggatatctaccaccaagaggcctgcggcgggtgcatcattagtgtcgggggacagatcccaaacaaccttgccgtgcccctttataaaaatggcgttaaaatcatggggacaagccctctccagatcgatagggcagaggatcggtccatttttagcgcagtgctggatgagctcaaggtggcacaggctccttggaaggccgtcaacacactgaatgaagcattggaattcgcaaaatccgttgactacccatgcctcctcaggccaagctacgtacttagcgggagtgcaatgaacgtggttttctcagaggacgaaatgaagaagtttctcgaagaggccaccagggtgagtcaggaacaccctgtagtgttgaccaagttcgtcgaaggagcaagagaggtcgagatggacgccgttgggaaggacggtagagtgattagccacgcaattagtgagcacgtggaagacgccggggtccactcaggcgatgcaacacttatgctgcctacacagacaatatcacagggggctatcgagaaagtgaaggacgctacaaggaaaatagccaaagccttcgccattagcggccctttcaatgtccagtttctcgtcaagggcaatgacgtacttgtgattgagtgtaatctgagagcgtccagaagttttccctttgtctcgaagacgctgggtgtcgactttattgatgtggcaactaaagtgatgattggggagaatgtggatgagaagcatctgcccacattggatcatcccattatcccggctgactacgtggccataaaagcacctatgtttagctggccccggctcagagacgctgacccgatacttagatgtgagatggcaagtactggagaggtggcgtgttttggcgaaggaatccacacagctttcctgaaggcgatgcttagcacgggcttcaagattccacagaaggggatcctcattggtatacagcaatccttcagaccacgctttctgggcgtcgcagagcaactacacaatgaaggttttaagctttttgctaccgaagcgacctctgactggctgaacgccaataatgtgcccgctacccccgtggcgtggccttcacaggaagggcagaacccttctctatcttctattcgcaaattgattcgggacggcagcatcgacttggtgatcaatctaccaaacaataacactaagttcgtacacgacaactacgtaattcgccggactgccgtcgatagtggaatccccctgctgaccaatttccaggtgaccaagttgttcgctgaggcagtgcaaaagtcccgcaaggtcgatagcaaatcgctctttcattatcgtcagtactccgccggtaaggctgct

SEQ ID NO: 8083 - DNA, 4500 bp, Artificial Sequence
  Description of Artificial Sequence: Synthetic coding sequence
atgactcggatcctgacggcatttaaggttgtgaggacccttaagaccggtttcggatttacgaacgtcaccgcacatcaaaagtggaagttttccagacccggcattcggttgttgtcagtgaaggcccagactgctcacatcgtccttgaagatggtactaaaatgaagggctactcatttgggcatccaagctcagtggcaggtgaagttgtgtttaacaccgggcttggaggttaccccgaagcaataaccgatccagcgtacaagggacagattcttaccatggctaatcccatcattggaaacggaggggcccctgatacgaccgccctcgatgaactcggtttgagcaagtacctcgagagcaacggaatcaaggtgtcagggcttctcgttcttgactacagcaaggattacaatcattggctggcaaccaagtcacttgggcagtggctgcaggaggaaaaagtccctgcaatctatggtgttgacacgagaatgttgactaaaatcattcgcgataagggtaccatgcttggaaaaatcgaatttgaaggtcaaccagttgatttcgttgaccctaataagcaaaaccttattgccgaagtgtcaaccaaggacgtgaaggtgtacggtaaggggaaccctaccaaagtggtcgcagtagattgtgggattaagaacaacgtgattcgattgctggttaagagaggcgccgaagtccatcttgtgccttggaatcacgactttactaagatggaatacgatggaatacttatcgctggaggacctgggaaccctgcgctggctgaacccctgatacaaaacgtcaggaagattctggaatcggatagaaaggagccactctttggaattagcaccggtaacctgataaccggacttgcagccggagcaaagacctacaaaatgtcgatggccaacagaggtcagaatcagccggtccttaacattacgaacaaacaggcattcatcactgcacagaaccacggctacgcacttgataacaccctccccgctggttggaaacccctgtttgtcaacgtgaacgatcaaacgaatgaaggcattatgcatgaatcgaagccattctttgctgtgcaattccacccagaagtcaccccaggcccaatcgacaccgaatacctgtttgatagctttttctcgctcattaagaagggcaaggcaaccactattacttcggtgcttccgaagccagcactggtcgcgagccgggtggaagtgagcaaggtgctgatcctgggatctggtggccttagcataggtcaggcaggcgaattcgattactccggctcccaggccgtgaaggcaatgaaagaagaaaacgtcaagaccgtcctgatgaatcccaatatcgcatcggtgcagactaatgaagtggggcttaagcaggcggataccgtttacttccttcccattactccacaattcgttactgaagtgattaaggcggagcaaccggacggtctgattctgggaatgggtggacaaactgcccttaactgtggggtggaattgttcaagaggggagtgctgaaggaatatggcgtcaaagtcctcggtacttcagtggaatcgattatggctaccgaggaccggcagttgtttagcgataaacttaatgagatcaatgaaaagattgcaccttcgttcgctgtagaatccattgaagatgcactgaaagcagcagacacgatcggttatccagttatgattaggtccgcatatgctcttggcgggctcggctcgggaatttgccccaacagagaaactttgatggacttgagcaccaaggcattcgcgatgaccaaccagatacttgtcgaaaagtcagtgaccgggtggaaggagatcgaatacgaggtggtgcgtgacgcggacgacaactgtgttaccgtgtgcaacatggagaacgtcgatgcaatgggagtgcatactggggattccgtggtcgtggcacctgcccagactctctccaacgcggagtttcagatgcttcggaggacgtctattaacgtggtgcgccacctgggaattgtgggagagtgtaacatacaatttgcgttgcatcctactagcatggagtactgcattattgaggtgaacgcaagactgtcacgctcgtcggcgttggcctcgaaggcaacgggttacccacttgcatttatcgcagcaaagatcgcactgggaattcctctgccggagattaagaatgttgtgagcggaaaaacctcagcatgctttgaacctagccttgattacatggtgactaagattcctagatgggaccttgatagatttcatggaacctcgtcgcgtataggctcctctatgaaatccgtgggagaggtgatggcaatcggaagaacctttgaagaatcgtttcaaaaggctcttagaatgtgtcatccttcgattgaaggatttaccccaagacttcctatgaacaaggaatggcctagcaatctcgatctccgaaaagagctttccgagcctagctcaactagaatttacgcgattgccaaagcgattgatgacaatatgtccctcgacgagatcgagaagctgacttacatcgacaaatggtttctgtacaagatgcgtgatatcctgaacatggaaaagaccctcaaaggactcaactccgagtccatgactgaggaaactcttaagcgggcgaaggagatcggttttagcgataagcagatttcaaaatgtcttggactcactgaagcccaaactagggaactgcgcctgaagaagaacatccatccatgggttaagcagatagacactctcgcagccgagtacccttcggttaccaactacctgtacgtgacctacaacggtcaagagcatgatgtgaatttcgatgatcatggtatgatggtccttggttgcggaccgtaccatattggttcctccgtggaatttgattggtgtgccgtgtcgagcatcagaactctgcgtcaactggggaagaaaactgtcgtggtgaattgtaaccccgagactgtgagcactgattttgatgaatgtgacaaattgtacttcgaggaactctctttggaacgcattctcgatatctaccatcaagaagcgtgcggcggatgtataatctcagtgggaggccaaataccgaacaacttggcagtgccgctttacaaaaatggcgtgaagattatgggtacctcaccactgcagatagatcgagcagaagatcgcagcattttctccgcagtgctggacgaactgaaagtcgcccaggcgccgtggaaggcggtgaacaccctcaacgaggcgctggagtttgcaaagtccgtggattacccctgcctcctccggccctcatacgtgctttccggctccgcaatgaacgtggtgttttccgaggacgaaatgaagaagttcctggaggaagcaacccgagtctcgcaggagcaccctgtcgtgcttaccaagtttgtggaaggcgcccgcgaagtggagatggatgcggtcggcaaggacggacgcgtcatctcgcatgcaatctcggaacacgtggaagatgcaggcgtgcacagcggggacgctactctcatgctgcctacgcagacgatttcccagggtgccattgagaaagtcaaggatgctactagaaagatcgcaaaagcatttgcaatttcaggaccattcaatgtgcagttcctggtgaaagggaatgatgtgcttgtgattgagtgtaatctgagagcctcccgcagcttcccgtttgtctctaagactctcggtgtggatttcatcgacgtggctacgaaggtgatgattggtgaaaatgtagacgaaaagcatctgcccactcttgatcatcccatcataccagccgattacgtggcgatcaaggctcctatgttttcttggccacggctgagggatgcggaccccattctcagatgcgagatggcatcaacgggagaagttgcctgtttcggcgaaggaattcataccgcatttttgaaggcgatgctctcgacgggttttaagattcctcagaaaggcatcctgatcggtatccaacagtcttttcggccccgattccttggcgtagcagaacagctgcacaatgaaggattcaagttgtttgcaaccgaagcaacctcggactggctgaatgcaaacaatgtgcccgcgacccccgtggcctggccttcacaagaagggcagaatccaagcctgagctcaatccgcaagctcattagagacgggtccatcgacttggtgataaatcttcctaacaataacactaagtttgtccatgacaattacgtcatccggaggaccgcggtggattcaggtattccgctgttgaccaactttcaagtcaccaagctgtttgccgaagcagtgcaaaaatcccgaaaggtcgattcgaagtcgcttttccactaccgccaatattccgcaggcaaagcggca

SEQ ID NO: 8084 - DNA, 4500 bp, Artificial Sequence
  Description of Artificial Sequence: Synthetic coding sequence
atgaccagaatcttgacggctttcaaggtcgtgaggacccttaagactggcttcggattcaccaacgtgaccgcacatcagaagtggaaattttcgcgcccgggaatccggctgctcagtgtgaaagcacaaactgcacatatcgtgcttgaggacggaaccaagatgaaaggttattcattcggccatccctcgtcagtggctggcgaggtggtcttcaacaccggcctggggggttacccggaagccatcaccgatcccgcctacaagggtcaaatcctgactatggctaaccccatcatcgggaacggaggcgccccggacactactgccctggacgaattgggcctgtccaagtacctggaaagcaacggaattaaggtcagcggactcctggtgctggattactccaaggattacaaccactggctcgcaaccaagtcactcggccaatggcttcaagaagagaaggtgcctgccatctacggagtcgacacccgcatgctgactaaaatcatccgggataaaggcactatgctcggcaagatcgagttcgagggccaaccggtcgatttcgtggacccgaacaagcaaaatctgatcgcggaggtgagcactaaggacgtcaaagtctacgggaaaggaaatccgaccaaggtggtggcagtggattgtggtatcaagaacaatgtgatcagactgctcgtgaagcggggggcagaagtgcaccttgtgccctggaaccatgacttcaccaagatggagtatgatggtatcctgatcgccggcggacccggaaatccggcgctggcggaaccgctgattcagaatgtgcggaagattctggaaagcgaccgcaaggaacctctgttcggcatctcaaccgggaatctgatcaccggactcgcagctggtgcgaaaacctacaaaatgtcgatggccaacagaggacagaaccagcccgtgctgaacatcaccaataagcaggcgttcatcacggcgcaaaaccatggatacgcgctggataatactctgcctgccggatggaaaccgctcttcgttaatgtgaatgaccagaccaacgaaggaatcatgcacgaatcgaagccgtttttcgcagtgcagttccatcctgaggtgactccaggccctatcgataccgaataccttttcgactcgtttttctccctgatcaagaaggggaaggcgacgaccatcacctccgtgctccctaagccggcgctggttgcatctcgcgtggaggtgtccaaagtgctgatcttgggatcgggaggattgtcaattgggcaagcgggtgagttcgattacagcggctctcaggcggtcaaggcgatgaaagaggaaaacgttaagactgtgttgatgaacccgaacatcgccagcgtgcagactaacgaggtgggcctcaaacaagccgatactgtctacttcctgccaatcacgccgcagtttgtgaccgaggtgatcaaagccgaacaacctgacggactgatcctcggcatgggtggccagaccgccctcaattgtggcgtggaacttttcaagcgcggagtgctgaaggagtacggcgtgaaggtgctgggaacctccgtggagtcaattatggcgaccgaggaccggcaactgtttagcgacaagctcaacgagattaacgagaagatcgccccatcattcgccgtcgaatcaatcgaagacgccctcaaggccgctgacacgatcggctacccggtcatgatccggtccgcttacgctctgggagggctgggatcgggtatctgtccaaacagggagacgctcatggacctcagcactaaagcgttcgccatgaccaaccagatcctggtggaaaaatcggtcactggctggaaggaaatcgaatacgaagtggtgcgggacgccgatgacaactgcgttactgtgtgcaacatggaaaacgtggatgcaatgggcgtccacactggtgactccgtggtcgtcgcgccggcgcagacgttgtccaacgcggagttccagatgctgcggaggacttcaatcaatgtcgtgcgccacctcggaatcgtgggagagtgcaacatccaattcgccctgcatcctacttccatggaatactgcatcatcgaagtgaacgcacgcctctcgagaagctctgccctggcgtccaaggcaaccggatacccgctggcctttatcgcggctaagatcgctcttggcatccctctgccagagataaagaatgtggtgtccggtaaaaccagcgcgtgttttgagccgtcgctggattacatggtgaccaagattccgcgctgggatttggacaggttccacggaacctcgtcgagaatcggttcgtcgatgaaaagcgtcggagaagttatggccatcgggcggaccttcgaagaatcttttcagaaggccctcagaatgtgccatccgagtatcgagggattcacgccacgcctgcccatgaacaaggaatggccatcaaacttggatctccgcaaggaactgtccgaaccatcatcgaccagaatttatgctatcgcaaaggcgatcgacgacaacatgtccctggatgaaatcgagaagctcacctacatcgacaagtggttcctttacaaaatgcgggatatcttgaatatggaaaaaaccctgaagggactcaattcagaaagcatgacggaagagactctgaaacgcgctaaagagatcgggttttcagacaagcagatcagcaaatgcctgggactgaccgaagcgcaaacccgggagctccggcttaaaaagaatatccacccgtgggtgaaacagattgatacgctcgcggccgagtacccatcagtgactaactacctgtacgttacctataacggtcaagagcacgacgtgaatttcgacgatcacggtatgatggtgctcggatgcggcccgtaccatatcgggtcgtcggtagagttcgattggtgtgctgtgagctccatcagaactctgcgccagctgggaaagaaaacggtcgtcgtgaactgcaatccagaaaccgtgtcaactgactttgacgagtgcgataaactttacttcgaagaactcagcctggaacggatcttggacatctaccaccaagaggcttgcggcggctgtatcatctcggtgggaggtcagatcccaaacaatctggcagtgcctctctacaagaatggcgttaagattatgggcacctcccccctccagatcgaccgggccgaggatagatcaatcttctcagctgtcctcgacgaactgaaagtggcgcaggctccgtggaaggctgttaacactctgaatgaggcgctcgaattcgcgaagtcggtcgattacccgtgtctgctgcgaccgtcctatgtgctgtcgggatcagccatgaacgtggtgttttcggaggacgaaatgaagaaatttctcgaggaagcgacgcgggtgtcgcaggagcacccagtggtcctcactaagttcgtcgaaggtgcacgcgaagtggaaatggatgccgttggcaaggatggacgggttatatcgcacgccatctccgaacatgtggaagatgcaggagtgcacagtggggacgcgaccctcatgcttccgacccagaccatctcccagggagccattgagaaggtcaaggatgccaccagaaaaatcgcaaaggccttcgccatttcgggccctttcaacgtgcaattcctggtgaaaggcaacgacgtcctggttatcgagtgcaatctgcgggcttcgcgctcgtttccttttgtgagcaagacccttggcgtggactttatcgacgtggccaccaaggtgatgatcggagaaaatgtggacgagaagcatctgccaactctggaccacccaatcatcccagcggactacgtggccatcaaggcgccgatgttctcctggccacggctgcgcgacgccgaccctatcctgcgatgcgagatggcttccacgggagaagtggcctgttttggagagggtatccataccgcttttctcaaggcgatgctctccaccggattcaagattccgcagaagggaattctgattgggatccaacaatcgtttcgcccgcgcttcctgggcgtggcagagcagctgcacaatgagggatttaaacttttcgccactgaggcaacgtcagactggctgaacgcgaataacgtcccggcgaccccggtcgcatggccctcgcaggagggccagaacccgtccctgtcctccatcagaaagctgattagggatggtagcatcgatctcgtcattaacctgccgaacaacaataccaagttcgtgcacgacaattacgttatccgccgcactgccgtggattcaggaatcccactgctcactaacttccaggtgacgaagttgttcgctgaagcggtgcagaagtcccggaaggtggattcaaagtcgctttttcactacagacaatactcagcgggaaaggccgcc

SEQ ID NO: 8085 - DNA, 4500 bp, Artificial Sequence
  Description of Artificial Sequence: Synthetic coding sequence
atgactcggattctgaccgcattcaaagtggtccggactcttaagacgggctttggcttcaccaatgtcaccgcacaccaaaagtggaagttttctcgccctggtatccgactcctcagcgtgaaggcacagaccgcacatatcgtgctggaagatggaacgaagatgaaggggtactctttcggtcacccctcatcagtggcaggagaagtggtctttaacactgggcttggaggttacccagaagcaattaccgatcccgcctacaagggtcagattcttactatggcaaaccctattatcgggaacggtggagccccagatactaccgctcttgatgaactgggactttcgaagtacctggaatccaacggaattaaggtgtcgggacttcttgtgctggattactcaaaggactataaccactggcttgcaaccaagtcgctgggacaatggctgcaagaagaaaaggtgcctgcaatttacggtgtggacaccaggatgctgacgaagatcatcagagataaaggtactatgctcgggaaaattgaattcgaaggacaaccagtcgatttcgtggatccgaataaacagaacctgattgccgaagtgtccaccaaagacgtcaaagtgtacggtaagggtaacccgaccaaggtggtggctgtggattgtggaattaagaacaatgttatccgtctccttgtgaagagaggagcggaagttcacctggtcccttggaaccacgacttcaccaagatggagtacgatggtattctcattgcaggagggcctgggaaccctgctttggcagaaccactgatacaaaacgtgcggaaaattctcgagagcgatcgtaaggagccgctgtttggaatctcgactggaaatcttattactggactcgccgcaggagccaagacctacaagatgagcatggcaaatagaggtcaaaatcagccggtgctcaacattacgaacaaacaggcatttatcactgcacagaaccacggatatgcactggacaatacccttccagccggatggaaacctctgttcgtgaatgtgaacgatcagaccaatgagggtattatgcacgaatccaagcctttctttgcagtgcaattccatccggaagtgacccctggtcctattgataccgagtacctcttcgattcattcttttctctgatcaagaagggtaaggcaaccactatcactagcgtgctccccaagcccgcacttgtcgcatcaagagtggaagtgtcaaaggtgctcattcttgggtccggtggtctgtcgataggtcaggcgggggaattcgattacagcggttcgcaagcagtcaaggcgatgaaggaggaaaatgttaagaccgtgctcatgaatcctaacattgcatcggtccaaaccaacgaagtcggtcttaagcaggctgacacggtctacttcctgccaatcactccgcagttcgtgaccgaagtgataaaagccgaacagccagatggtcttattctgggaatgggaggccagaccgcactgaactgtggtgtggaactgtttaaacgcggtgtgctgaaggagtacggagtgaaggtgctcggaacctcggtggagtccataatggccactgaggataggcagctgttctcggacaagctgaacgagataaatgagaagattgcacccagctttgcggtggaatccattgaagatgcacttaaggcagcagatactattgggtacccagtgatgatcagatccgcatacgcgcttggagggctgggttcaggaatttgccccaatagggaaacgctgatggatctttccactaaggcattcgcaatgaccaaccaaatcctggtcgagaaatccgtgaccggatggaaggagattgagtacgaagtggtcagagatgccgatgataattgcgtgaccgtttgcaatatggagaatgtagatgcgatgggcgtccacaccggcgattcagtcgtcgtcgcaccggcccagacgctttccaacgcagagttccagatgcttcggcgaacctccatcaacgtcgtccgtcatctgggcattgtgggtgaatgtaacattcaattcgcacttcatcctacctccatggaatactgcattattgaagtgaatgcaaggctgtcacgatcctcggctctcgcgagcaaggctaccggctaccctcttgcatttatcgcagccaagattgccctcggtattccgttgccagagattaagaacgtcgtctctggaaagaccagcgcatgttttgaaccaagcctggactacatggtgacgaagataccacgttgggatttggacagatttcatggcacctcctcccggatcggatcctcgatgaagtctgtgggcgaagtgatggcgataggtcgtacttttgaagagtccttccaaaaggcacttcggatgtgtcatccgagcattgagggatttactccaagactcccgatgaacaaggagtggccgagcaacctggaccttagaaaggagctttcagagcctagctccaccaggatatacgcaattgccaaagccatcgatgataacatgtccttggatgaaattgagaaactgacttacatagacaagtggtttctgtacaaaatgcgcgacattcttaacatggaaaaaactctcaagggtctgaattccgaatcaatgaccgaggaaaccctcaagagagcaaaggaaatcggattttctgacaagcaaattagcaagtgcctcggacttactgaagcccaaactagggaactgcgactcaaaaagaatatccatccctgggtgaaacaaatcgataccctggcggccgaatacccaagcgtcactaattacctttacgtgacttacaatggacaagagcacgacgtgaatttcgatgaccatggaatgatggtgctgggatgtggaccataccatatagggtcaagcgttgagtttgactggtgtgcagtctccagcattcgcacgctccgacagctgggcaaaaagaccgtggtcgtgaattgtaatcccgaaaccgtgtcgacggactttgatgagtgtgacaaactctattttgaagagctgtcgctggaacggatccttgatatctaccatcaggaggcttgtggtggatgcataatctcagtgggtggacaaattccgaacaacctcgctgtccctctctataagaacggggtcaagattatgggaactagcccgctgcagatcgacagggcagaggaccggtcgatcttttcggccgtgctggatgaacttaaggtggcacaggcaccctggaaggccgtgaatactctgaatgaagcccttgagtttgcaaagtcagtggactacccctgcctcctccgcccttcctacgtgctgtcaggatcagcaatgaacgtagtgttctcagaagatgagatgaagaagtttcttgaagaagcaactagggtcagccaggaacacccagtagtactcacgaagttcgtggaaggggctcgcgaggtcgaaatggatgccgtgggtaaggatggcagagtgatttcccatgcaattagcgaacatgtggaagatgccggtgtccattccggagacgccacccttatgctccctactcagaccatttctcaaggcgcaatcgaaaaagtgaaggacgccacccgcaagatcgccaaggcctttgcaattagcggaccctttaacgtgcaatttcttgtgaaaggaaacgatgtcctcgtgatcgaatgtaacttgagagcttcccggagcttcccatttgtgtctaagactcttggtgtggacttcatcgatgtggcaacgaaagtgatgatcggagaaaatgtcgatgaaaaacatctgcctaccctggatcatccaattatccctgcggactacgtcgcgataaaggcccctatgttttcgtggcctagactgcgcgacgcagatccgatcctgaggtgtgagatggcgtcgactggcgaagtggcttgttttggagaggggatccacactgccttccttaaggctatgctgagcaccgggttcaaaatcccacaaaaaggaatcctcataggaatacagcagagctttaggcctagattcttgggggtcgcagaacaacttcataatgaagggttcaagctgtttgccaccgaggccacttcagactggctcaacgccaacaatgtccccgcgaccccagtcgcatggccaagccaagagggtcagaacccctcactgtcgtccatccgaaagttgattcgtgatggctccattgatcttgtgatcaacttgccaaataacaacaccaagttcgtgcacgataactacgtgattcggagaacggcagtggacagcggcatcccactcttgaccaactttcaagtcactaaactgtttgcggaagccgtccaaaaaagcaggaaagtggatagcaagtcgctgttccactaccgtcagtactcagcaggtaaagcggcg

SEQ ID NO: 8086 - DNA, 4500 bp, Artificial Sequence
  Description of Artificial Sequence: Synthetic coding sequence
atgacgcgcatcctgactgcttttaaggtggtgaggactttgaaaactggatttgggttcaccaatgtgaccgcacaccagaagtggaagtttagccgccctggcatcagactgctctctgtcaaggcacaaaccgcccacatcgtcctcgaagatggcaccaaaatgaaaggctacagcttcggacacccatcctccgtggctggtgaggtcgtctttaacacggggcttgggggctaccctgaggccatcactgatcccgcgtacaagggtcaaattctgactatggcaaacccgattatcggcaatggcggcgccccggacaccaccgcgcttgatgaactgggcctgtcgaaatacctggaatcaaacggtatcaaagtgtcgggtctgttggtgctcgattattcgaaggattacaaccactggctcgccaccaagtccctggggcagtggctgcaagaggagaaggtgccagctatctacggggtggacacccggatgctgactaagatcatccgcgacaaaggtaccatgctgggaaagatagaattcgagggacagccagtggacttcgtggatccaaataaacaaaacttgatcgccgaagtgagcactaaggacgtgaaggtgtacggaaaaggaaacccgactaaggtcgtggccgtcgattgcggaatcaaaaacaatgttatccgcctgctggtgaagcggggagcggaggtgcatctcgtcccttggaaccacgatttcactaagatggaatacgatggaattctcatcgcaggcggccccggaaacccggcattggccgagccactgattcaaaatgtgagaaagatcctcgagtcggaccggaaagagcccctcttcggtatctccaccgggaatctgatcaccggactggccgcgggagcgaaaacttacaaaatgagcatggccaaccggggacaaaaccaaccggtgctgaacattaccaataagcaggcatttatcactgcccagaatcacggctacgcgctggataataccctgccggccggatggaagcctctgttcgtgaacgttaatgatcagaccaatgaaggcatcatgcacgaaagcaaacctttcttcgccgtgcagttccatccagaggtcactccgggacctattgacaccgaatacctcttcgactcgttcttctcactgatcaagaaaggaaaggcgaccaccatcacctcagtgctcccgaaaccagccctggtggcgtcaagggtcgaggtgagcaaggtgctgatcctcgggtcaggcggcttgagcattggacaagcaggcgaattcgactactcggggtcccaggcggtgaaagccatgaaagaggaaaacgtcaagactgtgctgatgaacccgaacatcgcctcagtgcagactaatgaagtggggctgaagcaagcagataccgtgtactttttgccgatcaccccacagttcgtgaccgaagtgatcaaggccgaacagccggacggcctcattctgggaatgggaggacaaaccgcactgaactgcggggtcgaactcttcaagcgaggggtgctgaaagagtacggtgtgaaggtgctcggaacttcagtagagtcgattatggctacggaggaccggcaacttttctctgataaactcaacgagatcaacgagaagattgcccctagcttcgccgtcgagtcgattgaggatgccctgaaagctgccgacaccatcggatacccggtgatgatcaggtcagcctatgccctgggcggactgggaagcggaatatgtccgaatagggaaactctgatggacctgtccaccaaggctttcgcgatgactaatcaaatcctggttgagaaatcggtcactggctggaaggaaatcgaatacgaagtggtgcgcgacgccgatgataattgcgtcaccgtgtgcaacatggaaaacgtggacgcaatgggagtccataccggcgattcggtggtcgttgcgccagcacagactctctcaaacgccgagtttcaaatgctcagaagaacctccatcaacgtggtgcgtcatctgggaattgtgggagaatgtaacatccagtttgctctgcatccgacgagcatggagtattgtatcatcgaggtgaacgcgcgcctgtcccggtcctcggcgctcgcatccaaggcgacgggatacccgttggcgttcattgctgccaagatcgcgctgggcatcccccttcccgaaatcaaaaatgttgtctccggaaagacctcggcatgctttgaaccgagcctcgactacatggtcaccaaaatcccgagatgggacctggatcggtttcatggaacttcgtcgcgcataggatcaagcatgaagtccgtcggagaagtgatggcgatcggacggactttcgaggaatcattccagaaggctctgcgcatgtgccacccatccatcgagggctttaccccgcggctgcctatgaacaaggagtggccttcgaacctggacctccgtaaggagctgtccgaaccctccagcacgcggatctacgctattgctaaggccatcgacgataacatgtccttggacgaaattgagaagctgacctacatcgataagtggtttctgtacaagatgagagatatcctcaatatggaaaagactctgaagggacttaactcggaatccatgactgaagaaaccctgaagcgagccaaagaaatcggattctccgataagcagatttcaaagtgcctgggccttactgaggcgcagactcgcgaactgcggctcaaaaagaacatccatccctgggtcaagcagatcgataccttggccgccgaatacccaagcgtgacgaactacctctacgtcacttacaacggccaagagcacgacgtgaacttcgacgaccacggcatgatggtgctcgggtgcggaccgtaccatatcggtagctcggtggagtttgactggtgtgccgtctctagcatcaggacgctgcgccagctcggaaagaaaacggtggtggtgaactgtaatccggaaactgtgtcaaccgactttgacgaatgcgacaagctctacttcgaggaactctctttggagcgcattctggacatctatcatcaggaagcctgcggcggctgcatcatctccgtgggagggcagatccccaacaacctggccgtgccactctataagaatggagtcaagatcatgggaacttcgccattgcaaatcgaccgcgcagaggaccggtctatcttctcagcagtgctggacgagctgaaggtcgctcaggcaccttggaaggccgtgaacaccctgaatgaggcactggagtttgcgaagtcggtcgactacccatgccttcttcggccatcctacgtcttgtcgggcagcgcgatgaacgtggtgttcagcgaggacgaaatgaagaagttccttgaggaagcgactcgcgtctcccaggagcacccggttgtgcttactaaattcgttgagggtgcgcgcgaagttgaaatggatgctgtggggaaggacggacgggtaatctcgcacgcaatctcagaacatgtcgaagatgccggtgtccatagcggggacgcaaccctcatgctgccgacccagaccattagtcagggagccattgaaaaggtgaaggacgccactagaaagatcgctaaggccttcgctatctccggtccgttcaacgtccaattcctggtcaagggaaacgatgtgctcgtgatcgaatgcaacctccgcgcatcccgctcgtttcctttcgtgagcaagactttgggcgtggacttcatcgatgtggctaccaaagtgatgatcggagaaaatgtggatgaaaagcacctcccgactctggaccacccgatcatcccggccgattacgtggcaatcaaggctccgatgtttagctggcctcggctgcgagacgccgaccccatcctgaggtgtgagatggcttcgacgggtgaagtggcatgcttcggagaagggatccataccgccttccttaaggctatgctgtcgaccggattcaagatcccgcagaaaggaatcctgatcggtatccaacagtcattcagacctagatttctgggagtcgcggaacagctgcacaacgagggattcaaacttttcgcaaccgaagccacctccgactggctgaacgcgaacaatgtgccggccactccggtcgcctggccatcccaggagggacaaaatccatcgctctcaagcatcagaaaactgatccgcgacggttccatcgatctcgtgatcaatctccctaataacaatactaagttcgtccacgacaattacgtcatcaggcggaccgccgtggactcgggaattccactcctcactaacttccaggtgacgaagttgttcgctgaagcggtccagaaatcgcgcaaggttgactcgaagtcccttttccactacagacagtactcagcgggaaaggcggcc

SEQ ID NO: 8087 - DNA, 4500 bp, Artificial Sequence
  Description of Artificial Sequence: Synthetic coding sequence
atgactcggatcctgaccgcattcaaagtggtccggacccttaagacgggcttcggattcactaacgtgactgcccaccaaaagtggaagttctctcggcccggaatccggctgctctcagtgaaagcacaaactgcgcacatcgtgttggaggacggtaccaagatgaagggttactcgtttggacacccgtcctcagtcgctggagaggtcgtctttaacactggattgggaggataccctgaggccattacggatcctgcatataagggccagatcctgaccatggccaatcctatcatcggaaacggaggagctccagacactactgccctcgatgaactgggactgagcaaatacctggaatcaaatgggatcaaggtatccggactccttgtgctcgactactccaaggattacaatcactggctcgccaccaagagcctcgggcaatggctccaggaagagaaggtgccagccatttacggggtggatactaggatgctgaccaagattatccgcgacaagggcaccatgctgggtaaaatcgaattcgaggggcaaccagtggactttgtcgacccgaacaaacagaatctcattgccgaggtgtcaactaaggatgttaaagtttacggcaaaggtaacccaacgaaggtggtggcagtggactgcggaatcaagaataacgtcatcagactgctggtgaaacgcggcgcggaggtgcatcttgtcccctggaaccatgattttaccaagatggaatacgacggcatcctgatagctggtgggccgggcaacccggcgctcgctgaaccattgatccaaaatgtgagaaaaatcctggagagcgacaggaaggaaccgctctttggtatctccactggcaatttgattactggacttgccgccggcgccaagacctacaagatgagcatggctaaccgaggacagaaccagccagtgctgaatatcacgaacaagcaagccttcatcaccgcccagaaccacggatatgcacttgataataccctgccagccgggtggaaaccgctgtttgtgaacgtgaacgatcagaccaatgagggaatcatgcacgagtcaaagccgttcttcgcagtgcaattccacccggaggtcaccccgggacctatcgacactgaatacttgtttgattcatttttcagcctgatcaagaagggcaaggctaccaccattacctcggtgctcccgaagccggccctggttgcgagccgggtggaggtcagcaaagtgctgattcttggttcagggggcctgtccatcggccaagccggcgaattcgattactcgggctcccaagcggtgaaggctatgaaggaggaaaacgtgaaaactgtgctgatgaaccctaacatcgcctcggtccaaaccaacgaggtaggactgaaacaggcggacactgtgtacttcttgccaatcactcctcagttcgtgactgaggtcatcaaggcagagcagccagatggcctgatcctcggaatgggaggacagactgcgttgaattgcggcgtcgaactcttcaagcgcggcgtgctgaaggagtacggagtgaaagtactgggaacctcagtggaatcaattatggccactgaggacagacagctgttctcggataagctgaatgaaatcaacgaaaagatcgccccatccttcgcggtggaatcgatcgaagatgctctgaaggccgctgatactattggatacccagtcatgatccgctccgcctacgccttgggaggcctcggttcgggcatctgcccgaatagagagactttgatggacctctcgaccaaggcctttgcaatgactaaccaaatcctcgtcgagaagagcgtgaccggatggaaagagatcgagtatgaggtggtcagggacgcagatgacaactgcgtgactgtgtgcaacatggaaaacgtggacgctatgggcgtgcataccggagattccgtcgtggtcgcaccggcacaaaccctgagcaatgcagaattccaaatgctgagacgcacttccatcaatgtggtgcgccatctgggaatcgtcggagaatgcaatatccaattcgccttgcaccctacctctatggaatactgcatcatcgaggtcaatgcccgtttgtcgagaagctctgcactggcatcgaaagccaccggatacccgctcgcgttcatcgctgctaagatcgcgctgggtatccccctcccggagattaagaacgtggtgtccggcaagaccagcgcttgcttcgaaccgtcacttgactacatggtcactaagatcccaaggtgggacctcgaccggttccacggaaccagctcgcgcatcggcagcagcatgaaatcggtgggcgaagtgatggcgatcggacggacctttgaggagtccttccaaaaggccctgagaatgtgccacccgtcaatcgaaggattcaccccgagactccccatgaataaggaatggccgagcaacctggatctcagaaaggaactgtcagaaccttcctccacccgcatctacgccatcgctaaagctatcgatgataacatgtcactggacgaaatcgaaaagctgacgtacatcgacaagtggtttctctataagatgcgcgacatcctgaacatggaaaagacgctcaaaggtctgaattcggaatccatgaccgaggagactctcaagagagcaaaagaaatcggcttcagcgataaacagatcagcaagtgcctggggctgaccgaagcgcagacccgggaattgcgcctgaagaagaatattcatccttgggtgaagcagatcgacaccctggccgcggaatacccgtcggtgactaattacttgtacgtgacctataatgggcaggaacacgacgtcaacttcgacgatcacggaatgatggtcctgggctgcgggccctaccacatcggctcaagcgtggagttcgactggtgcgcggtcagcagcatccggaccctgcgccagcttgggaaaaagaccgtggtggtgaattgcaaccccgagactgtctctaccgatttcgacgagtgcgacaagctgtacttcgaggagctctcgctggagcgcatcctcgacatttatcatcaggaagcatgcggaggatgcatcatctctgtgggtggacagatcccgaacaatctggctgtcccgctgtacaagaacggggtgaaaatcatgggaacgtccccactgcaaattgacagagccgaagatcggtcgatcttctccgcggtgctggatgagctgaaggtggcacaagcgccatggaaggcagtgaacactctgaatgaagcactcgagttcgctaaatccgtggattacccgtgcctgctgcgtccaagctacgtgctctcgggatccgccatgaatgtggtgttctccgaggatgagatgaagaagttcctcgaagaagccacccgggtgtctcaggagcaccctgtcgtgctgacgaaattcgtggaaggggcgcgcgaagtggaaatggacgcggtgggcaaagacggcagagtcatttcccacgctatcagcgaacacgtggaggatgcgggagtgcatagcggagacgctacgcttatgcttccgactcagactatctcacaaggcgcgatcgagaaggtcaaggacgcaactcgcaagatcgccaaagcgtttgcaatctcaggaccgtttaacgtgcagttccttgtgaaagggaacgacgtgctcgtgatagaatgcaatctgcgcgcgtcgagatcttttcctttcgtgagcaagaccctcggagtggatttcatcgacgtggcgactaaagtgatgattggcgagaacgtggatgaaaagcatctcccaactctggaccacccgatcattcctgccgactacgtggccatcaaagcaccaatgttctcctggccgcggctgagagatgcggatccgatccttcggtgcgaaatggcgtcgactggggaagtggcctgcttcggtgaaggaatccatactgccttcttgaaagcaatgctctcaaccgggttcaaaattccgcagaaggggatcctcattggaatccagcagtccttccggccacgctttcttggagtggcagagcagctgcataacgaaggattcaaattgttcgcgaccgaggcgacttctgactggctcaatgccaacaatgtccctgcaactccggttgcttggccgtcgcaagaaggacaaaacccgagcttgtcgtcgatccgcaagctgatccgcgacggatcgattgacctggtgattaacctgccaaataacaataccaagttcgtccacgacaattatgtgatccggcggactgctgtggactcgggaatcccgctcctcactaacttccaagtcaccaaactgttcgcagaggccgtgcaaaagtcccgcaaggtggattcgaaatcgctgtttcactataggcagtacagcgcgggcaaggctgcg

SEQ ID NO: 8088 - DNA, 4500 bp, Artificial Sequence
  Description of Artificial Sequence: Synthetic coding sequence
atgaccagaatcttaacagcattcaaagtcgtcagaactctgaagactggatttggatttacaaacgtgacagcacatcaaaagtggaaattctctaggcccgggatcaggctactgagcgtcaaggctcagaccgctcacattgttctcgaagatggtacaaaaatgaaaggatactcgttcgggcacccctcatctgtcgcaggtgaggtggtgttcaacaccggactcgggggataccctgaggctataaccgatcctgcctacaagggccaaatccttactatggctaaccccatcatcggcaatggaggcgcgccagataccactgctctcgatgagttaggacttagtaagtatctcgaaagtaacggaatcaaggtgtctggcctcctggtccttgactactccaaagactacaaccactggctagcaacgaagtcgctgggtcagtggcttcaagaagagaaagtgcctgcaatctatggcgttgatacccggatgttaacgaagataatccgagacaagggtacaatgctgggtaaaattgaatttgagggccagccggtcgatttcgtggaccctaacaagcagaatctgatcgctgaggtgtctacaaaggacgtgaaagtttacggaaagggcaaccctaccaaagttgtggccgtggactgcgggatcaaaaacaacgtgatccgtctcctggtgaagcgtggcgccgaggtccacttggtgccgtggaatcacgatttcacaaaaatggagtatgacgggatccttattgctgggggccctggaaatcccgcacttgctgagccattgattcaaaacgttcggaaaatcctggagagtgataggaaagaaccattgtttggtatcagtaccggtaatctgatcacaggcctggccgccggcgccaaaacctacaagatgagtatggctaaccgagggcagaatcagcctgtgctgaacatcaccaacaaacaggcctttatcacagctcagaaccatggctacgctttggacaatacgctgcccgccggctggaagcctctctttgtgaatgtcaatgaccagaccaacgaagggatcatgcatgaatccaagccgtttttcgctgtgcaattccacccagaagtaacgccaggtcctatagataccgaatacctgtttgactcttttttctctctgataaagaaggggaaagctacaacaatcacctcagtgttgcccaagcccgctttagtagcgtccagggtcgaagtatccaaagttctcattttggggtctgggggcttgagcatcggccaggcaggcgaatttgactactctggaagccaagccgttaaagcaatgaaagaagaaaacgtaaagaccgtattaatgaatccgaacatagccagcgttcagactaacgaagttgggctcaaacaggccgatactgtgtatttcctcccaattacacctcaattcgtgacagaagtgataaaagcagaacaaccggacggactcatcctagggatgggaggtcagaccgcgcttaactgtggtgtggagctattcaaacgcggcgtgttgaaggaatatggcgtcaaagttctggggactagtgtagagtcgattatggccaccgaagatagacagctgttctccgacaaacttaatgaaattaatgaaaagatcgctccaagcttcgccgtcgagagtatcgaagatgccttaaaggccgctgacaccatcggctacccagtgatgatcagatctgcttacgccctgggtgggctgggctccggcatctgcccaaacagggaaactctgatggacctgagcactaaagccttcgctatgaccaaccaaatccttgttgaaaagagtgtcacgggttggaaggaaattgaatacgaagtggtccgggacgctgatgataactgcgtcaccgtgtgcaacatggagaacgtagacgcaatgggcgtacacactggcgactctgtagtggttgcaccggcccagacgctgtccaacgcggagttccaaatgctgcgcaggacctcaattaacgtggtcaggcacctcgggatcgtgggagagtgtaacatccaattcgctttacacccaactagcatggaatattgtatcatcgaagtgaacgctaggcttagcagaagcagcgcccttgcctctaaggccacgggatacccactcgcattcatcgctgcaaaaatagctcttggcattccacttccagagatcaagaatgtcgtgtctggaaaaacatcagcctgtttcgagccctctcttgattacatggtgacgaaaattccaagatgggacctcgacaggttccacgggaccagtagccggattggatcttctatgaagagcgtcggggaggtcatggcgatcggccgcacatttgaggagtccttccaaaaagctttacgaatgtgtcacccttcaatagagggcttcactcccaggcttccgatgaacaaagaatggccttcaaacctggatttaagaaaagagctctctgagccatcatccaccaggatttacgcaatcgcaaaagctatagatgacaacatgagcctggatgaaatcgaaaagcttacctatatcgataagtggttcctatacaagatgagggatatcctgaacatggagaaaaccctaaagggccttaactccgaaagcatgacagaggagaccctgaaaagagctaaggagataggcttctctgacaagcaaatttcaaaatgcctgggactaacagaagcgcaaactagagagttaaggctgaaaaaaaacattcacccgtgggttaaacagatagatacccttgccgccgaatacccgagtgtcactaactatttatacgtgacatacaacggacaagaacacgatgtcaacttcgacgatcacggtatgatggttttaggatgcggcccctaccacattggcagctcagtcgaattcgactggtgcgctgtatccagtattcggactctgaggcaactgggaaaaaaaacagtagtggttaactgcaatccagaaactgtctctacggattttgacgaatgcgataagctttatttcgaagagctctccctcgagaggatccttgacatctatcaccaggaggcttgtggaggctgtatcatttctgtaggaggccaaatccctaacaatttggctgtgcccttatacaaaaacggggtcaaaatcatgggcacctcccctctgcaaatcgaccgagccgaggaccggtctatattttccgccgttctggacgaattgaaggtggctcaggccccttggaaggctgtaaataccctgaacgaggctttagaatttgctaagagcgtcgattacccttgccttctcagaccaagttatgtattgtctggttcagctatgaatgtagtgttttcagaggatgaaatgaagaaattcttggaagaggcaacaagggtgagtcaggagcaccctgtggttcttactaaattcgttgagggggctcgggaagtggagatggacgccgttgggaaggatggacgcgttatctctcacgccatcagcgagcacgtcgaagacgcaggggttcacagcggtgacgccaccctcatgcttcctacccagactataagccagggagctattgaaaaagttaaggacgcaaccagaaagatagcaaaggccttcgctatctcagggccatttaacgtgcagttcctcgttaaggggaacgacgtgctggtgattgaatgcaatctgagagccagcaggtctttcccttttgtttcaaagacactcggagtggacttcatcgacgtcgccacaaaggtgatgataggcgagaacgttgatgagaaacatttgccaaccctggatcacccaatcattcctgcggactatgtagcaattaaggccccaatgttttcctggccaaggttgcgggacgccgatcctattcttaggtgcgagatggctagtacaggagaggtcgcctgctttggggagggcatacacacagccttcctgaaggccatgctctcaaccggttttaagatcccccagaagggcattttaatcggcattcagcaatccttcagaccgaggttcctgggcgtagcagagcagcttcataacgagggttttaagctgtttgcaactgaggctaccagcgattggctcaacgctaataacgtaccagctactccggtggcctggccttcccaggaaggtcagaacccgtccctcagcagcattagaaagttgatcagggacgggagcatcgatctggtgattaacctgcctaacaacaataccaaatttgtacatgataactacgtaattagacggaccgctgtggattccggtattcctttgctgactaatttccaagtcaccaagctttttgctgaagcggtgcagaagagtagaaaggttgacagcaaaagcctctttcactatcggcaatactctgcaggaaaagcagcg

SEQ ID NO: 8089 - DNA, 4500 bp, Artificial Sequence
  Description of Artificial Sequence: Synthetic coding sequence
atgacaagaatactgactgcctttaaagtcgtgagaaccctaaagactggcttcggctttaccaatgtgaccgcacatcagaagtggaaattttctaggccaggaatacgcttattaagcgtgaaagcccagaccgcccacatagttctggaggacggaactaaaatgaagggatattccttcggccacccctctagtgtggcaggggaagtggtgttcaacacagggcttggtggttatcccgaggcaatcacagacccagcctacaaaggacaaattcttaccatggccaacccgattatcggaaatggcggcgcccccgacacaaccgccttggatgaactgggcctctctaagtatctggagagcaacgggattaaagtatccggactcctggtgctagactacagtaaggattacaaccactggctggctactaagtctctgggacaatggctccaggaagagaaggtgcccgctatatatggtgtggacacacggatgttgaccaagattataagagacaagggcactatgctcggtaaaatcgagtttgagggacagccagtggactttgtggatcctaataaacaaaaccttatagctgaggtgtcaaccaaggatgtgaaggtgtatggaaaaggcaaccctaccaaggtagtggctgtggattgcggaattaagaacaacgtgatccgcctgttggtgaagagaggagcagaagtccacttggtgccatggaaccacgactttactaagatggaatatgatggcatcctaattgccggtggacccgggaatcctgcccttgctgaaccactcatccaaaacgtgaggaaaattctggagagcgataggaaggaaccgctatttggcattagtaccgggaatctgattacaggtctcgccgccggcgcgaagacctacaagatgagcatggctaaccgcggacagaatcagccagtccttaacataacaaacaagcaggctttcatcacagcccagaatcacgggtacgccctggataacactctgccagcgggctggaaacctcttttcgtgaatgtaaatgatcagaccaacgagggcatcatgcatgaatctaaaccattttttgccgtccagttccatccagaagtgactccagggcccatagatactgagtacttgtttgactccttcttcagccttatcaagaaaggcaaggctaccactatcacgtctgtgctgcccaagcccgcactggtcgcgagcagagtggaagtgtcaaaagttctgattttaggtagtggaggcttatcaatcggacaggccggcgaattcgattactcgggtagccaagccgtgaaggcaatgaaagaggagaacgtgaaaacagttctaatgaatcccaacatagcctccgtgcaaaccaacgaggtgggcttgaagcaggcagacaccgtgtattttctgccgatcacccctcagtttgtgacggaggtgattaaagccgagcagccagatggactaatccttgggatggggggccaaacagccttaaactgcggggtggagctttttaagaggggggtactcaaagaatatggcgttaaggttctaggaaccagtgtggaatctatcatggccactgaggaccgccagctgtttagtgataagctgaatgagattaatgaaaaaatcgctccatcgttcgcagttgaaagtatcgaggacgctctaaaggctgcagacacgattggttaccctgtgatgatccggagtgcatatgcactagggggcctcgggtcaggcatatgtcctaaccgagaaactttgatggacctgtccacaaaggctttcgccatgaccaaccaaatactcgtggaaaagtccgtcacaggctggaaggaaattgagtatgaggtagtgagagatgcggatgataattgcgtcacagtctgtaatatggagaacgtcgacgccatgggtgttcacactggggatagcgtggtggtagcccccgcccagaccctcagtaacgccgagttccagatgcttcgcaggacctccatcaacgtggtgaggcacctgggtatcgtcggtgagtgcaatatccagttcgctctgcatcctacttcaatggaatattgcataatcgaagtcaatgccaggctgagccggtcttccgccctagcatcaaaagctactgggtacccgctagctttcattgccgccaagattgccttagggatccccttacccgagatcaaaaatgttgtatccgggaaaaccagcgcatgttttgaaccctccctcgattatatggttactaaaatcccaagatgggatctggaccgattccacggaacaagctcaaggatcggctccagcatgaagagcgtgggtgaagttatggcgattggaaggacctttgaagagagttttcagaaagcccttcggatgtgccatccttctattgagggctttactcctcggctgccgatgaataaggagtggccctctaatttagacctcaggaaagagttgtccgaaccatccagcactcggatctacgctatcgccaaagccatagatgacaatatgagccttgatgagatcgagaagctgacttacattgacaagtggttcctgtacaagatgagagacatccttaacatggaaaagaccctgaaaggacttaattctgagtccatgaccgaggagacactaaagagggctaaggaaatagggttttctgataaacagatctctaagtgcttgggactgaccgaagcacagacccgcgagctgcgactgaagaaaaacattcatccctgggtcaagcagatcgatacccttgctgcagaatatccttccgtaactaactacctttatgtgacatataacggtcaagaacatgatgtgaactttgacgaccatggtatgatggtgttaggctgcgggccataccacatcgggtcaagtgttgagttcgactggtgcgctgtaagctcaataagaactcttagacagttggggaagaagacagtggtagtaaattgcaaccccgagacagtttcaaccgacttcgacgagtgcgacaagttgtacttcgaagagctctcactagagaggatattggatatctaccaccaagaagcctgtggcggctgtatcatatctgttggtgggcagattcccaacaacctggctgtacctctctacaagaatggcgtgaagatcatgggaactagccccctgcagatagaccgagctgaagatcggtccatcttttcagccgttctggacgagttgaaagtggcccaggctccctggaaggccgtcaacactcttaacgaagccctcgagttcgcgaagtccgtcgactatccatgcctcctgcggccttcctacgtgctgtcaggatccgccatgaatgtcgtgtttagtgaagatgagatgaagaagtttttagaagaagctacacgggtctcacaggaacacccagttgtgcttacaaaatttgtggaaggggctcgagaggtggagatggatgctgtgggtaaggacggcagggtcattagccatgcaatcagcgagcatgtagaggatgcaggcgtccactcaggcgatgcaactttaatgttaccgacccaaaccatctcccagggcgcgatcgaaaaggtgaaggacgctactcgtaagatcgctaaggctttcgctattagcgggccctttaacgtccagttcctcgtgaaaggcaacgacgtgctggtgatcgagtgcaatctgcgggccagccggtcctttccctttgtgagcaagacactgggtgtggattttatagatgtcgcaaccaaagtcatgataggagagaatgtggacgagaaacatttacccacgctcgaccatcctattattccagccgactatgtggccataaaagccccaatgttcagctggcctaggcttcgggacgccgaccctatactgaggtgtgaaatggcctcaaccggagaggtggcatgcttcggggagggcattcacacagcgttcttaaaagccatgctgtctactggtttcaagatcccacagaagggcatactgattgggattcagcagtcttttcgcccgcgctttctgggagtggcagagcagttgcacaatgaggggtttaagttatttgcaactgaggctaccagtgactggttaaacgcgaacaacgttcccgccacgcccgtggcttggccgagccaggaggggcagaacccctcactgtcaagtatcaggaagctgattcgggatgggtcaatagatctggttatcaaccttcccaataataacaccaagttcgtacacgacaattacgtgattaggcgcaccgctgtggactctggaattccgctcctcaccaattttcaggtcaccaagttgtttgccgaggccgtacagaaatccaggaaggtcgactctaagtcgctgtttcattaccgccagtactccgccgggaaggctgcc

SEQ ID NO: 8090 - DNA, 4500 bp, Artificial Sequence
  Description of Artificial Sequence: Synthetic coding sequence
atgactcgtattctgactgcattcaaggtggtgcgcaccctgaaaaccgggttcggatttacgaacgtgaccgcacaccagaagtggaagttttccagacctggtattcggctcctttccgtaaaggcacagaccgcacacattgtgctcgaggatggtactaagatgaagggctattccttcggacatccctcgtcggtggcgggcgaggtcgtctttaacactggtcttggaggataccccgaagccattaccgatccggcctacaaggggcaaatccttactatggctaatcccataatcggaaacggaggggctcccgatactaccgcactggatgaactgggcctttcgaaatacctcgagagcaacggcatcaaagtcagcggactgcttgtgcttgactactcaaaggattacaaccattggctggcaaccaagtcactgggacaatggcttcaggaggaaaaagtgccagcaatctacggagtcgacaccagaatgcttacgaagattattcgagataagggtaccatgctcggcaagattgagtttgaaggacaacccgttgattttgtggatcctaataagcagaacctgattgcagaggtgagcactaaggatgttaaggtctacggcaagggaaatcctacgaaagtggtggcagtagactgtggcattaagaataatgtcattcgcctcctggtgaaaaggggcgctgaagtccacctggtgccttggaatcatgattttaccaaaatggaatacgacgggattctcattgcaggtggtcccgggaacccagctcttgccgaaccacttattcagaacgtccgaaagatacttgaatcggacaggaaggaacccctttttggaatatcgacgggcaacttgatcactggcctcgcagcaggagccaaaacttacaaaatgtccatggccaatagaggtcagaaccaacctgtgctgaatatcaccaataagcaggctttcataactgcgcagaaccatggttacgcactggataatacccttccagcgggttggaagcctctttttgtcaacgtcaacgaccagaccaatgaaggaattatgcatgagtcgaagccattctttgcagtgcaattccatcccgaggtgacgcctgggccaattgacacggaatacttgtttgactcgttcttctccctgatcaagaagggtaaagccactactatcactagcgtcctccccaagccggcacttgtggcatcgcgcgtggaagtctcgaaggtgcttattctggggtcaggcggactgagcattggtcaagcaggagagttcgattactcaggatcacaagcagtgaaggcgatgaaggaggaaaacgtgaaaactgtgcttatgaacccaaacatcgcctcagtccaaactaatgaggtcgggttgaaacaagcggatactgtgtacttcctgcctattaccccacaattcgtgaccgaagtgattaaggcagaacaacctgatggccttatccttggaatgggagggcaaacggcattgaactgcggcgtggagctgtttaaacggggtgtgcttaaggagtacggcgtgaaggtccttgggacctccgtggaatcgatcatggcaaccgaggacagacagcttttttccgataagttgaatgagatcaacgaaaagatagccccttcgttcgcggtggaatccatcgaggacgcacttaaggcggctgataccattggatacccggtgatgatccggtccgcctatgcgcttggggggctgggatccggaatctgtccgaatagggaaaccctcatggacctctcgactaaagcatttgcaatgacgaaccagatccttgtggaaaagtccgtgactggatggaaggaaatcgaatatgaagtggtgcgagatgccgacgacaattgtgtgaccgtatgtaacatggaaaatgtcgatgcaatgggcgtccatactggagattccgtggtagtggcgccagcccagaccctgtcgaatgcagaattccaaatgctgcgaagaacctcgattaatgtggtgagacacctgggaattgtgggtgaatgcaatatccaatttgcacttcatcctacttcaatggagtactgcattattgaagtcaacgcacggttgagccggtcatctgcactggcgagcaaggccacgggataccctctcgcatttatcgcagctaaaatcgctctggggattcccctgcccgagattaagaatgtggtgtccggtaagacctcagcctgttttgaaccttcgctggattacatggttacgaagataccacgctgggatctcgatagatttcatgggacttcgagtagaattggctcttccatgaagtccgtaggagaggttatggcaatcggtagaacttttgaggaatcgttccaaaaagcgcttaggatgtgtcatccctccattgagggttttaccccaagactcccaatgaataaggaatggccatcgaatcttgacctgcgaaaggagttgagcgaacctagctcgactcggatttacgctattgcaaaagcaattgatgacaatatgtcgctggatgaaatcgaaaaacttacttacatcgataagtggtttctctacaagatgcgtgatatactcaacatggaaaagactcttaaagggctgaacagtgaatccatgaccgaagaaaccctcaaaagggccaaggagattggattttcagataagcagatttcaaagtgtcttggactgaccgaagctcagaccagggaactgcgcctgaagaagaacatccatccatgggtcaaacaaatcgacacgcttgccgctgaatacccttcggtgactaattacctttacgtgacttacaacggacaagaacatgatgtcaactttgatgatcacggtatgatggtactgggctgtggaccataccatattggttctagcgtcgaatttgattggtgcgctgtgtccagcatccgcactttgagacagctgggaaaaaagactgtcgtcgtcaactgtaaccctgaaactgtgtccaccgacttcgatgaatgcgataagctgtactttgaagaattgagcttggaacggatcctggacatttatcaccaagaagcatgtggagggtgcattatcagcgtgggaggtcaaattcccaacaatctcgcagtgccgctgtacaagaacggagttaagattatgggcaccagccctctccaaattgatcgtgcagaagatcgctcaatcttttcggccgtgctggacgagcttaaggtggcgcaggccccttggaaggctgtgaacaccctcaatgaggccctggaatttgcaaagagcgtggattacccatgtctgctgcggccaagctacgtcctttcagggtccgcgatgaatgtcgtctttagcgaagatgaaatgaagaaatttctcgaggaagccacccgcgtatctcaagagcatccagtggtcctgaccaagtttgtcgagggggcgcgtgaagtcgaaatggacgcagtgggtaaggacggacgcgtcatttcccacgctatctcagagcacgtggaggatgccggagtccattccggcgacgccactcttatgcttcctacccagaccatttcacaaggagcaatcgagaaggtgaaggatgcaactcgcaagatcgccaaggcgtttgccatatcaggcccttttaacgtgcagttcctcgtgaagggtaacgatgtcctggtgatcgaatgtaaccttagagcaagcaggtccttccctttcgtgtccaagacccttggtgtggacttcattgacgttgcaaccaaagtgatgatcggggagaacgtggatgaaaaacatctgcctacccttgaccaccccataattcccgcagactacgtggcgattaaggcccctatgttttcgtggcctaggctgcgcgatgctgatcctatactcagatgcgagatggcgtccaccggagaagttgcttgtttcggagaggggattcacactgcatttctcaaagcaatgcttagcaccggtttcaaaatacctcaaaaaggtattctgattggaatacaacaatcattccggccaagatttttgggtgttgcagaacagctgcataacgaaggattcaaactctttgcaaccgaagctactagcgactggcttaacgccaacaacgtgccagcaactcctgtggcatggccaagccaggagggtcagaatccatccctttcgtccataagaaagctcattcgggatggttcaattgacctggtcatcaacttgcctaataacaacaccaaatttgtccacgacaattatgtgatacgtcggactgcagtggattccggtatcccacttctgaccaattttcaggtgaccaaacttttcgcagaggcagtgcagaagtcgcgcaaagtggatagcaagtcgctgttccattaccgacaatactcggcaggcaaggcagcg

SEQ ID NO: 8091 - DNA, 4500 bp, Artificial Sequence
  Description of Artificial Sequence: Synthetic coding sequence
atgactagaatactgactgcattcaaagtagtgcgcacactgaagaccggctttgggttcacaaatgtcactgcccatcagaagtggaagttttctagacccggaatcaggctgctgagtgtcaaggcacaaacggcacacatagtgttggaggatggtaccaagatgaagggatactcattcggccacccatcctctgtggctggagaagttgtgttcaacactgggctgggaggctacccagaagccattaccgacccagcctataaaggtcagatcctgaccatggctaaccctatcatcgggaacggtggcgctcccgacaccacagccctggatgagctgggtttaagcaaatatctagagagcaacgggattaaagtgagtggactgctggtattggattactccaaagattataatcattggcttgcgacaaagtcacttggccaatggcttcaagaggagaaggttccagctatctacggggtagacacaaggatgctcacaaaaatcatccgggacaaaggaacgatgctgggaaagatagaattcgagggacagccagttgacttcgtcgacccaaacaagcagaacctgatcgccgaggtgagcaccaaggacgtaaaggtgtatggtaagggaaaccccacgaaagtggttgcagtggattgtgggattaaaaacaacgtcattcggctgctagttaaacgcggtgctgaggtgcacctggtgccctggaaccatgatttcaccaaaatggaatacgacggcatacttattgccggtggtcctggcaacccagccctggccgagccactgatccagaacgtgcgcaagatcctggaatccgaccggaaagaacctctcttcggaataagcaccgggaacctgataacaggcctggccgccggagctaaaacttataagatgagcatggctaatcggggccagaatcagccagtgctgaacataacaaataagcaggcttttatcacagcccaaaaccatggatacgcactggataacactctccccgctggctggaagcctctattcgtgaacgtcaacgaccagacaaatgagggcattatgcacgaatcaaaacccttttttgccgtccagttccaccccgaggtcactccaggtccgattgacacagagtatctgtttgactccttcttctctctaataaaaaagggaaaagctacaaccatcacctccgtgttgccaaaacctgccctggtggcctcccgggtcgaagtctctaaagttctgatcctaggatcaggcggcttgagcattggccaggctggcgaattcgactactccggaagccaagccgtcaaagccatgaaagaagagaacgtaaagacagtcctaatgaaccccaatatcgcttccgtgcagacaaacgaggtgggcttgaaacaggcggatacagtgtattttttgccaattaccccgcagtttgtgacagaggtcattaaggccgagcagcctgatggattgatattaggcatgggaggccagaccgccctgaactgtggggtggagctgtttaagcgaggagtactgaaggaatacggagtgaaagtcttgggaaccagcgtggaaagtataatggccactgaggaccggcagctgttctccgacaaactgaatgagattaatgagaagatagcaccatctttcgcggtcgagtcaatcgaggatgctctcaaggccgccgacactataggctaccccgtgatgattcgtagtgcctatgcgcttggtggcctgggatccgggatatgccccaaccgcgaaaccctgatggacttatccaccaaagctttcgcaatgacaaaccagattctggtggagaagtcagtgaccgggtggaaagagatagaatatgaagtggtgcgagatgcagacgataattgcgtaacagtgtgcaacatggaaaacgtggacgctatgggggtgcacacgggcgactcagtggtagtggctccggctcagactctatcaaatgcggagttccagatgctgcgccgcacttccattaacgtggttagacacctgggaattgtgggtgagtgcaatattcagttcgccctccatcctacatcaatggagtactgcatcatcgaggtcaatgcaaggctttctaggagctcggctcttgcctccaaggcgaccggttacccattagccttcatcgccgccaagatagcactggggattcctctgccagaaattaagaatgtcgtgtccggaaagaccagcgcatgttttgagccctcgctcgactacatggtgacgaagatacctaggtgggatttagacaggtttcacggtacaagctcccgaatcggctcttcaatgaaaagcgttggcgaggtaatggcgatcggccgcacctttgaagagtcctttcagaaggcgctgcgaatgtgccacccctctatcgaaggcttcaccccccggcttccgatgaacaaggagtggccttctaacctggatctccgaaaggaactgtccgagccttccagtaccagaatatatgccatcgcgaaagctatcgatgataacatgtccctggatgaaatagaaaaactgacttacatcgacaagtggttcctgtataagatgcgggatattctcaatatggaaaagactctcaagggtttgaatagcgagtcaatgaccgaggagacccttaagagggccaaggaaataggttttagcgacaagcagatttcaaaatgccttggactcactgaagcacagacacgggagctgagacttaagaagaacattcatccatgggtcaaacagatagataccctcgccgctgagtacccgtccgtgaccaattatttgtatgtcacctataatggacaggagcatgacgtcaattttgatgaccacggaatgatggtgctgggttgcgggccgtaccatattggctcttctgtggaatttgattggtgcgcagtatcatccatacgtaccttacggcagttgggtaagaagacagtggtggtgaattgtaatcctgagacagtgtccaccgatttcgacgagtgtgacaagctctattttgaggagttatccctggagcgaatcctagacatctaccaccaggaggcatgcggaggctgtattatttccgtgggcggccagattccaaacaatcttgcagttcccctctataaaaacggagtcaaaatcatggggacatccccattacagattgatcgcgcggaagaccgctctatcttttccgcagtgttggatgagctgaaggtggcccaagccccttggaaggccgtcaacactttgaatgaggccttagaattcgcgaagtccgtggattacccctgcctactgcgcccctcctacgtattatccggttccgctatgaacgtggtgtttagtgaggatgagatgaagaaattcttagaggaggccactcgggtttcacaggagcaccccgtcgtgttaactaagtttgtggagggagcacgcgaagtagaaatggacgccgtaggcaaggacgggagagtcatctcacacgccatatctgaacacgtggaggacgccggcgtgcactctggtgatgcaacactgatgctgccaacgcagaccatcagtcagggcgcgatagagaaggttaaggatgctacaagaaaaattgcaaaggcgtttgcgatttcaggtcctttcaatgtccagttcctggtcaagggcaacgatgtccttgtgatcgaatgtaatctgagagcatcgcgctcattccctttcgtgagcaaaacgttgggggtcgacttcatcgatgtggcaacgaaagtcatgattggggaaaatgtcgatgagaaacatttaccgacccttgatcacccgattatccctgcggactatgtcgctatcaaagctcctatgttcagctggccacggctccgcgacgcagatccaatcctccgatgcgaaatggcatccaccggggaagtcgcatgcttcggagaagggattcacactgcttttctgaaagctatgctgagtaccgggttcaaaatcccgcagaagggcattctcatcggaatacaacagtcttttcggccccgcttcctaggagtcgctgagcaactgcacaatgaaggcttcaagttattcgccactgaggccacttcagactggctcaacgctaataatgttcccgccactcctgtggcttggccgtcccaggagggccagaaccccagcctttcttcaatccgaaaactcatccgtgatggatccattgatcttgtgatcaacctcccaaataacaatacaaagtttgtgcacgacaactatgtaattcgccggaccgcagtcgattccggcataccattactgactaatttccaggtgacaaaactctttgcagaggcagttcaaaagagcagaaaggtggatagcaagtcattattccactatagacagtattccgctgggaaagccgcc

SEQ ID NO: 8092 - DNA, 4500 bp, Artificial Sequence
  Description of Artificial Sequence: Synthetic coding sequence
atgactcgcattttgactgccttcaaggtagtacgtactctgaagacaggtttcggttttactaatgtcactgctcatcaaaagtggaaattctctaggccaggtatccgtttgctctctgtgaaggcccagaccgcacacattgttcttgaggacggcactaagatgaaaggttacagctttggacacccctcctcagtggccggagaagtggtatttaacactggcctcggtggataccctgaggcaattactgaccctgcctacaaaggtcagatcctgaccatggctaacccaattattggaaacggaggcgcacctgacactactgctctggatgaattgggtttgtcaaagtatcttgagtctaacggcataaaggtttctggtcttcttgtactggactactcaaaggattacaaccactggttggctactaagagcctgggccagtggctgcaagaggagaaagtccccgccatctatggcgtggacacccgtatgctgaccaagatcatccgcgataagggaactatgctgggcaagattgagtttgagggacaaccagtggacttcgtcgaccccaataagcaaaaccttatcgccgaagtgtccactaaagacgtaaaggtttacggcaagggcaacccaaccaaagtggtcgccgtagactgcggcatcaagaacaacgtcattagattgctcgtgaagcgtggcgccgaagtgcaccttgtgccatggaatcatgactttaccaagatggagtatgacggaattctgattgccggaggccctggcaacccagcactggctgaacccctgatacagaacgtgcgtaagatccttgagtcagataggaaggagcctctcttcggtattagtaccggcaacctcattaccggactcgctgccggagctaaaacttacaaaatgtctatggccaaccgcggtcaaaaccagcccgtgcttaatatcactaacaagcaagctttcataacagctcaaaaccacggttacgccctcgacaatactctgccagccggttggaaaccactgttcgtcaatgtgaacgatcagaccaacgagggaatcatgcacgaatcaaagcctttcttcgctgtccagttccaccctgaggtgacacccggtcctatcgacactgagtacctcttcgactcctttttctccctcataaaaaagggtaaggctacaacaatcacaagcgtgctccccaaacccgctcttgtggcttccagggtcgaggtcagcaaggtgttgattctcggatccggtggactctcaattggacaggcaggagagttcgattactccggctcacaggctgtaaaggccatgaaggaggagaatgtcaagactgtgctgatgaacccaaatattgcatctgtgcaaacaaatgaagtcggcctcaagcaggctgataccgtgtatttcctcccaatcacacctcagtttgtcacagaggtgatcaaagctgagcagccagatggtctgattctgggtatgggcggacaaaccgctctgaactgcggagtggaactctttaaaaggggcgtgctgaaggagtacggcgtgaaggtcctgggcacatctgtggaatctattatggcaaccgaggaccgtcagttgttctcagacaaactcaacgaaatcaatgaaaaaatcgccccttccttcgcagtcgagtccattgaagacgcacttaaggccgcagacaccattggctatcccgttatgatccgttctgcctatgccctgggaggactgggtagcggcatttgtccaaacagggaaacattgatggacctgtctaccaaagcttttgccatgacaaaccagatcctcgtggaaaagtctgtcactggttggaaggagattgaatatgaggtggtacgcgatgctgacgacaattgcgtcactgtctgcaacatggagaatgttgacgctatgggcgttcacactggtgatagtgtagtggtggctccagcccagaccttgtccaatgctgaattccagatgcttagacgcacctcaatcaacgtggtacgtcacctcggtatcgttggtgaatgcaatattcagtttgctttgcatcctacttctatggagtactgtatcattgaggtgaacgctcgtctgtctaggtcaagtgccctcgctagcaaggctaccggttaccccctcgcttttattgctgccaagatcgctctgggaatccccttgcccgagataaagaacgtggtctccggcaagacctctgcctgtttcgagccttctctggactacatggtgacaaagattccccgctgggatctggatagattccacggaactagctcacgcattggatctagtatgaagagtgttggcgaagtcatggccatcggtcgcactttcgaggagagcttccagaaggctctgcgcatgtgtcacccatccatcgaaggattcactccacgcctgccaatgaacaaagagtggccctccaacttggacctcaggaaagagctgagtgaaccctcctccacccgcatttacgctatcgctaaggccatcgatgacaacatgtccctggacgaaatcgaaaagctgacctacattgataaatggtttctttacaagatgcgtgacatactgaatatggagaagaccttgaagggtttgaatagcgaatccatgaccgaagaaaccctgaaacgcgcaaaggaaatcggcttctccgacaagcaaattagtaagtgtttgggtctgacagaggcccaaactcgtgaacttcgtctgaaaaagaatattcacccctgggtcaagcaaattgacaccttggccgctgagtatcctagcgtcaccaactacctgtacgtgacttacaacggacaggagcatgatgtgaatttcgatgaccacggtatgatggttctgggttgtggtccctatcacatcggttctagcgtggagttcgactggtgcgctgtatcaagcatcagaaccctgagacaactgggcaagaagacagttgttgtgaattgcaatccagaaactgtgtctactgactttgatgaatgcgacaagctttattttgaagagctttccctggagaggatcctcgacatctaccaccaggaggcctgtggaggatgcatcattagtgtaggcggccagatacccaataatcttgctgtccctctttacaagaacggtgtgaaaatcatgggtacttcaccactccagatagacagggccgaggaccgttccatcttctccgcagtgctcgacgagctgaaggtcgcccaagccccatggaaagcagtgaacaccctcaacgaggctttggagttcgcaaaatccgtggattacccctgtctgctccgccccagctatgttcttagcggttcagctatgaacgtcgtattctccgaggatgaaatgaaaaagttcctggaggaggctaccagagtgagtcaggaacatcccgtggtgcttacaaagttcgtcgaaggagctagggaggttgagatggacgctgttggcaaggacggaagagtcatctctcatgctatatccgagcatgtggaagacgctggtgtccactcaggtgatgctaccctgatgctccctacacaaactatttctcaaggtgctatcgaaaaagtcaaggatgctacacgcaaaatcgcaaaggcttttgcaatctccggtcctttcaatgttcagtttcttgtcaaaggaaatgacgtgctcgttatcgagtgcaacctgcgcgccagtaggtctttcccctttgtgagcaaaaccctgggtgtagatttcattgacgttgcaaccaaagtgatgatcggcgaaaacgtcgacgaaaagcaccttccaacactggatcatccaatcattcctgctgattacgtcgctatcaaggcccctatgttctcctggcctagattgagggacgctgaccctattttgcgttgtgagatggcctccactggagaagtggcctgcttcggcgagggtatccacacagccttcttgaaagcaatgttgtccacaggatttaagatcccccaaaagggtattctgattggaatccaacaatccttccgtcccaggttcctgggcgtcgcagagcaacttcacaatgagggcttcaagttgttcgcaactgaagcaacctctgattggctgaacgccaacaacgtcccagctactccagttgcatggccctcccaagagggacagaacccttctttgtcatctatcagaaagctgatacgtgacggtagcatcgacctggttattaacctgccaaataataataccaaattcgtgcacgataactacgtgattaggaggacagcagtagactctggcattccactgctgactaactttcaggttaccaaactcttcgcagaagccgttcagaaaagccgcaaggtggattctaagagtctgttccactataggcagtactccgccggaaaagcagca

SEQ ID NO: 8093 - DNA, 4500 bp, Artificial Sequence
  Description of Artificial Sequence: Synthetic coding sequence
atgacccgcattcttactgccttcaaggtcgtacgtaccctgaagactggatttggttttaccaacgtcaccgcccaccagaagtggaagttctcccgccccggcattagacttctcagcgtcaaagcccagaccgcccacatcgtcctggaggacggcactaagatgaagggttattccttcggtcatccatcaagcgtcgccggcgaggtggtcttcaacacaggactcggcggctaccccgaggccattaccgaccctgcttataagggacagatacttactatggccaatccaatcattggtaatggtggtgccccggatacaactgccctggacgagctcggtctgtctaagtacctggagtcaaatggaattaaggtgtccggtttgctagtgctggattacagtaaggattacaaccattggctggcgaccaaatctctcggccaatggctgcaagaggagaaggtcccggctatctacggtgtcgacacgcgaatgctgaccaagatcattcgcgataagggtaccatgctcggcaagatcgagtttgagggccaacccgtcgatttcgtcgaccctaacaaacagaaccttatagccgaggtgtctaccaaagacgtcaaggtctacggtaagggcaaccctaccaaggtggtcgcagttgactgcgggatcaagaataatgtgattcgcctactggtgaaacggggagctgaggtgcacctggtcccttggaaccacgacttcactaagatggagtacgacggaattcttattgcaggcggacccggtaaccctgccttggcggaacccctcatccagaacgtgagaaagattctagagtctgatcgcaaggagcccctgtttggcattagcacgggtaacctcattacgggtctcgccgccggcgccaagacgtacaaaatgtcgatggcaaaccgtggtcagaaccagccagtcctcaatataacgaacaagcaggcgttcatcactgcccagaatcacggctacgcactggacaacaccctgcctgcaggctggaaacctctgttcgtcaacgtgaacgatcaaaccaacgaaggcattatgcacgaatctaaaccgttcttcgcggtccagttccacccggaggtcacgccgggtcccatcgatacggagtatttgtttgattcgttcttttcccttattaagaaaggcaaggctactacgatcacgtcggtcctaccaaagccggcccttgttgcttctcgcgttgaggtgagcaaggtcctgattctcggctccggcggtctgagtattggtcaggcgggagaattcgactacagtggtagccaggccgtcaaagctatgaaggaggagaacgtcaagaccgtcctgatgaacccgaacatcgcctccgtccagacgaatgaggttggattaaagcaggccgacactgtctattttctacccattactcctcagtttgtcaccgaggtgattaaggctgagcagcctgatggactgattcttggcatgggcggtcagacggcattgaactgcggggtggaattgttcaaacggggtgtgctgaaggagtatggcgttaaagttttgggcacaagcgtggagtccataatggccacagaggacagacaactcttctctgataagctgaatgagataaacgaaaagattgctccttctttcgctgtggagtccattgaggacgccctgaaggctgccgacacgattggttaccctgtcatgatccgttcagcctacgcgttgggtggtttgggatccggtatatgtccaaaccgtgaaacgttgatggatttgtcgacaaaggccttcgcaatgaccaatcagatcctagtcgagaagagtgttaccggttggaaggagatagagtacgaggtcgtgcgcgacgctgacgataactgtgtcaccgtctgcaacatggaaaatgttgacgccatgggcgtgcacactggtgattctgtggtcgtggcgcccgctcagaccctaagcaacgcagagtttcagatgctccgccgcacatctatcaacgtagtccgccacctcggaatcgtgggtgagtgcaacattcagttcgctctccacccgactagcatggagtactgcatcattgaggtcaatgcccgtttatcccgttcttctgctttggcgtccaaggctacgggctatccgcttgctttcattgcggcgaagatcgccctcggcatccctctgcccgagattaagaatgtcgtttcgggtaagaccagtgcttgtttcgagccctctttggattacatggtgaccaagatcccccgctgggatttggaccggttccatggcacctcaagcagaatcggatcgtccatgaagagcgtcggcgaagtcatggcaattggtaggacctttgaagaaagtttccaaaaggcacttcgcatgtgccacccgagcattgagggttttactcctcgtttaccgatgaataaggagtggccgagcaacctggatcttcgtaaggagctgtccgagccctcctcaactcgaatctatgctattgcgaaggccatcgacgacaatatgtcgcttgacgagatcgaaaagctcacatacatcgacaagtggttcctctacaaaatgcgcgatattttgaatatggagaagacccttaaggggctcaacagcgagagcatgaccgaggagacactcaagcgtgctaaggagatcggtttctccgacaaacagatctctaagtgccttggtctcaccgaggcgcagactcgtgagcttcgcctgaagaagaacatccacccctgggtcaagcagatcgacaccctggccgcagaatatccctctgttactaactacctgtacgtgacatacaacggtcaagagcacgacgtgaacttcgatgaccacggtatgatggtgctgggttgcggaccgtatcatatcggaagttcggtcgaattcgattggtgtgcggtgagctctatcagaacccttcgccagctcggcaagaagaccgtcgtcgtcaactgcaaccccgaaaccgtgtcgaccgacttcgatgagtgcgataagctttatttcgaggaactctcgctcgaacgaatcctcgacatttaccaccaggaggcctgtggcggctgcatcatttctgttggaggacagatccctaacaatctggccgtgccactctataagaacggcgtgaaaatcatgggcacctctcctcttcaaatcgatcgtgcagaggaccgatcaatctttagcgccgtcctcgatgagctaaaagttgcacaagccccctggaaggcggttaacactctgaatgaggctctggaattcgccaaatccgtggattatccctgcctcctgcgtcctagttacgtcttgtcgggttcggcgatgaacgttgtcttcagcgaagacgagatgaagaagttcctggaggaggctactcgtgtctctcaagagcatcccgtcgtcctgaccaaattcgtggagggcgcccgcgaggtggagatggatgccgtaggtaaggacggacgcgttatttcgcacgctatttccgagcatgttgaggacgccggcgtccactctggtgatgccaccctgatgctccccacccagacaatttcgcagggagctatcgagaaagttaaggacgctacccgcaagattgcgaaggcgttcgccatctccggacccttcaacgtacagttcctcgttaaggggaacgacgtactggtcatcgagtgtaacctgagagcctccaggtcattccctttcgtcagcaagaccctgggggtcgactttattgatgtggccactaaggtcatgattggggaaaacgtcgatgagaagcacctcccgacccttgaccaccccatcattcccgcggattacgtcgccatcaaggcacctatgttctcgtggccccgcctgcgtgacgcggatccgatcctccgctgcgagatggcctcgaccggcgaggtagcgtgtttcggtgaaggtatccacaccgctttccttaaggcaatgctgagcactggcttcaaaatcccgcagaagggcatcctcattggcatccagcagagcttcaggccccgcttcttgggtgtggctgaacagttgcataacgagggtttcaagctctttgctactgaggccacgagtgactggctcaatgctaacaacgtgccggccacccccgtcgcctggcccagtcaggaaggccaaaatccttccctctcatcaatcaggaaacttatccgcgatggttcgattgatctcgtgatcaacctgcccaacaataacaccaaatttgtgcacgacaactatgtcatccgtcgcacggccgtcgactccggcatccccttgttgaccaacttccaagtcacaaagctgttcgccgaagctgtccagaaatcacgtaaggtggatagcaagagcttgttccactatcgccagtattccgccggcaaggcagca

SEQ ID NO: 8094 - DNA, 4500 bp, Artificial Sequence
  Description of Artificial Sequence: Synthetic coding sequence
atgacacgcatcctgaccgcttttaaagtggtcaggacactgaaaacaggattcggctttacaaatgttacagcccaccagaagtggaaattttcgcgtcctgggataaggctgctgtcggtgaaggctcaaacagcccacattgtattggaggacgggaccaaaatgaagggatactcattcggacacccttcatccgtagctggcgaggttgtctttaacacgggcctgggggggtatcctgaagcgatcactgatcccgcatataagggacagatactgaccatggcgaacccgataatagggaatggaggcgcaccagacaccactgcccttgatgagctagggttgagtaagtacctggaatccaacggcattaaagtctcaggcctcctcgtcctcgattacagcaaggactataatcactggctcgccacaaagagtctcggacagtggctacaggaggaaaaggttccagccatttatggtgtcgacacccgcatgctgaccaagattattagagataaggggacaatgttagggaaaatcgaattcgaggggcagccagttgactttgtcgaccccaataagcagaatttaattgctgaggttagtacaaaagatgtaaaggtttacggaaagggaaatcctactaaagtcgttgccgtcgattgcggtatcaagaacaatgtcatccgtcttctcgtgaagagaggagctgaggttcacttggtgccttggaaccatgattttacaaaaatggagtacgacggcatcctcatcgcgggcgggcccggaaatccagccttggccgagcctctaatccagaacgtgagaaaaatcctggagtccgatcggaaagagcccttgttcgggatcagcaccgggaacctcatcactggattggccgccggtgccaagacctacaagatgtccatggccaatcggggccagaatcagccagtacttaatatcaccaacaaacaggcttttataaccgcacagaaccatggctacgcactggataacacgctgcctgccgggtggaaaccgctgttcgtgaacgttaatgatcagaccaacgagggcatcatgcatgagagcaaacccttctttgccgtgcagttccaccctgaggtaacaccagggcccatagacacagaatatctcttcgacagtttcttttctttgattaaaaagggcaaggctaccacgatcacaagcgtgctcccgaagcccgcactcgtggcgtcccgcgtagaggtgtctaaggtgctgattttgggctcgggaggcttgagcatcggccaagccggcgagtttgattacagcggttctcaagccgttaaggctatgaaagaggagaacgtcaagactgtgctgatgaatcctaacattgcaagcgtgcagaccaacgaagtgggactgaagcaggccgacacggtgtactttcttccaattaccccgcagtttgtgactgaagtgattaaggctgagcagcccgacggcctgatcctcggcatgggtgggcaaactgcactaaattgtggggtcgagctcttcaagcggggggtgttgaaggaatacggagtgaaagtgctgggaacatccgttgagagtattatggccaccgaggatagacagctcttttcagacaaactgaatgagatcaacgaaaaaatcgctccatcttttgccgtggaaagtattgaggatgccctaaaggctgccgatacaataggttaccctgtaatgattaggagcgcatatgccctgggcgggctgggatcaggcatttgcccaaatcgcgaaactctgatggacctgtccacaaaggcattcgcaatgacgaatcaaatcctggttgagaaatcagttaccggttggaaggaaattgagtatgaagtagtccgggatgccgacgacaattgtgtaacggtgtgcaatatggagaatgttgatgctatgggcgtgcacactggggatagcgttgtagttgctcctgcccaaacgctttccaacgctgagtttcagatgctcaggcgcacaagcataaacgtggtgaggcaccttggcatcgtgggggaatgcaacatccagttcgccctgcaccctacatccatggaatactgcattatcgaagtgaacgctagactgtcgcgaagcagtgccttagcgtcgaaagccaccggctaccctctggcgtttatagctgccaaaatcgctctgggcatcccacttcctgaaattaagaatgtcgtgagcggcaaaacatcagcatgttttgagccatccctggattacatggtgaccaagattccgagatgggatctggaccgctttcacgggacttcctctaggatcggctcttctatgaaatccgtgggcgaggtcatggctatcgggcggacatttgaggagtccttccagaaggcacttaggatgtgccacccctccatcgagggcttcaccccacgtctacctatgaataaagagtggccatccaatttggacctccggaaagagctgagcgaaccctcctccacccggatttacgcgattgccaaggccatcgacgataacatgagcttagacgaaatcgagaagctgacatacatcgataaatggtttctctacaagatgagggatattctaaatatggaaaaaaccctgaagggcttgaattctgagtcaatgaccgaggagacgctcaaacgtgcaaaggagataggtttctcggacaagcagatcagtaagtgcttgggtttgacggaggctcagactagagaactgaggcttaaaaaaaatatacatccctgggtgaaacagatcgatactttagctgctgagtatcctagcgttactaattacttgtacgtgacctataacgggcaggaacacgacgtcaattttgacgaccatggcatgatggtgctgggctgcggcccctatcatatcggtagttctgtagagttcgattggtgtgcagtgtcgtccattaggacactgcgccaactcgggaagaaaacggtcgtcgtgaattgtaaccctgagacagtttcaactgactttgacgaatgcgacaaactctatttcgaggagctcagccttgagcgcatcctggacatataccaccaggaagcctgtggcggatgtattatctctgtcggaggacagattcctaacaacttggccgtgccgttgtacaagaatggagtgaagatcatgggaacgagcccactccagatcgatcgagccgaggacaggtccatcttctcagccgtgctggacgagctgaaagttgcacaggccccatggaaggccgtcaacaccctcaatgaagctcttgaattcgcgaagtcagttgactacccctgcctactgcggccaagttacgttctgagcggcagtgccatgaatgttgtctttagtgaggatgagatgaagaaattcctggaggaggctacacgagtgtcgcaggagcaccccgtggtactgaccaagtttgtcgagggggcgcgagaggtggagatggatgcagtcggcaaagacgggcgcgttatcagccatgccatcagcgaacacgttgaagacgccggcgttcattcaggggacgctaccctcatgcttcccactcagacaattagtcagggcgccattgagaaggttaaggatgcaacccgtaaaatagcaaaggcattcgcaatctccggtccttttaatgtgcagtttctggtcaaggggaacgatgtgctggtaatcgagtgcaacctgcgggcctcgaggtcttttccatttgtttcgaaaactctaggggtggactttatcgacgtggcaacgaaagtgatgataggtgagaatgtagatgaaaaacatcttccaactcttgatcatccgataatcccagctgactacgtagcaatcaaagcccctatgttcagttggcccagactaagagatgccgaccctattctgaggtgcgaaatggcttcaaccggcgaggtggcatgcttcggggagggcattcatactgcctttctgaaggcaatgctctccaccggttttaagattccccagaaaggcattctgatagggattcagcagagtttccggccgcgctttctgggggtggctgaacagctgcataatgaagggtttaagctcttcgctactgaggcaacctccgactggctgaacgccaataatgtgcccgcaacgccggtcgcttggccttctcaggaagggcagaacccctccttgagcagcatacgaaaactaatccgcgatggttccatcgacctggtgattaacctccccaacaataacacaaagttcgtgcatgataattacgtaatccgaaggaccgccgtggactccgggattccactcctgaccaattttcaggtgacaaaactcttcgctgaggccgtgcagaaatcccgcaaggttgactctaagtctttatttcattaccgacagtattctgccgggaaggccgcc

SEQ ID NO: 8095 - DNA, 4500 bp, Artificial Sequence
  Description of Artificial Sequence: Synthetic coding sequence
atgactcggattctcaccgctttcaaggtggtgagaaccctcaaaacagggtttggattcaccaacgtaacagcccaccagaagtggaagttttctcgccccggcatccggttattgtctgtgaaggctcagactgcccacatagtgctggaagacggtaccaaaatgaagggctactcgtttgggcatcccagttccgtagccggggaggtcgtattcaatactggtctaggaggctaccccgaggctattaccgacccagcatataagggccaaatcctgactatggctaacccaataatcgggaacggcggtgctcctgatacgactgcactggacgaattgggcctttctaaataccttgagtctaacggcatcaaagtttccggcctattagtactcgactactctaaagactataaccactggctggccacaaaaagtttgggtcagtggctgcaggaggagaaagtgcctgccatatacggggtggatactagaatgctgaccaagatcatccgggataaggggaccatgctcggtaaaatcgaattcgaggggcagcctgtggattttgtggatccaaacaaacagaatctgatcgccgaggtgtcgaccaaggatgttaaggtatatggtaaagggaacccgaccaaggtggtggccgtggactgcggtatcaagaacaacgtcatcaggttattggtaaagcggggggccgaagttcatttagtgccatggaaccatgattttactaaaatggagtatgacggaatcttaatcgcaggcggccccggtaatccggcgctggccgaacctctcattcaaaacgtgcgaaaaatattagagagcgatagaaaggaacccctgttcggcatctccactggcaacttgatcaccggactggccgccggtgccaagacatataaaatgtcaatggcaaaccggggacagaatcagccggtactgaatattactaataagcaagcctttattaccgcacagaatcatgggtacgccctagacaacaccctgcctgccggctggaagccattattcgtaaatgtcaacgaccagactaacgaggggatcatgcacgagtccaaacctttctttgctgtacaattccatcccgaggtcaccccgggccccatagacacggagtacttgtttgacagtttcttcagcctgatcaaaaaggggaaggccacaacaatcacaagcgtcctaccaaaaccggccctggtggcgtcacgggtggaggtaagcaaggtgctgattctggggagtggaggactttctatcggtcaggccggagagtttgactatagcggaagccaggcagtcaaggccatgaaagaggagaacgtcaaaacagtgctcatgaaccccaacatcgctagtgtgcagaccaacgaagtggggctaaagcaggctgatacagtgtacttcttacctatcactcctcagtttgttaccgaggtgattaaagcggagcagcctgatggattaatcttaggcatggggggacagacggccctgaattgcggagtggaactgttcaaacggggcgtcctcaaggagtatggagtgaaggtgctggggacatctgtggagtctatcatggctaccgaggatagacagctattctctgataaactcaacgaaatcaatgagaagatcgctcccagcttcgccgtggagtcaattgaggatgccctgaaggctgcagatacaattggatatcccgtcatgatccggagcgcctacgccctcggtggcctgggtagcgggatctgccccaacagggagacacttatggatttaagtactaaggctttcgccatgacgaaccagatcctggttgaaaagtcagtgaccggttggaaagagattgagtacgaagttgttcgggatgccgatgataattgcgttacagtctgcaatatggagaacgttgacgctatgggggtacataccggtgatagcgtcgtcgtcgcccctgctcagaccctcagtaacgccgagttccaaatgctgcgaaggacaagtattaacgttgtgcgccatctggggatcgttggggaatgtaacatccagtttgcgcttcaccctacctcgatggagtattgtatcattgaggtgaatgcacgtctgtctcggtcttccgcattagcttctaaggccaccgggtacccgctggctttcatcgctgcaaagattgctctgggaattcccctaccggagataaagaatgtggtctcagggaagacctctgcatgctttgagccttccctcgattacatggtgacaaagatccccagatgggatctagaccgcttccatggaacttccagtagaattggttcatccatgaaatccgtgggcgaggtgatggctattggtaggaccttcgaggaaagctttcagaaggcactgaggatgtgtcatccgtccatcgaaggatttacaccaaggctgcccatgaataaagagtggccctcaaatctcgacctgagaaaggaactaagtgagccctcgtctacccggatatatgctattgccaaggctatcgacgataacatgtcactggatgaaatcgagaagcttacatatattgataaatggttcctttacaagatgagagacatcctgaacatggagaaaactttgaaagggttaaactccgagagcatgacagaggagaccctgaaacgcgctaaggagatcgggttttccgacaaacagatatccaaatgccttggactgaccgaggcccaaacccgagagctgaggctaaaaaagaacattcacccctgggtgaaacagattgacactctggccgcggagtacccctcggtcactaattatctctacgtaacctacaatgggcaggaacatgatgtgaatttcgacgatcacgggatgatggtccttgggtgtggcccataccacattggctcttctgtcgagtttgactggtgcgctgtgtcaagcataagaacgttgcggcaactgggaaagaaaaccgtagtagtgaattgtaatcccgagaccgtctcaactgatttcgatgagtgcgacaagctttacttcgaagaactctctctggagaggatactggacatctaccatcaggaagcctgcggcggttgtattattagtgtaggtggtcagatacccaataatctcgcggtgccactgtacaagaatggcgtgaaaattatggggacctcaccactccagatcgaccgcgcagaggatcggagcatcttctctgccgtgttagacgaattaaaggtagctcaagctccttggaaagccgttaacaccttgaatgaggcactcgagtttgcaaagagtgtcgactatccttgtctgttacgcccttcatacgtcctgagcgggagcgctatgaacgtggtgtttagtgaggacgagatgaagaaattcttggaggaagccactagagtctcacaggaacaccctgtggtcttaacgaagttcgtggaaggcgctcgggaagtggagatggacgcggtcggaaaagatggtagagtcattagtcacgctatctctgaacacgtagaggatgctggagtgcattccggcgatgctacactgatgctgccaacccagaccatctcccagggggccattgagaaagttaaagatgcgacgcgcaaaattgcaaaagcctttgctatcagcggacccttcaacgtgcagttcctcgtgaaaggcaatgacgtcctcgtaatagagtgcaacctgcgcgcctccagaagctttcccttcgtgtctaagactttgggcgtggacttcatagatgtggcaaccaaggtgatgatcggagaaaatgtggatgagaaacatttacctacactggaccatcccatcattccagcagactacgttgccattaaggcaccgatgttctcttggcccaggctcagagatgcagacccaatcctcaggtgcgagatggctagcaccggcgaggtggcctgtttcggagaagggatccatacagcttttctgaaggcgatgctatccactggtttcaagattccgcagaaaggcatccttattggcatacagcagtccttcagacctaggtttctgggcgtagctgagcagttacacaacgaggggttcaaattatttgctactgaagcaactagtgattggctgaatgctaacaatgtccccgcaacaccggttgcctggccgagccaggaggggcaaaatccttctctgagttcaatacgcaagctgattagagacggatccatagacctcgtcatcaacctgcccaacaataacaccaagttcgtgcatgataattacgtgattcgacgcacagcggtggattcagggatcccactcctaactaatttccaggtaaccaagctgttcgcagaggccgtgcagaagtcacgtaaggttgatagtaaatccctgttccactaccgccagtattcggccggaaaggcagct

SEQ ID NO: 8096 - DNA, 4500 bp, Artificial Sequence
  Description of Artificial Sequence: Synthetic coding sequence
atgactaggattctcacagcctttaaagttgtgcgaacattgaaaaccgggttcggatttaccaacgtcaccgcccaccagaagtggaagtttagtcgcccggggattagactgttgtctgttaaggcccaaaccgcccatatcgtgttagaggacgggactaagatgaaggggtatagctttggccatccttccagcgtagctggagaggtagtatttaacacagggctagggggataccctgaagcaatcaccgacccagcatacaaaggccagattctgacaatggccaacccaataatcggtaacggtggcgcaccagacactaccgccctcgacgaactgggcctctccaagtacttggaatctaacgggataaaggtttccggtctcttggtgctggactactcaaaggattataaccactggctggccacaaagtccctcggtcaatggctgcaggaggaaaaagtgcccgcaatttacggcgtggacacgcgaatgttaacaaagatcatccgggacaagggaactatgcttggtaaaattgagttcgaagggcagcccgtggatttcgtggatcccaacaagcaaaacctcatcgcggaagtaagcacgaaggatgtcaaggtgtatggcaagggcaatcccacaaaggtggtggccgtcgactgcggtattaaaaacaacgtgatacggcttctcgtgaagagaggagccgaagtacacctcgttccctggaatcatgattttacgaagatggagtatgacggcatccttattgccgggggccccggcaacccagccctagcagaaccgctgattcagaacgtaagaaaaatcctcgagagtgacagaaaggagcctctgttcgggatatctacaggcaatcttataacaggcctggccgctggcgctaaaacctataagatgtcaatggccaatagaggacagaatcaaccagtgctgaatatcacaaataaacaggcttttatcaccgcccagaatcacggatatgcacttgataatacacttcccgctggatggaaaccactatttgtgaacgtgaacgaccagaccaatgagggcataatgcatgaatccaaacctttctttgccgtacagtttcaccctgaagtcacaccagggcccatagacaccgaatacctgttcgatagcttcttctccttgattaagaagggtaaagcaactacaatcactagcgtccttcccaaaccggccctcgtggcctctcgggtggaggtctccaaggtgctcatcctcgggtccggcggactttccatcgggcaggctggggaattcgattactcgggttctcaggcagtcaaggccatgaaggaggaaaatgtcaagacggtcctgatgaatcctaacatcgcaagcgtgcaaactaatgaagtcggcctgaagcaggctgacactgtctacttcttgcccatcacacctcagtttgtcaccgaggtgatcaaggcggaacaacccgatgggttgattcttggtatgggaggacagaccgctcttaattgcggggttgaactttttaaacgtggtgtcttgaaagagtatggcgtgaaggttttgggaacatctgttgaatccatcatggcgacagaagatagacagttgttcagtgataaactcaacgagattaatgagaaaatcgcaccctccttcgcagtggaatcaattgaggacgccctgaaggccgcagacaccatcggttacccagtaatgatcagatccgcttacgctctgggcgggttgggctcaggtatatgccctaatcgggagactctcatggacttgtctactaaggcattcgcgatgaccaatcaaatactcgtagaaaagtctgtcacaggctggaaggagatagagtatgaggttgttcgcgatgcagatgataattgtgtgacagtgtgcaatatggagaatgtggatgcaatgggagttcacactggggatagtgtggtcgttgctcctgctcagaccctgagtaacgctgagttccagatgcttagacgaactagcattaatgtagtgaggcacctaggtatagttggtgagtgcaacatccagtttgcccttcatcctacttcgatggagtattgcatcatcgaggtgaacgcccgacttagcaggtcttctgctttggcatccaaagccacaggatacccacttgcctttattgcggcaaagattgcactagggatcccacttcctgagatcaaaaatgtggtcagcgggaagacttctgcttgctttgaacccagcctggactacatggtcaccaaaattccaaggtgggatttagataggttccatgggacctctagtaggatcggtagtagcatgaaatccgtgggtgaagtcatggcaatcgggcgtaccttcgaggagagcttccagaaggccttacgtatgtgtcacccgtccattgaaggcttcactcctcgactgccgatgaataaggaatggccgtccaacctcgacctgcgtaaggagttgagcgaaccctcctccacgcgaatctacgccatagctaaagccatcgacgataacatgtcccttgacgagatcgaaaagctgacttatatcgacaagtggtttctttataagatgagggacatcttgaatatggaaaagactctgaagggtctgaatagtgagtccatgaccgaggagactctaaagagagccaaggagatcggtttttctgacaaacagatcagcaagtgtctcggactgactgaagcccagactcgagaactgagattgaagaagaacatccacccgtgggttaagcagatcgatacactagccgccgagtacccctccgtgacaaactacctctacgtgacatacaacggacaggaacacgacgtgaacttcgatgaccacggcatgatggttttgggttgtggcccttaccatattggcagtagcgtggagtttgactggtgtgcggtgagctctattagaaccctgcgacagctgggaaaaaagacggtcgtagtgaattgcaatcccgagactgtgtccactgatttcgacgaatgtgataagctgtacttcgaggaactttccctcgaacgaattctggacatctatcaccaggaagcatgcggagggtgcatcatcagtgtaggtggtcaaatccccaacaatctcgcagttccattatataaaaatggcgtcaagatcatgggaactagccctctccagatcgatcgagcggaagaccgatcaatcttttccgccgtcttggatgaactgaaggtggcacaggccccgtggaaagcagttaatacactcaatgaggcattggagttcgctaagagtgtggattatccctgtctgctccgccccagttacgtgctgtcaggatctgctatgaatgtggtcttctccgaggatgaaatgaagaagtttcttgaagaagcgacccgagtgagtcaagaacacccagttgtgctcaccaaattcgtcgagggagctagggaagtggagatggacgctgttggaaaggatggcagggtgatcagccacgcaatatccgagcacgtggaagacgcaggtgtgcattcaggggatgccacactcatgttaccgacccagacaatttcacagggggccatcgaaaaagtgaaggacgcgactaggaaaatcgccaaggcctttgcgatctccggccctttcaatgtgcagttcttagtgaaaggtaacgacgtcctggtcattgagtgcaatcttcgcgccagtcgatcattcccctttgtatctaagaccctcggtgtcgacttcattgacgttgcaaccaaggtaatgattggggagaacgtcgacgaaaaacatctgccaactctggaccatcccatcattccagctgattatgtggctatcaaggctcccatgtttagttggccccggctccgcgatgctgacccgatattaaggtgcgagatggcctccacaggcgaggtagcctgctttggcgaaggaatacatacagcgttcctgaaagctatgctcagcactggattcaagataccccaaaagggtatactcatcgggatacagcagagcttccgtccgcgatttctcggggtcgccgagcagcttcataacgagggcttcaagctattcgccactgaagccaccagtgattggctgaacgcaaacaatgtcccagctactcccgttgcatggccgtcccaggagggccagaacccctccctgagctctataaggaagctgatccgagatgggagcatcgatctggtgataaacctgcccaacaataataccaagtttgttcacgataattacgtaatcaggaggaccgcggtcgactccggcatcccattgttaactaatttccaggtgacaaaactgttcgcggaggccgtgcaaaagtcacgcaaggtggactccaaaagtcttttccactacaggcagtattccgcaggaaaagcggcg

SEQ ID NO: 8097 - DNA, 4500 bp, Artificial Sequence
  Description of Artificial Sequence: Synthetic coding sequence
atgactagaatactcacggccttcaaggtggtgcgaactctgaagacaggattcggatttaccaatgtgacggcacaccaaaagtggaaattttccaggcccggcatcaggctactgtctgtaaaagcacagacagctcatatcgttcttgaagacgggactaaaatgaaaggttattcctttggccatccctcttctgtggccggagaagtggtattcaatactggccttggcgggtatccagaggctatcacggatccggcctacaaagggcaaattttgacaatggccaatccaataatcggcaatggtggtgccccggacacaaccgcattagacgagctgggcctgagtaagtacctagaatcaaacgggataaaggtttcgggacttctggtcttagactattccaaggattataaccactggctagcaactaaatctttaggccagtggctgcaggaagagaaagtccccgccatttacggggtggatactcggatgttgaccaaaataatcagagataagggcaccatgctggggaaaattgaattcgaaggacaacccgtcgacttcgtcgatccgaacaaacagaacctgatcgcagaggtgagcacaaaagacgtgaaggtatacggtaagggaaatcccacaaaagtcgtggcggtggattgcgggatcaagaacaacgtgatcaggcttctagtgaaacgcggggcagaggtacacttagtaccttggaaccatgacttcacaaagatggaatacgatgggatccttattgcaggaggtccaggcaatcctgccttggcggaaccattaatccagaatgttcgcaagatcctcgagagtgaccgcaaggagcccctttttggtatcagcacaggaaaccttataaccgggctggcagcgggagccaagacttacaagatgtccatggcaaatcgcggacaaaaccagcccgttctgaatatcactaacaaacaggcctttattacggcgcagaatcacggctacgctctagacaatactctcccagcagggtggaagccattgtttgtgaacgtcaatgaccagacaaacgagggcattatgcacgaatcaaagccctttttcgccgtacagttccatcccgaggtgacccccggacccattgacaccgagtatctattcgacagctttttctccctcataaagaaaggcaaggctaccacgattacaagcgttctgccgaagcccgcactcgttgctagccgagtagaagtgtcaaaggtgctcattctcgggtcaggcggacttagcatcggtcaggcaggagagttcgattatagtgggtcccaagccgtgaaagcaatgaaggaggagaacgtgaaaaccgtgttaatgaatcccaacatagcaagcgttcaaacaaacgaagttgggctgaaacaggcagacactgtttattttttgcctataacgccgcagttcgtcacggaagtgattaaggccgaacagcctgacggactgatcctagggatgggcggccaaacagcactaaactgtggagtggaacttttcaagcggggtgttttgaaggagtatggggttaaggtcttgggcacctcagttgagtcaatcatggccacagaggaccgtcaactgttttccgacaaactgaacgagattaatgaaaagatagctccaagtttcgcagtggaatcaattgaggatgccctgaaggccgctgataccattggctaccccgtaatgataaggagcgcatacgcactagggggactcggatcaggtatatgtccaaaccgcgagactcttatggacctttccaccaaagcttttgccatgaccaatcagattctggtggagaagagtgtcacaggatggaaagagatagagtacgaagtggttcgcgatgcagacgataattgtgtgaccgtatgtaacatggagaacgtggatgctatgggggtccacactggggactccgtggtggtagccccggcacaaacactttccaacgccgaattccagatgctgcggcggactagcatcaatgttgtcagacatctgggtattgttggtgaatgtaatatccagttcgcactgcatcctacaagcatggagtactgtatcattgaagttaacgcccgactctcccgcagctccgcacttgcgagcaaagcaactgggtacccacttgcgtttattgcggccaaaattgctttagggatacccttgccagagataaaaaacgtggtatctggcaagaccagtgcttgttttgaaccaagtctcgactatatggttacaaaaatacccagatgggatctcgacagatttcacggaacctcgtcccgcattggctcatccatgaaatccgtaggcgaggtgatggcaataggtaggacattcgaagagtccttccagaaagccctgcggatgtgtcatccctctattgaagggttcaccccccggctgccaatgaacaaggaatggccctctaatctcgatctgcgcaaggaactctcggagcctagtagcacgcggatctatgctatcgctaaggccatagatgacaacatgtccttggatgaaatcgagaagctgacttacattgacaagtggtttctgtacaaaatgagggatattttgaacatggaaaaaacactaaagggactgaatagcgaatccatgactgaagagacactgaagcgcgcaaaggaaattggattttctgacaagcagatctctaagtgtctcggactcacggaagctcagacccgagagcttcggctgaagaagaatattcacccctgggtcaaacagatcgacacacttgcggcagaatacccttctgtgactaattatctctatgtgacctacaatgggcaggaacacgacgtaaactttgacgaccatgggatgatggtactaggatgcgggccttatcacatagggagcagcgtagagtttgattggtgcgccgtatcatcgatcagaacactgcggcagctgggcaagaaaacagtcgtggtgaactgtaaccctgaaacagtgagcactgacttcgacgaatgcgataaactctatttcgaggaactgagcctcgagcgtatcctcgacatctaccaccaggaggcctgtggcggttgcattattagtgttggcggtcagattcccaacaacctggcagtcccactctacaaaaacggcgtaaaaatcatgggcacttcaccactccaaatcgaccgggctgaggataggtctatttttagtgcggtcctggatgaactgaaggtggcacaggcgccttggaaggctgtgaataccctcaacgaggcattggagtttgcaaagtccgtcgactacccctgtctactgagaccgtcatatgtccttagtggatccgcaatgaacgtcgtttttagcgaggacgagatgaagaagtttcttgaggaagccacaagggtctcccaggagcatccagtggttctaactaagttcgtggagggcgctcgcgaggtcgagatggatgctgtgggaaaggatggtagagtgatctcccacgcgatctccgagcatgttgaagacgcaggcgtgcattctggggacgccacactcatgcttccgactcagacaatttcacaaggcgcaattgagaaggtcaaagacgctacgaggaagattgcgaaagcctttgcgattagtggccctttcaacgtgcagtttctcgtcaagggcaatgatgtcttagtcatagaatgcaatctgagggctagcagaagtttcccattcgtgtctaagacactgggcgtcgactttatcgacgtagccaccaaagtgatgattggagaaaacgttgacgagaaacaccttccgacactggatcatcctataatcccagccgattacgtggccattaaagccccaatgtttagttggccgagactaagagacgctgatccgatactgcgctgcgagatggctagcacgggagaggtagcttgctttggagaaggcatccatacagctttcttgaaggcgatgctgtccacaggttttaagatccctcagaaggggatcctaataggcatccagcagagttttagacctagatttctcggcgtcgccgagcagctgcacaacgagggcttcaagctcttcgctacggaggccacaagcgactggttaaacgcgaacaatgtgccagccacaccagttgcctggcctagccaggagggacagaaccccagtttgtcctcaattcgcaagcttattcgcgacgggtcaattgatttagtgataaacctgcctaacaataatacgaaatttgtgcatgacaattacgtcattcgccgcaccgccgtcgactctgggatccccctactcacaaattttcaagtcactaaactttttgcagaggccgtgcagaagagcaggaaggttgatagtaagtcgctgtttcactacaggcaatactccgccggcaaggcagcc

SEQ ID NO: 8098 - DNA, 4500 bp, Artificial Sequence
  Description of Artificial Sequence: Synthetic coding sequence
atgacgcgcatcctaacagccttcaaagtcgtgcggactctgaagactggctttggtttcactaatgtcacagcacatcaaaaatggaagttctcccgccctggcattagactgctgtctgtgaaggctcaaactgcacacattgttctggaagacggcactaaaatgaaaggctacagtttcggtcacccttcgtcagtggcaggcgaggtcgtgttcaacaccggactgggcggatatccggaagcaatcacagatccagcatacaagggccagattctgacaatggccaaccctataattggcaatggcggggccccagacactactgccttggacgagcttgggctctccaaatatctggaaagcaacggcatcaaagttagcggactgctagtgctggattactccaaggattataatcactggctcgcgacgaagtctctcgggcagtggctgcaggaggagaaggtgcccgctatctatggggtggacactagaatgctaacaaagatcatccgggacaaaggtacaatgctcggcaaaattgagttcgaggggcagcccgtggactttgtggaccctaacaaacagaatctgatcgccgaggtcagcacaaaggatgtgaaggtgtacgggaaagggaaccccacaaaagttgtggccgtggattgcggtattaagaataatgtgatccgattgcttgtgaagcggggtgctgaagtgcaccttgttccgtggaatcacgattttacaaaaatggagtatgatggaatacttatagcggggggccctggcaaccccgcattagccgagcctctgatccaaaatgttcgcaaaatcctagagagcgataggaaggaacctctattcggcatttctaccgggaacctgatcacaggactcgctgcaggggctaaaacctataagatgagcatggccaacagaggacagaaccagcccgtcctgaacattaccaataagcaggcgtttataactgctcagaatcacggctacgcacttgataacaccctcccggcaggatggaagcctcttttcgtgaatgttaatgaccaaaccaacgaagggatcatgcacgagtctaagccctttttcgccgttcaattccatccggaggtgacgcctggaccgatcgatacagagtacctgttcgattctttcttctccctgatcaagaagggcaaggccaccacaatcacgtcagtgctgcctaagcctgctctggttgcttctcgggtggaagtcagtaaggtgttaatcctggggtctggcggactgagcatcggccaagccggggagttcgactactccgggagccaggccgttaaagccatgaaggaggaaaatgtgaagaccgtactaatgaaccccaatatagccagtgtgcagaccaatgaggtaggcttaaagcaggcagataccgtgtatttcctccctatcacaccccaattcgtcaccgaggtgattaaagcagagcagcccgatggcctgattttgggtatgggggggcagaccgctctgaattgtggcgttgagctctttaaaagaggtgtgttaaaagagtacggcgtgaaggtgctcggcacctcagtggagtccataatggcaactgaggatcggcagctcttctctgacaagctcaacgaaattaacgagaaaattgcaccttctttcgcagttgagtcgatcgaggacgccctcaaagccgcagatacaataggatacccagtgatgatccgatctgcctacgccttgggggggttgggatcaggaatatgtccaaatcgggagaccctgatggacctttccacaaaggcatttgccatgactaatcagattttagtggagaagtcagtaacaggatggaaagaaatcgagtacgaagtcgtgcgggatgcggacgacaactgcgtcacggtgtgtaacatggagaatgttgatgcgatgggtgtacacacaggtgactctgttgtggttgcacccgcccagactctgtctaacgcagaatttcagatgcttcgccggactagtataaatgttgtgcgccatctaggaattgttggtgaatgtaatatccagtttgccctccaccccacttctatggagtactgtattatagaagttaatgccaggctgagtcggtcaagcgcccttgcctccaaggccacaggttatccgctggccttcatcgctgcaaaaatcgcgctgggaatccctttgcctgaaatcaagaacgtggtgtccgggaaaacaagtgcctgctttgaaccatcgctggactacatggtcaccaaaatcccacggtgggatctcgatcgttttcatggtactagtagcaggatagggtcctccatgaagtcggtaggcgaagttatggccatcggaagaaccttcgaagaaagctttcaaaaggctctgcggatgtgccacccctctattgagggctttaccccgcggctgcccatgaacaaagagtggccctccaatctagatttgcgaaaggagctgagcgagcccagctcaacacgaatttacgcgattgcaaaggctatcgacgataacatgagcctagacgaaatcgagaaactcacatatatcgataaatggtttctgtacaaaatgagagacattctcaacatggagaaaactttaaaaggcctgaactctgagagcatgaccgaggagacgctgaaaagagctaaggagattggcttttccgataaacagatttccaaatgtctaggtttaacagaggcccaaacacgggaactcagactgaagaagaacattcacccctgggttaaacaaattgacacacttgcagcggaatatccttcggtcaccaattacctgtacgtgacttacaacggtcaagagcatgacgtgaacttcgatgaccacgggatgatggtactggggtgtggaccataccacatcggttcctccgttgaatttgactggtgtgctgtatcaagcatcaggaccttgagacaactgggcaagaaaactgtggtcgtgaactgcaatcctgaaactgtgtctaccgacttcgacgagtgtgataaactatacttcgaggaactcagcctcgagcgtatcctagacatctaccatcaagaagcgtgcggggggtgcatcatatctgtcgggggacagatcccaaacaacctggccgttccactctacaagaacggggtgaagatcatggggacctctccactgcaaatcgaccgggccgaggataggagtatttttagcgccgtattggacgagctcaaagtggcccaggctccgtggaaagctgttaatacccttaacgaggccttggaatttgctaagagtgtcgactacccctgcttacttagaccctcttatgtgcttagcggcagtgccatgaacgtggtcttttcagaggatgagatgaagaaatttttagaagaagcaaccagggtctcccaggagcaccccgtggttcttaccaaatttgttgagggagcaagggaagtggaaatggacgccgtggggaaagacgggcgagtcatctcccatgcaatttctgaacacgtggaagatgccggagttcactctggggatgctaccctgatgttgccaacccaaactatatctcaaggtgcgattgagaaagtcaaggatgccactcgaaagatcgctaaggccttcgccataagtggtccgtttaacgttcagtttcttgtcaagggaaatgacgtcctggtaattgaatgtaatctgcgtgcgtcccgcagctttcccttcgtgagcaagactttgggcgtcgatttcatagatgtggccactaaggtaatgattggagagaatgttgacgaaaaacatctgccaacgttggatcatcctatcattcccgcggactacgtggcaatcaaagcccccatgtttagttggccccgacttagggacgccgaccctatcttacggtgcgaaatggcctccacaggggaggtggcttgctttggagagggaatacatacagcttttctgaaggccatgctaagtaccggctttaagatcccacaaaagggcatccttatcggcatccagcagtcctttcgcccccgcttcctgggggtggcagaacagctgcacaatgaggggttcaagctattcgccaccgaagcaacatcggattggctgaatgcaaacaatgtcccagctacccccgtcgcctggccctcacaggaggggcagaaccccagtctgtcgtccataagaaaactgattcgagacgggagcatcgatttggtcatcaatctccctaacaataacaccaaatttgtgcatgacaactatgtaattaggcgaacagccgtagactctggcattccactgctcacaaatttccaggtgacgaaactctttgccgaggccgtgcaaaaatccagaaaggtggacagcaaaagcttgtttcactataggcagtacagtgccgggaaggccgcc

SEQ ID NO: 8099 - DNA, 4500 bp, Artificial Sequence
  Description of Artificial Sequence: Synthetic coding sequence
atgaccagaattctgacggcttttaaagtggtgcggaccctgaagacgggatttggttttacaaacgtcaccgcgcaccagaagtggaagttctccagaccggggattaggctccttagtgtaaaagcccaaaccgcccatatagtgctggaagatggaactaagatgaagggatactctttcggccacccaagctccgtcgcgggcgaggtagtgttcaacaccggcctgggtggctatcctgaagccataacagatccagcatacaaagggcagattctcactatggccaatccgatcataggcaacggaggtgcacctgacacaacagccctggatgaacttgggttgtctaaatatctggaatcaaatgggataaaagtctctggccttcttgtgctggattacagtaaggactacaatcactggttggccacaaaatccctgggccaatggctccaggaggaaaaagtgcccgccatctatggcgtggatacaaggatgctcactaagattattagggataagggcacaatgctgggaaagatcgagttcgaaggtcagcccgtcgattttgtggaccccaacaaacagaatctgattgctgaagtgtccacgaaagacgtgaaagtgtacggtaaaggaaaccccactaaagtggtcgccgtcgactgcggcattaagaacaatgtaattagacttctggttaagcgaggggccgaagtgcatttggttccctggaatcatgactttacaaagatggagtacgatggcattctcatagcaggtggaccaggtaacccagcgctcgcagagcccctgattcagaatgtgaggaagattctcgaatctgatcgcaaggagccactgttcggcataagcaccggcaaccttatcaccgggctcgccgctggcgcgaagacatataagatgagtatggcgaaccgagggcaaaaccagccggttttgaacatcacaaacaaacaggcttttatcacagcacagaatcacggttatgctctcgataacacgctgcccgccggttggaagcctctcttcgtaaatgttaacgatcagaccaatgagggaatcatgcacgagagtaaacccttcttcgccgtgcagtttcaccccgaggttacacccgggccgatcgacaccgagtacctgttcgacagcttcttttctcttatcaaaaaggggaaagcaacaactattacaagcgtgctgccgaaaccagccttggtggcatctcgcgtggaagtaagcaaagtgctgattctgggaagcggggggcttagcattggtcaggcaggggagtttgactatagcggatctcaggccgtgaaggctatgaaggaagagaatgtaaaaaccgtgctcatgaatcccaatatagcatctgttcagactaacgaggtcggcctgaaacaggccgacaccgtgtactttctgcccattactccacaattcgtaaccgaggtgatcaaggcagaacagcccgatggcctcatactgggcatgggggggcaaactgctctgaattgcggcgtcgagctgttcaaaaggggcgtgctgaaagagtacggggtgaaggtgctgggtacgagcgtcgagagcattatggctaccgaggacagacagcttttcagcgataaacttaatgagatcaacgaaaagatcgctccctctttcgccgtggaatcaatcgaggacgcactgaaggcagccgacacgattggttaccccgtgatgatcaggtcagcttacgcactgggaggactgggctccggaatttgtccaaatcgagaaacccttatggatcttagcaccaaagcttttgccatgacaaaccagattcttgtggaaaaatccgtgaccgggtggaaggaaatcgaatatgaggtcgttagggacgccgacgacaactgcgtgaccgtctgcaacatggaaaacgtcgacgccatgggcgttcacaccggggattctgttgtcgtagcgcccgcccagacattgagcaacgcagaatttcagatgctgaggcgaacaagtattaatgtcgtccgacatctgggcatcgtgggcgagtgtaatatccagttcgctctgcacccaacatcaatggagtactgcatcatcgaagtaaatgccaggctctcacggtcctcagctctggcttccaaagcgacaggctaccctcttgcatttattgccgcgaaaatcgcactgggcatccccctccccgaaattaagaatgtggtctctggcaaaacctccgcttgtttcgagccgtccctggattacatggtgacaaagatcccaagatgggatctggaccggtttcacggcacatcatcccgcatcgggagcagcatgaagagcgtcggcgaagtgatggctattggccgcacatttgaagagtcttttcagaaggcattgagaatgtgccatccctctatcgaaggtttcacacctcgccttcctatgaacaaggagtggcctagtaacctcgatctgcgcaaggagctctctgagccatcttctacacggatctacgccatcgctaaagccattgacgacaatatgtcattggacgagatcgaaaagctgacctatatagataagtggtttctttataagatgcgagatattctcaacatggagaagacactgaaaggactcaactccgaaagtatgacagaggaaaccttgaagcgagccaaggagatcggcttctcagacaagcagatttccaagtgcctcggcctgaccgaagcccagacacgagagctgcgcctgaagaagaacatacacccctgggtgaagcagattgacacgctcgctgctgaatatccctctgtcaccaattacctctacgtgacgtacaatggccaggaacatgacgtgaacttcgatgatcatggtatgatggtcttgggatgtggcccttaccatattgggtcctccgttgagttcgactggtgtgctgtcagcagcatcagaactctgcgccaactgggcaagaagacagtagttgtgaattgcaatcctgaaacagtgagtaccgacttcgatgagtgcgacaagctttacttcgaggagttgagtctcgaaaggatactggatatctaccatcaagaggcctgcgggggttgcatcatcagtgttggcgggcagataccgaataacttggctgtgccactctacaagaacggggttaaaatcatgggaacaagcccccttcagatcgaccgggcagaggatcggagcatcttttcagcagtgttggatgaactgaaggtggcccaggccccttggaaagccgtgaatacactcaatgaggcattggaattcgcaaagtcagtagactatccctgtctccttaggcccagctacgtcctgtccggaagcgccatgaatgttgtgttcagcgaggatgagatgaagaagttccttgaagaagccacacgagtgagccaggagcacccggtcgtcctcactaagtttgtagagggcgcaagggaggtagagatggatgcagtgggtaaggatggccgcgtgatttcacatgccatcagcgagcacgttgaagacgctggtgtgcatagcggagatgcgactcttatgctgccaacccagaccatctctcagggcgctattgagaaggtgaaggacgccaccagaaagatcgccaaggccttcgccatctcaggcccattcaacgtgcaattcctggtaaagggaaacgacgtgctcgtcatcgagtgcaacctgcgcgcgagccgctcttttccctttgtttcaaagacccttggggtcgactttatcgatgtagcaactaaagtgatgattggagagaatgtggacgagaagcatctccctacactggaccatcctattattcctgcagactatgtcgcaatcaaggctcctatgtttagctggcctcgcttgcgggatgcagaccccattttgcgctgcgaaatggcttctaccggggaagtggcttgcttcggggagggcatacacactgcctttcttaaagcgatgttgagcaccgggtttaaaataccccagaaaggtatcctgatcggcatccagcagagctttcgccccaggtttttgggagtagcggagcagctgcacaacgaagggtttaaactgttcgcgacggaagcgacgtctgactggctgaatgccaataatgtgccagcgacgccagtggcatggccttctcaggaaggtcagaacccctctctcagtagtatccggaaactcatccgggatggatccatagatttggtgatcaacttgccgaacaacaatactaaattcgtgcacgataattatgtgattcgaagaacagccgtggactctgggatccccctgcttaccaacttccaggtgacaaagctgtttgctgaagccgtccagaaaagtaggaaagtggatagcaaaagcctgttccactaccgccagtatagcgcaggaaaggcggct

SEQ ID NO: 8100 - DNA, 4500 bp, Artificial Sequence
  Description of Artificial Sequence: Synthetic coding sequence
atgaccaggatcttaactgcgttcaaggtggtgcggaccctgaagaccggtttcggatttactaacgtgaccgcccatcagaagtggaagttttcgagacctggtatccggctgctttcggtgaaagcccaaaccgctcacatcgtgctcgaagacgggactaaaatgaagggatactccttcggtcatcccagctccgttgcgggggaagttgtatttaatactggactcggtggctacccggaggctattactgatcccgcctataaaggccagattttgaccatggccaaccccatcatcggcaacggtggggcacctgacaccactgctctagacgagctggggctcagcaaatatttggagtccaatggtatcaaagtgtcaggactcctcgtgctcgattactccaaggactataaccattggttagcgaccaaatccttgggccaatggttgcaggaggagaaagttccagcaatatatggggtcgacacaaggatgctcacaaaaatcatcagggacaagggaaccatgctgggcaaaatagagtttgaaggtcaacccgtggacttcgtagatcccaacaaacagaacctgattgcagaagtgtcaaccaaggacgtgaaagtgtacggaaaaggaaatcccaccaaggttgtggccgtggactgtggcattaagaataatgtcatccggctgttggtgaaaaggggggccgaggttcatctggtgccctggaaccacgactttacaaagatggaatatgatggtatcctcatcgccgggggacccggtaaccctgctctcgccgagcctctgatccagaatgtgcggaagatcctggagtcagataggaaggagcctctcttcggaatatccactggcaatctcattaccggcctggctgctggagccaagacctacaaaatgtccatggcaaatcgcggtcagaatcaacccgtgctgaacatcacaaacaagcaggccttcatcacagcccagaaccacggctacgccctggataacacgttgcccgcggggtggaagcccttgtttgtgaatgtgaacgatcaaacaaacgaaggaattatgcacgaatccaagcctttctttgctgtccagtttcaccctgaggtcacaccaggaccaattgacaccgagtacctcttcgactcattcttcagcttgatcaagaaggggaaagcaaccactatcaccagcgtgctgccgaaaccggccctggtggcctccagggtggaggtgtcaaaagtgctaattctcggctctggaggattatcgatcgggcaggccggggaattcgactattctggctcccaggccgtaaaagcaatgaaagaagagaacgttaagaccgtgttgatgaatcccaacatcgcgagcgtgcagaccaatgaagttggtctcaaacaggcggacaccgtgtatttccttcctattacacctcaattcgttacagaagtcattaaagctgaacaacctgatgggctgattctcggcatgggaggacagacagctctgaactgcggggtggagctgtttaagcgaggcgtcttgaaagagtacggagttaaagtattgggaacctccgtggaatccattatggcaaccgaggaccggcagctgttcagcgacaagcttaacgagatcaacgaaaagatcgccccatccttcgctgtagagtccatcgaagacgccctgaaagcggcggacaccataggctaccctgtcatgatccgaagtgcctatgctctgggggggctcgggtcaggaatatgtcccaatcgcgaaactctgatggatctcagtacaaaggcattcgccatgactaatcagatcttggttgagaaaagcgttactggatggaaggagattgagtacgaggttgtgagagacgctgatgacaactgtgtaaccgtttgcaacatggagaacgtggatgccatgggcgtccatactggcgattctgtggtggtggcgcccgcccagaccctgtctaatgctgagttccaaatgctgcggcgaacctctatcaacgtcgtgaggcatttgggcatagtgggtgagtgcaacatccagttcgccttacatcctacatcaatggaatattgtattattgaggtgaacgcccgcctgtcaagatcctctgctctagccagcaaagccacgggttacccactcgcctttattgcagctaagatcgcactgggcatcccccttccagaaatcaaaaatgtggtgagcggcaagacatccgcttgttttgaaccctctctggactacatggtgaccaaaataccacgctgggacctagacagatttcatggcacaagtagtaggatcggatcatccatgaagtccgtgggtgaggttatggcaatcggcagaaccttcgaagaatcgtttcaaaaggctctgagaatgtgccaccccagtattgagggcttcactcccagactgcctatgaacaaggagtggccgtctaatctggacttaagaaaggagctctcagagcccagcagcacaagaatatacgcaatagccaaggcaattgatgacaacatgagcctagatgaaatcgaaaaactcacttacatcgacaaatggtttctgtacaagatgagagatattctgaatatggagaagacgctgaagggactcaacagcgagagtatgactgaggagactctaaaaagggcgaaggaaatcggcttttcagataaacaaatctccaaatgccttggtctgaccgaggctcagactagggagctcaggctcaagaaaaatatacacccctgggtaaagcagattgacacactggccgcggagtatcctagtgtgaccaattatctgtacgtgacctacaatggccaggagcacgatgtaaacttcgatgaccacggaatgatggtgttgggctgcgggccctaccacattggttcatcggtcgaatttgattggtgcgctgtgtcttctattcggaccctgcgtcagctggggaaaaagactgttgtagtaaactgtaacccggagaccgtgagcaccgatttcgatgagtgcgacaagctgtacttcgaggagctgtccttagagagaatactggacatataccaccaagaggcatgtggtggctgtatcatctctgtcggagggcaaatcccaaacaatctggcagtccctctgtataagaacggggttaagatcatgggtacgagcccacttcagatcgaccgagcagaggacaggagcatcttcagtgccgtgctggacgagttaaaggtggctcaagccccctggaaggccgtgaatacgctgaatgaggccctcgagttcgccaaatccgtagattatccatgcctgctccgcccatcttatgtgctgtctggttcggctatgaacgtggtgttcagcgaagacgaaatgaagaagtttttggaggaagctacgcgcgtgtcgcaggagcaccctgtcgtcctgactaagttcgtcgagggagcccgcgaagtggagatggacgccgtcggcaaagatggtagagtcatctcacacgccatttccgagcacgtggaggacgcgggagtgcactcaggggacgcaacactgatgttgcccacccagactatatctcagggggccattgagaaagtgaaagatgccacaagaaagatcgcgaaagccttcgctatctcaggtcctttcaacgtgcagttcctggtcaagggtaacgacgtcttggtgatagagtgcaacctgcgtgccagccgatctttcccattcgttagcaaaaccctcggggtggacttcatcgacgtagcaactaaggttatgatcggcgagaacgttgacgagaagcatctgcctaccctggaccatccaatcatccccgctgactatgtcgctattaaagcccccatgttcagttggccacggcttcgggacgcggacccaattcttagatgcgaaatggcatctaccggcgaggtggcatgctttggcgagggtatccacaccgcttttctcaaggccatgctttctaccggctttaagatccctcaaaagggtatcctcattggcatccagcagtcctttagaccaagattccttggagtggctgagcaactccacaatgaaggttttaagctctttgccacggaggccaccagcgattggctgaacgctaacaacgttccggctacaccagtggcttggccaagccaagaaggccagaatccctctttgagtagtatccggaagttgatccgggacggctccattgacttagtcatcaatcttccgaataacaatacgaagttcgttcacgataactacgtcattaggcggactgcggtggacagcggcatacccctgctgactaatttccaggtcaccaagctatttgcagaggctgtgcaaaaatcccgaaaagtcgacagtaagtccttattccattatcgtcaatacagtgctggcaaggcagcc

SEQ ID NO: 8101 - DNA, 4500 bp, Artificial Sequence
  Description of Artificial Sequence: Synthetic coding sequence
atgacgcggatcttaaccgcctttaaggtggtgcggactttgaaaaccggctttggctttacaaacgtgaccgctcaccagaagtggaagttttctcgacctggcatccgtctgctatctgtcaaggcgcaaaccgcgcacattgtcctggaggacgggacgaaaatgaaaggctatagcttcgggcatccatcctcagtagccggcgaagtcgtattcaacactgggctcggcggttacccagaggccatcacggaccctgcatacaagggccagatcttgaccatggcgaatcccatcattggcaatggtggggcgcctgacactacagcccttgatgagctgggactctccaagtacctggagtcaaacggaattaaggtctcggggcttctggtactggactattctaaggattacaatcactggctggcaactaaaagcctgggtcagtggctgcaggaagagaaggttcctgccatctacggagttgacaccaggatgctgactaaaattatacgagacaagggaacaatgctgggcaagattgaattcgaaggccaaccagtggacttcgtcgaccctaacaagcagaacttgatcgccgaagtgtctactaaggacgtcaaggtttatgggaaaggcaatcctaccaaagtggtcgcggtcgattgtggtatcaagaataacgtcattaggctgctcgtgaagcgtggagccgaggtacatctggtaccctggaatcacgatttcactaaaatggaatacgacggcatcctgatcgcgggggggcccggcaatcccgctttggcggaacctcttatacagaacgtgagaaagatccttgaatcagatagaaaggaacctcttttcggcatctcaacaggaaacttaatcactggcctagcagccggagcaaaaacgtacaagatgagcatggccaaccgggggcagaatcagccagtgctaaatataaccaataaacaagcttttataaccgcacagaatcatggctacgcgctagataacacattacccgccggctggaagcccctgtttgtgaacgtaaatgaccagactaacgaggggatcatgcatgaaagtaaacctttcttcgcagtgcagttccaccctgaagttacgcctggtccaatagataccgagtatctgtttgattctttcttcagcctaataaaaaagggcaaggccaccacaattacctcagtgctgccgaagccagccctggtggcctcacgcgtcgaagttagcaaggtgctgattctcggttcggggggactaagcattggacaggccggagaattcgattatagtggttcgcaggccgtgaaggccatgaaagaggagaatgttaagacagtgctcatgaaccctaacatcgcttcggtccaaaccaacgaagtgggcctgaaacaggccgacacagtttattttctgcccatcactcctcagttcgtgactgaggtgatcaaagccgaacagcccgatggcctgatcctgggcatgggaggacaaactgcattgaactgtggagtcgagctgtttaaacgcggggtgctcaaggagtatggagtgaaggtgctgggcacaagtgtggaatctatcatggcgacagaggacaggcagctcttttcggataagctaaacgaaattaatgagaaaatagctccaagttttgcagtagagtccatcgaagatgcattaaaggcagccgacaccatcggttatccagtgatgatacgctctgcctacgctttgggcgggcttgggtccggaatctgtccaaatcgggagacactcatggacctgagcactaaggcgtttgcaatgacgaatcagattcttgtcgagaaaagcgtgacagggtggaaagagattgagtacgaggtagtgagggacgcggatgacaactgtgtgacagtgtgcaacatggagaacgtggatgcaatgggggttcatacaggtgactcggtcgtggtggcccccgcgcagacattgagtaacgccgaatttcaaatgctgcgccgaacctccatcaacgttgtacggcatttaggaattgttggcgaatgcaatatccagttcgcccttcacccgacttctatggaatattgcattatcgaggtaaacgcacggttaagccggtcgagcgccttggcatcaaaggctactggatatcccttagccttcatcgcagccaaaatcgctctcggaatcccactccccgagattaagaacgtggtctccggtaagacttccgcttgttttgagccctccttggattacatggtcacaaaaattccaaggtgggacctggaccgctttcacgggacatcctctcggattggctccagtatgaaaagcgtaggtgaagtgatggctatcgggaggacatttgaggaatccttccagaaagccctgcggatgtgtcacccctccattgaggggtttaccccgaggctgccaatgaataaggaatggccttccaatctcgatctgcgcaaagaactgtcagaaccatcaagtacccgtatatacgctatcgcaaaggccattgatgataacatgtcacttgatgagatcgagaaactgacttacatcgataagtggttcctgtacaagatgcgagacatcctcaacatggagaagactcttaagggcctaaacagcgagagcatgactgaagaaaccctgaagagagcaaaggagatagggttctcagacaagcagatttccaaatgtctgggcctgacagaagcccagactcgggagctgcgcctcaaaaagaacatccacccctgggtaaaacaaatcgacacactggcagcagagtatccgtcagtaacgaattacctctatgttacctacaatgggcaggagcacgacgttaactttgatgaccatgggatgatggtgttaggatgtggaccgtatcacataggatcttcggtggagtttgactggtgtgctgtgagttccattagaacccttaggcagcttggtaagaagaccgtggtggtcaactgtaatccagaaacggtgagtaccgattttgatgagtgcgacaagctctatttcgaggagctcagtctggaacggattctggacatctatcaccaagaggcgtgcggtggatgtatcattagcgttggcggccagatacctaacaatttagcagtgcccctttacaagaacggagtcaaaatcatgggaacatcacccctccagatcgatagggcggaagaccgttctattttcagcgccgtgttggatgaacttaaagtagcccaggcaccttggaaagcggttaataccctcaacgaggcccttgagtttgcgaaaagcgtggattacccctgtctgcttcggcctagttatgtgctgtccgggtcggccatgaatgttgtgttctccgaggacgagatgaagaaatttctagaggaggccacccgggtaagccaggaacatccagtggtactgaccaagtttgttgagggggctagagaagtagagatggatgccgttggcaaggatgggcgagtgataagccacgccataagcgagcacgtggaagacgctggcgtgcatagcggggatgcgacgctgatgttacccacccagacgatttctcagggtgcaattgaaaaggtgaaagatgctactagaaaaatcgcgaaagcatttgccattagcgggcccttcaacgtgcagtttctcgtgaagggcaatgatgtcctggtgattgaatgcaatctgcgtgcaagtagaagttttccatttgtgtcaaagacactgggcgtggatttcattgacgttgccacaaaggtaatgatcggcgaaaatgtggatgaaaagcatttgcccactctggatcatcccataatccccgcagactacgtggcgataaaagcgccaatgttcagctggcctcgcctccgagacgctgatcccattctgcgctgtgagatggcctcaacgggggaggtcgcttgcttcggggagggaattcacaccgctttcctaaaggccatgcttagcactggtttcaaaatcccccagaaggggattcttattggtatacagcagtccttccgtccccgctttcttggtgtggcagagcagctgcacaacgagggatttaagctatttgccacagaggcaaccagcgattggctgaacgctaacaatgtgcctgcaactcctgtagcatggccctcacaggaaggtcagaatccttctctgtcctcgatacggaagctaattagggacggttccattgatttggtgatcaacttgccaaacaataacactaagtttgtgcatgacaactacgtcattcgtcggacagccgtagattctggaattccgctgctgactaattttcaagtgactaagttgtttgcagaggctgtgcagaagtctagaaaggtagattccaaatctctgttccactaccggcagtactcagcaggtaaggccgca

SEQ ID NO: 8102 - DNA, 4500 bp, Artificial Sequence
  Description of Artificial Sequence: Synthetic coding sequence
atgaccagaattctcactgcattcaaggtagtgcgcacactcaaaactggatttgggtttacaaatgtgacagcacaccagaagtggaagttttcgcgcccgggcatccgtttactgtctgttaaagcacagactgcccacatagttctagaagacggcacaaaaatgaagggatattctttcggtcacccttctagtgtcgcaggagaggttgtcttcaatacaggattgggtgggtaccctgaggccattacagatcctgcctacaagggccaaatactgacaatggcaaacccgattattggcaacgggggtgcaccagataccaccgccctggacgagctcgggctgagcaagtatctggagtccaatggtattaaggtatcagggctccttgtactcgactacagcaaagattacaaccactggctggccacaaaatctctcgggcagtggctccaggaagagaaagtgcctgctatatacggagtggacactaggatgctgactaagattatcagggacaaagggactatgctgggcaagatcgagtttgagggtcagcccgttgattttgtggacccaaataagcagaacctgattgccgaagttagcacaaaggatgtgaaggtgtacgggaaaggcaatcccaccaaggtggtggcagtagactgcgggatcaaaaacaacgtgatacgccttctggtcaagaggggtgccgaggtacatctggtgccttggaaccacgatttcacaaagatggaatatgatggtattttgatcgccgggggaccaggtaaccctgccctggccgagccactgattcagaacgtgcgcaagatattggagagcgaccgcaaagaacccctctttgggatcagcacaggaaaccttatcactggcctggccgctggcgcaaaaacttacaagatgagcatggcgaacaggggccagaatcaaccggttttgaatataactaacaagcaggcgtttatcacagcccagaatcacggctacgccctggataatacactgcccgccggctggaagcccctgttcgtgaatgtgaacgatcaaacaaacgaggggattatgcacgaaagtaagccgttcttcgcagtgcagtttcatccagaagtgacccctgggcctatagatactgagtacctatttgattcatttttctctttgataaagaaaggcaaggcaaccacgatcactagcgtgcttcccaagccggccttggtggcgagccgagtcgaggtctcaaaggtacttattctgggaagtggaggtctgtctattgggcaggctggcgaattcgattactccgggagtcaggcagtgaaagccatgaaggaggaaaatgtgaagacagtgctcatgaatccaaacattgcctcggtgcagacaaatgaggtaggcctgaagcaggccgacacagtgtattttctccccattaccccccagttcgtcaccgaggtgattaaggcagaacagccggatggattaatcctgggaatgggcgggcagactgccctcaactgtggagtcgagctttttaagcggggagtattgaaagaatacggcgttaaagtgctggggacatcggttgaaagcataatggctactgaggaccgacagctgttctcggataagttaaacgaaattaatgagaagatcgctccttctttcgctgttgagagcatcgaggacgctctcaaggccgccgatactattggctatccggtaatgattcggagtgcgtacgcactcggcggattgggatccgggatatgtcctaatcgagaaaccttgatggatctaagcacgaaggcgttcgcaatgaccaatcagattcttgtcgagaaatctgtgacggggtggaaggagattgagtatgaggttgttcgcgacgccgacgataactgcgtgaccgtttgcaacatggaaaacgtcgacgctatgggggtgcataccggagatagtgtcgtggtcgcccccgcacaaacactgagtaacgcagagtttcagatgctgagacgtacaagcataaatgtggtgcgacatctgggcatagtaggggaatgcaatattcagttcgctctccatcctacctctatggaatactgcattatagaagtgaatgcccggctctctcggtcttctgccctcgcatctaaagccaccggctacccgctcgcatttatcgctgccaaaatcgcgctcggcatcccactgccagagattaagaatgtggtatccggtaaaacgagcgcctgctttgagcctagtctggattacatggtgaccaagatcccgagatgggacctggacagattccacgggacgagctctaggataggtagctctatgaagtccgttggagaagtaatggcgattgggcgaacgtttgaagaatccttccagaaggctctgcgcatgtgtcacccctctatcgagggatttactccgaggctgcctatgaacaaggaatggccaagtaatctcgacttaaggaaggagctgagtgaaccgtcctcgacaaggatttatgctatcgccaaggccatcgacgacaatatgtccttggacgaaattgaaaagctgacctacattgataagtggttcctttacaagatgagagacattctcaacatggaaaaaaccctcaaagggctcaacagtgagtcgatgacagaggagactttgaagcgcgctaaagaaataggcttctctgataagcagatttctaaatgcctcgggctcactgaggctcagacccgggagctgcgcctcaagaagaacattcacccctgggttaagcagatcgataccctggccgcggagtacccgtccgttactaattatctgtacgtgacgtataacggccaagaacacgacgtgaacttcgatgatcacggtatgatggtcctcggatgtggaccctatcatatcggttcaagtgttgaattcgactggtgtgctgtttcctccataaggactctgaggcaactggggaaaaaaacagtggttgtcaattgcaatcccgagacagtgtctaccgattttgacgagtgtgacaaactttactttgaggagctcagcttagagcgaatcttagacatctatcaccaggaggcctgtggcgggtgtatcataagcgtcggcggacagatccccaacaatctggcagtcccactgtacaagaatggcgtcaaaattatgggaactagtcctctgcagatcgatcgagccgaagaccggtctatatttagtgctgtgttggacgagctgaaggtggctcaggcgccttggaaggctgtgaacacactgaatgaagctctcgagtttgccaaaagtgtggattacccttgcttgctgcgtccatcctacgttctaagcggttccgctatgaacgtcgtgttcagcgaggatgaaatgaagaaatttctagaagaagcaactcgcgtatcccaagaacatcccgtggtgctgaccaagtttgtcgagggagcccgggaggtagagatggacgccgtgggcaaggacggtcgcgtgatctctcacgctattagtgagcacgtggaggatgcaggagttcattctggagacgctacgcttatgctgcctacgcagacaatatcccagggtgccatagagaaggtaaaggatgccactcgcaagatcgccaaagcattcgcaatctctggtccctttaatgtgcagtttcttgtgaagggcaatgacgtactggttattgagtgtaaccttagagcctcgagatcattcccctttgtgagcaagactctgggagtagactttattgatgttgccactaaggtcatgattggcgagaatgtggacgagaaacatcttcctacattagaccatccaattattcctgccgactatgtggcaataaaagctccaatgttctcatggccccgtctgagggatgcggaccccatcctgaggtgcgaaatggcctcaactggtgaagtcgcttgtttcggagaggggatccataccgcttttttaaaggccatgctgagtacagggttcaaaatcccccagaaaggcatcctcattggaatccagcagtctttccgaccaagattcctcggagtggctgagcagttgcataacgagggcttcaaattatttgccactgaggcgactagtgattggctgaacgcaaataacgttcctgccacccctgttgcgtggccatctcaggaggggcagaacccctcactgtcttcgatacggaaactgattagggacgggtctatcgacctggtgatcaatctgccgaataacaataccaagttcgtgcacgacaattatgtgattcggaggaccgctgtggacagcggaattcccctcctcaccaactttcaggtgactaagctattcgctgaggccgttcagaaatctcgtaaagttgatagcaagagcttgtttcactatcggcagtattcagcaggcaaggccgcc

SEQ ID NO: 8103 - DNA, 4500 bp, Artificial Sequence
  Description of Artificial Sequence: Synthetic coding sequence
atgaccagaatcctgacagcattcaaggtggtacgcaccctcaagacggggtttggctttactaatgttacggcccatcagaagtggaaattttcaaggcctggtattcgcctactcagcgtcaaagctcagaccgcacatatcgtcttggaagatggaaccaaaatgaaaggctactcctttggacatccgtcctccgtcgccggagaggtcgtcttcaacaccgggctaggcggttacccagaggcaattacagacccagcatataagggtcagatcctgaccatggccaaccccattattggaaacggaggggcccccgacactacagctttggatgaactcggactttcaaaatatctggagagcaatggaatcaaagtaagcggcctgcttgtgctggactactctaaggactacaatcactggcttgccaccaaaagcttggggcagtggctgcaggaagagaaggtcccagccatttatggggtagacacccggatgctcaccaagatcattcgggacaaggggaccatgttgggcaagattgagtttgagggtcagcccgttgatttcgtcgatccgaataaacagaatttaatagctgaagtgtctaccaaagatgtcaaagtctacggcaaagggaatccgaccaaggtagtggccgtggactgtggcattaaaaataatgtgattcggttgttggtgaaacggggcgccgaggtccacctagtcccctggaaccacgatttcaccaagatggagtatgatggcatcctcatagcgggaggtcccggtaatcccgcgcttgcagagcccctgatccagaacgtccgtaaaatcttagaatccgataggaaagagccactgtttggcataagtactgggaatctgattaccggcctggcagcgggcgctaaaacttataaaatgtctatggcaaatcgaggacaaaaccagcccgtcttgaacataacaaataagcaggcgtttatcactgctcagaatcatggatatgcactcgataatacgcttccggcgggctggaagccccttttcgttaacgtgaatgaccagaccaacgaaggaatcatgcacgagagtaagcccttcttcgctgtccaatttcaccctgaggtcacccccggtccaattgataccgagtacctttttgattcctttttcagcctgatcaagaagggaaaagctaccactattaccagcgtactgccaaagcccgcattagtggcctctcgggttgaagtatcaaaagtcctgattctgggaagtggcggtctctcgattggccaggctggggagtttgattactcggggagccaggctgtaaaagcgatgaaggaggaaaacgtgaagacagtacttatgaaccctaatattgcctctgtccagactaatgaggttggactgaagcaggccgacaccgtgtactttctgccaatcaccccacaatttgtcaccgaagtgatcaaagcagagcagccagatggactgatcctgggaatgggcggccagaccgctctgaactgtggagtagaattattcaaacgaggagtgcttaaagagtatggcgtcaaggtgttggggacctccgtggaaagtatcatggccacggaggatcgacaactgtttagcgataagctaaacgagatcaacgaaaagatagccccaagcttcgctgttgaatcaatagaagacgcactgaaggcggcagatacaatcggttaccccgtaatgattcgaagtgcctatgctctgggcgggctgggtagtggaatttgcccgaatagagagaccctcatggacctgagcacgaaagcatttgcaatgaccaatcagattctggtcgagaaaagcgtcacgggttggaaggaaattgagtatgaagtggtaagagatgccgatgacaactgcgttactgtctgtaacatggaaaatgttgacgctatgggggtgcacaccggggatagcgtggtggtcgctcccgcacagaccctatccaacgctgagttccaaatgctgcgacgaacctctatcaatgtggttaggcacctgggaattgtgggggaatgcaatattcagttcgccctacatccaaccagtatggaatactgcatcatcgaggtgaacgcccggttgagtcggagtagtgctttggcgagtaaagccactggctaccctctcgcttttatcgcggcgaaaattgcattaggcataccattgcccgaaataaagaacgtagtgtccggcaaaacgagtgcatgtttcgagccatctctcgactacatggttactaaaatccccaggtgggaccttgatcggttccacggtacatcctctaggattgggtccagcatgaagagcgtcggtgaagtgatggcgattggaagaacctttgaggagagctttcagaaagcactgaggatgtgtcaccccagcattgaaggcttcacccctaggcttccgatgaacaaagagtggccctccaacctcgatctccgcaaggagctatcagaaccctcttcgacgcgcatctatgccattgcgaaagcaatcgatgacaacatgagcttagacgaaattgagaaattaacatacatcgataagtggttcctctataagatgcgggacatcctaaacatggagaaaaccctcaaggggctgaacagcgaaagcatgaccgaagagacattaaagagagcaaaagaaatcggcttttccgataagcaaatcagcaagtgtctgggactcacagaggcacaaactcgcgaactgcggctcaaaaagaacatacacccctgggtaaagcagatagacactctcgcagccgaatacccgtccgtcacaaactacctctatgtcacatacaatggtcaagaacacgatgttaactttgacgaccacggcatgatggtgctaggctgcggaccctatcatattgggagcagcgtcgagttcgactggtgtgcagtctcttccatcaggacacttagacagttagggaaaaaaacagtggtagtgaactgcaatccagaaaccgtttccactgatttcgatgagtgcgataagctctactttgaggagcttagccttgagagaatactggatatataccatcaggaggcttgcggcgggtgtattatatctgtgggaggacagattcctaacaatctcgcagtgccactgtataagaatggagtcaaaatcatgggaacctccccactgcagattgaccgggctgaggacagatccatctttagtgccgtgctggatgaactgaaggttgcccaggccccctggaaggcagtcaatacactgaacgaggccctggaatttgctaaaagtgtggactacccttgcctgctaaggcccagttacgtcctgagtgggtccgcaatgaacgtcgtgttcagtgaagacgaaatgaagaagtttctggaggaggccacaagagtgagtcaggaacaccccgtcgtcctgaccaaatttgtggagggagctcgggaggttgagatggacgccgtgggcaaggacggaagagtgatctcccacgcaatttccgaacacgtagaagacgcaggcgtccacagtggcgatgcaactcttatgctgcccacccagaccattagtcagggcgctatcgagaaggttaaggatgccacgcggaagattgccaaggcttttgctatctctggacctttcaatgtccagttcctcgtgaagggaaatgacgtactcgtgatcgaatgtaatttaagggcctccaggtctttcccctttgtgtctaagaccctgggggtcgattttatagacgtcgccactaaagtgatgatcggagagaacgtcgacgagaaacacttacctaccctggatcaccccatcataccagcagactatgtcgccataaaggctcctatgttcagctggcctcgcttgagagacgctgatccaatcctccgttgtgaaatggcatccaccggtgaggtggcgtgcttcggcgaggggattcacacagcgttcctaaaggccatgctcagcacaggattcaagatccctcagaaagggattttgattggcattcagcagagcttccggcctcggttcctcggcgttgctgagcaactccacaacgaggggttcaaactcttcgcgactgaggccacatccgactggctgaatgctaacaatgtgccagctactcccgtcgcctggccgagccaggagggacagaaccccagcctgagtagtattcgcaaactcatccgtgacggttctattgacctggtgataaatctgccgaacaataatacaaagttcgtccatgataactacgtgattaggaggacagcagtggattccggtattcctttgctgactaactttcaggttactaagcttttcgctgaagccgtgcaaaaaagtcggaaagttgacagtaagtccctatttcactaccggcagtactccgccgggaaagccgcc

SEQ ID NO: 8104 - DNA, 4500 bp, Artificial Sequence
  Description of Artificial Sequence: Synthetic coding sequence
atgacgcgcatccttacagcctttaaagtggttcggactcttaaaaccggattcgggttcactaacgtgactgcccaccagaagtggaagttctcgagaccgggtattcggctgcttagcgtgaaggcgcagactgcacacatcgttctggaggacgggacaaagatgaaaggctactcctttgggcacccatctagtgtagccggcgaagtggtctttaatacagggctgggaggatatcctgaggcgatcacagatcccgcttacaaaggacagatcttaaccatggctaacccaataatcgggaacgggggtgctcctgacaccaccgcactagatgagttagggctgtctaagtaccttgaatccaatgggatcaaagtgagtggcctcttggtgctggactactctaaggattataaccactggctggctacgaaatctctgggacagtggttacaggaagagaaagtgcccgcgatctacggagttgacacccggatgttaaccaagatcatccgcgacaagggaactatgctgggcaagatcgagttcgaaggccagcccgtggattttgtggacccgaacaaacagaatttgatcgccgaagtcagcaccaaggatgtgaaagtttatggaaaaggaaatccaacaaaagtggtggcagttgattgcggcattaaaaacaatgttatccggctcttagtaaaacgtggggctgaggtgcatctggtgccatggaatcacgatttcacaaaaatggaatatgatggtattttgattgcaggtggccctggtaatcccgctctggcagagccactgatccagaacgtgaggaagattctcgaaagtgatcggaaggagccactcttcggcatatccaccgggaatctgatcacaggactcgccgcaggcgctaaaacgtacaagatgtccatggccaatcggggacaaaaccagccggtcttaaatatcactaataaacaagctttcatcaccgctcagaaccatgggtacgccttggacaacactctgcccgccgggtggaagccgctgttcgtgaacgtgaatgatcagacaaatgaagggatcatgcatgagagtaagcctttcttcgcagttcaatttcatccggaagttacccctggccccatcgacacagagtatctgtttgattcatttttctccctgattaagaagggaaaagccacaactataacttcggtactgcctaagccagccttggtggcttcccgggtagaagtctctaaggtattgatactcggatccggtggcctgtcaattgggcaggccggcgagttcgactactccggaagccaagcagttaaggcgatgaaggaagaaaatgtgaagaccgttctgatgaaccctaacatcgcgagcgtccagaccaatgaggtgggactgaagcaggccgacacggtgtacttcctgccaattactccccagtttgttaccgaagtaataaaagccgagcaacccgatgggctgatcctggggatgggcggccagacagcactgaactgtggtgttgaactttttaaacggggcgtgcttaaagaatatggggtgaaggttttggggactagcgtggaatcaattatggcaactgaggacagacagcttttctcggataagctgaatgagatcaatgagaagatagccccttcttttgccgtcgaaagcattgaggatgcactgaaggctgccgatacaatcggttaccccgtcatgatcagatccgcatatgcccttggagggctgggatctggtatttgccctaaccgcgagactctaatggacctgagtacgaaggctttcgccatgaccaatcaaatattggttgagaaatcagtgaccggatggaaagagattgagtatgaagttgtgagagatgccgacgataactgcgtaaccgtctgcaatatggagaacgtggacgctatgggggtccacacaggcgactctgtggtggtggcccccgctcaaactctcagcaacgccgaattccagatgctcaggaggacctccattaacgtcgtgaggcacctcggcattgtcggcgagtgcaatatccaatttgcactgcacccaacgtccatggaatattgcataatcgaagttaacgcccgcctctccaggtcatcggccctggcgtccaaagcaacaggttaccccctcgccttcatagctgccaaaattgccttgggtatcccattgccagaaatcaagaatgtcgtgagcggaaaaacatccgcctgttttgagcctagcctagattacatggtcactaaaatacctcgttgggatctggacagattccatgggacgtctagccgtatcggaagttccatgaaatccgttggggaggttatggcgatcgggcgaacattcgaggaaagttttcagaaggccctgaggatgtgccacccaagtatagaggggttcacaccaagactcccaatgaacaaagagtggcctagcaacttggacttgcgcaaggagctctcggaacctagctctactcgaatctacgctatcgccaaggccatcgatgacaacatgagcctagacgaaatcgagaagttaacctatattgacaagtggtttttgtacaaaatgcgtgacatcctgaacatggaaaagacgcttaaaggccttaactctgagtccatgactgaggagaccctgaaacgagctaaggagatcgggttttcagataagcagatcagcaagtgcttagggcttacagaggcccaaacacgggagttgcgtctcaaaaagaacatccacccatgggtcaagcagatcgacaccttggcagccgaatacccttctgtgacaaattatctgtatgtgacttataacggtcaagaacacgatgtgaactttgatgaccacggcatgatggtgctgggttgtggaccatatcatattggatcttctgtggaattcgactggtgcgcagtctcgtcgatccggacacttcggcagcttggaaagaagaccgtggtggtcaactgcaatcccgaaactgtctccacagacttcgacgagtgcgataaactgtattttgaggagctgtctttggagagaatcctggacatctaccaccaagaagcatgcggcggatgtatcatatcagtaggaggacagattccaaacaacctggccgtgcctctctataaaaacggcgtgaagatcatggggacgtctcccttacagattgacagagctgaggaccggtctatatttagtgctgtgctggacgagttgaaagttgcgcaggcaccctggaaggctgttaacaccttgaacgaagctcttgaatttgctaagtccgtagactatccctgccttctccggcccagttatgtgttgagcgggtccgccatgaatgtcgtgttcagtgaggacgagatgaagaagttcctggaagaagccacccgcgtcagccaagaacacccagtcgttctcacaaaatttgtcgagggggcccgcgaggttgagatggatgccgtaggaaaagatggtagagtgatttcgcacgcgattagcgagcacgtggaagacgcaggtgttcactccggcgatgccacactcatgctgcccacacagacgatatctcagggagccattgaaaaggtaaaggatgctacacgtaaaatcgctaaggcatttgccatttctggtccttttaatgtgcaattcctggtcaagggcaatgacgtgttggtaattgagtgtaatctgcgggcttcccggtcgttcccctttgtctcgaagacgctgggcgtggactttatcgatgtggccaccaaggtgatgattggggagaatgtcgatgagaaacatttgccaacgctggaccaccctatcataccagccgactatgtggctatcaaggccccgatgttcagttggcctagattacgcgatgctgatcctatcctgagatgcgagatggccagtactggcgaggtggcctgttttggggaggggatccacacggcttttctgaaggccatgctctctactggctttaagatcccccagaagggaatcctgattgggatccaacagtctttccggccacgctttttgggcgtggcggagcagttgcataatgaaggctttaagttgtttgctactgaggccacatccgactggctgaacgctaacaacgtgccagcgaccccagtagcttggccgtctcaggaaggacagaacccaagcctctctagtattcgcaaactgatacgggacggctccatagatctcgtgattaatttgccaaataataatactaaattcgtccacgataattatgtcattcgtaggacagctgtcgactctgggatcccgttgctcactaactttcaagtgacaaagttgttcgccgaagccgttcagaaatcacgcaaggtggactccaaaagcctgtttcattacaggcagtatagtgccgggaaggcagct

SEQ ID NO: 8105 - DNA, 4500 bp, Artificial Sequence
  Description of Artificial Sequence: Synthetic coding sequence
atgacgcgaatactaacggcgtttaaagtagtacgaacgttaaaaacgggttttggttttacgaatgtaacggcgcatcaaaaatggaaattttcgcgaccgggtatacgtctactatcggtaaaagcgcaaacggcgcatatagtattagaagatggtacgaaaatgaaaggttattcgtttggtcatccgtcgtcggtagcgggtgaagtagtatttaatacgggtctaggtggttatccggaagcgataacggatccggcgtataaaggtcaaatactaacgatggcgaatccgataataggtaatggtggtgcgccggatacgacggcgctagatgaactaggtttatcgaaatatctagaatcgaatggtataaaagtttcgggtctactagtactagattattcgaaagattataatcattggttagcgacgaaatcgttaggtcaatggttacaagaagaaaaagtaccggcgatatatggtgtagatacgcgaatgttaacgaaaataatacgtgataaaggtacgatgttaggtaaaatagaatttgaaggtcaaccggtagattttgtagatccgaataaacaaaatctaatagcggaagtatcgacgaaagatgttaaagtatatggtaaaggtaatccgacgaaagttgtagcggttgattgtggtataaaaaataatgttatacgtttactagtaaaacgaggtgcggaagtacatttagttccgtggaatcatgattttacgaaaatggaatatgatggtatactaatagcgggtggtccgggtaatccggcgctagcggaaccgctaatacaaaatgttcgaaaaatattagaatcggatcgaaaagaaccgctatttggtatatcgacgggtaatttaataacgggtttagcggcgggtgcgaaaacgtataaaatgtcgatggcgaatcgtggtcaaaatcaaccggtactaaatataacgaataaacaagcgtttataacggcgcaaaatcatggttatgcgttagataatacgttaccggcgggttggaaaccgttatttgttaatgtaaatgatcaaacgaatgaaggtataatgcatgaatcgaaaccgttttttgcggtacaatttcatccggaagtaacgccgggtccgatagatacggaatatctatttgattcgtttttttcgttaataaaaaaaggtaaagcgacgacgataacgtcggtattaccgaaaccggcgttagtagcgtcgcgagttgaagtatcgaaagttttaatattaggttcgggtggtttatcgataggtcaagcgggtgaatttgattattcgggttcgcaagcggtaaaagcgatgaaagaagaaaatgtaaaaacggtattaatgaatccgaatatagcgtcggttcaaacgaatgaagttggtctaaaacaagcggatacggtatattttctaccgataacgccgcaatttgttacggaagtaataaaagcggaacaaccggatggtctaatactaggtatgggtggtcaaacggcgttaaattgtggtgtagaattatttaaacgtggtgtattaaaagaatatggtgtaaaagttttaggtacgtcggtagaatcgataatggcgacggaagatcgacaattattttcggataaattaaatgaaataaatgaaaaaatagcgccgtcgtttgcggttgaatcgatagaagatgcgctaaaagcggcggatacgataggttatccggttatgatacgatcggcgtatgcgttaggtggtctaggttcgggtatatgtccgaatcgtgaaacgctaatggatttatcgacgaaagcgtttgcgatgacgaatcaaatactagttgaaaaatcggtaacgggttggaaagaaatagaatatgaagttgttcgtgatgcggatgataattgtgtaacggtatgtaatatggaaaatgtagatgcgatgggtgttcatacgggtgattcggtagtagtagcgccggcgcaaacgctatcgaatgcggaatttcaaatgttacgacgaacgtcgataaatgtagttcgacatttaggtatagtaggtgaatgtaatatacaatttgcgctacatccgacgtcgatggaatattgtataatagaagttaatgcgcgtctatcgcgatcgtcggcgttagcgtcgaaagcgacgggttatccgctagcgtttatagcggcgaaaatagcgctaggtataccgttaccggaaataaaaaatgtagtatcgggtaaaacgtcggcgtgttttgaaccgtcgctagattatatggtaacgaaaataccgcgttgggatttagatcgttttcatggtacgtcgtcgcgtataggttcgtcgatgaaatcggttggtgaagtaatggcgataggtcgaacgtttgaagaatcgtttcaaaaagcgctacgaatgtgtcatccgtcgatagaaggttttacgccgcgtttaccgatgaataaagaatggccgtcgaatttagatctacgtaaagaattatcggaaccgtcgtcgacgcgaatatatgcgatagcgaaagcgatagatgataatatgtcgttagatgaaatagaaaaattaacgtatatagataaatggtttttatataaaatgcgtgatatactaaatatggaaaaaacgctaaaaggtttaaattcggaatcgatgacggaagaaacgctaaaacgtgcgaaagaaataggtttttcggataaacaaatatcgaaatgtctaggtttaacggaagcgcaaacgcgagaactacgtttaaaaaaaaatatacatccgtgggtaaaacaaatagatacgttagcggcggaatatccgtcggttacgaattatttatatgtaacgtataatggtcaagaacatgatgtaaattttgatgatcatggtatgatggttttaggttgtggtccgtatcatataggttcgtcggttgaatttgattggtgtgcggtatcgtcgatacgtacgttacgtcaattaggtaaaaaaacggttgtagtaaattgtaatccggaaacggtatcgacggattttgatgaatgtgataaactatattttgaagaactatcgctagaacgaatactagatatatatcatcaagaagcgtgtggtggttgtataatatcggtaggtggtcaaataccgaataatttagcggtaccgttatataaaaatggtgtaaaaataatgggtacgtcgccgttacaaatagatcgagcggaagatcgttcgatattttcggcggtactagatgaactaaaagtagcgcaagcgccgtggaaagcggtaaatacgctaaatgaagcgttagaatttgcgaaatcggttgattatccgtgtttactacgtccgtcgtatgttttatcgggttcggcgatgaatgtagtattttcggaagatgaaatgaaaaaatttttagaagaagcgacgcgagtatcgcaagaacatccggtagttttaacgaaatttgttgaaggtgcgcgagaagtagaaatggatgcggttggtaaagatggtcgtgtaatatcgcatgcgatatcggaacatgttgaagatgcgggtgtacattcgggtgatgcgacgctaatgctaccgacgcaaacgatatcgcaaggtgcgatagaaaaagtaaaagatgcgacgcgaaaaatagcgaaagcgtttgcgatatcgggtccgtttaatgtacaatttctagtaaaaggtaatgatgttctagtaatagaatgtaatctacgtgcgtcgcgttcgtttccgtttgtatcgaaaacgttaggtgttgattttatagatgtagcgacgaaagttatgataggtgaaaatgtagatgaaaaacatttaccgacgttagatcatccgataataccggcggattatgtagcgataaaagcgccgatgttttcgtggccgcgattacgtgatgcggatccgatattacgatgtgaaatggcgtcgacgggtgaagtagcgtgttttggtgaaggtatacatacggcgtttctaaaagcgatgttatcgacgggttttaaaataccgcaaaaaggtatattaataggtatacaacaatcgtttcgtccgcgttttttaggtgtagcggaacaattacataatgaaggttttaaattatttgcgacggaagcgacgtcggattggttaaatgcgaataatgtaccggcgacgccggttgcgtggccgtcgcaagaaggtcaaaatccgtcgctatcgtcgatacgtaaactaatacgagatggttcgatagatttagtaataaatttaccgaataataatacgaaatttgtacatgataattatgtaatacgtcgaacggcggttgattcgggtataccgttactaacgaattttcaagtaacgaaactatttgcggaagcggttcaaaaatcgcgtaaagtagattcgaaatcgctatttcattatcgtcaatattcggcgggtaaagcggcg

SEQ ID NO: 8106 - DNA, 4500 bp, Artificial Sequence
  Description of Artificial Sequence: Synthetic coding sequence
atgacccgaatcctgacagctttcaaagtcgttcgaacattaaagaccggattcggtttcactaacgtaacagcgcatcagaagtggaaattctctcgacctggaattcggttgctctctgttaaagcccagaccgcccatattgtgctggaagatggcaccaaaatgaagggatattccttcggccacccttcctctgtggcaggcgaggtggtctttaacaccggattgggagggtatcccgaggctatcactgaccctgcttacaaggggcagatcctgaccatggctaaccccatcataggcaatggcggcgctcccgatacaaccgcgttagacgagcttggtctcagtaaatatctagaatctaatgggattaaggtgtccgggcttttggtcctggactactcgaaagattacaatcattggcttgcaaccaagtccctggggcaatggctacaagaagagaaggttcccgctatctacggagttgatacaagaatgctcaccaagattatccgagacaagggtaccatgcttgggaagatcgagttcgagggccagccggtcgactttgtggatccgaataagcagaacctcatcgccgaggtgtcgaccaaggatgttaaagtgtacggtaaaggcaacccaactaaagtcgtagccgtggattgtgggatcaaaaacaacgtcattaggcttctcgtcaagaggggggccgaggtgcatctcgtgccttggaaccacgattttacaaagatggagtatgacggtatccttatcgcgggcggccccggcaaccccgcgcttgccgagcccctcatccagaatgtgcggaaaatccttgagtctgatagaaaggagccactgttcggcatctccactgggaatttgataaccggcctagctgccggcgctaagacctataagatgagcatggccaacagagggcagaatcagcccgtgctgaacattaccaataaacaggcgttcattacagcccaaaaccacggatacgccctcgataatacgctgccagcaggatggaagccacttttcgtgaacgtgaatgatcagaccaatgagggaataatgcatgaatctaagcctttcttcgccgtacagttccaccctgaggtgacgcctgggcccatcgacaccgaatatctgtttgactcctttttcagcctgataaaaaagggtaaggcgacaacgataacctctgttctgcctaagcccgcactcgttgcgagccgcgtggaggttagcaaagtgctgatcctggggtccggggggctgtcaattggacaagcaggagagtttgattacagcggctcacaagctgtcaaggcaatgaaggaggaaaacgtgaaaaccgtgctgatgaaccctaacatcgctagcgtgcagaccaatgaggtcggtcttaagcaggccgatactgtgtacttccttcccataacccctcagtttgtaacagaggtgattaaggctgaacagcctgatggcctgattttagggatgggtggacagaccgccctgaactgtggagtggagctgttcaagcgaggggtcttaaaagagtatggcgtcaaggtgctggggacctccgtggagagcattatggcaacggaggacaggcagcttttttccgataagctcaacgaaataaatgagaaaatcgccccaagcttcgctgtagagtccattgaggacgctttaaaagcagccgacaccattgggtatccagtcatgattcgatcagcgtacgctctcggcggacttggctcaggaatatgccccaacagggagacgctgatggacctcagcacgaaggcctttgcgatgaccaatcagatcctcgtcgagaagtccgtaaccggctggaaggagatagaatacgaggtggtgcgcgacgccgatgataattgtgttaccgtgtgtaatatggagaatgtagatgccatgggagtgcacacaggggactctgtggtcgtcgctccggctcagacactgagcaacgccgaattccagatgctgcgtagaactagcatcaatgtcgtacgccatctcgggatagtcggggagtgcaatatccagtttgccctgcaccctacatccatggaatactgtatcatcgaggttaacgcaagactgtcccgcagttcagcactggcgtccaaggccaccggctaccctttggctttcatcgccgccaagatcgccctcgggatcccgttacctgagattaaaaatgttgtgtcaggtaaaactagtgcctgcttcgagcccagcctggattatatggtgacaaagatccctaggtgggatcttgatcggttccatggcaccagttccaggatcggtagctccatgaagtcggtaggcgaggtgatggcaatcgggagaacttttgaagagagcttccaaaaggccctgcggatgtgccacccatctatagagggcttcaccccgagactgccgatgaacaaagaatggccatctaacctggatcttcgaaaggaattgtccgaaccttctagcacacgaatctacgccatagcaaaagccattgatgacaatatgagcctggacgaaatagagaagttgacctatatcgataagtggttcctgtacaagatgcgagatatactcaacatggaaaagacacttaaaggtctgaatagtgagagcatgaccgaagaaacgcttaaacgcgccaaagagatcggatttagcgataagcagattagtaaatgtctgggactgacagaagcacagacaagggagctcaggctgaagaaaaatatccacccctgggttaagcagatcgatactctggcggcagagtacccttcagtaaccaactacctgtacgtcacttacaacggacaggagcacgacgtgaattttgacgatcacggtatgatggtgctcgggtgtgggccctaccacattggcagctctgttgagttcgattggtgtgccgtgtcttcaatacgcacactgagacagctgggcaagaagacagtggttgtaaattgcaatcccgagaccgtgtctactgactttgatgaatgcgataagttatacttcgaagagttatcccttgagagaatcctcgatatttaccatcaggaggcttgcggcggttgcatcatctcagtgggcggccagattccaaacaacctggccgtacccctgtataaaaatggcgtaaagattatgggcacttcccctttgcagattgaccgcgctgaggacagatcgattttctctgccgtgctggatgagctcaaagtggcacaagcaccctggaaagcggtcaacaccttgaatgaggccctggagttcgcgaagtctgttgactatccttgcctcctccgcccttcttacgtgctgagcggctctgcgatgaacgtggtgttcagtgaggacgagatgaagaagttcctcgaagaagcaacccgggtgagtcaggaacacccggtggtgttaaccaagtttgtggaaggggcacgggaggtggaaatggacgctgtgggaaaagatggaagggtgatctctcatgctattagtgaacatgtggaagatgcaggggtccattccggggacgctactctaatgctgcctacacagaccatctcgcagggcgccatcgagaaggtgaaagacgcgacccgcaaaatcgcaaaggctttcgcaatcagcggccctttcaatgtacagttcctggtcaaaggcaatgatgttctggtgatcgagtgtaaccttcgggcaagcaggtcttttcccttcgtaagtaagacgttgggggtagatttcatcgatgtggcaacgaaggtcatgatcggcgagaacgtggatgaaaagcacctgcctacgcttgaccatcctattattccggcagactacgtcgccattaaagcccctatgttcagctggccgcggttaagagacgctgatcctatcctgcgatgtgagatggcttcgaccggagaggtagcatgtttcggagagggtatacacaccgcatttctgaaggcaatgctttccaccgggtttaagatacctcaaaaaggcatactcatcgggatccagcagagttttcggccgaggttcctcggtgtagctgagcagctgcataatgaaggatttaagctgttcgcaactgaagcaaccagcgattggttgaatgctaacaatgtgccggcaacccctgtcgcatggccctcccaggaggggcagaaccccagtctatccagtatcagaaaactcattagggacggaagtatcgatcttgtgatcaatctgcctaataataacacaaagtttgtccacgacaactatgtgattcgaaggaccgcagtggactctggcatcccactgctgactaattttcaggtgactaagttattcgccgaggccgtgcagaagagccggaaggtggacagcaaaagcctctttcattatagacagtattccgccggaaaagcagct

SEQ ID NO: 8107 - DNA, 4500 bp, Artificial Sequence
  Description of Artificial Sequence: Synthetic coding sequence
atgacgagaatactgacagcatttaaagtagtacgcacattgaaaacgggtttcgggtttacaaacgtaacggcacatcaaaaatggaaattttctcgaccggggattcgtcttttatccgttaaagcccagacagctcatattgtactggaggatgggacgaaaatgaagggatactcttttggccatccatcttctgtcgctggtgaagtagtgtttaatacgggcctgggcgggtacccggaagcaattacggacccggcatacaaaggacaaatactgacaatggccaacccaattatcggaaatgggggggccccggacacaactgccctcgacgagctgggcctgtcaaaatacttagaatctaacggcatcaaggtttctggtttattagtcttagattattctaaggattataaccactggcttgcaaccaaaagcctgggacagtggttgcaagaagaaaaggtccctgcaatttacggggttgacaccaggatgctgaccaaaataattcgggacaaagggacaatgctgggtaaaatcgaatttgaaggccaaccagtcgatttcgtcgacccgaataagcaaaatttaattgctgaagtatcaaccaaggacgtcaaagtctacggaaaaggcaatcccacaaaagtcgttgccgtggattgtggaataaagaacaatgttattcgccttctggtcaagagaggcgctgaagtgcacctggtgccgtggaatcatgattttactaagatggagtatgatgggattcttatcgcagggggacctggaaatccggcattagcggagcctttgatacagaatgtacgcaagatcttggaatcagatcgcaaggagccacttttcggcatatctacggggaatctcattacaggtcttgccgcgggcgcaaaaacctataaaatgtcaatggcaaatagaggccagaatcaacctgttttgaatataacgaacaagcaagcctttattacagcgcagaatcatggatatgccttggacaatacgctgcccgcgggctggaagccccttttcgtgaacgtcaacgatcagacgaatgaaggcatcatgcatgagtctaaaccgttttttgcagttcaatttcatccagaggtcacgccgggcccgatcgataccgaatacctgtttgactcctttttcagcttgatcaaaaaaggcaaagctacgaccatcacgtcagtcttgcctaaaccagccctggtggcctctcgcgtcgaagtatccaaagttctcatcttaggttccggcggactttccattggccaagctggtgaatttgattattctggctcacaagcagtaaaggctatgaaggaggagaatgttaaaacagtgctcatgaacccgaacattgcaagtgttcagacaaatgaggttggattaaaacaggccgacacggtctattttttgccgattacccctcagtttgttacggaagtcattaaagcagaacagccggacggccttattttaggcatgggtggacagactgctttaaactgtggagtcgagctttttaaacggggcgtattaaaagaatatggcgtgaaagtattaggaacgagcgtggaaagcatcatggctacagaagaccgtcagctgttttcagataaactaaacgaaattaatgaaaaaattgcgccatcatttgctgtggaaagcatagaagatgcgttgaaagctgccgatacaattggctatccggtgatgatccgtagcgcttacgcccttggagggctgggtagcggcatttgtcctaaccgcgagacgctgatggacctttcaactaaggcatttgcaatgactaaccaaatcttagtagaaaaaagcgtgacaggttggaaagaaatcgaatacgaagtggtaagagatgccgatgataattgcgtaacagtttgtaacatggaaaatgtggatgcaatgggagtccacactggagattctgtggtcgttgctcctgcgcagaccctgagcaatgctgaatttcaaatgctgcgtagaacatcgatcaacgtcgtgcggcatctgggcattgttggcgagtgtaatatccaattcgccttacatccgacgtctatggaatactgcattattgaagttaacgcgcggttatccagatcttctgcacttgcgtctaaagctacaggttatccgctggcgtttattgcagcaaaaattgcgctgggtattccgctgccggaaattaagaatgtcgttagcgggaagacatctgcttgctttgaaccaagccttgattatatggttacaaaaataccccgttgggaccttgatcgcttccacggaacgtcaagcagaataggttcgagcatgaaatcagttggcgaagtgatggcgattggccgtacatttgaagaatcatttcagaaagcgttgcgaatgtgtcatccgagcattgagggatttacaccgcgattgccgatgaataaagagtggccttcaaatttagatcttagaaaggaactgtcagaaccaagtagcacacgaatttatgcgattgctaaggctattgatgataacatgtcattggatgaaatcgagaagttgacgtacattgataaatggtttctgtacaaaatgagagacattctcaatatggaaaaaacattgaaaggactgaattctgaatctatgacagaagagaccttgaaacgtgcaaaagaaattggcttttcagataagcaaatttccaagtgtcttggtttgactgaagcccaaacgcgcgagctacgcttgaaaaagaacatccatccttgggtgaagcagattgatacattggctgctgaatatccttccgtaacaaactatctttatgttacatataacggacaggagcatgatgttaactttgatgaccatggcatgatggttcttggatgtggcccttaccatattggatctagtgttgaattcgattggtgcgctgtatcctcaatccgtacattacgccaactgggtaaaaaaaccgttgtagttaactgcaatccggaaacggtatcgactgattttgacgagtgtgacaaactttattttgaagaattaagtctagaacgtattttagatatttaccatcaggaagcgtgtggaggctgtataatttcggttggcggtcaaattccaaacaatctggcagtcccgctttataagaatggagtgaaaataatgggaacttcaccgcttcagatcgatagagcagaggacagatcaattttttcagctgtcctggacgaacttaaggtagcgcaagcaccatggaaagcagttaatactttgaatgaagcacttgaatttgcaaaatctgttgattatccgtgcttactccgtccgtcatatgtactttcaggttctgctatgaatgtcgtgttctcagaagatgagatgaagaagtttttggaagaagcgacgcgcgtgtcccaggaacatcctgtcgtgttaaccaagttcgtcgagggtgcgcgtgaggtcgaaatggatgctgttggaaaagatggccgcgttatttctcacgctatcagtgagcacgttgaagatgctggcgtgcattcgggcgatgccacactgatgctgcctactcaaactatctctcagggggccattgagaaagttaaggatgctactcgcaaaatcgccaaagcttttgctatctcaggtccattcaacgtgcaatttctggtaaaaggtaatgatgtcctggttatcgaatgtaatctaagagcaagtaggtcatttccatttgtttcaaagacattgggtgttgatttcattgatgttgcgacaaaagtgatgattggcgagaacgttgacgaaaaacatcttccaactttggatcacccgataataccagcggattatgttgccattaaagcaccgatgttttcatggccacggctgagagacgctgatccaatcttaagatgtgaaatggcgtcaacgggcgaagttgcgtgttttggcgagggcatccacacagcgttccttaaagcgatgttgtcaaccgggtttaagattccgcaaaaaggtattctgattgggattcaacaatcctttcggccgcggtttctgggagtcgccgaacaacttcataatgaaggcttcaagctttttgctacggaagctacgagtgattggctgaacgcaaataatgtcccggcgacacctgtagcatggccttcacaggaaggacagaatccgtctctttcaagtatcagaaaactcatccgagacggttctatagatttagtgattaatctgccgaacaacaatacaaaatttgtgcatgataactatgttattcggcgaacagcggtcgactcaggtattccgctactcacaaattttcaggtgacaaaattgtttgcagaggcggtccaaaaatcacgtaaggtggatagcaaatcattgtttcattacagacagtatagtgctggcaaggcagcg

SEQ ID NO: 8108 - DNA, 4500 bp, Artificial Sequence
  Description of Artificial Sequence: Synthetic coding sequence
atgacgaggatactaactgcattcaaagtagtgagaaccctcaagacaggctttggctttactaacgtgaccgctcaccagaagtggaagttcagccgacctggcatcaggctcttgagtgtcaaagctcagaccgcgcacatagtgctggaggatgggacgaaaatgaagggctatagtttcggccacccgagctccgtggctggcgaagtggtgttcaacaccgggctcggtggatatcccgaagcaatcacagatcccgcttacaaagggcagatcctaactatggcgaatcccattatcggcaacggcggcgcccctgataccactgctcttgatgagctgggcctttccaagtacctggagagcaatgggatcaaagtctccggtctattggtgctggactattccaaggattataaccactggttggccacgaaaagcttgggccagtggctccaggaggaaaaggtaccggcaatctacggagtggatacaaggatgcttaccaaaatcatccgcgataagggcaccatgctaggtaagattgagttcgaagggcagcccgtggatttcgtggatccgaacaaacagaacctaattgcagaagtaagtaccaaagatgtgaaggtctatggtaaaggcaatcctacaaaggtcgttgcagtggactgtggcataaagaacaacgtgattcggctgttggtcaagagaggagcagaagttcacctagtaccctggaatcatgattttaccaaaatggaatacgacggcatcctaatcgcaggcggacccgggaatcctgctttggcagagccgctcatccagaacgtcaggaagattctggagtctgatcgaaaggaacccttgttcgggatatccacagggaaccttatcactggactagccgccggagccaagacgtataaaatgagtatggctaataggggacagaatcagccagtcctgaatatcacaaacaaacaggcctttatcactgcacagaaccatggatatgcgcttgataacactttgccagccggctggaaaccactgttcgttaatgtcaatgatcagactaatgaaggtattatgcacgagtctaagcctttcttcgccgtgcagtttcatcccgaggtcacccctggccctatcgatacggaatacctgttcgatagctttttctccctcattaagaaaggcaaagctaccaccattacctctgtgctacctaagccggccctagtcgcatccagggttgaggtgagtaaggtgttaatcttgggctccggggggctgagcattggacaggccggtgaatttgattattctggttcccaggcagtgaaggctatgaaagaagagaacgtgaagaccgtcctaatgaatcctaacatcgctagcgtccagaccaatgaagtcggtctgaagcaggctgatacagtctacttcctgcctattacacctcaatttgtgacggaggtaataaaagccgaacaaccggacggtctgatcctgggaatgggcggacagactgccctgaactgcggggtggagctgttcaagagaggagtgctgaaggaatacggagtcaaagtgctggggaccagtgtggaaagtatcatggcgaccgaggacaggcagctctttagtgacaaattgaacgagataaacgagaaaattgccccttccttcgcagtggagtcaattgaagacgccttgaaggctgctgacaccatcggctatcctgtgatgataagatcggcctatgctctagggggcctcggaagtgggatttgtcctaacagggaaacactaatggacctgtctacgaaggctttcgcaatgactaaccagatactggtggaaaagagcgtgacagggtggaaggagattgaatacgaggtggttagagacgccgacgataactgcgtcactgtctgcaacatggagaatgtggacgcgatgggcgtgcatactggagactcagtggtggtggctcccgcccagacactgtccaacgccgagtttcaaatgttgagaagaacatcaatcaatgtggtcagacacttagggatagtgggcgagtgtaacatccagttcgcactccaccccacatccatggagtactgtatcatcgaggttaatgctagactatcgcggtcaagcgcccttgcctcaaaagccacaggctacccactggccttcatagcagctaagatcgcccttggaatacccctgccagaaatcaaaaacgttgtctccgggaagacatcagcgtgtttcgagccatctctggactatatggtgaccaagatcccccggtgggatttggaccggttccacggcacaagttctcggattggctcctcaatgaagagtgtgggagaggttatggcaattgggcgcacattcgaggagagctttcaaaaagccctgagaatgtgccatcccagtatcgagggattcaccccgcgacttccaatgaacaaggaatggccatccaatctcgatctgcgcaaggaactctccgaacctagctctactaggatttatgcgatcgctaaagccattgatgataacatgtctctggacgaaatcgaaaagctcacctacatcgacaagtggttcttatataagatgcgcgacatcctgaacatggaaaaaacgttgaagggccttaattccgaatcaatgacggaggaaactctgaagagggctaaggagataggcttctccgacaagcaaatctcaaaatgtcttggcttaaccgaggcacagacaagggagttgcgacttaagaaaaatattcacccatgggtgaagcagattgataccctggccgcagagtaccccagtgttacgaactacctctatgtcacctacaatggtcaagaacacgatgtcaatttcgacgatcatggaatgatggtgctcggatgtgggccatatcacattggtagcagcgtcgaatttgactggtgcgctgttagttccattaggacactgcgacagctcgggaagaaaaccgtcgtggttaactgtaaccccgagacggtatccaccgattttgatgaatgcgacaagctgtatttcgaggagctgagtctggagcggatcttagacatctatcatcaggaagcctgtggcgggtgcatcatctcagtgggagggcagattccgaacaacttggccgtgccactttacaagaacggcgtgaaaatcatggggacatcaccgcttcagatcgacagggcagaggatcgctcaatcttctccgcagtccttgacgaactcaaggtggcccaggccccctggaaagccgttaatactctgaatgaggcactcgagtttgccaagtccgtcgattacccatgtttactgcgcccatcttatgtgctttctggcagcgctatgaacgtggtcttttctgaggatgagatgaagaaattcctggaggaggcgaccagagtgtcgcaagagcatccagttgtgctgacaaaatttgtggaaggggcacgggaggtggagatggatgcagtggggaaggatggcagagttatcagtcatgcaatctccgagcacgtagaggacgccggtgtgcactccggcgatgctacactgatgctgccgacacagacaatttctcagggggcaatcgagaaagtgaaggacgcaacccggaaaattgctaaggcctttgctatcagtggcccgtttaatgtgcagttcctggtcaaagggaacgacgtgctggtcatcgagtgtaatctgcgtgctagccgctcctttccttttgtctccaagaccctgggggtcgattttattgatgtagctactaaggtaatgataggcgaaaatgtcgacgagaagcatctccccaccttagaccacccgattatcccagccgactatgtggccatcaaggccccaatgtttagctggcccagactgagagatgccgacccgattctacgctgcgagatggcgtccaccggggaggtggcatgcttcggcgagggcattcacactgcgttcctaaaagccatgttaagcacagggtttaagatccctcagaagggcattctgatcggaatccaacagtccttcagaccccggttcctcggggtcgcggaacagttgcacaatgaagggtttaagcttttcgcaacggaagccacgtccgactggctaaatgccaacaatgtacctgccacccccgtggcttggccttcgcaagagggacagaaccccagccttagcagcatccggaaactaattagggacgggagcattgatcttgtgatcaacctccccaacaacaacacgaagttcgtgcacgacaactacgtgatccggcgtacagccgttgactctggcattcccctcctgacaaatttccaggtcaccaagttgttcgccgaggctgtgcagaagagtagaaaagtggacagtaagtccctttttcattaccgccagtactccgccgggaaggccgct

SEQ ID NO: 8109 - DNA, 4500 bp, Artificial Sequence
  Description of Artificial Sequence: Synthetic coding sequence
atgactaggatcctcacagctttcaaggtcgtgcggacgctgaaaactgggttcgggttcacaaatgtgacagcccatcagaagtggaagtttagcaggcctggcatacggttgctctctgtaaaggcccagactgcacatattgtcttagaggacggtacaaaaatgaaaggatattccttcggtcaccctagtagcgtagctggcgaggttgtgttcaacactggactgggcggttatcctgaggctatcactgatccagcatacaagggccagatcttaacaatggcaaatcctattattggcaacgggggcgcccccgatactaccgccctggacgagctgggtctgtctaagtatttggagtcaaatggaatcaaagtgagcggcctcctcgtattagactacagcaaagattataatcattggctggccactaagagtcttgggcagtggctgcaggaggaaaaggttcctgcaatctacggtgtggatacacggatgctgacaaaaatcattagggataaaggcactatgctagggaaaatagagtttgagggccagccagtagattttgtggatcccaataaacaaaatcttatagccgaagtttctacaaaggacgtgaaagtttatggtaagggtaacccaactaaagtcgtagccgttgactgtggaattaagaacaacgtgatcagacttctggtgaaacgtggggccgaggtgcacctcgttccctggaaccatgattttacaaagatggagtatgacgggatcctgatcgccggcggaccaggcaatcccgctctcgctgagcctctgatacagaatgtacggaagatattggagtccgatagaaaggagccactgttcggtattagtaccggaaatctgatcacagggcttgcggctggtgcaaaaacatataagatgtctatggccaatagagggcagaaccagccagtgctgaatatcacaaataagcaggctttcattactgcccagaaccacgggtacgctctcgacaacaccctgccagcgggatggaagcccttgttcgtaaatgtgaacgatcaaaccaacgagggtatcatgcacgaaagtaaacctttcttcgcagtacagtttcatccagaagttacacccggtccgattgacacggagtacttgttcgacagttttttttctctaatcaaaaagggaaaagccaccacaataacctctgtgttgcccaagcctgccctagtcgcaagtagggtagaagtgtcaaaggttttgattctcggcagcggaggcttatccatcggccaggctggggagttcgactactcaggatctcaggccgtcaaggcgatgaaagaagaaaacgtcaagactgtgctgatgaaccccaatatagctagcgtgcagaccaacgaagtcggcctgaaacaggccgacaccgtgtatttcctgcctattactcctcagttcgtaacagaagtgataaaagccgagcagcccgacggcctgatactgggcatgggcggacaaactgcccttaactgcggggtggagcttttcaaaagaggagtgctcaaggagtatggagtcaaagtcctaggtacctcagtcgaatctataatggccaccgaagatcgacagctcttctcagataaactcaatgagatcaatgagaaaatcgccccaagcttcgccgtggaatccatagaggatgcactgaaggcggcggacaccattgggtacccggtaatgatcagatccgcttatgctctgggcggacttgggtcaggtatttgtccgaatcgagagactctgatggacctttcaacaaaggccttcgccatgacaaaccaaattctcgttgaaaagtctgtgactgggtggaaagagatcgagtacgaagtggtgagagatgccgacgataactgtgtgaccgtttgcaacatggagaacgtggacgcgatgggcgtccataccggtgatagcgtagtggtcgctcccgcgcaaactctgtcaaatgccgagtttcagatgctccgacgcactagtataaacgtcgtaagacacctcgggatcgttggggaatgcaatatccagtttgcccttcacccaacctcgatggagtattgtatcattgaggtcaacgctagactgtctcgctcgtcagccttagctagcaaggcaacaggttatccccttgcatttatcgcagctaaaatcgcgctcggtatccctctgccggagataaagaatgtggtttcaggcaaaacgtccgcctgctttgagccgagcctggactacatggtcacgaagataccaagatgggatctggatcgcttccatggaaccagttcccgcatcggtagcagcatgaagtcggtgggcgaggtgatggcaatcgggcggacgtttgaggagtcatttcagaaagcattgagaatgtgccacccaagcatcgagggattcactccccgcctgcccatgaataaggaatggcccagcaatctggatcttagaaaagaactaagcgagccctccagcacccgtatctacgcaatcgctaaggccatcgatgataacatgtcgttagacgaaattgagaaactgacttatattgataagtggtttctgtacaaaatgcgggatatcctcaatatggagaaaactcttaagggcttgaatagtgaatcaatgacagaggagactttgaagcgagccaaagagataggattttcggataaacagataagcaagtgcttgggactgaccgaggcacagacaagggaactgcgacttaaaaagaacattcacccatgggtgaaacagatcgataccctggctgctgaatacccaagcgtgacaaattacctatacgtcacatacaatggccaggagcacgacgttaacttcgatgaccacggaatgatggtgttgggctgtggtccctatcacatcggctcctccgtggagttcgactggtgcgccgtcagctccatcagaacactgcgacagctagggaagaagacagtggtggtaaactgcaaccctgagacagttagtacagatttcgacgagtgcgacaaattgtactttgaagagctgagtcttgagcgaatcctggatatctaccatcaagaggcgtgcggagggtgcatcatctcagtcggcgggcagattcctaacaacctggctgtccccctatacaagaatggtgtgaagattatgggaacctcaccgttacagattgatcgagctgaagatcgaagcatcttcagtgctgttctggacgaactgaaggttgctcaagctccttggaaggcggtaaatactctgaacgaggctctagagttcgccaagtctgtggactacccatgcctgctgcgccctagctatgtactatccggttctgccatgaatgtcgtgttctccgaggacgagatgaaaaagttcctggaggaggcaacccgggtatcccaggaacacccagtggtcctgaccaaattcgtggagggcgcgagagaagtggaaatggacgccgtgggtaaagatggtcgtgtgatttcccacgcaatttccgagcatgtcgaagacgccggcgtacactctggggatgcaacattgatgctgccaactcagaccattagtcagggcgcaattgagaaagtgaaggatgccaccagaaagatagcaaaagcctttgccatctcagggccattcaacgtgcagtttttggtcaaaggcaatgatgttctggttatcgagtgtaatctcagggcctccaggagcttcccattcgtgtctaagacactcggtgtggatttcatagatgtggcaaccaaggtgatgatcggtgaaaatgtggatgagaagcatctccctaccttagatcaccctatcatacctgctgattacgtggcaattaaagcacccatgtttagctggcctaggctccgggatgcagatccaattttaaggtgcgaaatggcctctacaggcgaggtggcctgcttcggagagggaatacacaccgccttcctgaaagcgatgctcagtacaggcttcaaaataccccagaaaggaattctgattgggatccaacagtctttcaggcctcggttcctaggggttgcggaacagctgcataacgagggattcaagctgttcgcgactgaagccaccagcgattggctgaacgccaataacgtgcctgctactcctgttgcttggccttcgcaggaggggcagaatcctagcctcagcagtatccgcaagctgatccgggacggctccatagacttagtgatcaacttgccaaacaataacaccaagttcgtgcacgataattacgtgatccggcggaccgccgttgactctggcattcctttgctgactaattttcaggtaacaaaactgttcgcagaggccgtgcagaagagtaggaaagtcgattcaaagtccctgtttcattatcggcagtactccgccggaaaggccgct

SEQ ID NO: 8110 - DNA, 4500 bp, Artificial Sequence
  Description of Artificial Sequence: Synthetic coding sequence
atgacacggatcctcaccgctttcaaggtggtccgcacactgaaaacaggctttggcttcaccaacgtgaccgcacaccagaagtggaagttctccagacccgggatcagactcctcagcgtgaaggctcagacagcccacatcgtcctcgaagatgggacaaaaatgaaaggctattccttcggacacccatctagcgtggctggcgaagttgtgtttaacacaggactggggggctatcctgaagcaatcaccgacccggcgtataagggtcagatacttacgatggccaatcctatcataggtaatgggggtgcccctgacactacagccctggacgagctaggcctgagcaaatacctggagtcaaacggtatcaaggtgagcggacttcttgtgctggactattcaaaagattataaccattggctggcaacaaagagtctggggcaatggctgcaggaggaaaaagtgccagctatctacggcgtcgatacccggatgctaactaaaattatacgggataagggcacaatgctcggaaaaattgagtttgagggtcagccggtagattttgtggaccccaataagcagaacctgattgccgaagtttcaacaaaggatgtcaaagtttatggaaagggtaaccccactaaggtcgttgccgttgattgcggcattaagaataacgtcatccggctgctggtgaaaaggggggccgaggtgcacctggtgccatggaatcatgatttcactaagatggaatatgatggcattcttattgcgggcggccccggtaaccccgcactggcggagcccctgatccagaatgtgcgaaaaatcctggaaagcgacagaaaagaaccactctttggaatatctactggcaatctgattaccggtctggccgccggtgcaaaaacgtataaaatgtccatggcaaaccgcggacaaaatcagcccgttctgaacataactaacaagcaggcgtttattacggcacagaaccatggctacgcgcttgacaacacgttgcctgccgggtggaaacccctgttcgttaacgtgaacgatcagactaacgagggaatcatgcacgaaagcaaaccttttttcgccgtccaattccatccagaagtgacacccgggcctatcgatacagagtatctgttcgattctttcttttccctgatcaaaaaaggcaaggctactacaatcaccagcgtcttgcccaagccagcactggtcgcatcacgcgttgaggtttctaaagtgctgatcctgggaagtgggggcttatcaattgggcaggctggggaatttgactattcaggttcccaggctgtcaaggccatgaaggaagagaacgtgaagacggtgttgatgaatccgaacatcgcgtcagtccagaccaacgaggtcggtctaaagcaggccgatactgtatactttctacccattaccccccaattcgtcaccgaggtcatcaaagccgagcaacccgacggactcatactggggatgggaggccagactgccttgaactgtggcgtggagctattcaaacgaggggtgctgaaagagtacggtgttaaggttctcggtacaagcgtggagtctattatggcaaccgaggacaggcagctgttcagtgataaattgaatgaaatcaatgagaagatcgccccctccttcgccgtggaaagtattgaggacgcccttaaagctgctgataccattggatacccggtgatgatacgaagtgcctacgccctgggggggctgggtagcggcatctgtcctaacagagagactttgatggacttgtccaccaaagcttttgcgatgacaaatcaaatccttgtcgagaaaagcgtcaccggatggaaggagattgagtatgaggtggttagagatgccgacgacaactgtgtcaccgtttgcaatatggaaaacgtggatgccatgggagtgcataccggggatagtgtcgttgtggcccctgcccagaccctttctaacgccgagtttcaaatgctgcggcgaacatccatcaacgtggtacgccatctcggtattgtaggtgagtgtaacatccagttcgcactgcacccaacctcgatggaatactgtattatcgaagttaacgcccgtcttagtaggtcctcagccctcgccagcaaggccacaggatacccactggcctttatagctgctaagatcgccttggggatcccgctgcctgagattaagaacgtggtgtcaggaaaaacctctgcctgcttcgagccctccttggattacatggtgaccaagattccccgatgggatctggataggttccacggaacctccagcagaattggctctagtatgaagagcgtgggtgaggtgatggccatcggacgcaccttcgaggagagcttccagaaggccttaagaatgtgtcacccctcaatagaaggcttcactccccgtctcccaatgaacaaggagtggccctccaatctcgatctgcgcaaggagctgagtgagcctagcagcacccgaatctacgccatcgccaaggctattgatgataacatgagtcttgacgaaattgaaaaacttacttacatcgacaagtggtttctctacaaaatgcgcgacattttgaacatggaaaaaacactcaaagggctaaatagcgagtccatgactgaagaaaccctgaagcgggccaaggagatcggcttttctgataagcagattagtaagtgtctggggctgactgaggcgcagacgcgcgagctaaggctgaaaaagaacatacatccctgggtgaaacagatcgacacattggccgcagagtacccgtctgtgacgaactatctgtatgtgacttataacggccaggagcatgatgtgaactttgacgatcatgggatgatggttctgggatgtggcccataccacatagggtcctctgtggagttcgactggtgtgctgttagttccattaggactctccgccaacttggaaagaaaaccgtcgtagtgaattgcaacccagagaccgtgagcaccgatttcgacgagtgcgacaagttgtactttgaagaacttagtctggaacgcatcctggatatctaccaccaggaagcgtgtggaggttgtataatatcggttgggggtcagatccctaataatctggccgttccattatacaaaaacggagtgaaaatcatggggacaagccctttacagatagaccgtgcagaggacagatcgattttctcggcagttctcgacgagttgaaggtagctcaggcaccctggaaggccgtcaacaccctgaatgaggctctagaatttgcgaagagtgtcgactatccctgcctgctcaggccctcttatgtgctgtctggcagcgccatgaacgtggtctttagtgaggacgagatgaagaagttcttggaggaagctactcgggttagccaggagcaccccgttgtgttgacaaagttcgtagagggcgccagggaggtagaaatggatgcggtaggaaaggacggacgcgtgatctcacacgctataagtgagcacgtggaggacgccggcgtccacagcggcgatgcgacactgatgctacccacacagacaatctcacagggggctatagaaaaagtaaaggacgccactcgcaaaatagctaaagcctttgccataagcggaccattcaatgtgcagtttctcgttaaagggaatgacgtcctggtaattgagtgtaatttaagggctagccgtagctttccctttgtttcaaagactctaggggttgactttattgacgtggcgacgaaggtcatgatcggggaaaacgtggacgaaaagcatttacccacgctggatcaccccataataccggctgactatgtggccatcaaggctcccatgtttagttggcccaggcttagagacgccgatccaattctgcggtgcgaaatggcatccactggtgaggttgcctgctttggagagggtattcataccgcctttctcaaagccatgctttcaaccgggtttaaaattccccagaaagggattttgatcgggatacagcagtcctttcgaccaaggttcttgggagtggccgagcaactacacaacgagggttttaaactgttcgccactgaggctacctccgattggctgaacgccaacaacgtgccggctacacctgtcgcttggccgagtcaggagggtcagaacccgagcctctcaagtattcgcaagttgattagagacgggagcatcgacctggtcattaacctgccaaataataatactaagtttgtgcatgacaattatgttatccgccgcaccgctgtggattctggtatacctctgctgactaacttccaagtaaccaagctgttcgccgaagctgtgcaaaaatcacgaaaagttgatagtaaatcgctgttccactaccgccagtactctgcggggaaggccgcc

SEQ ID NO: 8111 - DNA, 4500 bp, Artificial Sequence
  Description of Artificial Sequence: Synthetic coding sequence
atgacccgcatcctgaccgcatttaaggtggtccggaccctgaaaaccgggtttggtttcacgaatgtaacagcacaccaaaagtggaagttttccaggccaggtattcggttgctgtcggttaaggcgcagaccgcacacatagtcctggaggatggtacaaaaatgaaaggctatagcttcggtcatccatctagcgtcgccggtgaagttgtttttaacactggcctgggtggttacccagaagccatcactgacccagcatacaagggccagattttgacgatggcaaatcctattatcgggaacggcggcgcgcctgatacaacggcgctggacgagctgggtctgtccaagtatttggagagcaatggcatcaaagtgagcggcctcttggttttggattatagcaaagactacaatcattggctggccacgaagagcctgggccaatggctgcaggaagaaaaggttcctgcgatttacggcgtcgatacacggatgctgactaagataatcagagacaagggcacgatgttaggtaaaatagagtttgagggccaaccggtcgatttcgtcgaccctaataagcagaacttgattgcggaggttagcaccaaagacgtcaaagtgtacggtaaaggtaatccaaccaaagtagttgcggtggactgtggcattaaaaataatgtgattcgcctgctggtaaagagaggcgctgaagttcacttggtcccttggaatcacgacttcaccaaaatggaatatgatggaattcttattgccggtggtccgggtaacccagctcttgccgagccactgattcagaacgtgcgcaaaattctggagtccgataggaaggaaccactgtttggtattagcaccggcaacctgattacgggcctcgcagccggagcgaagacctataagatgagcatggccaacagagggcagaatcaaccggtgctcaacatcaccaacaaacaggcctttatcaccgcgcaaaatcacggctacgcgctggacaacaccctcccggctggttggaaaccactgttcgtgaatgtaaacgatcaaaccaacgagggcattatgcatgagagcaaacctttctttgctgtgcagttccacccggaagtgacgcccggccctatagatacggaatacctgtttgacagctttttcagcctcatcaagaagggcaaagctacgacaattacctctgtgcttccgaaaccggcgttggtggcgtcccgcgtcgaggtaagcaaggttctgatcctgggtagcggtggtctgagcattggtcaagctggtgagttcgattattccggttctcaagcggttaaggccatgaaagaagaaaatgtgaagaccgtcctgatgaatcctaatattgctagtgtgcaaaccaacgaggttgggctgaagcaggcggacactgtgtactttttgccaatcactccacagtttgtgactgaagtcattaaggcggagcagccggatggcctgatccttggaatgggtggccaaacggccctgaattgcggcgtcgagttgttcaagagaggtgtcctgaaggaatacggtgttaaggttctgggcaccagcgtcgagagcattatggccactgaggaccgccaactgttctcagataagctgaacgagattaacgaaaaaatagccccatcctttgcagtcgagtcaattgaggacgccctaaaagcggcagatactataggatatccggtcatgatacgctctgcctacgcactgggtggcctgggtagcggtatctgtcctaatcgtgaaactcttatggacctgagcactaaggcgttcgcgatgaccaatcagattctggttgagaaatcggtgaccggctggaaggagatcgaatatgaagtagtgcgcgacgctgatgacaactgtgtgactgtctgcaatatggaaaatgtggacgctatgggtgtacataccggtgatagcgtggtggttgcaccagcgcagacactgtctaacgctgaattccaaatgctgagacggacttcaatcaacgttgtcagacacctgggcattgtcggcgaatgcaacattcaatttgctttgcatccgacgtccatggagtattgtatcatcgaagttaatgcacggctgagccgcagcagtgcgctggcgtcgaaagctaccgggtatccactggccttcatcgccgcaaagatcgccctgggtatccccctgcccgagattaaaaatgtggtcagcggtaagacgtcagcctgcttcgagcctagcctggattacatggttacgaaaatccctcgctgggaccttgatcgcttccacggcaccagcagcagaattggcagctctatgaagtccgtgggcgaggtgatggctatcgggcggactttcgaagagtcattccagaaagcccttcgaatgtgccacccaagcatcgagggctttacgcctcggctgccgatgaacaaggagtggccaagcaatctggacctgcgtaaggaattgagcgagccgagcagcacgcgtatctatgctatcgcaaaagcaattgatgacaacatgagtctggacgaaattgagaagttgacgtacattgacaagtggttcctgtataagatgcgagacattctgaatatggaaaaaaccctaaagggcttaaattccgagtctatgaccgaagaaacccttaaacgcgctaaggaaataggcttcagcgataagcagatctctaagtgcctgggtctgacggaggcgcagacccgcgaactgcgtctcaaaaagaacattcacccttgggttaaacagatcgatacgctggccgcggagtacccaagcgtcaccaattatttgtacgtcacctataacggccaagaacacgacgtgaatttcgatgatcacgggatgatggttttgggctgcggtccatatcatatcggtagttcggtggaattcgactggtgcgcggtttccagcatccgcacactgcgccagctgggaaaaaaaacggtggtagtcaactgtaatcctgaaacggtcagcacggacttcgatgagtgcgataaactgtatttcgaagagttgtctctggagcgcatcctggacatctaccatcaggaggcttgtggtggctgcattatcagcgtcggtgggcagattccaaacaacctggcagtcccgctgtataagaatggcgtgaagattatgggtacaagcccactgcagatcgatcgcgctgaagacaggtccatttttagtgctgtgctggacgagctcaaagtggcccaggcgccgtggaaggcggtgaataccctgaatgaggccctggagtttgcaaagtctgtggattatccttgtttgctgcgtccgagctatgttctgagcggcagcgctatgaacgtggtatttagcgaggacgaaatgaaaaagtttttagaagaagctactagggtttcgcaggaacatccggtcgtcctgacaaaattcgttgaaggcgcccgggaggtagaaatggatgcagtgggtaaggatggccgcgttattagccacgctatttcggaacacgtcgaagatgccggagtgcactcaggggatgcaacgctgatgcttccgactcagactattagccagggcgccattgagaaggttaaggatgcaacgcgaaaaattgccaaggcctttgcaatttcgggcccattcaatgtgcaatttctagtcaagggcaacgatgtcctggttattgagtgcaacctgcgcgcaagccgcagcttcccttttgtctcgaaaactttgggcgtcgatttcattgacgtcgcaacgaaagtgatgattggtgagaacgtcgacgaaaagcacctgccaacgctcgatcaccctattattccggcagattacgtcgcgatcaaggcgccgatgttcagctggccacgcctgcgtgatgccgaccctattctgaggtgcgagatggccagcacgggggaagttgcatgcttcggtgagggcatacataccgccttcctcaaggctatgctcagcaccggctttaagatcccgcagaagggcattttgatcggcattcagcagagctttcgcccgcgcttcctgggggtcgcagagcagctgcacaatgaaggcttcaagctgtttgcaaccgaagcaacatccgattggctgaatgccaataacgtcccagccactcctgttgcgtggccgagccaagaaggacaaaatccgtctctctccagcattcggaaactgatccgcgatggtagcattgatttagtgattaatctgccgaacaacaatacgaagtttgtgcacgacaattacgttatacgcagaaccgctgtggattcgggaatcccactgttaacgaatttccaggtaacaaagcttttcgccgaggcagtgcagaaaagcagaaaggttgacagtaagagcctgttccactatcggcaatacagcgccggcaaggccgca

SEQ ID NO: 8112 - DNA, 4500 bp, Artificial Sequence
  Description of Artificial Sequence: Synthetic coding sequence
atgacacgcatcctgaccgcttttaaggtcgtacgaaccctcaaaacaggattcggctttacgaatgtgaccgcacaccagaagtggaagttcagtagacctggcatccgcttactcagcgtaaaggcacaaaccgcccacattgttctggaagatgggaccaaaatgaaaggttattccttcggtcacccctctagtgtcgcaggggaggtggtcttcaacaccggacttggcggctatcctgaagctattaccgatcctgcatataagggacagatattaacaatggccaaccctattattggtaacggaggggccccggataccacagccctcgacgaactgggactctctaaatacttggaatcaaatggaatcaaagtatctggcctgctcgttttggattactccaaagattataaccattggcttgctacgaaaagtcttggtcagtggctccaggaggaaaaggtcccggccatttatggggtggacacacggatgctgactaaaattatacgtgacaagggtaccatgctcggaaaaattgagtttgaaggacaacccgttgacttcgtcgatcctaacaaacagaacctcattgctgaagtgtctactaaggacgtcaaagtctatggcaaaggcaacccaaccaaggtagtggccgttgattgtggaataaagaacaacgtcatcagactgctggtcaagcggggagctgaagtgcacctcgtgccttggaaccatgactttacaaaaatggaatacgatggtatcctgatagccggagggccaggcaaccccgcacttgctgaacccttgattcagaacgtgaggaagatcctggagagtgaccgcaaagaacctttgttcggcataagcactgggaacctcataactggtctggcggctggggccaagacctacaaaatgagcatggctaaccgaggccaaaaccagcctgtccttaacattactaacaagcaggccttcatcaccgcgcaaaatcacggatatgccttggacaacacgttgccagcagggtggaagccgctctttgttaacgtgaacgaccagaccaacgaaggtattatgcacgaatccaagccattctttgcagtgcaatttcaccctgaagttacccccggtccaatcgataccgaatatttgttcgacagctttttttccctgattaaaaagggcaaggccacaactattacatcagtcctgcccaaacctgccctggtagccagtagagtcgaggtgagtaaggtgctgatccttggaagcggaggcctgagcatcgggcaagctggagagttcgactactccggctcccaagctgtgaaagctatgaaggaggagaacgttaagaccgtcctcatgaatcctaacattgcttccgtgcagaccaacgaagttggactgaagcaggctgacaccgtctattttctccccattaccccacagttcgttaccgaagtcatcaaggctgaacagcccgatgggctgatcttggggatggggggccagactgcactcaactgcggagtagaacttttcaagaggggcgtcctgaaggaatacggagtcaaggtgttaggcacttcggtggaaagcattatggctactgaggaccggcagctcttttcagacaagttgaacgagataaatgaaaagattgccccatccttcgctgtagagagtatcgaagacgctctgaaggctgcagacacgattggctatccagtgatgatccgatctgcgtacgccctcggcggcctggggtctggaatttgtcctaaccgggagacactgatggacctcagtaccaaggcatttgcgatgactaatcagatcctcgtggagaagagcgtgacaggatggaaggaaattgagtacgaagtcgtgagggacgccgacgataactgcgtcacagtgtgcaatatggaaaatgttgacgcaatgggtgtccacacaggagactcagttgtcgtggctccagcacagaccctctcaaacgcagagtttcagatgcttcgaagaacgtccattaacgtggtgcggcaccttggcatcgtgggggaatgcaatattcagttcgcccttcatccgacatcgatggagtattgcattatcgaggtgaacgcacggctgagccggtcctctgcgcttgcctccaaagccacagggtatccacttgcattcatcgcagctaaaatcgccttggggatccccctgcctgagattaagaacgtggtgtccgggaagacatccgcctgctttgagccttcgctggattatatggttacaaagataccacggtgggacctggatcggtttcacggaacaagttctcggataggcagctctatgaagtccgtgggtgaggtcatggcgatcgggagaacctttgaggaatcatttcagaaagccctgcgcatgtgtcaccccagcatcgagggattcacaccaaggttaccaatgaacaaggagtggccaagtaaccttgatttgcggaaggagctttctgagccaagctcaactaggatttacgcaattgccaaggccattgacgacaacatgtccttagacgagattgaaaagctcacttatatcgacaaatggttcctgtataaaatgagagatatccttaatatggaaaagacccttaagggtctgaactccgagtctatgactgaagaaaccctaaagcgagcaaaggagattggtttctcggataagcaaatctctaaatgtttgggcttgactgaggcgcagacccgggagctgaggttgaagaaaaacatccacccgtgggtgaaacaaatcgacactctggcggcggaatacccctctgtaaccaactacctctatgtcacttataatggacaagaacatgatgtcaactttgatgaccacggaatgatggtgctagggtgcggcccataccatattgggtcgagcgtagagtttgactggtgcgcagtatcctcaatcaggactcttcgacagcttggaaagaagacagtggtcgtgaattgcaatcccgagactgtatctaccgactttgatgagtgtgacaaactgtatttcgaagagctttcattggaaaggatacttgacatatatcaccaagaggcttgtgggggatgtatcatctcagtcggcggccagattcccaataaccttgcagtcccgctttacaaaaatggtgttaagattatgggcacttcccctctgcagattgatcgcgcagaggaccgatctatattctcagcggtgttggacgaattgaaagtggcccaagcgccttggaaagccgtcaacactcttaatgaggccctggaatttgctaaaagtgtggactatccttgtctgctgaggcccagctacgtcctcagcgggagcgctatgaatgttgtcttctctgaagacgagatgaaaaagtttcttgaagaggccaccagggtttctcaggaacatcccgtcgtgctgacgaagttcgtggagggcgccagagaggtcgagatggacgccgtaggaaaggatggaagagttatctcccatgcaatctcagagcatgttgaagatgccggggtgcatagtggggacgcaacgttgatgttgcctactcagaccatcagtcaaggcgcgattgaaaaggttaaggacgcgacacgcaaaattgctaaagccttcgctatatctggccccttcaatgtacagttcctggtgaagggcaatgatgtgcttgtcatcgagtgtaacctcagagctagccggagcttcccatttgtaagtaagaccttgggcgtggacttcattgacgtggccaccaaggtcatgatcggggagaatgtggacgagaagcatctacctaccctggatcacccgatcattcccgctgattatgttgccattaaggcaccaatgttctcgtggccaaggttgcgggacgcagacccgatcctgaggtgtgagatggcatccaccggagaggttgcttgcttcggagagggtatccacactgcattccttaaggcaatgctttccacggggttcaagatccctcagaaaggtatattgattggaatccagcagtcattccgaccaagatttctgggagtcgccgagcaactacacaacgaaggcttcaagctattcgcaactgaagcaacttctgactggctgaatgctaacaatgttcctgccacccccgtcgcgtggccctctcaggagggacagaacccttccttgtcatccattagaaagttgatccgcgatggttcgatagacctcgtaatcaaccttccaaacaataacacgaaattcgtacacgacaactacgtgatacggcggactgccgtggactcgggtattcctcttctgaccaatttccaggtgactaaactgttcgccgaggctgtacagaagtcccgcaaggtggacagtaaaagccttttccactatcggcaatattccgccggaaaagcagcc

SEQ ID NO: 8113 - DNA, 4500 bp, Artificial Sequence
  Description of Artificial Sequence: Synthetic coding sequence
atgactcgcattttgacggcattcaaggtcgtgcgcaccttgaaaacaggtttcggattcacgaacgttacggctcatcaaaagtggaagttctctcgacccggtatccgcctcttgtcagtgaaggcacaaactgctcacattgtgctcgaggatggtaccaagatgaaaggctactccttcggtcatccctctagtgttgctggagaggttgtatttaacaccggcctcggaggctaccctgaggccattacagatcccgcctacaagggccaaattctcacgatggccaatcctattattgggaacggcggagcccctgatacaacagctttggatgaactcggcctgtccaagtacctggagtcgaacgggattaaggtgagcggtctcttggtccttgactactcaaaggactataaccactggcttgccaccaagtccctcggccaatggcttcaagaggaaaaggttcccgcaatttatggcgtggatacacgcatgcttaccaagattattcgggacaagggaacgatgttgggcaagatcgagtttgagggtcagcctgtggactttgtcgatcccaacaaacagaacctgatcgcggaagtttctacgaaggatgtaaaagtgtatggaaaaggcaatccgactaaggtggtggctgtagactgcggcatcaagaataatgttatccgccttctcgtcaagcgaggtgccgaagttcacctggtcccatggaatcatgatttcacgaaaatggagtacgatggcattctgattgctggcggtccgggtaacccggcgttggctgagccgctcatccaaaacgtgcgcaaaatactggaatctgacaggaaagagccattatttggaatcagtaccggaaatctgatcacgggtcttgcagcgggcgctaaaacttataaaatgtctatggcgaaccgtggtcaaaatcagccggtactcaatattacgaataaacaagctttcataacggcacaaaaccatggctacgcattggacaacacgcttcccgcaggatggaaaccactttttgtgaatgttaatgaccaaaccaatgagggaatcatgcatgaaagcaagccattctttgccgtgcaattccatcctgaagttacacccggtccgatagacaccgaatatttgtttgacagtttcttcagtttgatcaagaaaggaaaggcgaccactattacctcagtccttccgaagcctgctcttgttgcttcccgtgttgaagtgtccaaggtcttgattctgggaagtggcggcctttcgatcgggcaggcgggagagtttgactattcaggcagccaggcagttaaggcaatgaaggaggaaaacgttaagactgttctgatgaatcccaatatcgcttcggtacaaaccaatgaagtcgggctgaaacaggccgacacagtctacttcttgcccattacgccccagtttgtcacagaagtcattaaagcggaacaacccgacggtctcatccttggaatgggagggcaaaccgctttgaactgtggcgtagagcttttcaagagaggtgtgttgaaagagtatggagttaaagtgttgggtacatcagtcgagtctattatggctacagaggatcggcagctttttagtgacaagttgaatgaaataaacgaaaagatcgcaccatcgtttgccgtggaatcaatcgaggatgccctgaaggcggcggacaccattggttatcccgtgatgataagatccgcctatgctttgggcgggctgggatcaggaatttgtcccaatcgcgagaccctgatggacttgtcaacgaaagcttttgccatgactaatcagatcctcgttgaaaaatcagtaacggggtggaaggagatcgaatacgaggttgtccgtgatgcggacgacaactgtgtcacagtctgtaacatggagaacgtggatgccatgggcgtgcatactggtgattcggtggtggtggcgcctgctcaaaccctttcaaacgccgagttccagatgctccgacgcacgtcgattaacgtagtgagacacctagggatcgtgggagaatgcaatattcagttcgcactgcacccaacttccatggaatactgtattatcgaggtcaatgcgcgtctctctcgttcgtcagcacttgcttccaaagctacgggctacccactagccttcatcgcggctaaaattgcacttggtatcccactgccagagatcaaaaatgttgtatcgggcaaaacctctgcttgcttcgaaccttccttggattatatggtcacaaagatcccaaggtgggatctggatcgctttcatggcacctcgagccgcattgggtcgtcgatgaaatccgtgggcgaggtcatggccattggccggacatttgaggaaagctttcaaaaggctcttagaatgtgtcacccgagtatagagggattcacccctcgactacccatgaacaaggagtggcctagcaacctcgacttgcgaaaggagctctcggagcccagctcgaccagaatttacgccatagctaaggcgattgacgataacatgtccttagacgaaatcgagaaattgacttatatcgataagtggttcctctacaagatgagggacatcttgaacatggagaagacattgaaaggactgaactcagagtctatgacggaggaaaccctaaagagggccaaggagattggtttttcagacaagcaaatttcaaagtgtcttgggctgaccgaggctcagacgcgagagttgcgccttaagaagaatattcacccctgggtcaaacaaatcgataccctggctgccgaataccccagtgtgacaaactacctctatgttacatataatggccaagaacatgacgtcaactttgatgatcatggaatgatggtgctaggttgcggtccatatcatataggctctagcgtcgaattcgattggtgtgccgttagttcgatccgaacgctccggcagcttgggaaaaagactgttgtggttaactgtaatccggagaccgtatcgacagacttcgatgagtgcgataaactttacttcgaggaactatcactcgaacggatcctcgatatataccaccaagaggcctgtggcggatgtatcattagtgtcggcggacaaatcccgaacaaccttgccgtacccctttacaagaatggtgtgaaaattatgggtactagtccactccaaatcgaccgcgccgaggatcgatctattttctctgctgtactggatgagctcaaggtggcacaagcgccttggaaagcggtaaatactcttaatgaagccctggaattcgcaaagtctgttgactacccatgtttgttgcgtcccagctatgttttgtcaggctctgccatgaatgtcgtcttcagcgaagatgagatgaaaaagtttctggaggaagccactcgcgtcagccaggagcatccagtagtcctgacaaagttcgttgaaggtgcccgcgaagtcgaaatggacgctgtggggaaggacgggagagtcatctcacacgccatctctgaacatgtcgaagacgcgggcgtgcactctggcgatgctaccttgatgctccctactcagactatttctcaaggagcgattgagaaagtcaaggacgctacacggaagatcgctaaggcattcgccatctctggaccattcaacgtgcaattcctggtaaagggtaatgacgtcttggttatcgagtgtaacttgcgcgccagtcgctcctttccattcgtgtccaagactctcggagttgatttcattgacgttgctactaaagtgatgatcggagaaaacgtcgatgaaaaacatctgcctacactagaccaccccattatacctgctgactacgtggcaataaaggcacctatgttcagctggcctcgactccgcgacgctgacccaattctgcggtgtgagatggcttccaccggcgaagttgcctgctttggggagggtatccatactgcatttttaaaagccatgctgtcgacgggtttcaagatcccgcagaaaggcatcctcattggcatccagcagtcgttccggcccagatttttaggggttgccgaacaactgcacaatgaaggttttaaactcttcgcgaccgaggctacctctgattggctaaatgctaacaatgtccctgcgaccccagttgcgtggcccagccaggaaggacagaacccctcgctgagctcaattcgcaagcttatcagggatgggagcatagacctcgttatcaacttgcccaataacaataccaagtttgtccacgataactacgtgatccggcgcactgcggttgactctggtataccattgctcacgaacttccaggtaactaagttgttcgctgaagccgtccagaaaagccgtaaggtggactcaaagtcgctgttccactatcggcaatattccgccggcaaagccgca

SEQ ID NO: 8114 - DNA, 4500 bp, Artificial Sequence
  Description of Artificial Sequence: Synthetic coding sequence
atgaccagaatattgacagcctttaaagttgtacgtacccttaaaaccggctttggtttcacgaacgtcacagcgcatcagaaatggaagttttctagaccgggaattagactgctatcagtcaaggctcagacagcacacattgttttggaagatggcaccaaaatgaagggatactcttttggtcatccgtcatcggtggctggagaagtagtttttaacacaggtcttggaggctacccagaggccattactgatccagcatataagggacaaattctcacaatggcaaaccccatcataggaaacggaggagctccagatacgacagcccttgatgaactcggactgtccaaatatcttgagtcgaatggaattaaggtttctggattacttgttctcgactatagtaaggactataaccactggctggcaaccaaatccttgggacagtggctgcaagaagaaaaagttccagcaatttacggagtggataccaggatgcttacaaagatcattcgagataaggggaccatgttaggaaaaatagaatttgaaggacaaccagtagattttgttgatccaaacaaacaaaatcttatcgctgaggtttctactaaagacgtcaaggtttatggaaaaggaaatccgacaaaagttgtggctgtggattgtggaattaaaaataatgttattcggttgctggtgaaacgaggagctgaagttcatttggtgccatggaaccatgactttactaaaatggagtacgatggtattcttattgctggaggcccaggaaatccggctctcgctgagccattgattcaaaatgtccgaaaaatacttgagtctgatcgtaaagagccattgttcggaatatcgacgggaaacttaatcactggattagccgccggtgcaaagacctataaaatgtcaatggcaaatcgaggacaaaatcaacctgtgttgaacattacaaataaacaagcctttattacagctcaaaaccatggttacgcattagacaatacacttcctgccggttggaagccattgtttgttaatgtcaacgatcagactaatgaaggtattatgcatgagtcaaaaccgtttttcgccgtccagttccatcctgaagtgacacctggaccaatagatactgaatacctcttcgattcgtttttctctcttattaaaaaaggtaaagccactacaattacgagtgtactgccaaagccagctcttgttgcctcaagagtcgaagtctcaaaagttctaatcctcggtagcggaggacttagtattgggcaggctggagaattcgactacagcggatctcaagctgtgaaagcaatgaaagaagagaacgttaaaactgttctaatgaaccctaatattgcatcagtccaaacgaatgaagtcggactgaaacaagcagacacagtctatttcttgccaattactcctcaattcgtgactgaggtgattaaagcagaacagccagatggattgattttggggatgggaggtcaaacggcccttaattgcggagtcgaattgtttaagagaggagtgctcaaagaatatggcgttaaggtccttggtacatcagtcgaatcaatcatggctacagaggacagacagcttttttctgacaaactaaacgagatcaatgagaaaatagcaccatcgtttgctgtggaatcgatcgaagacgctttgaaggcagccgacactattgggtatccagttatgatacgatctgcgtatgcactgggtgggctgggatcgggaatttgtccgaatcgggagacattaatggatctatcgacaaaggcatttgcgatgactaatcaaattttagttgaaaaatccgtgaccggctggaaagaaatagaatatgaagttgtccgtgatgcagatgataactgcgttacggtttgtaatatggaaaatgtcgatgcgatgggagttcatactggagactcagttgtggttgcaccggcgcagactttatcaaatgctgaatttcagatgcttagacgcacctcgattaacgttgttcggcacttgggaatagtcggcgaatgcaatatccaattcgctttgcacccaacgtctatggaatattgtattatcgaagttaatgcaagactgtcaaggtcctcggctctagcttctaaagcgaccggatatcctttagcctttattgcagccaaaattgcacttggaattccattgccagaaattaaaaatgttgtgagcggtaaaacttccgcatgctttgaaccgtcactagattatatggtgacaaagattcctcgttgggacctagacaggttccatggaacgtcaagcagaatcggcagttcaatgaaatcagttggagaagtgatggctatcggtcgtacgtttgaagagtcgttccagaaagcgttgcgtatgtgtcacccaagcatcgaaggattcacgccacgcttgcctatgaacaaagaatggccaagcaatcttgatcttaggaaagaactctcggagccgtcatcaacacgtatctatgcaattgccaaagctatagatgacaacatgtctcttgatgaaattgaaaaacttacttacattgacaagtggtttctttataagatgagagacattctcaacatggaaaaaactctcaaaggactgaactctgaatcaatgaccgaggagacacttaagcgggcaaaagagatcggtttttccgataaacaaattagtaaatgcttgggactgacggaagctcaaacccgtgaattaagacttaaaaagaacatacacccatgggtgaaacaaatcgacaccctcgcagccgagtatccatcggtgacaaattatttatatgtcacatataatggacaggaacatgatgttaattttgatgatcacggcatgatggtcctaggatgcggtccgtaccatattggttcttcagtggagtttgactggtgtgcagttagcagtattagaactcttcgccaattgggaaaaaaaacagttgttgtgaattgcaaccctgaaactgtgtcaacggacttcgacgaatgtgataagctgtattttgaggaattgtccctcgagcgtattctcgatatttatcatcaggaagcctgtggtggttgcattatctctgtaggaggtcaaattcccaacaacttagcagtgcctttgtataagaatggagtcaaaataatgggtacttcgccccttcagattgatcgtgcagaggataggtcgatattttcagctgtacttgatgagctcaaggttgcacaagctccatggaaggcagtgaacactcttaatgaggctctagaattcgccaagtctgtcgattatccgtgcctccttcgcccttcgtatgtcctctctggatctgctatgaatgttgtcttctccgaagatgaaatgaagaaatttcttgaagaagcgactagggtgagtcaagagcacccggtcgttttgacaaaatttgtggaaggcgcccgagaagttgagatggatgctgtggggaaggacggaagagttattagtcatgctatttcagagcatgtagaagatgcaggcgtgcattccggagacgcaactttaatgttgccaacccagaccatttcacaaggggcaatcgaaaaggtcaaggacgcaacaagaaaaattgctaaggccttcgccatatcaggaccattcaacgtccaatttttggttaaaggaaacgacgtgctggttatcgaatgtaaccttcgtgcttctcgatcgttcccgttcgtctctaaaacactcggagttgattttatcgatgtggctacaaaagttatgattggagagaacgtggacgaaaaacatctacccaccctcgaccatccgattataccagctgattatgtggcaattaaagcgccaatgttctcctggccacgtctgagggatgccgaccccattttgaggtgtgagatggcttccacgggagaagttgcgtgttttggggaaggcatacatacggcttttttgaaagctatgttgtctactggatttaagataccacaaaagggtatactaatcggcattcaacaatcgttcagacctagattcctgggagtcgcagaacaattgcacaatgaagggttcaaattgttcgccacggaagctacatcagattggttgaacgctaataacgtgcctgccaccccagtggcttggccttctcaggaaggccaaaatccttctttgtcttcaattcgtaaattaattcgtgatggaagcatagatctcgttatcaacttgccgaataacaacacaaagtttgttcatgacaattatgttatccggagaacagcagtggactctggaattccactgctgaccaactttcaggttactaagttgttcgccgaagctgtccaaaaatctcggaaagtcgactccaaaagtctttttcattaccgtcaatattcagctggaaaagcggca

SEQ ID NO: 8115 - DNA, 4500 bp, Artificial Sequence
  Description of Artificial Sequence: Synthetic coding sequence
atgaccagaatacttacggccttcaaggtcgtcagaaccctgaagactggcttcgggttcaccaatgtgacagcacatcaaaagtggaagtttagtagaccaggaatacggctcttgtctgtaaaggcacagacagcacacattgtgcttgaggatggcacaaagatgaaggggtattccttcggtcacccgtcttccgtggctggggaagttgtgtttaacactggtttgggtggctaccctgaggctatcaccgatccagcatacaaaggacagatcttgaccatggctaaccccatcataggtaatggaggcgctcctgacacaacagccctggatgagctgggcctctccaagtacctcgagtccaatgggatcaaagtgtcagggctgctggtgctggattactccaaggactacaaccactggctggccaccaaatcacttggtcagtggctgcaggaagagaaggttcccgccatatacggagtagataccaggatgctgactaaaattataagggacaaaggcaccatgctgggcaagatagaattcgaggggcagccagtcgactttgtggatcctaacaaacaaaacttgatcgcagaggtgagcaccaaagatgtgaaagtttatggaaaaggcaatcccactaaagttgttgcagtcgactgtggaatcaaaaacaatgtgattcggttacttgtcaagaggggagctgaggttcatctggtcccttggaatcatgactttacaaaaatggaatacgacggcattcttatcgcaggtggccccggaaaccccgctctggcagaacctctcatccagaacgtgcggaagatactcgagtcagaccgaaaagagccacttttcgggatcagcaccggcaacttgatcacaggtctggccgcaggagctaaaacctacaaaatgagcatggctaatagggggcagaaccagcccgtgctcaacatcaccaacaaacaagcgttcatcaccgcgcaaaaccacggctacgccctggataacaccctcccagccggctggaagcctctcttcgtcaacgtgaacgaccagaccaacgagggaataatgcacgagagcaagcccttcttcgcagtccaattccaccctgaggtcacccctgggcctatcgataccgagtacttatttgacagtttttttagtctgattaaaaaggggaaggccacaaccattaccagcgtcctgccaaaacctgccctggtggcgtctagagtggaggtgtccaaagtgctgatacttggctctggcggcctttcaatcgggcaagctggagagttcgactattcaggctcacaggcggtgaaagctatgaaagaggagaatgtgaaaacagtacttatgaatcctaacattgcctctgtccaaaccaatgaagtcgggctgaaacaagccgatacggtctacttccttcccatcactcctcagtttgtgactgaggtcatcaaagcagaacaacctgatggcctgatcctcggaatgggtggccaaaccgcattaaactgcggggttgaactcttcaaaaggggcgtgctgaaagaatatggagtgaaagttctgggaacatctgtggagtccatcatggctaccgaggatagacagttgttcagcgacaagctcaacgaaattaacgagaaaatagcaccttccttcgccgtcgaaagcatcgaggatgctctgaaggcggccgacacgatcgggtatccagtgatgattaggtctgcatacgccttgggaggccttggatctgggatatgcccaaaccgcgagacactgatggacctgtcaacaaaagcatttgccatgactaatcagatcctagtggagaaatccgtaaccggctggaaggagatagaatatgaagtggtcagggatgctgatgataactgcgtgaccgtctgtaacatggagaacgtcgatgccatgggggtgcatacaggcgactcggttgttgttgcgccagcacagacactgtccaacgccgagtttcaaatgttgcgcaggaccagcattaatgtcgtgagacacctcggcattgttggcgagtgtaacatccagtttgccctgcatcctacatccatggaatattgcatcattgaagttaacgccaggctttcgagaagcagcgctttggccagcaaagctaccggatatcccctggccttcatagctgctaaaatcgcacttggaattcccctgccggagatcaagaacgttgtaagcggcaaaaccagtgcatgtttcgagccatcactcgactacatggtgacaaagattccaagatgggatctcgataggtttcatggcacttccagccgcatcggatcctcaatgaagtcagtcggtgaggtgatggcaattggtaggacattcgaggaaagttttcagaaagccttgcgaatgtgccatccctctatcgaggggttcacacctagactaccaatgaacaaagagtggccatctaacttggatttaaggaaggaattgtccgaaccatctagcaccagaatttacgctatcgcaaaagcaatagacgacaacatgtcattggatgaaatcgaaaagttaacatatattgacaaatggtttctgtacaagatgagagatattctaaacatggagaaaaccctcaagggactcaacagcgagagcatgacagaagagaccctgaagagggccaaagaaataggcttctctgataagcagatcagcaaatgcctggggctcaccgaagcacagacaagggagctgagactcaaaaaaaacatacacccctgggtgaaacagattgatacactggcagcagagtatccaagcgtcactaattacctgtacgttacttataacggtcaggagcatgacgtgaactttgacgaccatggcatgatggttttggggtgcggaccgtaccacattggtagcagcgtggaattcgattggtgtgccgtgagttctatcagaacactgagacaactgggaaaaaaaaccgtcgtggttaactgcaacccggagactgtgtccaccgattttgacgagtgcgataagctgtacttcgaagagctgagcctggagaggatcctcgacatataccaccaggaggcgtgcggggggtgcataatttccgttggcgggcagatcccaaacaacctggccgtgcctttatataaaaatggagtaaaaatcatgggaaccagtccactgcagatcgaccgcgcagaagataggtccatatttagcgcagtgctcgatgagctcaaggtagcccaggccccatggaaagccgtcaatacgcttaacgaggcactggagtttgcaaaatcagtcgactatccctgtcttttgcggcctagctacgtgctgagcggcagcgcaatgaatgtcgttttttcagaggatgagatgaagaagtttctggaggaggcaactagggtctcacaggagcaccctgtggtgctgactaagtttgtggagggggctagagaagtcgagatggacgctgttggcaaggatggcagagtgatcagccacgccatttctgagcacgtcgaggatgctggcgtgcatagcggcgacgctacactgatgctgcctacgcagacgatctcacagggcgcaatcgagaaagtaaaagacgccactaggaagatcgccaaagcattcgccatctcaggcccatttaacgttcagtttttggtgaagggcaacgacgttctggtaattgagtgcaaccttcgtgcttccagatcatttccgttcgtttccaagactctcggagtcgattttatagacgtcgccactaaagtgatgattggcgagaatgtggatgagaagcacctccctaccctcgatcacccaattatccccgcagattatgtcgctatcaaggccccgatgttctcttggccgaggctgagagacgctgacccaatcttgaggtgtgaaatggcctctacaggcgaagtcgcatgcttcggggaaggtatccatacagcttttttgaaggccatgttgagtactggtttcaaaatccctcaaaagggaatcctgatcggaattcaacaaagcttcaggccaaggttcctgggagtggctgaacaactgcataacgaaggtttcaagctgtttgctactgaggccacaagcgattggctcaatgctaataatgttccagcgacccccgtggcttggcctagccaggaaggtcagaacccaagtctgtctagtatcaggaagctgatccgggatggatccatagatctcgttatcaaccttcctaataataataccaagtttgtgcacgataactatgtcattcggcgaactgcagtggatagcggaattcccctactgacaaactttcaagtgacaaagctctttgctgaagctgtccagaagtctagaaaggtcgatagcaagagcctgtttcactacaggcagtattctgcggggaaagcagca

SEQ ID NO: 8116 - DNA, 4500 bp, Artificial Sequence
  Description of Artificial Sequence: Synthetic coding sequence
atgacccgaattttgactgcttttaaggtagtcaggactctgaaaacagggttcggatttactaacgtgactgcgcatcagaaatggaagttttcccggccaggcattagactactctcagtaaaagcgcagacggcacacattgtactggaagatggaacaaaaatgaagggatattcatttggccaccccagtagtgtggctggagaagttgttttcaacaccggacttggagggtatccagaggctatcaccgatccggcttacaagggtcagatccttaccatggctaatccgataatcggaaacgggggggcaccagacacgacggccttggacgaactgggattgtccaaatacctggaatctaatggcattaaggttagcgggctgctggtgctcgactactccaaagattacaaccactggctagccaccaagtcgttagggcagtggctgcaggaggaaaaggtgcccgcaatttatggggttgataccaggatgctgaccaagattattagggacaagggcacaatgctgggcaagatagagtttgaaggccaacccgtagacttcgtggatcctaataagcagaatctcatagctgaggtgtccacaaaagacgtgaaggtgtacggcaaggggaacccaacaaaagtagtcgctgttgactgcggcattaaaaacaatgtcatcagactcctggtcaaaaggggcgccgaggtgcacctagttccttggaaccatgactttaccaagatggaatatgacggcatccttatcgccggaggccccggtaatccagccctggccgaacctctcattcaaaacgtaaggaaaatacttgagagtgacagaaaggaaccactcttcggaatctcgacaggcaacctgatcacaggcctcgcagcaggagctaaaacatataagatgtcgatggctaacaggggacagaaccaaccagttctgaacatcactaacaaacaggccttcataactgcccagaaccacggctacgccctggacaacacgctgcccgcgggttggaaaccattattcgtcaacgtcaacgaccaaacaaatgagggaatcatgcacgagtcaaaaccttttttcgcagtccaattccaccccgaagtcaccccaggccccatcgatacagaatacttattcgacagtttttttagtttaatcaagaaggggaaagcaaccactatcactagcgtgctaccaaagccagcactggtagctagcagggtcgaagtctccaaagtccttattctggggagcggggggctgagcatcgggcaggccggagagttcgattacagtggaagtcaggctgtgaaagccatgaaggaagaaaatgttaaaacagttctgatgaatcccaacattgccagcgtacaaacgaatgaggtcggcctcaagcaggcagatacggtgtacttcctgcctattacgcctcagtttgtgacagaagtcataaaggccgagcagccggacggcctcattctcggtatgggaggccagactgcacttaattgcggagttgagctgtttaagagaggcgttctaaaagagtatggtgtaaaggtacttggaaccagcgtggaatcaattatggcgaccgaggacaggcagttattcagtgacaagcttaatgagatcaacgaaaaaattgccccatctttcgccgttgagtcaatcgaagatgctctcaaagcagccgatacaatcggttaccccgtcatgatacgctctgcctacgccctcgggggcttgggaagtgggatatgtcccaaccgtgagacattaatggatctgtcaacaaaggcttttgcaatgactaaccagattctggtggagaaatccgtgacggggtggaaggagatcgagtacgaagttgtcagggacgctgacgacaactgtgtgacggtgtgtaacatggagaacgtcgatgccatgggggtacatacaggcgacagcgttgtagtggcccccgcgcagacattgagcaatgccgaattccagatgctacgcagaacgtccattaacgttgtaaggcacctgggaatcgttggcgagtgcaacatccagttcgccctgcacccaacctcaatggagtactgtatcattgaggtcaatgccaggctgtcccggtcatcagcactggcttcaaaagccacaggatatcccctcgcattcattgcagccaagatagccctaggcatacccttgccagagatcaaaaatgtggtatctggtaagacatctgcctgcttcgaaccttccctggattacatggtcactaaaatccctcgctgggatctcgatcggtttcacggcacctcctccagaatagggtcctccatgaaaagcgttggcgaggtgatggcaattggacggacattcgaggagagttttcagaaggcgcttcggatgtgccatccttctattgagggtttcaccccaaggctcccgatgaacaaggaatggccctctaatctggaccttaggaaagaactaagcgaaccatcttcaacacgcatctatgccattgctaaagctatagacgataacatgtctctggatgagattgaaaagctgacctatattgataaatggtttctgtacaaaatgcgagacattctcaatatggaaaagaccttgaagggactcaatagcgaatccatgacggaggagacactgaaaagggcaaaggaaatcggtttttccgataagcagattagtaaatgtctgggcctcactgaagctcagacgagagagctgcgattgaagaaaaatatccacccctgggtgaagcagattgacacactcgctgctgagtatccctctgtaacaaattacctctatgtcacctacaacgggcaggagcacgacgtgaactttgatgaccacggcatgatggtgctcggatgcggtccttaccacattggatcctctgtcgagtttgactggtgtgctgtgtcatctattcgcacactgaggcagctcggcaagaaaacagtcgtggtgaactgcaacccagagactgtgtcaacggattttgatgagtgtgacaagctgtactttgaagagcttagtctcgaacgaattctcgacatatatcaccaagaggcctgcggcgggtgcataatcagtgtcggtgggcaaattcctaataacctggctgtgccactatacaaaaacggggtgaaaataatgggtacctcaccgctgcagatcgacagggcagaggatagatcgatctttagcgcagtcttggatgagctcaaggtcgcgcaggcgccttggaaagccgttaatactttgaatgaagccctggagttcgctaaaagcgtagactacccttgtctgctgcgcccatcctatgtgctgtctggtagcgcaatgaacgtggtcttctcggaggacgagatgaaaaaattcctggaagaggcgactcgggtaagtcaagagcatccagtggtgctgacaaagttcgtggagggcgccagagaagttgagatggacgccgtggggaaggacggcagggttatctcgcacgcaatttccgagcacgtggaagatgccggggtgcattcaggcgatgcaaccttaatgttacccacgcagaccatttctcagggggctattgagaaagtcaaggacgcaacacgcaaaattgccaaagcctttgctatcagtgggccctttaatgtgcagttcctagtcaagggaaacgacgtgctcgtgatcgagtgcaacctcagagcctctcgttcatttcccttcgtgtccaaaacactaggcgtggatttcatagacgtcgccactaaagtcatgatcggggagaatgtggatgagaaacacttgcccacactcgatcaccccattatccccgcggattacgtggccattaaggctcctatgttttcttggcctagactgcgcgatgctgacccgattttgaggtgtgagatggcttcaaccggggaagtggcatgctttggcgagggaattcacactgcgtttctgaaggctatgctatccaccggattcaagattcctcaaaaaggcatcctgattggcatccagcaaagtttcagaccccggttcctgggggtggccgaacagttgcacaacgaagggttcaaactgttcgctaccgaggccacttctgactggttgaacgccaacaatgtgcccgctacacctgtggcctggccctcgcaggaaggtcagaatccgagcctatcctctattagaaagctgataagggatggtagcatcgacctcgtcatcaatctgccaaataacaatactaaattcgtgcacgacaattatgtgattcgccggactgccgtggacagtggaatacccctgctgacgaactttcaggtgacaaaactttttgcagaagctgtgcagaagagccgcaaggtggattctaaatctctgtttcactaccggcagtacagcgccggaaaggcagcc

SEQ ID NO: 8117 - DNA, 4500 bp, Artificial Sequence
  Description of Artificial Sequence: Synthetic coding sequence
atgacacgaattcttacggcttttaaggttgtgaggactctgaagactggcttcggttttaccaatgttacagcccatcagaagtggaagttttcgcgtcctggtatccggcttctcagcgtcaaagctcaaaccgctcacatagtcttagaggatggcactaagatgaagggttactcctttggtcacccatccagcgtagctggcgaagttgtgttcaatacaggattgggaggttacccagaagctattaccgaccccgcatataaggggcaaatcttgacgatggcaaatcctattatcggcaacgggggagcccctgatacaacggcactggacgaactaggactatctaaatacctcgaaagtaatggaatcaaagtttctggcttgcttgtgctcgattattcaaaggattataatcattggctagctactaaatctttaggccaatggcttcaagaggagaaagtacctgctatctatggagtggacaccaggatgcttaccaaaatcataagagataaaggcacaatgcttggcaaaattgagtttgagggtcaacccgtcgattttgttgatcctaacaagcagaatcttattgccgaggtttctacaaaagatgttaaggtttatggtaaagggaatcctactaaggttgtcgcagttgactgtggtataaagaataatgtgatcaggttgttggtcaagagaggtgctgaggtgcacctcgttccttggaatcatgattttaccaagatggaatacgatggtatactgatcgccggtggtcctggtaatcctgctcttgcagaacctttgatccaaaacgttagaaaaattttggaatccgaccgtaaagaaccacttttcggtatcagtacgggtaacttgatcacaggtcttgctgcaggagccaagacttacaagatgtctatggctaatagaggtcagaatcagccagttctcaatattactaacaagcaggcattcatcaccgcacaaaatcacggttacgccttggataacacgcttcccgcaggatggaaaccacttttcgttaatgtaaacgaccagactaacgagggaattatgcacgaaagcaagcctttcttcgccgttcaatttcatcctgaagttactccagggcccattgatacagagtacctgtttgattccttttttagtcttataaaaaagggtaaggctactacaatcactagcgttctaccgaagcccgcacttgtggctagccgcgtagaggtatccaaggttcttatccttggtagcggaggactttccattggccaggctggcgagtttgactactcaggatctcaggcggtcaaggccatgaaggaagaaaacgtgaaaactgttcttatgaatccgaatattgcgtccgttcagacgaacgaagtagggctgaagcaggcagatacagtgtattttctgccaataacacctcaattcgtcacagaagtcattaaggccgaacaacctgatggtttgattttgggaatggggggtcagacagctcttaattgcggcgtggagctctttaagcgaggcgtgttgaaagaatatggtgtaaaagtgctgggcacaagtgttgaaagtatcatggctaccgaagacaggcaacttttttccgataaattaaatgagatcaatgaaaagatagctccatcattcgctgttgaatcaatcgaagacgctcttaaagccgcggatacgattgggtatcctgtgatgatccgcagcgcctacgccttgggagggttgggaagtggcatctgccctaatagagaaactcttatggatttgtcaacaaaagcttttgccatgactaaccaaattctcgttgaaaagagtgtgactggatggaaggagatagaatacgaggttgtcagagatgctgatgataactgtgtgactgtttgtaatatggaaaacgtagatgctatgggtgttcacactggggattcagttgttgtggctcctgctcaaaccttgagcaacgcagaattccaaatgttgaggagaactagcattaacgtggtgagacatttggggatagtgggtgaatgcaacatccagtttgctcttcatcctactagtatggaatattgtatcatcgaggttaatgcgaggctaagtaggagcagtgccctggcatcaaaggctaccggttatcctcttgcgttcatcgcagcaaagatagctcttggcattccattaccagagatcaagaacgtagtatcaggtaaaacatctgcttgcttcgaaccatcattagattatatggtgacaaagataccacgctgggatcttgatagattccacggaacctcaagcagaatcgggtcatctatgaagtcggttggagaagtgatggcgattgggcgtactttcgaggagtcattccagaaggcactccgcatgtgtcatccttctattgaaggctttacacctcggctccctatgaacaaagagtggcctagcaacctagacttgcgtaaagagttgtcagagccttcttcaacgaggatctatgcaattgccaaagcaattgatgataacatgtccctagatgaaattgaaaagcttacatatatcgataagtggttcttgtataagatgagggatatcttgaacatggaaaagaccctaaagggtctaaacagtgagtcaatgactgaggagacccttaaacgggcaaaggaaatcggattcagtgataaacagatctcaaaatgtcttggattgacagaggctcagacaagagaactgcggttgaagaaaaatattcatccttgggttaaacagatcgatactttggccgcagaatatccttcggtgacgaactatctttatgtcacctataacggccaggaacatgacgtcaatttcgacgaccatgggatgatggttctgggatgtggtccatatcacataggtagctctgtcgaatttgactggtgtgccgtgtccagtatccgaactttgagacaattaggaaaaaaaacagtcgttgtgaactgtaaccctgagaccgtttccacggattttgatgagtgcgataaactgtactttgaggaactctcactggagcgaatcctcgatatttaccatcaagaggcatgtggtggttgcattatatcagttggagggcaaattccaaacaacttggctgtgcctttgtataaaaatggtgtgaagatcatgggcacgtctccactccagattgatcgagcggaagataggtccattttttcagctgttttggatgagttaaaagtggcacaggccccatggaaggccgttaacaccttgaatgaagcactcgagttcgctaagagtgtcgattatccatgcctcctgagacccagttatgtactttcaggatccgcaatgaatgtggttttttctgaagatgaaatgaaaaaatttcttgaagaggctacgcgagtttcccaggaacatcctgtggttttaactaaatttgttgagggtgctcgtgaggtggagatggatgctgtaggaaaagacggcagggttatttcccatgcaatatcagaacatgttgaggatgcgggggtgcactcaggagacgcaactctcatgcttccaacacaaaccatatcccagggagcaatcgaaaaggttaaggatgcgaccagaaaaattgcaaaggcgttcgctatctccggaccctttaacgtgcagtttttagtgaaaggcaatgatgtccttgtcatagagtgcaacctgagagcatcaagaagctttccttttgttagtaaaactcttggtgtggactttattgacgttgctactaaggtaatgataggggaaaacgtggatgaaaaacatctacctacacttgatcatccaataattcctgctgactatgttgctataaaggcaccgatgttctcttggccaaggctgcgtgacgcagatcctatcttgcgatgtgaaatggcttctactggagaagttgcctgttttggagaaggaattcatactgcctttctgaaggcaatgcttagtactgggttcaagatcccacagaaaggcatcttgataggtatacagcagtccttccgtcccagatttttgggtgttgcagagcaactccacaacgaagggttcaagctttttgcaacagaggcaacctccgattggttgaatgctaacaacgttccggctacacctgttgcatggccatcacaggaaggccagaatccgagcctttctagtatcagaaaactcatacgtgatggttcaatagatttggtcattaatctccccaacaataacactaagttcgttcatgataattacgtcattagaagaactgcagttgatagcggtatccctctcctcactaattttcaggttaccaagttgttcgctgaggcagtgcagaagtcgaggaaagtcgatagtaaatccttatttcactatcgacaatactccgctggtaaggctgct

SEQ ID NO: 8118 - DNA, 4500 bp, Artificial Sequence
  Description of Artificial Sequence: Synthetic coding sequence
atgaccagaatcctgactgctttcaaggtggtgcggaccctgaaaactggattcggattcactaatgtaaccgcccaccagaagtggaagttctcccgcccaggaatccgactcctgtccgtcaaggcccaaaccgcacatatcgtgttggaggacggcaccaagatgaaaggatactcctttggccacccctcgagcgtggcaggtgaagtggttttcaatacgggcctcggaggctacccggaagcgatcactgatccagcttacaaaggccagatcctgactatggccaatcctatcatcggaaacggcggagccccggacacgaccgcgctggacgaactgggcctgtcgaagtacctggagtctaacgggatcaaagtctccggtctgctggtgctggactactccaaggattataaccattggctcgcaaccaaaagtctgggccagtggctccaggaggagaaagtgccggcgatctacggggtcgacactcggatgctgaccaagattatccgcgataaagggacgatgctgggtaagatcgagttcgaaggccaaccggtcgacttcgtggatccaaacaagcagaacctgatcgcggaggtgtcgacgaaggacgtgaaagtgtacggtaagggaaaccctaccaaggttgtcgccgtcgattgcggtatcaagaacaacgtgatccgccttctggtgaagcggggagcggaggtgcatctggtgccctggaaccacgatttcactaaaatggagtacgatgggatcctcatcgcgggaggacctggtaatcctgccctggccgaaccccttatccagaatgtgcggaagatattggaaagcgacagaaaagagccgctgtttggaattagcaccggaaacctgatcaccggattggcagcaggggccaagacttacaagatgtctatggcgaatagaggccagaaccagccggtgctgaacatcactaataaacaggcttttatcactgctcagaatcatggctacgccctggacaatacgctgccagcaggctggaagccactgtttgtgaacgtgaacgaccaaaccaacgaagggattatgcatgagtcaaagccgttctttgccgttcagtttcaccctgaagtcacgccgggacctatcgacactgaatacctgttcgatagcttcttctcgctgatcaagaaggggaaagcaaccactatcactagcgtgctgcccaagccggcactcgtcgcatcacgcgtggaagtctccaaggtgcttatcctgggctcgggaggactctcgatcggacaagcgggtgagttcgactactccggaagccaggcggtgaaggccatgaaggaagaaaacgtgaaaacggttctcatgaacccaaacattgcttcagtgcagaccaatgaggtggggcttaagcaagccgacaccgtgtacttcttgccgatcactccgcagttcgtgaccgaagtgatcaaggccgaacaaccggatggcctcatcctgggaatgggcggccaaaccgccctgaattgcggagtggaactgttcaagagaggagtgctgaaggagtacggagtcaaggtgctcggcacctcggtggaatccatcatggcgaccgaagatcgccagctgttctcggacaaactcaacgagatcaatgaaaagattgcgccgtcgtttgctgtcgaatcgattgaagatgctttgaaagccgcagacacgataggatacccggtgatgattcgctcagcctatgccctcggcggcttgggatcgggaatctgcccgaaccgcgaaactctcatggacttgtccactaaagcatttgcgatgaccaaccaaatcctggtcgagaagtcggtgactggatggaaggaaattgagtacgaagtcgtgagggatgcggatgacaattgcgtgaccgtatgcaatatggagaacgtggatgcgatgggcgtccacactggagactccgtcgtcgtggctccggctcaaaccctgtcaaacgcagaattccagatgctgcggcgcacttccatcaatgtggtccggcatctcggaatcgtgggggaatgcaacatccaattcgcactccacccaacttcaatggaatactgcatcatcgaggtgaacgctcgcctcagccgctcatcggcccttgcgagcaaggctactggttacccgctggcgtttatcgccgccaagattgccctgggaattcctttgcctgagatcaaaaacgtagtctcaggtaagacctccgcctgcttcgaaccctcccttgactacatggttacgaagattccgcggtgggacttggaccgtttccacggaacttcgtcccgcatcggatccagcatgaagtcggtcggagaagtgatggcaatcggaaggaccttcgaagagagcttccaaaaagctctgagaatgtgccacccatcaatcgaaggattcaccccgcgcctgcccatgaataaggagtggccaagtaatctggatctgcgaaaggaactcagcgagccttcgagcactcggatctacgccattgcgaaggcgatcgacgacaacatgagcctggatgaaatcgaaaagctgacctatatcgacaagtggttcctttacaaaatgcgcgacatcctgaacatggagaaaactttgaagggactcaattcagagagcatgaccgaagaaaccctgaagagagccaaggaaatcggtttctccgacaagcagatctcgaagtgcctcgggctcactgaagcgcagactcgggaactgcggctgaagaaaaacatccatccttgggtgaaacagatcgacaccctcgccgcagagtacccgagcgtgaccaactacctgtacgtgacctacaacggccaagaacatgacgtgaatttcgacgatcacggaatgatggtcctgggatgtggaccataccacatcggctcatccgtggagttcgattggtgcgccgtgtcatcgatcagaactcttcggcaactgggtaaaaagacggtggtcgtcaattgcaatccagagactgtgagcactgattttgatgagtgtgacaagctgtacttcgaggaactctcactggagcgcatcctcgacatctatcaccaagaggcctgcggaggttgtatcattagcgttggagggcagatccctaacaacctcgctgttccgctttacaagaatggcgtgaagatcatggggacctctccgctccagatcgatcgtgcggaggaccggtcgattttctccgccgtgctcgatgaacttaaagtcgcacaggccccttggaaagcagtgaacactcttaacgaggccctggaattcgctaagtcggtggattacccatgcctgctgcgaccgtcgtacgtgctctccggtagtgccatgaatgtcgtgttctccgaagatgagatgaagaagtttctggaagaagccacccgggtcagccaggagcatcctgtggtcctgactaaatttgtggaaggtgctagagaggtcgagatggacgccgtcgggaaggatggacgggtgatttcacacgcaatcagcgaacatgtggaggacgcgggcgtgcattccggagacgccactctgatgctccccacccagactatctcccagggagcaattgaaaaagtgaaggacgccacccgcaagattgcaaaggctttcgctatctcgggaccgttcaacgtccagttcctggtcaagggaaacgacgtgctcgtgatcgagtgtaacctgagagcctcgcgcagctttccgttcgtgtccaagaccctgggggtggactttatcgacgtggccaccaaagtgatgatcggagagaacgtcgacgaaaaacacctgccgaccctcgaccacccaatcatcccagcggattacgtggcaattaaggcgccaatgttctcatggccaaggctccgcgatgcggacccgatcctccgctgtgaaatggcctccacgggcgaggtggcctgtttcggagagggaatccacactgccttcctgaaggctatgctttccaccggctttaaaatcccacaaaagggaattttgatcgggattcagcaatcgtttcggcctagatttctgggggtcgcggaacaactgcacaacgaaggctttaagctcttcgcaactgaggctacctcagactggctcaatgccaacaacgtgccagctacccccgtggcgtggccgtcgcaggaaggacaaaacccgagcctctcttccatccggaagttgatcagggatggctcaatcgacctcgtcatcaatttgccgaataataacactaagttcgtacatgataactatgtgatcagaaggaccgccgtggatagcggaatccccctcctgaccaacttccaggtcaccaagttgttcgcggaggccgtccagaaatcaaggaaagtcgactcgaagagccttttccactacaggcagtactcggcaggaaaggccgcc

SEQ ID NO: 8119 - DNA, 4500 bp, Artificial Sequence; identical to SEQ ID NO: 8110
  Description of Artificial Sequence: Synthetic coding sequence

SEQ ID NO: 8120 - DNA, 4500 bp, Artificial Sequence
  Description of Artificial Sequence: Synthetic coding sequence
atgacccgcattctgacagctttcaaggtcgtgcgcaccctgaaaacgggattcggcttcactaacgtgaccgcccaccagaaatggaagttctcgcgccccggtatcaggttactttccgtgaaggcccagaccgcgcacattgtattggaagatgggaccaagatgaaaggatactcgttcggtcaccccagttcagtcgctggagaggtggtattcaataccggcttgggtggataccccgaggccatcacagatcccgcctataagggacagatccttacgatggcaaacccaattattggcaatggtggtgctccggacaccactgcgcttgatgaacttggcttgtcgaagtacttggagtccaacggcattaaggtcagtggtctgctggttctcgactacagcaaggattacaaccattggctcgccaccaaatcccttgggcagtggctccaagaggaaaaggtccccgctatttacggcgtcgatacgcgtatgctgacgaagattattagggataagggcaccatgctgggcaagatcgagtttgaaggccaacccgtggacttcgttgatcccaacaagcagaacctcatagctgaggtgtccaccaaagacgttaaggtgtacggtaagggcaaccctaccaaggtcgtcgccgtagactgcggtatcaagaacaacgttatccgcctcctggttaagcgcggcgcagaggtgcacctggtcccctggaatcacgacttcaccaagatggagtatgatggaattcttattgccggaggtcccggtaacccggccttggctgagcccttgatccagaacgttcgtaagattctcgagtccgatcggaaggagcccctcttcgggatctctaccggaaacctgatcaccggcctggctgccggggccaagacttacaagatgagcatggcgaatcgaggacaaaaccagcctgtgctgaatatcacgaacaagcaggctttcatcaccgcacagaatcacggctacgctttggataacacgcttcccgctggctggaaacctctcttcgttaacgttaacgaccagaccaacgaaggtatcatgcatgagtctaagcctttcttcgcagtccaatttcatcccgaggtgacgcccggccccatcgacaccgaatacttatttgattccttcttctcccttattaagaagggaaaggccacgactattacgtccgtcctccccaagcctgcgctggttgcctcccgtgtggaagttagcaaggttctcatccttggctccggcggtctgagcattggtcaggctggcgagtttgactattcgggatcacaggcggtcaaagcgatgaaggaggagaacgtcaaaaccgtcttgatgaacccgaacattgcaagcgtccagacaaacgaggtgggacttaagcaggccgacaccgtctatttcctgcccattaccccccagtttgtcaccgaggtgatcaaggcagaacaacccgacgggttgatcctcggcatggggggccagacggccctgaactgcggcgtcgagttattcaagcgtggagtgcttaaagagtacggcgtgaaggtgttgggtacttcagtcgagtcgatcatggctaccgaagaccgccagctgttttccgacaagctcaatgagataaacgagaagatcgccccgtctttcgctgtggaatcaatcgaggatgccctgaaagcggctgacactatcggttaccccgtcatgattcgcagcgcttacgcgctcggaggcctagggtccggaatttgcccaaaccgggagacgctgatggatttatcgaccaaagccttcgccatgactaatcagatcctggtggagaagtccgtcactggttggaaggagatcgagtacgaagtcgtgcgcgacgcggacgataattgcgtgactgtctgcaacatggagaacgtcgatgctatgggcgtgcataccggtgactccgtggtcgttgcccccgctcagaccctctccaatgctgagttccagatgctccggcgcaccagtattaacgttgtcagacatttgggcattgttggtgaatgcaacatccaattcgccctccaccccacgtcgatggagtactgtatcattgaagtgaacgcgcgcctctcacgttcatcagcactcgcttccaaggctaccgggtacccgctcgccttcatagccgcaaaaattgctctgggaatcccactccctgaaataaaaaacgttgtcagtgggaaaacatctgcatgcttcgaaccttccctggattacatggttaccaagatcccccgatgggacctcgaccgtttccatgggaccagctcccgaattggcagttctatgaagagtgtcggcgaggtcatggccattgggcgaacgttcgaggagtccttccagaaggccctccgtatgtgtcatccatcgatcgaaggattcactccccgcctccctatgaacaaggagtggcctagcaacttggatctgagaaaggagctttccgagcccagctccaccaggatttatgccatcgcaaaggccatcgatgacaacatgtccctggacgaaattgagaagctcacctatatcgacaaatggtttttgtataagatgcgtgacatcctgaacatggaaaagacgcttaagggccttaactcggagtccatgactgaggagacccttaagcgagccaaggaaatcgggttcagcgacaagcagatctccaagtgcctcggcctcactgaggcacagacaagggaacttagactgaagaagaacattcacccctgggttaagcagatcgacactctcgctgccgagtatccttcggttacgaactacctctacgtcacctataacggccaggagcatgatgtcaatttcgacgatcatggaatgatggttcttggttgcggaccgtaccacattggtagctcagtcgagtttgattggtgcgcggtgtcgagcatcaggactctgagacagttgggaaagaaaactgtcgttgtcaactgtaaccccgagaccgtgtccaccgacttcgacgagtgcgacaaactatattttgaggagcttagtctggagcgcatcctcgacatttatcaccaggaggcttgcggcggctgcattatctcggtgggtggtcaaatccccaacaaccttgccgttcccctttacaaaaacggggttaagatcatgggcacctcccccctccagattgatcgtgcggaggaccgcagtatcttttccgcagtccttgatgaattgaaggtcgcccaggccccgtggaaggcggtcaacaccctgaacgaagcactggagttcgcgaaatccgtcgactacccgtgcctgctgcgcccgagttacgtcctgtccggcagcgctatgaacgttgtcttcagtgaggacgagatgaaaaagttcctggaggaggcaacccgggtctcacaagaacaccctgtcgttctcacgaagttcgtcgagggagccagggaggttgaaatggacgccgtcggcaaggacggaagggtcatctcacacgccatctccgagcatgtggaggatgctggagtccacagcggcgatgccaccttgatgctgcccacccagacgatcagccagggagccatagaaaaggtgaaggacgccactcgcaagatcgccaaggctttcgccatctcgggcccttttaatgtgcagttcctcgtgaagggcaacgacgtcctcgttatcgagtgcaacttgcgcgcctcgcgttcgttccccttcgtctcgaagactctcggagttgacttcatcgatgtcgccacgaaggttatgatcggtgaaaacgtcgacgagaagcatctgccgaccctggaccacccgattattcccgcggattatgtcgctatcaaggcgcctatgttctcgtggccccgcctgcgtgacgctgatccgatcctgcgatgcgagatggcttctaccggcgaggtggcttgctttggagaaggaatccataccgcgttcttgaaggccatgctttccaccggcttcaagatcccacagaaggggatcttgattggcatccagcagtcgttccgcccgcgctttttgggtgtcgctgaacagcttcataacgaaggtttcaagctcttcgctacggaggcaacttccgactggctgaacgctaacaatgtcccggcaacccccgttgcttggcccagtcaagagggtcagaacccgagtctgtcttcgatccgaaagctgatccgcgacggatctattgacctcgtgataaatttacctaacaacaacacaaagtttgtccatgacaactacgttatcagacgtaccgctgtggattccggaatccctctccttacaaacttccaggtcaccaagctcttcgcggaggccgttcagaagtcccgaaaggtcgacagcaagtccttgttccattaccgccagtactcggccggcaaggccgct

SEQ ID NO: 8121 - DNA, 4500 bp, Artificial Sequence
  Description of Artificial Sequence: Synthetic coding sequence
atgacgagaatcctgaccgcctttaaggtggtgcggaccctgaagaccggctttggttttactaatgtgacggcacaccagaagtggaagttttctcgccctggaattagactgctctctgtcaaggcccaaactgcccacatcgttctggaagatggtacaaagatgaaggggtattcattcggtcatccctctagcgtggccggtgaagttgtgttcaatacagggctgggaggctatcccgaagccattaccgacccagcttataagggacagattcttactatggcgaaccctattattgggaacggcggcgctccagatacaaccgccttggacgagctcgggctctctaaatacctcgaatccaatgggataaaagtctcgggactactggtcctggattatagtaaagattataatcactggctagccacaaagtcccttggccagtggctacaggaagagaaagtgcccgctatatacggtgtggacacccgcatgttgactaagattattcgtgataagggtactatgttgggcaaaatcgagttcgaaggacagccagtggatttcgtggaccctaacaagcaaaatcttattgccgaagtctcaaccaaagatgtgaaagtgtacggaaaaggaaatccgaccaaagttgtggctgtggattgcggcataaagaacaatgtgatccggctgctggtcaagcgtggagcagaggtccatctcgtgccctggaatcacgatttcacaaagatggagtacgatggtatcctcatcgcaggaggccccgggaacccagccctggccgaaccactgattcagaacgtgagaaaaattctggaatcagacaggaaggagccactgtttggcatcagcactggaaatttgatcaccgggctagcagcaggtgcgaaaacttacaaaatgtccatggccaacaggggccagaaccaaccagtactcaacattaccaataaacaggcctttatcactgcacagaatcacggctacgcactggacaatacactgccggctggatggaagcctctgttcgtgaacgttaacgatcagaccaatgaggggattatgcacgagtctaagccttttttcgctgttcagttccacccggaggttacaccaggaccaattgatacggaatatctcttcgattcgttcttcagtctcatcaagaaggggaaggccacaaccataacctccgttctccccaagccggcgcttgtggcaagccgggtggaagtgtccaaagtgcttatccttgggtccgggggccttagcattggccaggctggggagtttgactactctggctcacaggcagtgaaagccatgaaggaagaaaacgtgaaaactgttctgatgaaccctaatatcgcgtccgtacagaccaatgaagtagggctaaagcaggctgacacagtttactttttgcctatcaccccccagttcgtgaccgaggtaattaaagccgaacaacctgacgggctaatccttggcatgggaggtcagactgcccttaattgcggggtggagctctttaaacgtggagtgttgaaggagtacggagtgaaggttctgggtacaagcgtggaatccatcatggccacagaggatcggcaattattcagtgataagctgaatgaaatcaacgagaaaattgcaccctcttttgccgtagagagtattgaggacgcccttaaggcagctgataccatcggatatccggtcatgattcgaagtgcctacgctctcggcggactcgggagtgggatctgccccaacagagagacacttatggacctgtccaccaaggcctttgcgatgacaaaccagattttggtagagaagtcagtaaccggctggaaggaaatcgaatatgaggtcgtgcgagacgctgacgataattgtgtaacggtctgtaatatggagaatgtggacgccatgggtgtgcatactggcgactccgtggtggtggctccagcacaaactctttcaaatgccgaatttcagatgcttcgccgcaccagtatcaatgtcgtcaggcacctaggaatagtcggagaatgcaacatacagttcgctttgcatccaacttccatggaatattgcataatcgaggtgaacgcccgtctgtcccggagttcggcactcgctagcaaggctaccggctacccgctggctttcatagcagcaaagatagcgcttgggattccccttccagagataaagaacgtcgtatcgggtaagacttccgcctgcttcgaacccagcctggattacatggtaaccaaaattccgaggtgggacctagatcgattccatggcacatcttcgaggatagggtcctccatgaaatccgtgggtgaggtgatggcgatagggaggacttttgaagaaagcttccagaaggccctgagaatgtgtcacccctccatcgagggtttcactccaagactaccgatgaataaggaatggccatccaatctggatctacgaaaagaactctcagagccaagctcgacaagaatatacgctatcgcaaaggccatcgacgataacatgtctctcgatgaaatcgaaaagctgacctacatcgacaaatggttcttatataaaatgagagacatcctcaacatggagaagaccctcaaggggctcaattctgagagcatgaccgaagagacactcaagcgcgcaaaagagattggtttctccgataaacagatctccaagtgtctgggcctaactgaagcccagacaagagaactaagactcaagaagaatatccacccatgggttaagcagatcgacacacttgcggccgagtatccctctgtcactaactacctatacgtgacatacaatggacaagaacacgatgttaattttgatgaccatggaatgatggtgctgggatgcggcccatatcacatcgggagcagcgtcgaattcgactggtgcgcggtttcaagtatcaggactctgaggcaactgggtaagaagactgtggttgtaaattgtaatccggagactgtcagtaccgatttcgacgaatgtgacaagctgtacttcgaggagctatcattggaacgcattctggatatttatcaccaggaggcgtgcggggggtgcattatttcagtgggcggacagatccccaacaacttggcggtaccgctctacaagaacggcgtcaaaatcatgggcaccagccccttgcaaatcgaccgagcagaggatcggtcaatcttctccgcagtgctagacgaacttaaagtcgcccaggctccctggaaagctgtaaacacattaaatgaggcattggagtttgcgaagtccgtggattatccttgcctactcaggccctcctacgtcctctccgggagcgcaatgaacgtcgtattcagcgaagatgaaatgaaaaagttcttagaggaagcaaccagggtgtctcaagaacatcctgtggtgctgaccaagtttgtcgagggcgccagagaggtggagatggacgcagtcgggaaagatggcagagtgatcagtcatgctatctcagagcacgtcgaggacgctggcgtgcactctggagatgccacattgatgctcccgacgcagacaatcagccagggcgctattgagaaggtgaaagacgctactcggaaaatagccaaagcctttgccatcagtgggccgttcaacgtgcagtttctagtcaagggcaacgatgttctggtgattgagtgcaatctcagggcgtctcgctcttttccattcgtgtcgaaaactctaggagtggattttatagacgttgccacaaaagtcatgatcggagagaacgtggacgagaagcatctcccaacactggatcaccctatcatccctgccgactacgtcgctatcaaggcacccatgtttagttggccgcggctgcgcgatgccgacccaattttgagatgtgagatggctagcacaggggaagttgcctgcttcggcgaggggatacacactgccttcctcaaggcaatgctcagcacggggtttaagatcccccagaagggcattctgatcggcattcagcagagctttcggcctcggtttctaggggtggcagaacaactacataatgaaggctttaaactgtttgccaccgaggctacatccgattggctgaacgcaaataatgtgcctgccacccccgtggcttggccatcacaggaaggtcaaaacccctctctgtcatcaatcagaaaattgatcagggacggaagtatcgacttggtcatcaatttgcccaacaacaatacgaagttcgttcacgataactacgtgatccgccggacggccgtggattctggtatacctcttcttacgaacttccaagtaactaagctattcgctgaggctgtacagaagagccggaaggttgactcaaaatcattatttcactataggcagtatagcgcgggcaaggccgcg

SEQ ID NO: 8122 - DNA, 4500 bp, Artificial Sequence
  Description of Artificial Sequence: Synthetic coding sequence
atgactagaatcttgactgcttttaaggttgttcgtacacttaaaactggattcggtttcacaaatgttactgctcatcaaaaatggaaatttagtagaccaggaattagattactttctgttaaggctcagacagctcatattgtacttgaagatggaactaaaatgaagggatattcatttggacatccatcaagtgtagctggagaagtagtatttaatactggattaggaggatatccagaagcaattacagacccagcttataaaggacaaattcttacaatggcaaatccaatcataggaaatggaggagcaccagatacaacagctcttgatgagctaggattaagtaaatatttagaaagtaatggaattaaagtttcaggtttacttgttttagattatagtaaagattataaccattggttagcaacaaaatcattaggacaatggttacaagaagaaaaagttccagctatttatggtgttgacactcgtatgttgactaaaattatcagagataaaggaactatgcttggaaaaatagaatttgaaggacaaccagttgactttgttgatccaaataaacaaaatctaatagctgaagttagtacaaaagacgttaaagtatatggaaagggaaatccaactaaagttgttgcagttgattgtggtataaaaaacaacgttattagacttttagttaaaaggggagcagaagttcatttggttccatggaatcatgattttactaaaatggagtatgatgggatactcattgcaggaggaccaggtaatccagctttagcagaaccattaatccaaaatgttcgaaaaatattagaatctgatagaaaagaaccattatttggtattagtacaggaaatttgattacaggattagctgctggagctaaaacttataaaatgtcaatggccaacagaggtcaaaatcagccagtacttaacattactaataaacaagcttttattacagctcaaaatcatggttatgctttagataatacattaccagctgggtggaaaccattattcgttaatgtaaacgatcaaactaatgaaggaattatgcatgaatcaaaaccttttttcgcagttcaatttcatccagaagttactccaggtccaattgacacagaatatctttttgattcttttttctcattaattaaaaaaggaaaagctacaacaattacaagtgttcttccaaaacctgctttagtagcaagtagagttgaggttagtaaggttttaattctaggtagtggaggattgtcaataggacaagctggagaatttgattattctgggtcacaagcagttaaagcaatgaaagaagaaaatgttaagacagttttaatgaacccaaatatagctagtgttcaaactaatgaagttggactaaaacaggctgatacagtttatttccttccaattacgcctcaatttgttactgaagtaattaaagcagaacaaccagatggtctaatattagggatgggtggacaaacagctttaaattgtggtgttgagctatttaagagaggagtacttaaagaatacggagttaaagtacttggaacatcagtagaatcaattatggcaacagaagataggcaattattttcagataaacttaatgaaattaatgagaaaattgctccatctttcgccgtagaaagtattgaagatgctttaaaggcagctgatacaattggatatccagttatgataagatcagcatatgcattaggaggtttaggaagtggtatttgtccaaatagagaaacattgatggatttaagtacaaaagcttttgcaatgacaaaccaaatattagttgaaaaatcagttacaggttggaaggaaatcgaatatgaagtggttcgtgatgctgatgataattgtgttactgtctgtaatatggaaaatgttgatgctatgggtgtacatactggtgattcagtagttgttgctcctgcacaaactctttcaaatgcagaatttcaaatgctaagaagaacatcaattaatgttgttagacatttaggaattgttggagaatgtaatattcaatttgctcttcatccaacgtcaatggaatattgtattattgaggttaatgcacgattaagtagatctagtgctttagcttcaaaagcaactggatatcctttagcttttattgctgcaaaaattgctcttggtattccattacctgagattaaaaatgtggttagtggaaaaacttcagcatgttttgaacctagtcttgattatatggtaacaaaaattccacgttgggatcttgatcgtttccatggaacatcatctcgtattggatcatcaatgaaaagtgtcggtgaggttatggctattggaagaacttttgaagaaagtttccaaaaagctttaagaatgtgtcatccatcaattgaaggatttacacctagactaccaatgaataaagaatggccatccaatcttgatcttagaaaagaattatccgaaccaagtagtacaagaatatatgctatagctaaagctatagatgataatatgtcattagatgaaattgaaaaattaacatatattgacaaatggtttttatataagatgcgagacattttgaacatggaaaaaactttaaaaggtcttaatagtgaatcaatgacagaggaaactcttaaaagagctaaagaaattggattttcagataaacaaataagtaaatgtttgggattaacagaagcacaaacaagagaattgcgtcttaaaaaaaatattcatccatgggttaaacagattgatacacttgcagctgaatatccatcagtgaccaattatttatatgttacgtataatggacaagaacatgatgtaaattttgatgatcatggaatgatggtattaggttgtggtccatatcatattggtagttcagttgaatttgattggtgtgcagttagttcaattagaactttaagacaattaggtaaaaaaacagttgttgttaattgtaatcctgaaactgtttctacagattttgatgaatgtgataaattatattttgaggaattgtcattagaaagaattttagatatttatcatcaagaagcatgtggaggatgtatcatttctgttggaggacaaatacctaataatttagcagttccactttataaaaatggtgttaaaattatgggaacttcaccattacaaatagatcgagcagaagatagatcaatattttctgctgttcttgatgaacttaaagttgcacaagcaccttggaaagcagttaatactctaaatgaggcattagaatttgctaagtctgttgattatccatgtcttttaagaccaagttatgttttatcaggatctgctatgaatgttgtctttagtgaagatgaaatgaaaaaatttttagaagaagctacaagagttagtcaagaacatcctgttgttttaactaaatttgttgaaggagcaagagaagttgaaatggatgccgttggaaaagatggaagagtcatttctcatgctatatcagaacatgttgaagatgctggagttcattcaggagatgcaacattaatgctacctactcaaactatttctcaaggtgctattgaaaaggtaaaagacgcaacacgaaaaatagctaaagcatttgctatatcaggaccatttaatgtacaatttctcgttaaaggaaatgatgttttagttattgaatgtaatcttagagcatcaagaagttttcctttcgtttcaaaaacgttaggagttgattttattgacgtcgctactaaagttatgataggagaaaatgttgatgaaaaacatttaccaactttagaccatccaattattcctgctgattatgttgctataaaagctccaatgttttcttggccaagattacgagatgctgatccaattttacgatgtgaaatggcatctactggagaagtagcatgttttggagagggaattcatacagcttttttaaaagctatgttaagtacaggttttaaaattccacaaaagggtattcttattggaatccaacaatcatttagaccaagattcttaggtgttgcagaacaattacataatgaaggatttaaattatttgcaactgaagcaacaagtgactggttaaatgctaacaatgttccagcaacaccagtagcttggccatctcaagaaggacaaaatccatcattatctagtattagaaaactaattagagatggatcaattgatttagttattaaccttccaaataataatactaaatttgtgcatgataattatgttattagaagaactgcagtcgattcaggaattccacttcttactaattttcaagtaactaaattatttgcagaagctgttcaaaagtctagaaaagttgacagtaaaagtctttttcattatagacaatattctgcaggaaaggctgca

SEQ ID NO: 8123 - DNA, 4500 bp, Artificial Sequence
  Description of Artificial Sequence: Synthetic coding sequence
atgacacggatcttaactgccttcaaggtggtccgcacactgaaaaccggctttggattcactaatgtgaccgcacaccaaaaatggaagttctcccgcccaggaataagattgctgagtgtgaaggcccagacggctcatatagttctcgaagatggcacgaaaatgaaggggtattcttttggtcacccttccagcgtcgcaggggaggttgtgtttaatacgggcctgggcggatacccggaggcaattacagaccctgcctacaagggacagatccttaccatggcgaacccgatcatcgggaacgggggcgcccccgatacaacagcattagacgaactaggactgagcaagtatctggagagcaatggcatcaaggtgagcggcttactggtgctggactacagcaaggactacaaccactggctcgctacaaaatcactgggccagtggttacaggaagaaaaggtccccgcaatctatggcgtggatactcggatgctgacaaagatcatccgcgacaaggggaccatgcttggaaagatcgagttcgagggacaaccagtggattttgtcgatccgaacaagcagaatttgatagcagaggtcagtactaaggacgtcaaagtgtatggaaagggtaacccaacgaaagtggtggcggtcgactgcggcattaagaacaatgtcatacgcctgctagtgaagagaggggccgaagttcacctggtgccttggaatcatgacttcactaagatggagtacgatggcatcctcatcgccggtggccccggcaaccctgctctggcagagcccctgattcagaacgtgaggaagatcttggagagcgatagaaaggagccgttattcggcataagtaccggcaatctgatcaccggtctggccgccggcgctaaaacgtacaagatgagcatggccaatcgggggcagaaccaacctgtcttgaatatcaccaacaaacaggcattcattaccgcccagaaccatggttacgcgcttgacaacactctgcctgccgggtggaagccattatttgtaaatgtaaatgatcagacgaacgaaggcattatgcatgagtcaaaacccttctttgctgtgcagttccatcccgaagttacccctgggccgattgatacagaatacctgttcgactcgttcttttctctcattaagaagggaaaagctaccaccattacttcagttcttcccaagcctgccctggtggcgagtcgggtcgaagtgagcaaggtactcatcttgggctctggaggcctcagtattggtcaagctggggagttcgactacagtggtagccaagccgtgaaggctatgaaagaagaaaacgtgaagactgtgttaatgaatcctaatatagcctcagtgcagaccaatgaggtcggtctgaaacaggccgacaccgtctacttcctccccatcacccctcagttcgttactgaggttatcaaagccgagcagcccgatgggctcattttggggatgggggggcagaccgcgttaaactgtggggtcgagctcttcaagcggggtgttctcaaagagtacggtgtgaaagtcttgggcaccagcgtcgagtccatcatggcgacagaagaccgacaactgttcagtgacaaattaaacgagatcaacgagaaaatcgcccccagctttgccgtggaaagcatcgaagatgccctgaaagcagcagatacaatcgggtatcctgtgatgattcgcagtgcttacgctctcggcgggcttggaagcggcatttgtccgaaccgcgagacactgatggacctctctactaaggcctttgcgatgacaaatcagattctggttgagaagtccgtgaccgggtggaaggagattgagtacgaagttgtacgcgatgccgacgataattgtgtgaccgtttgcaatatggaaaatgtagacgccatgggggtgcacactggcgactcagtggtcgtggcaccagctcagactctgtctaatgcagaattccagatgttacggaggacctccattaatgtggtccgccacctgggcattgtaggagaatgcaatatccaatttgccctgcacccgacctcaatggaatactgcatcatcgaggtaaatgcccgccttagcaggagttccgccttggcctcaaaggccactggatacccactggcctttatcgctgcgaagatagcactgggcattcctctgccggaaataaaaaacgtagtgagtgggaagacttccgcatgtttcgaacctagcctcgattacatggtcaccaagataccacgatgggacctcgaccgattccacgggacttcgagcagaatcgggagctccatgaagagcgtgggcgaagttatggccattggaaggacattcgaggaatcttttcagaaggcactacgaatgtgtcaccctagcatcgagggctttacaccgagactaccaatgaataaggagtggccctccaatttagacctgaggaaagagttgagtgagccttcctccacgcgcatatacgctattgcaaaggcaattgatgataacatgtccctcgacgagattgaaaaactcacgtacatcgataagtggtttttatacaaaatgcgagatatcttaaatatggagaaaactctgaaaggcttaaattccgagagtatgactgaggagaccctgaagcgcgccaaggagatagggttctccgataagcagatttccaagtgtttgggcctcacagaggcacaaacccgcgagctgagactaaagaagaacattcacccatgggttaagcagatcgacaccttggcagcggaatacccatcagttaccaattacctttacgtcacctataatgggcaggagcatgatgttaacttcgatgaccatggcatgatggtcttgggctgtggaccttaccatatcgggagctctgtagaattcgactggtgcgcagtgagctccatccgtaccctccggcagctgggcaagaagaccgttgttgtgaactgcaatccagagaccgtttcaaccgactttgacgagtgcgataagctgtatttcgaagaactcagtttagaacggattcttgacatctatcaccaggaggcttgtggcggctgcattataagtgttggggggcagatccctaataacttagccgtacctctgtacaagaatggggtgaagataatgggcacctccccacttcagatcgatcgcgcggaagataggagcattttttcagctgtcctcgatgaactgaaagtcgctcaggcaccttggaaggccgttaacactcttaatgaagccctggaattcgcaaaatccgtggattacccttgtctgctcagaccatcatatgtgttatccggatcagcgatgaatgtggtctttagtgaagacgaaatgaagaaattcctggaggaggccacacgcgtctctcaagaacacccagtggtgctgacaaaatttgtggagggagctagggaagttgaaatggatgccgtaggcaaagatggtcgggttatcagtcacgcgataagcgagcacgtcgaggacgcaggggtgcacagtggtgacgcaactctgatgctgccaacacagaccattagccaaggcgcaatcgagaaggttaaagatgctacccgcaagatagctaaggcttttgccatctctggcccttttaatgtacagtttttggtgaagggcaatgatgtgctggtgatcgaatgtaacttgagagccagccgttcatttccatttgtgagcaagaccctgggcgtggacttcattgatgtggcaaccaaggtaatgattggcgaaaatgtggatgaaaaacacctgccgactctggaccatcctattatcccggcagactacgtggctatcaaagctccaatgttcagctggcctaggctgagagacgccgatccaattcttcgctgtgagatggcctctacaggtgaggttgcttgtttcggcgagggaatccacaccgccttcctgaaggccatgcttagcacaggttttaagatcccccagaaaggaattctgataggcatacagcagtcgttccggccaagattcctgggggtggccgagcagctgcataacgagggtttcaaactgtttgctactgaagcaacttctgactggctcaatgccaataatgtgccagctacccctgtagcatggccaagccaggagggacagaatccttctttgtctagcatccgcaagctgatcagggatggctccatagatctagtgataaacctgcctaacaacaatacaaagtttgtgcacgataattatgtgatccggagaaccgccgttgactcgggaattcctctgctgactaacttccaggtcaccaagttatttgccgaagcggtccagaaatcgcggaaagtcgattccaagtccttattccactaccggcagtatagtgctggaaaggctgcg

SEQ ID NO: 8124 - DNA, 4500 bp, Artificial Sequence
  Description of Artificial Sequence: Synthetic coding sequence
atgactcggattctaacagctttcaaagtagttcgcactctaaagactgggttcgggtttactaatgtgacagcacatcagaaatggaagttttctaggcccgggataagactcctttctgtcaaagcccaaacagctcacatcgtgttagaggatgggactaagatgaaaggatattcctttggacatcctagtagtgtggccggagaagttgtatttaatacaggactaggaggataccctgaggctataacagatcccgcttataaagggcagatactcacaatggctaacccaattatcggaaacgggggggcccccgacactactgctcttgatgaactaggactgagtaaatacctggaatcaaacgggattaaagtgtctgggctgctagttttggactattctaaggattataatcattggttagcaactaagtctctggggcagtggctacaagaagaaaaggtccccgctatctatggagtggatacaagaatgcttacaaaaattatccgggacaaagggacaatgcttgggaagatcgaatttgagggacagccagtcgatttcgtcgatcctaacaaacagaatctcatcgcagaagtgtcaacaaaagatgtaaaagtgtacggaaaagggaacccaactaaagtcgtagccgttgattgtggaatcaaaaacaacgtaatccgcctgctggtgaaacgcggagcagaagtgcatttggtgccctggaaccacgattttactaaaatggaatatgatggaatactaatcgctggggggcctggaaacccagccctggctgaaccattaatacagaacgtcagaaagatattagaatcagacaggaaagaaccactatttggaatctccactgggaatttaatcactggactagctgctggagctaaaacttataaaatgtctatggccaatagggggcagaatcagccagtgctgaatatcacaaataaacaggcattcatcactgcccagaaccacgggtatgccctagataatactctgcccgccggatggaaaccactcttcgtcaacgtgaacgatcagacaaacgagggaataatgcatgagagtaaacccttttttgcagtacagttccaccctgaagttactcccggacccatagatacagaataccttttcgacagtttcttctcactgataaaaaaggggaaggcaactacaattacttctgttctgcccaaacctgctctagtcgcttcacgcgtggaagtctcaaaagtcctgattctcgggagtggagggctgtctatcgggcaagcaggggaattcgattattcaggatcacaggcagttaaggctatgaaagaagaaaatgtgaaaacagttcttatgaatccaaatatcgcttcagtgcagacaaatgaagtcgggctgaaacaggcagacacagtgtatttcctacctatcacaccacaatttgttacagaggtgataaaggctgaacagccagatggactgattctggggatgggggggcagacagcacttaactgcggggtcgaactgtttaagcggggggtgctgaaggaatatggagtgaaggtgttagggacttctgtagagtcaatcatggccacagaagaccgacagctgttctccgataagctgaacgaaatcaatgaaaaaatagccccatctttcgccgtggagtccatcgaagacgctcttaaagccgcggatacaatcggatatccagttatgatccgcagtgcttatgcactcggaggattagggtctggaatctgtccaaatcgagaaacacttatggacctgtctacaaaagcattcgcaatgacaaatcagatccttgttgagaagtctgtaactggatggaaagaaatcgaatatgaagtggttagggacgcagacgataactgcgttactgtgtgcaatatggaaaacgtcgatgcaatgggagtgcatacaggggattctgtggtagtcgccccagcccagacactgtctaatgctgaattccagatgcttcgaaggacatcaatcaatgttgtaagacacctagggatcgtcggagaatgtaacatacagttcgccctccatcccacaagtatggaatactgcatcatcgaggtgaatgcacggctttctcgctcttctgcactggcatccaaagctacagggtatccactggcattcatagcggccaaaatagcattgggaatacccctgcccgaaataaaaaatgtggtctcagggaaaacaagtgcctgctttgaaccttcactggattacatggtgacaaagattccacggtgggatctcgatcggttccatggaactagttctagaatagggtcttccatgaagtccgtcggggaagtaatggcaatcgggaggactttcgaagaatctttccagaaggcactacggatgtgtcacccatcgattgaggggtttactcctaggctccctatgaataaagagtggccctctaacttggatctgaggaaggaactatcggaaccctcatctacaaggatctacgctatagctaaagctatagacgataacatgtctctcgacgaaatcgagaaattaacatatatcgataaatggttcctttacaaaatgcgagatatactaaacatggaaaagactctcaagggattaaattcagaatctatgactgaagaaacactcaaaagagcaaaagaaatcggattttcagataaacagatatctaaatgtttagggctcacagaggctcagactcgggaacttaggctaaaaaaaaatatacacccctgggttaaacagattgatactctcgccgccgagtatccatctgtcactaattatctctatgtgacatataatgggcaggaacacgatgtgaactttgatgatcatggaatgatggtactggggtgtggaccttatcacataggatcttcagtcgaattcgattggtgtgctgtatcgagtatcagaacactacggcagctaggaaaaaaaacagttgttgtcaattgtaatcccgaaactgtatcaactgattttgatgagtgcgataagttatattttgaagaattgagtttagaacgaatactcgatatctatcatcaggaagcctgtgggggatgtatcatctccgtagggggacagatacccaataaccttgctgtgcccctctataaaaatggagttaagatcatggggacatctccactccagatagatcgagccgaggacagatctatcttttctgcagtgctggatgagctgaaagtagcccaggcaccctggaaggctgtgaacacacttaatgaagctctcgaattcgctaaatcagtcgactatccctgtctattgaggccctcttacgtactcagtgggtctgctatgaatgtggtcttctcggaagatgaaatgaagaaattcctggaggaagccacaagggtgtcacaggaacacccagttgttctcacaaaatttgtggaaggggcaagagaggttgaaatggatgccgtcgggaaagacgggagagtaatctcccacgcgatatccgaacatgtagaagatgcgggagtacactccggagatgcaacactgatgctgcccacacagacaataagtcagggggcaatagaaaaagtgaaagatgccacacggaaaatcgccaaagcctttgctatctcagggccatttaatgtccagtttctggtaaaagggaatgatgtgctagtcatagaatgtaatttaagggcttctcgatccttccccttcgtctctaagactttaggagtagatttcatcgatgtagccactaaggtgatgataggggaaaacgtggatgaaaaacatctccctacacttgatcatcccatcatacctgctgattacgtagcaatcaaggccccaatgtttagttggcccaggttgcgcgatgccgatccaatccttcgatgtgaaatggcgtctacaggggaggtcgcatgctttggagaggggatccacacagccttcctaaaagccatgctatctacggggtttaaaataccacagaaggggatactgattggaatccagcagtcgttcaggccccgatttttgggggtggccgaacagctgcataatgaggggtttaaactcttcgccactgaggctacatcagactggctcaatgccaacaatgtgcctgccactccagtagcctggccctcccaggaaggacagaacccttcactctccagtattaggaaactcatcagggatggatctatagatttagtgattaatctccccaataacaatacaaaatttgtgcacgataactacgtgataagacggacagcagttgattcagggataccacttttgactaacttccaggtaacaaaattatttgccgaagccgtacagaaatcgaggaaagtagattccaagtcgttattccactatcgacagtacagtgccggaaaagctgca

SEQ ID NO: 8125 - DNA, 4500 bp, Artificial Sequence
  Description of Artificial Sequence: Synthetic coding sequence
atgactagaatactgacagcgtttaaggtggtacgcaccctaaagactggattcggattcacaaatgtcacagctcaccagaaatggaagttcagcagaccaggtataagactactctcggtgaaggcacagacggcccacattgtgctggaagatgggactaagatgaagggatactctttcggccatccctccagcgtcgccggagaagtagtgttcaacaccggtctgggcggatatcctgaggccatcacagaccccgcctacaagggtcagatactgactatggccaatcccatcatcggaaatggaggagctcccgacaccactgcactcgacgaactaggtctgtccaagtaccttgagagtaacggtatcaaggtatctggtctgctggtcttagactattccaaagactacaaccattggttagctaccaagtccctcggacagtggctgcaggaggagaaagtgccggccatatacggcgtggatacgaggatgttaactaaaataattcgggataaggggactatgctggggaaaatcgaattcgagggccagcccgtagactttgtagatccgaacaagcagaatttaattgctgaggtatcgactaaggacgtaaaagtttacgggaagggtaaccccacaaaagtcgtggcagtggactgcggtattaagaacaatgtgattcgtctgctggtcaagaggggcgctgaggtgcacctcgtgccctggaaccacgatttcaccaaaatggagtacgacggaattctaattgcaggcggccctggcaaccccgctctagccgagcccttaatccagaatgtcaggaagatcctggagagcgacaggaaggaacctttgttcggcatatcaacagggaacctgatcactggcctggctgctggcgcaaagacttacaagatgtcgatggctaacagggggcagaaccagcccgtcctaaacattactaacaaacaggctttcatcaccgctcaaaatcatggctacgcattagataacaccctgccagcgggttggaagcctttatttgtgaacgttaatgatcagacgaacgaaggaatcatgcacgaatctaaacccttcttcgcggtgcagttccacccggaggttacgcctggaccaatagacaccgaatacctcttcgatagttttttttcactcataaagaagggaaaggcaacaactatcacctcagtgctgccaaagccagccctggtggcatcgagagtggaggtgagtaaggttctaatcctcgggtctggcggtctgtcaatcgggcaggccggtgagttcgactactccgggtcccaagccgttaaagccatgaaggaagagaacgtaaaaactgtcctcatgaacccaaacatagcgtctgttcagacgaatgaggtcggactcaaacaagcagacacagtttattttctgccaatcactccgcagttcgtaactgaagtgatcaaggccgagcagcccgatgggctaattctcgggatgggcgggcagactgccctgaattgtggagtggagctgttcaagagaggagtcctgaaagagtatggcgtgaaagtcttgggcacatcagtggagtccattatggccaccgaggaccgtcagctgttttccgacaaacttaatgaaataaatgaaaagatcgccccttcattcgccgtcgagagcatcgaagatgccttgaaggctgccgatacaatcggttaccctgtaatgatacggtctgcttatgctctaggcggcctgggttctggaatatgcccaaaccgagaaacactgatggacctgagcacgaaagcgtttgctatgacgaatcagatcctggtcgagaaatccgttactggatggaaggaaatcgagtacgaggttgtgcgtgacgctgatgataattgcgtaacggtatgtaacatggagaacgtggacgcaatgggcgtgcataccggagactcagtggtggtggcccccgctcaaaccctgagcaatgctgagttccagatgctgcgacgaacgtccatcaatgtggtcaggcatctcggaattgtcggggagtgcaacatccagttcgccctccacccgacaagtatggagtactgtatcattgaagtgaatgcccgtcttagcagaagcagcgccctggcctcaaaggcaactggctatcctctggcttttatcgctgctaagattgcccttggcatccccctgcccgaaatcaagaacgtggtgtctggtaaaaccagtgcctgctttgagcctagtttagactatatggtgaccaagattccaagatgggatctcgacaggtttcatggcacatcaagccggatcggctcctcaatgaagtccgtaggggaggtcatggcgatcggacggacctttgaggagagcttccagaaagcgctcagaatgtgccacccaagcattgaagggttcaccccacggctccccatgaataaggaatggccgtctaatctggatttgcgcaaagaactttccgaaccctctagcacacggatctacgctatcgccaaggccattgatgacaatatgtcacttgacgaaatagaaaagctgacatatatcgacaagtggttcctatacaaaatgcgggacattctcaatatggagaaaacccttaagggcctcaattctgaatcaatgacagaggagacgcttaagcgagcaaaagagatcggattttctgacaaacagatcagcaagtgtttgggactgaccgaagcacagacgagagaactgagattgaaaaaaaatattcacccctgggtgaagcagatcgataccttggcagcagagtaccccagtgtgaccaactatctgtatgttacctacaatggacaagagcacgacgttaactttgatgaccatgggatgatggtgttggggtgtggtccttatcacatcggcagcagtgtggaattcgactggtgcgcagtgtcgtccataaggaccttaaggcagctgggcaagaagacagttgtggttaactgtaaccctgaaacagtgtctacggatttcgacgagtgtgacaagctgtactttgaggaactctcgctggaaagaatcctcgatatttaccaccaggaggcatgtggaggctgcattatcagcgtgggcgggcagataccaaataacttagctgtccccctgtacaagaacggcgttaaaataatggggacttccccattgcaaattgaccgcgctgaggatcggtccatcttcagtgctgtactggatgagctcaaggtggctcaggccccttggaaggcggtgaatactttgaacgaagcactggagtttgctaagtctgtggactatccttgtctacttcgtccttcctatgtgctctccgggagtgcaatgaatgtcgtgttcagtgaggacgagatgaagaaattcctggaggaggccacccgggtgtcacaggagcatcctgtggtattgacgaagttcgtagagggcgcgcgagaggtggagatggacgcagtcgggaaggacgggcgggtaatatctcatgccattagtgaacacgttgaagacgctggagtgcactctggtgacgctactctcatgctcccaacacagacaatatcccagggtgctatagagaaagtcaaggacgctacacggaaaatcgccaaggcctttgccatatctgggccttttaacgtgcagtttttggtgaagggtaatgacgtcctggtcatcgaatgcaacctgcgggcttcgcggtcatttccctttgtgtccaagaccctgggagtggatttcatagacgtggcgaccaaggtaatgatcggagaaaatgtggacgagaagcatctgcccacattggatcaccccattatccccgctgactacgtggcaattaaagcccctatgttcagttggccacgcctgcgcgatgcagatccaatcctccggtgcgaaatggcttctacaggtgaggtagcatgctttggggagggaatccacaccgcatttctcaaggctatgctgtcgaccgggtttaaaatcccacaaaaaggtatcctgatcgggatccagcaatcgtttaggcctcggtttctgggggtcgctgagcagctccataatgaaggtttcaaattatttgcgacggaagccacatcggactggttaaatgctaataacgtacccgccacacccgttgcgtggccaagccaggagggtcagaacccctctctgtcgtcgatacgtaaactcattagagacgggtccatcgacttggtcatcaacttaccaaataataataccaaattcgtgcatgacaattacgtgattaggcggactgctgtagattcgggtatcccccttctaacaaattttcaggtcacaaagctgttcgcagaagctgtgcagaagagccgcaaggtggattccaagtccctgtttcattacaggcagtactctgcgggtaaggcggca

SEQ ID NO: 8126 - DNA, 4500 bp, Artificial Sequence
  Description of Artificial Sequence: Synthetic coding sequence
atgaccagaattctgacggccttcaaagtagtgcggacactcaagactggatttggcttcactaatgtcacagcccaccaaaaatggaagttctccaggccggggatcagacttctatctgtcaaggctcagaccgcccacattgtattggaagatggcacaaaaatgaaaggttactccttcgggcatcccagctctgtggccggcgaggtcgtcttcaacactggcctgggtggctatcctgaggcaattaccgacccggcgtataagggacagattctgacaatggcaaaccccatcattggtaacggaggcgctcctgataccaccgccttagatgagctgggcctgtcgaaatatctggaatcaaacggaattaaggtgagcggtcttcttgtcctggactactctaaggactataaccactggctggcaactaagtccctgggtcagtggttgcaggaagagaaggtgcccgccatctatggtgtggatactcgaatgctaacgaaaatcattcgagataagggtactatgctcggaaagatcgaattcgaggggcagcccgtcgacttcgtggatcctaacaaacagaacctgatcgctgaagtctctacaaaggacgtgaaggtgtacgggaagggcaaccccactaaggtcgtcgccgtggactgcgggatcaagaacaatgttataagacttttggtcaaacggggagctgaggtccacctcgtcccttggaatcatgactttactaaaatggaatatgacggcatcctgatcgccggcggacctggcaatcctgcccttgccgagcccctaatccagaacgtgagaaagatcctggaatccgaccgaaaggaaccactcttcggtataagtactgggaacctcataaccggcctcgctgccggtgcaaagacctataagatgtccatggcaaatcgagggcagaatcagcccgtgcttaacatcaccaacaaacaggctttcataactgctcagaatcatggctacgccctggacaacacgttgccagcaggctggaagcccctgtttgtcaatgtaaacgatcaaacaaatgaaggcatcatgcatgagtcgaagccattctttgctgtacagtttcaccctgaagttacacccggcccaatagatactgaatatctttttgactcttttttctctctcatcaagaaaggaaaagccacgaccatcacaagcgtccttcccaaacctgcgctggtggcctctagggtggaagtttcaaaggtgttgatcttaggctccggcgggctatcgatcggacaagccggtgaatttgactactctgggagtcaggcagtgaaggcaatgaaggaggagaacgtcaagacagtcctaatgaaccccaacattgcctccgtccaaaccaacgaagtgggcctgaaacaggccgatactgtctatttcctcccaataacccctcagttcgtgacggaagtcatcaaggctgagcagcctgatgggcttatattggggatggggggccagacggccctaaactgcggcgtcgaactgtttaaaagaggcgttttgaaggagtatggagttaaggtcctggggacctctgtcgaatcgattatggccactgaagaccgccagctgttttccgataagctgaatgagataaatgagaaaatcgctccctccttcgccgttgagtcaatcgaggacgctctcaaagccgccgatactatagggtacccggtgatgataagatctgcttacgcccttgggggcctgggctctggcatttgccccaatagggaaactcttatggacctgtccacgaaggcatttgcaatgaccaatcaaatcctggtggagaagtctgttaccggatggaaggaaattgagtatgaagtggttagggacgccgacgacaattgcgtgacggtgtgcaatatggagaatgtagatgccatgggtgtccatactggcgattcagtggtggtcgcccccgctcagaccctgtccaacgccgagttccaaatgcttaggaggactagcatcaatgtcgtacgacacctgggaatcgtgggtgaatgcaacattcagttcgctctccaccccacaagcatggagtattgcattattgaggtgaacgcaagactgagcaggtcatccgctctagcaagtaaggccactgggtatcccttggctttcatcgcggctaaaattgctctcggcattccccttcctgagattaaaaatgtggtgtccggtaagacgtccgcctgttttgaaccttcactggactacatggttaccaagatccctcgatgggatctggaccgttttcacgggacgagctccagaattggctcgagcatgaaaagcgtgggagaggtgatggccattggccgaacctttgaggagtcttttcagaaagcacttcgaatgtgtcacccctcaatcgaaggctttacccccagactgcccatgaataaggagtggcctagtaaccttgacctgagaaaggagctctccgaaccatcctcgacccgcatatatgctattgccaaggccatagatgacaatatgtcgctggatgagatcgaaaaacttacttatatcgataaatggttcctctacaaaatgagggacatactcaacatggagaagaccctgaagggcctgaacagcgaaagcatgacggaagaaacactgaagcgagcaaaggaaatcggattctccgacaagcaaatctcgaaatgcctgggcctcacagaagcccagacgagggagctccgactgaagaagaatattcatccgtgggtgaaacagattgacactctggccgcagagtacccctcagtgacaaactatttgtatgtgacctataacggtcaggagcacgacgtgaattttgacgatcatggtatgatggtattgggctgcgggccttatcacattggcagttccgtagaattcgactggtgcgccgtgagctcaattcgaactctccgacagctgggaaagaagactgtcgtcgttaattgcaaccccgagaccgtatccaccgattttgacgaatgcgacaaactgtattttgaggaactcagtctggagagaattctcgacatttaccatcaggaggcctgcgggggctgcatcatttccgtaggaggccagattcccaacaacttggctgttcctttatacaagaacggggtgaaaatcatggggacttcccccttgcagatagatcgtgccgaggaccgatcaatcttcagcgctgttttggatgagttgaaggttgcgcaggcgccatggaaggcagtgaacaccctcaatgaggcactggagtttgccaaatccgtcgactacccatgcctgctgaggccatcctacgttctgtctggaagcgcgatgaacgtggtttttagcgaggacgagatgaaaaagttcctcgaggaggcaacaagagtgtcacaagagcacccagtcgttcttacaaagtttgtcgagggagcgagagaagtcgagatggacgccgtggggaaagacggtagggtgatttcgcacgccatttctgagcacgttgaggacgcaggagtgcacagtggtgacgcaacactcatgctgccaacacagactatctcccagggcgcaatcgaaaaggttaaagacgcaacccgcaaaatcgcaaaggcattcgctatctccggaccctttaatgttcagttccttgtgaagggaaatgacgtgctggtgatcgaatgcaacctcagagcttctaggtcctttccttttgtgtccaaaacactcggagtcgattttatcgacgtggccacaaaggtgatgatcggggaaaacgttgatgaaaaacacctgccaacccttgatcatccgataataccagcggactacgttgctattaaggccccaatgttctcttggccgagactaagggacgcggatcctattttgagatgcgagatggcttcaacaggagaagtggcctgcttcggtgaaggcatacatactgctttcttaaaggccatgttgtccacaggcttcaagatcccacagaagggcatcctgattgggatacaacaatcttttagacctaggttccttggcgtggcagagcaactacacaatgaagggttcaagctctttgcaaccgaggctacaagcgactggttgaatgcaaacaacgtaccagccaccccagtggcgtggcctagccaggaagggcagaacccaagtctgtccagcataagaaagctaattcgcgacggaagcattgatctggtaattaatctgccaaacaataacactaaatttgtgcacgataactacgtgatacgacgaaccgcagttgacagcggcatccccttgttgaccaacttccaggtgactaaactgtttgccgaggccgtgcagaaatcacgaaaggtggatagtaaatcactgttccattacagacaatatagcgccggtaaggccgca

SEQ ID NO: 8127 - DNA, 4500 bp, Artificial Sequence
  Description of Artificial Sequence: Synthetic coding sequence
atgaccaggatcctgacagcttttaaggtcgtgaggacactgaagaccgggttcgggtttacgaatgttacagcccatcagaagtggaagttcagtaggcctggaataagacttctctctgtgaaagcgcagactgctcacatcgtacttgaggatggaacgaagatgaaaggttattccttcggccatccaagcagcgttgcgggggaggtagtgttcaacaccggcctggggggctacccggaggcaattaccgatccagcctataagggacagattttgacaatggccaaccccattattggaaacggcggcgcccctgataccaccgctctggacgagttgggtctgtccaagtatctggaatccaatggcataaaagtaagcggattgctcgttcttgactacagtaaggattacaaccactggctggccacaaagagtctgggccagtggctgcaagaggagaaagtacctgcaatctacggggtggacacaagaatgttgacgaagattattcgcgacaagggaacgatgctcggcaaaatcgaatttgaaggccagcccgtcgatttcgtggacccaaacaagcagaacctgatcgccgaggtttcaacaaaagatgtaaaggtgtacggcaaaggtaaccctaccaaggtcgtcgctgtggactgcgggatcaaaaacaacgttataaggctgctggtgaagagaggtgccgaagtgcacctcgtgccttggaaccatgattttactaaaatggagtacgatggtattctcattgcagggggtccaggcaacccagcattggccgaacctctgatacaaaatgtacgcaagatactcgaaagcgaccggaaagagcccttgttcggaatctctactggaaaccttattacaggcctcgccgcaggcgcaaaaacttataagatgagtatggccaacaggggacagaatcagcctgtgttgaatattacaaataagcaggcctttatcacagcgcagaaccacggctacgctctggacaacacactccctgcgggatggaagcctcttttcgtgaacgtaaatgaccagacaaatgagggtattatgcacgaatctaagccctttttcgctgttcagttccatcctgaggtgactcctggtccaattgatacggaatacctgttcgattcattcttttcacttatcaagaagggaaaagccacgacgatcacctcagttttgccaaagcctgccctggtcgcatctagagttgaggtctctaaagtcttgatcctgggctctggcggactctctatcggtcaagcgggcgaattcgactatagcggctcccaggccgttaaggccatgaaggaggagaatgtgaaaaccgttctgatgaaccctaacattgcaagcgtacaaacaaacgaggtgggccttaagcaagcagacaccgtgtacttcctcccaataacacctcagttcgtgactgaggttatcaaagccgaacagcccgacggcctgattttgggtatgggcgggcagaccgcactgaactgcggcgtggaactctttaaacgaggggtgcttaaagaatatggggtgaaagtcctgggtaccagcgtagagagtattatggccaccgaggatcgccagctgttcagcgacaagctgaatgaaattaacgagaaaatcgccccttcctttgctgtagagagcatcgaggacgctttgaaagctgcagacacaattgggtatcccgtgatgattcgatccgcctacgcacttggaggccttggatctggaatctgccctaaccgcgagactctcatggacctgagtaccaaggcgtttgcaatgactaatcaaatcctggtggaaaagtccgtcaccggatggaaggagattgagtatgaggtcgtcagagatgccgacgataactgtgtgactgtctgtaatatggaaaacgtcgacgcaatgggagtccataccggcgattctgtggttgttgcgccagcccaaacgttgagcaacgctgagttccaaatgctgagacgcacatcaattaacgtggtgcgccacctggggatcgtgggggagtgtaatatacaattcgctttgcatcctacgagtatggagtattgtattatcgaggtcaacgctagactttcccggtcatctgctctggcatctaaggctaccgggtatcctttggcttttatcgccgctaagatagcactcggcatccctctgcctgagataaagaatgtggtgagcggcaaaacttctgcatgcttcgagccttccctggactatatggtgactaagattcctagatgggatttggatagatttcatggcaccagcagtcgcatcggatcctccatgaagtcagtcggcgaggtgatggccatagggcgaacgttcgaggaatcctttcaaaaggccttgcggatgtgtcacccttctatcgaagggtttacaccccgacttcccatgaacaaagagtggcccagtaatcttgacctgcgcaaggaactgagcgaaccctccagcacgcgaatctacgctattgccaaagccattgacgacaacatgagccttgatgagatcgagaagctgacttatatcgataaatggtttctctacaaaatgagagatatattgaatatggaaaagaccctgaaggggctgaattccgagtccatgaccgaggaaacactcaagcgcgccaaagagattgggttctcagataagcagatatccaagtgtttggggctcaccgaagcccagacaagggagctgagactgaagaagaacattcacccctgggtgaagcaaatcgataccctcgccgccgagtacccttcagtgaccaattacttgtacgtgacatataacgggcaggagcatgatgttaactttgatgatcatgggatgatggtgctgggctgtgggccctaccatatcgggtctagtgtggagttcgactggtgtgcagtttctagtatcaggactcttcgacagctggggaaaaagaccgtcgtcgtaaactgcaaccctgagaccgttagcactgactttgatgaatgcgacaagttgtacttcgaagagctgtctcttgagagaatccttgacatataccaccaggaagcctgcggaggatgtatcatctctgtaggcggtcagataccaaataacctcgccgtgcccctctataaaaatggggtgaagatcatgggcacaagtccattgcagatcgatcgggcagaggataggtccatattctcagcagtgctggacgagcttaaggtggcccaagccccctggaaggcagtcaacacacttaatgaggccctcgagttcgctaagagcgtggattatccctgtctgctcaggccaagttacgttctgagcggatcagctatgaatgttgtcttctcagaggatgagatgaaaaagttcctggaagaggcgactcgcgtgtcccaggagcaccccgtagtgctgacaaaatttgttgagggcgcccgagaagtcgaaatggacgccgtcggcaaggatggtcgcgttatttctcatgccatatctgaacacgtggaagacgcaggcgttcatagtggggacgctacattgatgttgcccacgcagaccatttctcagggtgccatcgagaaagtgaaggatgcaacccgcaagattgcgaaggctttcgccatttcagggccttttaacgtgcagtttcttgtcaagggaaatgacgtgctcgtcatcgagtgcaatctgcgagcatccaggtcctttccattcgtgagtaagacacttggagtcgatttcatagacgtcgctactaaggtgatgattggcgaaaacgtggatgaaaagcacttgccaacactcgatcacccaattatacccgccgattacgtagccattaaagcacctatgtttagttggcccagactgagagacgctgaccccatcctgcgatgtgagatggcttccacgggggaggtagcctgtttcggagagggcattcatactgccttcctcaaagccatgctctcaaccggcttcaagatcccacagaagggtattctgataggcattcagcagagtttccggcccagatttcttggggtcgcggagcagttgcacaatgaggggtttaagctgtttgctacggaggcaacgtctgattggctgaacgccaataatgtgcctgcgacaccagtggcttggccctcccaggaggggcagaatccaagcctctccagtatcaggaagctgatacgcgatggctccattgacttggtgattaatctgcccaacaataacacgaaatttgtccatgacaactacgtgatcagaaggactgctgtggacagcggtatccctctcctgaccaattttcaggtaaccaagctttttgccgaagcagttcaaaaatctaggaaagtagacagcaagagtctgtttcattatagacaatatagcgcaggcaaggcagct

SEQ ID NO: 8128 - DNA, 4500 bp, Artificial Sequence
  Description of Artificial Sequence: Synthetic coding sequence
atgacgcgcatcctgacagcatttaaggtggtgaggactttgaagacaggatttggattcacgaacgtgactgcccatcagaaatggaagttctccaggcctggaatcaggctcctctccgttaaggctcaaacagcacatatagttttggaggatgggactaagatgaagggctacagcttcgggcatccgtcttccgttgcaggggaggtggtgttcaatacaggcctgggagggtaccccgaggcaataacagatccagcatacaaaggtcaaattttaacaatggctaacccgataataggcaatggaggcgctcccgatacaacggccttggatgagctgggcctgtctaaatatttggagtctaacggcataaaggtgagcggacttctcgtcctagactactcgaaagactacaatcattggttggccactaagtcactggggcagtggctacaggaagagaaggtgcctgccatatatggcgtggatacacgaatgctaactaagattatccgagacaagggcacaatgctgggaaagattgagttcgaagggcagcccgtggatttcgtcgatcctaacaagcagaacctgatcgcggaggtgagtaccaaagatgtaaaggtatatggtaagggtaacccaacgaaagtggtggccgtggactgtggtatcaagaataacgtgattaggcttttggtcaagaggggagccgaggttcatcttgttccctggaatcacgactttaccaagatggaatacgacgggattttgattgccgggggccccggaaatcctgccttggctgagccactgatccaaaacgtgcggaagatattggagagcgacaggaaggaacccttattcgggatatcaaccgggaatctaatcactggactcgccgctggggctaaaacctacaagatgtccatggccaaccgcggacagaaccagccggtgctcaatattactaacaagcaggcattcatcaccgctcagaatcacggatacgccctggataatacgctgcctgcaggctggaagcccttattcgtgaatgttaacgaccagactaacgagggcattatgcacgagagcaagccattcttcgcagtgcaattccatccagaagtaacacctggccccatcgacacagagtatcttttcgactccttcttttcattaatcaaaaaaggtaaagccaccaccataacgtcggtgctacccaaacccgccctggtggcctctcgagtggaagtttctaaggtcctgatccttggttctggcgggctttccatcggccaagcaggagaattcgattattcggggtcacaggcagtgaaagccatgaaggaggaaaatgtaaagacagtcctgatgaacccaaacattgcaagcgtgcagacgaatgaggtcgggctcaagcaggcggatacagtttattttctgcccatcactccacagttcgtgactgaggtaataaaagccgaacagcctgatgggttaattctggggatgggaggtcagactgctctgaattgtggggtcgaactgttcaagcgaggcgtccttaaagagtacggcgtgaaagttctcggtacaagtgttgaaagtattatggccacagaggatcgacagctcttcagcgacaaactgaatgagatcaatgagaaaatcgcgcccagttttgccgtagagtctatcgaggatgctctcaaagcggctgacacaatcgggtatcccgtgatgatccgatcggcctatgcccttggcggtctgggctctgggatctgtcccaatcgggagaccctgatggacttatctacaaaggcgtttgccatgaccaaccagatcctggtggaaaaatcggtaacaggctggaaagaaatcgagtacgaggttgtgcgggacgccgatgacaattgtgtgacggtctgtaatatggagaacgtagatgccatgggagtccataccggagacagcgtggtggtggccccagctcagacactgagtaacgccgaatttcagatgttacgccggacctcaataaatgtcgttcgccatttgggtattgtcggggagtgcaacatccaattcgcacttcacccaaccagcatggagtattgcatcatcgaggtcaacgccaggctgtcacggtcgtctgctctagcgtcgaaggccaccggatacccactggctttcattgctgcaaagattgcactgggaatccccttgcctgagatcaagaacgtggtgagcggcaagacaagcgcttgctttgaaccatcgctggactacatggttacaaaaattccacgatgggacttagacaggtttcacgggacctccagtcgaataggctcctctatgaagtcggtcggagaagttatggccatcgggcgtacctttgaagagagctttcagaaggctctacgaatgtgtcaccctagtattgagggtttcaccccccggttaccaatgaataaagaatggccaagcaatctcgacctccggaaggaactgagcgagccctcaagcactagaatttacgccatcgccaaagcaatcgacgataatatgagtttggatgagatcgagaaactgacgtacattgacaagtggttcctctacaagatgcgcgacatactcaatatggagaaaacgctcaagggtttgaactccgaatccatgactgaggagaccctgaaacgagctaaggagatcgggttcagtgataaacagatctccaaatgtctcgggctgactgaagcacagacaagggaattaagattgaagaagaatattcacccttgggtgaagcagattgacaccttagcggcagagtacccttctgtgactaactatctatatgtgacatataacgggcaggaacatgacgtgaattttgatgaccatgggatgatggtcctcgggtgtggtccctatcacatcggaagtagtgtggaatttgattggtgtgcagtatcatctatccgcactttgcgccagctgggaaagaagacggtggtcgtcaattgcaaccccgagaccgtgagcacagactttgacgaatgtgataagttgtacttcgaggagctctcgctggagagaatcttggacatctatcaccaagaggcctgcggcggctgcattatcagcgtaggcggccaaattccgaacaacctagctgtccccctgtataaaaatggagtgaaaatcatggggacaagtccccttcaaattgaccgcgctgaggatcggtcgatcttcagcgcagttctcgatgagctgaaagtcgcacaagcaccgtggaaggcggttaatacactcaacgaggccctggagttcgccaaaagtgtggattacccctgcttgctgagaccctcctatgtgctgtcaggctctgcgatgaatgtcgtgtttagtgaggatgagatgaagaaatttctggaggaggcgacccgggtctcccaggagcatcctgtggtactaaccaagtttgtcgagggagcaagggaggtggagatggatgctgtgggcaaggacggccgagtgatctctcacgccatcagtgagcacgtggaggatgcaggggtgcacagtggtgatgcaaccctcatgcttcctacccagactatttcacagggtgctattgaaaaagtcaaggacgccacgaggaaaattgcgaaagccttcgcaatctccggcccgttcaacgtgcagttcctagtaaagggcaacgacgtcctcgtgatcgagtgcaacttgagggcatcacggagtttccccttcgtcagcaagaccctgggagtggattttattgatgtggccaccaaagtcatgattggcgaaaacgttgatgaaaaacacctcccgacgttagatcacccgataatccctgctgattacgtcgctataaaggcaccaatgttcagctggccacggttgagagatgcagacccgatccttagatgtgagatggccagcaccggcgaggtggcttgcttcggagaaggcatccataccgcgtttctcaaagcaatgctcagtacaggtttcaagataccccagaagggcatcctgattggtatccagcagtctttccgaccacgcttcctgggcgtggccgaacaactgcacaacgagggctttaagctgttcgcaaccgaagcaacatcagattggctaaatgcgaacaacgtcccagctaccccagtggcatggccgagtcaggagggacagaacccctccttgtcctctattaggaaacttatccgagatggcagcatcgacctagtgataaacctgcctaacaataacacaaaatttgtccacgacaattacgttatccgtcggaccgcagtagacagtggaatcccgctacttactaattttcaggttacgaaattattcgccgaagcagtccagaagagtcgcaaggtcgactctaagtctctgttccattatcggcagtactcagccgggaaggccgca

SEQ ID NO: 8129 - DNA, 4500 bp, Artificial Sequence
  Description of Artificial Sequence: Synthetic coding sequence
atgactcgcatattaactgctttcaaggtggtgagaacactcaaaacaggattcggatttaccaatgttacagctcatcaaaaatggaagttcagtagaccaggaataaggctgctctctgtgaaggctcagacagcacacatagtgctcgaggacgggacgaaaatgaagggttattcttttggccacccttcttctgtggctggtgaggttgtattcaacacaggcctcggaggctacccagaggcgattactgatccagcttataagggccagattctaaccatggctaaccctatcataggaaatggcggcgctccggacacaaccgcactggacgagctcggacttagcaagtacctcgagtctaatggaataaaagtgtcagggttgcttgtgctcgactacagcaaggattacaatcattggctggcaacaaaaagcctgggccagtggttgcaggaagaaaaggtccccgcgatctatggagtggatacccgcatgctgaccaaaatcatccgggacaaaggcactatgctggggaaaatcgagtttgagggacagcctgtggactttgttgaccccaataaacagaacctcatagccgaagtgagcacaaaggacgtgaaagtttatggaaaagggaacccgacaaaagtggtggcggtggattgcggaatcaaaaataacgtgattaggctgctggtgaagagaggggctgaggtgcacctggtcccctggaatcacgacttcactaagatggagtacgatggaattttaatcgccggggggccgggaaacccagcactggctgaacccctgatacaaaacgtcaggaagatactcgaatccgatagaaaagaaccactcttcggcatctctacagggaaccttatcaccggcctggccgccggagctaagacctacaaaatgtcgatggctaaccgcggtcagaaccagcccgtgctgaacatcaccaacaagcaggcttttatcacagctcagaaccacggatatgccctggataataccctgcctgccggatggaaacctctgttcgtgaatgttaacgaccagacaaatgaggggatcatgcatgaaagtaaaccttttttcgccgtccaatttcaccccgaagtgacaccgggacctatagatactgagtacctgttcgactcattcttctcccttattaagaaaggcaaagctaccacaattactagtgttctgcccaagcctgcactggtggcgagccgggttgaggtcagcaaagtgttgattttgggctctggcggtctgtctattgggcaagctggagaatttgactacagtggctctcaggcagtgaaagccatgaaggaggaaaacgtgaagactgtgctgatgaacccgaacattgcaagcgtacaaactaacgaggtgggccttaagcaggcagatactgtatatttcctgcctatcacaccgcagtttgtgacagaggtcataaaagcagaacagccggatggccttatcctggggatgggtgggcagacagcgctgaactgtggtgttgaactcttcaaaagaggagtgctcaaagaatacggggttaaagtgctcggtacctccgtggaatctatcatggcaacagaagatagacaactttttagcgataagcttaatgagatcaacgagaaaatcgccccatcttttgctgttgagtctatcgaggacgcactgaaagctgctgacacaattggctatcccgtgatgatccgcagtgcctacgccctgggcggactgggcagcggcatttgtccaaatcgtgaaactctaatggacctatccactaaagcttttgccatgacgaatcaaatcctagtggagaagagtgtcaccggatggaaggagattgagtacgaggtcgtcagagatgccgatgataactgcgtcaccgtatgcaatatggaaaacgtcgacgcaatgggcgtccatacaggcgatagtgtagttgtagcacccgcccaaacactgagcaacgctgaattccaaatgcttagaaggacaagtatcaatgttgtgcggcacttgggaatcgttggagagtgtaacatacaatttgccctccaccctacttcaatggagtactgtataatcgaggtgaacgccagactgagtcgcagctctgccttagcaagcaaggccacaggctaccctctggcatttatcgctgccaaaatcgctctgggaatccctctgcctgaaattaaaaacgtggtgagtgggaaaaccagcgcttgctttgaaccatcactggattatatggtcactaaaattccaaggtgggacctcgacagatttcacggaacttcgtctcggatcggctcctcaatgaagagtgtgggagaggtcatggccatcggcaggaccttcgaagagtcatttcagaaggcactgaggatgtgccatccaagcattgaaggatttacacccaggttacccatgaacaaggagtggcctagcaatctggacctgagaaaggagcttagcgagcccagttccacccggatctacgctattgcgaaggccatcgatgataacatgagcctcgatgagatagagaagctgacatatatcgataagtggttcttgtacaagatgcgggacattttgaacatggagaaaacccttaagggattaaacagcgaatctatgactgaggagaccctgaagcgagccaaggaaattggattcagcgacaagcagatctccaaatgcttgggccttaccgaggcccagactagagagctacgccttaagaagaacattcacccttgggtcaaacagatcgacaccctcgctgccgagtacccgagcgtcacaaactacctgtacgtgacctataacgggcaggaacacgatgttaactttgatgaccatggcatgatggtgttggggtgcggcccctatcacatcggaagcagcgttgaatttgactggtgcgctgtttcaagcattcgcactttgcggcagctcggaaagaagacagtagttgtaaactgcaaccccgagaccgtctctacggacttcgacgaatgcgacaaactttacttcgaagaactgagtctcgagaggattctggatatttatcaccaagaagcctgcggaggctgcataatatccgtgggtggacagataccgaacaacctggctgtgccactgtacaaaaatggggttaagatcatgggcacctcaccactgcaaattgatagagcggaagacaggagcatcttttcagccgtccttgacgagctgaaggtcgcccaagcaccctggaaagctgtgaatacacttaacgaggctttagagtttgctaaatctgtcgattacccctgtcttctgagaccttcttacgtgctgtctggatccgcaatgaacgtggtgttcagcgaagacgaaatgaagaaatttttggaggaggcaacacgggtctcacaagagcaccctgttgtcctgacaaaattcgtagaaggcgcaagggaagtcgagatggatgccgtgggcaaggatggaagagtgatcagtcatgccatttccgaacacgtcgaggatgccggagtgcactcaggggacgcaactctcatgctgcctacccagacaatttctcagggggcaatcgaaaaggtgaaagacgccacgagaaagatcgctaaagccttcgctatctccggtccctttaacgtgcagttcttggtaaagggaaatgacgtcctggtgatcgagtgcaatctgcgcgcaagccgttcttttccctttgtaagcaagactttgggcgtggatttcatcgacgtcgctactaaggtcatgatcggagagaatgtggacgagaagcaccttcccaccctcgaccatcccatcatcccagccgactacgtcgctataaaggcgcctatgttttcctggccaaggctccgggatgctgatcccatcttgagatgcgaaatggcaagcaccggcgaagtggcttgctttggcgagggcattcacacggcattcctgaaggctatgcttagcaccgggtttaagatcccccagaagggaatcctgattggcatccagcaatcctttagacccagattcctgggcgttgccgaacaactccataatgaggggtttaaactattcgccactgaggccacaagcgattggctgaatgcaaacaatgtcccagctaccccagtcgcatggcctagccaggagggacaaaacccatctctgagttcaatcaggaaattgattagggatggaagcattgacctggtcatcaaccttcccaacaataacacaaaatttgtgcatgataactacgtgataagaaggactgcagttgactccggtattccactgctgaccaactttcaggtgaccaaactttttgccgaggcggtgcaaaagtctcgtaaagtggattccaagagcctctttcattatcgtcagtattcagctggaaaagctgca

SEQ ID NO: 8130 - DNA, 4500 bp, Artificial Sequence
  Description of Artificial Sequence: Synthetic coding sequence
atgacaagaattttgaccgcctttaaggtcgtgagaaccttaaagacaggctttggctttacaaacgtgaccgctcatcagaaatggaagttcagtcgacccgggattcgcctgctatctgttaaggcccagactgcacatatcgtcctcgaggatggcacaaaaatgaaaggctattccttcggtcatccttcctctgtcgccggagaggtggtgttcaatacagggctgggggggtatcccgaggccattacagatcctgcatacaaaggccaaatcctgaccatggccaaccctattatcggtaatgggggcgccccggatactactgccttggatgagcttggcctcagtaaatacttagagagcaacgggattaaggtgtcagggctgctcgttctggactattccaaggactataatcattggctagctaccaaaagcctggggcagtggttgcaggaggaaaaagtgccagccatctatggcgtggatacgaggatgctcaccaaaattatccgggacaagggtactatgctcggcaaaattgaattcgagggccaaccagtggactttgtagatcccaacaaacagaatctgatcgcagaggtgtcaacgaaggatgtgaaagtttatgggaagggaaacccaacaaaggttgtggcagtcgactgtgggatcaagaataacgtcatcagactgcttgtgaaaaggggtgccgaggtgcaccttgtgccgtggaatcatgattttactaagatggaatatgatggcatactaattgccgggggcccaggcaaccccgctctggccgagcccctcatacagaatgtgcggaagattctggagagcgataggaaagagcctttgtttggaattagcacaggcaacctgatcacaggactcgcagctggagctaaaacttacaagatgtccatggctaaccgtggacaaaaccagcctgtcttgaacataacaaacaaacaggcctttatcactgctcagaatcacggctatgctttggacaacacactgcccgctggatggaagcccctgtttgtgaacgtcaacgaccagactaatgagggtataatgcacgagtctaagcccttcttcgctgtgcaatttcatcccgaggttacacctggaccaatcgatacggagtatctgttcgactcattctttagcctcattaagaagggcaaggcaactaccatcacttcggtactgccaaagccagcacttgtcgcaagccgggtcgaggtgtctaaagtgttgatcctgggtagtggcggcttgtccatcggacaggctggcgaattcgattacagtggctctcaggccgttaaggctatgaaagaggaaaatgtgaagacagtgctgatgaatcccaatatcgcttccgtccagacaaatgaggtgggccttaagcaggccgacaccgtctacttcctccctattacaccacaatttgttactgaagtgattaaggccgaacaaccagatgggctgatacttggaatgggtgggcaaactgcattgaactgtggcgtggagctctttaagcgaggagttttgaaggaatatggggtcaaagtgctcggcacaagcgtcgagagtattatggccactgaggaccggcagctgttcagcgataagttgaacgagatcaatgagaaaatagccccttcgttcgccgttgagtccatcgaggacgccctgaaggctgcagacaccatcggctatcctgtgatgattaggtccgcatacgcactcgggggcttgggatctggtatctgcccgaatcgggagacactgatggacttgtccaccaaggctttcgccatgaccaatcaaattctcgttgagaaatctgtgacagggtggaaggagattgagtatgaagtcgtgagagacgcagacgataactgcgtaactgtgtgcaatatggaaaatgtggatgcgatgggggtacacacaggtgattccgtcgtggtggctccggcccagacgctgagcaatgccgagtttcagatgctgcggcggaccagcattaacgtcgtgcgccatctcggaattgtgggagagtgtaatatccagttcgctttgcatcccaccagcatggagtattgtatcatagaggtgaacgcccgcttgtctaggtccagcgctctggcctcaaaggcgactggttacccacttgccttcatagctgccaagatcgcgttgggaataccactgccagagatcaaaaatgtggtttccggaaaaaccagcgcctgtttcgagcctagtctcgattatatggttactaaaatccctagatgggaccttgatcgcttccacggcaccagtagcaggatcggctccagcatgaagagcgtcggagaggtcatggctattggtcggaccttcgaggagagttttcagaaggcgcttcggatgtgccacccctccattgaaggtttcacaccaaggctgccgatgaataaggagtggccgtcgaacttggacttgcgaaaagagttatcagaaccttcctctacacggatctatgccattgcaaaggctatagacgacaatatgtccctcgacgagatagagaagcttacttatatcgataaatggttcctctacaaaatgcgagatatcttgaatatggagaagaccctgaaaggactcaacagcgagtcgatgaccgaggagaccctaaagagggctaaagaaattggcttttcagataagcagatctctaaatgtttaggcttaacagaggcacagacacgggagctgcgtctcaagaaaaacatccatccctgggtcaaacagattgacacgctcgcagcggaatatccctccgtgacaaactacctgtacgtgacctataatggacaggaacatgatgtcaactttgacgaccatggtatgatggtactgggctgtggaccctaccacattggttcctctgtcgagttcgattggtgtgctgtttccagcattcggacactgcgacagttaggtaagaaaactgtggtggtgaactgcaatccagagacagtgtcaactgatttcgacgagtgcgataagttgtacttcgaggagctgagtttggagagaattctcgatatttatcatcaagaagcctgtggcggttgcattatatccgtgggcggccagattcctaacaatctggctgttccgctgtataagaatggggttaagatcatgggaacatccccgctccagatagatcgcgcagaagatagaagtattttttctgctgtgctggacgagctgaaagtcgctcaggctccctggaaggctgtcaatacgctcaatgaggccttggagtttgccaagagcgttgactacccctgtctgctgcggccaagctatgtccttagcggtagcgccatgaacgttgtattctctgaggatgaaatgaaaaaatttctggaggaggcaacacgagtatcacaggagcacccggtcgtgctgacgaaattcgtagagggcgcaagggaggtcgagatggatgctgtgggcaaagacgggagggtgatttcccacgccatctccgagcatgtagaggacgccggtgtgcattccggcgatgccactctcatgttgcctactcaaaccatctctcagggcgccatcgagaaagtgaaggacgctacgcggaaaatagcgaaggcctttgcgatttcaggtccattcaatgtgcagttcttagttaaagggaacgatgtgttagtaatcgagtgtaatcttagagcctccaggtcctttcccttcgttagtaaaactttaggagtggacttcatagacgtagctaccaaggtgatgataggcgagaacgtagatgaaaagcatctgccgaccctagatcatcctatcatacccgccgattacgtggccatcaaggcccccatgttttcatggcccaggttgcgcgacgcagacccaatcttgcggtgtgagatggccagcaccggagaggtcgcgtgtttcggcgaaggaatccacactgccttcctgaaggcaatgctaagcacaggttttaaaattcctcagaaaggtatcctaattggaattcagcagagttttagaccaagatttctcggagtggcagaacagctacacaacgaagggtttaagctttttgccacggaagccacctcggattggttaaatgccaacaacgttcccgctacccctgtggcttggccaagccaggagggccaaaacccttcattgtcgagcattaggaagctgattagggatggctcaattgatttggtgatcaacctgcccaacaacaacaccaagtttgtgcatgacaattatgttattagacgtaccgcagtcgactcaggaataccacttctcacaaattttcaggtcaccaagctcttcgccgaggcagtgcaaaagtcacgtaaggtggatagtaagtcactgtttcattaccggcagtacagcgctggaaaggccgct

SEQ ID NO: 8131 - DNA, 4500 bp, Artificial Sequence
  Description of Artificial Sequence: Synthetic coding sequence
atgacccgaatcctcaccgcattcaaggtcgtgcggactctgaaaacaggattcggattcacaaatgtcaccgcccatcaaaagtggaagttcagtcggccagggatacggttgctctcagttaaggcccaaacagcccacatcgtcttggaagatgggacaaagatgaagggatactctttcggacacccatctagtgtggccggagaggttgtgttcaatactgggctgggcggctatccagaggctatcaccgacccggcttacaaaggacagatccttacgatggcaaatccaatcatagggaacggaggcgcacccgacactaccgccttggatgaactgggactctccaagtacttggagagtaacgggatcaaggtctcaggcctgctcgtacttgattactcaaaggattataatcactggttggctacaaagtccctgggccaatggttgcaggaggaaaaggtccctgccatttatggcgtcgataccagaatgctgacgaaaatcatccgggacaaggggacgatgctgggcaaaattgaattcgaagggcaaccggtggactttgtggaccccaataaacagaatctcattgccgaagtatctactaaggatgtcaaggtgtatggaaaggggaaccccacaaaagtcgtggccgtcgactgcggcattaagaataacgtcattcgcctgttggtgaaacgcggcgctgaagtgcatttggtcccgtggaaccatgatttcacaaaaatggagtatgacggcatactgattgcagggggtccgggaaacccagccctggccgagcctctgattcagaacgtccgcaagatcctggaatctgatcgcaaagagccgttgttcggcatttccaccggaaatcttattacgggacttgctgcaggagcaaagacatacaagatgtcaatggccaatcgggggcagaaccagcctgtactcaatatcacgaacaagcaagctttcatcacggctcagaatcacggttacgcgttggataacacactcccggccggctggaagcccctcttcgtcaacgttaacgatcaaacgaatgagggtattatgcatgagtctaaaccgttcttcgctgttcagttccacccggaagtgacacctggccccatcgatactgagtatctgttcgactcttttttctcactgatcaagaagggtaaggctacgacaatcacatccgtacttcccaaacctgcactggtcgcgagtagagtagaagtcagcaaagttcttatactgggatctggcgggttgagcatcggacaagccggtgaatttgattactcaggatcccaggctgtcaaggcaatgaaggaggaaaacgtgaagaccgtgctcatgaaccccaatattgccagcgtccagacaaatgaagtcggcctgaaacaggccgatactgtgtactttctccctattacaccacagttcgtgactgaagtgatcaaagctgagcagccagatggcctgatactgggaatggggggacaaacagcactgaattgcggggtggagttgtttaagaggggcgtcttgaaggagtacggggtcaaagtgctgggcacctccgtggaatcaatcatggccactgaggaccggcagttgttctctgataaactcaatgagattaacgagaaaatcgctcccagctttgccgtagaatccatagaagacgcactgaaggccgcggatacaatcggatacccagttatgataaggtctgcgtacgcactcggaggtctgggcagcggcatttgcccaaatcgcgagactttgatggatctgagcacaaaagcattcgctatgaccaatcagatacttgtggaaaaatccgtaaccgggtggaaagagatagaatatgaagtggtgagggacgccgatgataattgcgttaccgtgtgcaatatggagaacgtcgacgctatgggagtccacaccggagattccgttgtagtggcacccgcacaaacactgagcaatgctgagtttcagatgctgcggcggacatctattaatgtcgtgagacacctggggattgtgggagaatgcaacatccaattcgctctccaccctacatcaatggaatactgtatcatcgaggttaacgctcgcctgagcagatccagtgctctggcatccaaggccacaggatacccccttgcatttatcgctgcgaaaatcgcactcggtatcccactgccagagatcaagaacgtggtttctggtaagacctcagcttgttttgagcccagtctggactacatggtgacaaagattcctcggtgggacctggataggttccacggaacttcttcccgcatcggatcttcaatgaaaagtgtcggtgaggtgatggccattggaagaactttcgaggaaagcttccagaaggctttgaggatgtgtcaccccagcatcgaagggtttacaccaagactgccaatgaacaaagagtggccatcaaatctggacctgaggaaggagctgtctgaaccatcttccactaggatttacgctattgcaaaagcaatcgacgataacatgagtcttgacgagatcgagaaattgacctacattgataagtggttcttgtacaaaatgcgcgacatcctgaacatggaaaaaacgctgaaggggctgaattccgaatccatgactgaggagaccctgaaaagggcaaaggagattggcttcagcgataaacagatttcaaaatgtctgggcctgacagaggcccaaactcgagagcttcgcctgaagaagaatatccacccatgggtcaagcagattgacaccctggccgcagagtatccctccgtgactaactatctgtacgtgacctataatggacaagagcatgacgtaaactttgatgaccacggtatgatggtgctgggttgcggcccataccacattgggtcttcagtcgaatttgactggtgtgccgtgtcatcaatcagaacactgcggcagctcggaaagaagaccgtggttgttaactgcaatccggagactgtttccaccgattttgacgagtgtgacaaactgtacttcgaggagctgtctctggagcgaattctggacatctaccatcaagaagcttgcggaggctgtataattagtgtgggcggacagattccgaacaacctggccgtccccctgtacaagaatggagtgaaaatcatgggaactagcccactccaaatcgacagagccgaggataggtctattttcagtgccgtgctggacgaattgaaagtcgcccaggccccatggaaggcggtgaacactcttaacgaggccctggagtttgccaaaagcgtggattatccatgcctgcttaggccatcttacgttttgtccggatcagccatgaacgtcgtattcagcgaggacgaaatgaagaagttcctggaggaagccacccgcgtgagtcaagaacaccctgttgtgttgaccaaatttgtcgagggggcacgggaggtcgaaatggacgcagtgggcaaggacggacgcgtgatctctcacgcaattagtgagcacgtcgaggatgccggggtgcacagcggagacgcaactctcatgctgcctactcagacaatcagccagggcgccattgagaaagtgaaggatgccactagaaagatcgcgaaggcttttgccatctctggcccgttcaatgtccaatttctcgtgaagggtaacgatgtgttggtcatcgagtgcaatctccgagcctcccggtcatttcctttcgtgtcaaagaccctgggcgtggacttcattgatgtggcaactaaggtgatgattggggagaacgtggatgagaagcacctgccaacattggaccacccaattatacccgcagactatgttgccatcaaggctcccatgttttcctggccacgattgcgagacgccgacccaattctcaggtgcgagatggccagcacgggcgaagtggcttgctttggcgagggaatccacaccgctttccttaaggcaatgctctcaactggctttaagatacctcagaaggggatcctcatcggcattcaacagtcatttaggccccgcttcttgggcgtcgcagagcagctccacaatgagggcttcaagctgtttgcgactgaggcgactagcgactggctcaatgccaataatgttcccgccacacctgtggcctggccgagccaggagggtcaaaatccatccctttctagtatccggaaactgataagagatggctctattgatcttgtgatcaatctgcccaacaataacaccaaattcgtgcatgacaactatgtaatccggcggacggccgtggatagtgggatcccactccttaccaactttcaggttacaaagctgttcgcagaggccgtgcagaaatccaggaaagtggacagcaagtctctgtttcattaccgacaatactcagccggcaaggccgct

SEQ ID NO: 8132 - DNA, 4500 bp, Artificial Sequence
  Description of Artificial Sequence: Synthetic coding sequence
atgactcgaatcctgacggccttcaaagtggtgcggacgctgaaaacagggttcggcttcaccaacgttacagctcaccaaaaatggaaatttagccggccagggatccgtctccttagcgtgaaggcgcaaactgcacacattgtactggaggatgggactaaaatgaagggttactctttcggccacccctcgtcagtggccggcgaggtcgttttcaatactgggctgggtggttatccagaagccattaccgatcctgcgtataaggggcagattttgacaatggctaatccaattataggtaatggaggtgccccggacaccactgctctcgacgaacttgggctgtcaaagtatctcgagtccaatggcattaaagtctctggactgttggtactggattattcgaaggattacaaccactggctggccaccaagtccctgggccagtggctccaggaggaaaaagtaccggccatctacggcgtggatacaaggatgcttaccaagatcatccgagataagggcactatgctcggcaaaatcgaattcgagggacagcctgtggactttgtcgaccccaacaaacagaatcttatcgccgaagtctccacaaaggacgtgaaggtctacgggaaaggcaaccctaccaaagttgtcgctgtggactgtgggatcaagaacaacgtgatacggctgctggtgaaacgcggggccgaagtccatctcgtcccatggaatcacgacttcacaaagatggaatatgatggcatccttatcgcgggcggaccgggcaacccggcactcgcggaacctttgattcaaaacgtcagaaaaattctggagtctgatcgcaaggagcctctgttcggaatctctaccggaaacttgatcaccgggctggcagccggtgctaaaacctataaaatgtcaatggcaaatcggggccagaaccagcccgtcttgaacatcacaaacaaacaagccttcatcaccgcccaaaatcatggctacgcactcgacaatacactgcccgctgggtggaagcctctgtttgtcaatgtgaacgatcagacgaacgagggcattatgcatgagtctaaaccttttttcgcagtgcagtttcatccggaggtgaccccagggccaatcgatactgagtacctgtttgattcattcttttcacttattaaaaaaggaaaagcaactacaattacttctgtacttccaaaacccgccctggtggccagccgagtggaagtgtcaaaagtgctgatactgggcagcggaggactctctatcgggcaggccggtgagttcgattattctggttcccaagctgtaaaggccatgaaagaggagaacgtgaaaaccgtcctgatgaaccctaatatcgcctctgtccaaacaaatgaggtaggattaaagcaagctgatactgtgtacttcctgcctattactccacaattcgtgactgaggttatcaaagccgagcagcctgacggactcatactcggaatgggtgggcagaccgcactcaattgtggagtcgagctcttcaaaagaggtgtgctgaaagaatacggagtaaaggtcttgggcacctccgtcgagtcgatcatggccaccgaggaccgccaattgttctcagacaagctgaatgagataaacgagaagattgcgccctctttcgccgtggaatcaatcgaggatgcactgaaggcagcagataccatcggctatcctgtgatgatccgcagtgcatacgccttagggggcttgggcagtgggatctgccccaatcgagaaaccctgatggacctgtcaaccaaggcttttgctatgaccaatcagattctggtcgagaaatccgttaccggttggaaggaaattgagtatgaggttgtacgcgatgcagacgacaactgtgtgaccgtatgtaacatggaaaacgtggatgccatgggcgtgcatacaggtgattcagtcgttgttgcacccgctcagaccctcagcaatgctgaatttcaaatgctgagaagaacgtccattaacgttgtccgacacttgggaattgtgggggaatgcaatatacagttcgcactgcatcccacttctatggagtattgtattatcgaagtcaacgctagactgagtaggagctcagctctcgcttctaaggccaccggctatccgttagcattcatcgctgccaagatagcactcggcatccccctccctgagatcaaaaacgtggtgagcggaaagacttcggcctgcttcgagccgtcattggactatatggtgacgaagataccgcgctgggacctggaccgctttcatggtacctcttcgaggatcggctcctcaatgaagagtgtgggggaagttatggcaattggcaggacgtttgaagaatcattccaaaaagctctgcgaatgtgccaccccagtattgaggggttcaccccacggttgcctatgaacaaggagtggcccagtaatttggacttgcgcaaagagctgtccgagccttcctccactaggatatacgcaatcgctaaagcaatcgacgacaatatgtcactcgacgagattgagaaactgacctacatagacaaatggtttttatataagatgcgtgatattctaaatatggagaaaaccctaaagggtctgaactccgaatccatgacagaggagacactgaaacgggctaaagaaatagggttttctgataagcagatcagtaaatgtttgggactgacagaagctcaaacaagagaattgcggctgaaaaaaaatatccatccctgggtcaagcagatcgacacgctagccgcggaatacccctccgtgacaaactatttgtacgttacgtacaatggacaggaacatgacgtcaactttgacgatcacggaatgatggtactcggctgtggcccctaccatattggatctagtgtcgaattcgattggtgcgcagtttcatcaattcgcaccctgaggcaactgggaaagaaaactgtggtggtgaattgcaatcccgaaacggtctccactgactttgatgaatgtgataagctttatttcgaagagctgtctctggagaggatacttgatatctaccatcaagaagcgtgtggcggttgcatcatttctgtaggcggccagattcccaataatttagcagtacctctttataagaacggcgtcaaaatcatgggcacatcaccattgcaaatcgacagggccgaggatagatctatcttctctgccgtgttggatgaactgaaggtggcacaagctccgtggaaagccgtgaacaccttgaatgaggcactggagtttgcaaagtcagtagattacccgtgtctcttgaggccaagctacgtactgagcggaagtgcaatgaacgtcgtattctctgaggacgaaatgaagaagtttctggaggaagcgaccagggtgagccaggagcatcctgttgtcctcaccaagttcgtcgagggcgctagggaagttgagatggatgccgtggggaaagacggacgggtgatctctcacgcgatcagcgagcacgtcgaagatgctggtgttcatagcggagacgccacattaatgctcccaacccagactatcagccagggagctatagagaaggtcaaagacgcaacacgtaagatcgcgaaagctttcgctatcagcggacctttcaatgtgcagttcctggtgaaagggaacgatgtgctggttatagaatgcaaccttcgggcgtctcgaagctttccatttgttagtaaaacactgggcgtggattttattgatgttgcaacaaaggtcatgatcggcgagaacgtggacgagaaacatctcccgacactcgatcacccgattatccctgccgactacgtggccatcaaggcccctatgttttcttggcctaggctgagagacgcggacccgattcttcggtgtgaaatggcttcaactggggaagtggcttgctttggagagggtatccatactgcatttctaaaggctatgctctcaaccggattcaaaattccgcagaagggaattctgattggaattcagcagagctttcgccctagatttttaggggtggcagagcaactccacaatgagggctttaaattgttcgccacagaggcaacatccgactggctcaatgctaacaatgtgccggccacccccgtcgcatggccttctcaggaagggcagaatccatctctctcatccatacgcaagctcattcgcgatggatctatcgatcttgtaattaatctgcccaacaataacacgaaatttgtacacgacaactacgttatacgacggacggccgtggattccggcatccccctgctcacaaatttccaagtgaccaaattgttcgctgaggcagtccagaagtctcgcaaggtggattcgaaatctctgttccactaccggcagtactcagccggaaaagcggct

SEQ ID NO: 8133 - DNA, 4500 bp, Artificial Sequence
  Description of Artificial Sequence: Synthetic coding sequence
atgacaaggatcctgactgcgttcaaagttgtgcgcaccctgaagaccggatttggctttaccaacgtgaccgcacaccagaagtggaaattcagcagacccgggatccgcctgctgagcgtgaaagcacagacagcccatattgtgctggaggatggtactaaaatgaaaggatactcctttggccatccctcttcggtcgccggtgaagtggtgttcaacacaggattgggcgggtaccccgaggctatcaccgatcccgcatataagggccagatcctgaccatggccaatcctatcatcggcaacggcggagctcctgatacaaccgctctcgacgaactagggctgtctaaatatcttgagagcaatgggataaaggtgtcaggactcctcgtcttggactactctaaagattacaaccactggctggcgaccaaaagtctggggcaatggctccaagaggagaaggtcccagcaatatatggggtcgataccaggatgctgactaaaattatacgcgataaggggacgatgctgggcaaaatcgagtttgaaggccagccggtcgattttgtggacccgaataagcagaacctcatcgccgaggtgtccaccaaagacgtgaaggtttatggcaaggggaatcccacaaaggttgtggcggttgactgcgggatcaaaaacaacgtcattcgcctgctcgttaaacggggcgccgaagtgcatctcgtgccgtggaatcatgacttcacaaaaatggagtatgatggaatactgattgctggggggcccgggaacccggcactggccgaacccctcatacagaatgtgcggaagatcctggagagtgacagaaaagaaccactctttggcatttctaccggcaatttgattactggtctggctgctggagccaagacatacaagatgagtatggccaatcgaggtcagaaccagcctgtcctcaatatcacaaacaagcaggcttttataaccgcccagaaccacggatacgcgctggataacactcttccggcaggttggaaacctctttttgttaatgtaaacgaccagaccaatgaagggatcatgcacgaaagcaaaccgttcttcgcggtccagttccatcctgaagtgacacccggaccaatcgacaccgaatacctgtttgatagctttttcagcctgattaagaaaggaaaggccacgacgattacctccgtcctgcctaagccggcattggtcgcctcgcgggtcgaagtgtctaaggttctgatcctagggtcaggcggactttccataggccaggccggtgagttcgattatagcggaagccaagccgtaaaggcaatgaaagaggagaatgtgaaaacggttctgatgaaccccaatatagccagcgttcaaacaaacgaagtcgggctcaaacaggccgacaccgtctacttcctgcccattacaccccagtttgtaacagaggtaattaaggcggagcagcccgacggtctaatacttggtatgggtgggcagacagccttgaattgtggcgtggagctgtttaaacgtggcgtcctgaaagagtatggggtgaaggtgttaggcacaagcgtcgagagcatcatggccaccgaggacaggcagctattctctgacaagcttaatgaaattaatgaaaagatcgcgccttcattcgccgtggaaagcatcgaagatgccctgaaggccgccgatacaatcggatatccggtcatgataaggtctgcctacgcgcttggcggcctaggatccggaatttgtcctaatcgcgagacgctgatggacctatccactaaggccttcgctatgacaaatcagatcctcgttgaaaaaagtgtgacaggctggaaggagattgaatatgaagttgtgagagatgccgatgacaattgcgtaacggtctgcaacatggagaatgtggacgcgatgggcgtccatacaggcgactcagtggtggtggcccctgctcagaccttatccaacgctgaattccagatgctgcggcggacatctatcaatgtagtcaggcacctcggcattgtcggcgagtgtaacatccaatttgccctgcaccccaccagcatggagtattgcatcatagaagtgaacgcgaggctgtcacgttcctccgcacttgcctctaaggccactggctacccgctcgccttcattgcagctaagatcgcattgggcatccctctgcccgagatcaagaatgtggtgtccggcaaaactagtgcgtgtttcgagccaagtttagattatatggtgacgaaaatacctcgttgggatctcgataggttccatggaacctcgtcgagaattggaagcagcatgaaatcagtcggggaagttatggctatcggccgtaccttcgaagagtctttccagaaggcactaaggatgtgccacccttctatcgaggggttcaccccacgcctgcctatgaacaaggagtggccttctaacctagaccttcggaaagagttgtccgaaccgagttcgacacggatttacgcaatagcaaaagctatcgacgataatatgtcccttgacgaaatcgaaaagcttacttacattgacaagtggttcctgtataagatgagagatattctgaacatggagaagacattaaagggcctgaatagcgaaagcatgacagaggagactttgaagcgggccaaggagattggattcagtgacaagcagattagcaaatgcctggggttgaccgaagcgcagacgagggagctgagactgaagaagaacattcacccctgggtgaaacagatcgacaccttggccgctgagtacccgagcgtaactaactacctgtacgtgacctataatgggcaggagcacgatgttaattttgacgatcacggaatgatggttctagggtgtggtccttatcacattggctctagcgtcgaattcgattggtgcgcagtaagcagtatccgaactctgaggcaactgggcaaaaaaacagtggtagtcaattgtaatccggagacagtaagtacggattttgacgagtgtgacaagctttatttcgaggagctgtctttggaaaggattctggatatctatcaccaggaagcctgcggcgggtgcattatctcagttggaggccagattcctaataatctagccgtcccactgtataaaaatggggtgaagattatgggcacatccccactgcagatagatcgcgccgaggacagaagcatcttctccgctgtcctggacgaacttaaggtggctcaggccccttggaaggcggtgaacactctgaacgaagctttggaatttgccaagtcggtggactatccatgcctgttgcggccctcatacgtcttgtccggtagcgctatgaatgttgtgtttagcgaagatgagatgaagaaatttctcgaggaggctaccagggtttcacaggaacaccccgtggtgctgaccaaattcgtggaaggcgcacgggaagtcgagatggacgccgtggggaaggacgggagagtgatcagccacgctattagcgaacacgtggaagacgcgggcgtgcactctggcgatgctacacttatgctgcccactcaaacaataagccagggagcaattgaaaaagttaaggacgcaacgcgtaagatcgccaaggcattcgcaatctccgggccattcaacgtacagttcctggtaaagggcaacgacgtgctggtaatcgaatgcaatctcagagcctcccgttcatttccatttgtcagtaagacactgggagtggacttcatagacgttgccactaaggtgatgatcggggaaaacgtggatgagaagcacctgcccaccttggaccacccgattattcccgccgactacgtcgccataaaggcccctatgtttagctggccgcgtttgcgggacgctgacccaattctacgctgtgaaatggcgtctacaggggaggttgcatgtttcggtgagggcattcatacggctttcctcaaggcaatgctctcaacagggtttaagataccgcagaagggaatcctgatcggaatccagcagtctttccggccaagattcctcggagtggcggagcaactccacaatgaggggtttaaactgttcgccacagaggctacgagtgactggttaaacgccaacaacgtacccgctacaccagtcgcatggccttctcaggaagggcagaatccttccctatccagcatccggaagctgatccgagacggctcgatcgacctagtcatcaatttacccaacaataatacgaagtttgtacacgataattatgtgatccggcgaactgccgtcgatagcggcatcccactattaactaacttccaggtgaccaaattgtttgccgaggccgtgcaaaaaagccggaaggtcgactcgaaatccctatttcattaccggcagtattctgctgggaaggccgcg

SEQ ID NO: 8134 - DNA, 4500 bp, Artificial Sequence
  Description of Artificial Sequence: Synthetic coding sequence
atgactcgcattttgaccgccttcaaggtagttagaactctcaagactggattcggcttcaccaacgttaccgctcatcagaagtggaaatttagtagacctggcatacgcctcctgtctgttaaggcccagaccgcacacatagtgctggaggacggaaccaagatgaagggttatagtttcggacacccttcttccgtggcaggcgaggttgtattcaacaccggcctcggcggatatccagaagccattactgatcccgcttataagggtcagatcctcactatggccaacccaatcatcggtaacggcggtgcccccgacacaactgccctggacgagctcggcctgtctaagtatctggagagcaatggcatcaaagtgtcaggtttgctcgtcctggattactcaaaagattacaaccactggctggccacaaaatctctgggccaatggcttcaggaagagaaagtgcctgctatctacggcgtggacacccgtatgctcaccaagattatacgcgataagggtaccatgctgggcaagatcgaattcgagggacagcctgttgacttcgtcgaccctaataagcaaaacctcatagcagaagtgtccaccaaggatgtcaaagtctacggaaaaggaaaccctaccaaggttgtggctgttgactgtggaattaagaacaatgttatccgcttgctggttaagcgtggcgctgaagtacacctcgtcccatggaaccacgacttcaccaagatggaatatgatggtatcctgatcgctggaggcccaggcaatcccgcccttgctgagccccttattcaaaatgtccgtaaaatcctggagtccgaccgcaaggagccacttttcggtataagtactggaaacctcattacaggtctggccgccggcgctaagacatacaagatgtccatggctaaccgcggccagaatcagccagtgctgaacattactaataagcaggcttttatcaccgctcagaaccacggttacgccttggataatactctcccagccggttggaagcccctgttcgtaaatgtcaacgaccagaccaatgagggtattatgcatgagtctaagccattttttgctgtacagtttcaccctgaagtcacacctggacctatcgacacagaatacttgtttgattccttcttttcacttatcaagaaaggcaaggctaccacaataacctctgtgttgcccaagccagctcttgtcgcaagcagggtggaagtctcaaaagtgttgatcctgggcagtggaggcctctctattggacaggccggtgaattcgattattctggatcacaagccgtcaaggctatgaaggaagagaatgtgaaaaccgtccttatgaaccccaacatcgccagcgtgcagactaatgaagttggtctgaagcaagcagacacagtatacttcttgccaatcactccccagttcgtgactgaggtcataaaagctgagcagccagacggcttgatcttgggaatgggtggacaaacagctctcaactgtggagtagagctgttcaaaagaggtgttttgaaagaatacggcgtgaaagtactgggaacctctgtggagtcaataatggccacagaagatcgtcagttgttttctgataaactcaacgagatcaacgagaaaatcgctccctctttcgctgtagaatccatcgaggacgccctcaaggccgccgacaccattggataccccgtcatgatccgttccgcctacgcacttggaggtcttggctccggaatttgccccaacagggagactctgatggaccttagcaccaaagcctttgcaatgactaaccagattctggtggaaaagtctgtgactggttggaaggaaatcgaatatgaggtcgtgagggacgccgatgacaactgtgtcaccgtttgcaacatggagaacgttgacgccatgggtgtccacacaggagatagcgtggtggtcgctcccgcacagacactgtcaaacgccgaattccagatgttgagaaggacctctatcaatgttgtgcgtcacttgggaatcgtgggcgaatgtaacattcaattcgctttgcaccccacctccatggaatactgcatcatcgaagtcaatgcccgcctcagcagatcaagcgccttggcttctaaagcaaccggttatcctctggctttcattgctgctaagattgccctgggcatccctctgcctgagattaagaacgtggtttcaggcaaaacctctgcatgttttgaaccttctctcgattacatggtgactaagatcccacgttgggacctggatagatttcacggtacttcaagcagaatcggatcctctatgaagtcagtcggtgaggtgatggcaattggacgcaccttcgaagagtccttccagaaagccttgagaatgtgtcatccctcaattgaaggcttcacacctcgcctgcccatgaacaaggagtggcccagtaacctggatttgaggaaggagctgtcagaaccctcttccacccgcatatacgctatagctaaggctatagacgataacatgtctcttgacgagatagagaaactgacttacatcgacaagtggttcctgtacaagatgagagatatattgaacatggaaaagaccttgaaaggtcttaattccgagtctatgaccgaggagaccttgaagcgtgcaaaggagataggatttagcgacaaacagatctctaagtgccttggactcaccgaagctcaaactagggaattgcgtttgaagaagaacattcatccatgggtgaaacaaatcgatactctggccgcagagtaccccagcgtaaccaattatctgtacgtcacttacaacggacaggagcacgacgttaattttgatgaccacggtatgatggtactcggctgtggtccctaccacataggctcatctgtggaattcgactggtgcgccgtcagtagcattcgtactctgagacaactgggcaagaaaactgtggttgttaactgtaaccctgagacagtgtctacagactttgatgagtgtgataagctctactttgaagagctgtccttggaacgtatcctcgatatctaccaccaggaggcctgcggtggatgcatcatctctgtgggcggacagattcccaacaaccttgccgttcccttgtacaagaacggagtgaagatcatgggaacatcccctcttcaaatagacagagccgaagataggtccatcttctctgctgtcctggacgagctgaaggtcgcccaggcaccctggaaggccgtcaatactcttaatgaagctctggaatttgctaagtcagtggactacccatgtctgcttcgcccttcctacgtgctcagtggaagtgctatgaacgtcgtgttctcagaagacgagatgaaaaagttcctggaggaagctacccgcgtgagtcaagagcaccctgtagttctcacaaaattcgttgagggcgcccgtgaagtcgagatggatgctgtaggaaaggatggcagggtaatcagtcatgcaatcagcgagcacgtcgaagacgctggcgtacattcaggtgacgctaccttgatgcttcctacacaaaccatctctcaaggagctatcgagaaggtgaaggatgccacccgcaagatcgctaaggcttttgcaatctcaggacctttcaacgttcagttcttggtgaagggcaacgacgttctcgtgatcgaatgcaacctgcgtgccagccgtagcttcccattcgtttctaaaacattgggagtggacttcatcgacgtcgccacaaaagtgatgatcggcgagaatgtcgatgagaaacacctgcccaccctggatcacccaatcatcccagctgattacgtggctataaaagcccctatgttttcctggcctcgtctgagagatgccgacccaatcctcagatgcgaaatggcatctactggcgaggtcgcctgctttggagaaggaatccatacagcttttttgaaggccatgctgtcaaccggatttaagatcccccaaaaaggtatcctgatcggtattcagcagagcttccgtcccagattcctgggagtagctgaacagttgcacaacgagggctttaagctcttcgctactgaagctaccagcgattggttgaacgcaaacaatgtccctgctactcccgtggcctggcccagtcaagagggacagaatccaagtctgagtagcatcagaaagttgatacgtgacggatcaattgacctcgtgatcaaccttcctaacaataatactaagttcgttcatgacaattacgtaatcagaagaaccgccgtcgattcaggaatccctcttttgacaaacttccaagtcactaagttgtttgccgaggctgtacagaagagtaggaaggtggactccaagagtttgttccactaccgccaatacagtgccggcaaggccgcc

SEQ ID NO: 8135 - DNA, 4500 bp, Artificial Sequence
  Description of Artificial Sequence: Synthetic coding sequence
atgacccgcattctcaccgcgttcaaagtggtcaggacactgaagacgggatttgggttcactaatgttaccgcacatcagaagtggaagttcagtaggcccgggatccggctgctgtctgtgaaagctcagacagcacacatcgttctggaagatggtaccaagatgaaaggttattcatttggacatccaagtagtgtggctggtgaggtggtgttcaacactggactcggtggctatccagaagccattacggaccctgcttacaagggtcagattctgactatggcaaatccaatcattggaaatgggggagctcccgacaccactgcgctcgatgagctcggcctgagtaagtatctggagtccaacggtataaaggtgagcggactgctcgttctcgattactccaaagattataaccactggctcgccaccaagagtcttggccagtggctccaggaggagaaagttcctgccatttacggcgtggacacccgcatgctgacaaaaattattagggacaaggggaccatgttgggcaaaattgaatttgagggtcagcctgtggacttcgtggacccaaataagcagaacttgatcgccgaagtttcaaccaaagacgtgaaggtgtatggcaaagggaatccgaccaaggtcgtagctgtagactgcggcattaagaataacgtcattaggttgctcgttaaacgcggagccgaggtgcatctggttccatggaaccatgactttactaagatggagtacgatggaattcttatcgcgggcgggcctggcaaccccgcactcgctgagccgctaatacagaacgtcaggaagatcttggaaagtgatcgaaaagagcctttgtttggcatttctaccggcaacttaattacgggtctggccgccggcgccaagacctacaaaatgagcatggccaatcggggacagaatcagccagtgctgaatattacgaataaacaggccttcatcacagcccaaaaccacggatacgccctcgacaacactttgccagcgggatggaaacccctatttgtgaatgtgaacgatcagactaacgaaggcatcatgcacgagagtaagcctttttttgcagttcagtttcatcctgaagttacccccggcccgatcgatacggagtacttgtttgatagctttttttcattgataaagaagggcaaagcaactacaatcacatcagttctgcccaagcccgcccttgtcgctagtagagtcgaggtttctaaggtgctgattttaggcagtggcgggctgagcatcggccaggctggtgagttcgattattccggctcccaggctgtgaaggccatgaaggaagaaaatgttaaaacggttcttatgaaccctaatatcgctagcgtacaaaccaatgaagtcggtcttaaacaggccgacactgtctacttcctccctattactccccagtttgtgacggaagtgatcaaggcggagcagcccgacggactgattctggggatgggtggacagacagcgcttaactgcggagtcgagctattcaagcgtggcgtgttgaaggagtatggggtaaaggtattagggacttccgtagagagcataatggccaccgaggaccgacagcttttctctgacaaactgaacgagatcaatgagaagatcgctccatcttttgctgtggagtctattgaggacgccctgaaggctgcagataccattggatatcctgttatgatccggtcagcgtacgctctcggggggctgggttccggaatttgcccgaaccgggaaaccctgatggacctgtccactaaggctttcgcgatgactaatcaaatcctggttgagaaatctgtgacagggtggaaagagatcgaatatgaggtcgtaagggacgccgatgataactgcgtgaccgtctgcaatatggagaatgtcgatgccatgggcgttcatacaggggattcagtggtagttgcccccgcacagaccttgtctaatgctgaatttcagatgctgagaagaacaagtatcaatgtggttcgccatctcggaattgtaggcgagtgcaacattcagttcgcgcttcatccgacttcaatggagtactgcattattgaggtgaatgctaggctgagtagaagttcagccctggctagtaaggctacaggctatccccttgccttcatcgcggctaagatcgcactcgggattccactgcctgagattaagaacgtggtatctggcaagacctcagcttgcttcgagccctccctggactacatggtgaccaagataccgcggtgggatctagaccgcttccatggaacatccagtaggattggaagttcaatgaagtctgtcggggaggtcatggccattggtcgtacatttgaggaatcctttcagaaggctctgaggatgtgtcatcctagtatcgaggggtttactccccgattacctatgaacaaggagtggccttctaacctcgacctgaggaaagagttaagtgagccctcatctacccggatctacgctatcgcaaaggccattgatgataacatgtccttggatgagattgaaaaattgacctacattgataaatggttcctttacaaaatgcgtgacattcttaacatggagaaaacacttaagggtcttaactctgagtccatgactgaagaaacactgaaacgggcaaaggagatcggattttccgataagcagatctcgaagtgtctaggactaactgaagcccagacccgggagctgcgccttaaaaagaacattcatccttgggtgaagcagatcgacaccctggcggctgagtatccatcagtgactaattacctttacgtcacgtataatgggcaggagcacgacgtgaatttcgacgaccatggcatgatggtgttgggctgtggcccttaccacatcgggagctctgtcgagttcgactggtgcgcagtgtctagcatcaggactcttaggcaactgggcaaaaaaaccgttgtggtgaactgcaatcctgagaccgtgtccactgactttgacgaatgcgacaagttgtatttcgaagagttgagtcttgagcgcatcctggatatctaccaccaagaagcctgcggtgggtgtatcatcagtgtgggcgggcagattcctaacaatctggctgtgcctctctacaagaacggcgttaaaatcatgggtacttccccacttcagatagatagagccgaggaccggagcatttttagtgccgtgctggatgaattgaaggtagcccaggctccatggaaggcagtgaataccttaaacgaggccctagagttcgcgaagagcgtggattatccatgcctgctgcggccgtcttacgttttatccggtagtgccatgaatgtggtgttctccgaagatgaaatgaaaaagttcctggaggaagctacgcgggtgagccaggaacatcctgtggttttgactaaatttgttgagggtgcccgcgaggtggaaatggacgccgtgggaaaagacggcagagtgatcagtcatgccatctcagagcatgttgaggatgcaggtgtgcattccggtgatgcaaccctgatgttgcccactcaaaccatatcacagggtgccatcgagaaggtaaaggacgcaactcgcaagatagctaaggcctttgcaatatcaggcccttttaatgtgcaatttcttgtgaagggaaacgacgttcttgtgattgagtgcaatctgcgtgcatcacggtccttccccttcgtctccaagaccttaggagtagattttatagatgtggccacaaaagtcatgatcggcgaaaatgtagatgaaaagcacctccctacactggatcatcctataatcccggccgactacgtcgccattaaggcacctatgttcagttggcctaggctacgtgatgctgatcctattctgaggtgcgagatggcgtcgactggcgaagtcgcctgcttcggcgaaggtattcacactgcctttttaaaggccatgttaagtaccgggtttaaaataccccagaagggtatcttgatcggcatacaacagtccttcagacctagattcctcggagttgcggaacagctgcacaatgagggatttaagctcttcgctaccgaggctacatccgattggctaaatgctaacaacgtacccgctacgccggtagcatggccctcacaagagggacagaacccgtcactgtcctcaatccgcaagttaatccgcgacggttctatcgacctagtgatcaatctacctaataacaacaccaaatttgtgcacgacaactacgtgatcagaaggaccgccgtagacagcggaatccctctgctaacaaatttccaggtgacaaagctctttgctgaagccgtccagaaatcaaggaaagtggatagcaagtccctgttccattatcggcagtactccgctggcaaggccgcc

SEQ ID NO: 8136 - DNA, 4500 bp, Artificial Sequence
  Description of Artificial Sequence: Synthetic coding sequence
atgacgaggatcctgactgcattcaaggtggtgcgtacgcttaagacgggttttggattcaccaacgtcacagcacaccagaagtggaagtttagcaggcccggaattaggctcttgtctgtcaaggcccagaccgcccacatagtgctcgaagacggtacaaaaatgaaagggtattcattcggccacccatcatctgtggctggcgaggttgtattcaacacaggcctcggggggtacccggaggcaatcaccgatcctgcctacaagggtcagatcctgactatggccaatccgatcattggaaacggcggggctcctgatactaccgccttggacgagctggggctcagtaaatacttggagtcaaacgggatcaaggttagcgggttgctggtcttggattacagcaaagattataaccattggttggcaaccaagtctcttggacagtggcttcaggaagaaaaggtgcctgctatctacggggtggatacgcgcatgctcacaaagattattagagacaaaggaacaatgcttgggaagattgagtttgaaggtcagcctgtggacttcgtggaccccaataagcagaatctgattgcagaggtgtccactaaggacgtgaaggtgtacggaaaaggcaatccgacgaaagtggttgccgtggactgcggaatcaaaaataatgttattcgtctgcttgttaagaggggcgccgaggtgcaccttgtgccctggaaccatgactttacaaagatggaatacgatggcattttaatagctgggggcccaggtaatccggccttagccgaaccgctgattcagaatgtccggaagattctcgagtctgatcgtaaggagcctttatttggcatcagtactggaaacctgataactggactggcagcaggggccaaaacttacaaaatgagcatggcaaatagaggccagaaccagcccgtgttgaatatcaccaataagcaggcattcattacagcccaaaatcatgggtatgcactggataacaccctgccagccggatggaagccactttttgttaatgtaaatgatcagacaaatgaggggatcatgcatgagtctaaacccttttttgctgttcagtttcaccccgaagtgacacccgggcctattgacaccgagtacctgtttgacagcttcttttcacttattaagaagggaaaggctacaacgattacttctgtgctgcctaagcccgcgttggtcgcttccagagtggaggtgtctaaggtcctgattctgggctcaggcggcctcagtatcggccaggccggtgaattcgattactctggctctcaggccgtgaaggccatgaaagaggagaacgtgaagacagtgctgatgaaccctaacatcgcctccgttcagaccaacgaagtgggcctgaaacaggctgataccgtatacttcttgcccattactccccagtttgtcaccgaggtcattaaagccgagcagcctgacggccttatattggggatgggcgggcagaccgcactgaattgtggggttgagctctttaaacggggtgtgctcaaagaatacggcgtaaaagttctcgggacaagtgtggagagtatcatggctaccgaagatagacagctcttcagcgataagcttaatgagattaatgagaagattgcgccatccttcgccgtggagtctatcgaggacgccctcaaagccgccgacaccatcggctatccggtgatgatccggtccgcatacgcattgggcggcctgggctccggaatctgtcctaacagagagaccctaatggacttgtcaactaaggcgttcgccatgacaaaccaaatccttgtggagaaatcagtcactggctggaaggagatcgagtatgaggtggttagagatgccgacgataattgtgttaccgtctgcaatatggaaaacgttgatgccatgggggttcatacaggagactctgttgtggtggcccccgcccagactttatctaatgccgagttccagatgctgcgacgtacaagcattaacgtcgttaggcacttggggatcgtcggtgagtgcaacattcagttcgcacttcatcccacctcgatggagtactgcatcatagaagttaatgcccgactgtcacggtccagcgccttggcctcgaaggcaaccggatatcccctagcattcattgctgcaaagatcgcactgggtatccctctccctgagattaagaatgtcgtgagtggcaagacttcagcgtgctttgagccctcccttgactatatggtgaccaaaatcccgagatgggatcttgatcggtttcacggcacttcttctagaatcggttcgtccatgaagagcgtcggagaagttatggcgatcggccggacgttcgaagaatcatttcaaaaggcgcttcggatgtgtcatccctcaatcgagggttttacacctcggctgccgatgaacaaagagtggccaagcaatctggacctgcgaaaagaactgtctgagccatccagcactcggatttatgcaattgcaaaagctatagatgacaatatgagcctggacgaaatcgaaaagctcacatacattgacaagtggttcctttataaaatgcgcgatattctgaatatggaaaagaccttgaaaggactgaacagtgagagtatgacagaagagacccttaagcgcgctaaagaaattgggttttctgacaagcagatctccaaatgcctgggcctaactgaagcgcaaactcgcgaattaaggctcaagaagaatattcacccatgggttaaacagatcgataccttggctgccgaatacccctctgtgacaaattacctttacgtgacctacaacggccaggagcacgacgtaaatttcgacgatcacggcatgatggtcctgggctgtggcccgtatcatatcggctcctccgtagaatttgactggtgcgcagtcagtagcatacgcactctgcgtcaactgggtaaaaaaaccgtggttgtgaattgtaacccggaaacagtatctacagattttgacgagtgtgataagctttacttcgaggaactttcactggagcgaattctggacatttaccatcaggaagcttgtggaggatgcattatttctgtaggcggacagattccgaataatctggctgtaccactctacaagaatggcgtcaagattatggggacatctccccttcagattgatagagctgaggataggtccatcttcagtgccgtgctcgatgaacttaaggtagctcaggccccttggaaagcggtgaatacgctgaatgaggctcttgagtttgctaaatctgtggattacccttgcctgctgcggccttcttatgtactgtctggatccgccatgaatgtggtcttctctgaggacgaaatgaagaagtttcttgaggaagccacacgggtgtcgcaggaacatcctgtcgtcttgactaagttcgtagagggggcccgagaggttgaaatggacgctgtcggaaaagacggaagggtgatctctcatgctatcagcgagcatgttgaagatgccggggtccactccggagatgccactctaatgctgcccactcagacaatctctcagggggcaattgagaaggtaaaagacgccactagaaaaatcgctaaagcattcgctatctctggcccattcaatgtacaatttctggtcaagggaaatgatgtgctcgtaattgaatgcaacctgagagcctcgcgcagcttcccgtttgtctctaaaactctgggcgtagatttcatcgatgtggctaccaaggtaatgattggcgaaaacgtggatgaaaagcacttacctactctggaccaccctatcatcccagccgattatgtggccatcaaggctcccatgttctcttggccaaggttgcgggacgccgatcctattctgaggtgcgagatggccagcacgggcgaagttgcctgttttggcgaggggatacacacagcatttctcaaggcgatgctcagtaccgggtttaaaataccgcagaagggcatccttattggtatccagcagtctttcaggccacgattcctgggcgtggctgagcagcttcacaacgagggatttaaactttttgctacagaagcgacaagtgattggctaaatgctaataatgtgcccgctacgcctgtcgcctggccttctcaagaggggcagaaccctagcctcagttccattaggaagctgatccgggacggctcgatcgacctcgtgataaatttgcctaataataatactaaattcgtgcacgacaattacgttattcggaggaccgccgtggacagcggcatccccttgctgaccaacttccaggtgacaaaactattcgctgaggctgtgcagaaaagcagaaaagtcgactctaaatcactctttcactaccgccagtactcagctggcaaagctgct

SEQ ID NO: 8137 - DNA, 4500 bp, Artificial Sequence
  Description of Artificial Sequence: Synthetic coding sequence
atgaccaggatcttgaccgccttcaaggttgtgcggaccttgaagacagggttcggcttcactaacgtgacagcccatcagaaatggaagttctctcgccctgggattaggctcctgtccgtgaaagcccagactgctcatatagtgttggaggacgggacaaaaatgaaaggctacagcttcggacacccatcttctgtcgccggagaagtggtgttcaatactggactgggagggtatccagaggccataactgatcccgcctataaaggccagatactaaccatggcaaacccgatcataggtaacgggggggcgccagatacaaccgctttggacgaactgggcctgtcaaagtaccttgaatctaatggcataaaagtttccggcctattggtactggattactcaaaagactacaatcattggctggcgacaaagagtctgggacagtggcttcaggaggaaaaggtgcctgccatctatggggtggacacacgaatgctgaccaaaatcattcgtgataaaggaactatgctcgggaagatagagttcgagggtcaacccgttgatttcgtggacccaaacaagcagaatctcatcgctgaggtttcgaccaaagacgtcaaggtgtacggcaaagggaaccccaccaaggtggtggccgtggattgcgggatcaagaataatgtgatccgcctcctggtcaaacgtggagcagaggtccacttggtcccctggaaccacgacttcaccaagatggagtatgacggtatcctcatcgcgggtggacctgggaatcctgcactggccgagcccctgatccagaacgtgcgcaagatcctcgagtctgatcggaaggagcccttatttgggatcagcaccgggaacctgatcaccggcctggcggctggggctaagacatataagatgtcaatggctaatcgtggccagaatcagcccgtactgaacattactaacaagcaggctttcatcacagctcaaaaccacggatatgccctggataatactttacccgccggctggaaacccctcttcgtgaacgtgaatgaccagactaatgaaggaatcatgcacgaatctaaacccttctttgccgttcagtttcatcccgaagtcaccccaggcccaatcgatacagagtatcttttcgattcctttttcagtctcatcaagaagggcaaagcgacaaccatcaccagcgttctaccaaaaccggcactggtagcatctcgggtcgaggtctccaaagttctgattctcgggagtggaggactgagtatcgggcaggctggcgagttcgactactcaggctcccaggctgttaaggccatgaaggaagagaacgtgaagaccgtgctcatgaaccctaatatcgcatcagtgcagactaacgaggtgggtctgaagcaggccgataccgtctacttcctgcccataacgccccagttcgtcacagaagtgatcaaagcggaacagccggatggcctgatactgggaatgggtgggcagactgccttaaactgcggcgtcgagctcttcaagagaggggtgctcaaggagtacggcgttaaggttctgggcacatccgtcgagagtatcatggcaacggaggatagacagttgttctctgacaagctcaatgaaataaacgagaagatcgctccgtcatttgctgttgaaagtatcgaggatgccctgaaggcggccgataccatcggctatcccgtgatgatccgatctgcctatgccctcggcggacttggctctggaatctgtcccaaccgggagacactgatggaccttagtacgaaggccttcgcgatgaccaatcagatccttgtagaaaaatccgtcactggatggaaagaaattgagtacgaggtggtccgggatgccgatgataactgtgtgaccgtctgcaatatggaaaacgtcgatgcgatgggcgtgcataccggagattccgtggtggttgcaccagcacagacactgagcaatgccgagtttcagatgcttaggcgcacttctatcaacgtcgtccgacacctgggaattgtcggggaatgcaatattcagtttgcacttcatcctacgagcatggagtattgcatcatcgaagtgaacgcccgcttgagcaggagttctgcgttagcctcaaaagccactgggtaccccctggcattcatcgccgcaaaaatcgcattgggcatccccctgcccgaaattaaaaacgtggtctccggaaagacaagcgcctgcttcgagccttccctcgattatatggtgacaaagattcccaggtgggatctcgaccggtttcatggcacttcatctcgcattggctccagcatgaagtccgtgggcgaagtcatggctatcggtcggacctttgaggaatcctttcagaaagccctgaggatgtgccatcctagcattgaggggttcacacccagactacctatgaataaagagtggccatccaaccttgatctgcgaaaggagctaagtgaaccatctagcacacggatctacgccattgccaaggccatcgatgacaatatgtccttggatgagatcgagaagcttacctacatagacaaatggttcctctacaaaatgcgggatattctgaatatggaaaaaactctgaaggggcttaatagcgagtccatgacagaggaaaccctgaagagagccaaggagatcggattcagcgacaaacagattagcaagtgcctcggactgacggaggcccaaaccagggagctgcgactcaagaagaacatccatccatgggtgaagcaaatcgacacacttgctgccgagtatcccagcgtgaccaactatttatacgtgacctataatggccaggaacacgatgtgaattttgacgaccacgggatgatggttcttgggtgtggcccctatcatatagggtcctcggttgaatttgactggtgcgccgtgagctctattcggaccctcaggcagctgggaaaaaagacagttgttgtgaactgcaaccccgagaccgtgtccaccgacttcgatgagtgtgacaagctttacttcgaagagctgtcattggaaaggattctcgacatttatcaccaagaagcttgcggggggtgtattatctccgtgggggggcagatccctaataacctggccgtgccgttatataagaatggcgtgaagattatggggacctctccgttgcagatcgacagggccgaagacaggtccatcttttcggctgtcctcgacgagctgaaggtggcgcaggctccttggaaagccgtaaacaccctcaacgaagcgctggaattcgctaaatccgtggactacccttgcctcctgcgaccttcttacgttcttagtggctcagcgatgaacgtagtgttcagcgaggatgagatgaagaagttcctcgaagaggcaacgcgtgtgtcccaagagcatccggttgtgttaaccaagtttgtggagggggccagggaagtggagatggacgctgtcggcaaggacggtagagtgatctcccatgccatcagtgagcatgtggaagacgccggggtgcatagcggcgacgcaaccctcatgctgccaacccagacgattagccagggggcaattgaaaaagtgaaggacgcaacacggaagatcgcgaaggcgtttgcaatcagtggtccgtttaatgtccagtttcttgtcaaaggaaatgatgtgctggtcattgagtgcaatcttcgggcgagtaggtcgttccccttcgtgtccaaaactctcggagtcgacttcatcgacgtcgcgacaaaggtgatgattggggaaaatgtcgacgagaaacatcttcctaccctggatcatccaatcattcctgcagattatgtcgcaatcaaggctcctatgttcagctggccgcgtctgagggatgcggaccctatactgagatgtgagatggcgtctaccggtgaggtggcctgtttcggcgaaggcatccacaccgccttcctgaaagccatgctgtctacgggattcaaaattccacagaaagggatccttattggcatccagcaaagctttcgccccaggttcctgggtgtggccgaacagctgcacaacgaaggtttcaagctgtttgctacagaggccacgagcgattggcttaatgctaataacgtgcctgctacacctgtggcctggcctagtcaggagggacagaatccatccctgtcatccattcgcaaactaatacgcgacggcagcattgatctggtgataaacctccccaacaataatactaagttcgtccacgacaactatgtaatcagacgaacagcagtggattcgggcatacctctgcttactaatttccaggtgactaagctgtttgcagaggccgtgcagaaaagtaggaaggtggactctaaaagcctgttccattaccggcaatactcagccgggaaggctgct

SEQ ID NO: 8138 - DNA, 4500 bp, Artificial Sequence
  Description of Artificial Sequence: Synthetic coding sequence
atgactaggatattaactgcgtttaaagtggtcaggacactaaaaacagggtttgggtttactaacgttactgcccaccagaaatggaaatttagtcgacccgggatccgattactttccgtgaaagctcagactgcccatattgtgctggaagatggaactaaaatgaaagggtattctttcgggcacccctccagtgttgccggggaagtggtattcaacactggacttggaggatatcccgaagccataacagaccctgcctacaaaggacagatccttacgatggccaatccaattatcggaaacgggggggcaccagatactactgccctcgatgaattggggctcagtaaatatctggagagtaatggaatcaaggtttctgggctgctggtgctggattattctaaagattataaccattggctcgctacaaagagtcttggacagtggctccaggaagaaaaagtgcccgcaatatatggagttgatactcggatgctcactaaaataatacgggataaaggaactatgctggggaaaatcgagtttgaaggacagccagtggattttgtggatcctaacaaacaaaatttgatcgccgaggtatcaacaaaggacgtgaaagtctacggaaaggggaatcctacaaaagtcgtagccgttgattgtgggatcaaaaataacgttataaggctcctagtcaaacgaggagctgaggtgcatttagtaccatggaaccatgattttacaaaaatggagtacgatggaatcctcatagcaggggggcccggaaatccagcattagccgaacctctcatacagaacgtgcggaaaatcctagagagtgatcggaaagaaccattatttgggatatccactggaaatttaataacaggattagccgccggagccaaaacttataaaatgagtatggcaaacagagggcaaaatcagcccgtgttaaacatcactaataaacaggctttcatcactgcacagaatcacgggtatgcactcgataatactcttccagccggatggaagcctctgtttgttaacgtgaacgatcagacgaatgaaggaataatgcatgaatctaaaccattctttgcagttcagtttcaccccgaagttactcctggacccatagatacagaatatctctttgactctttcttttcattgatcaaaaagggaaaggcaacaacaatcacaagtgttctgcccaaaccagcccttgtcgcatctagagtggaagtgtctaaagtccttatcctcgggtccggagggctgtccatcggacaggcgggggaattcgactattcgggatctcaggccgtgaaagcgatgaaagaagaaaacgtgaaaactgttttaatgaatcccaatatagcttcagtgcagacaaacgaagtgggactcaaacaggctgatacagtgtatttccttcccattactccacagtttgtgacagaagtcatcaaagccgaacagcccgatggactgatattagggatgggggggcagacagcgctaaattgcggggtcgagctcttcaaacgcggagtgctgaaggaatatggggtgaaagtactggggacatcagtagagtcaatcatggctactgaagacaggcagctgttttctgacaaacttaacgagatcaacgaaaaaatagctccttctttcgctgtagaatcaatcgaagacgccctaaaagcagcagacactatcggatatccagtcatgatcagatctgcctacgccctgggaggactcggatctggaatctgccctaatcgggaaactttgatggatctgagtacaaaagccttcgccatgacaaaccagatcctagtagaaaaaagtgtgacagggtggaaagagatagaatacgaagtagtccgggacgctgacgacaattgtgtgacagtatgtaacatggagaatgttgatgcaatgggggtgcacactggggattctgtggtagttgcccccgcccagactctctctaacgccgagttccagatgttacgtaggacaagtatcaacgtagtccgccacctcgggatagtgggggaatgcaatatacagtttgccctccatcctacaagtatggaatattgtataatcgaggtaaacgcaaggctgagtagatcttcagccctcgcatctaaagccactggatatcctttggcatttatcgccgccaaaatcgccctcgggatacctctccccgaaataaaaaatgtagtctcaggaaaaacatccgcctgtttcgaaccctccctcgattacatggtgacaaaaatccctcggtgggacctggatcggttccatgggacgtcttcccggattgggtcttcaatgaaaagtgtcggggaagtgatggctatcggacgcacattcgaagaatctttccagaaagcactacgcatgtgccatccctctatcgagggatttacaccccgtcttccaatgaataaagaatggccctcaaatctagatctaaggaaggaactatctgaaccatcttccactcgcatctatgctatagctaaagccatcgacgataatatgtccctcgacgaaatagaaaaattgacatatatcgacaaatggttcctgtataagatgcgggatatattaaacatggaaaaaacattaaaggggcttaattcagaaagtatgactgaagaaactctaaaacgcgctaaagaaataggattctctgataagcagatatctaaatgtctcgggcttacagaagcacaaacacgcgaactaagactcaagaaaaatatccacccctgggtcaagcagatcgatactctcgctgcagaatatccatctgtgacaaactatctttatgttacatacaacgggcaggaacacgacgtaaactttgatgatcacggaatgatggtgctggggtgtgggccataccatattggatcatccgtggaattcgattggtgcgccgttagttctattcgaactctccgacagcttgggaagaagacagttgtggtgaattgcaatcccgaaactgtgtctacggatttcgatgaatgcgataaactctattttgaagagctttctctggaacgaatactcgatatatatcaccaagaggcttgtggagggtgcataatctctgtcggggggcagatccccaataatctcgcagtgcctttgtacaaaaatggagttaaaatcatgggaacttctccccttcaaatagatcgagctgaggaccggtctatattttcagccgtattagatgaactcaaggtcgcccaggctccctggaaagctgtcaacactctgaacgaggccctagagtttgcaaaatccgtcgattatccttgtctgcttagaccaagttatgtactttctggatcagccatgaacgtggtgttttcagaagatgaaatgaaaaagtttctcgaagaagctactcgggtctctcaggaacatcctgtagtactcacaaaatttgtcgaaggggcacgggaagtagagatggatgctgtcggaaaggatggacgagtcatctcacatgcaatctcagaacatgttgaagatgcaggagtccattcgggagatgcaactctcatgctgccaactcagacaatatcccaaggagcaatcgaaaaagttaaagatgccacacgtaagatcgccaaagcttttgctatctctgggccttttaatgtgcagttccttgtgaaagggaatgatgtcttggtgattgaatgtaatttgagagcctcgcggtccttcccctttgtttccaaaactctaggagtggactttattgatgtggccactaaagtcatgataggagaaaacgtggatgaaaaacacctccctacacttgatcacccaatcattcccgccgattatgtggctataaaagcaccaatgtttagttggccaaggctgagggacgctgatcccatactccgttgtgaaatggcatctacaggagaagtagcgtgttttggggaagggatacacacagcattcctcaaagccatgctgagtactggatttaaaataccacagaaaggaatcctcatcgggatacaacagtcttttcgccctaggttcttaggagttgccgagcagctacataatgaggggtttaaactgttcgccactgaagcaacatccgattggctaaacgcaaacaacgtaccagcaacacctgtcgcctggccatcccaggaagggcaaaacccctccctatcaagtattcgcaaactgattagggatgggtctatcgatctcgtgataaatctgcccaataataatacaaaattcgtacatgataactatgtaatcaggcggactgccgtggattctggaataccacttctgacaaacttccaggtgacaaaactcttcgctgaagctgtccagaaatcaagaaaagtcgattctaaatctctatttcattatcgccagtactccgctgggaaagcggca

SEQ ID NO: 8139 - DNA, 4500 bp, Artificial Sequence
  Description of Artificial Sequence: Synthetic coding sequence
atgacacgcattctgacagccttcaaggtcgttcgcacattgaagaccggattcggatttaccaacgtgactgcgcatcagaagtggaagttttcacggcccggaattcggctgctcagcgtcaaggctcaaacagctcatattgtgctggaggacggtactaaaatgaagggctattcctttgggcatccaagcagcgtcgcgggcgaagtagttttcaacactggactgggtggctatcctgaagccatcaccgatcccgcctataagggacagatactcactatggccaacccaatcatcggcaacgggggggctccagacacgacagcactggatgaactgggactgtctaagtacctggaaagtaatggcatcaaagttagtggcttgttagtgttagattacagcaaagactataaccactggctggccacaaagagtttgggtcagtggctccaagaggagaaagtgcctgcaatttacggcgtggatacacggatgctaactaagattattcgcgacaagggaaccatgctgggtaagattgaattcgaaggccagcctgttgattttgtggaccccaacaaacaaaatctgattgctgaagtatccactaaggacgtgaaggtctacggcaaaggcaaccctactaaagtggtcgccgtagattgtggcatcaagaacaatgtgatcaggcttttggtgaagaggggggctgaggtgcacttagtgccctggaatcatgattttactaaaatggagtacgacggaatcctgattgctggcggacctggtaatcccgctctcgctgaaccgttgattcagaacgtgaggaagatcctcgagtcagaccgtaaggaacccttgtttgggatcagtaccggaaatttgatcaccgggctagctgcgggcgccaagacttacaagatgtctatggccaataggggacagaaccagcccgtgttgaacataaccaacaagcaggccttcatcacagctcaaaatcacgggtatgcattggataacactctcccagcgggatggaaacctctatttgtcaatgtgaatgatcaaacaaatgagggaataatgcacgaatctaaaccattcttcgccgtccagttccacccagaagtgaccccggggccaatcgacaccgaatacctgttcgatagctttttctcactgatcaaaaaaggaaaggccaccacaatcactagcgtcttaccaaagcctgccctagtcgcttcaagagtcgaagtgtcaaaagtgctgatactaggaagtggagggctgtcaatcggccaggccggcgagtttgattattctggctcccaggccgtgaaagccatgaaggaagaaaatgtgaaaactgtgcttatgaatccgaacattgcttctgtacagacaaatgaagtgggactgaaacaggctgataccgtttacttcctccccatcacacctcaattcgtcacggaagtcattaaggccgaacagcctgatggcctgatcctgggaatgggaggacaaactgcactgaattgcggggtggaactgtttaaacggggggtactcaaggagtatggcgtgaaagtgcttgggacatccgttgagtcgatcatggcaacagaggaccgacagttgttttctgacaagctgaacgaaattaacgaaaaaattgccccaagctttgcagttgagagtatagaggatgccctgaaggcggcagacacaatcggataccccgtcatgatccggagtgcttacgctctcggaggacttggaagcggaatctgtccgaaccgcgagaccctgatggatctgagtactaaagcattcgcaatgactaatcagatcctggtagagaagtctgttacaggttggaaagaaattgaatatgaagtcgtgcgggatgcggatgataactgcgtaaccgtgtgcaatatggagaacgttgacgcaatgggagttcacactggggactcagtcgtggtagcgcccgcacaaacactcagcaatgctgagttccagatgttgcgccgtacctctatcaatgtggtgcgacacttgggaatagtgggagaatgcaacatccagtttgcgctgcaccctacttccatggaatattgtattatcgaggttaatgcacggctatccagatccagcgcgctggctagcaaggcgaccggatacccactcgctttcattgcagctaagatcgccctcgggattccgctgccagaaataaagaacgtggtgtcggggaagacaagcgcgtgttttgaaccttccctggactacatggtcaccaaaattccccgatgggaccttgatagattccatggtacatcttcacgtatcgggtcatccatgaagtccgtcggagaggtcatggctattgggaggactttcgaggaaagctttcagaaggcacttcggatgtgtcatccatccattgaagggttcacccctcggctgccgatgaataaggagtggccttccaatctggatctccgtaaagaactgtcagagccaagctctactcgtatctacgctatagctaaggccatcgacgataacatgtccctagatgagatcgagaaactaacgtatatcgataaatggtttctgtataaaatgcgggatatattgaatatggaaaagaccctgaaagggttaaacagtgagagcatgacagaagagacattgaaacgcgcaaaggaaatcgggttttctgataagcagattagcaagtgcttaggcctgaccgaggctcagactcgggaactccggctgaagaaaaatatccacccttgggttaaacagatcgacactctggctgcggaatatccatccgtgactaactatctgtacgtcacgtataacggtcaggaacacgacgtgaatttcgacgaccacggtatgatggtgctgggatgcgggccataccacatcgggtccagtgtcgagttcgactggtgcgctgtgtcaagcattcggacactgaggcagctcggcaaaaaaaccgtcgtagtcaattgcaatcccgagactgtcagtactgatttcgacgagtgcgataaattgtactttgaggagctatctctggagagaatcttagatatctaccatcaggaggcttgcggcggctgtattatttcagttggcggccaaattccaaataatttggctgtgccactatacaagaatggagtaaaaatcatggggaccagtccactccaaatcgatagagccgaagacaggagcatcttttctgccgtgttggacgagttaaaggtcgctcaggctccgtggaaggcggtgaataccctgaatgaagccctggagtttgccaaatctgtcgattacccctgcctactgagaccatcttacgtgctgtccggtagcgccatgaacgtggtgttcagcgaagatgaaatgaagaagtttctggaagaggccacccgtgtgagccaggagcatcccgttgtactgaccaagttcgtggaaggtgcacgcgaggtggagatggacgctgtggggaaggatggccgcgtgatctcgcatgccatctctgaacacgtggaggacgcaggggtgcacagtggtgacgccacattaatgctccccacccagactatttcccagggggcgatcgagaaagtgaaggatgccactcgtaaaattgccaaggcgtttgcaatttctgggcctttcaacgtgcagttcctcgtgaagggcaacgatgtcctcgtaatagaatgtaatctgcgggccagccgctctttcccatttgtgagcaagaccttgggggttgacttcatcgacgttgcaaccaaggtcatgatcggggagaatgttgacgaaaaacacctgccaactctagaccaccccataatccctgcggactatgtcgctattaaggcccccatgttctcctggcccaggctccgtgacgccgaccctattttacgctgcgagatggccagcacgggcgaagtcgcatgctttggcgaaggaatccacactgcgttcctcaaagccatgctgagcaccggctttaagatccctcaaaaaggcatccttatcggtatccagcagagcttcagacccagattcttgggtgtagccgagcagctccataatgaagggttcaaactttttgcgacagaggccacctccgactggcttaacgcgaacaatgtgccggcaacgccagttgcttggccttcacaggaggggcagaacccttctctgtccagtattcgaaagttgatcagggatggatctatcgacctggttatcaacctccccaataataacaccaaatttgtgcatgataattatgtgattcggaggactgctgttgactccgggattcctctgctcactaatttccaggtgaccaagctatttgccgaagccgtccagaagtccagaaaggtcgattcgaagagtctcttccactaccggcagtatagcgccgggaaggcagct

SEQ ID NO: 8140 - DNA, 4500 bp, Artificial Sequence
  Description of Artificial Sequence: Synthetic coding sequence
atgacaaggattctcacagcgtttaaagtcgttagaactctcaagaccggattcggtttcactaatgtgactgctcaccaaaagtggaaattctctcgcccaggaattaggcttctgtctgtgaaagcccaaactgcgcacatcgtcctcgaggacggaaccaagatgaaaggctactctttcggtcatccttcttccgtggctggtgaagtggtgttcaatacaggtctgggaggctaccctgaagctattactgatccagcttacaagggtcagatactcaccatggctaacccaattattggtaatggaggagcccctgataccactgccttggatgagctgggtctgagtaagtacctggaatccaatggaatcaaggtgagtggtttgctggtgttggactacagcaaggactacaatcattggctggcaactaagtcacttggtcagtggctgcaggaagaaaaggttccagccatttatggagttgacactagaatgttgaccaagataatcagagacaagggaactatgctgggaaagatcgagttcgagggacaacctgtggattttgtggacccaaacaagcaaaacctcatcgctgaagtctccaccaaagatgtgaaagtttatggaaagggcaaccctaccaaagtggtggcggtcgattgcggtattaagaataacgtcataagactcctggttaagagaggcgctgaggtgcatttggttccgtggaaccacgacttcaccaagatggaatatgacggaatcctcatcgcaggcggtccgggcaacccggctctcgctgaaccacttatccaaaacgtgcgcaagattttggagtcagataggaaggaacctctgttcggaatttcaactggcaacttgatcacgggcctggccgctggagctaagacatacaagatgagcatggcaaatcgcggtcagaaccaacctgtcctgaacatcactaacaagcaggcgtttatcaccgcccagaaccacggctacgctctggacaacacactgcctgctggctggaagccattgtttgtcaacgtaaacgaccagaccaacgagggtattatgcacgaatctaaaccattttttgccgtacagtttcatccggaggtcacgccaggacccatcgacaccgaatatttgttcgactctttcttctccttgattaagaaaggaaaagctaccaccatcacttcagtccttcctaagcctgctctggtggcttccagagtcgaagtgtccaaagtgcttattctgggtagcggtggtctgtctataggacaagctggtgagttcgactactctggcagtcaggctgtgaaagcgatgaaagaagagaacgtgaagaccgttctgatgaatcctaatatcgcctctgtccagaccaacgaggtcggtcttaagcaagcggataccgtttattttctgcccatcaccccccaattcgtgacagaggtgatcaaagcagagcagcctgatggcctgatccttggcatgggcggacaaacggccctcaactgtggagtagagttgtttaagagaggcgtactcaaggagtatggtgttaaggtattgggaacctcagtagagagcataatggccacggaggacaggcaactcttcagcgacaagctgaacgagattaatgaaaagattgctcccagtttcgctgtggaatctatcgaagacgctttgaaagcagccgatactattggttatcctgttatgattcgctctgcctacgctcttggcggtttgggttccggtatctgtcccaacagggaaaccctgatggacttgtcaaccaaggctttcgcgatgacaaaccaaatactcgtggagaagagcgtgaccggttggaaagagattgaatacgaggtggtaagagacgcagacgacaattgtgtcaccgtctgcaacatggagaacgttgacgctatgggtgtgcatactggcgacagcgtcgtggttgctcctgcccagacattgtctaatgcagagtttcagatgctgagaagaacgagcattaacgtggtacgccatctgggcattgtcggtgaatgcaatatacagttcgctctgcatcctacttccatggagtactgtatcatcgaagtcaacgccagactgagcaggtcatctgctctggcttctaaggcgacgggctacccgctcgcttttatcgcggctaagatagctttgggtattcccttgccagagatcaagaatgtcgtgtcaggaaagacttctgcttgcttcgagccaagcctggattacatggttactaagatccctagatgggacctcgatcgctttcatggaaccagctctcgcatcggatcctctatgaaaagtgtgggcgaagtgatggccatcggaagaacattcgaagagtcatttcagaaagcgctcagaatgtgccacccctccattgagggcttcacgcctaggctcccgatgaacaaagagtggccaagcaacttggatctcagaaaggaactctccgagccgtcatctaccagaatttacgctatcgccaaagctatcgatgataacatgtctctcgacgaaatagagaaactgacctatatcgacaaatggttcctgtataagatgagagacattctgaacatggagaagacactgaaaggtttgaactccgaatccatgaccgaggagaccctgaagagggcaaaagaaattggattctcagataagcagatctcaaaatgcctgggacttacagaagcacaaactagagaactccgcttgaagaagaatatccatccctgggtaaaacagatcgacactcttgcggctgagtacccgagcgtgaccaactacctgtatgtcacatataatggccaagagcatgatgtcaacttcgacgaccacggaatgatggtgctgggctgcggcccgtaccacataggatccagtgttgagttcgattggtgcgctgtgtcatcaatacgcaccctgagacagctgggaaaaaagacggtcgtggtgaactgtaatccagagactgtgtcaactgatttcgacgagtgcgataagctctacttcgaggaactgtcactggagaggattttggatatctatcaccaggaagcctgtggcggatgtatcattagtgtaggaggccagatcccgaacaatctcgctgttccgctctacaaaaacggtgtgaagataatgggtactagccctcttcaaatagaccgcgcagaggatagatctattttctctgccgttctggacgagttgaaggtggcccaggccccgtggaaagcggtgaacactctgaatgaggccctcgagtttgccaaaagcgtcgactacccttgcttgctgagaccatcctatgttctttctggctctgcaatgaacgtagtcttctccgaggacgagatgaagaagttcttggaggaggccacaagggtttcacaagaacacccagttgtcctcaccaaattcgtagagggcgcacgcgaggtggagatggatgctgtgggcaaggatggccgcgttatttctcatgccatctccgaacatgtcgaggacgctggcgtgcactcaggcgatgctactctgatgctgcccacgcaaactatttcacagggtgcgatcgagaaagtcaaggatgcgacccgcaaaattgccaaggcattcgctatcagcggacctttcaacgtacagttcctggtgaagggaaatgatgtacttgttatcgagtgcaatctcagggcctcccgctcatttccttttgtgtccaagaccttgggtgttgacttcatcgatgtcgcgacgaaagtgatgatcggtgaaaatgtggacgagaagcatttgcctaccctcgaccatcctattattccggctgattacgttgccatcaaagcccccatgttcagttggcccagacttagagatgccgatcccattcttaggtgtgaaatggcttcaacaggtgaggtcgcctgtttcggagagggaattcacactgctttccttaaggcgatgctttccacaggatttaagatcccccagaagggaattctgatcggcattcagcaatctttcaggccgaggttcctcggcgtagctgaacagctccacaacgagggctttaagctgtttgccaccgaagcgactagcgactggctgaacgcaaacaacgtaccggccacgcctgtggcttggcccagccaggaaggccaaaacccgtccttgtcatccattcgcaagctgattcgcgacggatctatcgatcttgtgattaatctgcccaataacaacacaaagttcgtgcatgacaactacgtgatcagaagaaccgccgtagacagcggtattcccttgctgaccaatttccaggttacaaaattgtttgcggaggctgtgcaaaagagcagaaaggtggactccaaatccctgtttcattataggcagtactctgcaggcaaggccgca

SEQ ID NO: 8141 - DNA, 4500 bp, Artificial Sequence
  Description of Artificial Sequence: Synthetic coding sequence
atgacccgtattctgacagcttttaaagttgtgcgaacgctgaagacaggttttgggttcaccaacgtcaccgcccatcaaaagtggaaattctcacgcccaggaatacgtctgttgtcggtcaaggcccagacagctcacattgtcctggaggacggcaccaagatgaagggctacagcttcggccacccgtcaagtgtggccggagaggtcgtgttcaatacgggcctaggcgggtatccggaggccatcacggatcccgcgtacaagggtcagattctaaccatggccaatccaattattggtaatggaggggcgcctgacacgaccgcgttggacgaactcggactgagcaagtacctagagtcaaacggaatcaaagtgtccggactgctcgtcctcgattactcgaaggattacaatcactggctggctacgaagtcgctcggccagtggctgcaggaggagaaggttcccgccatatacggcgttgatacccggatgctaacgaagatcatccgcgacaaaggcaccatgctaggcaagatcgaatttgaaggacagcctgtggatttcgtggatcccaataaacagaaccttatagctgaggtttccacgaaggacgtgaaggtctatggtaaaggcaatcctaccaaggtggtggccgtggactgtggcatcaaaaacaacgtgatccgtctgctggtgaagcgtggagctgaagtgcacctggtcccctggaaccatgatttcacaaagatggaatacgacggtatcctaattgctggaggccccggcaaccccgccctcgcagagccactgatccagaacgtgcgtaagatcttagaatcggatcggaaagagccactcttcggaatttccaccggcaacctaattacaggactggccgcaggcgcaaaaacctataaaatgtcgatggccaaccgcggacagaaccagcccgtgctgaacataacaaacaaacaagccttcatcacagctcaaaatcacggctatgctctggataacacactgccggcgggctggaaaccgctgtttgtcaatgttaacgatcaaaccaacgaggggataatgcacgagtcaaagcctttcttcgccgtgcagtttcatcccgaggtcaccccgggacccattgatactgaatatctgttcgattcgttcttttcactgatcaagaagggcaaagccaccaccattacctccgtgttacccaaacccgcattggtggcgagtagggtcgaggtgagtaaagtcttgatcctaggctcgggcggacttagcatcggccaggccggtgagttcgactactcggggtcccaggctgttaaggccatgaaagaggagaacgtaaagaccgtattgatgaatccgaatatcgcttcggtacaaacgaacgaggtggggctgaagcaggcagatacagtatactttctcccaattacgcctcagttcgtgacggaggtcataaaggcagaacagccggatggcctgattttaggtatgggaggccaaacggccctgaactgcggcgtggaactctttaagcgcggagtcttgaaagagtacggagtgaaggtcctgggaacatcggtcgagtcgatcatggctacagaggatcgccaactgttcagcgacaagttgaatgaaataaacgagaagatcgccccaagctttgctgtggaatccattgaggatgccctgaaggcggctgacaccataggctacccagtcatgatcaggtctgcatatgcgctgggtggactggggtcgggaatttgcccaaaccgggagactttgatggacctgtcgaccaaagccttcgccatgactaaccagattctggtagaaaagtccgttaccggctggaaggagattgagtatgaagtcgtgcgcgacgcggatgataattgtgtcaccgtctgcaacatggagaatgtggatgcgatgggagtgcacacaggcgacagcgtggtcgtcgcacctgcacagaccctctccaatgccgagtttcagatgctgcgccgcacgagcattaatgtcgtaagacatcttggaatcgttggcgaatgcaatatacagttcgctttgcatccgacctcgatggagtactgtattattgaagtcaacgcacgcctgtcgcgcagtagcgcgcttgcctcaaaggccacaggttacccgctagcatttattgccgcgaagatagcgctaggaatcccccttccggaaattaagaatgttgtctcgggtaaaacatcggcatgcttcgagcccagtttagactatatggtgacaaagattccacgctgggacttggaccgctttcacggtacctcctcccgcattggaagctcgatgaagtccgtgggtgaggtaatggccattggtcggacatttgaggagtcgttccaaaaggcactgcgcatgtgccatccgagcattgagggctttaccccgcgtctccccatgaataaggaatggcctagcaatctggatctcagaaaagagttgtccgagcctagcagcacccgtatctatgcaatcgcgaaagccatagatgataacatgtcgctcgacgagatagaaaaactgacctacatcgacaagtggttcctgtataagatgcgtgacattctgaatatggaaaagactcttaagggactgaactccgagagcatgacagaggaaactttgaagcgcgctaaggagatcgggttctctgataagcagatctccaagtgcttaggattgactgaagcccagacccgggagttgcgcctgaagaagaacattcacccttgggtaaagcagatcgacaccctagccgcagagtacccatccgtaacaaactacctttatgtgacgtacaacggacaggagcacgacgtaaacttcgacgatcacggcatgatggtcttgggatgcggaccgtaccatatcggctcctccgttgagttcgattggtgcgctgttagttcgattcgtactctgcgccagctaggcaaaaaaacggttgtcgttaactgcaacccagagacagtgagcactgacttcgacgagtgtgataagctgtacttcgaggaactgtccctggaacgcattctggatatataccaccaggaagcctgcggcggctgcatcatctccgttggaggacagatccctaacaacctggcagtcccgctctacaagaacggtgtgaagatcatgggcacttcgccgctgcagattgatcgagctgaagaccgttccattttttccgctgtcctggatgagctgaaggtggcacaggctccctggaaggccgtgaatacgcttaacgaagccttggaatttgccaagagcgtagactatccctgtctgttgaggcctagctatgtgctgtcgggcagtgctatgaacgtggttttttcggaggatgaaatgaaaaagttcctggaagaagctacacgtgtgtcgcaggagcacccggtggtactgacgaagtttgttgaaggcgccagggaggtcgagatggacgccgttggcaaagacggccgtgtgattagccatgccattagtgaacacgtggaggatgctggcgttcacagcggtgatgccacgctgatgcttcctacacaaactatttcccaaggggcgatagagaaagtcaaagatgccactcggaagattgccaaggcattcgcaataagcggtccattcaatgtacaattcctggtcaagggcaacgatgtgctggtgatcgagtgcaatttgcgagcctcccgcagttttcccttcgtgagcaaaaccttgggcgttgatttcatagacgtggcgaccaaagttatgataggagagaacgtagacgagaagcatcttcccactctcgaccacccgataatcccggctgattacgtcgccatcaaggcccctatgttctcttggccgaggttgcgagacgccgatcctattcttcgctgcgagatggctagcaccggtgaggtagcctgtttcggcgagggaatacacacagccttcctgaaggctatgctgtccaccggctttaagataccgcaaaagggtattttgatcggtattcaacagtcattccgtccgcgtttcctgggcgttgctgagcagctccacaacgaaggattcaagctgttcgcaactgaggctaccagcgactggctgaatgcgaacaatgtgcccgccaccccagtggcttggccgagtcaggaggggcagaacccatctctgtccagcattcgcaagcttatccgagacggttcaatcgatttggttattaatctgcccaacaacaatacaaagttcgtgcacgacaactacgtcattcgacggaccgcggtcgatagcggtattccgctcctcaccaactttcaggttacgaagctgttcgcagaggctgtgcaaaagtcgaggaaggttgattctaagtcgctgttccattacagacagtactcggctggaaaagccgcc

SEQ ID NO: 8142 - DNA, 4500 bp, Artificial Sequence
  Description of Artificial Sequence: Synthetic coding sequence
atgaccaggattttgaccgcattcaaggtggtccgcacattaaagacaggattcggcttcacgaacgtgacagcgcaccagaaatggaagttctcacgacccggcattcggttgttatcagtcaaagcgcagactgctcatatagtccttgaagacggcaccaaaatgaagggctattctttcggccacccatccagcgtcgccggtgaagtggtgttcaacacaggcttgggaggctatcccgaagctataactgaccccgcctataagggccagattttaactatggccaatcctatcatcggtaatggcggcgcccctgacaccacagcattggatgaattggggctgtcaaagtacttggagtcaaatggtataaaagtgtctgggcttttagtgctcgattacagcaaggactataatcactggctcgcaacaaagtcactgggccagtggctccaggaggagaaggtgcccgccatttatggtgttgataccaggatgcttaccaagatcatcagagacaagggcacaatgttgggaaaaatcgaatttgagggccagcccgtcgacttcgtggatccaaacaaacagaaccttatcgcagaggtgtctaccaaggacgttaaggtgtacggcaaaggaaaccccaccaaagtcgtggcagttgactgtggcatcaaaaataacgtaatcaggctgctagtcaaaaggggcgccgaagtgcatctcgtcccctggaaccacgatttcacaaagatggagtatgatgggatcctcattgccggcggtccaggcaacccagccctggcagagccactgatccaaaacgtgcggaagatcctcgaaagcgaccggaaggaaccactgttcggcattagtacaggcaacttgatcaccggacttgccgctggcgcgaaaacgtataaaatgtcaatggctaatagaggtcagaatcagcctgtcctgaacatcacaaacaaacaggctttcattaccgcccagaatcatggatacgccctcgataatacgttgcctgctggatggaaaccgctgtttgtcaacgtcaacgaccagacgaacgagggaatcatgcatgaaagcaagccttttttcgccgtccagtttcatcccgaggtgactccaggtcctatcgacaccgaatatctatttgactctttcttctctctgatcaaaaaaggcaaagcaaccaccattactagcgtgcttcccaagccagccctagtagcatcccgcgtagaggtgtcaaaggtgttgatactgggctcagggggcctttcgatcggccaagccggcgaatttgattactcgggatctcaagcggtgaaggcgatgaaggaagaaaacgtgaagacggtcctgatgaacccgaacattgctagtgtacagaccaacgaagttgggctcaaacaagctgatacggtgtattttctgccaataacaccacaatttgtgaccgaggtgattaaggctgagcagcccgacggcctcatcctggggatgggggggcaaacagctttgaattgtggggttgagctgttcaagaggggggtacttaaggaatacggtgtcaaggtcctaggcactagtgttgaatccataatggccaccgaagatagacagctgttcagcgacaagctgaacgaaattaatgagaaaatcgccccctctttcgccgtagagtcgatcgaggacgccctgaaggccgcggatacgattggttatcctgtcatgatccgcagtgcctacgcgctgggagggctagggagcggcatctgcccgaatagggaaacccttatggatctgagcaccaaggcttttgctatgaccaaccagatcctggtggaaaagtctgtgaccgggtggaaggagatcgaatacgaggtcgtacgcgacgctgacgacaattgtgtgaccgtgtgcaatatggaaaatgtggatgcaatgggggtccacaccggtgattctgttgtcgtcgctcccgctcagacactgagcaacgctgagttccaaatgctgcggaggacctctattaacgtagtaaggcatctgggcattgtgggggagtgcaacattcagtttgctctccatccgacttcaatggaatattgtattatcgaagtcaatgctagactgagccgcagcagcgctctcgcttctaaggctactggctaccctctggccttcatagcagcaaaaatcgccctcggcatccctcttccagagataaagaatgtggtgagcgggaagaccagcgcatgcttcgagcccagcctagattatatggttacaaagatcccgcggtgggacctcgatcggttccatgggacttctagcaggatcggttcaagtatgaaaagcgtgggggaagtcatggccatcggacggacatttgaagaatcctttcagaaggcacttcgcatgtgccacccatccatcgaaggcttcacaccgaggctccccatgaataaggaatggccatctaatctcgacctaagaaaagagttaagtgagccatctagcacaagaatttatgcaatagctaaggcaatagacgataatatgtccctagacgaaatagaaaagctgacgtacatagataaatggttcctatataaaatgcgggacattcttaatatggagaagactttaaaaggcctgaattccgaatcaatgactgaggagacattgaaacgggccaaggagatcggcttttccgataagcagatctctaaatgtctgggacttaccgaggcccaaaccagggagctccggttaaagaaaaacatccatccctgggtaaagcagattgacaccctggctgcggagtacccaagcgttacaaattacctttatgtgacgtataatggccaggagcatgatgtgaacttcgacgaccacgggatgatggtccttggatgcggcccatatcatatcggatctagtgtggagttcgactggtgcgccgtgtcctctatacgcactctgcgccaactgggcaaaaagaccgtagtcgtgaattgcaacccagagaccgtttccacagatttcgatgagtgcgataaactctactttgaagagctgtccctggaacggatacttgatatttaccaccaggaagcatgtggcggttgcatcatatccgttggggggcaaatcccgaataacctcgcggtacccctgtacaagaatggcgtgaagatcatgggcacctcccctcttcagatcgaccgagcagaagacaggtccattttctctgccgttctcgacgaactcaaagtggcccaggcgccgtggaaggcagtgaatacgttaaacgaagctctcgaatttgctaagtccgttgattacccatgtctgctccggccttcgtatgtgttgtctgggtcggcaatgaacgtggtgttctccgaggacgagatgaagaagttccttgaagaagccacaagagtgtcacaggagcacccggtggtcctgacaaagtttgtggaaggcgctcgggaggtggagatggacgctgttgggaaagatggccgggtcatctcacatgccatcagcgagcatgtggaggatgctggggtgcactctggagacgcgaccttgatgcttccaacccagacaatctctcagggagccatagagaaggtgaaagatgcaacccgaaaaatcgctaaggccttcgcaatttctgggccctttaacgttcagttcctagtaaagggaaatgacgttttggtcatcgagtgtaacttgagggcctctcgcagctttccattcgtttcaaaaaccttaggggtggactttatagacgtggcaaccaaggtgatgatcggggagaacgtcgatgagaagcacctgcctacactggaccaccccattattcccgcagactacgtggctataaaggcccctatgttttcctggcctcggctacgggacgctgaccccattctgaggtgcgagatggcatctactggagaggtggcgtgtttcggagaggggatccatactgcctttctgaaggcaatgctgtcaacaggctttaagataccacagaaggggattctcatagggatacagcagagtttccggcccagattccttggggtagcggaacaactgcacaacgagggcttcaaacttttcgctacagaagctactagcgattggcttaacgcgaacaacgtgcctgccactcccgtggcgtggccctctcaggaagggcagaacccttctctctcttccatcagaaaactcataagagacgggtccatcgacctcgtgatcaacctcccgaataacaacacgaagtttgtccacgataactatgtaatcaggaggaccgcagtggactcaggtattcctttgctcaccaacttccaggttaccaagttatttgccgaggccgtgcagaagtcccgcaaggtggatagcaagtccctatttcattacaggcagtacagtgctggaaaagcggca

SEQ ID NO: 8143 - DNA, 4500 bp, Artificial Sequence
  Description of Artificial Sequence: Synthetic coding sequence
atgacccgcatactgacggcattcaaagttgtccggaccctgaaaacgggcttcgggtttactaacgtaacagcgcaccaaaaatggaagttttccagaccaggaatacggctattaagcgtcaaggcccaaactgcacatatagttctggaggatggcactaaaatgaagggttacagttttggccatccatcttccgtcgctggagaggtggtctttaacaccggcctgggaggctacccggaggctattaccgaccccgcgtacaaaggacagattctgactatggcaaatcctataattggcaacgggggcgctcctgacactactgccctggacgaactgggcctgtcaaaatatctagaatcgaatggtataaaagtctcaggtctgttagtgctcgattatagtaaagactacaatcactggctggcaacaaagtccctcggtcaatggttacaggaagaaaaggtgcctgccatctatggcgtggatacacgcatgcttaccaagataatcagggataaaggaacaatgctggggaaaatcgaatttgaagggcagcccgttgattttgttgatccaaacaaacagaacctgatcgccgaggtgagcactaaggacgtaaaggtctacggaaaggggaatccaacgaaagtggtcgctgttgactgtgggataaagaacaacgtgatccgcctgctggttaagaggggggctgaggtccacctagtgccttggaatcatgatttcacaaaaatggaatacgacggcattctgatcgccggtggacccggcaatcctgccttggccgaaccactgatacagaatgtgcgcaaaatcctagaatctgacaggaaggaacctctgttcggtatcagcacggggaacctcattacgggtctggccgcaggagcaaagacctacaagatgtcgatggcaaacagagggcaaaaccagcccgtgctgaatattacaaacaaacaggccttcatcactgctcagaatcatgggtatgcgctggacaataccctgccagccggttggaagccactgttcgtcaacgttaatgatcagacaaatgaaggtattatgcatgagtccaaacctttcttcgctgtacaattccatcccgaagtgactccagggccgatcgatactgagtacctgtttgactcttttttctccctgattaagaagggtaaggctaccacaataacttctgtccttcccaagcctgcactggtcgcaagtcgcgtggaggtatctaaggtcctaatcctggggagcgggggactgtccatagggcaagccggcgagtttgattactctgggtcgcaagcagtgaaggcgatgaaggaggagaacgtgaagaccgtgcttatgaaccctaatatcgcatctgtacagactaacgaggtgggactgaaacaggcagacaccgtttatttcttacccattacaccccagtttgtcacggaggtaataaaggctgaacaacctgatgggcttatcttaggcatgggcggtcaaacagctctgaactgtggcgtggagctattcaagcggggcgtactcaaagaatatggcgtgaaagtgctgggcacgtctgtagagtctataatggcgacagaggacagacaactgttcagcgacaagcttaacgagataaacgagaagatcgcaccctctttcgcggtggaaagcattgaggatgcgctgaaagccgccgacactatcggatacccagtgatgattagatcagcctacgcactgggaggccttggctctgggatttgcccgaacagagaaaccctgatggacctgagcacaaaggccttcgccatgaccaaccagatcctggtggaaaaaagcgtgacaggctggaaggagattgaatatgaggtagtgagagatgcagacgacaattgtgtgaccgtgtgcaatatggagaacgtggacgctatgggagtccatacgggagactctgtggtggttgctccagcccagaccttgagcaacgcagagttccagatgctcagacgtactagtattaacgtggttcgtcatctgggaatcgtgggcgagtgcaacattcagttcgccctacaccctaccagcatggagtactgcattatcgaggtgaatgcgcgcttgagccgctcgtccgcactggcctcaaaagctactggctatcccctcgccttcatcgccgcgaaaatcgcacttggcatccctcttccagaaatcaagaatgtggtgagcggaaagacaagcgcctgcttcgaaccttccctggactatatggtaaccaagatacctcgctgggatctcgaccgcttccacggcacaagctcccggattggttcatcgatgaagagcgtgggagaggtaatggccataggaaggacattcgaggagtcattccagaaggctctcagaatgtgccacccatcaatcgaaggatttaccccacgactgccgatgaataaagaatggccatcaaatttggacttgagaaaagaactttccgagccttcatcaaccagaatatacgcgattgcaaaggccatcgacgataacatgtccctggatgagatcgagaagctcacttacatcgacaagtggtttctgtataaaatgagagacatccttaacatggaaaaaaccctgaaggggcttaactcagaatccatgacagaggaaacattgaagcgtgccaaggaaatcggatttagcgataaacagatctccaagtgtctgggtctgactgaggctcagacccgagaactgcgcctgaagaagaacattcatccatgggtcaaacagatcgacaccctagccgccgaatatcccagtgtgactaattacctgtatgtgacttataatgggcaggaacatgacgtgaactttgatgaccacggcatgatggttctcggatgtggaccttatcacattgggtccagcgtcgagttcgactggtgcgctgtctcttcgattaggaccttgaggcagctgggcaagaagacagttgtggtgaattgtaacccggaaacagttagcacagacttcgacgagtgtgacaagctgtacttcgaggaactgagcttggaacgtattctggatatttatcaccaggaagcctgtggaggttgcattatcagcgtcggcggccaaatccctaacaatctggccgtcccactttataaaaacggcgtgaagataatggggacctctcccctgcaaatcgatcgcgccgaagataggtccattttttctgccgtgctagatgagctgaaggtggcccaggctccctggaaagctgtcaacaccctgaatgaggccctggagttcgccaagtcagtcgattacccctgtctcctaagaccctcttacgtgttatccgggtctgcgatgaatgtggtgttctctgaagacgaaatgaagaaattcctggaggaagccacgcgtgtaagtcaggaacatccagttgtcctgaccaaatttgttgagggcgctcgggaagtagagatggacgcagtcgggaaggacggtagggtgataagccatgcgataagcgagcacgtcgaggacgctggcgtccatagcggggacgctacgcttatgttacccactcagacgatcagccagggtgcaatcgaaaaggtcaaggacgctactcggaaaattgccaaagctttcgccatctccggtccgttcaacgtgcagttcctagtgaaaggaaacgacgtgctggtaatagaatgcaacctccgagcctccaggtcatttcctttcgtgtccaagacccttggagtcgacttcatcgacgtggctaccaaggttatgattggcgaaaatgtagatgagaaacatttacctactctcgaccacccaatcatcccagccgactacgttgctatcaaagcgcccatgttctcatggccccgattgagagatgccgaccctatcctacgctgcgaaatggcgagcactggagaggtggcatgcttcggggagggcattcacacggcattcctgaaagcaatgctatcgacaggctttaaaatcccccagaagggcattttgattgggattcaacaaagcttcaggccaagattcctcggcgtggccgagcagctgcataacgagggctttaagctgttcgcaactgaagcgaccagcgattggctgaacgcaaataacgtgcctgcgacccctgtagcctggccaagccaggagggtcagaacccttcgctgtcatcgatccgcaagctgataagggatggctctattgacctggtgataaacctgcccaataacaacacaaagttcgtgcatgacaattacgtcataagaaggactgctgtcgattcaggcatacctttactcacaaattttcaggttacgaagctgttcgctgaggccgtgcagaagagcagaaaggtagattcgaagtctctgtttcactatagacaatacagcgcaggtaaagcagcg

SEQ ID NO: 8144 - DNA, 4500 bp, Artificial Sequence
  Description of Artificial Sequence: Synthetic coding sequence
atgacacggatactaacagctttcaaagtggttcggaccctcaagacaggcttcggctttactaatgtcacagctcatcagaaatggaagttcagtcgcccaggaattagactgctgtctgttaaggctcaaacagcccacatcgtgctggaggacggcacaaagatgaaaggctatagcttcgggcatccaagttccgtcgcaggcgaggtggtctttaacacaggcctgggcggctaccctgaagccatcacagaccctgcctacaaggggcagatactgacaatggctaatccaataatcggcaacggtggggcccctgacaccaccgcccttgatgaattagggctcagcaagtatctggagtctaatggcataaaggtgtccggcctgctggtgctggactactctaaagattacaaccactggctggcaacaaaatcactggggcaatggctgcaggaggagaaagttccagcaatctacggcgtggacactaggatgctgactaagataattcgcgacaagggaacaatgctgggcaagatcgaatttgaagggcagccagtggacttcgtggaccctaacaagcagaacctgatcgcagaggtgtcaaccaaggacgtgaaggtgtacggaaagggtaacccaactaaggtggttgctgttgactgcggcatcaaaaataatgtgattagactgttagtcaagcggggcgccgaggtgcatttagtgccatggaaccacgattttactaagatggaatatgacggaatcctgatcgcaggaggcccaggcaacccagcccttgctgaacctttaattcaaaacgtccggaagatcctggagagtgaccgtaaggagcctcttttcggcatatctacaggaaacctgatcaccggccttgccgctggcgcaaaaacctacaagatgtcaatggcaaatcgcggtcagaaccagcctgtgctgaacattacaaataagcaggctttcattactgcccagaatcacggctacgctctggataatacactgccagccggctggaagcctctgttcgtaaatgtaaacgaccagaccaacgaagggataatgcatgagtcaaaaccctttttcgccgtccagttccacccagaggtgacacccggccctattgatactgaatacctgtttgactccttcttctctctgataaagaaaggcaaggctaccaccatcacaagcgtgcttcctaagcccgctctggtggctagcagggtcgaagtaagcaaggtgctcatcctgggcagtggtggcctgagcattggccaggcaggggaattcgattatagcggctctcaggctgtgaaagccatgaaagaagagaatgtcaaaaccgtactgatgaatcccaacatagccagcgtgcagacaaatgaggttggtctgaaacaagccgacaccgtgtacttcctccccatcacaccccagttcgtgacagaagtgataaaggctgaacagcctgacgggctgatactcggcatgggaggtcagacagcactgaactgtggggtcgagctgttcaagcggggggtcctaaaggagtacggcgtgaaggtcctggggaccagcgtcgagagcattatggccactgaagaccgccagctctttagcgacaaactgaacgagatcaacgagaaaatcgcacctagtttcgctgtagagagcattgaggatgccctgaaagcagctgatactatcggctatccagttatgataagatctgcctacgctctgggcggattaggctccggaatctgtccaaatcgggaaaccctgatggacctctctaccaaggcattcgcaatgacaaaccagatcctagtggaaaagagcgtcactggttggaaagagatagagtacgaagttgtgagggacgctgatgacaactgcgtgaccgtctgcaatatggagaatgtggacgccatgggagtacacacaggggacagcgtcgttgtcgcccctgctcagaccctgtccaacgctgaatttcagatgctgaggcgcacctctataaatgtcgttcgccacctgggcatcgtaggcgaatgcaatatccagtttgccctgcaccccacttccatggagtactgcattatcgaggtgaatgctcgactctcacggtccagcgcactggcatctaaagccaccgggtaccccctcgcttttatcgctgccaagatcgccctcggcatcccattacccgaaattaaaaatgtagtgtcaggtaagacttcagcctgcttcgagccttcccttgactatatggttaccaaaattccacgctgggacctggaccggtttcatggaacctcttcccgcataggttcctctatgaagtctgtaggggaggtgatggctattggtcgaaccttcgaagagagtttccagaaagccttaagaatgtgtcacccatccatcgaggggtttacacccaggctcccaatgaacaaggagtggcccagtaacctggacctaagaaaagagcttagcgaaccaagttccaccaggatttatgccatagccaaagctatcgacgacaacatgagtttagatgagatagaaaagctgacttatatagacaagtggttcctgtataaaatgcgggatatactgaatatggaaaaaacactgaaggggctgaactccgagtctatgaccgaagagacattaaagagggcaaaagagattggctttagcgacaagcaaattagcaagtgtttaggccttaccgaggcccagacaagagaactgagactcaaaaagaacattcacccctgggtcaagcaaatcgataccctggcagccgagtacccaagcgttaccaattatctgtatgtcacctataacggacaggaacacgatgtgaattttgatgaccatggaatgatggtgctgggctgcggaccctatcacataggaagttctgtggagtttgactggtgcgccgtgtcatccatccgtactctacggcagctaggcaagaaaaccgtcgttgtaaactgcaaccctgagaccgttagcaccgacttcgacgaatgcgataaactgtacttcgaggagctgagcctagagaggatactggacatatatcatcaggaggcttgtggagggtgcatcatctcagttggcggtcaaattcctaacaatctggccgtgcctctttacaaaaacggagtgaagatcatgggtacatcaccactacaaattgatagagcagaggatcggtctatcttttctgcagtgctggatgaactgaaggtggcccaggccccatggaaggcagttaacactctgaatgaggctttagagttcgccaagagcgtcgattatccctgcctgctgaggccaagctatgtgttaagcggttctgcaatgaacgtggtgttttctgaggatgagatgaagaaattcctggaagaggctaccagggtgagtcaggagcatcctgtcgttctgacaaaatttgtggaaggggcacgggaagtggaaatggacgccgtgggcaaggatggtcgcgtcatttcacacgccatctccgaacatgttgaggacgctggggttcactcaggtgatgccaccctcatgctccccactcagacaattagccagggcgctatagagaaagttaaagacgccaccaggaagatcgccaaagccttcgccatatccggcccatttaacgtgcaattcctggtgaaaggaaacgatgtgctggtgattgagtgtaatctccgagcctcccgttctttcccttttgtgagtaaaactctgggcgtcgacttcatcgatgtggcaactaaggtgatgattggtgagaacgttgatgagaagcatctgcccacactggatcaccccattatacccgccgattatgtggccattaaggccccaatgttttcttggccacggctgcgagacgctgaccccatcctgcgttgtgagatggcatccaccggggaagtggcttgcttcggagaggggatccacacagcctttctgaaggcaatgctgtctaccggcttcaagataccccagaagggaattctcattggcatacaacagtcttttcggcctcggtttttaggggtggcagaacagctgcataatgaggggttcaagctgttcgctaccgaagccacttctgactggctcaacgcaaacaacgtacctgctacacccgtggcctggccctcccaagagggccaaaaccctagcctaagtagcattcgaaagttgatacgtgatgggtctatagacctggtgattaacctgccaaacaataacacaaagttcgtccatgataactacgtgatacgaaggactgctgttgatagtggcataccactcctgaccaatttccaggtgaccaagctgttcgcagaggccgtgcaaaagtccagaaaggtggactcaaagagtctcttccactaccgacagtattctgccggtaaggccgct

SEQ ID NO: 8145 - DNA, 4500 bp, Artificial Sequence
  Description of Artificial Sequence: Synthetic coding sequence
atgacgcggattctgacagctttcaaagtcgtgcgcaccctcaagaccggattcgggtttaccaatgtaactgcccatcagaaatggaaattcagcagaccgggcatccggctcctatctgttaaggcacaaaccgctcatattgttcttgaggatgggaccaaaatgaagggctattcgtttgggcacccctcctccgtagcgggggaggtcgtctttaacaccgggctgggcggatatcctgaggccataaccgaccccgcatacaaagggcagattctgaccatggcaaaccctataatcggtaatggcggtgcaccggatactactgctctggatgagctcggtctcagtaaatatctggagtccaacggcatcaaagttagtgggctgctggtacttgattactcaaaggattacaatcattggctcgctacaaagtccctggggcaatggctgcaagaggagaaggtccccgctatttacggcgtcgatacgcggatgctcactaaaatcataagggacaagggcacaatgctgggcaagattgaattcgaggggcagcccgtcgacttcgtggatcctaataaacagaacttgatagctgaagtctctactaaggatgtaaaagtgtacggtaaaggtaatcccacaaaggtggtggccgtcgactgtgggattaaaaacaatgtgattagactgttggttaaacgaggcgccgaagtgcacctggtgccctggaatcacgactttactaaaatggagtacgatggaatccttattgccggcggtcctgggaatccagcactggccgagccactcattcagaatgtccgcaaaattctcgaaagtgataggaaggagcctctgtttggcatctcaacgggtaacctgatcacaggacttgctgccggtgccaaaacctacaagatgagcatggctaatcgcgggcagaaccagcctgttttgaatattactaacaagcaggcttttatcacagctcagaaccacggctatgctctggacaatacattgccagctgggtggaagccactgtttgttaacgtgaatgaccagactaacgagggcatcatgcatgagagtaagccgtttttcgctgttcagttccacccagaggtaacaccggggcctatcgatacagagtatctcttcgactccttttttagtttgataaagaaagggaaagccactaccataacctctgtccttcccaagccagcactagtggccagccgggtggaagtatccaaagtcttgattctgggctccggtgggttgtctatcggccaggctggagagttcgattactccggttcccaagcagtcaaggctatgaaggaggaaaacgtgaagacagtgctcatgaaccctaatattgctagtgtgcagacgaacgaggtggggttaaagcaggccgatacagtgtattttctgccaatcaccccccagttcgttacggaagtgatcaaggcggagcagccagacggacttatactggggatgggggggcagacagcactcaactgcggggtcgagctgttcaagcggggcgttttgaaagagtatggagttaaggtgctaggcaccagtgtggaaagcattatggccactgaggacaggcagctgttctccgataaactgaacgaaattaacgagaagattgcccctagctttgcagtcgaaagcatcgaggatgcactgaaggccgcagacaccataggatatccagtgatgatccgctctgcttacgccctgggcggcctaggctcaggaatttgccctaaccgtgagactctgatggacctgagcacaaaagccttcgctatgaccaatcagatccttgttgagaaaagcgtcaccgggtggaaggaaattgaatatgaggtggtaagggatgctgatgacaactgtgtgactgtttgcaacatggagaacgtagatgcgatgggagttcatactggtgactccgttgtagtagcacctgctcagaccctttcaaatgcggaattccagatgctcaggcgtacttcaattaacgtggtgaggcatctcggcattgtgggcgagtgcaatatccagttcgctctccatcccacgtcaatggagtactgcatcatcgaagtcaacgcaaggttgagtcgatcttctgcgctggccagcaaagccactggatatccgctcgctttcatcgcagcgaagatcgcactggggattccactgcctgagataaaaaatgtggtgtccggaaagacgtcggcctgttttgaaccctccctggattatatggttaccaaaatcccccgctgggatctggaccgtttccacggcacctcttcgagaattggaagttccatgaagtccgtgggcgaggttatggctataggccgaactttcgaagaatcctttcagaaggccctgaggatgtgccaccctagtattgagggcttcacacctcggctacctatgaataaggagtggccgtctaatcttgatttaaggaaagaactgtccgaacccagctcaacccgtatttacgccatcgccaaagccatcgacgacaatatgagcctggatgagatagaaaagctgacttacatcgataagtggtttctatataaaatgagggacatattgaacatggaaaaaacgctgaaaggtctgaactcagagagcatgaccgaggagaccctgaagagggccaaggagattggcttcagcgataaacaaatcagcaagtgcttgggtctgactgaagcccagacgcgggagttaaggcttaaaaaaaacatccatccatgggttaagcagatagacacgttagctgcggagtacccctccgtaacaaattatctgtacgtgacatataatggccaagaacatgatgtcaattttgatgatcacggcatgatggtcctcggttgcggtccctatcatatcggttccagtgtggaatttgactggtgcgccgtgtcctctatacggacgttaaggcagttgggaaagaaaactgtcgtcgtcaactgcaaccccgaaactgtgagcaccgacttcgacgagtgtgacaagctttacttcgaggagctatctctggagcgaatactggatatatatcaccaggaggcatgcgggggctgcattatctccgtcgggggacagatcccaaacaacttggctgtgcccttgtataaaaacggcgtgaagatcatggggacatcccccctgcagatcgatcgggccgaagacagaagcatcttctccgcagttctggacgaactgaaggtggcccaagccccatggaaggccgttaataccctcaacgaagcccttgagttcgcgaaaagtgtggactacccttgcttactgcggcctagctatgttctgagtggcagtgccatgaatgtcgtgttctccgaagatgagatgaaaaaattcctggaggaagcaaccagagtgagccaagagcatcccgtggtactcacgaagttcgtggagggggcccgcgaagtggaaatggacgctgtggggaaagatggccgggtgatcagccatgccatatccgagcatgttgaagatgctggagtgcactcaggagacgccaccctgatgctgcccacgcagacgatatcccagggcgccattgagaaagtaaaggatgccacccgcaagatcgccaaagccttcgctatctctgggcctttcaatgtgcaatttctggtgaaggggaatgacgtcctggttattgagtgcaatttaagagcctctaggtcatttccctttgtgagcaaaaccctcggcgtggactttatcgatgttgctacgaaggttatgataggagagaacgtggatgagaagcatctgcccactctcgaccatcccattataccagcagattatgttgccatcaaagcccctatgttttcctggccccgcttgcgcgatgcagacccaatactgcgatgcgagatggcaagcactggcgaggtggcttgtttcggcgagggcattcacacagctttcttgaaggctatgctgtctacggggttcaagataccacagaaaggcattctgatcgggattcagcagagttttcgcccacgcttcctcggagttgccgaacagctccacaatgagggctttaagctatttgccaccgaggctaccagtgattggctgaatgctaacaatgtgccagcgacgccagttgcgtggcccagccaggaggggcagaatccctccttgtcctccattagaaaactgattcgcgacggtagcatcgatctggtaattaatctccctaataataataccaagttcgttcatgacaattacgtcatacgaaggaccgccgtggattccggtattcctttgctgacaaactttcaggtcaccaaactgttcgccgaggcggtgcagaaatctcgcaaagtggatagcaagagcctctttcactatcggcaatactccgccgggaaggcggct

SEQ ID NO: 8146 - DNA, 4500 bp, Artificial Sequence
  Description of Artificial Sequence: Synthetic coding sequence
atgacgcgcatcctgaccgcattcaaggtcgtcaggactcttaaaacagggttcgggttcacgaacgtgactgcacatcagaagtggaagttttcgcggcctggaatccggctgctgagtgtgaaggcccagacggctcacattgtactggaggacggcacgaagatgaaagggtatagttttggacatcctagcagcgtggccggggaggtagtgtttaacaccggattgggcggatacccggaggccatcactgatccagcatacaaaggccagattcttactatggcaaaccccatcattggtaatggcggcgccccagacactaccgctctggacgaactgggattgtctaaatacttggaatccaatgggatcaaagtctccggcctgctcgttttggattactcaaaggactataatcactggctcgctaccaaatctttgggacagtggttgcaggaggagaaggtgcccgcaatctatggcgtggatacacgcatgctgacaaagatcattcgcgacaagggtaccatgcttggcaagattgagttcgaaggtcagcccgttgactttgtcgaccccaataagcagaatttgatcgctgaggtgagcactaaggacgtgaaggtgtacggcaaaggcaatcctacaaaggtggtggctgtcgattgcggaatcaaaaataatgtgattaggctcctggtcaaaagaggagccgaggtgcaccttgtaccttggaaccatgattttaccaagatggagtacgatggcatcctaattgcaggcggcccaggtaacccggctctggcagagcccctaatccagaatgttcgtaagatactggaaagcgatcgcaaagagccgctgttcggaatttcgaccggaaatctcatcacgggcctggccgccggggcaaaaacgtataagatgagcatggccaacaggggacagaaccaacctgttctgaatatcacaaacaaacaggccttcataacagctcagaatcatgggtatgcccttgacaacacactccctgctggttggaagcctctcttcgtgaacgtaaatgaccaaacaaatgaggggatcatgcacgagtcgaagcccttctttgctgtgcaattccaccccgaggtgactccaggaccaatcgatacggaatacttgtttgatagtttttttagccttatcaagaaaggcaaggcaacaactattacttccgtgttgccaaagcctgccctcgtggccagccgggtggaagttagcaaagtattgatccttgggagcggtggcctgagtataggccaagctggggaattcgattactccggctctcaggcagtgaaagccatgaaagaggagaacgtgaagacggtactcatgaatccgaatatcgcgtctgttcagaccaacgaggtgggcctgaagcaggcggatactgtgtactttctccccatcacaccccagttcgtcaccgaggtgattaaagccgagcagccagacggtctgatcctggggatgggtggccagactgcattaaactgcggagtcgaattgttcaagcggggtgtactgaaggaatatggggtgaaagttctggggacctccgtagaatccattatggccacagaagaccgccaactcttttctgataagcttaacgaaattaacgaaaagattgctccctcatttgcggttgagtctattgaggatgcccttaaagctgccgatactataggctaccctgtgatgatccgaagtgcctacgcacttggggggctgggctcgggaatttgccctaacagagaaaccctcatggatttgtccactaaggcatttgccatgacgaatcagattcttgtcgaaaagagcgttaccggctggaaggaaatagagtacgaggtggtgcgcgatgcagatgataactgcgtaacagtgtgtaacatggaaaatgtggatgctatgggggtgcatacaggtgactccgtggtcgtcgcacccgctcagacgctgtcgaatgccgagttccagatgctgcgaagaaccagtataaatgtggtgagacatttgggtatcgtgggtgagtgcaacatacagttcgccttacatcccacctccatggagtattgcatcatcgaagtgaatgcacgcctgagtcgctcatccgctctggcctccaaagccacagggtaccctctggcctttattgctgctaagatcgctctggggatcccattgccggagatcaagaatgtcgtgtctgggaaaacaagtgcctgctttgaacccagtctggactatatggtaactaaaattccgcggtgggatctggatcgcttccatggcacctcaagccggatcggttcctccatgaagagcgttggcgaggtgatggccattggccggacgtttgaggaatcctttcagaaagcgttgaggatgtgtcacccttccatagaggggtttacaccacggctgccaatgaacaaggaatggccttccaacctcgatctgaggaaagagctgtctgaaccgagcagtacacgaatttatgccatagctaaagctatcgatgataacatgtctttggatgaaatagagaaactgacatatattgataagtggtttctgtataaaatgagagatattctgaacatggagaaaactctcaaaggcctgaattcagagagtatgaccgaggagacactgaaacgggccaaggaaatcggcttcagcgataagcagatttcaaagtgtctgggattaaccgaggctcagacccgagagctgagacttaagaagaatattcacccgtgggtaaaacagattgataccctcgccgccgagtacccctctgtgaccaattacctctacgtgacctataatggccaagaacatgacgtgaacttcgatgatcacggcatgatggttctgggatgcggaccgtatcatattggatcctcagtcgaattcgattggtgcgcggtaagttcaatcaggacactgagacagctcggtaagaaaacggtggttgtcaactgcaaccccgagactgtgtccacggattttgacgagtgcgacaaactctactttgaagagttgtccctggagaggattctggacatttaccaccaggaagcctgcggtggatgtatcatctctgtgggtggacagattcccaataatttagccgtgcctctctacaagaacggcgtaaagatcatggggacgtcgcctctgcagattgaccgggctgaggatcggtctatcttcagcgccgtgctggatgagctgaaggtggcccaagctccatggaaggccgtgaacaccctgaacgaggcattagaattcgctaaaagcgtagactacccctgccttttaagaccttcctacgtcctcagtggaagcgctatgaacgttgtattttctgaggacgagatgaagaagtttctagaggaggctacccgcgtgtcccaggaacatccagtcgtcctcaccaaattcgtcgagggggccagggaggtggagatggatgctgtcgggaaggacggaagggtgatcagccacgccatcagcgaacatgtggaggacgccggcgtacacagtggagacgctactttgatgctgcctactcagacaatcagccagggcgctatcgagaaggtgaaagatgcgacaagaaagatcgccaaggccttcgcaatatccggcccattcaatgtacagtttctcgtgaaaggcaacgatgtgctggtgattgaatgcaacctgagagcatcccgcagttttcctttcgtgagcaagacacttggagtggacttcatagacgtagctacaaaagtgatgattggagaaaacgtagacgagaaacacctgccgacattagaccaccccatcattccagcagattatgtggctatcaaggcgccaatgtttagttggccccggttgagagacgctgaccccatcctgcgctgcgagatggcttccacgggcgaagtggcatgctttggcgaagggatccacactgcatttttgaaagcaatgctgtcaaccggatttaagattcctcagaaggggatactgatcggcattcagcagagctttcgtccccggttcttgggtgtcgcagaacagctccacaacgagggttttaagctcttcgcaaccgaggctacatcggactggctgaacgctaataatgtgcctgcaacacctgtagcatggcccagccaggaaggccagaatccaagcctgagtagtatcaggaaactcatccgggacggatcgatcgatctggtgataaatcttccaaacaataacacgaagttcgtccacgacaactacgtgattcgaaggactgctgtagacagcggtatccctctcttaactaacttccaggtgaccaaactgtttgctgaagctgtgcaaaaatccagaaaagttgactcgaagtctctgttccattatagacagtatagtgcagggaaggctgcc

SEQ ID NO: 8147 - DNA, 603 bp, Artificial Sequence
  Description of Artificial Sequence: Synthetic coding sequence
atgtcaagacgggaaggctctttggaggatccacagaccgattccagcgtgagcctcctgccccatctcgaggcaaagatacgccagacgcattcacttgcgcacctcctgacaaaatatgccgagcagctactgcaggagtatgtgcagctacagggcgatccatttggactgccttctttctcccctcctagattaccggtcgctggtctgtctgcaccagctcctagtcacgccgggctgcccgttcatgagcgactgcgattggacgctgcggcgctggccgcactgccccccctgctggatgccgtctgcaggcggcaggctgaactgaacccaagagctccaaggttactgagacgactggaggacgccgcgaggcaggcaagggcactgggcgcagccgtcgaagcgctcctggcagcactgggtgccgctaacagaggaccaagggcggagcctccagcggccaccgcgagcgccgcctctgccactggtgtctttccagctaaagtgctgggcctccgagtgtgcgggttgtacagagaatggctcagcagaactgagggggacctgggacagctgctcccaggcggttccgct

SEQ ID NO: 8148 - DNA, 603 bp, Artificial Sequence
  Description of Artificial Sequence: Synthetic coding sequence
atgtctcggcgcgagggctcgctcgaagatccccaaacggactcatcggtgagcctcctcccgcatctggaggccaaaatcagacagacccattcactggctcatctcctcaccaagtacgccgaacaattgctgcaagagtacgtgcagttgcaaggagatccgttcggacttccatcattcagcccccctaggttgcccgtggcgggactgtcagcaccagccccatcccacgccggcctcccagtccatgaaagactgcgcctcgatgcggccgctctggccgcgctccctcctttgctggacgcagtctgccggagacaggccgaactcaatccgcgcgcccctcggctgcttcggagacttgaagatgccgccagacaggcgagagctctgggagccgcagtggaagccctgcttgcagcacttggagccgcaaataggggacctcgcgcagaacccccggcagcgaccgcttctgcagcttccgccacgggtgtttttccagcgaaggtgctgggactgcgggtgtgcggtctgtaccgagaatggctgtcgcggaccgaaggtgatctggggcagctgctgccgggaggctccgcc

SEQ ID NO: 8149 - DNA, 603 bp, Artificial Sequence
  Description of Artificial Sequence: Synthetic coding sequence
atgtcacgacgggagggctcactagaggatcctcagaccgactcctccgtctctctgctcccgcatctggaagctaaaattcggcaaacacatagcctggctcacctgttgactaagtatgctgaacagctcctgcaagagtacgtacagttgcagggggaccccttcggacttccgtctttttcgcctcccaggctgccggttgctggattatcagcccccgctccttcgcatgccggcctgcccgttcatgaacggctgcgtctggatgccgcagccctcgccgccctcccccctctcctcgatgctgtctgtcggagacaagcagaactcaaccctagagctcctcggttgttgagaagactggaggacgcagctcgccaggcccgtgcattgggagcagccgtggaggcactcttggccgctttgggagcggcaaatcgtgggcccagggctgagccgcccgccgctacagcctcagcggctagcgccacgggcgtgttccctgcgaaggtgcttgggctgcgagtgtgcggtctgtatcgcgagtggctgtcccggacggaaggagatctcggacagctacttcctggcgggtctgca

SEQ ID NO: 8150 - DNA, 603 bp, Artificial Sequence
  Description of Artificial Sequence: Synthetic coding sequence
atgtcccgccgcgaaggatcgctcgaagatccgcagaccgatagctcggtttcgctgttgccccatctcgaagcaaagattcggcagactcactcgctggcacatctcctgactaagtacgcagaacagcttctgcaagagtacgtgcaactgcaaggtgacccattcggactgccgtcattcagcccgccgcgcctgcctgtggcggggttgagcgctccagctcctagccatgcaggtctgccggtccacgaacggctcagactggatgccgcagcgctggccgcgctgccaccactgctggacgcggtgtgccggcgccaggcggagcttaacccacgggccccgcggctcctcagaaggctcgaggacgcggccaggcaggccagagccctgggcgccgccgtcgaagctctcctcgcggccctcggggccgccaaccgggggccaagggctgaaccgcccgccgctacggcctccgcagctagcgcaactggagtttttccggccaaggtgcttggacttagagtctgtggcctctatcgcgaatggctgtcacggaccgagggcgacctgggacagctgctgccaggtggatccgcc

SEQ ID NO: 8151 - DNA, 603 bp, Artificial Sequence
  Description of Artificial Sequence: Synthetic coding sequence
atgtcccggcgcgaaggatcgctcgaagatccacaaactgactcatccgtgtcactgctgcctcacctcgaggcgaagatccgccaaacccactcactggcgcatttgcttaccaaatatgcagaacagttgctgcaggaatacgtgcaactccaaggggacccgttcggactgccttcgttcagcccgccgaggctcccggtcgcgggactctccgccccggcgccatcccatgcaggactcccggtccacgaaagactccgcctcgatgccgcggccctggccgcgttgccgccattgctcgacgcggtctgccgccgtcaggccgagctgaaccctcgtgcgccgcgactgctgaggcggttggaggacgccgctcggcaggcccgggctttgggcgccgccgtcgaagccctgctggcggccctcggcgccgccaacagaggaccaagggccgaaccgccggctgctactgctagcgcagcatcggcgactggagtgtttcccgcgaaggtgttgggattgcgcgtgtgtggattgtacagagaatggctgtcacgcaccgaaggggacttgggacaactgctgccaggaggctcggca

SEQ ID NO: 8152 - DNA, 603 bp, Artificial Sequence
  Description of Artificial Sequence: Synthetic coding sequence
atgagtaggagggagggaagtctggaagatccccagacagacagctcggtctctctgcttccccacttggaggctaagataagacagacccatagccttgctcatctacttaccaagtatgccgagcagttgctacaggagtatgtccagctccagggagatccgttcgggttacccagcttcagcccccccagattgccagtggctggattgagcgcccctgccccgtcccatgccggccttccagtgcacgagcggttacgtctggatgctgccgctcttgctgccctacccccactcctagacgcagtgtgcagacgacaggctgaactgaatccgcgagcgcctcgattactgcggagattggaggacgctgcaaggcaagcccgagcgctaggggccgccgtggaagccttgctggccgcccttggggccgccaacagggggcccagagccgagccccctgccgcaactgcttccgcagcctccgcaaccggggtatttcctgccaaggtgctgggactgcgtgtttgtgggttatatcgggagtggctatcaaggacagaaggagacctcggacagttgctgcccggcggcagtgct

SEQ ID NO: 8153 - DNA, 603 bp, Artificial Sequence
  Description of Artificial Sequence: Synthetic coding sequence
atgagtaggagagagggttccttggaagatccacagacggacagctccgtcagtctattaccacacctcgaggccaaaattcgacagactcatagcctggcccacctcctcactaaatatgctgagcagctgctgcaagaatatgtgcagcttcaaggagaccccttcggattaccaagtttcagtcctccaagactcccagtcgctgggctttcggctcccgctcccagccatgctggacttcccgtgcacgaaagactccgtttggatgctgctgcactggccgcacttccacccctgctcgatgcggtttgcaggagacaggccgaacttaaccctagggctcccagactcttgcggcgtttggaggatgccgctaggcaggccagagccctgggcgcagcagttgaggcgctgttggctgccctgggggctgctaatcgagggcctagggctgaacccccggccgccaccgcctccgccgcaagtgccacaggggtctttccggccaaagtgctggggctgagagtatgcgggctatatagggaatggctgtccaggactgagggtgatctgggtcagctcctgccgggtggatcagct

SEQ ID NO: 8154 - DNA, 603 bp, Artificial Sequence
  Description of Artificial Sequence: Synthetic coding sequence
atgagccgacgtgaagggtcgttggaggaccctcaaaccgactcgagcgtgtcactcctcccgcatcttgaagctaagatcaggcaaacccacagcctcgcccatttgctcactaagtacgctgaacaactgctccaagaatacgtgcagctgcagggagatcctttcggccttccttcgttctcgccaccacggcttcccgtggcagggctttcagcacctgcccccagtcatgctggactgccagtccacgaacggctgcgtctggacgccgcagcactggcagcgttgccgcccctgctcgatgcggtgtgccggcggcaagccgaattgaacccgcgcgctccccgcttgctgcggcgacttgaagatgccgcaagacaggcccgagcgttgggagctgccgtggaggcactcttggcggcactgggagcagcaaacaggggtccacgggcagaacctccggccgccaccgcgtctgcggcttcggcaactggagtgtttccagcgaaagtgcttggactcagagtttgcggcctgtacagagagtggctgtcgcgcacggagggtgacctgggacagctcctgccaggtggatccgca

SEQ ID NO: 8155 - DNA, 603 bp, Artificial Sequence
  Description of Artificial Sequence: Synthetic coding sequence
atgtcgcgcagggagggtagcctcgaagatcctcagaccgactcatcagtgtccctcctgccgcatttggaggccaagatccggcagacccactctctggcccacctcttgacgaagtacgccgaacagttgctgcaggaatacgtgcaactgcaaggcgacccattcggactgccgtccttctcgccgccgcgcctgcctgtcgccggtctttcggccccagcgccttcgcacgctggtctgccagtccacgagcgccttcgactggatgctgccgcgctggcggccctcccaccactgttggacgcagtgtgccggaggcaggccgaactcaatccgcgcgccccccggttgctgagacggcttgaggatgcggcccgacaggccagagcccttggcgcagccgtggaagcactcctggcagcactgggagcggcgaaccgcggaccccgcgccgaaccgccggcagctactgcctcagcggctagcgctaccggtgtgtttccagctaaggtgctgggcctgcgtgtttgcggcttgtaccgcgagtggctgagcagaactgagggtgaccttggacaactcctgccgggtggatcggcc

SEQ ID NO: 8156 - DNA, 603 bp, Artificial Sequence
  Description of Artificial Sequence: Synthetic coding sequence
atgtctcggagagaaggatctctcgaagatcctcagactgattcatcagtctcgctgcttcctcacctcgaggccaagatcagacaaacgcatagccttgcgcatcttcttactaaatacgccgagcaattgttgcaggaatacgtgcaactgcagggcgacccctttggactcccatccttctcaccccctcgtctgccggtggcaggcctttccgcacccgccccatcgcacgcaggactccccgtccatgagagacttcgccttgatgcggcagcacttgcagcactgccgccacttcttgacgcagtgtgtcgtagacaagctgaactgaaccctagggcacctaggctgctcagaaggctggaagatgctgcacgacaagcaagagcccttggtgctgcagtggaagcgctccttgcagcgctgggagccgcaaaccgcggcccacgggcagaaccacctgcggcgaccgcaagcgcagccagcgccaccggcgtgttcccagcgaaggtcctgggccttcgagtgtgtgggctgtatagggaatggctctcgagaactgaaggtgatctgggccaacttctgcccggcgggtcggcc

SEQ ID NO: 8157 - DNA, 603 bp, Artificial Sequence
  Description of Artificial Sequence: Synthetic coding sequence
atgtcgcgacgtgaaggttcgttagaagatccgcaaacggattcgtcggtatcgttattaccgcatctagaagcgaaaatacgtcaaacgcattcgttagcgcatttattaacgaaatatgcggaacaactattacaagaatatgttcaattacaaggtgatccgtttggtttaccgtcgttttcgccgccgcgtttaccggtagcgggtctatcggcgccggcgccgtcgcatgcgggtctaccggtacatgaacgtctacgattagatgcggcggcgctagcggcgctaccgccgttattagatgcggtatgtcgtcgacaagcggaattaaatccgcgagcgccgcgtttattacgacgactagaagatgcggcgcgtcaagcgcgtgcgctaggtgcggcggtagaagcgttactagcggcgctaggtgcggcgaatcgtggtccgcgtgcggaaccgccggcggcgacggcgtcggcggcgtcggcgacgggtgtatttccggcgaaagttttaggtttacgtgtttgtggtttatatcgagaatggttatcgcgaacggaaggtgatttaggtcaactattaccgggtggttcggcg

SEQ ID NO: 8158 - DNA, 603 bp, Artificial Sequence
  Description of Artificial Sequence: Synthetic coding sequence
atgtcacgccgtgagggtagtctggaggacccccagaccgattccagtgtgtcccttctgcctcatctggaagccaaaatcagacagacacacagcctggcccacttgttgacaaaatacgccgagcaactgttgcaggagtacgtgcagcttcaaggcgacccctttggcctgcccagtttttcacccccccgtctcccagtcgctggcctctccgctccagctccctcacatgccggccttcctgtgcacgagcgcctgaggttggacgcagctgctttggctgctcttccccctctgctcgacgccgtgtgtcgtaggcaagctgagttgaatccaagggctccaagactgcttaggcgccttgaggacgctgccaggcaggcccgtgccttgggagcagcagttgaagccttgctggctgctctgggcgctgcaaaccgtggcccacgcgctgaacctcctgccgctactgccagcgcagccagcgctactggtgtgttcccagcaaaggtgctcggcctgagggtctgtggactgtacagggaatggctttctcgcacagagggagatctgggtcaactgttgcccggcggcagtgcc

SEQ ID NO: 8159 - DNA, 603 bp, Artificial Sequence
  Description of Artificial Sequence: Synthetic coding sequence
atgagcaggcgagaaggctcactggaggatccccagaccgatagctcagtgtctttgcttccacatctggaggcgaagattagacaaacccatagtcttgcacatttgctgactaagtacgcggaacaactgctgcaggaatacgtgcaactccaaggtgatccgtttggtctgccatcctttagcccacctagactgcccgtggcaggtttgtctgcaccggcaccctcccacgctggactgcctgttcacgagcggcttaggttggacgccgccgccttggccgcgcttccgccccttttggacgcagtgtgtcgtcggcaagcggaacttaatccgagggcaccaaggctccttcgccggctcgaagatgcagctcggcaggcacgcgcactgggggcagcagtcgaagcgttgctcgccgcactcggggcagccaaccgcggaccaagggccgagcctcctgcggccaccgcatcggctgcctccgccaccggagtgttccccgctaaagtgcttggcctgagagtctgcggactgtaccgggagtggctctcgcgcactgaaggtgacctcggccagcttctgcctggagggtcggcg

SEQ ID NO: 8160 - DNA, 603 bp, Artificial Sequence
  Description of Artificial Sequence: Synthetic coding sequence
atgtcccgtagagagggcagcctggaggacccgcagacggattcctctgtctccctgctgccacacctggaggcaaagatcagacagacgcactcactggcgcacctgctcaccaaatacgcagagcagctccttcaggagtatgttcagctgcagggcgatccattcggcctaccatcctttagcccgccacggctaccagtggcaggcctgtcagctccagctcctagccatgcgggtttgcctgtacacgaaaggctgcgcctggacgcggctgccctggctgcgcttccccccctgcttgatgctgtttgcagaagacaggccgaattaaacccaagggcgccaaggctgcttcgaagactcgaagatgcagcacgacaggccagagcactaggggccgctgtggaggctttgttggcggccctgggagccgctaaccggggccctcgggccgagccaccggcagccaccgccagcgcggccagtgctactggtgtattcccagcaaaagtactcgggctgagagtatgcggcctataccgagagtggctgagcagaaccgaaggggatctgggtcagctgctgccgggaggtagtgca

SEQ ID NO: 8161 - DNA, 603 bp, Artificial Sequence
  Description of Artificial Sequence: Synthetic coding sequence
atgtctcggagggaggggtcgctcgaggacccgcaaaccgactcatcggtgtcgctgctgccacatctggaggcaaagatcagacagacgcactcccttgcccatctgttgactaagtacgccgagcagctgctgcaggagtacgtgcagttgcagggcgaccctttcggactgccttccttcagccccccaaggctgccggtggcaggattgtcagcaccagctccgagtcacgccggactccctgtgcacgagagattgcggctcgatgcggctgccttggctgccctgccaccactcctggatgccgtgtgccggcgccaagctgagctgaacccgagagcaccacgcctgctccgccggcttgaggatgccgcgcgccaagccagagccctgggcgctgctgtggaagccctccttgcggccctcggggccgccaacagaggaccgagagcagaaccgccagcggccaccgcgagcgcggcctcggccaccggagtctttccggcgaaggtgctgggtctgagagtgtgtggcttgtaccgagagtggctctctcgcaccgagggggacctcggccagctgcttcccggcggcagcgcc

SEQ ID NO: 8162 - DNA, 603 bp, Artificial Sequence
  Description of Artificial Sequence: Synthetic coding sequence
atgtccagacgtgagggatcgcttgaagatccacagaccgatagcagcgtgagcttgctcccccacctggaagcaaaaatcagacaaacccattcactcgcccatctgctcaccaaatacgcagaacaattgttgcaggaatacgtccagctccaaggtgacccgtttggactgcctagtttttcccctcctcgcctccccgtggcaggtctttcggcaccggcaccatcgcatgctggtctgcctgtgcacgaaagattgcggcttgatgcagcagcactcgccgcacttcctccgttgctcgacgccgtctgcagaaggcaggcggagctgaacccacgtgccccgagacttcttcggcgactcgaggatgcggcaagacaggcacgtgctctgggtgcagcggtggaggccctgctggcagcactgggggccgccaatcgtggaccacgggcggaacctcctgcggcaacggcaagcgcagcctcagctactggcgtttttcctgccaaggtccttggcctgagagtgtgtggcctgtaccgggaatggctcagccgtactgaaggagatctgggacaacttctgccgggcggttcagca

SEQ ID NO: 8163 - DNA, 603 bp, Artificial Sequence
  Description of Artificial Sequence: Synthetic coding sequence
atgtcaagaagggagggctctttagaagacccacagaccgattcatccgtatctctgctcccacatctcgaagccaagatcaggcagacgcattctctggcccatcttttaacaaaatatgctgagcaactgttgcaggagtacgtgcagctccagggcgatccctttggcctcccctcctttagtcctccaagactgcccgtggcaggcctatcagctcctgcgccctcacacgccggccttccggtgcacgagagacttaggcttgacgcagctgccctggccgctttgcccccactgttggatgcagtgtgtaggcgtcaagcggagctgaacccccgagctcccagactccttcggcgcctggaagatgccgcgagacaagccagagctctcggtgccgccgtggaggcgcttcttgccgccttgggagctgccaacaggggcccgagagcagaaccccccgcagccactgcgtcggccgcctcagcaactggggtgtttccggccaaagtccttggcctccgagtgtgtgggctgtaccgtgaatggcttagccgaacagagggtgatctagggcaactcctgccggggggctcagct

SEQ ID NO: 8164 - DNA, 603 bp, Artificial Sequence
  Description of Artificial Sequence: Synthetic coding sequence
atgtcccggagggagggaagcctggaggatccccaaacagattctagcgtgagcctgctcccccacctggaagcaaaaatcaggcaaactcactcactcgcccacctgctgactaagtacgcggaacagctgctgcaggaatacgtccaattacaaggcgatccttttggtctgcctagtttcagccccccaagactgcccgtagccggacttagtgcccccgcaccatctcatgccgggttgccagtgcatgagcggctgcggctagacgccgccgccctcgcggccctgcctcctctactggacgccgtctgtcgtcgacaggcggagcttaacccacgcgctcccaggctattaaggcggctcgaagacgccgcacggcaggctagggcactcggcgcagcggtggaagcactgctcgcggctctgggagctgccaaccggggccctcgagcagagccacccgccgcaaccgctagtgccgctagtgctacaggcgtgttcccagccaaggtgctcggtttgcgcgtgtgcggcctctatagggaatggctatctaggaccgagggcgatctcgggcagcttcttccaggcggaagtgct

SEQ ID NO: 8165 - DNA, 603 bp, Artificial Sequence
  Description of Artificial Sequence: Synthetic coding sequence
atgagtagacgagaaggatctttggaagatccccagactgattcctccgtgtctctcctccctcatctcgaggctaagatacgacagactcactcgctggcccatctgctgacaaagtacgctgagcaactattacaggaatacgtgcagttacagggagatcctttcggattacccagtttctcccccccccgtctacccgttgcagggctctcagcccctgcaccatcacacgccgggttgcctgtccacgaaagactgcgactcgatgccgccgccttggctgccttgccacctctccttgacgctgtgtgtagacgtcaggctgaattgaatcctcgagccccacgcctcttaagaaggttagaagatgctgctaggcaggctcgcgcactcggggccgccgtggaagcgctgctagctgcattaggagctgctaatcgggggcccagagccgaaccaccagccgccacagcttcagccgcatctgctacaggagtgttcccagcaaaggtactcggattaagggtctgcgggctgtacagggaatggctctctagaacagaaggagacttagggcagctactcccaggggggtctgca

SEQ ID NO: 8166 - DNA, 603 bp, Artificial Sequence
  Description of Artificial Sequence: Synthetic coding sequence
atgtcacgcagagaaggaagtcttgaggatccgcaaacagactctagcgtgtccctgctgccccaccttgaggccaaaatccgtcagacccattccttagcccacctgctgaccaaatacgccgagcaactgttacaagaatatgttcagctacagggcgatccatttggattgccgagcttcagccctccaaggctgcccgtcgcaggcctgagcgcccccgcaccttcccatgctggcttgcctgtgcacgaacggctgcgcttagatgctgcggcactggctgccttgccccccctcctcgacgccgtgtgccgtcgacaagcggagcttaacccaagggccccaagactgctaaggaggctcgaagatgctgccaggcaggctcgcgcactcggagctgccgtggaggccctgttagcagccctgggtgcagctaaccgcggaccccgtgcagagccacccgccgctaccgctagcgccgcctctgccaccggagtttttccagcaaaagtcttgggattacgcgtatgcggtttgtatcgggagtggctttcccgaactgaaggcgacctgggacaacttctgccagggggaagcgca

SEQ ID NO: 8167 - DNA, 603 bp, Artificial Sequence
  Description of Artificial Sequence: Synthetic coding sequence
atgtcgcgacgagaaggcagcctggaggatccccagacagactcttctgtaagcttgctcccacacctggaggctaagattcggcagacgcacagtctcgcccatctcctgactaagtacgctgaacagttgctccaagagtacgttcagttacaaggcgaccccttcggattaccctcctttagcccaccaaggctgcccgtcgctgggctgagcgcacccgcaccctcacatgcaggactgcccgtgcatgaacgccttcgtttggatgccgccgctcttgctgcccttccgccgctcttagatgccgtttgtcgccgacaggccgagttaaatcctcgggcgccccgccttctccgtagactggaggacgccgccagacaggcgagggcactgggggccgctgttgaggccctgctggcagcattgggggccgctaacagggggcccagggctgagccccccgccgcaacagctagcgccgcctccgcaacaggcgtctttccagccaaggtactggggttgcgcgtatgcggtttgtacagggagtggctgagcaggaccgaaggggatttgggacagttgcttccaggtggttcagcc

SEQ ID NO: 8168 - DNA, 603 bp, Artificial Sequence
  Description of Artificial Sequence: Synthetic coding sequence
atgagcagacgggaaggctcgctggaggacccacagacggattcttctgtgtccctcttgccacacttggaggccaaaattcgacaaacacatagcttggcgcacctgctaacaaagtacgccgagcaactcctacaggaatacgtgcagctgcagggcgacccttttgggctgcccagtttctctcctccacgccttccagttgccggcctctcagccccagcaccctctcacgcaggtctgcccgtgcatgagcgactgcgattggacgcagcggccctcgctgcactgcctccgttgctcgacgcggtttgtcgccgacaggctgaactgaatcctagggcccccagactgcttagacggctggaagacgctgcccggcaggccagagcattaggggccgccgtcgaagcacttctcgccgctctcggggcagccaaccgtgggccacgggctgaaccccctgctgccaccgctagtgccgccagtgccacaggggtcttccctgcaaaagtattaggtcttcgggtctgcggcctttacagagaatggctgtcaaggacagagggtgacctgggacagctgttgcctggcggtagtgcg

SEQ ID NO: 8169 - DNA, 603 bp, Artificial Sequence
  Description of Artificial Sequence: Synthetic coding sequence
atgagccgacgagaggggtccttggaagaccctcagaccgacagctcagtctccctcctgcctcacctggaggcaaaaatccgccagacccacagcttggcacatctcctgactaagtatgcagaacagttgctacaggagtacgttcagctgcagggcgatccatttggcctaccttctttttctccaccacgtctcccggtggccgggttgtcagctcctgctcccagccacgccggcctacccgtgcacgagaggctgcgccttgacgccgccgccttggccgccctgcctccactgctggatgccgtttgccggcgccaagctgaactgaatcctcgggccccccgactgctgcgcaggctcgaggatgctgctaggcaagcaagagctctgggagctgccgtcgaggctcttctggcagccctgggcgccgctaatagggggccaagggctgagccacccgccgctactgcctctgccgctagcgctacaggagttttccccgctaaagtgctgggtctccgtgtctgtgggctgtaccgggagtggctcagccggaccgaaggagacctgggccaactgctgcctgggggctcggcc

SEQ ID NO: 8170 - DNA, 603 bp, Artificial Sequence
  Description of Artificial Sequence: Synthetic coding sequence
atgagcagacgcgaggggagcttggaagatccacaaaccgatagcagcgtcagcctcctcccccatctggaggccaagattcgccaaactcatagcctcgcgcacctcttgacaaagtatgccgaacagctgctacaagagtacgtacagctgcaaggagatccgtttgggctaccatcctttagccctccccgcctcccagtggctgggctgagcgccccggcgccttcccacgctggccttcccgtgcatgagagactgcgccttgatgccgccgccctcgcagcactcccacctctgcttgatgctgtttgccgcaggcaggcggaactcaaccctcgggcacccagacttcttaggaggttagaggacgcagccagacaggctcgagccctgggcgccgctgttgaagctctgctggctgcactgggtgctgcaaaccggggaccacgtgcggaaccacccgccgcgactgcatcggccgcctccgctactggagtgtttcccgctaaagtgctaggcttgagggtgtgtgggctctatagagagtggctaagccgcacagaaggggaccttgggcagctgttacctgggggaagtgcc

SEQ ID NO: 8171 - DNA, 603 bp, Artificial Sequence
  Description of Artificial Sequence: Synthetic coding sequence
atgtccagaagagaaggttccctggaagatccacagactgattccagcgtttcactgctgccacacttggaagcaaagatcagacaaacccattcgctggcgcatcttctgactaagtacgcggaacaacttcttcaggaatatgttcaactccaaggggatccttttggtttgcctagcttttcgccgcctcgccttcctgtggctgggctgtcggctcccgctccatcccatgcggggctgccagtccacgaaaggctgcgacttgacgccgcagccctggcagcgcttcctccacttttggatgcagtctgcagaaggcaggcagaattgaaccctagggcaccacgccttctgcgccgactggaggacgccgccagacaggcaagagctctcggtgcggcagtggaagcccttttggcagcacttggagcggcaaaccggggacccagggcagaaccaccagccgcaaccgcgtcggcggcgagcgcaaccggcgtgttccctgcgaaggtgcttgggcttcgggtgtgcggactctaccgggagtggctgtcgcgcactgagggtgatctggggcaactgcttcctggtggaagcgca

SEQ ID NO: 8172 - DNA, 603 bp, Artificial Sequence
  Description of Artificial Sequence: Synthetic coding sequence
atgagccgccgagaaggttcgctggaagaccctcagactgattctagcgtgagcctgctgcctcatttggaggctaagataagacaaactcactctctggctcaccttctgacgaaatacgcggagcaactgctgcaggagtatgtgcaactgcagggggacccattcggcctgccttcgttttcaccaccgcgccttccagtcgcgggcctcagcgcgccagcgcctagccacgcaggcttgccagtccacgagaggcttcgtctggatgctgccgccctcgctgctctgcccccgttgttggacgcggtctgtcgccgacaggcggagctgaacccaagggctcctagattactgagacgtctggaggacgccgcccgacaggcacgcgcgctgggagcagccgtggaagccctgctagccgctcttggtgcggccaataggggaccgagggcagagcctccagcagcgacggcatcagcagcgagcgctactggtgtcttcccagccaaggttctgggcctgcgcgtttgcggcctgtacagggagtggctgagccggaccgaaggtgacctgggtcaattgctaccaggaggctccgca

SEQ ID NO: 8173 - DNA, 603 bp, Artificial Sequence
  Description of Artificial Sequence: Synthetic coding sequence
atgtcccgccgcgaaggttctctggaagacccacagactgacagttcagtgagcctgctacctcacctcgaggctaagatccgtcaaacacactccctcgctcacctgctgacaaagtatgccgagcagctactccaggagtacgttcagctacagggtgacccgttcggccttccctccttttcaccccctcgtcttcctgttgcgggcctatccgcgcctgctccgtcccacgcaggcctgcctgtgcatgagcgcttgaggttagacgctgccgctcttgccgctcttcctccactgctggacgctgtgtgcaggaggcaagcggagttaaatccccgcgccccacggctcctgaggcggctggaggacgcagcacggcaggcgcgggcacttggcgctgccgtggaggcactccttgctgccctgggggcagcaaacagaggtccgagagcagaacccccagccgctacagcgagtgcagcttctgcaaccggcgtgttcccagccaaggtgctcggcttgagggtctgcggcctttatagggagtggttgtctcgcacagagggagatctcggacagctgctgccgggagggagtgct

SEQ ID NO: 8174 - DNA, 603 bp, Artificial Sequence
  Description of Artificial Sequence: Synthetic coding sequence
atgagcaggcgtgaaggctcgctcgaggatccgcagacggattcaagcgtttccctgctcccccacttggaggcaaaaatccggcagactcattccctcgcccacctgctgaccaagtacgctgagcaactgcttcaggaatacgtgcagctgcaaggggacccatttggactcccatcattctcgccgcctcgcctgcctgtggcaggactgagcgccccggctccgtctcacgcggggctcccagtccatgagcggctgaggctggatgcagccgcactcgcggccctgccgcccctgctcgacgcggtgtgcaggagacaagcggaactcaatccgcgggccccgagattgctgaggcgactggaggatgcggcacggcaagcccgggcccttggtgcggctgtggaagccctcctggcggcgcttggtgccgcgaacaggggaccgcgggcggaaccgccggctgctaccgcgtcggcagcctccgccaccggtgtattcccggcaaaggtcttgggattgcgcgtgtgcggactctaccgcgagtggctgtcgagaaccgaaggtgatctcggacagctcttgccggggggaagcgct

SEQ ID NO: 8175 - DNA, 603 bp, Artificial Sequence
  Description of Artificial Sequence: Synthetic coding sequence
atgagtcgacgcgaaggctcccttgaagacccccagaccgactctagtgtgtctctgttaccccatctggaagccaagattcgccagacccactccctcgcccacctcctgactaagtatgcagagcaactgttgcaggaatacgtgcaactacagggcgatcccttcggcctcccctctttttcccctccccggctgcctgtggctggcctcagtgctcctgctcctagccatgccggattgcccgtgcacgagcggcttagactcgatgcggccgctctggcagcactgcccccccttctggatgcagtttgcaggcgccaggccgagttgaatccacgggctccaaggctactccgtcgactggaagatgccgcacgtcaagcccgcgccctaggcgccgccgtggaagctctccttgctgccctgggagccgcaaaccgcggcccccgggctgagccccccgcagcaaccgctagcgctgcatcagcgaccggagtcttccccgccaaggtcttgggccttagagtatgcggtctgtatcgggaatggttgtcccgaaccgagggggacctaggacagctgcttcccggaggtagcgct

SEQ ID NO: 8176 - DNA, 603 bp, Artificial Sequence
  Description of Artificial Sequence: Synthetic coding sequence
atgtcgcgcagggagggatccctggaagatcctcagactgactcatcggtcagcctcctacctcacttggaagccaaaatccgacagacgcactctcttgcacacctgctgaccaagtacgccgagcagctgctccaggagtacgttcagctgcagggggacccgttcgggctcccttccttctccccgccacgtctccctgtggccggactgtccgccccagccccttcacatgcaggcctgcccgtccacgagcgcctaaggttggatgcagcggctctcgctgccctcccccctctccttgatgctgtctgtaggcgacaggctgagcttaacccccgagccccccggctgctgcggagacttgaggacgccgcccgtcaggcgcgggctctaggagccgccgtcgaggccttactcgccgcgctcggtgcagctaacagaggacctcgggcagagccacctgctgcgaccgcaagcgccgcgtcggccacaggagtgttcccagcaaaagttctgggactgagagtgtgtggcctgtaccgggagtggttgagcaggactgaaggggaccttgggcagttgctccctggaggcagcgcc

SEQ ID NO: 8177 - DNA, 603 bp, Artificial Sequence
  Description of Artificial Sequence: Synthetic coding sequence
atgtcacgccgcgagggatcactcgaagatccccagactgacagctcggtgtcgctgctgccacatctcgaggcgaagatccgacagactcattccctggcccacttgcttactaagtacgcagaacagctgctccaagaatacgtgcaactgcaaggcgacccctttggtctgccttcgttctccccacctcgccttccggtggctggattgagcgcaccggcgccgtcccacgccggactgccggtgcatgagcgcctcagactggatgccgccgcgctcgctgcgctgccgccgcttcttgacgccgtctgccgccgtcaggcagaactcaacccccgcgcgccgcgcctgctgagacggttggaggacgcggcgcggcaggcgcgcgccctcggcgcggccgtggaggctctgttggcagcactgggcgccgcgaaccggggaccgagagccgaaccaccggcagctaccgccagcgcggcatcggccactggtgtattccccgcaaaagtgctgggcttgcgggtgtgcgggctgtacagggaatggctgagcagaactgaaggagacttgggacagctcctgccgggaggaagtgcc

SEQ ID NO: 8178 - DNA, 603 bp, Artificial Sequence
  Description of Artificial Sequence: Synthetic coding sequence
atgtctagaagggagggatctctagaggatcctcaaaccgactcttccgtgtcacttctcccacatttggaggccaaaatccgtcaaacacactcattagctcaccttttgactaagtacgctgagcagctcctccaagagtacgtccaactccaaggtgaccccttcggtttaccttcattcagtccacctagactgcctgtggcaggtctcagtgcgcccgcgccatcccatgcaggtttacctgtgcacgagagacttcgactagacgctgctgccttagctgcattgcccccacttttggacgctgtttgcaggaggcaggcggaattaaatcccagggcccccaggctgcttcgaaggctagaggacgcagcaaggcaagctagagcacttggggcagccgttgaagctcttttggccgctctcggagctgcaaataggggccctagggctgaaccgccagctgcgaccgcttctgctgcatctgcaactggcgtcttccccgcgaaggtcctaggactgagggtttgtggtctttatagggaatggctctcccgtactgaaggagatttggggcaattgttgccagggggtagtgca

SEQ ID NO: 8179 - DNA, 603 bp, Artificial Sequence
  Description of Artificial Sequence: Synthetic coding sequence
atgtcccgacgtgaggggtccctggaggatccccagaccgatagttctgtgtcactcctcccgcatctggaagccaagatccgtcaaacccattctctggcccacttactgactaagtatgctgaacaactgttgcaggagtatgtccagctccagggcgaccccttcggtctgccgagcttctccccgcctcgtctgcccgtggcaggattgtctgccccggccccaagccacgcgggtctgcctgtccatgagcggctgcgcctggacgcagctgccctggcagctctaccaccacttctcgatgcagtctgcagacgacaggctgagttgaatccccgggctcccagactcctcagacgattagaggatgctgcaaggcaggctcgcgctctgggcgcagctgtggaagcactgctcgccgcacttggggccgccaacagaggcccccgagccgagcctcctgcagcaacggcttccgccgcttctgctaccggagtcttcccagcaaaagtcctgggactccgtgtttgcggcctgtatcgtgagtggctgagccgaaccgagggggatctgggtcagctgttgcccggtgggagtgct

SEQ ID NO: 8180 - DNA, 603 bp, Artificial Sequence
  Description of Artificial Sequence: Synthetic coding sequence
atgagtcggcgagaaggcagcttggaagacccccagaccgactctagtgtcagtctgctcccacatctagaggcgaaaatccgtcagacccacagtttagctcacctgctgactaaatatgcagaacagttgctccaggagtatgtccagctgcaaggagatccatttggactaccaagcttcagccccccccgcctccctgtggccgggttgtccgcccccgctccttcacatgcgggcctacccgtccatgagaggttgaggctcgacgcggccgccttagctgctctaccccccttgctcgacgccgtatgtaggagacaggccgaattgaaccctagggcacccagattactccgccgactagaagatgccgctaggcaggcgcgagctctcggcgcagctgtagaggcccttctggccgccctcggagctgcaaatagaggacctcgcgcagaacctcccgcggccacagcaagtgccgcatccgccacaggagtatttcctgcaaaagtcctgggccttcgtgtctgtggtctctacagggagtggctgtcacgcactgaaggcgatctaggtcagctcctcccaggcggcagtgca

SEQ ID NO: 8181 - DNA, 603 bp, Artificial Sequence
  Description of Artificial Sequence: Synthetic coding sequence
atgagtcgcagagaagggagtctcgaagaccctcagacagacagcagcgtgtccctactgcctcatctggaggctaaaatacgccaaactcacagtctcgctcacctattaaccaaatacgcagaacaactgttgcaggaatacgtccaactgcaaggcgacccttttggactgccaagtttttcaccccctagattaccagttgctggcttgtctgccccagccccttctcacgctggtctacccgtgcatgagaggctgaggctggatgctgccgccctggcagctctccctccactacttgatgctgtctgccgacggcaggccgaactaaatcctcgtgccccccgcctgctcagacggttagaagacgcagcccgccaagcaagagcactgggggccgccgtcgaggctttgttggccgccttaggggcagccaataggggacctcgggccgagcccccagccgccaccgcctccgcagccagtgctactggcgtctttcctgccaaagtcctagggctgagagtatgcggcctttatcgagaatggctcagcagaacagagggcgacctaggccagctactcccaggcggtagcgcc

SEQ ID NO: 8182 - DNA, 603 bp, Artificial Sequence
  Description of Artificial Sequence: Synthetic coding sequence
atgagtagaagagaaggtagtttagaagatccacaaacggatagtagtgttagtcttttaccacatcttgaagctaaaattcgtcaaacacattctttggcacatttattaacaaaatatgctgaacaacttttacaggaatatgttcaattacaaggagatccattcggattaccttcattttcacctccaagattaccagtagcaggattatcagctccagccccaagtcatgcaggtcttcctgtacatgagagattaagacttgacgcagcagctttggctgcacttccacctcttttagatgcagtgtgtcgaaggcaagctgaattaaatccaagagcaccacgtcttcttcgacgtcttgaagatgctgcaagacaagctagagcattaggagcagctgtagaagctcttcttgcagcacttggagctgctaatagaggaccacgagcagagcctccagctgcaactgcttcagctgcttcagccacaggtgttttccctgcaaaagtattaggacttagagtttgtggattatatagagaatggttatcacgtacagaaggagatttaggacaattattaccagggggatcagca

SEQ ID NO: 8183 - DNA, 603 bp, Artificial Sequence
  Description of Artificial Sequence: Synthetic coding sequence
atgtcccgccgagaagggtcgctggaggacccgcagactgattcttcggtttccctgctgccgcaccttgaggctaagattagacagacccatagcctcgctcatttgctgaccaaatatgccgaacagttgctgcaagaatatgtgcagctccagggagatccgttcggactcccgtcgttctccccacctcggctgccggtcgccggtctgtcggcaccagcaccgtcccatgcaggcctgcctgtgcacgaacggctgcgcctggatgcagccgccctcgcggccctcccaccgctgctggacgctgtgtgtcggaggcaggccgagctgaatccgcgggctccgcggcttctcaggcgattggaagatgccgctcgccaagcaagggcactcggggccgctgtggaggccctcctcgccgcattgggagcagcaaaccgcggaccgcgcgccgaaccacccgcggcgaccgcgtccgccgcttcggcgactggggtctttcccgccaaggtgcttggactcagagtgtgcggactttaccgcgaatggctcagcaggaccgagggcgatctgggacagctgctgcctggaggctcggct

SEQ ID NO: 8184 - DNA, 603 bp, Artificial Sequence
  Description of Artificial Sequence: Synthetic coding sequence
atgagtcgacgcgagggctcccttgaagatcctcagaccgattcctctgtcagcctactgccgcatttggaggcaaagatcagacagacacactcattagcccacctcttgacaaagtacgcggagcagcttctccaagaatacgtgcagcttcagggagatcctttcgggctcccctcattttcaccaccccgcttgcctgtagccggtctatcggcccctgccccatcccacgctggtcttcctgtgcacgagcggctcaggctggacgccgcggcactagccgctctgccacccttgctcgacgcagtgtgtcggcgtcaggctgagcttaatccacgggcgcccaggctcctgcgccgtcttgaagatgcggcccggcaggcgcgtgctctgggcgcagccgtggaggccttacttgccgctttaggagccgcaaacaggggcccacgggctgaacccccggcggcaacagcctccgctgcgtctgcaaccggcgtgtttcccgccaaggtgctgggacttagagtgtgcggactgtatcgcgagtggctttccaggaccgagggggacctaggccagctgcttccgggtgggtccgcc

SEQ ID NO: 8185 - DNA, 603 bp, Artificial Sequence
  Description of Artificial Sequence: Synthetic coding sequence
atgtcaaggagggaaggtagccttgaggacccccagaccgactctagcgtctccctgctgcctcacctggaagcaaagattagacaaacacacagcttggctcacttgcttactaaatacgcggaacagctgcttcaggagtacgttcagctgcagggtgacccttttgggttgccgagctttagccctccgcgactgcccgtggcaggactgtctgcacccgccccatctcacgcaggcctgccggtccatgagaggctgcggctggacgccgccgccctggcagcactgcccccactccttgacgcagtgtgcagacgccaggccgagctgaacccaagagctccaaggctgcttaggagacttgaggatgcagcgagacaagcccgcgccctgggcgcagcggtggaggccctcctggccgccctgggcgccgctaaccgcgggcccagggccgaaccgccagccgcaacagccagcgccgcttctgcgactggtgtgtttcccgcaaaggtgctggggctgagagtatgcggactttatagggaatggctttcacgaaccgagggcgaccttgggcagctcctgcccggaggctccgct

SEQ ID NO: 8186 - DNA, 603 bp, Artificial Sequence
  Description of Artificial Sequence: Synthetic coding sequence
atgagtcggcgcgagggatctctggaagacccgcagaccgattctagcgtttcactcctgccacacctggaagcgaagatccgccaaactcactctctcgctcatttgttaacaaagtacgcagaacaactgctgcaagaatacgtccagctacagggagacccctttggtcttccaagcttctcccctcctaggctccccgtggccggtttgtctgcgccagccccatcacacgctgggcttcctgtacatgagcggttgcggctggatgctgccgccctcgccgccttacccccacttctggatgcggtatgtcgccgccaggcggaactgaacccgcgggctcctcgcctgctcagacgattggaggatgccgcgcgccaagcaagggcattgggagccgccgttgaagccctgctggccgctttgggtgcagcaaaccgcggaccacgagccgagcccccagccgccactgcttctgctgcatccgcgacaggagtcttcccagccaaggttttggggctgcgggtttgcggcttgtatagggaatggctgtccagaacagagggtgatctaggacagcttctcccgggcggctctgcc

SEQ ID NO: 8187 - DNA, 603 bp, Artificial Sequence
  Description of Artificial Sequence: Synthetic coding sequence
atgtcacgccgggaaggaagtctggaagatccgcagactgatagttccgtgtcactactcccccacctcgaagcgaaaattagacaaacccatagtttggcccatctgctaacaaagtatgctgaacaattgctccaagaatatgtacagttgcagggtgaccccttcggcttgccgtcgttcagtcctccgagactaccagttgccgggttaagcgcaccagctccatctcatgctggcctgcccgtccacgagcgcttgagattagacgccgcagcattagcagcattacctccattactagacgctgtgtgcagaagacaggctgaactaaatcctcgagctccgcgactccttcgtagacttgaagacgcagcgcgccaagcacgtgctttgggagctgctgtagaggccctcctcgcagcactgggagcagctaatagaggaccaagagccgagcctccagccgcaacagctagtgcagcttcagctaccggtgtttttccagctaaggtgctaggacttagagtgtgtggtctctatcgggaatggcttagccgaactgagggagaccttggacaattgctgccaggcggatcagct

SEQ ID NO: 8188 - DNA, 603 bp, Artificial Sequence
  Description of Artificial Sequence: Synthetic coding sequence
atgagccggcgcgaaggaagcctcgaagatccgcagacggactcgagcgtgagcctgctgccccacctcgaggcgaagattagacaaactcattcactggcacatctgctgactaagtacgcggagcagttgctgcaggaatacgtgcaacttcaaggcgaccccttcgggctgccgtcgttctcgccgccacgcctgcccgtcgcgggactctccgccccagcgccttcccacgccggactgcccgtccacgaaaggctccgcctggacgctgccgcgctggcggcactgccgccgctccttgacgccgtctgtcgccgccaagcggagctgaacccgcgggccccgcggttgcttagaaggctcgaggacgcagctaggcaggcgcgggcactgggcgcggcggtggaggcgctcctggcggctcttggtgcagctaatcggggtccccgcgcggaaccgcctgctgccaccgcatccgcggcctcggcaacgggcgtctttccagccaaagtcctggggctgcgggtctgcggactgtaccgggagtggctctccagaaccgagggggacctgggacagctcctgcctggcggcagcgcc

SEQ ID NO: 8189 - DNA, 603 bp, Artificial Sequence
  Description of Artificial Sequence: Synthetic coding sequence
atgagtaggcgagagggttctctcgaagaccctcagaccgatagttcagtgtcgttgctgccacatctggaagcaaagatcagacagacgcactcccttgcccacctgctgaccaaatacgcggagcagctcctgcaggagtatgtccagctccagggtgatcctttcggcttgccatcatttagtccccccaggctgccggtagctgggttaagcgcgcctgccccctcacatgcaggcttgcctgtgcacgagcgtctgcggttggacgccgcagctcttgccgctctgccacctctcctcgatgcagtgtgtcgcagacaagcggaactgaatccgcgggcgcctcggctgttgcgccgactcgaggacgccgcccgacaggctcgagcgctgggagccgccgtcgaagccctgctggcagccttaggtgccgctaatagaggcccacgggcggaaccacccgctgccactgccagtgctgccagcgcaaccggagtgttccctgccaaagtgctggggttgcgtgtctgcggtctgtatagagagtggctcagcaggaccgagggggacctggggcaactcctgccaggaggctccgcc

SEQ ID NO: 8190 - DNA, 603 bp, Artificial Sequence
  Description of Artificial Sequence: Synthetic coding sequence
atgtccaggcgcgagggcagccttgaggacccacagacggatagtagcgtatccctgctgcctcaccttgaggccaagattcgacaaacccacagcctggcacacctgttaaccaaatacgctgaacagttgctacaagagtatgtccagctccaaggggacccattcggtctgcctagcttctccccacctaggctcccagtggcaggcctcagtgcacctgccccctcccacgcaggacttcctgttcacgagaggcttcggctcgacgcagcagcgctggctgcccttcctccactccttgacgctgtgtgcaggcggcaagccgaactaaatcctagagcacctaggctgctgcggagattggaagacgccgctcgccaggcccgcgcacttggagccgccgttgaggcgctgcttgcagctttaggagccgccaacagagggccccgcgcagaacctcccgcagctaccgcgtctgctgccagcgctaccggtgtttttcctgctaaagtcctcgggctgcgtgtatgtggactgtatagggaatggttgtcccgtacagaaggagacctggggcagctcctccctggaggctctgca

SEQ ID NO: 8191 - DNA, 603 bp, Artificial Sequence
  Description of Artificial Sequence: Synthetic coding sequence
atgtctagaagggaaggatcactggaagacccacagacagattcctctgtatcactcctgccccacctggaagcaaaaatcaggcagacacattctcttgcccatttgttaactaaatatgctgaacaactcctccaggaatatgtccagctgcaaggagacccatttggactaccaagtttttctcctcccagactcccagtagcgggactctccgctcctgcacctagtcatgccggactacctgtacatgagcggctccggctagatgccgcggccttggctgccctgcccccactgctcgatgccgtctgtcggaggcaggctgaactgaaccctcgagcccctaggctcctcagaaggttagaagatgccgcacgacaggcccgggcgctgggagctgctgtcgaagctctcctggccgcacttggggcagccaatcggggacccagggctgagccccctgcggctacagcttctgccgcatccgctactggagtgtttccagctaaagtgctaggactccgggtctgcggattataccgagaatggctcagtcggactgagggagatttgggacagctcttacccggagggtccgca

SEQ ID NO: 8192 - DNA, 603 bp, Artificial Sequence
  Description of Artificial Sequence: Synthetic coding sequence
atgagtcggcgagaaggcagcctggaggatcctcaaacggatagcagcgtcagcctgcttcctcatctggaggcgaaaatccggcaaacacatagtctcgctcacctgctcactaagtacgcagagcagttgctacaagagtacgtccaactgcaaggagatccatttgggctgcccagcttttctccccccaggctccctgtcgctggtctgagtgctccagccccaagccatgctggattaccagtccacgagagactgcgccttgacgctgccgccttggccgccttgccaccactcctagatgcagtctgtcgccgacaggccgagctgaacccaagggccccaaggctgctgcgccggctggaggatgccgctaggcaggcaagagcactgggagcagcggtcgaagcactgctggcagctttgggagcagctaaccggggtccacgggcggagccccctgcagccactgcaagtgccgcaagtgccaccggcgtcttcccagcaaaagtccttggactcagggtttgcggcctctatcgagagtggctcagcagaaccgagggtgacctgggtcaattactgcctggtgggagcgcg

SEQ ID NO: 8193 - DNA, 603 bp, Artificial Sequence
  Description of Artificial Sequence: Synthetic coding sequence
atgagccgacgggagggttctcttgaagatccacagactgattcctcagtgtcgctgctgcctcacctggaagccaaaattcgtcaaacccattcgctcgcacatctgctgactaagtatgcagaacaactcctccaggaatacgtccaactgcagggcgatccattcgggttgccttcctttagcccaccgaggctgccggtggcgggtctgtccgcacctgcaccttcgcatgcaggacttcctgtgcatgaaagacttagactggacgcggcagcactggcagcgctccctccactgctggatgcggtgtgtcgtcgccaggccgaattgaacccacgcgctccacggctgctgcgtcgcctggaagatgccgcacggcaggcgagagcactcggagcagccgtcgaagcccttctcgcggcccttggagctgcaaacagaggaccgagagcagaacctccagcagctaccgcatcagccgcgtccgcaactggcgtgttccctgcaaaggtgcttggtcttagggtgtgtggactctaccgagagtggctgtcacggaccgaaggagacttgggccagctgctccctgggggatcggca

SEQ ID NO: 8194 - DNA, 603 bp, Artificial Sequence
  Description of Artificial Sequence: Synthetic coding sequence
atgtcaaggcgggaagggtctttggaagacccgcagactgactctagcgtgtccctccttcctcatcttgaggcgaagattaggcagactcactccctagcacaccttctgaccaaatatgccgaacagcttttgcaagagtatgtacagctgcagggcgaccctttcgggttgcctagcttttctcctccccggcttcccgttgccggcctatctgccccagctcccagccatgcaggcctacctgtccacgaacgactccgtttggatgccgcggcgcttgctgcattgcctcctttgttggatgccgtttgccgtaggcaggccgaactaaacccgagggctccacgactgttgcggagactcgaggacgcagcacggcaggcacgagctttgggagcagctgtcgaagccctcctcgccgctctgggagccgccaatcggggaccgcgagccgagccccctgctgccaccgctagtgccgcctccgccaccggagtgtttcccgcaaaggtattgggtctgcgggtgtgtggcctttatagagaatggctgagccgcactgagggagatctcggccagttattgcccggcggatccgcc

SEQ ID NO: 8195 - DNA, 603 bp, Artificial Sequence
  Description of Artificial Sequence: Synthetic coding sequence
atgtccaggcgggagggctctcttgaagatccacagacagactcctccgtgtcattgttacctcatctggaagccaaaatacgtcagacgcactcactggcccacttgcttacaaagtacgctgaacagctgcttcaagaatacgtccagttacaaggtgatcccttcggcctgccctcatttagcccaccccggttacctgtggctggactgtctgcccccgccccatcacacgccggcctccctgtgcacgagcggctccgtctcgatgctgcagctctggcagcgcttccccccttgctggatgccgtatgcaggcgacaggcagagctcaatccacgtgccccccggctcttgagaagactggaggatgcagcaagacaggccagggctctcggagccgctgtcgaggctctgctggctgccttgggtgctgcaaatcgtggacctagggccgaaccgcccgccgccaccgcctcagcggcctcagctacaggtgtgtttcccgcgaaggtcctgggtctccgcgtatgcggactttacagagagtggctcagtaggactgagggcgatctcggacagctcttgcctgggggaagtgcc

SEQ ID NO: 8196 - DNA, 603 bp, Artificial Sequence
  Description of Artificial Sequence: Synthetic coding sequence
atgtcgaggagagaggggagcctggaggatccccagacagatagttcagtgagcttgctgccacatctggaggccaagatcagacagacacactccctagcacatctgctcacaaagtacgccgaacagttactgcaggaatatgtgcagctgcagggagacccattcgggctgccgtctttcagcccgccccgcctgccggtggcgggacttagtgcgccagctcctagccatgccggcctccccgttcacgaaagactacgcctggatgctgcggcacttgccgcactgccccccctgcttgacgcggtgtgccggagacaggcggaactcaacccacgggcacctcgacttcttcggaggctcgaggatgctgcacggcaggcgagggccctgggcgccgcagtggaagccctcctggcggcactcggcgctgccaaccgaggtccaagggccgagcctcccgcagccacggcttctgctgctagcgcaaccggcgtttttccagcgaaggtcctggggctgcgagtgtgtggactgtatcgtgagtggttaagccggacagagggggatctcggacaattgctcccaggcggctccgcc

SEQ ID NO: 8197 - DNA, 603 bp, Artificial Sequence
  Description of Artificial Sequence: Synthetic coding sequence
atgtcccggagggagggcagtcttgaagatccgcagactgattcatccgtgtcacttcttcctcatctcgaagctaaaattaggcaaacacattcgttggctcacttactgaccaagtacgccgagcagctgttacaggaatacgtgcagctgcaaggagacccgtttgggctgccatccttttccccccctaggttgccagtcgctggtctctccgcccccgcgccctcccacgccgggttgcccgttcacgaaaggctgcgtttagacgctgcggcacttgccgcactccctcctctcttggacgccgtatgcagacggcaagcggagttaaacccaagagctcctcggctgctccgcagactggaggatgctgcccgccaagctcgagccttaggcgcggccgttgaagccttgcttgcggccctcggagcggcgaaccggggaccgagagccgagccgccggctgctaccgcgagcgccgcttctgccacaggggtgttccccgctaaagttctcggcctgcgagtgtgtggcctttaccgggaatggctttcacggactgaaggggatttggggcaattgctacctgggggcagcgcc

SEQ ID NO: 8198 - DNA, 603 bp, Artificial Sequence
  Description of Artificial Sequence: Synthetic coding sequence
atgtctaggagagagggttccttggaagacccccagaccgactcatcagtgtccttgctgcctcatctcgaggccaaaattaggcagacccattccttggctcacttgttgacaaagtacgcggaacagctgctgcaggaatacgtgcaactgcagggtgatccatttggtttgccttcattcagtccacccaggctgcccgtggctggtttgagtgctcctgctcccagccacgcaggtttgcccgtgcatgaaaggctgcgcctggacgcggccgctttggccgccctccctcctctcctcgacgctgtttgcaggaggcaggcagagttgaatcctagggccccaaggctcctccgcagactggaagatgctgcaagacaagcgcgcgctcttggtgccgctgttgaagccctgctcgcggctctgggcgctgctaaccgcggcccaagggctgagcccccagccgcgacggcctccgccgccagtgcaactggcgttttcccagcaaaagtacttggactgagggtgtgtggcctctacagggaatggctgtctagaactgagggcgatctcggccagttgttgccaggtggttcagcc

SEQ ID NO: 8199 - DNA, 603 bp, Artificial Sequence
  Description of Artificial Sequence: Synthetic coding sequence
atgtccagacgcgaggggtctcttgaagaccctcagaccgattcaagtgtatcacttttgccgcatctcgaagccaagatcagacagacccacagcttggcgcacctgctcacaaagtacgctgagcagctcttgcaggagtatgttcagttgcagggggacccctttggcctcccgagcttctctccccccaggttgccagtcgcaggcctctcggcaccggcaccgagccacgccggccttcctgtccacgaaaggctgcgtctagacgccgcagcgctcgccgcactcccacctttgctggacgccgtctgcagacgtcaggctgagcttaacccaagagccccccgcctgctgagaaggctcgaggacgctgccaggcaggcacgcgcccttggcgccgccgtcgaagcattattagctgctcttggcgctgccaatcgcggcccaagggcagagccacctgctgccactgccagcgctgcctcggctaccggagtgtttcctgcaaaggtgttggggttgcgagtatgcggcctgtatcgtgaatggttgtcccgcacggagggggacctgggccagctcctgcccggggggagcgca

SEQ ID NO: 8200 - DNA, 603 bp, Artificial Sequence
  Description of Artificial Sequence: Synthetic coding sequence
atgtcaaggagagaaggctcgctggaagatcctcagacggactcgtccgtctcactcctgcctcatcttgaagcaaagattaggcaaactcatagccttgcacatcttctgaccaagtacgccgaacaacttctccaggagtacgtgcagcttcaaggtgacccatttggcctgccatctttttcgcccccgcgtctcccagtggcaggcctttccgcacctgccccttcccatgcaggcttgccagtgcacgaaaggctgagacttgacgccgctgcacttgctgcacttcctccactcctcgacgcggtgtgccgccgtcaggcagaactgaaccccagggcgccacgccttcttcggagactggaagatgctgcacgccaagcccgggcgctgggtgcggcggttgaggcattgctcgctgcccttggcgccgcaaacaggggaccaagggcagagccccctgcggcaactgcatcagcagcatctgccactggagtgtttccagcgaaggtgcttggtcttagagtgtgtggtctgtaccgggaatggctttcccggacggaaggggatcttggtcaacttctgccagggggtagcgcc

SEQ ID NO: 8201 - DNA, 603 bp, Artificial Sequence
  Description of Artificial Sequence: Synthetic coding sequence
atgtctaggcgggagggcagccttgaagacccacagacggattccagtgttagtcttctgccgcacctggaagcaaagatccgacagacccacagcctcgcccatttgttgaccaagtatgccgagcagctgttgcaggaatacgtacaactccagggcgatcccttcggattgccaagttttagtccaccacggctacctgtcgctggcttgtctgcacccgctcctagccacgccggtctgcccgtgcatgaacggctccggcttgatgcagcagctctggccgccctccccccattactggacgccgtgtgtcgaaggcaggccgagctgaatcccagggctccccgcctgctacggagacttgaagatgccgcgaggcaggcccgcgcactgggcgccgccgttgaggcgctcctcgctgccctgggggctgctaatcgcggcccgagagcggaaccacctgccgctaccgcctccgctgcatcagctaccggcgtgtttccggcaaaggtcctgggattacgtgtctgcggcctgtatcgcgagtggctgagcaggacagagggggacttaggccaactgttaccgggcggcagcgcg

SEQ ID NO: 8202 - DNA, 603 bp, Artificial Sequence
  Description of Artificial Sequence: Synthetic coding sequence
atgtcccgtcgggagggaagtctggaggatccacaaaccgacagcagcgtctcgctcttgccgcacctcgaagcaaagatccgccagacgcattcactggctcacctgcttaccaagtacgccgaacaactgctgcaggaatacgtccaactgcagggggatccctttggcttgccatcgttcagcccgccaagactgccagtggccggactctctgccccggcaccgagtcacgccggactcccggtgcatgaacggttgcgcctggacgccgctgctcttgctgcattgccacctctcttggacgcggtgtgcaggagacaggcggagctcaatccgagagctccgcgcttgctgcgtcggctggaggatgccgcccgccaggcgagagcactgggcgccgcagtggaagcactgctcgcagctctgggggccgccaaccgcggtccccgggcagagccccctgccgcgaccgcttccgcggcgtccgcgactggagtgttccctgcgaaagtgcttggtctgcgggtctgtggactctaccgcgagtggctctcgagaactgaaggcgacctcggccagctgctgccaggaggaagtgcc

SEQ ID NO: 8203 - DNA, 603 bp, Artificial Sequence
  Description of Artificial Sequence: Synthetic coding sequence
atgtcccggcgtgaaggtagtctggaagacccgcagactgattctagcgtttcactcctgccccacctggaggctaagatccgtcagacacactccctggcccacctgctgaccaagtacgcagagcagctactccaggagtacgtgcagctacagggcgatccctttggactcccgagtttttcaccccctcggcttccggtagccggtctgtcagccccagctccatcccacgccggacttcccgtacacgaaaggctgcgcctggacgctgccgctcttgctgcccttccacccctccttgacgctgtttgtcggcggcaagctgaactgaatccccgggcccctcgtctgctgcgccgtctcgaagatgcagctcgccaggcgcgtgctctgggcgcagccgtcgaggcgctgctggccgccctgggtgccgcgaaccgtggcccgcgcgcggagccgccggccgctaccgcaagcgccgcctctgccaccggtgtttttcccgcaaaggtgctcggcctccgtgtctgtggattgtaccgcgagtggttgagcaggactgaaggcgatcttggccaacttctccccggtggttccgcg

SEQ ID NO: 8204 - DNA, 603 bp, Artificial Sequence
  Description of Artificial Sequence: Synthetic coding sequence
atgtcacggcgcgaaggctcgcttgaggacccacagaccgatagcagcgtgagcttgctgccccatttggaagccaagattcggcaaacgcactccctggcgcaccttctgactaaatacgcggaacagttgctccaggagtacgtgcaactgcaaggagatccgtttggtctgccatcgttctcgccgccgaggctgccggtggctggactgtccgctcccgctccttcgcacgcaggactgcctgtccacgaacgcctgcgcctggacgctgcggctttggcggctctgccaccattgctcgacgctgtgtgtcggcggcaggccgaattgaacccgcgggcccctcggttgctgaggcggctggaggatgccgcacggcaagcgagagctctgggagcggccgtggaggctctgctcgctgcactcggagcagccaacagaggacccagagccgaacctccagccgcaaccgcgtcagccgcaagcgccactggtgtgtttccggcgaaggtccttggacttagagtgtgcggactctaccgggagtggctgagccgtactgaaggagatctcgggcagctgcttccaggagggtcggct

SEQ ID NO: 8205 - DNA, 603 bp, Artificial Sequence
  Description of Artificial Sequence: Synthetic coding sequence
atgagcaggcgcgaaggctctttggaggacccgcaaactgactcctccgtgtcgctgctgccgcacttggaagcaaagatcagacagactcatagcctcgcccacctgcttacgaaatacgccgagcaactcctccaggaatacgtgcaactccagggcgacccatttgggcttccgtcgttctcgccgccacgcctgccagtggcgggtctgtcggcgccagctcctagccacgctggacttccggtgcacgaacggctgcggctggatgccgcggcccttgcggcgctgccgccgctgttggatgccgtgtgccggcgccaggcggaactcaatccgagagcaccacggctccttcggcggcttgaggacgcggctaggcaggcccgcgccctcggggccgccgtggaagctctgctggccgcgctgggagccgccaaccgaggaccgagggcagaaccacctgcagcgacggcctcagcagcctcggcaactggtgtattcccagcaaaggtcctcggactcagagtgtgtggactctaccgcgaatggctctcccgaaccgagggcgaccttggacagctcctgccaggagggtccgca

SEQ ID NO: 8206 - DNA, 603 bp, Artificial Sequence
  Description of Artificial Sequence: Synthetic coding sequence
atgagccggagagaagggtctctggaagacccccaaacagactcctctgtgagcttgttgccccacctggaagcaaagattagacagacacacagcctggcacaccttttgaccaagtatgcggaacagcttttgcaggaatacgttcagttgcagggcgatcccttcgggcttccaagcttctcaccgccacggttgcctgttgccggtctctccgctcccgccccatctcatgccgggctgccggtgcacgagcggctgaggctcgacgccgctgccttggccgcactgcctcccctgctcgatgcagtctgtcggaggcaggcagaactgaatccccgcgctcctcgattgttgaggagattggaagatgctgcacggcaagcgcgggccctgggggccgccgtggaggcactgctcgccgccctgggcgctgctaacaggggtccccgagccgaaccgccggccgccacggcctccgcagcctcagccaccggcgtctttccagcaaaagtgttgggtctgagagtctgtggactgtatagggaatggttgagccggaccgaaggggacctgggtcagctcctcccaggcggctcagcc

SEQ ID NO: 8207 - DNA, 603 bp, Artificial Sequence
  Description of Artificial Sequence: Synthetic coding sequence
atgtcacgcagggaaggatcccttgaggaccctcagactgattcatctgtgagcctccttcctcatctggaggccaaaattcgccagacgcactcactggcacatctcctgaccaagtacgcagaacaactccttcaagaatacgtccaactgcaaggtgacccgttcggacttccatccttttcacctccacgactgcctgtggcaggtctttcggccccggcaccatcccatgcaggacttcctgtgcatgaaagacttcgccttgatgcggccgccctcgctgcgctcccccctctgcttgatgctgtgtgtagacgacaagccgaactcaaccctcgagcacctcgactgcttcgtagactggaagatgcggctcgccaggccagagcactgggagccgcagtcgaggcactccttgctgcactcggagcagccaacagagggcctagggccgaacctccggccgcaactgcatccgcagccagcgcaactggggtctttccagcgaaggtcctggggcttcgagtctgtggtttgtaccgcgaatggctctcgcgcactgaaggagatctgggtcaacttctgcccggaggatccgca

SEQ ID NO: 8208 - DNA, 603 bp, Artificial Sequence
  Description of Artificial Sequence: Synthetic coding sequence
atgtctcggcgcgaaggctcgcttgaggacccccagacggactcaagcgtctcactgctccctcatctggaagccaaaattcggcaaacccattcacttgcccacctgctgactaagtacgcagaacagctgctccaagaatacgtgcaactgcaaggtgaccctttcggtctgcctagcttttcgcctcctagactgcccgttgcaggtctgtctgcacccgcaccttcgcacgccgggctgccagtccacgaaagactgcgtcttgatgcggcagctcttgcagcactgcctcccctgctggatgcagtatgtaggaggcaggcagaactcaaccctcgtgcaccgagactgcttaggcggcttgaagatgcggcacgacaggccagggcactgggggcagctgtggaagcactgcttgcggcactcggtgcagcaaatcggggcccaagagcagaaccaccagcagctaccgcgagcgccgcgtccgcaactggagtgtttcctgccaaggtgcttggcttgcgggtgtgcggactttaccgagaatggctttcgcgaactgaaggggacttgggacagcttcttcctggagggtccgcc

SEQ ID NO: 8209 - DNA, 603 bp, Artificial Sequence
  Description of Artificial Sequence: Synthetic coding sequence
atgtccagacgggagggttcactcgaagatcctcaaaccgattcgtcagtgagcctgttgccacatcttgaagcgaagatcagacagacccactcgttggcccatctcctcaccaagtacgcagaacaacttctgcaagagtacgttcaacttcagggggatccttttggacttccatcgttcagccctccacgactgccggtggcaggtttgagcgctcccgccccgagccatgccggccttccggtccacgagcggctcagactggatgcagccgcattggcagcgttgcctcctcttctggacgccgtgtgtaggagacaggccgagctgaaccctagagccccacgcctgcttcgtaggcttgaggacgcagcaagacaggcacgcgccctgggcgcagccgtggaagctctgttggcagctctgggggctgcaaaccgcggcccccgcgctgaacctccggcagcgaccgcatccgccgcgtctgcgaccggagtgtttccagctaaagtcctcggacttagggtatgtggtctgtaccgagaatggctgtcaaggacggaaggagatctcggtcaactgttgccaggaggatccgca

SEQ ID NO: 8210 - DNA, 603 bp, Artificial Sequence
  Description of Artificial Sequence: Synthetic coding sequence
atgtcacggcgagagggatcacttgaagatccacaaactgactcatctgtttcgctgctcccacatctcgaagcaaagattagacaaacccattcactcgcccatctcctgaccaaatacgcagaacagcttctgcaagaatacgtgcagcttcagggtgacccctttggactgccttccttctccccacctaggctgcccgtggcgggcctttcggctcccgcgccatcccacgccggtttgcctgtgcacgagagacttcgcctggatgcagcagcacttgcagcattgccccctctcctggacgcggtctgtagacggcaagctgagttgaaccctagggctccgcgtctgcttaggagactggaagatgctgcacggcaagctcgagcactcggcgcagcggtggaagcccttctcgccgcgctgggagcagcaaatcggggacctcgagccgagcctccagccgccaccgcttcggcagcgtccgcaacgggcgtttttccggctaaggtcctcggtttgagagtgtgcggactgtacagagagtggttgtctcgtactgaaggcgatcttgggcaacttcttccgggtggatcggcc

SEQ ID NO: 8211 - DNA, 603 bp, Artificial Sequence
  Description of Artificial Sequence: Synthetic coding sequence
atgtcgcggcgagaaggatcactggaggacccgcagactgattcatctgtctcgctgcttccgcatttggaggccaagatccgccagacccactcgctggcacacctcctgactaagtacgcagaacaacttctgcaagaatacgtgcaactgcaaggcgacccattcggcctgccttcattcagcccgcctcgcctgccagtggcaggactgtcggcccccgcgccatcccacgctggactccctgtgcacgagcggctcagactcgacgcggcagccttggccgcactcccgcctctcctcgacgcagtctgccgccggcaggcggagctcaacccacgtgcgccgcggctgctgcgccggctcgaggacgcggcccgccaggcgagagccttgggagccgcagtggaggcactcctggcggcactcggcgcggccaatcggggaccacgggctgagcctccagctgcaactgcctccgctgcgtccgccaccggagtgtttccggccaaagtgctgggactgcgcgtgtgtgggctttaccgcgaatggctgtccagaactgaaggggacctcggacagctgctccctggtggatcggca

SEQ ID NO: 8212 - DNA, 603 bp, Artificial Sequence
  Description of Artificial Sequence: Synthetic coding sequence
atgtcccgccgcgaaggctcgctcgaagatccgcagaccgactcgtcagtctccctcctgcctcatctggaagctaagatcagacagacccatagcttggcgcatcttctgactaaatacgctgaacaactgctccaggaatacgttcagttgcaaggcgacccattcggtctgccgtcgttttccccaccgcgcctccctgtggccggcctgagcgcgccggccccatcgcatgccggtctgcccgtgcacgagcggctgcggctggatgctgcggcgctggccgcactgccacctctcctggacgcagtgtgtcgccgtcaggcggagctgaacccccgggcgccgagacttctgagacgccttgaggacgccgccaggcaggctcgggccctgggtgccgccgtggaggccctcctggcggcacttggggcggcaaacaggggacctcgcgcagaaccgcccgcagccactgcatccgcagcaagcgcaaccggagtgtttccggctaaagtgctgggactgagagtctgcggactctaccgcgagtggctgagccgcaccgagggagatctgggacaactgctccccggagggtccgct

SEQ ID NO: 8213 - DNA, 603 bp, Artificial Sequence
  Description of Artificial Sequence: Synthetic coding sequence
atgagtaggcgggaaggatcactggaggacccccagactgatagctcagtgagcctcctgccacatctggaggctaagattagacagacccacagcctggctcatctcctgacaaagtatgcagaacagctgctgcaggagtatgtgcaactgcaaggagatccctttgggctcccatctttcagtccaccacggttgccggtggctgggctgtccgcccccgcaccatctcatgccggtcttcctgtccacgaaaggctgcgcttggacgctgccgcactcgccgccttgccccccctcctcgacgcagtctgcaggaggcaggcagagctcaatcccagggcgcccaggctgctccggcgcctggaagatgccgcccgacaggccagggctctgggggctgccgttgaggctcttttggctgccctcggcgccgcgaataggggccccagggctgagccccctgccgccacggcctccgccgccagcgccacaggggtgttcccagccaaagtgctcggtctcagagtatgcggactctaccgcgaatggctctctcgcacggagggcgacttgggacagctgcttcccggcgggtccgcc

SEQ ID NO: 8214 - DNA, 603 bp, Artificial Sequence
  Description of Artificial Sequence: Synthetic coding sequence
atgtcacgcagggaagggtcactggaggatccccaaaccgattcgagcgtgtccctgctcccgcaccttgaggcaaagatcagacagacgcactccctcgcgcacttgttgactaagtacgccgaacagcttctgcaggaatacgttcagcttcaaggagatccttttggcctgccctcctttagcccaccaagactgccagtggccggtcttagcgcaccggcaccttcgcatgcaggactgcctgtccatgagagactccgactggatgcagccgcactcgcggcactgcccccgttgttggacgcagtctgtcggcggcaagcagagctgaacccgcgtgcaccacggctcttgaggagactggaagatgctgcacggcaggcgcgggcattgggagcagcggtggaagcactgctggcagcactcggagcggcaaaccgcggaccccgggcagaacctcccgcagctaccgcaagcgctgcctcagcgactggagttttccctgcaaaggtgctcgggcttcgcgtgtgtggactgtaccgcgaatggctctcccggaccgaaggagatctgggccaactgctgccaggaggctctgca

SEQ ID NO: 8215 - DNA, 603 bp, Artificial Sequence
  Description of Artificial Sequence: Synthetic coding sequence
atgtctaggcgtgagggctcgcttgaggatccccagacggatagctccgtttccttgctcccccacctagaagctaagattaggcagacgcattcactggcccatctgctgaccaaatacgcagaacagttactgcaggaatatgtacagttgcagggggatccgttcggactcccttcattctccccaccgcgattgcctgtcgctggattgagcgcacccgccccctcccacgctgggctgcccgtgcatgaaagactcagactggacgcagccgccctagccgccctgcccccattgctggacgcagtatgtcgtcgccaggcggaactgaaccctcgggctccacgcttgctccgtcgcctggaggatgcagccagacaggcgcgcgccctgggggctgccgtggaggcactgctcgcagcgctgggggccgctaatagagggccacgggccgagcctcccgcagctaccgcctctgccgcgtccgccaccggcgtttttcctgccaaagttctcggactgcgtgtgtgcggactgtatcgcgagtggctcagtaggacagagggggacctgggccaacttttgccgggaggctcggcc

SEQ ID NO: 8216 - DNA, 603 bp, Artificial Sequence
  Description of Artificial Sequence: Synthetic coding sequence
atgagcagaagagagggttccttggaggatcctcaaactgactcttccgtgtcgctgttgcctcaccttgaggccaagatcaggcagacccactcactggctcacctgctgacgaaatacgcagagcaactgttgcaagaatacgttcagctgcagggagatccctttggcctcccgtcattctcgccgccaaggttgcccgtggctggcctgtcagctccggccccaagccatgcgggactgccggtgcatgaacggcttcgcctggacgctgctgcccttgccgctttgccgcccctccttgacgctgtgtgccgccggcaagcagaactgaacccacgggccccgagactgctgagaaggttggaagatgcagcgaggcaggcgcgggccctgggagcagcagtagaggcactccttgcggctctcggggcagcaaacagaggccctcgagccgaaccgccagccgccaccgcctcggccgcgtccgccaccggcgtctttcccgcaaaggtgctggggctgagagtgtgcggactctaccgagagtggctgagtcgcactgaaggggacctgggacagctgctccccggaggaagcgcg

SEQ ID NO: 8217 - DNA, 603 bp, Artificial Sequence
  Description of Artificial Sequence: Synthetic coding sequence
atgtcacgccgggaaggaagcctggaggatccccaaactgacagctcagtgtcacttctgcctcatctcgaggccaagattaggcagacccacagtctggcacacctcctgaccaaatacgcagaacagcttctccaggaatacgtgcaactccaaggagatcccttcggactgccgtcattttcaccgccccgccttcctgtagcaggactctccgctcctgcaccatcgcacgccggtctgccggtgcacgaacgtcttagactggacgccgcggcacttgcggcacttcctccattgctggatgcagtgtgcaggcgtcaggcagaattgaaccctcgagccccacggctgctgcgcagactggaggatgcagctcgtcaagcacgcgcgcttggcgcggcagtcgaagcccttctcgcagcactgggggccgcgaatcgaggcccaagagcagaacccccagcggcaacggcgtcggcagcatcagcaactggagtgttccctgcaaaggtcctcggactcagagtctgtggactttacagagagtggctgagccggactgaaggcgatctgggtcaattgcttccgggcgggtctgcc

SEQ ID NO: 8218 - DNA, 603 bp, Artificial Sequence
  Description of Artificial Sequence: Synthetic coding sequence
atgtccaggagagagggttcactggaagacccccaaactgatagttcagtgagcctgttgccccacttggaggctaagattaggcagactcactcacttgctcatcttctgacaaaatatgcggagcagctcttgcaggagtatgttcaactgcagggggacccttttggactgcccagcttcagtcctccgagactccccgtcgctggtctgtctgcgcccgcgcccagtcacgcaggactgcctgtgcatgagcgattacgcttggacgctgccgccttggccgctctgccacctctgttggatgcggtctgcaggcgacaggccgagctgaatccgagagctcctcggctactgcgacggttggaagatgctgcacgccaggcacgggcgttaggtgccgcagtggaggctctgcttgccgcgcttggtgcagccaatcggggacctcgtgccgagccccctgccgccaccgcatcagccgcctccgctaccggtgtgtttcccgctaaggtgttgggcctgcgtgtttgcgggctgtatcgtgaatggttgagccgtacagagggagacttgggacagcttctcccgggcgggagcgcc

SEQ ID NO: 8219 - DNA, 603 bp, Artificial Sequence
  Description of Artificial Sequence: Synthetic coding sequence
atgtcccggcgcgagggaagcctggaagatccacaaactgattcatccgtctcgctgttgccacacctggaagcgaagatccgacagacccattccctggctcacttgcttaccaaatacgctgaacaactcctgcaggaatacgtgcagctccaaggagatccgtttggtttgccgtccttctccccgcctaggctcccagtcgcagggctgtccgccccggctccatctcatgctgggttgcccgtgcacgaacggctgcgcttggacgccgcggccctcgccgcactcccaccgctcctggacgcagtctgcagacggcaagctgaactgaacccgcgtgcccccagactgctgcggcggctggaggacgcggcgcgccaggcgcgggcgttgggagctgctgtggaggcactgctggccgcgcttggggcggcgaatcggggacctagggctgagccccctgctgcgacggcctcggcggcctcagctactggagtattccctgctaaggtcctcggtctgagagtgtgtggactttacagagaatggctttcgcgcactgagggagacttggggcagctgctgccgggcgggagcgct

SEQ ID NO: 8220 - DNA, 603 bp, Artificial Sequence
  Description of Artificial Sequence: Synthetic coding sequence
atgtcccgcagagaaggctcccttgaggatccacaaaccgactcttcggtcagccttctcccccatctcgaagctaagattagacaaacccattcgctggcacatctcttgaccaagtacgcggagcaacttctgcaagagtacgtgcaactgcaaggtgatccatttggactcccatccttttccccacccagactgccggtggcaggactttcggcacctgcgcctagtcacgcagggcttcctgtccacgagaggcttaggctggacgcagcagctttggcggccctgccacctctgctcgacgcagtgtgtagacggcaagcagagctgaacccacgcgcgccgagactcttgagacgactcgaagatgctgcaaggcaggccagagcgctgggcgcggctgtggaagcactccttgccgcactgggtgccgcgaacagaggtccacgtgcagaaccgcctgccgcaaccgcgtcggctgcctcggccactggtgtgttcccagcgaaggtcctgggcctccgcgtttgtgggctgtaccgagagtggctgagcagaacggagggagatctggggcaactcttgcctggcggatcagca

SEQ ID NO: 8221 - DNA, 603 bp, Artificial Sequence
  Description of Artificial Sequence: Synthetic coding sequence
atgtcgaggcgcgagggatcgcttgaggacccacaaacggactcaagtgtgtcgctgcttccacatctggaggctaagattcgccagacccattccctggcccacctgctgacgaaatacgcggagcaactcttgcaggagtacgtccagctgcagggtgacccatttggattgccatctttttcaccaccacgccttccagtcgcgggtttgagcgcgccggccccgtcgcacgcgggcctaccggttcatgagaggctcaggctcgatgccgccgcacttgcggcgctgccaccgctgctggatgccgtgtgccgccggcaggccgagctgaaccctagagcaccgaggctcctgcgccgcctcgaggatgccgcgcgtcaggcccgggcgctgggggccgcagtggaggcgttgctggccgccttaggggccgccaaccgcggcccaagagctgagcccccggccgccactgcctctgccgccagtgcgacaggggtgttccccgccaaggtgctcgggctgcgcgtgtgcggcctttaccgtgagtggctatcgcgcaccgagggagacttgggccaactgttgcccggcggctcagcc

SEQ ID NO: 8222 - DNA, 603 bp, Artificial Sequence
  Description of Artificial Sequence: Synthetic coding sequence
atgtctcgcagagagggatccctggaagacccccagaccgattcatccgtgtccctgctgcctcacctggaagcgaagatccgccagacccatagtctcgcacacctgctgaccaagtacgcagagcagctgcttcaggagtacgtccaactccaaggggacccgtttggtctgccatcgttctccccgcctcggctgccggtggcgggcctgtcagctcccgccccttcgcacgctggactgccagtgcatgaacggctgcgactggatgcagcagccctggcagcactgccgcctctgctggatgcggtctgccggcgccaggccgaactcaatccacgcgcgcctcgcctgctgcggaggctggaggacgctgccaggcaggcccgcgctctcggggccgctgtcgaagcgctcctggccgcgctgggagccgctaaccggggtcctcgggccgagccccctgcggccacggcgtcggccgctagcgcgactggtgtgtttccagccaaggtcctcggactgagagtgtgtggactgtatcgcgaatggctgtcgcggactgaaggcgacctgggccagctgctgcctggggggagcgcc

SEQ ID NO: 8223 - DNA, 603 bp, Artificial Sequence
  Description of Artificial Sequence: Synthetic coding sequence
atgtcgagaagggaggggagcctggaggaccctcaaaccgattcgtcggtcagccttcttccacatctggaagcaaagatacgccaaacgcactcgctggcacacttgttgacgaaatatgcagaacaacttctgcaggaatacgttcaactgcaaggtgatccctttggacttccctcgtttagccccccacgtctgcccgtggcaggactctcggccccagcaccctcgcatgctggccttcccgtgcatgagaggcttagactcgatgccgccgcactcgcagccctgccacctcttctggatgcagtgtgcagacgacaggctgaattgaacccgcgtgccccaagattgctccgacggcttgaagatgcagcaaggcaagcccgggcactcggcgcagcagtggaggcactgcttgccgccctgggggccgcaaatcgtggtccccgggcggaaccgcctgcggcaactgcatccgccgcctcagcaaccggtgtgttccctgctaaggtgcttggcctgcgggtctgtgggctgtaccgagaatggcttagccggactgagggggatcttggacagttgcttcctggaggatcagca

SEQ ID NO: 8224 - DNA, 603 bp, Artificial Sequence
  Description of Artificial Sequence: Synthetic coding sequence
atgtctagacgtgaaggaagccttgaggatcctcagacagattctagtgtgtcccttctgccgcatcttgaagccaaaattcgccagactcatagtctcgcgcatctgctgactaaatacgccgaacaactcttacaggaatatgtgcagctgcagggcgatccttttgggctgcctagtttctcccccccaagactgcccgtagctggcctgtctgctccggccccatcccatgcagggttgccggttcatgagcgactgaggctcgacgctgctgctctagcagccttgccgccactattggatgccgtttgccgcagacaagctgagctgaatccaagagcaccccgcctcctgagaaggctggaggatgccgcccggcaagcgcgagcgctcggtgcggctgttgaagccctcttggccgctctcggagcagcaaacaggggtcctcgcgcagaacctccagctgccactgcatccgccgctagcgccacgggtgtgttccccgcaaaggtcttgggactgcgtgtgtgtggactatatcgcgaatggctcagccgaactgaaggggatctgggccagctgctgcccggaggcagcgcc

SEQ ID NO: 8225 - DNA, 603 bp, Artificial Sequence
  Description of Artificial Sequence: Synthetic coding sequence
atgtcccggagagagggctcacttgaggacccacaaaccgatagttccgtatcacttctcccacacctcgaagctaaaatacgacagacccattccttggcccacctcctgactaaatacgccgagcaactactccaagagtacgtgcaactacagggggatcctttcggcctgccatcattctcgcctccgcgccttccagtggcgggcttgtcggcccccgcgccatcacacgcgggactgccagtccacgaacgactacggctggatgccgcggctctcgccgctctgcctccgctgctggatgctgtctgcagacgtcaggcggagcttaacccaagagcaccgcgcctgctgcgacgacttgaggatgctgctaggcaagcacgcgctttaggagccgccgtggaggccttgttggctgcattgggggccgctaatcgtggccctcgtgctgaaccgcctgccgccacggcctcggccgcctctgccacgggtgtgttcccggccaaagtgcttggcttacgtgtgtgcggattgtatcgagagtggttgtcccggactgaaggtgatctggggcaacttcttccgggaggaagtgca

SEQ ID NO: 8226 - DNA, 603 bp, Artificial Sequence; identical to SEQ ID NO: 8166
  Description of Artificial Sequence: Synthetic coding sequence

SEQ ID NO: 8227 - DNA, 603 bp, Artificial Sequence
  Description of Artificial Sequence: Synthetic coding sequence
atgtcgagacgcgagggaagcctggaagatccacagactgattcttcagtcagcctcctcccgcacctggaagccaagatccgccagacgcactcattggcccatctcctcactaaatacgccgaacagctgcttcaggaatacgtgcaactccagggtgacccgttcggcctgcctagcttttcccctccgcgtctgcctgtggcagggctgtcggccccggccccatcgcacgctggcctcccggtgcatgagcgactccggctggatgcagctgctctggcagcgcttcctcccctgttggacgctgtgtgcaggcggcaagccgaactcaacccgcgggcacccagactgctgcgcaggttggaggacgcggcccggcaggcccgcgcgctgggagcagccgttgaggctcttctggcagccctgggagccgcaaatcgcggaccaagagccgaaccgccagcggcgaccgcgtcagcggcctccgccaccggcgtgttcccagctaaggtcctcgggctgcgcgtctgtggactgtaccgggagtggctgtccagaaccgaaggagacttgggacaactgcttccgggtggctcggcg

SEQ ID NO: 8228 - DNA, 603 bp, Artificial Sequence
  Description of Artificial Sequence: Synthetic coding sequence
atgtcgcgccgggaaggttcccttgaagatcctcagactgactccagcgtgtcgcttctgcctcatctggaagcaaaaatcagacagactcattcgctggcccatctcctcaccaagtacgcagaacaactgctgcaagaatacgtgcaacttcagggagatccttttggccttccttctttttcgccaccacgtctgcctgtggcgggcctgagcgcacctgcaccttcacacgcaggtctgcccgtgcatgaacggctgcggcttgacgccgcagcccttgccgctttgcctcctctgctggatgcagtgtgtcggcgacaagcagagctgaatccgcgggcaccccgcctgctgcggaggttggaagatgcggcgagacaggcacgggcactcggagcggcagttgaagccctgctggcagctcttggagcagctaaccgcggaccgcgtgctgagcctccagcagcaactgcatcagcagcctctgcgactggagtgttccctgcgaaagtgctgggtctgagagtctgcggactgtatcgagagtggctgtcaaggaccgaaggagatcttgggcagttgcttcctgggggcagcgca

SEQ ID NO: 8229 - DNA, 603 bp, Artificial Sequence
  Description of Artificial Sequence: Synthetic coding sequence
atgtctcggagagagggctctctcgaagatccacagacagattcatccgtctcccttctgccgcatttagaagcgaagattcggcagactcattcattagctcacttactgaccaagtacgctgaacaacttctccaagaatatgttcagttgcaaggagacccgtttggcctgccgagtttctcgccgccacggttgccggtcgctggcctgtctgctccggccccttctcatgcagggctgccggtccatgaacgtctgcggctcgatgcagctgctttagcggcgcttcctccacttctcgatgcagtttgtcgtagacaagctgaacttaacccacgcgctccgcgcctgcttcgcaggctcgaagatgcggccaggcaggcccgggccttaggggctgctgtcgaggctcttcttgcggcccttggcgcggcaaatcggggtcctcgagcagaaccgcctgcagcaacggcatccgcagcatcagccacaggagtcttcccggcaaaagtgctgggactacgcgtctgcggattataccgggagtggttatcccgaacagaaggagacttgggccagctcctgccgggagggtccgca

SEQ ID NO: 8230 - DNA, 603 bp, Artificial Sequence
  Description of Artificial Sequence: Synthetic coding sequence
atgagtcgacgggaaggttccttagaagacccccaaacagactctagcgtatcccttctgccccatcttgaagctaagatcaggcagactcactcccttgcccacttgctgaccaagtatgccgagcagctgctccaggaatatgtccagctgcagggggacccgtttgggttgccatccttcagccccccccgactgcccgtggcaggtctctccgctccagccccgtctcatgcgggcctgcctgtgcacgagcggctgcgactggacgccgcggccctcgccgctcttccaccactgctcgatgccgtatgccgtaggcaagcagagctcaatccacgcgcgcccagattgttgcgacgcctggaagacgcagctcgacaggccagggccttgggcgcggcggtggaggctctgcttgcggccctcggcgccgcaaatcgaggcccccgggctgagccgccagctgcgacggcgtctgctgccagcgccaccggagtattcccggctaaggtgctggggctccgggtgtgcggtctgtacagagaatggctgtcacgcacagagggagacttaggtcagcttctcccaggcggttccgct

SEQ ID NO: 8231 - DNA, 603 bp, Artificial Sequence
  Description of Artificial Sequence: Synthetic coding sequence
atgagccgccgagaagggagcctggaggacccacagacagattcttctgtgagcttactgccacacctcgaggctaagatcaggcagacacattccctcgcccacctgctcactaaatatgccgagcagctcctgcaggagtacgtccagctacaaggtgatccttttggcttaccctctttttccccacccagacttccagtggcaggactgtcggcaccagcccctagccatgccgggttgcctgtgcatgagcggctaagactggatgccgcagctctagccgcattaccgccactgcttgacgctgtctgtaggcgccaggccgagcttaatccgagggcaccccgcctcttgaggcggcttgaagacgcagctcggcaggctcgagctttaggagcagctgtagaggcgctcctagcagctctgggagctgctaacaggggtccacgtgcagaaccgcccgcagcaacagcctctgcggcgtccgcaacgggcgtattccctgccaaagtattaggcctgcgggtgtgtggactttacagagagtggttgtctaggaccgaaggagatctcggtcaactgctgcctggtggcagcgca

SEQ ID NO: 8232 - DNA, 603 bp, Artificial Sequence
  Description of Artificial Sequence: Synthetic coding sequence
atgtcaagacgggaaggttcattggaagatcctcaaaccgattcaagcgtgagccttctgcctcacctcgaggcaaagattaggcagacccactcgctcgcacacctgctgaccaagtacgcggaacaactcctccaggaatatgtgcaattgcagggtgacccctttggactcccttcgttctcaccccccagattgcctgtggctggcctctcagctcctgcaccttcccatgccggactgcctgtccatgaacgcctgcggctggatgcggcggctctggctgccctgcctcctcttctggatgcggtgtgtaggcgccaagctgagcttaaccccagagcaccaaggctgctgcgccgcctcgaggacgccgcacgccaggcaagagcgctcggagcagcagtcgaggcactgcttgcagcactgggtgcggcaaacaggggaccccgagccgagccaccagcagcaaccgcgtcggcagccagcgcaacgggagtgttcccagcaaaagtcctcggactgcgggtgtgtggactttacagagaatggctgtccaggaccgaaggcgatctgggacagcttctgcccggtggctccgcc

SEQ ID NO: 8233 - DNA, 603 bp, Artificial Sequence
  Description of Artificial Sequence: Synthetic coding sequence
atgtccaggagagaggggtcattggaagatccccagactgattcgagcgtgtcgctgctgccgcatctcgaggcaaaaatccggcagactcactccttggcccacttgctcaccaagtacgcagaacagcttctgcaggagtacgtgcaactgcagggagatccgtttgggctgccatctttcagtccgcccagactgccggtcgctggcctgtccgcaccggccccttcccacgcgggcctgccggttcacgagcggcttagactggacgcggctgctctggcggcactgcctccgctccttgatgccgtgtgccgaaggcaggccgagctgaatccgcgcgccccacgtctgctgcgcaggctggaggacgcggcgcgccaggcgagagctctgggggccgcagtggaagcgcttcttgcggctctgggagctgccaacagaggaccacgggccgagccgccagctgcaactgcctccgccgctagcgccactggtgtgttcccggcaaaggtcctgggacttcgcgtgtgcggcctttaccgcgaatggctgtcacgcaccgaaggagatctggggcagcttctgcccggaggctcagcc

SEQ ID NO: 8234 - DNA, 510 bp, Artificial Sequence
  Description of Artificial Sequence: Synthetic coding sequence
atgaagacccagcgtaacgggccaagcctgggcagatggtccctggtgttactgctgcttggactggtaatgccactggcaattgtcgcccaggtactctcttatcaggaggccgttctgcgggccatcgatggcataaaccaacgctcgagtgatgcaaatctgtatcggctgctggacctcgacccccgtccaactatggatggagacccagacacacctaagcccgtgtccttcacggtcaaagagacagtgtgcccacgaacaacgcagaaaagccctgaggactgcgattttaaggaagacggcctggtcaaaaggtgcgtcggcaccgtgatactgaaccaggcccgtgattcctttgacatcagctgcgacaaggacaatcgccgatccgctcggttaggtaacttcttcaggaaggtaaaagagaagatcgggggcggcttaaaaaaggtggggcaaaaaattaaggatttccttggcaacctcgtgccgcggacggcatct

SEQ ID NO: 8235 - DNA, 510 bp, Artificial Sequence
  Description of Artificial Sequence: Synthetic coding sequence
atgaaaactcagaggaacggtccaagtttaggccggtggtctttagtactcctgctcctgggactcgtcatgccactcgcaatagtggcacaggtgttgtcttaccaggaggctgtgctcagggcgatcgatggaatcaatcagcggagtagcgacgccaatctttacaggctccttgatcttgatccgaggccaactatggatggagatcccgacacgccaaagccagtctcctttaccgtaaaggagaccgtatgtcctcgaacaacccagaaatcccccgaggattgcgacttcaaggaagacgggctggttaagcggtgcgtgggtacagtcattctgaaccaggctcgcgattcgtttgatattagctgcgataaagataacaggaggtctgccaggctcggtaacttcttccgaaaagtaaaggaaaagattggtggtgggctgaagaaggtgggccagaagatcaaggatttcctcggcaatctcgtccctcgcaccgccagc

SEQ ID NO: 8236 - DNA, 510 bp, Artificial Sequence
  Description of Artificial Sequence: Synthetic coding sequence
atgaaaactcagcgcaatgggccttctttggggcgttggtcccttgtgttgcttctgttgggcctggtgatgccgctggcgatcgtcgcgcaagtcctcagctaccaagaagcagttcttcgcgccatcgatgggattaatcaacgttcgagtgacgccaacctgtataggctgctggatctcgacccgaggccaaccatggacggcgaccccgacaccccaaaacccgtttcctttactgtcaaggaaaccgtgtgtccgcggaccactcagaagtccccggaggattgcgatttcaaggaagatggtcttgtgaagaggtgcgtgggaactgtgatcctgaatcaggctcgcgactccttcgatatcagctgcgataaggacaacagacgaagcgcccggcttggaaacttctttcggaaggtgaaagagaaaattggaggaggcttgaagaaggtcggacagaagatcaaagacttcttgggtaacctcgtgcctcgcaccgcatca

SEQ ID NO: 8237 - DNA, 510 bp, Artificial Sequence
  Description of Artificial Sequence: Synthetic coding sequence
atgaaaacccagaggaatggaccgagcttgggcagatggtccctcgtgctgctgttactggggttggtaatgccgctggctattgtggcgcaggtcctaagttatcaggaagccgtgttacgtgcgattgacgggattaatcagcgtagcagtgatgccaacctttaccgcctgctggacttggaccctaggcctacaatggacggcgacccagacacccccaagccggtctcctttacagttaaagagacagtttgcccccgtacaactcagaagtccccagaggactgtgatttcaaggaggatgggcttgttaagcgatgcgttggaacagtgattcttaatcaggctagagactcattcgacattagctgcgataaagataacaggcgaagtgcccgactgggtaatttctttcggaaagtcaaggagaagatcggcggcggcctgaaaaaggtgggccagaagattaaggactttctggggaacctggtccccagaacagcgagc

SEQ ID NO: 8238 - DNA, 510 bp, Artificial Sequence
  Description of Artificial Sequence: Synthetic coding sequence
atgaagacgcagcggaacggaccttctctgggacggtggagtctggtattactgctgctgggactggtgatgcctctggccatagtggcccaggtgctgtcctatcaagaggcagtgctgcgggccatcgacggcattaatcagcgcagttcagatgcgaacctgtaccgcttgcttgacttggaccctcgcccaaccatggatggggatcccgacaccccgaaacctgtatcctttaccgtaaaagaaacagtgtgcccgaggactacccagaagtccccagaggactgtgatttcaaggaggacggcctcgtcaaaaggtgtgttgggactgtaatccttaatcaggctcgagattcctttgacatcagttgcgacaaggacaacagacgctctgcccgtcttggcaacttcttcagaaaggtgaaagagaaaatcggaggggggctaaaaaaggtgggccagaagattaaggacttccttggcaatttggtgccaaggaccgcatcc

SEQ ID NO: 8239 - DNA, 510 bp, Artificial Sequence
  Description of Artificial Sequence: Synthetic coding sequence
atgaagacccagcggaatggccccagtcttggccggtggtccctggtgttgcttctcctgggcctggtaatgcccctcgccatagtcgcacaagtgctgagctaccaggaggcggtgctgcgggccatcgacgggattaaccagagaagttccgatgccaacttgtaccgattgctggatctggatcccaggccgaccatggatggcgacccggacaccccaaagccggtctccttcactgtaaaagagacagtgtgccctcgtaccacacagaaatctccagaagattgtgattttaaggaggacggtctagtgaagaggtgtgtaggaacagtaattttgaaccaggcccgggatagctttgacataagttgcgataaggacaaccgtcgaagtgctaggcttggtaacttcttcagaaaggtgaaagaaaagattggaggcggccttaagaaggttggccagaaaatcaaagactttcttggcaacttggtgccccggaccgcaagt

SEQ ID NO: 8240 - DNA, 510 bp, Artificial Sequence
  Description of Artificial Sequence: Synthetic coding sequence
atgaaaactcaacggaacggcccatctctcggacgttggtctttagtgctattgcttcttggactggtgatgcctctagctattgtcgcacaggtcctctcttaccaggaagcagtgttacgggccatagatggtattaatcagaggagctcagacgccaacctgtacaggctcctcgatctcgatccgcgacctactatggacggggaccctgacaccccaaaaccagtctcgtttacagtgaaggagacagtttgtccccggacaacccagaagtcccctgaagattgcgactttaaggaggatgggctggtgaaaaggtgcgtgggaacagtgattctcaatcaagcccgcgattcctttgacatctcctgcgacaaagacaaccggagaagcgcgaggcttggcaatttcttcagaaaggtcaaagaaaagatcgggggcggcctgaaaaaagtgggacagaaaattaaagactttctcggtaacctggtgcctcgcaccgcgtct

SEQ ID NO: 8241 - DNA, 510 bp, Artificial Sequence
  Description of Artificial Sequence: Synthetic coding sequence
atgaaaacccaacgcaacggtccctcactcggaaggtggtcgctggtgctgcttctgctcggtctggtgatgccgctggctattgtggcgcaggtgctgagttaccaggaagcagtgttgcgcgctatagacggaatcaaccagcgctccagcgacgccaacctgtacagactccttgacctcgaccctcggcctaccatggatggcgacccagataccccaaagcctgtgtcattcaccgttaaagaaactgtgtgcccgaggaccacgcaaaagtcgccggaagattgtgactttaaagaggacgggctcgtgaagcgctgtgtcggaaccgtcatcctcaaccaggcgcgcgactccttcgacatcagctgcgataaggacaataggcggagcgctcgcctcggaaatttctttcgcaaggtcaaagaaaagatcggaggtggcctcaagaaggtggggcagaagattaaggacttcctcggcaaccttgtccctcgcactgcatct

SEQ ID NO: 8242 - DNA, 510 bp, Artificial Sequence
  Description of Artificial Sequence: Synthetic coding sequence
atgaaaacccagcgtaacggaccgtccctgggacggtggagccttgtcctgctgcttcttggtctggtgatgcctctggcaatcgtcgcacaagtgctgtcataccaagaggcagtgcttcgggcaatcgacggcattaaccagcgctcgtccgatgcgaacctgtaccgccttctggatcttgacccaagacctaccatggacggggatccagatactcctaagccagtgtcgtttaccgtcaaagagactgtgtgtcctagaaccactcaaaagtctcccgaagattgcgatttcaaggaagatggacttgtcaagcggtgtgtgggcactgtcattcttaatcaagccagagactcgttcgacatttcctgtgataaagataatcgaagaagcgcaagactgggtaactttttccgaaaggtcaaagaaaagatcgggggagggctcaagaaggtcgggcagaagattaaggactttcttggtaacctggtgccacgtactgcatca

SEQ ID NO: 8243 - DNA, 510 bp, Artificial Sequence
  Description of Artificial Sequence: Synthetic coding sequence
atgaaaacgcagcggaatgggccaagccttggtagatggtccctcgtcctccttttgcttggactggtgatgccactcgctatagtggcacaagtcctgtcgtaccaggaagcagtgctccgcgcgattgatgggattaaccagcggtcgtcggacgccaacctttaccgactccttgatctggatccccgcccaaccatggatggggatcccgacacccctaaacccgtctcttttactgtgaaggagacggtgtgtccaaggactacccaaaaatcaccggaagattgtgactttaaggaagatggcctggtgaagcggtgcgtgggtaccgtgatcctgaaccaagcaagagacagcttcgatatttcatgtgacaaagacaacaggagatctgcacggcttggtaacttctttcgaaaagtgaaggaaaagataggagggggccttaagaaggtgggacagaagattaaagatttcctgggaaacctcgtgcctagaaccgcaagc

SEQ ID NO: 8244 - DNA, 510 bp, Artificial Sequence
  Description of Artificial Sequence: Synthetic coding sequence
atgaaaactcagcggaatggcccatccctcggccgatggtcactcgtgctgcttttgctgggccttgtgatgcctcttgctatcgtcgctcaggttctttcgtaccaggaagccgtgcttagagctatcgacggcattaaccaacgtagttcagatgccaatttgtatcggctgctggatttggaccctcgccccacaatggatggtgatccagacacaccgaaaccagtgtcatttactgtgaaggaaaccgtctgtcctcgtaccacccaaaagagccctgaagactgcgatttcaaagaagatggccttgttaaacgatgtgtcggcacagtcatcctcaatcaggctagagacagctttgacatcagctgcgacaaggataaccgtcggagtgctagactcggcaacttcttccgcaaggtgaaagaaaagatcggcgggggcctcaaaaaggttggccagaagataaaggacttcttgggtaatctggtgcctcgcacagcctcc

SEQ ID NO: 8245 - DNA, 510 bp, Artificial Sequence
  Description of Artificial Sequence: Synthetic coding sequence
atgaaaacccagaggaacggtccatccctcggacggtggtcgctcgtcctgcttctgctgggactggtcatgcccttggcaatcgtggcccaggtcctttcctaccaggaagcggttctgagagccattgacggcatcaatcagaggagctcagacgcaaatctgtaccgtctcctggatttggatccgaggccaaccatggatggcgaccccgacacgccaaagcccgttagcttcaccgtgaaagagactgtgtgcccgcggacgactcagaagtcgccagaggactgcgactttaaggaggacggcctggtgaagcggtgcgtcggtaccgtcatccttaaccaagcccgcgactctttcgacatcagctgtgacaaggataacagacggagcgccagactgggaaactttttcagaaaggttaaggaaaagataggtggagggctgaaaaaggtgggacaaaagatcaaagatttcctgggcaacctggtgccgcgcactgcctcg

SEQ ID NO: 8246 - DNA, 510 bp, Artificial Sequence
  Description of Artificial Sequence: Synthetic coding sequence
atgaaaacacagagaaatggtccgagtctcggacggtggtcactcgttctcctgctcttgggtctagtcatgccactcgcaattgttgctcaggtgcttagttatcaagaagctgtgctgcgtgcaattgatggaatcaaccaacgttcgagcgatgctaatttgtatagacttctagatttggatcctaggccgacaatggacggagatccagataccccgaaaccagtcagttttactgttaaggagacggtgtgtccacgtacgacacaaaaatctccggaagattgcgattttaaggaagatggtttggttaaacggtgtgtgggcaccgttattttgaaccaagcgcgagattctttcgacatttcttgcgataaggacaatcgtcgctcagcgcgattaggaaatttttttaggaaggtcaaagagaaaatcggcggaggattaaagaaagtaggacaaaaaataaaagattttcttggcaatcttgtcccaaggacagcttcg

SEQ ID NO: 8247 - DNA, 510 bp, Artificial Sequence
  Description of Artificial Sequence: Synthetic coding sequence
atgaaaacccaacgcaacggcccctcgttgggaagatggtcactggtcctcctgctgctgggtctggtcatgccactcgccattgtggcacaagtgctgtcctaccaggaggccgtgctgagggctattgatggcataaaccagcggtcctcagatgctaacctgtacagactcttggatctcgatccgcggcctactatggacggtgaccctgataccccaaagccagtgtcattcactgtcaaggaaactgtgtgccctcggaccacccaaaagtcgcctgaagattgtgacttcaaggaggacggtctggtgaaacggtgtgttggcacggtgatccttaatcaggcacgggactcctttgatatttcttgtgataaagacaaccgcagatctgcacgccttggtaactttttccggaaggtgaaggaaaagatcgggggtggattgaagaaggtgggacaaaagattaaagattttcttggcaatttggtgccgagaacggcgagc

SEQ ID NO: 8248 - DNA, 510 bp, Artificial Sequence
  Description of Artificial Sequence: Synthetic coding sequence
atgaaaacccagcgaaatggcccttctttaggacgctggtccctcgtgttgttgcttctggggttggtcatgcctctagcaatagtagcccaggtgctctcctatcaagaggctgtactcagggcaattgacggtattaatcagagatcatcagacgctaatctctacaggctgctcgacctcgacccccggccaactatggatggagacccggatactccgaaacctgtcagtttcacagtgaaagagactgtttgccctcggactactcagaagtcacccgaggattgcgactttaaggaggatggcctggtgaaacggtgtgtcgggacagttattctgaaccaagccagggacagcttcgacattagttgcgataaggataatcggcggagtgccaggttgggtaattttttcaggaaagtgaaggaaaaaatcggtggaggtctcaagaaggttggccagaagatcaaggacttcctaggcaacctcgtgcccagaacagccagt

SEQ ID NO: 8249 - DNA, 510 bp, Artificial Sequence
  Description of Artificial Sequence: Synthetic coding sequence
atgaaaactcagcggaatggaccaagcctcggtcgttggtccctggtgctccttctcctcgggctggtcatgcctctggcaattgttgcccaagtcttgtcataccaggaagccgtgctgcgggctattgatggcatcaatcaaagatcttctgatgcgaatctgtaccggctgctcgatctcgaccccaggcccaccatggatggtgatcctgatacgcctaagccggtgagcttcaccgtcaaagaaaccgtatgccccagaaccactcagaagtcaccagaggactgtgacttcaaggaggatggtctggtcaagcgatgcgtgggaactgtgatcctgaaccaggcccgcgactccttcgacatcagctgtgacaaggacaaccggaggtcagcacgtctggggaacttttttcggaaagtgaaggaaaagattggaggaggactcaagaaagtgggccaaaagataaaggattttctgggaaacctggtgcctcgaactgcaagc

SEQ ID NO: 8250 - DNA, 510 bp, Artificial Sequence
  Description of Artificial Sequence: Synthetic coding sequence
atgaaaactcaaagaaatggcccatcactgggaagatggagcctggtcctgcttctgctcggcctggtgatgccccttgcaattgtggcccaagttctgagctaccaggaggctgtgctgagagcgatcgacggaatcaaccaacgcagctcagacgcaaatttgtaccgcttgctggacctggaccctcggcctaccatggacggggatccagatacgccgaagccagtgtctttcaccgtcaaagaaactgtgtgtccgagaactacccagaagagcccggaggactgcgatttcaaggaggacggtttggtcaagcgctgcgtcggaacggtgatcttgaatcaggcacgggattcgttcgatattagctgcgacaaggataaccggcgctcggcgcgcctgggcaatttctttcgcaaggttaaggagaaaataggcggaggactcaagaaggtgggccagaagatcaaggacttcctcggaaaccttgtgccgcggaccgcatcg

SEQ ID NO: 8251 - DNA, 510 bp, Artificial Sequence
  Description of Artificial Sequence: Synthetic coding sequence
atgaaaacccaaaggaacggcccgtccctgggccgctggtccctggtgctcctgctcctgggactcgtcatgccgctggcaattgttgcccaggtgctgtcctaccaagaggcggtgctccgcgccattgatggcattaaccaacggtcgtccgatgccaacctgtaccggttgctcgacctggacccacgccctactatggacggcgaccccgatactcccaagccagtctcctttacggtgaaggagactgtgtgcccccgcaccactcagaaatcgccggaggactgcgacttcaaggaagatggcctggtcaaaagatgtgtcggtaccgttatcctgaaccaagccagggattcgtttgacatctcgtgcgataaggacaaccgcaggtcagctcgccttgggaatttcttccggaaggtgaaagagaaaatcggaggaggcttgaaaaaggtgggacagaagatcaaggacttcctgggaaacctggtcccgaggactgcttca

SEQ ID NO: 8252 - DNA, 510 bp, Artificial Sequence
  Description of Artificial Sequence: Synthetic coding sequence
atgaaaactcaacgtaacgggccttcgctgggacgctggtccctcgtgttgcttcttcttggccttgtgatgccgcttgccattgtcgcacaagtgctctcctaccaggaagcagtcctgcgcgcgatcgacggtatcaaccagcgctcaagcgatgctaacctgtacagactcctcgatcttgacccccggccaacgatggatggagatccggacactccaaagcctgtctcgtttaccgtgaaggaaactgtctgccctaggaccacccaaaagtcccccgaggattgtgatttcaaggaagatggcctggtgaagcggtgtgtcggaactgtgatattgaaccaggcaagggatagcttcgatattagctgtgataaagataatcgccgttctgcgcgtctggggaatttctttagaaaagtgaaggaaaagatcggcgggggtctgaaaaaggtcggacagaagattaaagattttctgggaaacctcgtgccgagaacggcaagc

SEQ ID NO: 8253 - DNA, 510 bp, Artificial Sequence
  Description of Artificial Sequence: Synthetic coding sequence
atgaagacgcagcggaatgggccatcactggggcgttggtctctcgtactcctgctgcttggactggtaatgccgcttgcaattgttgcacaagtgcttagctaccaggaagcagtgcttcgggctattgatggcataaatcagaggtcctccgacgcaaatttatacaggcttcttgacctcgaccctcggccaaccatggacggcgatccagacactcccaaacctgtgtccttcaccgtgaaggaaaccgtgtgccctagaacgacccagaaaagtccagaagactgcgactttaaggaggacgggctggtgaagcgctgtgtcgggactgtgatccttaaccaggcccgggactccttcgacatttcttgtgacaaagacaataggaggagcgctcgattgggcaacttcttcagaaaggttaaagagaagattggtggcggcctcaaaaaggtcggccagaagatcaaggacttcctgggcaatctggtgcccaggaccgcgtct

SEQ ID NO: 8254 - DNA, 510 bp, Artificial Sequence
  Description of Artificial Sequence: Synthetic coding sequence
atgaaaactcagagaaacggaccgtccctcgggaggtggagcctcgtgttgctcctgttggggcttgtgatgcctctcgctatcgtggcccaggtgctttcctatcaggaagccgtgcttcgcgccatcgacggaatcaaccagcggagcagcgacgcgaacttataccgtttattagatctagatccgcgacctacgatggatggcgaccccgatacaccaaagccagtaagttttacggtcaaagaaactgtgtgcccaaggaccactcagaaatcccctgaggattgcgatttcaaggaagacgggctggtgaagcgatgtgtggggactgtcatactgaaccaggcccgtgactcattcgacatttcctgcgacaaggataatcgccgatcagcaaggcttggtaacttcttccggaaagtaaaagaaaagatcggcggtggtctgaaaaaggtggggcagaagatcaaagactttctgggcaacctagtacctcgcacggctagt

SEQ ID NO: 8255 - DNA, 510 bp, Artificial Sequence
  Description of Artificial Sequence: Synthetic coding sequence
atgaagacacagcgcaatggtccctccttgggtcggtggtccctcgtattgcttctcctgggactcgtgatgccgctggccattgtggcccaggtgttgagctaccaggaggcggtgctgcgggccatcgatgggataaatcaaaggtcctctgatgcaaatctttatagattgctcgatttggaccctcgcccaaccatggatggagatcctgataccccgaagccagtctcctttacagtaaaagagactgtttgccccagaactacacagaagtctcctgaagactgcgatttcaaggaggatggccttgtgaagaggtgcgtcggaaccgtaatcctgaaccaggctcgcgacagctttgatatttcctgcgataaggataacagaagatcagctagactcggtaattttttccggaaggtcaaggaaaaaatcggaggtggactcaagaaagtgggccaaaagatcaaagactttctgggcaacctggtacctaggaccgcaagc

SEQ ID NO: 8256 - DNA, 510 bp, Artificial Sequence
  Description of Artificial Sequence: Synthetic coding sequence
atgaagacccaacgaaatggcccgtcacttggtcgatggtccctcgtgttgctcctcctaggactggttatgccattggcaattgtggcccaggtcttgtcttatcaagaagccgttctaagggctattgacggcattaaccagcgctccagcgacgctaatttgtataggctcctcgatctggatccgcggccaaccatggacggcgatcctgatacaccaaagcctgttagctttacggtgaaagagaccgtgtgtccacgtaccacacagaaaagtcctgaggattgtgattttaaggaggacgggctggtaaagaggtgtgttggaacagtgattctgaatcaggctcgggattcttttgacatctcttgtgacaaagacaataggcgatccgctcggctgggtaattttttccgcaaggtgaaggagaaaataggcggcggccttaaaaaagttggacagaaaataaaggactttctcggcaacttggtgcctcgaaccgcatca

SEQ ID NO: 8257 - DNA, 510 bp, Artificial Sequence
  Description of Artificial Sequence: Synthetic coding sequence
atgaaaacacagcggaacggaccttctctggggcggtggtctctcgtactgctgctattgggactggtgatgcccctggccatcgtagcccaggtgctctcctatcaggaagctgtgctgagggctattgatgggattaatcagcgctcttcagatgctaacctgtataggttactcgacttagatccacggcccacaatggatggggatccagatactcccaaacctgtgtctttcacagtaaaagaaacagtgtgtcctcgaacaacacagaaatctcccgaagattgcgattttaaagaggatgggctagtaaaaaggtgtgtcgggactgtaatcttaaatcaggctcgagattccttcgatatatcttgtgataaagataaccgaagatcagctcgactcggaaacttttttcggaaggtaaaagaaaaaatcgggggaggacttaagaaagtgggacagaaaatcaaggattttcttgggaatctcgtcccaaggacagcctct

SEQ ID NO: 8258 - DNA, 510 bp, Artificial Sequence
  Description of Artificial Sequence: Synthetic coding sequence
atgaaaacccagcgcaatggcccctctctgggccggtggtcacttgttctcctgctgctcggcctggtgatgccgttggcgatcgtggcacaagtgctgagctaccaggaagccgtgctgcgggcaatcgacggaatcaatcagaggagcagcgacgcaaacctttaccgcctgctggacctggatcctagaccgaccatggatggcgacccggacactccgaagccagtgtcgtttaccgtgaaggaaactgtgtgccctcgcactactcaaaagtcccccgaggactgcgacttcaaagaggacgggctcgtgaagcgctgcgtcgggactgtgatcctcaaccaggcccgcgattccttcgacatctcgtgtgacaaggacaatcgccgctcagcgagactgggaaacttttttcgcaaggtcaaagaaaagattggtgggggtcttaagaaggtggggcagaagatcaaggatttcctgggaaacctcgtgccgcggaccgcttct

SEQ ID NO: 8259 - DNA, 510 bp, Artificial Sequence
  Description of Artificial Sequence: Synthetic coding sequence
atgaaaacccagcggaacggaccgtcactgggacgctggtcactggtgttgttgttgctgggcttggtgatgccgctcgccatcgtggctcaggtgctctcgtaccaagaagcagtcctcagagccattgatggaattaaccaaaggagctcagacgctaacctgtaccgactcctggacctcgacccgcgtccaactatggatggggacccggacactccaaagcccgtcagcttcactgtgaaggaaaccgtgtgcccgcgcaccactcagaaatcgccggaggattgcgacttcaaggaagatggcctggtgaagcgttgtgtcggcaccgttatcctgaaccaagcacgcgactcctttgatatctcctgcgataaggataatagacggtctgcccggcttggaaatttcttcagaaaggtcaaggaaaagatcggtggcgggctgaaaaaagtgggtcagaagatcaaggattttctgggaaacctcgtgccccggaccgcgagc

SEQ ID NO: 8260 - DNA, 510 bp, Artificial Sequence
  Description of Artificial Sequence: Synthetic coding sequence
atgaaaacccaacgtaatggaccatcattgggtcgctggagcctcgttcttttgttattgggattggttatgccattggccattgttgctcaagttctatcatatcaggaagccgtccttagagctatcgacggaattaaccaaagatcctccgatgctaatctctataggcttctcgatcttgatcctcgtccaactatggacggtgaccctgatacccccaaacctgtgtccttcactgttaaggaaaccgtatgtccccgtaccactcaaaaatctcccgaagattgcgattttaaggaggacggacttgtgaagcgatgcgttggaactgttattctcaatcaagctagggacagctttgatatttcttgtgataaagataataggaggtcagctagacttggaaacttttttcgcaaggtgaaggaaaaaattggtggtggtctgaagaaggtcgggcaaaaaattaaggactttctgggaaacttggtgccgaggacagccagc

SEQ ID NO: 8261 - DNA, 510 bp, Artificial Sequence; identical to SEQ ID NO: 8248
  Description of Artificial Sequence: Synthetic coding sequence

SEQ ID NO: 8262 - DNA, 510 bp, Artificial Sequence
  Description of Artificial Sequence: Synthetic coding sequence
atgaaaacccaacgcaatggaccgagtctcggcaggtggagcctggtgcttcttctgctggggctggtgatgccactggcgatcgtagcacaggtgttgtcctaccaggaggccgtccttagagcaattgatggaataaaccagcggtcctctgatgcaaacctctacagactgctcgatctcgatccaagacctactatggatggagatcccgataccccaaagccagtttcgttcaccgtgaaagagactgtctgccctcgtacgacgcaaaagtctccggaagattgtgacttcaaagaagatggtcttgtgaaaagatgtgtggggactgttatcctgaaccaggctcgtgattcctttgacatttcatgtgacaaggataacagacggtcggcacgacttggtaacttttttcgcaaagtgaaggaaaagatcggcggtggacttaagaaggtcggacaaaagatcaaggatttcctgggaaatcttgttcccagaactgcgagc

SEQ ID NO: 8263 - DNA, 510 bp, Artificial Sequence
  Description of Artificial Sequence: Synthetic coding sequence
atgaagacacagcgcaatggtccttcactcggtcgttggtctttggttctcttgctgctgggtctagtgatgcccttggcaatcgtcgctcaggttctgtcataccaagaggccgtcttgagggccatcgacggtataaatcagcgcagctccgatgctaatttgtataggttactagacctggatccccggccgaccatggacggcgacccggatacaccaaaacctgtgtcgttcacagtgaaagaaaccgtctgtccccgaaccacccagaagagcccagaagattgcgactttaaggaggatggcctcgtcaaaagatgcgttggcaccgtgattctgaaccaggcgcgggactccttcgatatctcgtgtgataaggacaatcggaggtcggcaaggcttggaaacttctttcggaaagtgaaagaaaaaatcggcgggggtctcaagaaagtgggccaaaagataaaagacttccttggaaacctggttcctcgaacagcttcc

SEQ ID NO: 8264 - DNA, 510 bp, Artificial Sequence
  Description of Artificial Sequence: Synthetic coding sequence
atgaaaactcagagaaacggtccaagcttggggcgctggtctttggtcctgctattgctgggcctcgtgatgccattggctattgttgcacaggtgttgtcttatcaggaggccgtgttacgcgcaatcgacggaatcaatcagcgctccagtgacgcgaacctgtacaggctgctcgatctggacccacgccctacaatggacggagatcctgacacgcctaagcccgtgtctttcacagtgaaggaaactgtctgtccgaggactacccaaaaatcacccgaggactgcgacttcaaagaggacggccttgtcaagagatgtgtggggactgtcatcctgaaccaggctagggactcattcgatattagctgcgacaaagacaacagaaggagcgcacggctgggtaactttttccgaaaggtcaaggagaagattggcggaggtcttaagaaggtgggacaaaaaattaaggatttcctggggaacctagtgccgcgcacagcctcg

SEQ ID NO: 8265 - DNA, 510 bp, Artificial Sequence
  Description of Artificial Sequence: Synthetic coding sequence
atgaaaacccaaagaaacggaccctctcttggacgctggtccctcgtgctgcttctccttgggcttgtgatgcccctcgccatagtggcgcaagtgctctcctaccaggaggcagtcctccgcgctatcgatggaatcaatcagcgatcgtcggacgcaaacctctaccgcctgctggaccttgatcctagacctactatggacggagatcctgataccccgaaacccgtttcgttcaccgtgaaggaaactgtctgcccacggactacgcagaaatcgcctgaggattgtgacttcaaagaagatggtctggtgaaacgctgtgtgggaacggtgattcttaatcaagccagggactctttcgacatttcatgtgataaggacaatcggagatccgcaagactggggaacttttttcggaaggttaaagaaaagataggaggcggtctgaagaaggtgggccaaaagataaaggattttctcggtaacctcgtccctagaactgcgagc

SEQ ID NO: 8266 - DNA, 510 bp, Artificial Sequence
  Description of Artificial Sequence: Synthetic coding sequence
atgaaaacacaacgcaacggtccctcattggggcggtggtcccttgttctgctgctcctgggcttagtgatgccgctagcgatcgtggcgcaggtcctgtcataccaggaagcggtgctgagggccatcgacggcatcaaccagcggtccagtgatgccaacctgtataggcttttggatctggacccgcggccaactatggatggagaccccgataccccaaaaccagtgtccttcaccgtaaaggagactgtgtgccctcggacaactcaaaagtcgccagaagactgcgactttaaagaagacggccttgttaagcggtgtgtcgggacagtcatactcaaccaagctcgagatagcttcgacatcagctgcgacaaggacaataggcgatcggcccgcttggggaacttctttcggaaggtgaaggagaagatcggcggaggactgaagaaagtgggacagaagattaaggatttccttggtaacctggtgccacggacagcctct

SEQ ID NO: 8267 - DNA, 510 bp, Artificial Sequence
  Description of Artificial Sequence: Synthetic coding sequence
atgaaaacccagcggaatgggccgtcgctgggacgctggtcgctggtgctcctcctcctgggcctcgttatgccactcgcgatcgtggctcaggtgttgtcgtaccaagaagcggtcctcagggcgatcgacggcatcaaccaacgttcgtccgacgccaatttgtaccggctgcttgacctggatccccgaccaaccatggacggcgacccggatactccgaagccagtctcgtttactgtgaaagagactgtgtgtccacgcaccacccaaaagtccccagaggactgcgactttaaggaggacgggctggtgaagagatgcgtgggaaccgtgattctgaaccaggccagggattccttcgatatctcctgcgacaaggataaccggcggtcagcgaggctcggaaactttttcagaaaagttaaagagaaaatcggaggtggactgaagaaagtgggtcaaaagatcaaggatttcctggggaatctggtgccgagaactgcctcg

SEQ ID NO: 8268 - DNA, 510 bp, Artificial Sequence
  Description of Artificial Sequence: Synthetic coding sequence
atgaagacgcaacgaaacggacctagcctgggcaggtggagcctggtactacttctcttgggactggttatgccgctggccatcgtagcacaggttctgagttaccaggaggctgttctgagggccatcgatggcatcaatcagcgcagcagtgatgctaacctctaccgtctgctggacctagacccgcggccgacgatggacggcgatccggacaccccaaagccggtgtcattcaccgtgaaggagacagtctgcccccgcaccactcagaaatcccccgaggactgtgacttcaaagaggacggccttgtgaagcgctgcgtgggtacagtgatcttgaaccaggcccgggattcctttgatatcagctgcgacaaggacaatcgccggagcgctcgcttaggaaacttttttaggaaggttaaggagaagataggtggcggactcaagaaggttggacagaaaataaaggatttcttgggaaatctcgtaccccgcacagctagt

SEQ ID NO: 8269 - DNA, 510 bp, Artificial Sequence
  Description of Artificial Sequence: Synthetic coding sequence
atgaagactcagaggaacggtcccagtctggggagatggtcacttgtgcttctcctcctaggactggtgatgcctctggcaatcgtcgcacaggtgttgtcctatcaagaggccgttctccgagcgatcgacggcattaatcagcgctcgtcagacgctaacctctaccggctgctggatttggatcctcgcccgacaatggacggtgaccctgatacccctaagcctgtgagcttcacggtgaaagaaacggtttgcccacggacaactcagaagtcgccggaagattgcgatttcaaagaggacggcctggttaaacgctgtgtgggaactgtcattctgaaccaggccagggatagctttgacattagttgcgataaggataaccgcaggtctgcacggctgggaaatttctttcgtaaagtcaaggagaaaatcggtggaggtctcaaaaaggtcggccagaagataaaagatttcctcgggaacctggtcccccgaaccgcttcc

SEQ ID NO: 8270 - DNA, 510 bp, Artificial Sequence
  Description of Artificial Sequence: Synthetic coding sequence
atgaagacccagaggaatggaccttcattgggccggtggagtctggtgctgttgcttctgggcctagtcatgcctctagccatcgtggctcaggtgctgtcctatcaggaggctgtcctgcgggcaatagatggcattaaccagagatcaagtgacgcaaatctgtaccgtctgctggacctagaccctaggcctactatggacggcgaccccgacactccgaaaccagtatcctttacagtaaaggagacagtgtgtcccaggacaactcaaaaatcccctgaagattgcgattttaaggaggatggtttagtgaaaaggtgcgtcgggaccgtgatcctgaatcaggcacgggacagttttgacatctcctgtgataaggacaaccgtaggtccgcacggttgggcaatttcttcagaaaggtgaaggagaagattggcggggggcttaagaaggtggggcagaagatcaaggatttcctcggaaacctggtgcctaggacagcgtcc

SEQ ID NO: 8271 - DNA, 510 bp, Artificial Sequence
  Description of Artificial Sequence: Synthetic coding sequence
atgaaaacccagcgcaacggaccgagcctgggacgatggtcgcttgtgcttctcctcctgggacttgtgatgccactggctatcgtggcacaagttcttagctaccaagaagcagtcctccgcgcaattgatggaatcaaccagagatcgagtgacgcgaacctgtacagactgcttgatctggatccgcgtcctaccatggacggtgaccctgatactcccaaaccagtctcctttacggtcaaggagactgtatgccccagaaccacccaaaagtcacctgaggactgtgatttcaaggaagatggtttggtgaagagatgcgtgggtactgtgatacttaaccaggcacgcgactccttcgatatttcctgtgataaagacaatcgacggtccgcccgcctcggcaactttttccggaaagtgaaagaaaagattgggggtggcttgaagaaagtggggcaaaagatcaaggattttctgggcaacctggtgccacgtaccgcctca

SEQ ID NO: 8272 - DNA, 510 bp, Artificial Sequence
  Description of Artificial Sequence: Synthetic coding sequence
atgaaaacgcagaggaacggcccatcactggggcgttggtctctggtccttctgctgcttggactcgtcatgccccttgccatcgtggcccaagtgctgtcctaccaggaggccgtgctgagggccatcgatggcatcaatcagaggagttccgatgccaacctatatcgcctgctggacttagacccgcggcccactatggatggagaccctgacacgccaaaacccgtcagttttactgtaaaggaaaccgtgtgtccgaggactacgcagaagtccccagaggattgcgatttcaaggaagatggtctggtgaaacgttgcgttggcactgtgattctgaatcaggcaagggacagctttgatatcagttgcgacaaggataaccgtcggtccgcccgcctgggaaacttttttaggaaggtcaaggagaagattggcggtggtctgaaaaaggtgggccagaagatcaaggacttcctcggcaacctggtccctaggacagccagc

SEQ ID NO: 8273 - DNA, 510 bp, Artificial Sequence
  Description of Artificial Sequence: Synthetic coding sequence
atgaagacccaaaggaatgggccttccctcggccgatggtctctggtgctactgttactggggctggtgatgcccttggcgattgtggcccaggtgctctcttaccaggaagcagtgttaagggccattgacggtattaatcaacgttctagtgacgccaatctgtatcgattgcttgatcttgatcctcggccgaccatggatggcgacccagacacgcctaagcccgtgagtttcacagttaaggaaacagtttgtcccagaactacccagaagagccctgaagattgcgacttcaaagaagacgggttggtgaagaggtgcgtgggcacagtcatactaaatcaggccagggattcttttgatataagctgcgacaaggataaccggaggtccgcccgcctgggtaactttttccggaaagtaaaggaaaaaatcggcggcggactgaagaaggtaggtcaaaagatcaaggactttctgggaaatcttgttccaaggacggcctca

SEQ ID NO: 8274 - DNA, 510 bp, Artificial Sequence
  Description of Artificial Sequence: Synthetic coding sequence
atgaaaactcagaggaatggcccatctcttggtaggtggagtctagtgctgctccttctggggctggtgatgccactggcaatcgtggcccaggtgctgtcctaccaggaggctgtattgcgtgccattgatggcataaaccagcggtcttccgatgccaacctatataggctcctcgatcttgaccctagacccacaatggatggggaccccgatactccaaagcccgtttcatttaccgtcaaggaaactgtgtgtccaagaacaacgcagaaatccccagaagactgcgatttcaaggaagacggcttggtgaaaagatgcgttggtacagtgatattgaatcaagcccgcgactcctttgacattagctgcgataaagataatcggaggtcagcgagactgggcaacttcttccgcaaagtcaaagagaagattggaggcggcctcaagaaagtgggccagaaaattaaggacttcctggggaacttagtacctcgcacagcaagt

SEQ ID NO: 8275 - DNA, 510 bp, Artificial Sequence
  Description of Artificial Sequence: Synthetic coding sequence
atgaaaacgcagagaaatggaccatcgctcggacggtggtcgttggtcttgctcctcctcggactggtcatgcccctcgccattgtggcccaggtgctcagctaccaggaagcggtgctgcgcgctatcgacggaattaaccaaagatcttccgatgccaatctgtaccggctgctggaccttgatcctcgtccgactatggatggggacccggatactccaaagcctgtgtccttcaccgtgaaggaaactgtctgcccacgaaccacccaaaaatcaccggaggactgcgactttaaggaagatggactggtgaaacgctgcgtggggaccgttatcctgaatcaggcgcgggactccttcgacatctcatgtgataaggacaacagacgctcggcacgccttggaaactttttccggaaggtgaaggagaaaatcggtggcggtctgaagaaggtcggccaaaagatcaaggacttcctgggcaacctggtgccgaggactgcaagc

SEQ ID NO: 8276 - DNA, 510 bp, Artificial Sequence
  Description of Artificial Sequence: Synthetic coding sequence
atgaagacacagagaaacggccctagcctgggtaggtggagtctggtgctgctgctcctgggattggtcatgccattggcaatcgttgcccaggtgctcagttatcaggaggctgttctcagagctatcgacggtatcaatcagaggtcaagtgatgcaaacctttataggttgctggatcttgacccgagacctactatggacggagacccggacacccccaaacccgtgagcttcaccgtgaaggagaccgtctgcccgaggacaacccaaaaatctcctgaggattgtgattttaaagaggacggcctcgtcaagaggtgcgtaggcacggtcatcctgaatcaggcccgggatagttttgatatcagttgtgataaggacaaccgccggagcgcaaggttgggtaatttttttcgaaaggtaaaggagaagattgggggtggactgaagaaggtgggacagaagatcaaggacttcctgggcaatctggtgccccggaccgctagc

SEQ ID NO: 8277 - DNA, 510 bp, Artificial Sequence
  Description of Artificial Sequence: Synthetic coding sequence
atgaagacacagagaaatggcccctctctggggaggtggtcattggtgctgcttctcctgggactggtcatgccacttgccatcgtggcacaggtactgtcctaccaggaggcagtgctccgggctattgacggaattaatcagcggagctccgatgcaaacctttatcgcttactggatttggatccacgacctacgatggatggagaccccgatacaccaaaacctgtctcctttacagtgaaggagacagtctgcccccggaccacccagaagtctcccgaggactgtgatttcaaggaggacggcctggtgaaacggtgcgttggaactgtcatcctgaaccaggctcgcgactcttttgacatctcttgcgacaaggacaaccgtcggtccgctcgcctagggaacttttttcgaaaggtgaaagaaaagattggcggcgggcttaaaaaagtgggtcaaaaaatcaaggacttccttggaaatttagtaccccggacagccagt

SEQ ID NO: 8278 - DNA, 510 bp, Artificial Sequence
  Description of Artificial Sequence: Synthetic coding sequence
atgaaaactcaaagaaacggacctagcttgggtagatggtcgctggtgctcctgcttttgggactcgtgatgccgctggcgattgtggcacaggttctttcctaccaagaagcagtgcttcgtgctatcgacggaattaaccagcgatcatccgacgcaaatctgtaccggctcttggatctggaccccaggccaaccatggacggcgacccagacacgccgaaacctgtttcgtttacggtgaaggagacggtctgccctcgaactacccagaagtctcccgaagattgcgatttcaaggaggatgggttggttaagcgatgtgtcggaaccgtgattctgaaccaggcaagggattcgtttgatatatcctgtgataaagacaatcggaggagcgcgagactgggtaactttttccggaaggtgaaagaaaagattggaggagggcttaagaaggtcggacaaaagatcaaggattttctcggcaacctggtacctagaactgcgtcc

SEQ ID NO: 8279 - DNA, 510 bp, Artificial Sequence
  Description of Artificial Sequence: Synthetic coding sequence
atgaaaacgcaacgcaatggtccttctctgggccggtggtcgctggtgctcttgctgctgggcctcgtgatgcccctggccattgtggcacaagtgctctcgtaccaggaggcagtgctccgggcaatcgatggcatcaaccagcgatcgtcagatgcaaatctgtaccgccttctcgatcttgatcctcgtcctaccatggatggtgacccagacactcccaaaccggtgtcgtttaccgtgaaggaaaccgtgtgccctcggaccacgcagaagtcgcccgaagattgcgacttcaaagaggatggattggtcaaacggtgcgtggggacggtgattctgaaccaagcgagagattcgtttgacatttcctgtgacaaggataaccggagatcagccaggcttggcaatttctttagaaaggtgaaggaaaagatcggtggtggcctcaagaaagtgggacagaagattaaagatttccttgggaacctggttcctagaactgcaagc

SEQ ID NO: 8280 - DNA, 510 bp, Artificial Sequence
  Description of Artificial Sequence: Synthetic coding sequence
atgaaaacccagcgcaatggaccttccctgggtaggtggagcctggtgttgctcctcttggggcttgtcatgccacttgcaatcgtcgcgcaagtgctctcgtaccaagaagcagtgctgcgggccattgatggaattaaccagaggtcctcggacgcaaatctttaccgacttctcgatcttgaccctcgccctaccatggatggagatccagatacccctaaaccagtgtcgtttaccgtgaaggagactgtgtgtcctagaacgactcaaaaatcccctgaggactgcgactttaaagaggacggtttggtcaaacgctgtgtgggaactgtgattcttaaccaggcacgggattcttttgatatatcatgtgacaaggataacaggcggagcgcgcgcctgggcaacttctttaggaaggtgaaggaaaagattggtgggggactgaagaaagtgggtcagaaaatcaaggacttcctcggcaacctggtgcctagaactgcgtca

SEQ ID NO: 8281 - DNA, 510 bp, Artificial Sequence
  Description of Artificial Sequence: Synthetic coding sequence
atgaaaacgcagcgcaatggaccctcccttggtcgctggtcccttgtgctgctgctgcttggacttgtgatgccactggccatcgtggcacaggtgctctcctaccaagaggccgtgcttcgcgcgattgatggcataaaccaaagatcctcggatgcaaacctgtacagactccttgatctggaccctcggcccacgatggatggagatcctgacacccctaagcctgtctcattcaccgtcaaggagactgtgtgtccgcgcactactcaaaagagccccgaagattgtgactttaaagaagatggtctggtcaagagatgcgtcgggacggtgattctcaatcaagcaagagattcgtttgatatttcatgtgacaaggacaataggagatcggcacggctgggtaactttttccgaaaggttaaagagaaaatcggaggtggacttaagaaggtggggcagaagataaaagacttcttggggaatcttgttccgagaaccgcatcg

SEQ ID NO: 8282 - DNA, 510 bp, Artificial Sequence
  Description of Artificial Sequence: Synthetic coding sequence
atgaaaactcagagaaacgggccgagcctgggcaggtggagcctggtgcttcttcttctgggcctcgtgatgcctcttgctattgtggcccaagtcctgtcataccaggaagccgtgctcagagctatcgacggaataaaccagcggtcgtcggacgcgaacctctacagactgctggacttggacccacgcccaaccatggacggtgatcccgacaccccgaagccggtgagcttcactgtgaaggaaactgtctgtccacgcactacccagaagtcaccggaggattgcgatttcaaggaggacgggctcgtgaagcgctgtgtcggcaccgtgattctgaaccaggctcgcgacagctttgatatctcgtgcgacaaagacaaccgacgctcggccagactgggcaacttcttccgcaaagtcaaagaaaagatcggagggggcctgaagaaagtgggacagaagattaaggactttctgggaaatttggtgcctcgcactgcctcc

SEQ ID NO: 8283 - DNA, 510 bp, Artificial Sequence
  Description of Artificial Sequence: Synthetic coding sequence
atgaaaacacaacgtaacggaccaagcctgggtcgttggagcctcgttttgctgctgctgggccttgttatgcctctggccattgtggcccaggtgctgtcataccaagaggcagtattgagagcgatcgacggtatcaaccaacgcagcagcgacgccaacctgtaccgcttgctggatctggacccacgcccaacgatggatggagacccggacaccccaaagccggtgtcgttcaccgtcaaagagaccgtgtgccctaggaccacccagaagagcccagaagactgcgattttaaagaggacggtctggtgaagcggtgcgtgggcaccgtcattctgaatcaggcccgtgacagttttgatattagctgcgacaaggacaaccggcgctctgcgcgcctgggcaactttttccgcaaagtcaaggaaaagatcggcggtgggctgaagaaagtgggtcagaagattaaagactttctgggtaacttggtccctcgcacagcgtca

SEQ ID NO: 8284 - DNA, 510 bp, Artificial Sequence
  Description of Artificial Sequence: Synthetic coding sequence
atgaagactcagcgcaatgggccctctctggggcgctggagtctggtactgttgttgttgggtctggtgatgcccctggccatcgtcgctcaggtgctctcctaccaggaggccgtgttaagagcgatcgatgggatcaaccagcgaagcagtgatgcaaacctgtaccgccttcttgacctggatcccaggccaacgatggacggcgatccggacacaccaaagccagtctcattcactgtgaaagaaactgtctgccctaggacgacccagaaaagtcctgaagactgcgattttaaggaggacggtctggtcaagcggtgtgtgggaactgtgatcctgaaccaggctcgggattctttcgacatctcttgcgataaagacaacaggagaagtgcccggctgggcaacttttttcgcaaagttaaggagaagatcggcggaggcctcaagaaggtgggtcagaagatcaaagatttcttgggcaatctggtgcccagaacagccagc

SEQ ID NO: 8285 - DNA, 510 bp, Artificial Sequence
  Description of Artificial Sequence: Synthetic coding sequence
atgaagactcagaggaacggtccttcactgggacgatggagcttggtcctacttctgctgggactcgtcatgcctttggcgatagtcgcacaggtcctttcgtatcaagaagctgttttgagagcgattgatgggatcaaccagagaagctctgatgcgaatctttaccgactcttggatcttgatccacgccctactatggatggagatcccgacactcctaaacctgtgtccttcaccgtcaaggaaactgtatgccctcgaactacccaaaagtcaccggaggactgtgacttcaaagaggatggcctcgtcaaaagatgcgtcggtactgtaattctcaatcaggctagggactcgtttgatattagttgcgacaaggataatcgccgctcggcccggctgggtaattttttcaggaaagtaaaggagaaaatcggaggtggtttgaagaaggtcgggcagaaaattaaggacttcctagggaacctagtaccgcggacggctagt

SEQ ID NO: 8286 - DNA, 510 bp, Artificial Sequence
  Description of Artificial Sequence: Synthetic coding sequence
atgaagacccaacgaaatgggcctagtctgggccgttggagcctggtgctgcttctactgggtctagttatgccactggctattgtggctcaggtcctgagttatcaggaagcggtgctccgtgccattgatggcattaaccagcgcagctccgacgccaatctgtacaggttgttagacttggatcccagaccaacgatggatggcgaccccgacacgcccaagcctgtgtcctttaccgtaaaagagaccgtatgtccccgcactacccagaagagtcccgaagactgcgattttaaggaggacggcctggttaagagatgtgtagggacggtgattttgaatcaagcacgcgattctttcgacatatcttgtgataaggacaacagaaggtcggcccgactcgggaactttttcaggaaggtaaaggaaaaaatcgggggcggcttaaaaaaagtgggacagaaaattaaagattttcttggcaatctggttccacgtacagcttcc

SEQ ID NO: 8287 - DNA, 510 bp, Artificial Sequence
  Description of Artificial Sequence: Synthetic coding sequence
atgaaaactcaacgcaatgggccctcccttgggcgatggtcactcgtgcttctgcttctcggacttgtgatgcctcttgcaatcgtggcacaagtgcttagctaccaggaagctgtgctcagagctattgatggaatcaaccagcgctcctccgatgctaacctctacagacttttggatctcgatccaagaccaactatggacggggatccagatacccccaagcctgtgagctttaccgtcaaggaaaccgtgtgcccacgcacgacccaaaaatcgccagaggattgtgactttaaggaagatggtttggtcaagagatgcgtcgggactgtgatcctgaatcaggcgagggactcatttgatatttcgtgcgataaggacaaccggagatcggcccgtttgggaaacttttttcgtaaagttaaggaaaagattggcggtggcctgaagaaggtgggtcaaaagattaaagacttcctgggtaatctggtcccacgtacggcgtcc

SEQ ID NO: 8288 - DNA, 510 bp, Artificial Sequence
  Description of Artificial Sequence: Synthetic coding sequence
atgaaaacccagcgcaacggccccagcctggggcggtggtcactcgtgctgctcctcttgggtctggtcatgccactcgccatcgtggcgcaggtgctgtcctaccaggaggctgtgcttcgcgcgatagacggaatcaatcaacgatcgagcgacgcaaacctttatcgcctcctggatttggatccccgccctaccatggacggagatcctgacacgccgaagccagtgtccttcaccgttaaggaaactgtgtgtcctcgcactactcagaagagcccggaagattgcgatttcaaggaggacggactggtcaagagatgcgtgggcaccgttattctgaatcaggctagggattccttcgatatctcctgcgacaaggacaatagaagaagcgcccggctcggaaacttctttcggaaagttaaggagaagattggcggaggattgaagaaagtagggcaaaagatcaaagactttctggggaacctggtgccgcgcaccgcgtcg

SEQ ID NO: 8289 - DNA, 510 bp, Artificial Sequence
  Description of Artificial Sequence: Synthetic coding sequence
atgaaaacccagcgcaatggtcctagcctcggaagatggtcactggtccttctcctgctcggactggtgatgccgctcgctatcgtggcgcaggtcctgtcctaccaagaggccgtccttcgggcaatcgacggaatcaaccagagatcgtctgatgccaacctgtaccgcctcctcgacctggacccaagaccaaccatggatggagatcctgacacccctaaaccggtttccttcactgtcaaggagacggtgtgtcctagaaccacccaaaagtcgccggaggactgcgatttcaaggaggacgggttggttaagcgctgtgtgggaactgtgatcctcaaccaggcacgcgattcgttcgacattagctgcgacaaggataaccgcagatccgcgcgccttggaaactttttccgaaaggtcaaggagaagattggaggcggcttgaagaaggtgggacagaaaatcaaggacttcctgggtaatttggtcccacggactgcctcc

SEQ ID NO: 8290 - DNA, 510 bp, Artificial Sequence
  Description of Artificial Sequence: Synthetic coding sequence
atgaaaacacagagaaacggaccttcactcgggagatggtcccttgtcctcctgcttctagggctagtgatgcccctcgctatagtcgcacaggtcctgagttatcaggaagccgttcttcgagccatcgatgggattaaccagcgatcaagtgatgccaatctctaccgcctactggatctggatcctcggccaacaatggatggagatcctgatactcccaaacccgtgtccttcactgtcaaagaaactgtttgtcctagaacaactcagaaatcgccagaagattgtgattttaaagaagatgggctggtgaaaaggtgcgtagggacagtgatcctcaatcaagctagggattcctttgatatctcctgtgataaagataataggcggagtgcaagactcggaaacttcttcaggaaagtgaaagaaaaaataggaggaggacttaaaaaggtcggacaaaagatcaaagatttcctagggaatctggtgcctcgcactgctagt

SEQ ID NO: 8291 - DNA, 510 bp, Artificial Sequence
  Description of Artificial Sequence: Synthetic coding sequence
atgaaaacccagaggaatggaccatctctgggtcgctggtctctggtgctcttgctgctcggactcgtgatgcccctggcaattgtcgcgcaggtgctgtcctatcaggaagctgttctgagagctatcgatggtatcaaccagaggtcttcagatgctaacttgtatcgcctgctggacctcgatcctaggcccacaatggatggtgacccagacacccctaagcccgtgtcctttactgttaaggagactgtgtgccccaggaccacacagaaatcccctgaagactgtgatttcaaagaagacggtctcgtgaagagatgcgtcggcacagttatcctcaatcaagcacgcgattctttcgatatcagttgtgataaagacaacaggaggtcagcccgcctgggaaatttctttcgcaaagtcaaggaaaagatcggcggaggtttgaagaaggtcggccaaaagattaaagacttcctgggtaacttggtgccccgcacagctagt

SEQ ID NO: 8292 - DNA, 510 bp, Artificial Sequence
  Description of Artificial Sequence: Synthetic coding sequence
atgaaaacccagaggaacggtccttcactcggcagatggtccctggtgctcctgctgctcgggctggtcatgccactcgcaattgtggcccaagtcctgtcgtaccaagaggcggtgttgcgagccattgacggaatcaaccagcggtcctccgatgccaatctctacagactcctggacttggacccacgcccaactatggatggcgatccggatacgccgaagccggtgtcgttcactgtcaaagaaacggtctgcccccgcaccactcagaagtcgccggaggactgcgacttcaaggaggacggactcgtgaagaggtgtgttggtaccgtgatcttgaaccaagcgcgtgactcgttcgatatctcgtgcgataaggacaaccgtcggtcagctagactcggaaacttcttccgcaaggtgaaggagaaaatcggcgggggactcaagaaggttggacagaaaatcaaggacttcctggggaatctggtcccccggactgcgtcg

SEQ ID NO: 8293 - DNA, 510 bp, Artificial Sequence
  Description of Artificial Sequence: Synthetic coding sequence
atgaagacgcagcgaaacggacctagcttaggacgttggagcttagtgcttttgttgctcggtctcgtgatgccactggccatcgtggctcaagtcctctcgtatcaggaggcagtcttacgggctatagacgggattaatcagcgaagctcagacgctaacttatacaggctgttggacttggaccctcgaccaaccatggatggtgacccagatacccccaaacccgtgagttttaccgtcaaggaaacggtgtgcccaagaacgacacaaaaatcaccggaggactgcgatttcaaggaagacgggttggttaagaggtgcgttgggactgtgattctaaaccaagccagagactctttcgacatcagctgcgataaggataaccggcggagcgcacgacttggcaacttctttagaaaagtcaaggagaagatcgggggcgggctaaagaaggtgggtcagaagatcaaggacttcctagggaacctcgttcctaggacagccagc

SEQ ID NO: 8294 - DNA, 510 bp, Artificial Sequence
  Description of Artificial Sequence: Synthetic coding sequence
atgaaaactcaaagaaatggacctagcctgggacggtggtccctcgtgctgctccttctcggactggtgatgccccttgccattgtcgctcaagtcctttcgtaccaagaagcagtgctgagggctatcgacggaatcaatcagcggtcgtcggacgccaacctctatcgcctcctggacctcgacccaagacctaccatggatggagatccggacactcctaagccggtatccttcactgtgaaggagactgtgtgccctcgcaccactcagaaatctcctgaagattgcgacttcaaggaagatggcttggttaaaaggtgcgtgggaaccgtgatcctgaaccaggcgcgggatagctttgacatcagctgcgacaaggataatagacgctcggcccggctgggcaatttcttcagaaaagtcaaggagaagattggaggaggcctcaagaaggtggggcagaagattaaggactttctgggtaatcttgtcccacggaccgcatca

SEQ ID NO: 8295 - DNA, 510 bp, Artificial Sequence
  Description of Artificial Sequence: Synthetic coding sequence
atgaaaactcaacgcaacggccccagcttgggtcgatggtccctcgtccttcttctgctggggctggtcatgcctctcgccattgtggcccaggtactgtcttatcaggaggcggtgctccgggccatagacggcattaatcagaggtccagtgatgccaacctttaccggcttttggacctcgatcctcggcccacgatggatggagatccggacacccccaagcctgtctcctttaccgtcaaggagaccgtttgcccacgcacgacccaaaagagtcctgaggattgcgacttcaaggaggatgggcttgttaaaaggtgtgttgggactgtcattttgaatcaggcgcgagacagttttgatataagttgtgataaagacaacaggcggagcgccagactcgggaactttttccggaaggtcaaggaaaagataggaggagggttgaaaaaggtagggcagaaaatcaaagacttcctgggaaatctcgtgcctcgcaccgccagc

SEQ ID NO: 8296 - DNA, 510 bp, Artificial Sequence
  Description of Artificial Sequence: Synthetic coding sequence
atgaaaacgcaaaggaacggaccctctctgggcaggtggtcccttgtacttttgctgctgggactggtcatgcctctggccatcgtggcacaggtgctaagttaccaagaagctgtgttaagagccattgacggcatcaatcagcgatccagcgatgctaatctatatagactcctcgacttggatccgaggcccactatggatggggacccagacacccctaagcctgtttctttcacggtgaaagaaacggtttgccctaggacaacacagaaatccccagaggattgtgactttaaggaggacggtctcgtgaagcgatgcgtaggcacagtgattctgaaccaagctagggactcctttgatattagctgtgataaggataacagaaggtccgcccgcctgggcaacttcttcagaaaagtaaaagaaaaaatcggcggaggcctgaagaaggtgggacagaaaatcaaagacttccttgggaatctcgtacccagaaccgccagt

SEQ ID NO: 8297 - DNA, 510 bp, Artificial Sequence
  Description of Artificial Sequence: Synthetic coding sequence
atgaaaacacaaagaaatggaccaagtttaggtagatggtcattagtattattattattaggattagttatgccacttgctatagtagctcaagtacttagttatcaggaagctgttcttcgagcaattgatggaattaatcaacgatctagtgacgctaatctttatagacttttagatttagatccaaggccaacaatggatggagatccagatacaccaaagcctgtatcattcacagttaaagaaacagtctgcccacgaacaactcaaaaatctccagaagattgtgattttaaagaagacgggttagttaagagatgtgttggaacagttatattaaatcaagcaagggattcatttgacatttcgtgtgataaggataatagacgatcagcaagattaggaaattttttccgaaaagtaaaagaaaaaataggaggtggattgaaaaaagttgggcaaaaaatcaaagattttttaggaaaccttgttccacgaactgcttct

SEQ ID NO: 8298 - DNA, 510 bp, Artificial Sequence
  Description of Artificial Sequence: Synthetic coding sequence
atgaaaactcagagaaacggaccaagcctgggacggtggtcacttgtgctgcttctccttggattggtgatgcctctcgcaatagtggcccaagtgctgagctaccaagaagccgtgctgagggccatcgatggtatcaaccaacgctcgtcggacgcaaacctctaccggcttttggacctggatccaagaccaaccatggacggagatcctgacacccctaagcccgtgtcgttcactgtcaaggaaactgtctgcccacggacgactcaaaaatcgcctgaagattgcgatttcaaggaggacgggctcgtgaagcgctgtgtgggaaccgtgattctgaatcaagcccgagattccttcgatatcagctgtgataaggacaaccggagatcagctagactgggtaactttttccgtaaggtcaaggagaagatcggcgggggcctgaaaaaggtggggcagaagatcaaggacttccttggaaacctggtgccaagaacggcgagc

SEQ ID NO: 8299 - DNA, 510 bp, Artificial Sequence
  Description of Artificial Sequence: Synthetic coding sequence
atgaagactcagcgcaacggtccttccctcggccggtggtccctcgtgttactccttctgggactcgtgatgccgctcgctattgtcgcccaggtgctgagttaccaggaggctgtcctccgtgccattgacggtatcaaccagcggtcttctgatgctaacctctaccgcctgctcgacctcgacccccgtcctacgatggatggtgacccggacactcccaaacccgtctccttcactgtgaaggagaccgtgtgcccccgcaccacgcagaagtctcccgaagactgtgacttcaaggaggacggcctggtgaagcgctgcgtcgggaccgttattctgaaccaggcccgcgattctttcgatatttcgtgcgacaaggacaacagacggtcggctcgcctaggaaacttctttcgcaaggtcaaggagaagatcggtggtggcctcaagaaggtcggtcagaagatcaaggattttctaggcaacctcgtaccgcggaccgcctct

SEQ ID NO: 8300 - DNA, 510 bp, Artificial Sequence
  Description of Artificial Sequence: Synthetic coding sequence
atgaaaactcaaaggaacggcccctcactcggcaggtggagcttggtactgttgctcctcggtctggtgatgccactcgcgatcgtggcacaggttctttcgtaccaggaagcggtgctgagagcgatcgatggtatcaatcaacgcagctcagacgctaatttgtacagactgctcgacctggaccctagaccgaccatggatggggacccagacaccccgaagcccgtctctttcactgtcaaggaaacggtgtgtccacggactacccagaaatctccagaggactgcgatttcaaagaggatggcctggtgaaacgttgcgtgggcaccgtcattctgaatcaagcccgggactcctttgacatcagctgcgacaaggataaccggcgctccgccaggctcggcaacttcttcaggaaggtgaaagaaaagatcggagggggactcaagaaggttggtcagaagatcaaggactttctgggaaacctggtgcctcggaccgcctcc

SEQ ID NO: 8301 - DNA, 510 bp, Artificial Sequence
  Description of Artificial Sequence: Synthetic coding sequence
atgaaaactcaacggaatgggccgtctctgggacgatggtcactggtgctgttgcttctcgggctggtgatgcctctggcaatcgttgcacaggtgctttcgtaccaagaagccgtgctcagggccattgatgggattaaccaaaggtcctcggacgcaaatctctacagactgctggaccttgatcctcgtcctaccatggacggtgatccagatacgcctaagcctgtgtccttcactgtgaaggagactgtatgccccaggaccacccagaagagccctgaagattgcgactttaaggaggacggtcttgtgaaaaggtgtgttggcactgtgattctcaatcaggcacgggattcgtttgatatatcatgtgataaggataacagacgcagcgccagactggggaacttcttccggaaagtgaaggagaaaatcggtggcggactgaagaaggtgggtcagaagataaaggactttctcgggaatctcgtgccacgaaccgcttcg

SEQ ID NO: 8302 - DNA, 510 bp, Artificial Sequence
  Description of Artificial Sequence: Synthetic coding sequence
atgaagacccaaagaaatggcccttcacttggcagatggtccctagtcctgctactgctcgggctggtcatgcctctcgctattgtggcccaggtcttgagttatcaggaggccgtactaagagccattgacggcatcaatcaaagatccagtgacgccaatctataccgccttctggacttggacccaaggcctaccatggacggcgatcccgatacccctaagcctgtgtccttcacagtcaaggaaaccgtgtgccctagaacaacacagaaaagtccagaagattgcgactttaaggaggatggcctggtgaagagatgtgtgggcacagtcatcctcaaccaagctagagattctttcgatatttcctgcgacaaggacaacaggaggtccgctcgcctgggtaatttttttcggaaggtaaaagagaaaatcggaggaggtctgaagaaagtgggccagaaaataaaagactttctgggcaacctcgttccaaggacagctagc

SEQ ID NO: 8303 - DNA, 510 bp, Artificial Sequence
  Description of Artificial Sequence: Synthetic coding sequence
atgaaaacgcaacgtaatggtccgtcgttaggtcgttggtcgctagtactactactattaggtctagtaatgccgctagcgatagtagcgcaagttctatcgtatcaagaagcggtattacgagcgatagatggtataaatcaacgatcgtcggatgcgaatctatatcgtctattagatttagatccgcgtccgacgatggatggtgatccggatacgccgaaaccggtatcgtttacggttaaagaaacggtatgtccgcgtacgacgcaaaaatcgccggaagattgtgattttaaagaagatggtttagtaaaacgttgtgtaggtacggttatactaaatcaagcgcgagattcgtttgatatatcgtgtgataaagataatcgacgttcggcgcgactaggtaatttttttcgtaaagttaaagaaaaaataggtggtggtttaaaaaaagtaggtcaaaaaataaaagattttctaggtaatctagtaccgcgaacggcgtcg

SEQ ID NO: 8304 - DNA, 510 bp, Artificial Sequence
  Description of Artificial Sequence: Synthetic coding sequence
atgaagactcagagaaacggcccatccctcgggagatggagtctggtgcttttactcttggggttggtcatgcccctggccatcgtggcgcaggtattatcgtaccaggaggcagtactccgggcaatcgatgggattaaccagcggtccagtgacgccaatttgtatcggctactggatctcgatccccggcctaccatggacggcgacccagataccccgaaacccgtgtcctttaccgtcaaggagaccgtctgccctcggaccacccagaaaagtcccgaagattgcgatttcaaggaggacggtctggttaaacgctgtgttggcaccgtgattttgaaccaggctcgtgattcttttgacattagctgtgataaggacaaccgccgttccgcgcggctgggcaacttttttcgaaaagttaaggagaagataggtggtgggctgaaaaaggtcggacagaaaataaaggactttctcggcaatctagtgccacgaactgcgtcc

SEQ ID NO: 8305 - DNA, 510 bp, Artificial Sequence
  Description of Artificial Sequence: Synthetic coding sequence
atgaagactcaaagaaacggcccgtctctgggaagatggagccttgtcttgttactgttgggcttagtaatgccgctagctatcgtagcgcaggtgttatcttatcaagaagcagtcctgagggcgatcgatggtataaatcaaagaagcagcgatgcgaatttatacagattattggacctggatcctcgcccgacgatggacggagatccagatacgcctaaaccggttagctttacggtcaaagaaactgtctgtccgagaacaacgcagaaatcaccggaggattgtgattttaaggaggatggattggtcaaacgctgtgtgggaacagtgattctgaatcaggctagagattcttttgatattagttgtgataaggataataggaggagcgcacgtctgggcaatttctttcgaaaagtcaaggagaagataggaggcggccttaaaaaagttggtcagaagattaaagattttcttggtaatctcgtgcctcgtacagcaagc

SEQ ID NO: 8306 - DNA, 510 bp, Artificial Sequence
  Description of Artificial Sequence: Synthetic coding sequence
atgaaaacccagcgcaacggaccctccctcggacgctggtcgctggtgctgctgctgctggggctggtgatgccactggccattgtggcacaggtgttgtcgtaccaggaagccgtcctgcgcgcaattgacggaatcaaccagaggtcctcggatgctaacctgtacagactcctggacctggatccgcggccaaccatggatggggaccccgacacgccgaagcccgtcagcttcaccgtgaaggaaaccgtgtgtcctaggaccactcagaagtcgccggaggattgtgacttcaaagaggacggactggtcaagcggtgtgtgggcaccgtgatccttaatcaagcgcgcgactcctttgacatctcctgcgataaggacaacagacgctcggctagactgggcaatttcttccggaaggtgaaggaaaagatcgggggaggcctcaaaaaggtgggccagaagataaaggacttcttgggaaacttggtgccgcggaccgcgtcc

SEQ ID NO: 8307 - DNA, 510 bp, Artificial Sequence
  Description of Artificial Sequence: Synthetic coding sequence
atgaaaacgcagcgcaacgggccctcattagggagatggagtttggttcttctcctactcgggctggtcatgccgttggcaatagtggcgcaggtgttgagctaccaggaagctgtactgagggccattgacgggataaatcagagaagctcagatgctaacctgtataggctgctagaccttgaccccaggccaaccatggacggcgatcccgacactcccaagccggtctcctttactgtaaaggagactgtgtgcccgcgcaccacacagaaaagtcccgaggattgtgacttcaaagaagacggacttgtgaaaagatgcgtcggtactgttatcctgaatcaagccagggactcatttgatatctcctgtgataaggacaatagacgttctgctcgactgggcaatttttttagaaaggtaaaagagaagataggcggtggcttgaaaaaggttggtcagaagattaaggacttcctcgggaatctcgtgcccagaaccgcttct

SEQ ID NO: 8308 - DNA, 510 bp, Artificial Sequence
  Description of Artificial Sequence: Synthetic coding sequence
atgaaaacccagaggaacggaccctcacttggccgttggagccttgtcctcctgctgcttggtctcgtaatgccacttgccatcgtggctcaggtgctttcatatcaggaggcagttctgagggccattgatggcattaaccaaaggtctagtgatgccaacctgtacagattgctcgatctggaccccaggcccactatggatggggatcctgacactccaaagccagttagttttacggtgaaggagaccgtgtgtcctaggaccactcagaaaagtcctgaagattgcgattttaaagaagacggacttgtgaagcgctgtgtggggactgtcattttgaatcaagcccgggactcttttgatatttcatgcgacaaggataacagacggtccgctcgtctgggtaactttttccgtaaagtgaaggagaagatcggagggggactgaaaaaggtaggccaaaaaataaaggactttctaggtaatttggttccgcggaccgcctcc

SEQ ID NO: 8309 - DNA, 510 bp, Artificial Sequence
  Description of Artificial Sequence: Synthetic coding sequence
atgaagacccaacgcaatggtcccagtctcggacggtggtctctcgtgcttctgctactcggactcgtgatgccattggctattgtggcccaggtcctgagctatcaggaagctgtgctgcgcgcaatcgacggaatcaatcagagaagctctgacgcgaacttatacaggctgctggacctagacccccggcccacaatggacggcgatcccgacacccccaaacctgtgagtttcacagtgaaggagaccgtctgtccccggactactcaaaaatctcctgaagattgcgactttaaggaggatggcctggtcaagcgatgcgttgggactgttattttaaatcaggcccgggacagctttgacatttcatgtgacaaggataatcggaggagcgcgagactcggcaacttttttagaaaggttaaagagaaaatcggcggtggtctcaagaaagtcggacagaagatcaaagatttccttggaaacctagtgccccggactgccagt

SEQ ID NO: 8310 - DNA, 510 bp, Artificial Sequence
  Description of Artificial Sequence: Synthetic coding sequence
atgaagacccagagaaatggtccctctctcgggcgatggagtctcgtgcttcttctgcttgggctggtcatgccattagctatcgtggcccaagtgctgagctatcaggaggctgtccttagagccattgacgggattaaccaaaggtctagcgacgctaatctgtatcgactattagatttggatccgaggcccaccatggacggagacccagatacccccaaacctgttagctttacagtgaaagagaccgtatgtcctaggactacacaaaaatcgccagaggactgcgattttaaagaggacgggttggtgaagcgctgtgtggggacggtaatactaaaccaggctcgagacagtttcgacatctcctgcgataaagacaacaggcggtcagctcgtcttggtaatttttttcgcaaagtaaaggaaaaaatcggtggcggactcaaaaaggtcggtcaaaagatcaaagactttctgggcaacctggtccctcgcactgcctcc

SEQ ID NO: 8311 - DNA, 510 bp, Artificial Sequence
  Description of Artificial Sequence: Synthetic coding sequence
atgaagactcagcggaacgggccttccctggggcgctggtccctggttctgctgctgctgggactggtgatgcccctggctatcgtggctcaggtcctttcctatcaggaggcagtgcttcgagcaattgatggaataaaccagagaagcagcgatgcaaatttgtataggctgctggatttggacccaagacctaccatggatggagatccggatacaccgaagcctgtttccttcaccgtcaaggagaccgtgtgtcctagaactactcaaaagtctcctgaggattgtgatttcaaagaggacggcctggtaaaacgctgcgttgggacagtgatcctgaatcaagcccgggattctttcgacattagttgcgataaggacaatcgaaggagcgccagactggggaatttttttcggaaggtgaaagagaaaatcggtggggggctgaagaaagtcgggcaaaaaatcaaagactttctggggaacctcgtcccgcggacagcttca

SEQ ID NO: 8312 - DNA, 510 bp, Artificial Sequence
  Description of Artificial Sequence: Synthetic coding sequence
atgaaaacgcagagaaacggcccctctcttggaaggtggagccttgtgctcctcctgttgggactggtcatgccgctggcgatcgtggctcaagtcctgagctaccaggaagcagttctccgcgctatcgatgggatcaatcagcggtcgtctgatgccaatctgtaccgcctgcttgaccttgatccgcgcccgacgatggacggcgacccagacactccaaaacctgtgtcgtttaccgtcaaggagactgtgtgcccgcgcactacccagaagtcgcctgaagattgcgacttcaaggaggatggcctcgtgaaacgctgcgtgggaactgtgatcttgaaccaagcccgggactccttcgacatcagctgtgacaaagacaatcggaggtccgcgcgcctggggaacttcttccgaaaggtgaaggaaaagatcggcgggggcttgaaaaaagtgggtcaaaagattaaggatttcctgggaaacctggttccacgcaccgcgtct

SEQ ID NO: 8313 - DNA, 510 bp, Artificial Sequence
  Description of Artificial Sequence: Synthetic coding sequence
atgaaaacccagagaaatggaccctcgcttggacggtggagcctcgtccttctcctcctggggctggtgatgccactggcaatcgtggcacaggtgctgtcctaccaagaagcggtgctgagagcaattgatggcattaaccaacgatcgtccgacgccaatctgtatcgcctgcttgatctcgatcctaggcctactatggatggtgaccccgatactccaaaacctgtgtcgtttactgtgaaagaaaccgtctgcccacgaaccacccaaaagagtccagaggactgtgatttcaaagaagatggtcttgtgaagcggtgtgttggaaccgtcattctgaatcaggcacgggatagctttgatatatcctgtgataaggacaacaggcggtcggccaggcttggaaatttcttcaggaaggtgaaggaaaagatcggtggaggtttgaaaaaagtgggacagaaaatcaaagacttcctcgggaatctggtccctaggactgcttca

SEQ ID NO: 8314 - DNA, 510 bp, Artificial Sequence
  Description of Artificial Sequence: Synthetic coding sequence
atgaagactcagcggaatggtccttccctgggccgctggtcattggtcctcctcctcctgggcctggtcatgcctctggcaattgtcgcccaagttctgtcttatcaggaagcagtgctgcgggcaattgatgggataaaccagaggtcaagtgatgccaatctctatcgcttgttggatcttgaccctaggccgaccatggacggcgacccagatacccccaagcccgtgtcctttacagtaaaagaaaccgtgtgtccacggaccacgcaaaagtcccccgaggattgtgactttaaagaggacgggctggtgaagcgctgcgtgggcaccgtgattctgaatcaagctcgcgattctttcgatatatcctgcgacaaggacaacaggagatcagctcggctggggaacttcttcaggaaggtgaaggaaaaaattggaggcgggctgaagaaagttggccagaaaatcaaagacttcttgggcaatctggtccctagaacggccagt

SEQ ID NO: 8315 - DNA, 510 bp, Artificial Sequence
  Description of Artificial Sequence: Synthetic coding sequence
atgaagacacagcgcaacggcccctccctcggcaggtggagcctggtactcttgctcctgggcctggtcatgccacttgctattgtggctcaggtgttgtcttatcaagaggctgtcttgagggccattgacggtatcaaccaacgttcttctgacgccaacctgtaccgcctgctggatcttgatccacgtccaactatggacggtgaccccgacactccaaaaccagtctcattcaccgtcaaggaaacagtatgccccaggaccacacagaaaagtcccgaggactgcgatttcaaggaggatggtttggtcaagcgctgcgtgggaaccgttatcctcaatcaggctcgcgattctttcgacatctcctgcgacaaggataataggagatcagccaggcttggtaatttcttccgcaaggtcaaagagaagattggtggcggactcaaaaaagttggtcaaaaaatcaaggacttcctgggcaacttggttccacgtactgctagc

SEQ ID NO: 8316 - DNA, 510 bp, Artificial Sequence
  Description of Artificial Sequence: Synthetic coding sequence
atgaagactcagcgcaacggaccgtcgctgggacgctggtcactggtgttgctcctgctgggtctggtcatgccactggcaatcgttgcccaagtgctttcataccaggaggccgtcctgagggcgattgatgggattaaccagcgttcttccgatgctaacctgtacagactcctcgacctcgacccgcgtccgactatggacggcgatccggacaccccaaagccagtgtcattcaccgttaaggaaaccgtgtgcccgcggactacccagaagagcccggaagactgcgacttcaaggaagatggccttgtgaagcgctgcgtgggcactgtgatcctgaatcaggcccgcgactcgttcgatatcagctgtgacaaagacaaccggagatcggccaggctcggaaatttcttccgcaaggttaaggaaaaaatcggaggaggactgaagaaggtcggccaaaagatcaaggattttcttggcaatctggtgccgcgcaccgcttcc

SEQ ID NO: 8317 - DNA, 510 bp, Artificial Sequence
  Description of Artificial Sequence: Synthetic coding sequence
atgaagacccagcggaacggcccctcattgggacggtggagtctcgtgctactccttttaggactggtaatgcccctggcaatcgtggctcaggtcctgtcctaccaggaagctgtattgcgggcgatcgacggtatcaaccagcggagcagcgacgccaacctgtaccgccttttagatttggatcctagaccaacaatggacggtgacccagatactccaaaaccggtcagcttcaccgtaaaggagacagtctgccctaggaccactcagaagtctcctgaggactgcgactttaaagaagacggactcgtgaagcgctgtgtggggaccgtaatccttaaccaggcgagagatagctttgacatttcctgtgacaaagataaccgacggtccgcccggctggggaacttttttaggaaagtcaaggaaaaaatcggtggaggactgaagaaggtgggccagaagatcaaagatttcctgggaaatctggtgcccaggaccgcctca

SEQ ID NO: 8318 - DNA, 510 bp, Artificial Sequence
  Description of Artificial Sequence: Synthetic coding sequence
atgaaaactcaaagaaatggtccatccctgggtagatggtcgctcgttcttcttctgttgggcctggtcatgcctctggccatcgtcgcccaggtgttgagctaccaagaggcagtgctccgcgcgattgacggtattaaccagagaagcagcgacgcgaatttgtaccggctcctggatctcgatccacggccgactatggatggagatcccgacacgcctaaacctgtctcctttaccgtcaaggaaactgtgtgcccacgaaccactcaaaaatcaccagaggactgtgacttcaaggaagatgggcttgtgaaacggtgtgtgggtaccgtgatcctgaaccaagcacgggattcctttgacattagctgtgataaagacaatagacgcagcgcacggcttggtaacttctttagaaaggtgaaagagaagattggaggtgggctgaagaaggtcggtcagaagataaaagatttcttggggaacctggtgcctcgaaccgcatcc

SEQ ID NO: 8319 - DNA, 510 bp, Artificial Sequence
  Description of Artificial Sequence: Synthetic coding sequence
atgaaaacccagcgaaacggaccttcactcgggcggtggagcttggtcttgttgctgcttgggttggtgatgcccctggctatcgttgcccaggtgctttcctaccaagaagccgtcctgcgcgcgatagatggtatcaaccagcgcagctcggacgccaatctctaccggctgttggatttggacccgcgcccgacgatggacggtgatcctgacactccgaaacccgtgagcttcaccgtgaaggaaaccgtgtgtccaaggactacgcagaagtccccggaggactgcgatttcaaggaggatggcctggtgaaacgatgcgttggaaccgtgatcctgaaccaagcgcgtgactcgttcgacatttcctgcgacaaagacaatagaaggtcggcacggctcggaaactttttccggaaggtcaaggaaaagatcggcggagggctgaagaaggtcggacaaaagatcaaggattttctcggtaacctggtgccaagaactgcttct

SEQ ID NO: 8320 - DNA, 510 bp, Artificial Sequence
  Description of Artificial Sequence: Synthetic coding sequence
atgaagacccagcggaatgggccttctttagggagatggtcactagttctgctcctgctaggactggttatgccccttgccatagtcgcccaggtgctgagctaccaagaggccgtgctgcgggccatcgatggcattaatcagagaagcagtgacgccaatctgtaccggctgctggatttggatccgaggcctaccatggacggtgaccctgatactcccaaaccagtctcctttaccgtcaaggagacggtttgccccagaaccacccagaagagccccgaggactgcgacttcaaggaagacggcctcgtaaagcgatgtgtaggaaccgtgattctcaaccaagctcgggactccttcgacatatcttgcgataaggacaaccgacggagtgcaagactcgggaacttctttagaaaggtgaaggaaaaaatcgggggtggtctgaagaaagtggggcagaagatcaaagacttcctgggaaaccttgtgccccgaactgctagc

SEQ ID NO: 8321 - DNA, 510 bp, Artificial Sequence
  Description of Artificial Sequence: Synthetic coding sequence
atgaaaacgcagcgcgatggacactcactggggagatggtccctggtcctgctgcttctgggcttggtgatgccgttggcaatcatcgcacaggttctctcgtataaggaggcagtcctccgggcaatcgacggaatcaatcaacgctcatcagacgccaacctctaccgcttgctggacctcgatcccaggccgaccatggatggtgacccggacaccccaaaacctgtgtcgttcactgtgaaggaaaccgtctgtccgcgcaccactcagcagtctccagaagattgcgacttcaagaaggacggactggtgaaaagatgtatgggtactgtcaccctcaatcaagcacgcggatcgttcgacatttcgtgcgacaaggacaataaacggtttgccctgctgggggacttcttcaggaagagcaaggagaagatcggaaaggaattcaagcgcattgtgcagcggatcaaagatttcctgagaaatctggtcccccgcactgagtcc

SEQ ID NO: 8322 - DNA, 510 bp, Artificial Sequence
  Description of Artificial Sequence: Synthetic coding sequence
atgaaaacgcagagagatggtcattcgctggggcggtggtctttggtgctccttcttcttgggctcgttatgcctctcgcaataatcgcgcaggtcctttcgtacaaggaagccgtccttagagcaatcgacgggattaaccagcgctcatccgatgccaacctttaccgacttctggatctcgatccgaggcctactatggacggggatcctgatacccccaagccagtgtcgttcaccgtgaaggaaacggtctgtcctcgaacgactcagcaaagcccagaggactgtgatttcaagaaggatggcctcgtcaagaggtgtatgggtactgtgactcttaaccaagccaggggatcctttgatatttcatgtgacaaggataacaagcgctttgccctgctcggagatttctttagaaagtccaaggagaaaataggaaaggagttcaaacggatcgtgcagcggattaaggatttcctgcgtaacctggtccctcgaactgaaagc

SEQ ID NO: 8323 - DNA, 510 bp, Artificial Sequence
  Description of Artificial Sequence: Synthetic coding sequence
atgaagacacagagagatggacactctctaggtcggtggagtctcgtcttgttgctactgggccttgtcatgccgctggcaattattgcccaggtgttgagttacaaggaggccgtgctccgggctatagatggcatcaaccagcggtcatcggacgcaaacctctacaggttactggatctggatccccgccctactatggatggcgatcctgatacaccaaagcccgtttccttcacagtcaaagagactgtgtgtccaagaaccacccagcagtcaccagaggattgtgacttcaagaaagacggccttgtaaaaaggtgcatggggacagtgaccctgaatcaagccagaggaagttttgacatcagctgcgacaaggataacaagaggtttgcgcttttgggcgacttcttcagaaagagtaaggaaaaaatcggaaaggaattcaagaggattgtgcagcgtatcaaggacttcctacggaacctcgtgccccgcactgaatca

SEQ ID NO: 8324 - DNA, 510 bp, Artificial Sequence
  Description of Artificial Sequence: Synthetic coding sequence
atgaagacccagagggatggacattctctgggccgttggtctctggtcttgcttctgttaggccttgtgatgccattagctatcatcgcacaggtgttgagctacaaagaggctgttcttcgggctattgacggcattaaccagcgaagctcggacgccaatctatacagactcctggatttggatccccgcccaacaatggacggggatcctgacacgccaaaacccgttagttttacggtcaaagagactgtctgtccccggacaacccagcaatcccctgaggattgtgatttcaaaaaagatgggctggtgaagcggtgcatgggtaccgtcactctgaaccaggctcggggtagtttcgatatcagttgtgataaagacaataagcggttcgctttgctcggtgacttcttccgaaagtcaaaggaaaagattggcaaggagtttaaacggattgtacagaggattaaggactttttaagaaacttagtaccccgtactgagtct

SEQ ID NO: 8325 - DNA, 510 bp, Artificial Sequence
  Description of Artificial Sequence: Synthetic coding sequence
atgaagacccagcgggacggtcattccctgggacgatggtccctggttttgctgttgctcgggctagtcatgccccttgcgattatcgcccaggtcctgtcgtataaggaggctgtattgcgtgcgatcgacggtatcaaccagcgaagcagcgacgcaaacctgtaccgccttctcgacctggatccccgtcccaccatggatggtgatcccgacacacccaagcccgtcagcttcaccgtcaaggagactgtctgtccacgcaccacccaacaatcccccgaggactgcgatttcaagaaggatggcctcgtcaagcgttgcatgggcacggtcaccctcaatcaggctcggggttctttcgacattagctgcgataaggataacaagcggtttgccctcctcggagacttcttcagaaagtctaaggagaagatcggtaaggagttcaagagaatcgtccaacgaatcaaggacttcctgcggaacctcgtaccccgtaccgagtct

SEQ ID NO: 8326 - DNA, 510 bp, Artificial Sequence
  Description of Artificial Sequence: Synthetic coding sequence
atgaagacacagcgggatggacattctctgggacgctggtccctagtattgcttctactagggctggtcatgcctttggctatcatagcacaggtgctctcctataaagaagccgtccttagagctattgacgggataaaccagagatcctcagatgcgaacctttatcgattactggatttggatccccgccccactatggacggggatcctgatactcccaaacccgtgtccttcactgtaaaagaaactgtgtgcccaagaacaactcaacagtctccagaggattgtgacttcaagaaagatggactcgtgaaacgatgcatgggaacagtaacactcaatcaggctagaggaagttttgacatatcatgcgacaaagataataaaaggttcgcccttttaggggatttcttcagaaaaagtaaagaaaagatagggaaagaattcaaacggattgtacagagaattaaagattttctccgcaatctcgtccctcgcactgaatct

SEQ ID NO: 8327 - DNA, 510 bp, Artificial Sequence
  Description of Artificial Sequence: Synthetic coding sequence
atgaaaacacagagagacgggcattcgttaggacgatggtcactcgtgctgctacttctgggcctggtgatgcccctcgccattatcgctcaagtgctttcgtacaaggaggccgtgctgagggccatcgacggtattaatcagcggtcttccgacgcgaacctgtaccgcctgctggaccttgatccacgccccaccatggatggagaccccgacaccccaaagcccgtgtcttttaccgtcaaggagactgtgtgccccaggacgacccagcaaagccccgaggattgtgattttaaaaaagacgggctagtcaaacgatgcatgggaaccgtcactttgaaccaggcacgtgggtctttcgatatctcatgcgataaagacaacaaacggtttgcgctgttgggcgacttttttcggaagtccaaagaaaaaatcgggaaagaatttaaacgtatcgtgcaacgcattaaggatttcctgagaaatttggtgcctcgcaccgagtcc

SEQ ID NO: 8328 - DNA, 510 bp, Artificial Sequence
  Description of Artificial Sequence: Synthetic coding sequence
atgaagacccaaagagacggccatagtttggggagatggagcctggtcctacttctcctgggcctggtgatgcctttggctataattgcacaggtgctttcttataaagaggccgtcttgagagccatagatgggataaaccaaaggtcttccgacgcaaatttgtatcgtttattggatttggatccgcgtccgacaatggacggagaccccgatacgccgaaacccgtatctttcacagtcaaagaaactgtatgcccacggacaacgcaacaatcaccggaagattgtgatttcaagaaagatggccttgtaaagcgctgcatggggacggtcacactcaatcaggcccgcggcagttttgacatctcttgtgacaaagataataagcggttcgcactgctgggcgatttttttcgtaaatcaaaagaaaaaataggaaaagagtttaagaggattgtgcagaggattaaagattttcttaggaatcttgtgccgaggactgaaagt

SEQ ID NO: 8329 - DNA, 510 bp, Artificial Sequence
  Description of Artificial Sequence: Synthetic coding sequence
atgaagacacagcgcgacgggcatagcctgggccggtggtcactggtgctgctgcttttggggcttgtcatgcccttggccattatcgcacaagtactctcttacaaagaggcggtcctccgggctatcgatggcatcaaccagcggtccagtgacgctaatctgtacagactgctggatctcgatccgcggcctacaatggacggcgacccagacacacctaagccggtgtcctttacagtgaaagagaccgtgtgcccaaggactacgcagcagagtcctgaggattgtgatttcaagaaagacggcttggttaaaaggtgtatgggaactgtaacgctgaatcaggcaaggggatccttcgacatttcttgcgacaaagacaacaagcggttcgccctgctgggcgacttttttcgaaagtccaaggagaaaataggcaaagagttcaagcggatcgtccagcgaatcaaagatttcttgaggaatctggtgcctcgaacggaaagt

SEQ ID NO: 8330 - DNA, 510 bp, Artificial Sequence
  Description of Artificial Sequence: Synthetic coding sequence
atgaagacacagcgggacggtcactcccttggccgatggtctctggtgctgctgcttctcggacttgttatgccgctagccataattgcccaagttctgtcctacaaagaagctgtactaagagccatagatggcattaaccagagaagtagtgatgccaatctgtatcgcctgctggacctcgaccccaggccgacgatggatggcgacccagatacacccaaacccgtttccttcacagtcaaggagaccgtgtgcccccgcaccactcagcagagtccggaagactgcgatttcaagaaggatgggcttgtgaagcgatgcatgggcactgtcaccctgaaccaagctaggggctccttcgacatcagttgcgataaagataataaacgtttcgcgctgctgggcgacttttttaggaagagcaaagaaaaaatcggcaaggagttcaaaagaattgtccagaggattaaagacttcttgagaaacctcgtgccgaggacagagagc

SEQ ID NO: 8331 - DNA, 510 bp, Artificial Sequence
  Description of Artificial Sequence: Synthetic coding sequence
atgaagactcagagggatggccactcgttaggccgatggagcctggtacttctgcttctcggcttagttatgcccctggccatcattgctcaggtgctgtcatacaaagaggcagtcctgagggctatagatgggataaatcagcgctcaagcgacgccaacctctaccggcttctcgatctcgatcctagacccacaatggatggcgaccctgacacacccaaacctgttagctttactgtgaaagaaactgtgtgcccgaggaccactcagcagtcccctgaggattgtgactttaagaaagacggactggtcaaacgctgcatgggcacagtcaccctgaatcaagccaggggaagtttcgacatcagctgcgacaaggacaacaaaaggtttgccctgcttggcgatttttttcgtaaaagcaaagagaagatcggaaaagaatttaaacggatcgttcagagaattaaagacttcctcaggaacctggttccgagaacagagagc

SEQ ID NO: 8332 - DNA, 510 bp, Artificial Sequence
  Description of Artificial Sequence: Synthetic coding sequence
atgaaaacccagcgggatgggcactccctgggaaggtggtcgctcgtactcctgcttctcggacttgtcatgccgcttgcgatcatcgcgcaggttctctcatacaaggaggcagtgctccgggctatcgacggtattaaccaaaggtcgtccgatgccaatctgtatagactgcttgatctggatcctaggccgactatggacggggatcccgacactccgaagccggtgtccttcaccgtgaaagaaacggtgtgccctagaaccacccagcaatcaccagaggactgtgacttcaagaaagacggtctggttaagagatgcatgggtaccgtcacgttgaatcaggcccgaggctcattcgacatctcatgcgataaagataacaagcggttcgcactcctcggcgacttttttcgcaagtccaaggagaaaatcggaaaggaattcaagcggatcgtgcagaggatcaaggatttcctgcgaaacctcgtgcctcgcactgaaagc

SEQ ID NO: 8333 - DNA, 510 bp, Artificial Sequence
  Description of Artificial Sequence: Synthetic coding sequence
atgaagacacagcgtgacgggcacagccttggaaggtggagcctcgtcctgctgttgttgggcctagttatgcctctggctatcattgcacaagtgctatcctacaaggaggctgttcttcgggcgatcgatggaatcaaccagcgatcatccgacgcaaatctttacaggctcctcgatctggacccgcggccaaccatggacggagaccctgataccccaaagccagtgagcttcactgtgaaagagacagtctgccctcgaacaactcagcagagccccgaggactgcgattttaaaaaggatgggctggtgaaacggtgtatggggactgtgacacttaaccaggcccgcgggtcattcgatatatcgtgcgataaagacaataaacgattcgcactgctgggtgattttttcagaaagtcaaaggagaaaattggaaaggagtttaagaggatcgtgcaacggattaaggacttcctccgtaacctagtgccaagaacagagtct

SEQ ID NO: 8334 - DNA, 510 bp, Artificial Sequence
  Description of Artificial Sequence: Synthetic coding sequence
atgaaaactcagagggatggacattctttgggaagatggtcactcgtgctcttgcttctgggattggtgatgccactggctatcatcgcccaggtgcttagctacaaggaggccgttttgcgcgctattgacggtatcaatcagagaagtagtgacgcaaatctttaccgcttgttggacctggacccacgtcccactatggacggagacccagacacacccaaacccgtctcttttaccgttaaagagacagtgtgcccaagaacaacccaacagtcccctgaagactgtgacttcaaaaaggacggactggtgaagcgctgtatgggaactgtaaccctcaaccaggcaaggggctctttcgacatctcctgtgacaaagataacaagaggttcgccttgttgggcgactttttccgtaagtccaaggaaaaaataggaaaagagttcaaacgcattgtacagcgtatcaaagactttctgagaaacctcgtcccaaggaccgaaagt

SEQ ID NO: 8335 - DNA, 510 bp, Artificial Sequence
  Description of Artificial Sequence: Synthetic coding sequence
atgaaaacgcaaagagacggacactctctgggacgttggtcgctggtgcttttgctcctcggtttggtcatgccacttgcaatcattgcacaggtgctctcatacaaggaggcagtcctcagggcaattgatgggattaaccagcgatcaagcgatgcaaatctgtacaggcttcttgatttggaccctcgccctaccatggatggagatccagatactccaaagccagtctccttcaccgtgaaggaaaccgtgtgccctaggactacccagcaatcccccgaggattgcgatttcaagaaggacggccttgtgaaacgctgtatgggaaccgtgaccttgaaccaggcaagaggttcgttcgacattagctgcgataaagacaacaagaggtttgcactcctcggagacttctttagaaagtcgaaggaaaagattgggaaagaattcaagcgaatcgtgcaaagaatcaaggactttttgcgcaaccttgttccccggactgaaagt

SEQ ID NO: 8336 - DNA, 510 bp, Artificial Sequence
  Description of Artificial Sequence: Synthetic coding sequence
atgaaaacccaacgcgacgggcactctctcggtcgctggagcctggttctgctgctcctagggttggtgatgccactggcaattatcgcgcaggttctaagctacaaagaggcggtgctgcgcgctatcgacggcatcaatcagcgcagcagcgacgctaatttgtaccgtttgctggatttggaccctaggccgactatggacggagaccctgatacccctaaaccagtgtcttttacggtcaaagagaccgtttgtcctcgaactacccagcaatctccagaggactgtgatttcaaaaaggacgggctggtgaaacgctgtatgggtaccgtcaccttgaaccaggcccgcggtagctttgatatttcttgcgataaggacaacaagcgctttgcgttgttgggggatttctttcgcaagagcaaggagaaaatcggaaaagaatttaaacgcattgtgcagcgaatcaaagattttctgcgcaacctcgtgccgcggaccgaatcc

SEQ ID NO: 8337 - DNA, 510 bp, Artificial Sequence
  Description of Artificial Sequence: Synthetic coding sequence
atgaagacacagcgggacggacacagcctgggcagatggtcactagtgctgctgctgctggggttggtgatgcccctcgccataattgcccaggtgctgagctacaaggaggcagtgctgcgggcgattgatggcattaaccagaggtccagtgatgctaatctgtatcgcctcttggacctggatccaagacccactatggacggggaccccgatacccctaagcctgtgtcctttactgttaaggagacagtatgcccgcggacgacacagcagtcccccgaggactgtgattttaagaaggacgggttagtgaagaggtgcatgggaacagtcacattgaatcaggccagaggtagctttgacatttcttgcgataaggataacaaaagatttgcactgttgggggacttctttaggaagtccaaggaaaagatcggtaaagagttcaagaggatagtacagcgtatcaaagacttcctgaggaatctggtccctcgaaccgagagc

SEQ ID NO: 8338 - DNA, 510 bp, Artificial Sequence
  Description of Artificial Sequence: Synthetic coding sequence
atgaaaactcagcgggatggccattcgttggggcgttggtccctcgtcctcctgcttctgggcctggtgatgcctctggcgatcatcgctcaagtgctctcgtacaaggaagccgtccttagagcaattgatggcattaatcaacggagctccgatgcgaatctctacagacttctcgaccttgacccccggcctactatggatggtgatcccgatacgccaaagccggtcagctttaccgtgaaggaaaccgtttgtcctaggaccacgcagcagagcccagaggattgcgacttcaaaaaggacggcctggtgaagcgatgtatgggtaccgtgactcttaaccaggctagaggctcgtttgacatttcatgtgacaaagacaacaaacgttttgcactgcttggggacttcttccgcaagtcaaaggagaaaataggtaaggagtttaagagaattgtgcaacgaatcaaggattttcttcgaaacttggtccccagaactgagtcc

SEQ ID NO: 8339 - DNA, 510 bp, Artificial Sequence
  Description of Artificial Sequence: Synthetic coding sequence
atgaaaactcagcgggatgggcattcactaggacggtggagtcttgttctcctattactggggctagtgatgccacttgcaataatcgcccaggtactgtcctataaagaagccgtgttaagagctattgatgggataaatcagaggtcttccgacgcaaacctttataggttacttgacctcgatcccaggcctacaatggatggggatcccgacacaccaaagcccgtgtccttcacagtgaaagaaactgtgtgtccaaggactacacagcagtctcctgaggattgcgattttaaaaaagatggactcgtgaaacggtgcatggggacggtcactctcaatcaggccagggggtccttcgatatatcgtgcgataaagataacaagagatttgcactcctcggagattttttccgcaaatccaaagagaaaataggaaaagaatttaaacggattgtgcagcgcattaaagactttctccgcaacctcgtgccccgcacagaaagt

SEQ ID NO: 8340 - DNA, 510 bp, Artificial Sequence
  Description of Artificial Sequence: Synthetic coding sequence
atgaaaacgcagcgggacggacactccctcggaaggtggtccctggtcttgctgctcctgggtctggtgatgcccctcgccatcatcgctcaggtgctgtcatacaaagaagcagtgcttcgggccatcgatggaatcaatcagcgtagctcagacgccaacctctaccggctgttggacttggacccaagacccaccatggacggagatccggatactcctaagccggtgtcgttcaccgtgaaggaaaccgtgtgcccacggacgacccagcaaagccccgaagattgcgatttcaagaaagacgggctggtgaagcgctgcatgggaaccgtgactcttaatcaggccagaggttcatttgacatctcatgcgacaaagacaacaagagattcgccttgctcggagatttcttccgcaagtctaaggaaaagataggtaaggagtttaagcgaattgttcaacggatcaaagacttcctgaggaaccttgtgccgcgcactgaatcc

SEQ ID NO: 8341 - DNA, 510 bp, Artificial Sequence
  Description of Artificial Sequence: Synthetic coding sequence
atgaagacacaacgcgatggtcattctctgggccgctggtcactggtccttttgctgctgggtctggttatgccactcgcaatcatcgcccaggtcctttcatacaaggaggctgtgctgagggctatcgatggcattaatcagcgctcatcagatgctaatctctacagactgctggaccttgacccacgcccaacaatggacggagaccccgacactcccaagcccgtttcttttacggtcaaggaaactgtctgcccaagaaccactcaacagtctcccgaagactgcgacttcaaaaaggacggtctcgtaaagcgctgtatgggcaccgttacccttaaccaggcccgcggtagcttcgacatctcttgtgataaggacaacaagagattcgccctcctgggtgacttttttcgcaaaagcaaagagaagataggaaaggagttcaaaaggattgtacagagaattaaagacttcctgagaaatttggttcccagaacagaatct

SEQ ID NO: 8342 - DNA, 510 bp, Artificial Sequence
  Description of Artificial Sequence: Synthetic coding sequence
atgaaaactcagagagacggacactcgctgggacggtggtcccttgtccttcttctcctcggacttgtcatgccgttggcgattattgcacaggtgcttagctacaaagaagccgtcttgcgtgctattgatggtattaaccagagatcatcggatgcaaacctttaccgccttctggatctggatcctaggccaactatggatggagatccagatacccccaagccagtgtcctttaccgtgaaagaaactgtgtgcccccgcactacccagcagtcaccagaagattgtgactttaagaaggacggcctcgtcaaaagatgtatgggtactgtgaccctgaaccaggcacggggttcattcgacatcagctgtgacaaggacaataagcgttttgcgctgcttggagacttttttcgcaaatcaaaggagaaaattggcaaggagtttaagaggatagtgcagaggattaaggatttcctgcgcaaccttgtcccaagaactgagtcg

SEQ ID NO: 8343 - DNA, 510 bp, Artificial Sequence
  Description of Artificial Sequence: Synthetic coding sequence
atgaaaacccagcgcgacggacactctctcggtcgctggtccctggttctgctactgctgggactggtgatgcctttagcaatcatcgcacaggtgttgagttacaaggaggctgtgctgcgagccatcgatggcatcaatcaacggtcttcagacgcaaatttgtaccgattactggacctcgatccacggcctacaatggacggagatccagacacacccaagccagtctcattcactgtcaaagagaccgtttgccctcgcacaactcagcaatcccccgaagattgtgacttcaagaaggatgggttggtgaagagatgtatggggacggtgaccttgaatcaggcccggggttcgtttgacatctcctgcgacaaggataacaagaggttcgccctgctgggagatttttttagaaagagtaaagagaaaatcggtaaggagtttaaacgtatagtgcagcgaataaaagacttcctcagaaacctggtgcctcgcaccgaatcc

SEQ ID NO: 8344 - DNA, 510 bp, Artificial Sequence
  Description of Artificial Sequence: Synthetic coding sequence
atgaagactcagagggacggacactctctagggcgatggtcactggtcctcttgctactaggcctggttatgccactcgcaattattgcccaagtgcttagttataaagaagctgtcctgagggccatagatggtataaatcagaggagctctgatgcaaatctgtatcgcttactggatctggacccgcgtccaacaatggatggtgatccagacactcctaaaccggtatcttttacagtgaaagaaacggtttgccctcgcactacccagcagtctcccgaagactgcgacttcaaaaaggatggcctggtgaaaagatgtatgggcacagtcaccttgaaccaggccagggggtcttttgatatttcctgcgataaggacaataagaggttcgccctgttgggcgatttttttagaaagtccaaagagaaaattggcaaagaattcaaaaggattgtacagcggatcaaggatttcctgagaaacctggtgccccgcaccgagagc

SEQ ID NO: 8345 - DNA, 510 bp, Artificial Sequence
  Description of Artificial Sequence: Synthetic coding sequence
atgaaaacgcagcgggacggacatagcctgggaaggtggtcgttggtgctcctgctgttggggcttgtgatgccccttgccataatcgctcaagtcctctcgtacaaggaagccgtcctccgcgccatcgatgggatcaatcaacgcagctctgacgcgaacctgtaccggctcctcgatctcgatccacgaccaactatggacggagatccggacacgccgaagccagtttcattcaccgtgaaagagactgtgtgtccccggaccactcaacaatcgccggaagattgcgacttcaagaaggacggactggtgaagcggtgcatgggaaccgtgaccctgaatcaagcgaggggttcctttgatatttcatgtgacaaggacaacaaacggttcgccctgctgggcgactttttccggaagtcgaaggagaaaatcgggaaggaattcaagagaattgtgcaacggatcaaggatttcctcagaaacctggtgcctcgcaccgaatca

SEQ ID NO: 8346 - DNA, 510 bp, Artificial Sequence
  Description of Artificial Sequence: Synthetic coding sequence
atgaagactcagagggacggtcacagtctgggccggtggtccctcgtgctgctacttcttggactggttatgcccttagcaatcattgctcaggtgctttcttacaaagaggccgtccttcgagccatcgacggcatcaaccagaggtccagtgacgccaatttatacaggctgctcgatcttgatcctaggcccaccatggacggagaccccgatacgcctaagccagtgtcattcaccgtgaaagaaaccgtgtgtccgagaacaacccaacagagccccgaagattgtgattttaagaaggatggcctggtcaaacgctgtatgggcactgtaactctgaaccaggcaaggggatcattcgatatcagttgtgataaggataataaacgctttgcattactgggtgacttttttagaaagtccaaggaaaaaataggtaaagagttcaaaagaatcgtccagcgtatcaaggacttcctacggaacctggtgccgcgtacagagtcc

SEQ ID NO: 8347 - DNA, 510 bp, Artificial Sequence
  Description of Artificial Sequence: Synthetic coding sequence
atgaaaacccagcgcgacggacacagcctgggccgctggtcactggtcctgctcctcctgggactggtgatgccactcgcgataattgcccaagtcctctcttacaaggaagcggtgctccgggccattgacgggatcaatcaacggagcagtgatgcaaatctgtaccgccttcttgacctcgaccccagaccgactatggacggcgatcctgacaccccaaaaccagtgtcgttcactgtgaaagaaaccgtgtgcccccgcacgacccaacagtccccggaggactgcgacttcaagaaggatgggttggttaaacgctgtatgggaacggtgactcttaaccaggcgagaggatctttcgatatctcctgcgacaaggacaacaagcgatttgctctgttgggtgatttctttcgtaagagcaaggagaagatcggcaaggaattcaagagaatcgtgcagaggatcaaagactttctgagaaaccttgtaccgaggactgagtcg

SEQ ID NO: 8348 - DNA, 510 bp, Artificial Sequence
  Description of Artificial Sequence: Synthetic coding sequence
atgaaaacccaacgcgacggccatagcctcggtcggtggtcattggtgctgctcctgctgggcttggtgatgccgcttgctatcatcgcacaagtgctctcgtacaaagaagcggtgctcagagcaatcgatggaatcaatcaacgctcctcagacgccaacctgtacagactgctggacctggatcctagaccgactatggacggcgatcctgacaccccgaagccggtgtcgttcaccgtgaaggaaactgtctgcccccggactacccagcagtcaccggaagattgcgatttcaagaaggatggccttgtcaagcggtgtatgggaactgttaccctgaaccaggcccgcggatccttcgatatctcgtgcgacaaggataacaagcgctttgcactgctgggggacttcttccgcaagtcaaaggagaagatcggaaaggaattcaaaagaatcgtgcagcggataaaagactttcttagaaatctcgtcccaaggactgaatcc

SEQ ID NO: 8349 - DNA, 510 bp, Artificial Sequence
  Description of Artificial Sequence: Synthetic coding sequence
atgaagacacaacgagatggtcactccctaggacgatggagcttggttttgctgctattgggtctggttatgcctcttgctattatagcccaagttctctcctacaaagaagcagtattgagagcaatcgatggtattaaccagagaagctcagatgcaaatctgtatcgactccttgacctggacccacgtccaacgatggatggcgatccagatacacctaagcctgtctcattcactgtgaaagagactgtttgcccccgtactactcagcaatcacccgaagattgtgatttcaaaaaagatggtttggtaaagagatgtatgggaaccgtcacacttaatcaggccagaggttcgttcgacattagctgcgataaagataataaacgcttcgctctgcttggtgatttttttcggaagtccaaggaaaaaatcggtaaggagttcaagagaatagtgcagcgtatcaaggatttcctccgtaatttagttcctagaacagaatct

SEQ ID NO: 8350 - DNA, 510 bp, Artificial Sequence
  Description of Artificial Sequence: Synthetic coding sequence
atgaaaactcagagggatggacactcattgggcagatggtcgcttgtcctgctcctgctgggactggtgatgccactcgcaatcatcgcccaggtcctctcgtacaaagaagcggttctgcgggcaattgatggaattaaccagcgatcctcggacgccaacctttacaggctgctcgacctcgatcccagacctactatggacggcgacccggatactccaaaaccggtgtcctttactgtgaaggaaaccgtgtgcccgcgcaccacccaacaatcacctgaggactgcgacttcaaaaaggacggactggtcaagagatgcatggggactgtgacgcttaaccaggctagaggtagcttcgacatctcctgtgataaggacaataagcggtttgccctgctcggagacttcttccgcaaaagtaaggagaagatcgggaaagaattcaagcgcatcgtgcagcgcatcaaggatttccttagaaatctcgtgccgaggaccgagagt

SEQ ID NO: 8351 - DNA, 510 bp, Artificial Sequence
  Description of Artificial Sequence: Synthetic coding sequence
atgaaaactcagagggatggacattcccttggacgttggtcactcgtcctgttgctgctcggcctggtgatgccgctggcgattattgcccaagtgctttcctacaaagaggccgtcctgcgggcgatcgatggaatcaaccaacggtcctccgacgcaaatctctaccgcctcctggaccttgacccccggcctaccatggacggggacccggatactccaaagcccgtcagtttcaccgtgaaagagactgtgtgtccacggaccactcagcagagcccagaagattgcgacttcaagaaagatggccttgtgaagcgctgcatggggaccgtcaccctgaatcaggcacggggctcctttgacatctcgtgtgacaaggacaacaaacgctttgcgctgctgggggacttcttccgcaagtcaaaggaaaagattgggaaggaattcaagagaattgttcaaagaatcaaggacttcctgcggaacctggtgccgaggaccgaatcc

SEQ ID NO: 8352 - DNA, 510 bp, Artificial Sequence
  Description of Artificial Sequence: Synthetic coding sequence
atgaaaacccagcgcgacggacattcgttgggaagatggtcgttggtcctccttcttctgggccttgtgatgccgcttgccatcatagcacaggtgcttagctacaaggaggcagtgctcagagccatcgacggaatcaaccaacgttcctcggatgcaaacctctacaggttgctcgatctggatccccgccctactatggatggcgacccggacactcccaaaccagtgagctttactgtcaaggaaaccgtgtgccctaggactacccagcaatccccagaggactgcgatttcaaaaaggatggtcttgtgaaacgttgtatgggaacggtgaccctgaatcaagcccgggggagctttgatatctcatgtgataaagataacaaaaggttcgcacttctgggagactttttccgaaaatcaaaggagaaaattggcaaggagtttaagcggattgttcaaagaattaaggattttcttcgaaacctggtcccaaggaccgaaagc

SEQ ID NO: 8353 - DNA, 510 bp, Artificial Sequence
  Description of Artificial Sequence: Synthetic coding sequence
atgaaaacgcagagagacgggcacagtctggggcggtggtcactggtgctcctcttgctcgggctggttatgcccctcgccataatcgctcaagtactgtcatacaaggaggccgtattgagggccattgatggcataaatcagcggtccagcgacgccaacctctaccgactgctggatctggacccacgaccgactatggatggagaccctgacacaccaaagccggtctcctttactgtcaaggaaacagtctgccctaggaccacgcagcaatcccccgaggactgtgatttcaagaaggacggcctggtgaagaggtgcatgggtactgttacactgaatcaggcgaggggttcctttgacatctcctgcgacaaagacaacaagcggtttgcactgctgggtgatttttttcggaagagcaaggagaaaatcggtaaggaatttaagaggattgtccagcgaataaaagacttcctcaggaacctcgtccccaggacagagagc

SEQ ID NO: 8354 - DNA, 510 bp, Artificial Sequence
  Description of Artificial Sequence: Synthetic coding sequence
atgaaaactcaacgagatggtcatagtttaggtagatggagtcttgttttattattattgggattagttatgccacttgctattattgcacaagtcttatcatataaagaagcagtactaagagcaatagatggaattaatcaaagatcatcagatgcaaatttatatagattattagatcttgatccacgtccaactatggatggagatcctgatactccaaaacctgttagttttactgtgaaagaaactgtttgtccaaggacaacacaacaatcaccagaggattgtgattttaaaaaggatggtttggtaaaaagatgtatgggtactgttactttaaatcaagctagaggatcatttgatatcagttgtgataaggataataaaagatttgctcttctaggagacttttttagaaaatcaaaggaaaaaattggaaaagaatttaagagaattgtacaaagaattaaagatttcttaagaaatcttgttccaagaacagaatca

SEQ ID NO: 8355 - DNA, 510 bp, Artificial Sequence
  Description of Artificial Sequence: Synthetic coding sequence
atgaaaacccagcgggatggacacagcttggggcgatggtcgctggtgctgctcctcctcgggctcgtgatgccactcgcgattatcgcgcaggtgctgagctacaaggaggccgtcctgagggcgattgacggaatcaaccagcggagttctgacgccaatctttacagactgctcgacctggatccacgacccaccatggatggcgaccctgacaccccgaagccggtgtcatttacggtgaaagagacggtctgtccacgcactacccagcagtcgccggaagattgcgacttcaagaaggacggactcgtcaagagatgcatggggactgtcaccctgaaccaagcccgcggatcgtttgatatctcttgtgataaagacaacaaacggtttgccttgctgggagacttcttccggaaatcaaaggagaagatcggaaaagaattcaaacgcatcgtgcaacggatcaaggatttcttgagaaatttggtgccgaggactgaatcg

SEQ ID NO: 8356 - DNA, 510 bp, Artificial Sequence
  Description of Artificial Sequence: Synthetic coding sequence
atgaaaacgcagcgcgacggacactcacttggccgctggtccctggtgctgctgctgcttggtttggtgatgccacttgcgattatcgcccaggtgctcagctataaggaggccgtcttgagagctattgacggcatcaaccagagatcatcggacgctaacctgtaccggctgctggatctggacccgcgcccaaccatggatggtgacccggatacgccgaagcctgtctctttcaccgtgaaggagacggtttgcccgcggactacccagcagtccccagaggactgcgacttcaagaaggatggattggtgaagcgttgtatgggcactgtgaccctgaatcaagcgcggggctcgtttgatatctcctgtgataaagacaataagaggttcgcactcctcggtgacttctttcggaaaagcaaggagaagatcggcaaggaattcaaaagaatcgtccagcggattaaagacttcctgcggaacctggtgccgcgcaccgagtcc

SEQ ID NO: 8357 - DNA, 510 bp, Artificial Sequence; identical to SEQ ID NO: 8346
  Description of Artificial Sequence: Synthetic coding sequence

SEQ ID NO: 8358 - DNA, 510 bp, Artificial Sequence
  Description of Artificial Sequence: Synthetic coding sequence
atgaaaacccagcgcgacgggcactcactgggccgttggtctctggtcctgctgctgctggggctcgtgatgccgctggcaatcatagcccaagtcctgtcatataaggaagctgtactgcgggcaatcgatggcattaaccagcgctcctcggatgctaacttgtacaggctactggatttagaccctaggcctaccatggatggcgatcctgatacaccaaaaccggtgagctttacggtgaaggaaacagtgtgccccagaacaactcaacagagtccagaagactgcgacttcaaaaaagatgggctcgtgaaaaggtgcatgggcacagtgacgctgaatcaagcccgtgggtcatttgacatttcctgtgataaagacaacaaacgcttcgcgttgctcggagatttctttcggaagtcaaaggagaagatcggtaaagagttcaagcgcatcgtgcaacgaatcaaagattttttacgtaacttggtgcctaggactgagagc

SEQ ID NO: 8359 - DNA, 510 bp, Artificial Sequence
  Description of Artificial Sequence: Synthetic coding sequence
atgaagactcagagggacggccactcactgggtcgctggtccctggtgctgctgctcctcggcctggtaatgcctctggccatcatcgcacaagttctaagctacaaggaggcagttttgagagcaatcgatgggatcaaccagaggagctcagacgctaatttatacagactgctcgaccttgacccgcggcccaccatggatggcgacccagatacaccgaaaccggtgtcattcacagtgaaggaaaccgtgtgccctcggaccacccaacagtctcccgaagattgtgattttaagaaggatgggctggttaaacggtgcatgggtacggttacactgaaccaggctcgggggtcctttgatattagctgcgataaagataacaagcgctttgctttactgggggacttcttccgcaagtcaaaggagaaaatcggcaaggagttcaaacgaatcgtccagcggatcaaagactttctcaggaatctggtgccaaggacggaatct

SEQ ID NO: 8360 - DNA, 510 bp, Artificial Sequence
  Description of Artificial Sequence: Synthetic coding sequence
atgaagacccagcgggacggtcactcgctgggacgctggtcacttgtcctgctccttctgggtctggttatgcccctggctatcatcgcacaagtgctgagttacaaagaggccgttctccgtgcgatcgatggtatcaatcaaaggtcgagtgatgcgaatctctaccgattgctcgatcttgacccacgtccgacgatggatggcgaccccgatacgcccaagccagtttccttcacggtgaaggagactgtttgcccacgtactacacagcagagcccggaggattgtgacttcaagaaggatggtttggtgaagcgctgcatggggactgtgaccttaaaccaagcacgagggagctttgatatttcctgcgataaagataataaacgatttgccctgttgggagatttcttccgcaagtccaaagagaagataggcaaagagtttaagcgcattgttcagcgtatcaaggattttctcaggaacctggtccctagaacagagagt

SEQ ID NO: 8361 - DNA, 510 bp, Artificial Sequence
  Description of Artificial Sequence: Synthetic coding sequence
atgaaaacccaacgtgacggacattcccttggtcgttggagccttgtgcttctcttgcttgggctcgtgatgccccttgctattatcgcgcaagtgctttcgtacaaggaggcagtgctgagagctattgatgggattaatcagcggtcgtccgatgcaaatctgtaccggctgcttgatctggaccctagaccaactatggacggtgaccctgataccccaaagcccgtttcctttaccgtcaaggaaaccgtgtgtcccagaactactcaacaaagccctgaggattgtgacttcaagaaggatggccttgtgaagagatgtatgggaacggtgacgcttaaccaagcacgcggttcatttgacattagctgcgataaggataacaagcggttcgcacttctcggagatttcttccgcaaatcaaaggaaaagattggaaaggagtttaagcgaattgttcagcgcataaaagattttctccgtaaccttgttccacggaccgaatcc

SEQ ID NO: 8362 - DNA, 510 bp, Artificial Sequence
  Description of Artificial Sequence: Synthetic coding sequence
atgaagacacaacgtgacgggcactcgcttggtcgatggtctttggtcctgctcttgctcgggttggtaatgccccttgctatcatcgctcaggttctgagctacaaggaagctgttttacgggcgatcgatgggattaatcaacgctctagcgacgcaaatctctacagattgttggatcttgatccgcgtccgaccatggacggtgatcccgacactccgaagcccgtgtccttcactgtgaaagagaccgtgtgccctcgaaccacccagcaaagcccagaggattgcgatttcaagaaggatgggctggttaagaggtgtatgggaacggtaacattaaaccaagccagaggctcgtttgatatatcgtgtgacaaggataacaaaaggttcgcgttgctcggcgacttctttcgaaagagtaaagagaagattggcaaggaatttaagcgcatcgtgcagaggatcaaggattttttgcgtaatctggtcccacgaaccgagagt

SEQ ID NO: 8363 - DNA, 510 bp, Artificial Sequence
  Description of Artificial Sequence: Synthetic coding sequence
atgaaaacgcagcgtgacgggcactccttaggtcggtggagtctggttctgctactgctgggccttgtgatgcccttagccatcatcgcccaggtactgtcctacaaggaagcggtgctcagagctattgacggtattaatcagaggagctctgatgctaacctctatcgactgctcgatttggaccctagaccaaccatggatggtgatcccgacactcctaaacctgtatctttcacagtaaaagaaacagtgtgcccccgtacgacgcagcagagccccgaggattgtgattttaaaaaagatggacttgttaagcgttgcatgggcacggtgacactaaatcaggctcgcggttcctttgacatatcttgcgacaaagataataaaaggttcgccctgctcggagatttcttccggaagtccaaggaaaaaattggaaaggagtttaaacgcatcgtccagcgaattaaggattttttacgcaacctggtgccaagaacagaaagt

SEQ ID NO: 8364 - DNA, 510 bp, Artificial Sequence
  Description of Artificial Sequence: Synthetic coding sequence
atgaagacacagagggacggccattcgctcggacggtggtccttggtactgttattgctggggctcgttatgccccttgccatcatcgctcaggtcctcagttacaaagaggccgtgctgagagcaattgacggtataaatcagcgctctagcgatgctaatctgtatcggctcctcgatttggatcctaggcctactatggacggtgatcctgatacgcccaaacccgtttcttttactgttaaagaaactgtatgtccgcggactacgcaacagtctcctgaggactgtgactttaagaaggatgggcttgtcaaacggtgcatgggcaccgtcaccctcaatcaggcccgcggctcatttgatataagctgcgacaaggataacaaacgcttcgctctactgggggattttttcaggaaatccaaggagaaaatcggcaaagagttcaagcgaatagtgcagaggatcaaagactttctgaggaatctcgtgccccgcacagaatct

SEQ ID NO: 8365 - DNA, 510 bp, Artificial Sequence
  Description of Artificial Sequence: Synthetic coding sequence
atgaaaacccagagagacggtcatagtttggggcgttggtcactggttcttctgctactgggtctcgtgatgccacttgctattattgcacaggtgctttcatacaaggaggccgtgctgagggccatcgatggcataaatcaacggtccagtgatgccaacctgtatcgcctgctggacctggacccacggcccactatggatggcgaccctgatacccctaagcccgtgagtttcaccgtcaaggaaacagtatgcccacgtacaacacaacaatcaccagaagactgtgatttcaagaaagatggcttagtgaaacggtgcatggggacagtgaccctgaatcaagcacgcgggtccttcgacattagctgcgataaagacaacaaacggtttgccttgttaggcgacttttttcggaagagtaaggaaaaaatcggaaaagagtttaagcgaattgtgcagcgtatcaaggacttccttcggaatctggtgcccaggacagagtcc

SEQ ID NO: 8366 - DNA, 510 bp, Artificial Sequence
  Description of Artificial Sequence: Synthetic coding sequence
atgaaaacacagcgcgatggtcacagcctgggcaggtggtctttggttcttttgctgctcggactggtcatgcccctagcaattatcgcacaggtcctgtcgtacaaagaagccgtcctgcgggcgatcgatggaatcaaccagcgcagttctgacgcaaatctgtacagactcctggacctcgaccctagacctacaatggatggagatcctgacactcctaaacctgttagttttaccgtgaaggagaccgtgtgtcctaggaccacccagcagtcacccgaggattgtgattttaagaaagatggtctggtgaagcggtgtatgggaacagtgacacttaatcaggccagaggctcttttgatatttcgtgtgataaagacaacaaaaggttcgcactgctcggagacttcttccggaaatctaaagaaaagattgggaaggagtttaaacgcattgtacaaagaatcaaggattttctcagaaacttggtcccgcggacagagtcc

SEQ ID NO: 8367 - DNA, 510 bp, Artificial Sequence
  Description of Artificial Sequence: Synthetic coding sequence
atgaaaacacagagagacgggcacagcttgggccgttggagcctagttttgctgctgttgggactggtgatgcccctcgccattatagcacaggtgctttcctacaaggaagcggtgctgcgtgcgatagatgggattaatcagcgcagctcggatgccaacttgtacagacttctcgatctggatcctaggcctactatggacggtgaccccgacactcccaagcccgtaagttttaccgtcaaagagaccgtctgccccagaacaacccagcagagccctgaggattgtgatttcaagaaggacggcctggtgaagcgctgcatgggcaccgtgactttgaatcaggcaaggggcagctttgatataagctgtgacaaagacaacaagaggttcgctctcctcggtgatttcttcagaaaaagcaaagagaagattggcaaagaatttaagcggatcgtgcagagaatcaaggattttcttaggaatctagtccccaggactgagagt

SEQ ID NO: 8368 - DNA, 510 bp, Artificial Sequence
  Description of Artificial Sequence: Synthetic coding sequence
atgaaaacccagcgggacggacattccctcggccgctggagcttggtcctgctgctgctcggtttggtgatgccgctggccatcatcgcccaagtgctgagctacaaggaggcagttctccgggctatcgacggaatcaaccaacggtcatccgacgcgaatctctaccgcctcctggacctcgatccccgccctactatggacggagatcccgacactccgaagcccgtctcgttcaccgtgaaggaaaccgtgtgccctcggactacccaacagtcaccagaagattgtgactttaagaaggacggcctcgtgaaacgctgtatggggactgtgactctgaatcaagccaggggatcgttcgacatctcatgcgacaaggataacaagcgcttcgccctgctgggcgactttttccgcaaatcaaaggagaagatcggcaaggaattcaagcgcattgtccagagaatcaaggattttcttaggaacttggtgccgagaactgagagc

SEQ ID NO: 8369 - DNA, 510 bp, Artificial Sequence
  Description of Artificial Sequence: Synthetic coding sequence
atgaaaacgcagagggacgggcactcccttggacggtggagcctggtactgctgctgctcgggttggtcatgcccctagctataatcgcacaggtcctgtcttacaaagaggccgtcttacgggccatcgacggcattaaccaaaggtccagcgacgccaacctttatcggctgctagacttggacccccgaccaacaatggatggcgaccccgacactccgaagcccgtgtctttcactgtgaaggagacggtttgccctaggacgacccagcagagccctgaggactgtgattttaaaaaggatggcttggtgaagaggtgtatgggcacagttaccctgaatcaggcccgcggatcatttgatatatcctgtgacaaggacaacaagcgatttgcgttgttgggagactttttcagaaagtccaaggaaaaaattggcaaagaatttaagcgcatcgtacagagaattaaggacttcctgagaaacttagtgccacggacagagagt

SEQ ID NO: 8370 - DNA, 510 bp, Artificial Sequence
  Description of Artificial Sequence: Synthetic coding sequence
atgaaaacgcagagggatgggcactcgcttggaaggtggagcctggtgctccttctgctcggactcgtcatgccattggccatcattgcacaagtgctctcatacaaggaagcagtgctgagggcaattgatgggatcaatcaaaggtcatcggatgcaaacctgtacagacttctggaccttgacccacgccccaccatggatggtgacccagataccccgaagccggtgtcatttaccgttaaggaaaccgtgtgtcctcgtaccactcaacaatccccagaagattgcgatttcaagaaggatggcctggtgaagcgctgtatgggtacggtgaccttgaaccaggcaaggggatcatttgatattagctgtgataaagataacaagagattcgcacttctcggagactttttccgaaagtcaaaggagaaaataggaaaggaattcaaacggatcgtccaacgcataaaagacttccttcgcaacctcgtgcccagaaccgagagc

SEQ ID NO: 8371 - DNA, 510 bp, Artificial Sequence
  Description of Artificial Sequence: Synthetic coding sequence
atgaagacccagcgggacggacatagtctgggacggtggtctctggtacttctgcttctaggcttggtcatgcctctggccatcattgcgcaagtgctctcatacaaagaagcagtgctgcgggcaatcgatgggatcaatcaacgttcctctgatgccaatctctatcgattgctggacttggatcctcgtcctaccatggatggagaccccgatacccccaagcccgtgtcatttaccgtgaaagaaaccgtatgcccacgaacaacacagcagagtccagaggattgcgacttcaagaaagatggtttggtgaagagatgcatgggcaccgtgacattgaatcaggcccgcggcagcttcgatatctcttgcgacaaggataacaaacgctttgctctgctcggcgacttcttccgaaagtccaaggagaaaataggcaaggagtttaagaggatcgtgcagaggattaaggattttctcaggaacctggtgcccaggacagaatcc

SEQ ID NO: 8372 - DNA, 510 bp, Artificial Sequence
  Description of Artificial Sequence: Synthetic coding sequence
atgaaaacccagcgggacggacactcactcggacgctggtcactggtcttgctgctgcttgggctggtgatgcctctggctattatcgcccaggtcctgagctacaaggaagcggtgctgcgcgctatcgatggaatcaatcagcgcagctcggatgcgaatctctaccgcctccttgacctcgacccgaggccgaccatggacggtgacccggacaccccgaaacccgtatccttcaccgttaaggaaactgtgtgcccaagaaccactcaacaatcacctgaggactgcgacttcaagaaagacggactcgtcaagcgctgcatgggcactgtgactctgaaccaagcacgcggttcgttcgacatctcatgtgacaaggacaacaagaggtttgccctgctgggggactttttcaggaagtccaaggagaaaatcggaaaagaattcaagcgcatcgtccagaggattaaagatttcttgaggaaccttgtgccacgcaccgagtcg

SEQ ID NO: 8373 - DNA, 510 bp, Artificial Sequence
  Description of Artificial Sequence: Synthetic coding sequence
atgaaaacgcaaagagatggccactcgctgggtagatggtcgctggtcctcctgttgctgggactggtcatgccgctcgccataattgcacaggttctctcatacaaggaagccgtgctgagggccattgatggcattaaccaacgctcgtccgatgctaatctttacagattgctggatcttgacccacgccctaccatggacggggatccagatacccctaagcctgtgtcatttactgtcaaggaaactgtgtgtccgcgaacgactcaacagtccccagaagattgcgatttcaagaaggatggacttgtgaagcggtgtatgggaaccgtgactctgaaccaagccagaggttcgttcgacatttcgtgcgataaggacaataagaggtttgcactgctgggagacttttttcgtaagtccaaggaaaagattggtaaggagtttaaacgcattgtgcaacgcatcaaagactttttgcgaaacctggtgccacgcaccgaatcg

SEQ ID NO: 8374 - DNA, 510 bp, Artificial Sequence
  Description of Artificial Sequence: Synthetic coding sequence
atgaagacacagagggacggtcactccctagggagatggtccctcgttttgctgctcttgggacttgtaatgccgcttgcaatcattgcccaagtcctgagctataaggaagctgtgttaagggcgatcgacgggatcaaccagcgctcctctgacgctaatctgtaccggctgctcgacctggatccacgtccaaccatggatggagacccagacacgcccaagcccgtatccttcactgttaaagagacagtgtgtcctaggaccacgcagcagagccctgaagactgcgatttcaaaaaggatggactggtaaagcggtgtatgggcaccgtaacactgaaccaagccagggggagtttcgacatttcatgtgataaggacaacaagcggtttgcactgctaggagacttctttagaaaatctaaggaaaagataggcaaagagttcaaacggatcgtgcaaaggattaaggacttcctgcgcaacctggtgccgcggaccgagagc

SEQ ID NO: 8375 - DNA, 510 bp, Artificial Sequence
  Description of Artificial Sequence: Synthetic coding sequence
atgaaaacccagcgggatgggcattcccttggaagatggagcctggtgctgctgcttctcggactcgttatgccgctcgcaattatcgcccaagtgttgagttacaaggaagctgtacttagggccattgacggcataaatcaacggagctcggatgccaacctttaccgtctcctcgatcttgatcctaggcctactatggacggtgatccagataccccaaagcctgtctcattcaccgtcaaagaaaccgtgtgtccaaggacgacccagcagagcccggaggattgtgacttcaaaaaagacggacttgtcaagcgttgtatgggaaccgtgactctcaaccaggcaagaggctcctttgatatctcgtgtgacaaggataacaagagatttgcccttctgggagatttctttcggaagtcgaaggagaagataggtaaggagtttaagcggatcgtgcaacgtattaaggatttccttagaaacctggtgccccgcactgaatcg

SEQ ID NO: 8376 - DNA, 510 bp, Artificial Sequence
  Description of Artificial Sequence: Synthetic coding sequence
atgaaaacccagcgcgatggacattcactgggacgttggtcccttgtgttgttgcttttgggccttgtcatgccgctcgcgattatcgcacaagtgctgtcatacaaggaagcagtcctgcgggccattgacggaattaaccagagatcctccgacgctaatctgtataggctgctcgatctcgatccacgccccactatggatggggaccctgatacgccaaagcccgtgagctttaccgtgaaggagactgtgtgccccagaaccactcagcaatcgcctgaggattgtgatttcaaaaaggacggtctggtcaaacggtgtatgggaactgtgactcttaaccaggcgcgcggttcgtttgacatcagctgcgacaaggataacaagagatttgcattgctgggagactttttcaggaagagcaaagaaaagattggaaaagagtttaagcgtatcgtgcagcgcattaaggattttctgaggaaccttgtgcctaggaccgaaagc

SEQ ID NO: 8377 - DNA, 510 bp, Artificial Sequence
  Description of Artificial Sequence: Synthetic coding sequence
atgaagacccagcgcgacggtcattcactcggccggtggtctctggtactactgctgttaggccttgtgatgcctctggccattatcgcccaggttttgtcctataaggaagccgtcctacgcgccatcgacgggataaaccaacgcagctccgacgctaatctttatcgtctgctcgatttggaccctaggcccaccatggacggggaccctgatactcccaagcccgtaagttttaccgtgaaggaaaccgtgtgcccgaggactacccagcagtcccctgaagattgcgacttcaagaaggacggcctggtgaaaagatgcatgggcactgtgaccctcaaccaggctagagggagtttcgatatctcttgtgacaaggataacaaacgctttgccttgttaggtgactttttccgcaagtcgaaagaaaaaatcggcaaggaatttaaacggatagtgcagagaatcaaagacttcctgcgcaatctcgtcccaagaacagaaagt

SEQ ID NO: 8378 - DNA, 510 bp, Artificial Sequence
  Description of Artificial Sequence: Synthetic coding sequence
atgaaaactcagagagacggccattcactgggacgctggtcgctggtgctcctcctcctgggccttgtgatgcctctcgccatcatcgctcaggtcctgagctacaaagaagcagtcttgcgcgccatcgatggaatcaaccaaagatcctctgacgctaacttgtaccgcctgctggatctggatccacgcccgactatggacggagatccggacacgcccaagccggtttcgttcactgtgaaggaaaccgtgtgccctcggaccactcaacaaagcccagaggactgcgacttcaagaaagatggactcgtgaagaggtgtatgggaaccgtgaccctcaaccaagcccgcgggagcttcgatatcagctgcgataaagacaacaagaggttcgcactcctcggggacttctttcggaagtcgaaggaaaagatcggaaaggagttcaaacgcatcgtgcaaagaatcaaagactttctgagaaatctggtgccaagaaccgaatca

SEQ ID NO: 8379 - DNA, 510 bp, Artificial Sequence
  Description of Artificial Sequence: Synthetic coding sequence
atgaaaacccaacgggacggccatagcttgggtcgctggtcacttgtgctgctcctgcttggcctcgtcatgcctctcgccatcattgcccaggtgttgtcgtacaaggaggccgtgctgcgcgccatcgatggaatcaatcaacgctcgtccgacgctaatctctacagactcctcgacctggatcctcgcccaaccatggatggggacccagacactcctaaaccggtgtcgttcaccgtgaaagagacggtctgcccacgcaccacccaacagtcgccggaggactgcgatttcaaaaaagacggacttgtgaagaggtgcatgggtaccgtgacgctgaaccaggcacgcggatcattcgacatttcatgtgataaagacaataagcgcttcgccctgttgggagatttcttcagaaagagcaaggagaagatcggcaaggagtttaagaggatcgtgcaacgcatcaaggatttcctgcggaacctggtcccgagaactgagtcc

SEQ ID NO: 8380 - DNA, 510 bp, Artificial Sequence
  Description of Artificial Sequence: Synthetic coding sequence
atgaagacccagagagacggccatagtctcggcagatggtctctcgtgctcttactcctagggctcgtgatgcccctggctatcattgctcaagttctgagctacaaagaagcagtgctgagggccatagacggaatcaaccagaggtcaagcgacgctaatctgtaccgcttgttagaccttgatcccaggccgacaatggacggagatccagatacccccaagccggtgagctttacagtcaaggaaactgtgtgcccaaggacaactcaacagtcccccgaagactgcgactttaaaaaagatggactggtgaagagatgcatgggaaccgtaacgctgaaccaagctaggggatctttcgatatcagctgcgacaaagataacaagagatttgccctgcttggcgattttttccggaagagcaaggagaagatcggcaaggagttcaaacgcatcgtgcagagaattaaggacttccttagaaaccttgtaccgcgcaccgaaagt

SEQ ID NO: 8381 - DNA, 510 bp, Artificial Sequence
  Description of Artificial Sequence: Synthetic coding sequence
atgaaaacccagagagacggtcatagcctgggccgttggtcacttgtactcctcctcctggggctggtaatgcctctggccatcattgcccaagtgctgagctataaggaagcagtgctgagagccattgatgggattaaccagcggtccagcgatgccaacttgtaccgcctacttgatttggaccccagacctacgatggacggggaccctgacacccccaagccagttagctttacagtgaaagaaaccgtctgtccgaggacaacacaacaaagcccagaggactgcgacttcaagaaggacgggctcgtgaagcgatgcatgggtacagtcacacttaaccaagctcggggtagcttcgatatctcctgcgacaaagacaataagcggttcgccctgctgggcgacttctttagaaagagtaaggagaagattggcaaggaatttaagagaatcgtgcagcgtatcaaggactttctgcgaaatcttgtgccaaggaccgagagc

SEQ ID NO: 8382 - DNA, 510 bp, Artificial Sequence
  Description of Artificial Sequence: Synthetic coding sequence
atgaaaacccagcgggacggtcacagtctcggacgctggagcctggtgctgctccttcttggcctggtaatgccgctcgcaataatcgcgcaggtgctttcatacaaggaagccgtgctgagagcgatcgacggaatcaatcagcggtcatcggatgcaaacctgtaccgcttgctcgacctggacccacggccaaccatggatggtgacccggatactccgaagccagtgtcattcaccgtgaaggaaaccgtgtgccctcgcaccactcagcaatccccggaggactgcgacttcaagaaggatggattggtgaaacgatgcatgggaacggtcaccctgaaccaggccaggggctccttcgatatctcctgcgataaggacaacaaacggttcgccctgttgggggacttctttcggaaatccaaagagaagatcggaaaggagtttaagcggatcgtgcagcggatcaaggacttcctgcggaatttggtccctcgcactgagtcc

SEQ ID NO: 8383 - DNA, 510 bp, Artificial Sequence
  Description of Artificial Sequence: Synthetic coding sequence
atgaagacccagagggacggacacagtcttggcaggtggagcttggttctgctgttgctcgggctggtaatgcctctggccatcatagctcaggttctgtcctacaaagaggcagtgctccgggccattgacggtataaaccagaggtccagcgacgccaatctgtatcgactcctggaccttgacccaaggcctacaatggatggtgaccccgatacccctaagccggtgtcctttactgtgaaagagaccgtgtgccctcgcactacccagcagtctcctgaggactgcgattttaagaaggatggcctggtgaaacggtgtatgggcaccgtgaccctcaaccaggcccgcggcagcttcgatatttcttgcgataaggacaataaaagattcgcactcctcggcgatttctttcgcaagagtaaggagaaaatagggaaggagtttaaaagaattgtgcaacggatcaaagactttctcagaaatctcgtgccacgcacagaatcc

SEQ ID NO: 8384 - DNA, 510 bp, Artificial Sequence
  Description of Artificial Sequence: Synthetic coding sequence
atgaaaacgcagcgcgacggtcacagcctgggccgttggtcccttgtgcttctcctcctcggtttggtgatgcctctggcgatcatagcacaagtgctgtcttacaaagaagccgttctgcgggccattgacggcattaatcagcggtcgtccgatgccaacctttataggctgcttgaccttgatcctagacctactatggatggtgaccctgatactcccaagccagtctcatttaccgtgaaggaaactgtgtgtccgcggactactcagcagtcgcccgaagattgcgatttcaagaaagatggtcttgtgaagcgttgcatgggtaccgtcaccctgaaccaagcgaggggtagcttcgatatttcatgtgataaggacaataagagattcgccctcctgggcgactttttcagaaagtcaaaggaaaagatcggaaaagagtttaagagaattgtgcagcgcatcaaggattttcttcggaatctggtccccaggactgaaagc

SEQ ID NO: 8385 - DNA, 510 bp, Artificial Sequence
  Description of Artificial Sequence: Synthetic coding sequence
atgaagacccagagggatggacacagtctgggacggtggagcctcgtgcttctgttactgggcctcgtcatgccgttggcgataatcgctcaagtactttcatataaggaagccgtcctcagagctatcgatggaatcaaccagcggtcatccgacgctaacttatatcgcctgttggatctggacccccgcccaactatggatggggaccctgatactcccaagccggttagtttcaccgtcaaagagacggtgtgtcctaggaccacgcagcagtctccggaggattgcgacttcaaaaaggatggtcttgtcaagaggtgtatggggaccgtgacgctgaaccaagcacgcggctctttcgatatatcatgtgataaggacaacaaacgctttgctcttctgggcgatttttttcgtaagagcaaggagaaaattgggaaggaattcaagcgtattgtccaaagaataaaagacttccttaggaacctggtccctagaacggaaagc

SEQ ID NO: 8386 - DNA, 510 bp, Artificial Sequence
  Description of Artificial Sequence: Synthetic coding sequence
atgaagacacaacgtgatggccattcacttggaaggtggtcccttgtcttattgttacttggccttgtaatgcccttagcaattatcgctcaagtattgtcttacaaggaggctgtgctacgagctatcgatgggatcaatcaaagaagttcagatgctaatctttaccggctcctcgatttggatcctcgtcccacgatggacggagatccagacacgccgaaaccagtatctttcactgtgaaagagactgtttgtccacgaacaacacagcagagcccagaggactgtgattttaaaaaagatggactcgtaaaaagatgtatgggaacagtaacactgaatcaagcgaggggatcgttcgatatttcatgcgacaaagacaataagcgatttgccctgcttggagactttttcagaaagagcaaagaaaagattggaaaggaattcaagagaattgttcaacgcataaaagactttttaaggaatttggttccacgaactgagtcc

SEQ ID NO: 8387 - DNA, 510 bp, Artificial Sequence
  Description of Artificial Sequence: Synthetic coding sequence
atgaaaacccaacgtgatggtcattccctggggaggtggtccctggtcctgctgctgttgggattggtgatgcctcttgcaattatcgcacaggtcctttcttacaaagaggcagtccttcgagcgattgacggaatcaaccaacggtcgagcgatgcaaacctttataggctgctcgatcttgatcctagacccaccatggacggggaccccgataccccaaagcctgtgtcatttaccgtgaaggaaaccgtctgtccaaggactacgcaacagtcgcctgaggactgcgatttcaagaaggatggtctggtgaagaggtgtatgggcaccgtgactcttaaccaagcccggggttcgtttgacatatcgtgcgacaaggacaataaacgattcgcgctgttgggcgactttttccgcaagtccaaggaaaagattggaaaagaattcaagcggattgtgcaaaggattaaggattttcttagaaatcttgtgccacgtaccgaatcg

SEQ ID NO: 8388 - DNA, 510 bp, Artificial Sequence
  Description of Artificial Sequence: Synthetic coding sequence
atgaaaacccagagagacggacattcgctgggcagatggtcactggtccttctccttcttggacttgtgatgcctcttgcaatcatcgcccaggtgctgtcttacaaggaagcagtgcttagagccatcgatggtatcaatcagagatcatcggacgcaaacctttaccggctgttggacctcgatcctcggccgactatggacggcgatcctgatactcctaaaccagtctcattcacggttaaagaaacggtgtgtccacggactacccaacaatcccctgaggactgtgatttcaagaaagatggtctggtcaagcggtgcatgggaactgttactctgaaccaagctagaggatcgtttgatattagctgcgataaggataacaagagattcgcccttctgggtgatttctttcgcaagtcaaaagaaaagataggtaaagagtttaagcgaattgtgcagcgtatcaaggactttcttagaaatctggtccctagaaccgaaagc

SEQ ID NO: 8389 - DNA, 510 bp, Artificial Sequence
  Description of Artificial Sequence: Synthetic coding sequence
atgaaaactcagcgtgatggacacagcctgggacgctggtcgctggtgctgctcctcctgggactggtgatgccgctcgcgatcatcgctcaggtcctgagctacaaggaggcagtcctgagagccattgacggcatcaatcaaagatccagcgatgccaacttgtacaggctcctggatctcgaccccaggcctacgatggacggggacccggacaccccgaagcctgtgtcgttcactgtgaaggaaactgtgtgcccacgcaccacccagcagtccccagaggactgcgattttaagaaggatggattggtgaagcgctgcatgggcaccgtgaccttgaaccaagcccgaggttccttcgacatctcatgtgacaaagacaacaagcggttcgcgctgctgggcgacttctttcggaaatcaaaagaaaagatcggaaaggaattcaaacgcattgtccaaagaatcaaggatttccttcggaatcttgttccgcggactgagtcg

SEQ ID NO: 8390 - DNA, 510 bp, Artificial Sequence
  Description of Artificial Sequence: Synthetic coding sequence
atgaaaacccaaagggacggacactcgcttggtcggtggagcctggtcctgttgctgctcgggctggtcatgccactggccattatagcgcaggtgctgtcctacaaagaggctgtgctccgggcaatcgatggtatcaatcaaaggtcctcggacgccaatctctaccgactccttgatctcgatccgcgcccaaccatggacggcgacccggacaccccgaagccagtctcgttcaccgtcaaggaaaccgtctgcccacgcacgactcagcagtcccccgaggattgcgacttcaaaaaggatggacttgtgaaacggtgtatggggaccgtaactctcaatcaggccagaggcagctttgatatctcatgcgataaagacaataagcgtttcgctctgttgggagattttttccgtaagagcaaggagaagatcggcaaggaattcaagagaattgtgcaacggatcaaggacttcctgcggaacttggtgcctcgcactgaatct

SEQ ID NO: 8391 - DNA, 510 bp, Artificial Sequence
  Description of Artificial Sequence: Synthetic coding sequence
atgaaaacgcagcgcgacggtcactccttgggacggtggtcactggtgctgctcttgctgggccttgtgatgcccctggccatcatcgcacaagtcctttcgtacaaagaagccgtccttcgggcgatcgacggtatcaatcagcggagctcagacgcaaatctgtaccgccttctcgatctcgatccaaggccgactatggacggagatccagatactccgaaacctgtgtcattcaccgtgaaggaaaccgtgtgcccaagaacgacccagcagtcccctgaggactgtgacttcaagaaggatggactggtaaagaggtgcatgggcacggtgactctgaaccaggctcgtggatcgtttgacatctcatgcgataaggacaacaagagattcgccctgctcggggacttctttcgaaagtcaaaggaaaagataggaaaagagttcaaacggatcgttcaaagaatcaaagacttcctgaggaacctcgtgcctcggaccgaatct

SEQ ID NO: 8392 - DNA, 510 bp, Artificial Sequence
  Description of Artificial Sequence: Synthetic coding sequence
atgaagacacagagggatgggcattccctcgggcgatggtctttagtcttgcttctcctcgggttggtcatgcctcttgcaatcatcgcgcaggtgttgtcatataaggaagcagtcctccgggccatagatggaatcaatcagcgctccagtgacgcgaacctgtaccgcctgcttgatctcgatccaaggcctaccatggacggggaccccgatacacctaaacctgtctctttcacagtgaaggagacagtgtgtccaagaactacacagcagagtccagaggattgcgattttaagaaagatggcctagtgaaacggtgtatgggcaccgtgacactgaaccaggcaagaggcagtttcgatatctcctgcgacaaagacaataagcgctttgcccttctgggggacttcttcaggaagtccaaggagaagattggaaaggaattcaagaggatagtgcaacggattaaggatttcctgcggaacttagtcccaaggactgagagc

SEQ ID NO: 8393 - DNA, 510 bp, Artificial Sequence
  Description of Artificial Sequence: Synthetic coding sequence
atgaaaacccagcgcgatggacactcgttgggacggtggtccctggtgcttctgctgctcggactggtgatgccacttgctattatcgcacaggtcctgtcgtacaaggaagccgtgctgagagcgatcgacggaatcaaccaaaggagctcagacgccaacctctatcggctcctggatctggaccctcgtcctaccatggatggagatcccgacactccgaaaccagtctccttcaccgtgaaggaaaccgtgtgtccgcgaacgactcaacaatcgccggaggactgcgacttcaaaaaagacggcctggtgaagcggtgcatgggaaccgtcactctgaatcaagcgagaggatcctttgacatctcgtgcgataaagataacaaacggttcgcgctcctcggagatttcttccggaagtcaaaggagaaaattggtaaggaattcaagcgcatcgtccaacggatcaaggattttctgcgcaacctggtgccgcgcaccgaatcg

SEQ ID NO: 8394 - DNA, 510 bp, Artificial Sequence
  Description of Artificial Sequence: Synthetic coding sequence
atgaagacccagcgggacggacattcactgggacggtggtccctggtgctgctccttttgggtctcgtgatgccacttgccatcattgcacaggtgcttagctataaagaggcggtcctgagggccatcgatggcataaaccagcggtcctccgacgccaacctgtatagactgctggatttggatccgcgacccactatggacggcgaccccgacactccaaagcctgtgtctttcactgtaaaagagaccgtgtgcccacggacaacgcagcagtcacctgaggattgcgacttcaagaaagatggactcgtgaagcggtgcatgggtaccgtgacactgaatcaggctcgaggtagtttcgatatcagttgtgataaggataataaaaggttcgctctgctgggggacttcttcaggaaaagtaaagagaaaattggcaaggagttcaagcggatcgttcagcgaatcaaggattttctcaggaatcttgtgcctagaactgagtcc

SEQ ID NO: 8395 - DNA, 510 bp, Artificial Sequence
  Description of Artificial Sequence: Synthetic coding sequence
atgaaaacgcaacgtgatgggcacagcctcggcaggtggagcctggtgctcctcctactagggctggtcatgcctcttgcaattatcgcccaggtcctcagctataaagaggctgtcctcagggcaatcgacgggatcaaccagcgaagcagtgatgcgaacttgtaccgactgctcgacttggacccgaggccaaccatggacggtgaccccgatactcctaagcccgtctcatttaccgttaaggaaactgtgtgcccacgcaccacacaacagtcacccgaggactgcgacttcaagaaggatggacttgttaagcgatgtatgggcaccgttaccctcaatcaggcccgaggatcgtttgacatttcttgtgataaggacaataaaagattcgccctgctcggtgacttctttcgaaagagcaaagagaaaataggaaaagaattcaaacgcatcgtccagaggataaaggactttctgagaaatttggtgccccgtaccgagtcc

SEQ ID NO: 8396 - DNA, 510 bp, Artificial Sequence
  Description of Artificial Sequence: Synthetic coding sequence
atgaaaacacagcgcgacggacactctttgggccggtggtctctagtgctgctgctgctagggttggtgatgcctctggctataatagcacaggtcctctcctataaggaagcagtgctgcgggcgatcgatggcattaatcagcgaagctctgatgctaacctctatcgcctcctcgacctggaccctcggcctaccatggacggagatccagacacaccaaaacctgtgtcgttcacagtcaaggagacagtgtgccctcgaaccactcagcagagcccagaagattgtgatttcaagaaagatggtcttgtgaaaaggtgcatgggcacagtcaccctaaatcaagcacgagggagcttcgacatctcttgtgacaaggacaacaaaaggtttgcactcttgggcgacttctttcgcaaatcaaaagaaaaaataggaaaggaatttaagcggatcgtacagcggattaaggattttttaagaaatttggttccacggacagagtct

SEQ ID NO: 8397 - DNA, 510 bp, Artificial Sequence
  Description of Artificial Sequence: Synthetic coding sequence
atgaagactcagcgagacggccatagtctgggccggtggagccttgtgctcctcttgttgggtttagtgatgccgctcgccataatcgctcaggtgctatcctacaaagaggcagtcctgagagcaatcgatgggatcaaccagcgttcttcagacgcgaatctgtatagattactagacttggacccccggccgacaatggacggtgaccctgatactcccaaaccggtttcattcacagttaaggagacagtctgccccagaacaactcagcagtcccccgaggactgcgattttaagaaggatgggctggttaagcggtgcatggggacggtgactctgaaccaagcacgtggatctttcgacattagctgtgataaggacaataaacggtttgcactgctcggagacttctttaggaaatccaaagagaaaattgggaaggagttcaagagaatcgtgcagaggatcaaagacttcttgcggaatctcgtcccacggactgagagc

SEQ ID NO: 8398 - DNA, 510 bp, Artificial Sequence
  Description of Artificial Sequence: Synthetic coding sequence
atgaagacccaacgagatggacactctttgggccggtggagtttggtcctcctccttctggggttagtgatgccactggccataattgctcaagttttatcgtataaggaggcagtccttcgggctatcgatgggataaaccagcggagctccgacgcgaacctgtaccgccttcttgaccttgaccctaggccaactatggatggcgaccctgatactcccaaacccgtgtccttcacagtcaaggagacggtgtgcccgaggacaacccagcagtcacctgaggactgcgatttcaagaaggacgggctggtcaaaaggtgtatggggacggtaacacttaaccaagcacgggggtccttcgatatttcttgtgacaaagacaataaacggtttgctctattgggggatttttttagaaaatcaaaggaaaagatcgggaaggagtttaaacggattgtgcagcgcatcaaggacttcctccgaaacctggtgcctcgtacagaaagc

SEQ ID NO: 8399 - DNA, 510 bp, Artificial Sequence
  Description of Artificial Sequence: Synthetic coding sequence
atgaaaacccaacgggatggtcatagtctcggtcgatggtcgcttgtccttcttctgctggggttggtcatgcctctggccattattgcacaagtcttgagctacaaggaagcggtgctcagggcaattgatggtatcaaccagagatcaagcgatgcaaatctgtaccgacttctggatttggatccaagaccaactatggacggagatcctgacactcctaaacccgtctcctttaccgttaaggaaactgtatgccccagaacgacccaacagtccccagaagattgtgacttcaaaaaagacggacttgtaaagaggtgcatgggaactgtgaccctcaaccaggccagaggttcgttcgatatttcctgtgataaggataacaagcgatttgcactgctgggagacttctttagaaagtccaaggagaagataggaaaagagtttaagcgcatcgtgcaacgcatcaaggacttccttcggaatctggtcccacggactgaatct

SEQ ID NO: 8400 - DNA, 510 bp, Artificial Sequence
  Description of Artificial Sequence: Synthetic coding sequence
atgaaaacccagcgcgatggtcattctttgggacgctggtcgcttgtcctgctcctgctgggactggtgatgcctctcgcgatcattgcacaagtgctctcctacaaggaggccgtcctgcgggcaatcgacggaatcaaccaacggagctctgacgctaatctttacaggcttctggatctcgatcctcgtccgactatggatggcgaccccgacacgcccaagccagtgtcctttactgtgaaagagactgtgtgtccacgcactactcagcaaagccctgaagattgcgacttcaagaaggacgggttggtgaagcgatgtatgggtactgtgacccttaatcaagcacgcggctcatttgatatcagctgtgacaaggataacaagcgctttgccctcttgggggacttctttcgcaagtcgaaggaaaagattggtaaagaattcaagagaattgtgcaacggatcaaagattttcttaggaatctggtaccgcggaccgaatcg

SEQ ID NO: 8401 - DNA, 510 bp, Artificial Sequence
  Description of Artificial Sequence: Synthetic coding sequence
atgaagacgcagagggacggccactccctggggcgttggtctctcgtgctgctgcttctgggtctcgttatgccactggctatcatcgcacaggtgctaagctacaaagaagctgtcttgcgggccatagatggcatcaatcagcgtagttcagatgcgaacttgtacagactgctagatctggacccccggcctaccatggacggtgaccctgacacacctaagcccgttagctttactgtaaaggagaccgtttgcccacggaccacccaacagtcccctgaagactgtgatttcaaaaaagatggcctggtgaagcggtgcatgggcaccgtgacactgaatcaggcacgcggatcatttgatatcagctgcgacaaagacaacaaaaggttcgctttgttaggggatttcttcagaaagtcaaaagagaagatcggaaaggagtttaagcgcattgttcagcgtatcaaagacttcctccggaacctggtgccacggactgagtcc

SEQ ID NO: 8402 - DNA, 510 bp, Artificial Sequence
  Description of Artificial Sequence: Synthetic coding sequence
atgaaaacacagcgcgatggacactctctcggcaggtggagcctggtcctgttactcctgggattagtgatgcccctggcaatcattgctcaggtcttgtcatacaaagaggcagtcctccgggccattgatggtatcaatcaacggtcttcagatgcaaacctttatagactcctcgacctggatccaagacctacgatggatggggaccccgacactcccaagcctgtaagtttcaccgtaaaggaaaccgtctgcccacgcactacacagcagtcaccggaagattgtgacttcaaaaaggacggactggtgaaaaggtgtatgggcaccgtgacactgaaccaggcgagggggagttttgatattagctgtgacaaagacaataaaagatttgctctgttaggtgactttttccggaagtcaaaggagaagatagggaaggagtttaaacggatagttcagaggattaaggactttctgcggaacctggtgcctcgaacggagtct

SEQ ID NO: 8403 - DNA, 510 bp, Artificial Sequence
  Description of Artificial Sequence: Synthetic coding sequence
atgaaaacccagagagacgggcattctctggggcgctggtcactcgtcttgctgctgttgggacttgtcatgcccctcgccattattgcacaggtcttgtcctacaaggaagccgtcttgcgggctatcgatggcataaatcagaggtccagtgatgccaacttatatagacttctcgatctcgatcctcgacctacaatggatggtgaccccgacacccccaaacctgtttcttttacagtcaaggagactgtgtgcccacgaaccacgcagcagtcccccgaggactgcgatttcaagaaggacgggctagtcaaaagatgcatgggaaccgtgaccttgaaccaggcaagaggatcgtttgacatctcgtgcgataaagataataagcggttcgctctgctgggggatttcttccgtaaatccaaagagaagatcggaaaagaatttaaacgtatcgtacagcgcataaaggattttcttcgaaacctggtccccaggacagaatcc

SEQ ID NO: 8404 - DNA, 510 bp, Artificial Sequence
  Description of Artificial Sequence: Synthetic coding sequence
atgaaaacgcaacgtgatggtcattcgctaggtcgttggtcgttagttctattattattaggtttagtaatgccgctagcgataatagcgcaagtactatcgtataaagaagcggttttacgagcgatagatggtataaatcaacgatcgtcggatgcgaatctatatcgtttactagatttagatccgcgtccgacgatggatggtgatccggatacgccgaaaccggtatcgtttacggttaaagaaacggtttgtccgcgtacgacgcaacaatcgccggaagattgtgattttaaaaaagatggtctagttaaacgatgtatgggtacggttacgttaaatcaagcgcgaggttcgtttgatatatcgtgtgataaagataataaacgttttgcgttattaggtgatttttttcgaaaatcgaaagaaaaaataggtaaagaatttaaacgtatagttcaacgtataaaagattttttacgaaatttagttccgcgtacggaatcg

SEQ ID NO: 8405 - DNA, 510 bp, Artificial Sequence
  Description of Artificial Sequence: Synthetic coding sequence
atgaaaactcaaagggacggacattcccttggcagatggagccttgtgctcctccttcttggattggtgatgcctctcgccatcattgcccaagtgctttcatacaaggaggcggtgctccgagcaattgacggaattaaccagcgatcgtccgatgcgaacctgtacaggctgcttgatctcgatcctagacctactatggatggcgatcccgacacgccgaaacccgtgtcattcaccgtcaaggaaacggtctgtccacgcactacccaacagtccccggaggattgtgatttcaagaaggatggtttggtgaaacgatgcatgggtacggttaccctgaatcaggcacgcggctcgtttgatatctcctgcgacaaggacaacaagaggtttgcactgttgggggacttcttccgcaagagcaaagaaaagataggcaaggaattcaaaagaatagtgcaacggatcaaggattttcttagaaatttggtgccaagaactgaaagc

SEQ ID NO: 8406 - DNA, 510 bp, Artificial Sequence
  Description of Artificial Sequence: Synthetic coding sequence
atgaaaacgcagagggacggccattcccttggaagatggagccttgtccttttgctcctcggccttgttatgcctctcgcaattatcgcacaagtcctcagctacaaggaggcagtgcttcgcgccattgatggtatcaatcaacgctcgtccgacgcaaacctgtaccggctgcttgatctggatccccgccctaccatggacggagatccggatacccctaagcctgtgtccttcaccgtgaaggaaaccgtgtgtcctcgcactactcagcaatcacctgaagattgtgatttcaaaaaagatggactggtgaagagatgcatggggaccgttaccctgaatcaagcaaggggatcatttgatattagctgtgataaggataacaaacgatttgccctgctcggagatttcttccgcaagagcaaggaaaagattggcaaggagtttaagcgcatagtccagaggattaaggatttcctcagaaatctcgtgcctagaactgaatcg

SEQ ID NO: 8407 - DNA, 510 bp, Artificial Sequence
  Description of Artificial Sequence: Synthetic coding sequence
atgaaaacgcaacgcgacgggcacagcctcgggcgctggtcattggttcttctgctgctgggattagtcatgcccctggccattatcgcacaagtcctcagctacaaggaagcggtactccgagctatcgacggcattaatcagcggtccagtgacgccaatttgtaccggctcctagacttggaccccagacctacaatggatggagatcccgacaccccgaaaccggtctcctttactgttaaagagactgtttgcccacgcacaacacagcagtccccggaggattgcgatttcaagaaagacggtttagttaagcgctgtatgggcaccgtcactctgaatcaggcccgagggtcatttgatatctcctgcgataaggataataagcgattcgccttgcttggcgacttttttaggaagtccaaggaaaagattggaaaagagtttaaaagaatcgtacaaaggatcaaggattttctgcgaaacctagtgccaaggactgagagt

SEQ ID NO: 8408 - DNA, 552 bp, Artificial Sequence
  Description of Artificial Sequence: Synthetic coding sequence
atggcggaccacctcatgctggccgaagggtacaggctggtacagcggcctccatcggccgctgccgcccacggaccgcatgcactccggactctcccaccctacgccggaccgggactcgattcaggcctgcgcccgcggggcgcacccctgggaccgcctccgccacggcagcctggagccctggcatacggcgccttcggccctccgtctagcttccagccatttccagctgtgccgccgccggccgctggtatcgcccacctgcaacccgtggcgaccccatacccaggacgcgcggcagccccaccaaacgcccccggaggaccgccgggacctcaaccagctccgtccgctgcggctccgcccccaccggcccatgcgttgggtggaatggatgcggaactcatcgacgaagaggcactgacttcgttggaactggagttgggactgcaccgcgtccgcgagctcccggagctcttcctggggcagtccgagttcgactgcttttcggaccttggatcggctccgccagcaggaagcgtgtcgtgt

SEQ ID NO: 8409 - DNA, 552 bp, Artificial Sequence
  Description of Artificial Sequence: Synthetic coding sequence
atggccgatcacctgatgctggcagaggggtaccgattagtccaaaggcctcccagcgctgccgccgctcatggaccacacgcccttcggacactgccaccatatgccggaccaggtctagattctggcctccgacccaggggagctcctctggggcctcctccacctaggcagcctggagccctggcatacggcgcattcgggcctccttccagttttcaaccttttcctgccgtgccaccacccgccgccggtattgctcacttgcaacccgtagccaccccatatccaggacgggcagccgcaccccctaacgcaccaggggggcctcccggcccacagcctgctcctagtgccgcagctcccccccctcccgctcacgccctaggtggcatggacgctgagttaatcgacgaagaagctctgactagtctggaactcgagctaggcctacacagggttcgggagctacctgaactgtttctgggccagtccgagtttgactgtttctccgatctcggctctgcacctcccgccggaagcgttagctgc

SEQ ID NO: 8410 - DNA, 552 bp, Artificial Sequence
  Description of Artificial Sequence: Synthetic coding sequence
atggcggatcatctaatgttagcggaaggttatcgtctagtacaacgtccgccgtcggcggcggcggcgcatggtccgcatgcgctacgtacgctaccgccgtatgcgggtccgggtctagattcgggtctacgtccgcgaggtgcgccgctaggtccgccgccgccgcgacaaccgggtgcgttagcgtatggtgcgtttggtccgccgtcgtcgtttcaaccgtttccggcggtaccgccgccggcggcgggtatagcgcatttacaaccggtagcgacgccgtatccgggtcgtgcggcggcgccgccgaatgcgccgggtggtccgccgggtccgcaaccggcgccgtcggcggcggcgccgccgccgccggcgcatgcgctaggtggtatggatgcggaattaatagatgaagaagcgctaacgtcgttagaattagaattaggtctacatcgagttcgagaactaccggaactatttctaggtcaatcggaatttgattgtttttcggatttaggttcggcgccgccggcgggttcggtttcgtgt

SEQ ID NO: 8411 - DNA, 552 bp, Artificial Sequence
  Description of Artificial Sequence: Synthetic coding sequence
atggcggatcacctgatgctggccgaaggctatcgattagtgcagcgccccccctcagcggcagccgcccatggaccccacgccctcagaacactgcctccatatgccggtccagggctggactccggactgcgcccaaggggagcacccctcggtcctccccctccaagacagccgggcgcgctggcctacggggccttcggcccccccagcagcttccagccgtttcccgcagtccctcctcctgcggcaggcatcgcacatctccagccagtagcaaccccctacccgggtcgtgcggctgcgcctccaaacgccccaggaggcccgcccggtccacagccagctccctccgctgctgcacctcccccccctgcccacgctcttggcggcatggatgcagaactgatagacgaggaggccttgacttccctagagctcgaactgggcttacatagggtacgggaactgccagagctctttctggggcagtccgaattcgactgctttagcgacctggggagtgctcctccagccggatccgttagctgc

SEQ ID NO: 8412 - DNA, 552 bp, Artificial Sequence
  Description of Artificial Sequence: Synthetic coding sequence
atggcagaccacctgatgttggctgagggatatagactcgtgcaacggcctccttcagctgcagctgcccatggtccgcatgctttgagaacccttccgccttatgctggtcccggattagattctggcctgaggccccgcggggctccacttgggcccccacccccacggcaaccaggggctcttgcctatggggcctttggccccccaagttcctttcagccttttcctgcagtcccacctcctgcagcagggattgcccacctgcagcccgtcgccaccccatacccaggcagggctgccgctccccctaatgcaccagggggcccccctggtccacagcctgcgcccagtgcggctgcccctcccccccctgcccacgccctcggcggaatggatgccgagctgattgacgaggaggctctgaccagcctagagttagagctaggtttacatagagtccgagagctccccgaactgttcttggggcagtccgagttcgattgctttagtgatcttggctcggccccccctgctggatccgtctcatgt

SEQ ID NO: 8413 - DNA, 552 bp, Artificial Sequence
  Description of Artificial Sequence: Synthetic coding sequence
atggcagatcatttgatgctcgctgaggggtaccgcctagtccagagacctcctagcgcggccgccgctcacggcccgcatgcccttcggactctgcctccatatgccggcccaggacttgacagcggcctgaggccccgtggagcccctctcggccctcctccacccaggcagcccggcgcacttgcttatggagcgttcgggccacctagcagttttcagccatttccggctgtccctcccccagccgccggaatcgctcatttgcagcctgtggctacaccctacccaggtcgcgctgctgcacccccgaatgcacccgggggtccaccaggcccccagccagcccctagcgccgctgcccctcctccccctgctcacgccctcggaggaatggatgcagaattgatcgacgaggaggctctgacctcgctggagctcgagctgggcctgcacagggtccgtgaactgcctgagctgtttctgggacaatccgagttcgactgcttcagtgacttgggtagcgcccctccggctggatccgtctcatgc

SEQ ID NO: 8414 - DNA, 552 bp, Artificial Sequence
  Description of Artificial Sequence: Synthetic coding sequence
atggctgatcacctcatgcttgcagaaggatacaggttggtgcagcgaccgccctccgccgcagcggcccacggaccccacgccctgcggactctgccaccttacgcgggaccagggctcgactctgggcttcgacccagaggagcaccactggggcctccaccacctaggcagcccggggctctggcctacggggcgttcgggccaccatccagtttccagccattccccgccgtgcccccacccgctgcagggatagcccatctccagccagtggctacaccctatcccgggagggcggcggctccccccaatgcccccggagggccacctgggcctcagcccgctccctccgctgctgcccctccccctcccgcacatgctctgggagggatggatgcagaactcattgatgaagaagctctcacatcactcgaactagaactagggcttcatcgggtgagggagcttcctgaactttttttaggacagtcagaatttgattgtttctccgatcttggatcggcccctccagctgggagtgtttcttgc

SEQ ID NO: 8415 - DNA, 552 bp, Artificial Sequence
  Description of Artificial Sequence: Synthetic coding sequence
atggccgaccacctgatgttggcagagggctatcgacttgttcagaggccgccttccgctgccgctgcacatggaccccatgctcttcgtactctgcccccatacgccggccccggacttgacagtggcctgcgtccccgaggggcaccattaggacccccccctccccgacaaccgggtgccttagcttatggagcattcggaccccccagcagttttcagccttttccagctgtgccaccccctgcagcgggaatcgcacatctccagccggtggccactccctatccagggcgcgcagccgctcccccaaatgcccccggggggcctccgggcccacaacctgccccatctgccgctgcacctccgccacctgcacacgcactgggcggaatggatgcggagctaatagatgaggaggcactcacatctctcgagctggaactcggcttgcacagagtgagggagctgcccgagctgtttctgggtcagagtgagtttgattgtttctccgatttagggtcggccccaccggccggctcagtttcttgt

SEQ ID NO: 8416 - DNA, 552 bp, Artificial Sequence
  Description of Artificial Sequence: Synthetic coding sequence
atggctgatcatttaatgttggctgaaggttatagattagtacaaagacctccaagtgctgcagcagctcatggtccacatgcattaagaacattacctccatatgctggaccagggcttgattctggtttaagacctagaggagcaccattagggccaccacctcctagacaaccaggagctcttgcttatggagcatttggtccaccatcatcttttcagccatttcctgcagttccaccaccagctgctggaatagctcaccttcaaccagttgctacaccttatccaggacgtgcagcagccccacctaatgctccaggaggtccaccaggaccacaaccagctccatcagctgcagcaccaccaccaccagcccatgcacttggaggaatggatgccgaattaatagatgaagaagctcttacatcacttgaattagaattgggattacatcgagttagagaattaccagaattatttcttggacaatcagagtttgattgtttctcagatcttggaagtgctccaccagctggatcagtatcttgt

SEQ ID NO: 8417 - DNA, 552 bp, Artificial Sequence
  Description of Artificial Sequence: Synthetic coding sequence
atggcagatcatcttatgcttgcagaaggctacagattggtgcaacggcctccttcggccgcggcagcacacggaccacatgccctgcgtactctcccgccctacgcgggtcctggactcgactccgggttgcggcctaggggcgcaccactgggacctccaccacctcgccaacctggagcattggcatacggagccttcggtccaccctcgtcctttcaaccttttccagccgtcccaccacctgcggcagggattgcacacttgcagcctgtggcaaccccgtaccccggccgcgccgctgcgcccccaaatgcccccggaggccctcccggccctcaacctgcacctagcgctgcagcaccgcctcctccagcccacgctcttggcggtatggatgccgaacttatcgatgaggaagcactcacgtcgctggaactggagctgggattgcaccgggtgcgcgaacttcccgagctctttcttgggcagtcggaatttgattgtttctccgacttggggtcggccccgcctgccggatcagtgagctgc

SEQ ID NO: 8418 - DNA, 552 bp, Artificial Sequence
  Description of Artificial Sequence: Synthetic coding sequence
atggcagaccaccttatgctggcagagggatacagactcgttcaacgaccaccttccgcagctgccgcacatggaccccatgctttgaggacccttccgccctacgcgggacctgggctcgattcgggacttcgcccacgtggcgcacctcttggcccgccgccgcctagacaacctggagcactggcctacggggctttcggtccccctagcagctttcaaccattccctgcagtgccacccccagcggcaggcatagcccacctgcagcccgtggccaccccttaccctggacgtgcagccgcgccgcctaacgcaccaggaggcccccctggtcctcagccagctccatcagcggcagccccgccaccgccagcacatgcacttggtggcatggacgcagaacttattgatgaagaagcactgacttcgctggaactcgagctgggcctccatagggtgcgcgagctccctgaattgtttcttggtcagtccgaatttgattgttttagtgatcttgggtctgcgccacccgcagggagcgtatcgtgc

SEQ ID NO: 8419 - DNA, 552 bp, Artificial Sequence
  Description of Artificial Sequence: Synthetic coding sequence
atggctgaccacctgatgcttgccgagggatacagacttgtgcagcgccctccttccgcagcagccgctcacgggccacacgcgctgcggacgctgccgccttacgcaggaccaggattggacagcggcctccgcccacgcggcgcaccgctgggaccgcccccgccgcggcagcccggcgcgctcgcttatggtgctttcggacctccgtcctccttccagcctttcccagcagtgcctcctccagcggccggaatcgctcacctccagccggtcgccaccccataccctggccgggctgctgcaccgccgaacgctcctggcgggccgccgggtccgcaacccgccccctcagccgcggctccaccgcctccggcccatgcccttggagggatggatgccgaactcattgacgaagaggcactgacttcgttggagcttgaactcgggctgcatcgagttcgcgagctgccggaactgtttctggggcaaagcgagttcgactgcttttctgatctcggctcagcaccgccagccggatcagtgtcgtgc

SEQ ID NO: 8420 - DNA, 552 bp, Artificial Sequence
  Description of Artificial Sequence: Synthetic coding sequence
atggccgaccacctcatgctcgccgagggataccggctcgtccaacgcccgccgagcgcggctgctgcacacggccctcacgccctgcgcacccttccaccctacgccggcccaggacttgattccgggctgcggccgaggggagcaccgctgggcccgccgccgccacgccagcccggagctctggcctacggtgcgttcgggccaccttcgtcgtttcagccgttcccggcagtgcctccgcctgcggccgggatcgcccacctccagccggtcgccactccttaccctggaagagcggcggcaccaccaaacgcaccgggaggacctcccggcccacaaccagctccgtcagcggctgcaccgccgccccccgcccatgccctgggtggtatggacgctgaactgatcgacgaagaggccttgacctcgctggagctcgaattgggactgcatagagtgcgagagctcccagaactgtttctgggacagtctgaattcgattgcttctccgacctgggatcagcgccaccggccggcagcgtgtcctgt

SEQ ID NO: 8421 - DNA, 552 bp, Artificial Sequence
  Description of Artificial Sequence: Synthetic coding sequence
atggcagaccatctaatgttggccgagggctatcggctcgtgcaacgtcctccatcggccgcagcggcccacggcccgcacgctctgcgaacccttcctccgtacgccggtccaggcctggacagcggcctgcgcccacgcggtgccccacttggcccaccaccccctagacagcctggggctctcgcttatggtgctttcggtccaccgagctccttccagcctttccccgcggtgccgcccccggctgccggcatcgcccacctgcagccagtcgccaccccctaccctgggcgcgccgctgcaccaccaaatgctcccggaggcccgccgggtccacagccagccccaagcgcggctgcaccccccccacccgctcacgccctagggggaatggatgcggagttgattgatgaggaggccctgacgagcctggagctggagctcggactacacagggtgagagaactcccagagctgtttctgggccagtccgagttcgattgtttctccgatctgggaagcgcaccgccagcgggttccgtgtcctgc

SEQ ID NO: 8422 - DNA, 552 bp, Artificial Sequence
  Description of Artificial Sequence: Synthetic coding sequence
atggctgatcacctaatgctggcggaaggctaccggctcgtgcaacggcctccttctgctgctgctgcccacggcccacatgcactcagaaccttgcctccctatgcgggtcctggccttgactctgggcttcgcccacgcggagccccacttggtcctcctcctccacgccagcccggagcactcgcctacggtgctttcggacccccgtctagcttccagccgttcccggctgttccgccaccggcggcgggaatcgcgcacctccaacccgttgcgacaccttaccccggcagagccgctgcgccgcccaacgcgccaggtggtcctccgggaccgcagcccgcacccagtgccgctgcgccgcctcctcctgcccacgcgctgggtggtatggatgctgagcttattgatgaggaggccttaacctccctagagctggaactggggttgcaccgcgtccgggagcttcccgagctgtttctcggccagtcagaattcgactgctttagtgacctcggtagtgccccgcccgcgggttcagtttcatgc

SEQ ID NO: 8423 - DNA, 552 bp, Artificial Sequence
  Description of Artificial Sequence: Synthetic coding sequence
atggcagaccacctgatgctcgcagaggggtaccggcttgtgcagcgtcccccttcagcagcggctgcccatggaccacatgcacttcgcacgcttccaccatacgcaggccctggcctggattccggcctgcgacctcgtggggctcctctgggaccgcccccacccagacagcctggcgcactcgcatacggagcatttgggccaccctcgtcgtttcaaccattccccgcagtgcctcctccagcggcaggaatcgcacatctgcagcctgtcgctaccccttaccctggtcgtgcagcagcgccaccgaacgcccctggcggccctccaggtccacaacctgccccatcagcagcagcacctccaccgcctgctcatgcactggggggaatggatgcagaactcattgatgaggaggcgcttacttctcttgagctggaactcgggcttcatcgggtgcgggagcttccagagctgttcctgggacaatccgagtttgactgcttttcggacctgggttcggctcccccagccggtagcgtgtcctgt

SEQ ID NO: 8424 - DNA, 552 bp, Artificial Sequence
  Description of Artificial Sequence: Synthetic coding sequence
atggccgatcacctcatgctcgccgagggttacagactggtgcagcgtcctccctcggctgctgcggcccacggaccgcacgctctccgcactttgccaccttatgccggtccgggtctggattctggcctgcggcctcggggcgcccccctaggtcctcctccaccacggcagccgggtgccctagcatatggtgccttcggtccgccctcttccttccagccgttccctgcggtgccgccccctgctgcgggaattgcccacctccagccggtggcgacgccttacccgggccgagcagctgccccgcccaacgctcccggtggaccccccggaccacaacccgcgcccagtgcagccgcgcctcccccgccagcccacgccttgggcggcatggacgctgaactcatcgatgaggaggctctgacctccctggagctcgagttgggcctacaccgtgttcgagaactgcccgagctgttcctggggcaaagcgagttcgattgcttctcggaccttgggtccgcacctcccgctggatctgtttcgtgt

SEQ ID NO: 8425 - DNA, 552 bp, Artificial Sequence
  Description of Artificial Sequence: Synthetic coding sequence
atggcggatcacctgatgttggcggagggttaccggctggtgcaaagaccaccttcggctgccgccgcacacggtccccacgccctgcggacgctgccaccttacgccggccccggacttgactcaggacttcgaccgcggggcgcccctctggggcctcccccgccccggcagccgggagccctggcctacggagcctttgggcctccgtcctccttccagccattccctgcagtgccaccaccagccgcaggcatcgcgcacctgcaaccagtcgccactccgtaccctggaagggctgccgcccctccgaacgcgccgggtggaccgcctggacctcagccggctccttcagcagctgcgccgccgccgcccgcacatgccctgggaggaatggacgccgagctgatcgacgaggaagccctgacgtcacttgagctggaactcggcctccatagggtgcgcgagctgccggagctcttcctgggacagtccgagtttgactgtttctccgatctcggatccgcgcccccggccggatcggtgagctgc

SEQ ID NO: 8426 - DNA, 552 bp, Artificial Sequence
  Description of Artificial Sequence: Synthetic coding sequence
atggcggaccacctcatgttagcagaagggtataggcttgtacaaaggcctcctagcgcagcagccgcccacggcccacatgccctcagaaccctgccgccatacgcaggacccgggctagacagcggcctcaggcctcgaggagcacccctgggccctccgcccccgcgacagccaggcgcactggcctacggggccttcggcccaccaagctcttttcaacctttccctgcagttccaccccctgccgcaggaatagcccacctgcagcccgttgctactccttacccgggccgagccgcagcccctcccaacgcccctggcggacccccgggaccccagccagcaccatccgccgccgcccctcccccacctgcccacgcactcgggggaatggacgctgaactcattgacgaggaggccctgacctcactggaacttgagttaggactccaccgcgtccgtgaactgccggagttatttcttggccagagtgagttcgattgtttttcggaccttgggtcagccccccctgctggatccgtgagctgc

SEQ ID NO: 8427 - DNA, 552 bp, Artificial Sequence
  Description of Artificial Sequence: Synthetic coding sequence
atggcggatcatctgatgctggccgaggggtaccgactggttcagaggcctccttctgccgccgccgcccatggcccgcatgcacttaggacactccccccctacgcagggcccgggctggactccgggctaagacctaggggcgctccgctcggcccgccgccccctcggcaaccgggtgccctagcctacggcgcctttggcccccccagtagcttccagccttttcccgctgtaccaccccccgccgccggcatcgcccacctgcagcccgttgctactccataccccggcagggcggccgccccgcctaacgctcccggcggaccacctgggccccagcctgctccttcagccgccgcgcccccgccaccggcacacgctcttggaggtatggacgcagagcttatcgatgaagaggccttgacttccctcgagttggaacttgggctgcacagagtgagggagttgcctgaattgtttctcgggcaatctgaatttgactgcttttctgaccttggaagcgccccgccagccggatctgtttcctgc

SEQ ID NO: 8428 - DNA, 552 bp, Artificial Sequence
  Description of Artificial Sequence: Synthetic coding sequence
atggctgaccatctcatgctggcggaaggataccgcctggtccagcgtccgccgtcggcggcagcggctcatgggccccacgcccttagaaccctgccaccatacgcggggcctggacttgattctggactccgacctcgcggcgctcccttgggaccaccaccaccgagacaacccggcgcccttgcatatggagcatttggacctccctcatccttccagccgtttccggcagttccgccccctgcagccggaatcgcccatcttcagccggtggctactccgtacccgggccgggctgccgcgcctccgaatgcccctggaggccctccaggaccgcagcccgctcccagcgcggccgccccacctccaccggcacacgcgcttggtggaatggacgccgagctgatcgatgaagaggcgctgacctcgttggagctcgaactggggctgcaccgggtgagggaactgcctgaactcttcctgggccaatccgagtttgattgtttcagcgaccttggctcagcaccgccggccggctcggtgtcttgt

SEQ ID NO: 8429 - DNA, 552 bp, Artificial Sequence
  Description of Artificial Sequence: Synthetic coding sequence
atggcagatcatctgatgctggccgaggggtaccgcctggtccagcggccaccctctgctgctgcggcccatgggcctcatgcactgagaacgttacccccatacgcgggccccggcctggattcaggactgcggccaaggggtgcccctctcggccctccaccaccaaggcagccaggcgccctagcgtatggagcctttggtcctccctcctccttccagccatttccagctgtgccccccccagcagcaggcattgcccacctccagcctgtggcaactccgtatcccggacgcgcggcggcccctcccaacgcgcccggggggcctcccgggccacagccagctcccagcgcggccgccccgcctcctccggcccatgccctcggaggaatggacgccgagcttatcgacgaggaggccctgactagtctcgaactggagctggggctccaccgtgtgcgcgaacttccagagctgttcttgggccagtccgaattcgattgttttagcgacctaggttccgctccaccagccggctcagtaagctgc

SEQ ID NO: 8430 - DNA, 552 bp, Artificial Sequence
  Description of Artificial Sequence: Synthetic coding sequence
atggcagaccacctgatgcttgctgagggttaccgcctggtacagcggcccccttcagcagcagcggcccatggaccacatgcgctgcggaccctcccaccttacgcgggcccaggccttgatagcggcctgcgtcctaggggtgctcctctcggcccccctccccctcgccagccgggggccctggcctacggagcgttcggacctccttccagctttcagccttttcctgccgtacctccccctgccgcgggaattgcccacttacagccagtcgcaacgccctatcctggcagggctgcggcacctccaaacgcacctggtggccccccggggccgcagcctgcccccagtgcggccgcacctcccccccctgctcacgccctgggaggcatggacgcagagcttattgatgaggaagccctgacctccctagagctggagctagggttacaccgcgtgcgggagctaccagaattgttccttggccagtcagagttcgattgtttcagcgacctcggctccgcaccacccgccggttctgtgagctgt

SEQ ID NO: 8431 - DNA, 552 bp, Artificial Sequence
  Description of Artificial Sequence: Synthetic coding sequence
atggccgatcatctgatgcttgctgaggggtacagattggtgcaaagaccaccaagcgccgccgcagcccacggtccacatgccctccgtactctccctccatacgcgggaccaggtctggattcggggcttcggccgcggggcgcaccactgggtccgccacctcctcgccaacccggtgcactcgcatacggcgcattcggccccccatcatctttccagccgtttccagcagtgccaccacctgcagcaggaatcgcacacctgcaaccagtcgcgaccccttaccctggtagagcggcggcaccgccaaatgcacctggagggccacccggaccgcaaccagccccaagcgcagcagcccctccacctcctgcacacgcactgggagggatggatgcagaactcattgacgaggaagccctgacgagcctcgagctggaacttggactgcaccgggtgagggagctgccagagcttttcctgggacagtcagagtttgattgcttctccgatctgggctcggcgccccctgcgggctcagtctcctgc

SEQ ID NO: 8432 - DNA, 552 bp, Artificial Sequence
  Description of Artificial Sequence: Synthetic coding sequence
atggccgatcatcttatgctagcagaaggctatcgcctggtgcagagacccccgtctgcagctgccgcgcacggaccacacgccctacggacactgccaccgtacgcagggccaggcctggattctgggctccggccccggggagcacccctgggtccaccgccaccaaggcagcccggcgccctcgcgtacggtgccttcgggccaccttcaagcttccagcccttccccgctgtccccccacccgccgccggaatagcacacctgcagccggttgccactccctatcctggacgtgccgcagcccctcccaatgccccagggggaccccccggaccccagccagcccccagtgccgcagccccccccccacccgcccatgccttaggggggatggatgcagaactcattgatgaagaggccttgaccagtcttgagctggagttgggtttgcaccgcgtgagagaactgcccgagttattcctgggacaaagcgagttcgattgctttagcgacctgggatcagccccccccgccggctctgttagttgc

SEQ ID NO: 8433 - DNA, 552 bp, Artificial Sequence
  Description of Artificial Sequence: Synthetic coding sequence
atggccgaccacctgatgttggcagaggggtacaggctggtacaaagacccccctcagcagcggccgcgcacggaccgcatgcgctgaggacactgcccccatacgccggaccgggcctggattccgggcttaggccacggggagctccactcggacctccacccccacggcagccaggtgccctcgcatacggcgcattcggtcctccttcctccttccagcccttcccagcggtgcccccccctgccgctggcattgcccatctccagccagtggccactccgtaccctggcagggctgcggcaccacccaatgcgcctggtgggccccctggaccacaacctgcgcccagcgcagcagctccccccccccccgcccacgcactgggcggcatggatgctgagcttatcgacgaagaggccctcactagcctggagctggaattaggattgcaccgcgtccgagagctaccagagctgtttctgggccaatctgagtttgactgtttttccgatctgggaagtgctcctcctgcagggagcgtgtcctgt

SEQ ID NO: 8434 - DNA, 552 bp, Artificial Sequence
  Description of Artificial Sequence: Synthetic coding sequence
atggccgaccatctaatgttagctgaggggtacagactggtgcagaggcccccgagcgcagctgccgcacacggcccacatgccttgaggacgctgcctccctatgccggacccggcctggacagcggactccgcccacgcggtgctccccttggcccccctccccctcgtcaacctggagctttggcctatggcgctttcggacctcctagttcatttcagccctttccagcggtgccccctcccgctgctggcattgcccatctgcagcctgtggcgactccctatcccggccgggcagccgcaccacctaacgcaccagggggacctccagggcctcagcccgcgccgtcagccgcggccccacctcccccagcccatgcgctgggaggcatggatgcggagctaatcgacgaggaagctttgacgagtcttgagttggaacttggacttcatcgagtgagagagctgccagagttgtttctggggcagagcgaatttgattgtttctctgatctggggtccgccccccctgctgggtccgttagctgt

SEQ ID NO: 8435 - DNA, 552 bp, Artificial Sequence
  Description of Artificial Sequence: Synthetic coding sequence
atggcagatcacctgatgcttgccgagggatacagacttgttcaacggcctccctccgcggccgcagcacacggaccacatgcactgagaacgctgcctccctacgctggacctggactggattcgggcctccgtccacgtggagccccactggggcccccaccacccagacagcctggagccctggcatacggagcattcggcccgccttcgtcgtttcaaccttttccagcggtgccaccccctgcagcgggtattgcacacctgcaaccagtggcaaccccataccctggccgggcagcagctccgcctaacgcccccggggggcctccaggtcctcagccggcgcccagcgcagccgctccacctccaccagcacatgcacttggaggcatggatgctgagcttatcgacgaagaagcgttgacttccctcgaactcgaactcggacttcatcgggtccgggaacttccagaattgtttttgggtcagtcagagttcgattgtttcagcgatctgggatcagcacctcccgccggtagcgtgtcctgc

SEQ ID NO: 8436 - DNA, 552 bp, Artificial Sequence
  Description of Artificial Sequence: Synthetic coding sequence
atggccgatcacctcatgctggcagagggttatagactggtccagcgtcccccatccgctgccgctgctcatggcccacacgcactcaggaccctgcctccatatgccggcccaggcttggattcaggactgcgccctcgtggagcacctctgggcccccctcccccaagacagccaggagctctcgcctacggtgccttcggcccccccagcagcttccagccattccctgcagtccctcccccagcagccggtatcgcccatctgcaacctgttgcaactccctatcccggaagagcagccgctccacccaacgcccctggaggaccccccggtccacagccagctcccagcgccgctgctcccccaccacccgctcacgctttgggaggaatggacgctgagttgatcgatgaggaggctctgaccagtctcgagctcgagctcggactccaccgcgtgagggagttgcctgaactcttccttggccagtcagagtttgactgcttctccgacctcggttctgcacccccagctggctcagtcagctgt

SEQ ID NO: 8437 - DNA, 552 bp, Artificial Sequence
  Description of Artificial Sequence: Synthetic coding sequence
atggccgaccatcttatgctggcagaagggtacagactcgtgcaacgtcctccctcggcagcagcagcccacggaccacacgcactccggacgcttccaccttacgcaggaccaggtcttgatagcggacttagacccagaggagcaccactgggaccaccccctccaaggcagcccggggcacttgcctacggggcattcggtcctccttccagcttccaaccgttcccagcagtgccccctcctgcagccggcatcgcacatctgcagcctgtggcgactccgtacccaggccgtgcggcagccccaccgaatgcgcccggaggaccaccaggtccccagcctgcgccttcggcagccgctcctcctcccccagcacacgcactgggcgggatggacgcggagctcattgatgaagaggccctcacctcgctggagctggagcttgggcttcatcgggtgagggaacttccggaattgtttctggggcagagcgaatttgattgtttttccgatctggggagcgccccacctgcaggaagcgttagctgt

SEQ ID NO: 8438 - DNA, 552 bp, Artificial Sequence
  Description of Artificial Sequence: Synthetic coding sequence
atggccgaccacctgatgcttgcggagggctaccgccttgtccaacgtccgccatccgcagcagccgcgcacggtcctcatgcgctcagaactcttcccccatatgctggcccaggacttgactccggcctgaggccacgaggcgcgccgttgggaccccctccccctagacaacctggggcattggcttacggggcattcggtcctccctcgtcgtttcagccatttcctgctgtgcctccgccagcagcagggatcgctcatctgcagcctgtggccaccccttacccaggaagagccgcagcaccacccaacgcaccaggaggaccaccaggcccccagcctgctccaagcgccgcggcacccccaccccctgcacatgcacttggaggaatggatgccgaacttattgatgaggaagctctgacttcacttgagttggaactcggacttcatcgggtgcgtgaactgccagaactctttctggggcaatccgaattcgattgcttttcagatctgggaagcgccccgcctgcaggttcggtatcgtgt

SEQ ID NO: 8439 - DNA, 552 bp, Artificial Sequence
  Description of Artificial Sequence: Synthetic coding sequence
atggcggaccatctgatgctggccgagggataccgcctcgtgcagaggcccccgagcgccgcggcagcgcacggcccacatgccctccggactctcccgccgtacgccggcccgggtcttgattccggattgcgcccacgcggcgctcctttggggcctccgcccccgagacagccaggggcactcgcttacggagcctttgggcctccttcgtcgttccagccttttccggccgtgcccccacctgccgccggaatcgcccatctgcaaccagttgcgactccttacccgggacgcgccgctgcgccacctaacgcgcctgggggaccgccaggaccgcagcctgccccatcggctgcagccccgcctccaccggcccatgcgcttggggggatggacgcggaactgattgatgaggaagcgctgacctcgctggagctcgagctgggattgcaccgggtgcgggagctgccagaactgttcctggggcagtccgaattcgattgcttttcagacctgggctccgcgccgcctgctggatcggtgtcctgt

SEQ ID NO: 8440 - DNA, 552 bp, Artificial Sequence
  Description of Artificial Sequence: Synthetic coding sequence
atggcggatcatctcatgctggcagaaggttatcgcctggtgcagcgaccaccgtccgcggccgccgctcacggcccccacgccttgcgaacccttccgccctacgccggaccgggcctggactcggggctgcgcccacggggagccccgctcggcccgccacctccaagacagcctggggccctggcctacggagcgttcgggccaccgtcgagcttccagccgttccctgcagtacccccaccggctgccggtatcgctcacttgcaacccgtcgccactccgtacccagggagggcagccgcgccaccaaacgcgccgggtggaccgccgggacctcagcccgcaccttccgcagctgctccgccgccgcctgcacacgctctgggaggcatggacgcagaacttattgatgaagaggccctgacctcgctcgagctcgaacttggattgcatcgcgtgcgggaactgccggagctgttcctgggccaatcagaatttgactgcttttctgacctcgggtcagcgccaccagccggatccgtgtcatgc

SEQ ID NO: 8441 - DNA, 552 bp, Artificial Sequence
  Description of Artificial Sequence: Synthetic coding sequence
atggccgatcatcttatgcttgcggaaggctaccgccttgtgcaaagaccaccctcagccgcagcagcacatgggccacatgcactcaggactctgccaccctacgcaggtccaggcctcgatagtggtcttaggccgcgcggtgctcctctgggcccacctccacccagacaaccaggagctctcgcgtacggtgcatttggacctcctagctcctttcaacctttcccggccgtgcctccacccgctgccggaatcgctcatctccaaccagtggcaaccccatatcccggacgagcagcagcgccacccaacgcaccagggggacctcccggccctcaaccagcaccatcggctgccgcacctcccccaccagcacacgcacttggaggaatggatgcagagctgattgatgaagaagcactcacttcactcgagctggaactgggtctgcacagagtgagagaacttcctgagctttttctggggcagtcggaatttgattgtttttcggacctgggatccgcacctccagcgggttccgtgtcctgt

SEQ ID NO: 8442 - DNA, 552 bp, Artificial Sequence
  Description of Artificial Sequence: Synthetic coding sequence
atggctgaccacttgatgcttgccgagggttaccggctggtccaacgcccgccgagtgccgccgcggcacacggtccacacgcgctgcgcactctcccaccctatgccgggcctggcctcgacagcggccttcgccctcgcggcgcccctctgggccccccacctcctcgtcagcctggtgccctagcctacggagcttttggaccccccagttctttccagcctttcccggctgtgcctcctccggccgcggggatagcccacctgcaaccggtggctactccctatcccggaagggctgctgctcccccaaacgcccccggcggcccacccggaccacaacccgcaccgtccgccgcagcccctccccctcccgcccacgctcttggcggcatggatgcagagcttattgacgaggaagcccttacatctctggaactcgaattgggtcttcacagagtgagggagctgcctgaactgtttctgggccagagcgaattcgattgcttttcagatctggggagcgccccaccagctggatctgtgagctgc

SEQ ID NO: 8443 - DNA, 552 bp, Artificial Sequence
  Description of Artificial Sequence: Synthetic coding sequence
atggccgaccatcttatgctggcagagggataccgtctagtgcagagacctccaagcgctgccgccgcacacggacctcacgccctacgcacactgccaccatatgcaggccccggcttagatagcggcctcaggccgaggggagctccattgggacccccacctccccgccaacctggggccctagcctatggtgcattcgggcccccatcatccttccaacctttccccgccgtgcccccgccagctgcgggtatcgcccaccttcagccagtagccacaccctacccaggccgcgctgccgcccctccgaatgcaccaggtgggccaccagggccccagcccgctccgtcagcagcagccccccctccaccggctcatgcacttggcgggatggacgctgaactcatcgatgaagaggctctaacttccctggagctcgagctcggattgcaccgggtccgcgaacttcccgaattattcctaggccagtctgaattcgattgtttcagcgatcttggaagtgccccgcctgcggggtctgtgtcctgt

SEQ ID NO: 8444 - DNA, 552 bp, Artificial Sequence
  Description of Artificial Sequence: Synthetic coding sequence
atggctgatcatctgatgctggctgaaggctataggctggttcagaggccacctagtgcagctgccgcgcatgggccccacgccctccgaacccttccaccttacgcgggaccgggactcgactcaggacttcgccctcgaggcgctcctttgggaccaccaccccccagacagccaggcgctcttgcctatggcgcattcggacctccgtcttcctttcagccctttccagccgttcctcctcccgctgctgggatcgcccacctccagcctgtggctacgccctaccccgggagagccgcggccccaccaaatgcaccaggggggccccccggtccccagcccgctcccagtgctgcagccccccctccaccagcacacgctctcggaggcatggacgcagaactgattgacgaagaggccttgacttctttggaattggaactcggcctgcacagagtcagggagcttccagagctgttcctgggccagtccgaattcgactgtttctctgatctggggagtgcccctcctgccggcagtgtcagctgc

SEQ ID NO: 8445 - DNA, 552 bp, Artificial Sequence
  Description of Artificial Sequence: Synthetic coding sequence
atggctgatcacttgatgctggcggaggggtaccgtctggttcagaggccgccttctgctgccgcggctcacggaccccatgccttaagaaccctccctccttatgcaggccccggcttggatagtggattgaggcctaggggggcaccccttggtccacctccaccacgacaacctggagcactcgcttacggtgcatttggaccaccaagtagtttccagccgttccctgctgtgcctccgcccgctgcaggtatagcccatttgcaaccggttgctaccccttatccaggccgggccgccgctccacccaatgcacctggtggacccccgggtccacagccagctccttccgctgctgccccccctccccccgctcacgctctcggaggcatggatgctgagctaatcgatgaagaggcgcttacatctctggaacttgaactcggactccatagagtcagagagcttcctgagctatttcttggtcaatctgaattcgactgtttctctgatctcggctccgctccgccagctggctctgtgtcttgt

SEQ ID NO: 8446 - DNA, 552 bp, Artificial Sequence
  Description of Artificial Sequence: Synthetic coding sequence
atggccgaccacctcatgcttgcagaaggttaccgcctggtgcaacggccgccatcagcagccgccgctcacggtccccacgcactgcgcacgttgccgccctacgccggccccggactagactcgggcctgcgcccccgcggcgcgccactgggacccccccctcccagacagcctggcgccctggcttacggggcattcggtcccccttcctcttttcaaccctttcctgctgtccctccacccgccgctggtattgcacacctgcagcccgtggcgacaccatatcccgggagagccgcagcaccgccaaatgcccccggcggccccccaggaccacagccagcacccagcgcagccgctcccccaccgccagctcatgcgcttggaggtatggatgccgagctgatcgacgaagaagctctgactagcctcgagctcgagctcgggttgcaccgagtcagagagctgcctgaactgtttcttggccagtcagaattcgattgcttctccgacctagggtcagcgccccctgctggaagcgtttcctgc

SEQ ID NO: 8447 - DNA, 552 bp, Artificial Sequence
  Description of Artificial Sequence: Synthetic coding sequence
atggcggaccaccttatgcttgctgaaggatatagactcgtgcaaagaccaccttcagcagccgcagcgcatggccctcatgccctgcggactttgccaccgtacgctgggcccggattggacagcggactccggcctagaggcgcacccctgggccctcctccaccaaggcagccaggagcacttgcatacggtgcgttcgggcctccttcgtcgtttcaaccttttcccgcagtgcctcctcctgcagccggaattgcacatcttcaacccgtggctactccgtaccctggtagagcagcagcccctcctaatgcacctggcggtccgccaggtccccaaccagccccgtccgcggcagcacctcccccacccgcacacgcactgggagggatggatgcagaacttattgatgaggaggcacttacctcccttgagcttgaattgggacttcatcgggtcagagaacttccagaactcttcctgggacaatccgagttcgactgtttctccgatctcggctcagcaccgccggcaggatccgtgtcgtgc

SEQ ID NO: 8448 - DNA, 552 bp, Artificial Sequence
  Description of Artificial Sequence: Synthetic coding sequence
atggctgatcacctcatgttagccgaaggataccgcctggttcaaagaccaccttcggccgcagccgcccatggcccacacgcattacgaaccctgcccccatatgcgggccctgggctcgacagcggtctaagaccaaggggggctccactgggtccaccaccacccagacagcccggcgctctggcctacggcgcgttcggaccgccatccagttttcagccctttcccgctgttccaccacctgcagcgggaatcgctcatctgcagcctgtggccactccatacccaggaagagccgcagccccccctaatgccccgggtggcccccccggaccacagcctgctcctagcgctgcggcccctcctccacctgcccacgccctgggtggaatggatgccgagctcatcgacgaagaagccttgacttccctggagctagagctggggttgcacagggtgcgagagctcccagaactgttcctcggtcagagcgagtttgactgcttcagtgatttgggctctgcccccccggcgggcagtgtgagttgc

SEQ ID NO: 8449 - DNA, 552 bp, Artificial Sequence
  Description of Artificial Sequence: Synthetic coding sequence
atggccgaccatctcatgctggctgagggataccgactcgtgcagaggcctccgtcagcggccgcggcacacggcccgcacgcgctccggacccttcctccatatgcaggccccggtctggattccggactgcgcccacgcggcgccccacttggcccaccgccacctagacagccgggagccctcgcctacggcgctttcggacccccgagctcgttccagccttttcctgctgtgccgccgccggccgctggtattgcacacctgcagccagtggcaactccgtacccggggagagccgctgccccgcctaacgctcctggtggacccccgggcccacaacctgcgccgtctgcggcggccccgccaccacctgcccacgccttgggagggatggatgccgaactcatagacgaggaggcgctgacttccctcgaattggaactcgggctgcatcgggtcagagaactgcctgaactcttcctggggcaatcggagtttgactgtttctcggatctcggcagcgcaccgccagctggaagcgtctcgtgc

SEQ ID NO: 8450 - DNA, 552 bp, Artificial Sequence
  Description of Artificial Sequence: Synthetic coding sequence
atggccgaccatcttatgttggccgagggataccgcttggtgcaaagacctccgtccgcagccgcggcacatggaccccacgcacttcgtactctccctccctacgcaggccccggcctcgactccggcctgaggcctaggggagctccacttggcccacctccacctcggcagcctggtgcacttgcctacggcgcattcggtcccccttcatcatttcaaccattcccagctgtcccgccacctgccgcgggtatagcacatctgcagcctgtggcgaccccgtacccaggtagagccgcagcgccacctaacgcacctggtggcccccctggacctcagccagcaccctccgcggcagcccctccccctcctgcccatgcactcggagggatggacgccgaactgattgacgaagaagcattgacctcccttgaactggaacttggactccatcgggtcagggaacttccggaactctttctgggacaatcggagtttgattgtttttccgaccttgggtcggcgccgcctgcaggatccgtctcttgc

SEQ ID NO: 8451 - DNA, 552 bp, Artificial Sequence
  Description of Artificial Sequence: Synthetic coding sequence
atggcagatcatctgatgctcgccgagggctataggttggtccagagaccgccaagcgccgccgcagcccacggaccacacgcacttcgaacactacctccatatgcagggccagggctagactcagggctgcggccgcgaggagcgccactgggcccaccacccccgcgccagcctggggcactagcatatggggccttcggccctccaagttcttttcagccctttcccgcagttccaccccctgccgcggggattgcacatctgcaacctgtcgccacaccatatcccggccgcgctgcagcaccacccaacgcccctggaggtcccccggggccacagcccgccccctcagccgcggcgcctccacctcctgcccacgccctgggtggcatggacgcggagctgatcgacgaagaagctttaacctctctggaacttgagctcggattgcatagggtgcgagaactcccggaactgttcctcggtcagagtgagttcgattgttttagtgacttaggaagcgccccccctgccggttcagtgtcctgc

SEQ ID NO: 8452 - DNA, 552 bp, Artificial Sequence
  Description of Artificial Sequence: Synthetic coding sequence
atggcggatcatctgatgctcgcggagggttatcgtctggtccagaggccgcctagcgctgccgccgctcatggaccccacgctctccgcacactcccaccatatgctggaccaggcctcgatagcgggttgcgccctcgtggagcacctctgggcccacccccaccccggcagccgggcgccctagcctacggtgcttttgggccgccgagttcattccagcccttcccagctgtgcctccacctgccgccgggatcgcccatctccagcccgtcgcaacaccatatccagggcgcgccgccgctcctccaaacgccccaggtggtccgcctggtcctcagccagccccctccgccgcggcgccaccaccaccagctcacgcgctgggcggtatggacgccgagctcatcgacgaggaggcactgacctctctcgagctcgagctgggcttgcatcgcgtaagagaacttcccgagctattcctgggtcagtccgagttcgattgtttttcagatctagggtccgctcccccggctggctcagtgtcctgt

SEQ ID NO: 8453 - DNA, 552 bp, Artificial Sequence
  Description of Artificial Sequence: Synthetic coding sequence
atggccgatcaccttatgcttgccgaaggataccggttggtccagcggccaccctcagctgccgcggctcacggcccacacgcgctgcggactctccctccgtacgccgggccaggactggatagcggactccggcctagaggcgcacctttgggccctcctccgcctaggcagcctggcgcgctcgcttacggagcatttggtcctccatcgtccttccaacctttcccagccgtgccaccgccggccgctgggatcgcccacctccaaccagtggccactccgtaccccggaagagccgccgctccacccaacgccccgggcggaccaccaggaccgcagcccgcaccatcggctgctgccccgccgcccccagcacacgccctcggaggaatggacgcagagctcatcgatgaagaagcgctgacttcactggagctggaactgggactgcatcgcgtgcgcgaactgccggagctcttccttggacagagcgagtttgactgcttctccgacctgggcagcgccccgccagccgggtcggtgtcatgt

SEQ ID NO: 8454 - DNA, 552 bp, Artificial Sequence
  Description of Artificial Sequence: Synthetic coding sequence
atggccgatcacctcatgctggcagaaggatataggctcgtgcaaaggcctcctagcgccgcagctgcccacggcccacacgccttgcgcaccctgccaccgtatgccggccctggactggattctggattgagacctagaggtgcccctctgggaccgccacctccacgccaacccggcgcccttgcatatggtgctttcggacctccttcttcattccagccttttcccgctgttcctcctcctgccgctggaatcgcgcatctccagccagtggcaaccccgtaccccggccgggccgccgctccgccgaacgctcccggcggaccacctggcccccaaccggcaccatctgctgctgcgcctccccctcccgcccacgctctgggcggcatggacgctgagttaatcgacgaagaggctcttacaagcctggaattggaactgggactgcacagagtacgcgagttgcccgagctgttcctcggacaaagcgagttcgattgcttcagcgacctgggaagcgctccacctgctggtagcgtatcttgc

SEQ ID NO: 8455 - DNA, 552 bp, Artificial Sequence
  Description of Artificial Sequence: Synthetic coding sequence
atggcggaccatctcatgctagcagagggttataggctcgtacagaggcctccctctgctgccgctgctcatggccctcacgccctgcgcacattgcccccttacgctggcccaggattagattctggactgcgccctaggggggcaccactgggacctccccctcctaggcagcccggcgccctcgcttacggagcttttggacctccaagttctttccaacctttcccagcggtaccacccccggcggccgggattgctcacctgcagcctgttgcaactccctatcctgggcgcgcggctgctccgcctaacgctccaggtggcccccccggcccacagcccgcaccttccgcagcagccccaccccctcccgctcatgccttgggcggtatggacgcagagctgatagacgaggaggccctgacaagcctggaattggagctgggattgcaccgcgttagagagctccccgagctctttcttggtcaaagcgagttcgattgcttcagcgaccttgggagcgccccaccagccgggtcagtgagttgc

SEQ ID NO: 8456 - DNA, 552 bp, Artificial Sequence
  Description of Artificial Sequence: Synthetic coding sequence
atggcagatcatcttatgctcgcagaaggataccgactcgtgcagcgacctcccagcgcagccgctgcgcatgggcctcatgcactgcgcaccctccctccatatgccggcccaggactggattccggactgcgcccacggggagcaccgctcggtcctcctccgcctcgtcagccaggcgcgctggcatacggagcctttggcccacccagctcgtttcagccctttcccgcagtccctcccccagcagcaggtatagcgcatctccaacccgttgccactccataccctggcagagcggccgcccctcctaacgcacctggaggacctcctggtcctcaaccagcaccatcggcagccgcaccacctcctcctgcacacgcacttggagggatggatgcagaactgattgatgaggaagcacttactagccttgaactggagttgggactgcatcgcgtcagagaactcccagaactttttctggggcagtccgagttcgattgtttttcggatcttggctcggcccctccagccggatccgtctcgtgt

SEQ ID NO: 8457 - DNA, 552 bp, Artificial Sequence
  Description of Artificial Sequence: Synthetic coding sequence
atggccgaccacctgatgctggctgaggggtatcgcctcgtacaaaggccgcccagtgccgctgccgcccacgggccccacgcgctgaggactctcccgccgtacgccgggcccgggctcgactctgggctgcgccctaggggcgcaccattgggccccccaccccctcgccagccaggggcactggcctatggtgcctttgggcccccaagttcctttcagccgttcccagctgtgccaccaccagccgctggcatagcacatctgcagcccgttgcaaccccatatcctggaagggctgctgctccgcccaacgcgccaggcggcccacctggacctcagcccgccccatcagcagcggccccacctccacctgcccacgccttgggaggaatggatgccgagttgatcgatgaagaggccctcacatccctcgaactggagctgggattgcatcgagtgagagagctgcctgaacttttccttggacagtccgaatttgactgctttagcgacctgggtagcgctcctccagcaggcagcgtgtcttgt

SEQ ID NO: 8458 - DNA, 552 bp, Artificial Sequence
  Description of Artificial Sequence: Synthetic coding sequence
atggcagaccatttaatgctcgccgaaggttaccgtctggttcagaggcccccgagtgctgccgcagcacacgggccccatgctttacgcacacttcccccgtacgcagggcctgggctggattcgggacttcgaccacgcggagcgcccctaggacccccgcctccaaggcagcctggggccctggcatacggggctttcggaccaccttcctcttttcaacctttcccggccgtgccccctcccgctgcgggcattgcacacctacaacccgtcgccacgccttaccctggccgcgccgctgctcccccaaacgctcctggtggcccccctggtccccaacccgctcctagcgctgccgctcccccacctccagcgcatgccctggggggcatggacgccgaactgattgacgaggaggccctgacgagcttggagttggagctgggtctgcatagagtgcgggagctacccgagctcttcctgggtcagagtgaatttgactgctttagcgacctgggaagcgccccgccagcaggttcagtgtcgtgc

SEQ ID NO: 8459 - DNA, 552 bp, Artificial Sequence
  Description of Artificial Sequence: Synthetic coding sequence
atggcagaccacctgatgctcgcagaaggatacagactcgtgcagcgcccgccttcggctgccgccgctcatggcccccatgccctccggaccctccccccgtatgctggccctgggctcgactccgggctgcgcccgaggggcgccccgcttggaccgccaccgcctcgccaacctggtgcgctggcttacggcgcattcgggcccccgtcgtccttccaaccattccctgctgtgcccccgccagcggcgggtatcgcccacctccagccagtcgcaaccccctacccagggcgggctgctgcgcctccaaacgcaccgggaggcccgccggggccgcagccggcgccctccgccgccgccccgcctccgccagctcacgcactgggaggtatggatgcagagttgatcgatgaggaagccctgacttcattggaactggagctgggactccaccgggtacgcgagctgcccgaattgtttctgggacagtcggaatttgactgtttctcagacctcggatctgccccaccggcaggatcggtgtcctgc

SEQ ID NO: 8460 - DNA, 552 bp, Artificial Sequence
  Description of Artificial Sequence: Synthetic coding sequence
atggccgaccacttgatgctggcggaggggtacaggctggtccagcgcccgccgtcagcggcagccgcccatggccctcatgcgctgagaaccttgcccccgtacgccggacctggactcgattcaggcttgcggccgcgcggggcgccgctgggtcctccaccaccaagacagccgggagcgctcgcatacggcgctttcggacccccgtcgtcatttcagccttttccggccgtgccacctcccgccgctggaatagcacacctccaacctgtggccactccatacccgggacgtgcagcggccccacctaacgccccaggtggtccgccgggaccacagccggctccgtccgccgctgccccaccgccgccggcgcacgcgctggggggaatggacgctgaacttatcgacgaagaggcattgacctcccttgagctggaactgggcctgcatcgggtccgggagctgcccgagctcttcctcgggcaaagcgaattcgattgtttctccgaccttggctcggcgcctcccgctggaagcgttagctgc

SEQ ID NO: 8461 - DNA, 552 bp, Artificial Sequence
  Description of Artificial Sequence: Synthetic coding sequence
atggcggaccacctgatgctcgccgaaggttaccggctcgttcagagaccgcccagcgccgctgcagcccatggtccccacgcccttcggacactgcctccatacgctggtcctggtcttgatagtggccttaggcctcgcggcgctccattggggccacctcctcccagacagccaggggccctggcctatggagctttcggacctcccagctcctttcagcccttcccggcggtccccccgccagctgccggcattgcacatctgcagcctgtggccaccccctaccctggcagagccgccgcacctcccaacgcacccggcggaccacctggaccccaaccggccccgagcgccgccgccccaccaccgcctgcacacgccctcggtggtatggacgcggagcttatcgatgaagaggccctgacatcgcttgagctggaactgggtttgcacagggtccgtgagttaccggagctgttcttggggcagtccgaatttgattgtttctccgaccttggcagcgcccccccagctggctctgtaagttgt

SEQ ID NO: 8462 - DNA, 552 bp, Artificial Sequence
  Description of Artificial Sequence: Synthetic coding sequence
atggcagatcatctgatgctggcagagggttacagattggtccaaaggccaccaagcgcagcagcagcccatggaccccacgcgcttcggactctcccgccatacgcaggcccggggctcgactccggtttgcgcccacgcggggccccactcggtccaccacctccaagacagcctggagcactggcatacggggctttcggaccgccatcctcctttcaaccgttccctgcagtgccccctcctgccgcagggattgcccatctgcagccagtggcgactccttaccccggcagggcagcagcacctcccaatgcaccaggtggaccacctggaccacagccagcaccgagcgccgccgcgcctccgccacctgcgcatgcactgggaggaatggatgcggagcttatcgacgaagaagcgctgacctccctggaattggagcttggactccatcgcgtgcgcgagctgcctgagctgtttctgggacaatcggaatttgattgtttttcggacctgggatccgcaccccctgctggtagcgtctcctgt

SEQ ID NO: 8463 - DNA, 552 bp, Artificial Sequence; identical to SEQ ID NO: 8429
  Description of Artificial Sequence: Synthetic coding sequence

SEQ ID NO: 8464 - DNA, 552 bp, Artificial Sequence
  Description of Artificial Sequence: Synthetic coding sequence
atggctgatcacctcatgttagcagaaggctaccggcttgtgcagagaccaccatcagctgctgctgctcacggaccacatgccttgcgtacacttccaccatacgcaggaccaggtttagatagcggccttcgcccgagaggtgcgcctttgggtccaccaccaccgcgacagcctggtgctctggcgtacggagctttcggaccgccatcgtccttccagccattcccagccgttccaccaccagcagcgggaatagcccatttacaaccggttgccacaccgtatccagggagggcggcggcaccaccgaacgcaccgggtggaccaccagggccacaaccagcaccatctgctgctgctccgccgccaccggcacatgctcttggaggtatggatgcggagctgatagatgaggaagcccttacatctcttgaactcgaacttggtctgcaccgagttcgtgagttgccagagctttttcttggacagtcagagtttgattgttttagcgatcttggatctgcaccaccggcaggtagcgtatcgtgc

SEQ ID NO: 8465 - DNA, 552 bp, Artificial Sequence
  Description of Artificial Sequence: Synthetic coding sequence
atggccgatcatttaatgctggctgagggctaccgcctagtgcaacggccaccctccgccgccgccgcgcacggaccccatgccttgagaacgctgcctccctatgccggaccaggcctcgactccggccttaggccacggggggctccactgggcccccctccacccagacagcctggggctcttgcttatggcgccttcgggcccccaagttccttccagcctttcccagccgtgccccccccagccgcagggatcgctcacctgcagcctgtcgcaacgccctaccctggtcgagccgctgcccccccaaacgctcccggaggcccaccgggcccccagcccgctcctagcgccgctgcccctccaccacccgcgcacgcgttgggggggatggatgccgaactcatagatgaagaggctctcaccagtcttgagctggaactgggcctgcatcgagttcgggagcttcctgagctgtttcttggccagagcgagttcgactgcttctcagatctgggttccgccccccccgcgggaagcgtgagctgc

SEQ ID NO: 8466 - DNA, 552 bp, Artificial Sequence
  Description of Artificial Sequence: Synthetic coding sequence
atggcagaccatctcatgcttgccgaaggctacaggctggtgcagcgacctccatcagccgcagcagcacacggcccacatgcccttaggacccttcctccttacgcaggaccgggtctggattccgggctgcgtcctcgtggcgcccccctcgggcctccacctcccagacaacctggtgccctggcgtacggcgcttttgggccaccatcgtccttccaaccatttccagctgtgcccccacccgccgccgggatcgcccacctgcaaccagttgcaactccttaccccggacgtgcggcagcaccacccaatgcaccaggcggtccacccggaccacagcctgcgcctagcgcagcagcacctccccctcctgcgcatgcactgggtggcatggatgcggaattgattgatgaagaggcgcttacctcgcttgagctcgaactcggtctgcatcgcgtgagagaactccctgaactttttcttggacaatcggaatttgactgtttctccgatctgggaagcgcaccaccggctggatcagtctcttgt

SEQ ID NO: 8467 - DNA, 552 bp, Artificial Sequence
  Description of Artificial Sequence: Synthetic coding sequence
atggccgaccacctgatgttggccgagggctaccggctggtgcagaggcccccatctgctgcagccgcacacggacctcacgcacttaggacactgcctccttacgccggccccggtcttgactccggccttcgtccacgaggcgccccgctagggccccctccacctcgccagccgggggcgctggcttatggggcctttggaccgcccagttccttccagcccttcccagcagtgccccctcccgctgctgggattgcccatctccagccagtggccaccccttatccgggacgcgctgccgcccctccaaacgccccgggaggcccccccggcccccagcctgctccaagcgctgccgcaccaccccctcccgcccacgccttgggtggcatggatgccgagctgattgatgaggaagctctcactagcctggaactggaattgggactgcatcgggtccgcgagctcccagagctatttttgggacaatctgagttcgattgcttctcggatctgggttccgcaccacctgccggttcggtcagctgc

SEQ ID NO: 8468 - DNA, 552 bp, Artificial Sequence
  Description of Artificial Sequence: Synthetic coding sequence
atggccgatcatctgatgctcgccgaagggtaccgcctcgtccagcgcccaccctccgccgccgcggctcacggaccccatgccttgcgaactctgccaccgtacgctggcccagggcttgactctggtcttcgacccagaggggcccctttggggccgccgcctcctaggcagcccggagccctcgcctatggcgcctttggcccccccagcagctttcagcccttcccggccgtccccccaccggccgccggaatcgcacacttacagcctgtcgcaacgccataccccggcagggccgccgctccgcctaatgcacccggaggaccccccggaccacagcccgctccttctgctgctgctccccctccaccagctcacgccctggggggcatggacgcagagcttattgatgaagaagccctaacaagcctcgagttggaattgggcctccaccgcgttcgagagctgccagagttgttcctgggtcagagcgagttcgactgcttctcggacttagggagcgcacccccagctggaagtgtcagctgc

SEQ ID NO: 8469 - DNA, 552 bp, Artificial Sequence
  Description of Artificial Sequence: Synthetic coding sequence
atggcagatcatctcatgcttgcagaaggctatcgcctggtgcagcgtccacccagtgctgctgccgcacacggacctcatgcgctgcggacgttgcctccctacgcgggcccaggcctggactccggcctccgtcctcggggtgccccactgggacctccgccccctcgtcagcccggggccctagcctacggcgcattcggccctccaagtagcttccagccctttccagcagtacctcctcccgccgcgggaattgctcaccttcagcctgtggccaccccttaccccgggcgggcagcggctccccccaacgcccccggcggaccccccgggccccagcccgcgcctagcgctgcagctccccccccccctgctcacgctcttggcgggatggatgcggagttaattgatgaagaagcattgaccagcctcgagctcgagctgggcctccatagggtccgtgagctgcccgagctttttctgggacaaagcgagttcgactgctttagtgatctagggtccgccccacctgccgggagtgtgtcgtgt

SEQ ID NO: 8470 - DNA, 552 bp, Artificial Sequence
  Description of Artificial Sequence: Synthetic coding sequence
atggctgatcacctgatgctggcagaagggtaccggctggtgcagcgcccgccgagcgctgcggctgctcacggcccgcatgccctccgcaccctgcccccgtacgcgggaccgggactggactctggactgcgcccgaggggcgcgccactcgggcctccgccgccacggcagcctggtgccctcgcatacggcgcctttgggcccccatcatcgtttcagcctttcccagcagtcccgcctccggcggctggcatcgcgcacctgcaaccggtcgccactccttatccgggaagggcggcggcccctcccaacgcgcccgggggaccccccggtccgcaaccagcacccagcgctgcggcacctccaccgccggcacacgcgttggggggaatggacgcagaactgatcgacgaagaggctctcacctccctggaactggagctcggattgcatcgagtccgcgagctcccggaactttttctcggacagtcggagttcgattgtttttcggaccttggctctgcaccaccagcgggctcggtgtcgtgc

SEQ ID NO: 8471 - DNA, 552 bp, Artificial Sequence
  Description of Artificial Sequence: Synthetic coding sequence
atggcggatcatcttatgctcgcggaaggatacagactcgtgcagcggccaccaagcgcggcagctgcgcacggaccgcacgctctgcgcactctgccaccatacgccggccctggactggactccgggctccggccacgcggagcaccccttggtccgccacccccacgccagccaggtgccctggcgtatggggctttcggcccgccgtcctcgttccaaccgttcccggccgtcccgccacctgctgctggtatcgcacacctgcagccggtggctacgccgtacccaggcagggcggctgcgccgccgaacgctcccgggggtccgcctggaccgcagcccgcaccgagcgctgctgccccacctccacccgcccacgcactcggcggcatggacgccgagctgatcgatgaagaagctctgacttccctcgagctcgaactgggactccaccgcgtgagagagctgccggaacttttcctcggacagagcgaattcgactgcttctctgacctcggatcagcgccacctgccgggtccgtctcatgc

SEQ ID NO: 8472 - DNA, 552 bp, Artificial Sequence
  Description of Artificial Sequence: Synthetic coding sequence
atggcagaccacctcatgctggctgagggttatcggctggtgcagaggcctccatcagctgcagccgcccacggaccacacgccttgaggaccttgccaccatatgctggccctggactggactccggcctgcgtccccgcggggcaccccttgggcctcccccacctcgccaacctggtgctctggcctacggtgctttcggtcctccgtcctcttttcagccatttccagccgtgccaccccccgcagccggcatcgcgcacttacagcctgtagcgactccctatcctggtcgcgccgccgcacctcctaacgcaccaggggggccacccggaccccagcctgccccctccgcagctgcacctccacctccagcccatgcgctcggaggtatggacgctgaactgattgatgaagaagctctcacatccctggagctggagctcggactgcaccgtgttcgggagctaccagagctcttcttgggacagtctgagtttgactgtttttccgacttaggcagcgcaccgcccgccggcagcgtttcctgc

SEQ ID NO: 8473 - DNA, 552 bp, Artificial Sequence
  Description of Artificial Sequence: Synthetic coding sequence
atggcagaccacttaatgcttgccgaaggttacagactggtgcagcgaccaccttctgctgccgccgctcacggcccacatgcgctgcgaacgttgcctccttacgccggccctgggctggattctgggctgaggccgcgaggcgctccgttaggccctccccccccccggcagccaggagctctcgcatacggcgcgttcggcccaccatcaagttttcaacctttccccgccgttccacccccagccgcaggcattgcccatctccagccagtcgccaccccataccccggtcgggctgctgcaccaccaaacgctcccggtgggccccccggccctcagccggccccctccgctgcggcaccaccaccccccgcacacgcactgggcggcatggatgccgagctgattgatgaagaagcactcactagcctggaactggagttgggactgcatagggttagggagttacccgagttgtttctggggcagtctgagtttgattgtttctctgacctggggtcggcgcctcctgccggtagcgtgagttgc

SEQ ID NO: 8474 - DNA, 552 bp, Artificial Sequence
  Description of Artificial Sequence: Synthetic coding sequence
atggctgaccatttgatgctcgccgagggatatcgccttgtgcaacgtccaccgagcgccgccgctgcacacgggccgcacgcactccggaccctgccaccctatgccggccctggactcgattcaggcttacgcccacgaggcgccccactgggaccaccgcccccccgacagccaggagccctcgcatacggcgcatttggcccaccctcaagtttccagccttttccagcagtacctcctccagctgctggtattgcacatttgcagcccgtcgcaacaccctacccaggccgggccgccgctccgcctaatgcaccagggggacccccaggaccacagcccgccccatcagcagcagcaccgcctccccctgctcatgccctgggcggaatggacgcggagctaattgacgaagaggctcttaccagcctagagctagaactgggcctgcaccgtgtccgcgagctccccgagctttttctgggtcaatcagaattcgattgcttctccgatctggggagtgcacctcccgcggggagtgtctcttgt

SEQ ID NO: 8475 - DNA, 552 bp, Artificial Sequence
  Description of Artificial Sequence: Synthetic coding sequence
atggcagaccacttaatgttggctgaaggctatcgtcttgtccaaagaccgccttctgcggctgcagcccatggcccacatgcgcttcgaaccctccctccttacgcaggtcctggattagattcaggattgagaccgaggggggcaccgttgggtcctccgccacctcgtcagccgggagctttggcatacggagcctttggaccaccgtcttcctttcagccttttccagcagttccaccgccagctgcaggtatcgctcacctgcagccggtcgcaacaccttatcctggcagggctgctgcgccacctaacgcacccggcggaccgccgggtcctcagccggcgccttccgccgcggcaccaccgccgccagcacacgctttggggggcatggatgccgagctcattgacgaggaagcactaacaagcttagagttagaactaggtcttcatcgagtacgcgaactccctgaactgtttctgggtcagagtgaatttgattgcttttccgatctgggaagcgctccgccggcgggttcagttagttgt

SEQ ID NO: 8476 - DNA, 552 bp, Artificial Sequence
  Description of Artificial Sequence: Synthetic coding sequence
atggccgaccacctaatgttggccgaaggataccgtctggtgcagcggccgccatccgcagccgctgcccacgggccacacgcactaaggactctgcctccctatgccggcccaggtctggatagcggtctgcggccccgcggagctccacttggcccaccacctcccaggcaacccggagctttagcctacggcgccttcgggccgccctcctcattccagccattcccagctgtacccccacccgctgcgggaatcgcccatctgcaacccgtcgctaccccttaccctggaagggccgccgcaccgcctaacgccccagggggtccccctggcccacaacccgcaccgagcgctgctgcaccccccccaccagcgcatgctcttggaggcatggacgcagagttgatcgatgaggaggccctaaccagtctagagctggagctggggctgcaccgggtccgcgaactccccgagctgttccttggccagtcagagtttgattgttttagtgacctggggagcgccccccctgccggatccgtctcctgt

SEQ ID NO: 8477 - DNA, 552 bp, Artificial Sequence
  Description of Artificial Sequence: Synthetic coding sequence
atggcggatcacctcatgctcgccgaaggttaccgtttggtccagcgaccccctagcgcagccgcggcacacggaccccacgccctgagaactcttcccccctacgcaggcccagggctggactcggggctcagaccgcgtggtgccccactcggaccaccacctccgaggcagccgggggcgctcgcctacggtgcattcggccccccatcctctttccaaccttttccggccgtccctccaccagccgcaggcattgcacatctccaacctgtcgcaactccgtacccaggtcgggcagccgcgccgccaaacgcaccggggggcccacctggtcctcaacctgccccctcggcagcggcaccgccccctcctgcacatgccttggggggaatggatgcagaactgatcgatgaggaagccctgacgagccttgaactcgaacttggtttgcatcgcgttcgagaactccctgagcttttccttgggcagtcagagtttgattgcttttccgatctgggaagcgctcctcctgccggatcggtgtcctgt

SEQ ID NO: 8478 - DNA, 552 bp, Artificial Sequence
  Description of Artificial Sequence: Synthetic coding sequence
atggccgaccacctgatgctggcagagggataccggctggtccagcgccctccatcagccgccgcagcccatggaccgcatgccctcaggaccttgcctccatacgcaggaccggggctcgattccggactgaggccccgtggcgctccgctcggaccgccgcccccgcgccagcctggagctctggcgtacggggccttcggaccaccttcgtcctttcagccattcccagccgttcctccgccggccgctggaattgcccacttgcagccggtggcgaccccctacccgggacgcgccgccgcccctcctaacgctccaggagggccaccggggccgcagcccgcgccgtctgcggccgccccgcccccgccggctcatgctcttggcggcatggacgcagaactcatcgacgaagaagccctcacctcgctggaactggaactgggactccatagagtgcgcgaattgccggaactttttcttggacaatccgaattcgattgcttcagcgacctgggaagcgcgcccccggcaggctcggtgtcgtgc

SEQ ID NO: 8479 - DNA, 552 bp, Artificial Sequence
  Description of Artificial Sequence: Synthetic coding sequence
atggccgaccaccttatgctggccgagggataccgcctggtgcaaagaccgccatcggctgctgccgcacacggaccccatgcgctgagaactctgcctccgtacgccggcccgggattggactcgggactgcggcctcggggtgccccgctgggacccccgccgccacgccaaccaggagcactcgcgtacggcgctttcggaccgccctcgtccttccagccgttccctgccgtgccaccaccggcggcaggaattgcgcatctccagcccgtcgctaccccttacccgggacgagctgcagcccctccaaacgctccgggcgggccgcctgggcctcagccggcgccctcagcggccgcaccacctccaccggcgcacgcgctgggcgggatggacgccgagctgatcgacgaagaagccctgacctcactggaactcgagctcggccttcacagagtccgagaacttccagaactctttttgggtcagtcagaatttgattgtttcagtgatctggggagcgccccgccggccggctccgtgtcctgc

SEQ ID NO: 8480 - DNA, 552 bp, Artificial Sequence
  Description of Artificial Sequence: Synthetic coding sequence
atggcggatcatcttatgctcgctgagggttaccgcctggtgcaaagacctccctccgccgcggccgcacatggaccacacgctctcagaaccctgcccccatatgcaggaccaggactggattcgggcctgaggcctagaggcgccccccttgggccaccaccacctagacaacctggagcactggcatacggagcatttggtcctccctcgagctttcaacctttccctgcagtccctccacccgccgccggaatagcacatctgcaacctgtggcaactccttaccctggccgcgcagcagccccaccaaatgccccaggtggtcctccaggccctcaaccagcgccttccgctgcagcgcctcccccgccagcccatgcactgggaggtatggatgccgaactcatcgacgaagaagcattgacctcccttgagctggaactgggactgcaccgggtgagagagctcccagaactgtttctcggacagagcgagtttgattgtttttccgaccttggaagcgcaccgcctgccggaagcgtgtcatgt

SEQ ID NO: 8481 - DNA, 552 bp, Artificial Sequence
  Description of Artificial Sequence: Synthetic coding sequence
atggcggatcatctgatgcttgcagaaggatatcgcctcgtccaacggcctccttccgccgcagctgcgcatggtcctcacgcactcagaacccttccgccatacgcaggccctgggctggactctggacttcggccaagaggggccccactcggccctccccctccgaggcagcctggagcacttgcatacggagcatttggaccaccctcctcattccaaccatttcccgcagtgcctccacccgctgcagggatagcacatctgcagccagtcgctaccccttaccctggtcgagcagcagccccgcccaacgccccgggtgggccaccaggtccccaacctgctccaagcgctgcggctcctcctcctccagcacatgcccttggaggcatggatgcagaactgattgatgaagaagcacttacttcgcttgagttggaactcggtctgcaccgagtgcgcgagctcccagaactctttttgggccaatccgagtttgactgcttcagcgatctgggctctgctcccccggcaggatcggtgtcgtgt

SEQ ID NO: 8482 - DNA, 552 bp, Artificial Sequence
  Description of Artificial Sequence: Synthetic coding sequence
atggcggatcacctcatgttggctgaaggatacaggctggtccagcggccaccctcagctgctgctgctcacggaccacacgcacttaggactctgccgccatacgctggaccagggctcgactccggcctgaggcctcggggcgccccactgggcccaccccctccaagacagcccggtgcactggcttacggagcattcgggcccccatccagcttccagccttttccggccgtgccaccgccggctgcgggtatcgctcatctccagccagtggctaccccctatccagggagagccgccgccccacctaatgcccctggtggaccgccagggccacagcctgcaccttcagctgcagccccaccacctccggctcatgcattgggcggaatggacgccgaactcatcgacgaagaagccctcacctctttggagctggagctcgggttgcaccgcgtgcgcgagcttccagaactgtttttgggccagagcgagtttgactgtttctctgaccttggatccgcccctccagctggaagcgtcagttgt

SEQ ID NO: 8483 - DNA, 552 bp, Artificial Sequence
  Description of Artificial Sequence: Synthetic coding sequence
atggcggaccacctgatgctcgctgaaggataccggctggtgcagcgcccaccgagtgctgctgcagcgcatggcccacatgcacttcgaaccctgccgccgtacgccgggccgggactggactcgggactccggcctaggggagctccactgggcccgcccccaccgcgccaaccaggcgctctggcctacggcgcatttggaccaccaagcagcttccaaccctttcctgcagtgccaccaccggccgccggtatcgcacatcttcagccagtcgcaaccccatacccggggagagcggccgcgcctcctaacgccccgggcgggcctcccggaccgcagccggcccctagcgcagctgcccctcctcctccagcacatgctctcgggggaatggatgccgagctgatcgacgaggaagcactgacttcgctggagctggaactcgggctgcaccgggtgcgcgaactgccggagctctttcttggtcagtcagagttcgattgcttctcagatcttggaagcgctccgcctgcgggaagcgtgtcgtgt

SEQ ID NO: 8484 - DNA, 552 bp, Artificial Sequence
  Description of Artificial Sequence: Synthetic coding sequence
atggccgaccatctcatgctggcagagggatacaggttggtccagaggcctccgagcgcagctgctgctcacggaccgcacgcgctgaggactctgcctccgtatgctggccccggtctggattctggccttagaccaagaggagccccacttggtcctcctccacctaggcagccaggcgctttggcttacggtgcctttggccctcccagttcatttcagccctttccagccgtgccaccccccgccgcgggtatagcgcacctgcagccggtcgccaccccttacccaggccgcgcggctgctcctccaaacgctccaggaggaccccctggcccacagcccgcaccatcagctgccgctcccccccccccggcccacgcgcttggaggaatggatgcggagttgatagacgaggaggccctgacatctttggaactggagctgggtctccatagggtgcgcgaactgcctgagctgttcctgggtcagtcagagttcgactgtttctccgatctcggcagcgctccgccagccggttctgtaagctgt

SEQ ID NO: 8485 - DNA, 552 bp, Artificial Sequence
  Description of Artificial Sequence: Synthetic coding sequence
atggcggaccatctcatgctggctgaaggctatcgccttgtgcagagaccaccatccgctgccgctgcacacgggccccacgctctgcggactctgcccccttatgccggcccaggcctggatagtggactccgcccaaggggagcccccctaggaccaccccccccccgccaacccggagcactcgcttacggtgcattcggaccccccagctccttccagcctttcccggccgtgccacccccagcagcagggatcgcacatctgcagcctgtggcgacaccctatcccggtcgcgccgccgcccctccaaatgcacccggaggacctccagggccacagccagccccaagcgcagctgctccccctccccccgcccatgcgctgggcggaatggatgctgagctcattgatgaggaagctctcactagtctggagctggaactgggactgcaccgggtgcgcgagctacctgagttgtttttgggtcagtcggagtttgactgcttttctgacctcggaagcgcccctcctgccggttccgtgagttgt

SEQ ID NO: 8486 - DNA, 552 bp, Artificial Sequence
  Description of Artificial Sequence: Synthetic coding sequence
atggcggaccatctgatgctggctgaggggtatagactcgtacagcggcctccttcagcagcagccgcgcatggtccacatgctctccgcacattgcccccgtatgccgggccaggtttagacagtggactaagacctaggggtgcaccactggggcctccccccccaaggcaacccggagccctggcatacggcgcttttggcccccctagcagcttccagccttttcctgctgtgccgcctccagccgccgggatagcacacctccagcccgtcgctacgccctaccctgggagagcggccgctccacccaacgccccagggggaccacccgggccacaacccgctccctcggcggccgctcctccccctcccgcacatgcactggggggcatggacgctgaactgattgatgaggaggccctcacgtctttagagctggagctgggtctccatcgcgtgcgcgaactcccagagttgttcctggggcagagtgagttcgactgttttagtgacttgggcagcgcaccaccagccgggtcagtctcctgt

SEQ ID NO: 8487 - DNA, 552 bp, Artificial Sequence
  Description of Artificial Sequence: Synthetic coding sequence
atggcagatcatctgatgcttgcagaaggatacaggctcgtccagaggcctccctcagcagcagcggcgcatggccctcacgcactcaggaccctgcctccatacgcagggccaggcctggactctggacttagaccacgcggcgcacctcttggccctccacctcctagacaacctggtgcactggcctacggagcgtttggacctccttcatcgtttcagccttttccagcggtccctcctccagccgccggtatcgcgcatcttcaacctgtggccactccatatcccgggagagccgccgcacccccaaatgctccgggtggtcccccggggccacagccagcaccctcggcagcagcccctccaccgcctgcacacgcactgggtgggatggatgccgagctgattgatgaagaagccttgacttccctcgagctggaactcggtctgcatcgtgtgcgggaactgcctgagctgtttttgggacagtccgaattcgattgcttctcggaccttggctcagcaccacctgcgggaagcgttagctgc

SEQ ID NO: 8488 - DNA, 552 bp, Artificial Sequence
  Description of Artificial Sequence: Synthetic coding sequence
atggctgatcacttaatgctggcagaaggttataggctagttcaaaggcccccatcggccgcagccgctcacgggccacacgcccttagaactttgcccccctacgcaggcccagggctcgattccggtctgaggcctcggggcgctcccttgggccctccacctccccgtcagcctggtgccctggcctatggcgctttcggcccaccttcctccttccagccttttccggccgtccctccacctgctgctggaatcgcccatctgcagcccgttgccaccccctaccctgggagagccgccgctcctcccaacgctcccggcggtccccccggtccacagccagccccaagcgctgctgctcctccgccacccgcccacgcactgggaggcatggatgccgaattaattgacgaagaggcactgacctcgctggagctggagttgggtctccacagggtcagagagctacccgaacttttcctcgggcagtctgaatttgactgtttcagtgatctcggtagcgctcctcctgcaggctctgttagctgt

SEQ ID NO: 8489 - DNA, 552 bp, Artificial Sequence
  Description of Artificial Sequence: Synthetic coding sequence
atggcggatcaccttatgcttgccgaagggtatcggttggtgcagcgccccccttctgcggctgcagcccacggaccccatgctctgcgcactctgcccccctatgcagggcccgggctcgattccgggttgagaccgcggggggcccccctgggacccccgcccccgcgccaacccggagcattggcatatggagccttcgggccacctagttcgttccagccattccccgcagttcctccccccgctgcaggaatagcacatctccagcctgtggctactccttatccaggacgggccgccgcgcccccaaacgctcctggaggaccacctggaccacagccagcaccttctgctgcagctcctcctcctcctgcccacgcattaggagggatggacgccgaacttatcgatgaagaggcactcacaagtcttgaactagaactggggcttcaccgagtgcgcgaattaccagaacttttcctaggacagagtgaattcgattgttttagtgacttaggatccgcaccacccgctgggtccgtctcatgt

SEQ ID NO: 8490 - DNA, 552 bp, Artificial Sequence
  Description of Artificial Sequence: Synthetic coding sequence
atggcagaccacctgatgctggctgaaggataccgccttgtccagcggccgccgtccgcggcggccgcccatggtccgcacgccctgagaacgctgccgccctacgccgggccaggactggattccggtctgcgccccaggggtgcgccactcgggccacccccgccgcggcagccaggagcgttggcctacggagcatttggaccgccgagctctttccagccattcccggccgtcccaccccctgccgccggtatcgcacacttgcagccggtggcgaccccgtacccgggacgggcggcagcacctccgaatgcaccaggtggcccgcctggaccgcagccagccccatcagcggcagccccaccgccgccagcccatgccctcgggggcatggacgccgaactcatcgatgaagaggctctgacctcgctggaactcgagctcgggctccatcgggtgcgagagctcccggagctgttcctggggcagtcagaatttgattgcttctccgacctcggctccgcgccgcccgctggatcagtctcgtgc

SEQ ID NO: 8491 - DNA, 552 bp, Artificial Sequence
  Description of Artificial Sequence: Synthetic coding sequence
atggccgatcacctcatgctagcagaagggtatcggctggtccagcgccccccatctgccgcagcggctcatggaccgcatgctctgaggacactgccaccatatgctggccccgggttggatagtgggctgagacctcgaggggccccgttgggaccacctcctccccgccaacctggagccttagcttatggagctttcggccctcctagtagcttccagccttttccggctgtgcccccccccgccgcagggatcgctcacctgcagcctgtcgctaccccttatcccgggcgggccgccgctcctcctaacgcccctggaggccccccgggcccccagcccgcaccaagcgccgcagcccctccgcccccggcacacgcactaggcggcatggatgcagaacttatcgatgaagaagccctcacttcccttgagctcgaactgggactacacagggtgcgggagctccccgagctgtttcttgggcagagtgagtttgattgcttctcagacctgggttctgccccccctgctggatcagtcagttgt

SEQ ID NO: 8492 - DNA, 552 bp, Artificial Sequence
  Description of Artificial Sequence: Synthetic coding sequence
atggccgatcacctgatgctcgctgaaggttaccgcctcgtgcagcggccgcctagcgccgccgcggcccacggtccgcacgcattgagaaccctgccaccctacgccggacctggcctggactccggcctccgaccgcggggtgcaccgctgggaccgcccccaccacggcaaccaggtgccctggcctacggagcctttgggccaccttcaagtttccagccgttccctgctgtcccgccgccggccgccgggatcgctcatctccagcccgtcgccaccccctacccgggacgcgcggccgctccaccgaacgcgccaggcggcccaccaggcccgcagccagcaccatccgccgccgcgcctccgcctcctgcacatgcactcgggggaatggacgctgaattgatcgacgaggaagcacttacttccctggagctggaactcggcctgcacagagtgcgcgaattgccagaattgtttctggggcaatcggaattcgattgcttttccgatctgggctcggctcctccggccggctccgtcagctgc

SEQ ID NO: 8493 - DNA, 552 bp, Artificial Sequence
  Description of Artificial Sequence: Synthetic coding sequence
atggcggaccatctcatgctggccgaagggtatcgccttgtgcagcgtcctcctagcgcggctgcggcccacggtcctcatgctctgagaactctgccgccatatgccggtccgggcctcgactccggactgcgacctcggggagcaccactgggcccaccgccaccccgccagcctggtgctcttgcatatggcgcctttggccctccttcttccttccaaccctttcccgccgtgccgccaccggccgccggcatcgcccacttacagcctgttgcaacgccatacccgggccgcgctgcggcccctccgaacgcaccaggaggtccccctgggccacagccagctcctagcgcagccgccccaccgcccccggcccacgccctgggcggtatggacgccgagcttatcgacgaagaggcattaactagcttggagctggagctgggcctccaccgcgttcgcgagctccctgagctcttcctgggacagtccgagttcgactgttttagcgacctgggcagcgcacctcctgctggcagcgtgtcctgt

SEQ ID NO: 8494 - DNA, 552 bp, Artificial Sequence
  Description of Artificial Sequence: Synthetic coding sequence
atggcagatcatctgatgctcgcggaaggataccgattggtccagcgcccacctagtgcggcagcggcacacggaccacatgcccttaggacgctcccgccgtacgcggggcccggcctggattccggcctccgtccgaggggtgctccgctcggaccaccaccaccgcgccaacctggcgctcttgcttacggtgccttcggtccacctagcagctttcaacctttcccggccgtgcctccacctgcagcgggtatcgcacacctgcaaccggtcgccaccccctaccccggacgcgccgctgcccctcctaacgccccgggagggccccccggaccgcagccggcgccttcagctgccgctccacctccgccggcacacgccctgggaggaatggacgccgaactgattgatgaagaagcgctgacctcgcttgagctcgaactgggactccatagagtcagagagctgccggagctcttcctgggccagtccgaattcgactgcttcagcgacctcgggtcagccccgcctgccggctcggtgtcgtgc

SEQ ID NO: 8495 - DNA, 3195 bp, Artificial Sequence
  Description of Artificial Sequence: Synthetic coding sequence
atgaaaattcttatccttggtatctttcttttcctgtgctcaacaccagcctgggctaaggaaaagcactactatatcggaatcatcgaaactacttgggactacgcctctgatcatggcgagaaaaagctgatctcagttgacactgagcattccaacatttacctgcagaatggcccagataggattggaagattgtataagaaagctctctacctgcagtatactgacgagacctttagaaccactattgagaagccagtgtggctgggctttctgggcccaattatcaaggctgagaccggcgataaagtgtacgtgcatcttaaaaacctggcgtctagaccatataccttccactctcacggaatcacgtactataaggagcatgaaggcgcaatatatccggataataccactgactttcaaagagctgatgataaggtgtatccgggtgaacagtatacatacatgctgctcgctaccgaagaacagtcaccgggtgaaggcgacggaaattgtgtcaccagaatctatcattcccacattgacgcccctaaagacatcgctagcggccttattggccccttgattatttgcaaaaaggactccctggataaggagaaggaaaaacacatcgaccgcgaattcgtggtgatgttctctgtcgtcgatgagaatttctcatggtatttggaggataacataaagacgtactgctccgagcctgaaaaggtagataaggacaacgaggacttccaggagtctaaccgcatgtacagcgtgaatggttacaccttcggctccctgccaggtctttctatgtgtgcagaagatagagtgaagtggtaccttttcggcatgggaaacgaggtggacgtgcacgccgccttctttcatggacaggccctcacaaacaagaattaccgcattgacaccattaacctgttccctgctacgctgttcgatgcatacatggttgctcagaacccaggcgagtggatgctctcctgtcagaatctgaaccaccttaaagcaggacttcaagccttcttccaggttcaagagtgtaataagagctcctctaaggataatattagaggtaaacatgtgcgccactattacatcgccgcagaggagatcatttggaattacgcgccaagcggaatcgatatctttactaaggagaacctgaccgcacccggctcagattcagccgttttcttcgagcagggtactacgagaataggtggatcatataaaaagctcgtgtacagagagtataccgacgccagttttaccaaccgcaaagagcgcggtccagaagaggagcatctgggtatccttggcccggtgatctgggcagaggtgggagataccatccgcgtgacgttccacaacaagggagcttacccgctctctatcgagcctatcggagttaggttcaacaaaaataacgaaggaacttactatagccccaactacaaccctcagtctagaagtgttcctcccagcgcttctcacgtcgctcctacagaaacatttacttacgagtggaccgttcccaaggaagtgggtcctacgaacgccgatcccgtttgcctggcgaagatgtactacagcgccgtcgaccctaccaaggatatcttcacaggcctgattggtccaatgaagatctgcaagaaaggtagcttgcacgccaacggcagacagaaagatgtggacaaagaattctatctcttccccactgtttttgatgagaatgaatctctgctcctggaagacaatataagaatgtttaccacagctccagaccaggtcgataaggaggacgaggacttccaggagtcaaataaaatgcactcaatgaacggcttcatgtacggtaaccaacccggcctgactatgtgtaagggcgattcagtggtgtggtacttgttctcagcaggtaacgaggcagacgttcatggcatttacttttctggcaatacctacctttggcgcggcgaaaggcgcgacacagctaacttgttccctcaaactagcctgacgctgcatatgtggcccgacaccgagggtaccttcaacgtggaatgtctgaccacagatcactatacgggaggaatgaagcagaaatacactgtgaaccaatgccgccgccaaagtgaagactccactttttatcttggagagaggacatattacatcgccgctgtggaggtagagtgggactactccccacagagagaatgggagaaagagcttcatcacctgcaagagcagaatgtttcaaacgcgttcctggacaagggcgaattttacatcggaagtaagtacaaaaaagtggtctacagacaatatacagactccaccttcagagtgccagtggaacgcaaagctgaggaggaacatttgggtatcctgggacctcaactccacgccgacgttggagacaaggtcaagataatttttaaaaatatggctaccaggccctacagtatccacgcccatggcgtccagacagaatcctctacggtaacaccaacattgccaggcgaaactctgacatacgtctggaagataccagaacgcagtggtgccggtaccgaggacagtgcatgtatcccctgggcatactactctaccgtcgaccaggttaaggacctctatagcggactgatcggcccacttatcgtctgtaggaggccctatctcaaggtattcaaccccagacgcaagctggagttcgccctcctgtttctggtgtttgacgaaaatgaatcctggtacctggacgataatattaaaacatactccgatcaccccgagaaagtcaacaaagatgacgaagagttcatcgaatcaaacaagatgcacgcaattaacggcagaatgtttggtaacttgcagggactgacaatgcacgtgggtgacgaggtgaattggtatctcatgggaatgggtaacgaaattgatctgcatacagtccacttccatggccacagtttccagtataagcaccgcggagtatactcaagtgatgtttttgatatcttcccaggcacataccagactctggagatgttcccaagaacaccaggaatctggctgctccactgccatgtgaccgaccatatacacgctggcatggagaccacctacaccgtcttgcagaatgaggatacaaaatctggt

SEQ ID NO: 8496 - DNA, 3195 bp, Artificial Sequence
  Description of Artificial Sequence: Synthetic coding sequence
atgaagatcctcatcctcggcatcttcctgttcctttgctcgactcctgcatgggccaaggagaaacactactacatcggaatcatcgagactacgtgggactacgccagcgaccacggagaaaagaagctgatctcggtggatactgagcactctaacatctaccttcaaaatggaccggaccgcatcggcagattgtataagaaggccctgtacttgcaatacactgacgaaaccttcagaaccaccatcgaaaagccagtttggctggggttcttgggacccattatcaaagcagagacgggcgataaggtctacgtccatcttaagaacctggcttcgcgcccatacacgttccattcccatggaatcacctactataaagagcacgaaggagctatctacccggacaataccactgacttccaacgggctgacgacaaagtgtacccgggtgaacaatacacctacatgttgctcgctactgaggagcagagccctggggaaggcgacggaaactgcgtgaccaggatttaccattcccacatagacgcccctaaggacattgcctctgggctcatcggaccgctcattatctgcaaaaaagactcgctcgataaagagaaggaaaagcacatcgaccgggaatttgtggtgatgttttcagtggtggacgaaaacttcagctggtacctggaggacaacatcaagacttactgctcagaaccagaaaaagtcgacaaggacaacgaggacttccaggaatctaaccgcatgtactcagtcaatggatacacctttgggagtctgcctggcctgtcgatgtgcgcggaggatagggtgaagtggtacctgttcggaatggggaacgaggtggatgtgcacgcggccttcttccacggacaggctttgaccaataagaactaccgcatcgacaccatcaacctgttcccggccactctgtttgatgcctacatggtggcacagaatcctggtgaatggatgctcagctgtcagaacctgaatcatctcaaggccgggcttcaagcattcttccaggtgcaggaatgcaataagtcctcctctaaagacaatatcaggggcaagcacgtgcgccattactacatagccgctgaagaaatcatctggaactacgcgccttcaggaatcgacatctttaccaaggagaacctgacggccccggggtcggactccgccgtgttcttcgaacaggggactacccgcatcggaggaagctacaagaagctggtgtatcgcgaatacaccgacgcatcattcaccaaccgcaaagaacgggggccagaggaagagcatctgggcatcctgggtccggtgatctgggctgaagtgggcgacacgatccgcgtcacgttccacaataagggggcatacccactcagcattgagcctatcggcgtgcgcttcaataagaataacgaagggacgtattactcgccgaactacaatccacaaagccggtccgtgcccccttccgcgtcacacgtggcccctactgagacgtttacttacgaatggaccgtccccaaggaagtcggtccgaccaatgccgatccagtgtgcctggccaagatgtattactcggcggtggatccgaccaaggatatcttcactggactcattggaccgatgaagatttgtaagaagggctccctgcacgcaaacggacggcagaaggatgtcgataaggaattctatctgttcccgacggtgtttgacgagaatgaatcgcttctgctggaggacaatattcggatgtttactaccgcgccagaccaagtggacaaggaggatgaagatttccaggaatcgaacaagatgcactcaatgaatggttttatgtacggtaaccaaccgggcctgaccatgtgcaagggcgacagcgtggtttggtatctgttctcggcgggaaacgaggctgacgtgcacggaatttacttctccggaaacacttacctctggcggggagagcggagagatactgcaaacctgttcccccaaacttccttgactctgcatatgtggccggatactgaaggcactttcaacgtcgaatgcctgaccactgatcattacaccggcggaatgaagcagaaatacaccgtgaaccagtgtagacgacagtcggaggactccaccttttacctcggggaacggacctattacatcgctgctgtggaggtcgagtgggactactctccacagcgggagtgggaaaaggagcttcaccacctgcaagagcagaatgtctccaacgcatttctggacaagggagagttctacatcggatcaaagtataagaaggttgtgtatcgccagtacaccgactcaaccttccgcgtgccagtcgaacgcaaggcggaggaagaacatctgggaatcctgggcccacagctgcatgcggacgtgggcgataaagtgaaaatcatctttaagaatatggcaacgcggccgtacagcatccacgctcacggggtgcagaccgaatcaagcacggtgacccccaccctgcctggagaaaccctcacctacgtgtggaagataccggaacgctcgggggccgggaccgaggactcggcatgcatcccatgggcttactattcgacggtggaccaggtgaaagatctgtactccggccttatcggccctctcatcgtttgtcgtcgcccgtatcttaaagtgtttaacccgaggagaaaactggaatttgccctgctgttcctcgtattcgacgagaatgagtcttggtacttggacgacaacatcaaaacgtactcagatcaccccgaaaaggtgaacaaagatgatgaagagtttatcgaatccaacaagatgcatgctatcaatggccggatgttcggcaacctgcagggactgaccatgcacgtcggagacgaggtcaactggtacctcatgggaatgggtaacgaaatcgatctccataccgtgcacttccatggacactctttccagtacaagcacagaggagtgtactcctctgacgtttttgacatcttcccgggaacctaccaaactttggagatgtttccaagaactccgggaatctggctcctgcattgccatgtgactgatcacatccacgcgggcatggagactacttacaccgtcctgcaaaacgaggacactaagtccggc

SEQ ID NO: 8497 - DNA, 3195 bp, Artificial Sequence
  Description of Artificial Sequence: Synthetic coding sequence
atgaaaatactcatcctgggaatctttctgttcttgtgttcaactcccgcatgggcaaaagagaaacattactacatcgggattattgaaaccacctgggactacgcatccgaccatggcgagaagaaactcattagcgtggacaccgaacacagcaatatctacctgcaaaacggtccagatcggatcggacgtttgtacaagaaagctctgtacctgcagtacactgacgaaacttttcgcactactatcgaaaagcctgtatggcttggtttcctcggtccaataatcaaagcagaaaccggagataaggtgtatgttcatctcaagaatcttgcgtcccggccttacacctttcattcacatggtattacctactacaaggaacatgaaggggccatttaccctgataacactaccgactttcagcgggcggacgataaggtctatcccggagaacaatacacttacatgctcctcgcaaccgaagagcaatctccgggagaaggtgacggtaactgtgtgacccggatttaccactcacacatcgacgcacctaaggatatagcctccggtctgataggacctctgatcatatgtaaaaaggactccctggacaaagagaaagagaagcacattgatagggagttcgtcgtgatgttttcggtggttgatgaaaacttcagctggtacctggaagataacatcaaaacttactgctcggagcccgaaaaggttgacaaggataacgaggattttcaggaaagtaaccgtatgtactcggtcaacggctacacctttggtagcctccctggtctgagcatgtgcgcagaagatcgggtcaagtggtacttgtttggaatgggcaacgaagtggacgtccatgccgcctttttccatggtcaagcactgactaacaagaactaccgcattgataccattaacctctttcctgcgactctgtttgatgcatacatggtggcacagaacccaggcgagtggatgctctcgtgccaaaatctgaatcacctgaaagcggggctccaggcatttttccaggtccaagaatgcaacaaatctagctccaaggataacatacgagggaaacacgtccggcattactatattgcagcggaagaaatcatctggaactacgctccctcaggtattgatatcttcaccaaggaaaacctgaccgcaccaggatcggattccgcagtgtttttcgagcagggcactactaggattggcgggtcttataagaaattggtgtacagagagtacactgatgcatcgtttaccaatcggaaggaaaggggaccggaggaagaacaccttggaatattggggcccgtcatctgggctgaggtgggagataccatccgagtcacctttcacaataagggagcatatccactctcaattgaacccattggggtgagatttaacaaaaacaacgagggtacctattactcacctaactacaatccccaatcccgatcggtaccccctagcgcatcgcacgtggcaccaaccgaaacttttacttatgagtggaccgttccaaaagaggtgggacctaccaatgccgacccagtgtgtctcgccaagatgtactactccgccgtggatcccaccaaggatatcttcacgggactgattggtcccatgaagatttgtaaaaagggctcccttcacgcaaatggtagacaaaaggatgtggataaggagttttacctgttcccaaccgtttttgacgagaacgagtccctcctgttggaggataacattcgcatgtttactaccgcacctgaccaggtcgacaaagaggatgaggacttccaagaatcgaataagatgcatagcatgaacggatttatgtatggtaaccaaccaggcctgaccatgtgtaaaggagactcggtggtgtggtacctgttctccgccggaaatgaagccgacgtccatggtatttacttctccggaaacacgtacctttggcgtggtgaacgacgagacactgctaacctgtttccacaaacttcacttacgcttcacatgtggcctgatactgaagggacgtttaacgtggaatgtctgaccaccgatcattacacgggaggcatgaagcaaaagtacacggtgaaccaatgtagacgccagagcgaggatagtaccttttacctgggcgaaaggacttattacattgccgccgtggaagtggaatgggattactcgccgcagagggaatgggagaaggaattgcatcacctgcaggagcagaacgtctcgaatgcattccttgacaagggcgaattctatatcgggagcaagtacaagaaagtcgtttacagacaatacaccgattccacttttcgggtgccagtggagagaaaggcagaagaagaacatttgggaattctgggacctcaacttcatgcagatgtgggagataaggttaagattatctttaagaacatggccactagaccctacagcatccatgcacacggcgtccaaacggaatcatcaactgtcacgccgaccctcccgggggagactctgacttatgtgtggaaaatcccagaacgatcaggagcaggaaccgaagatagtgcatgcattccatgggcctactacagcactgtcgatcaagtgaaggatctttactcgggacttattggacctttgatcgtctgtaggcgtccgtaccttaaagtgttcaatcccagacgtaagctcgagttcgcccttcttttcctcgtgtttgatgagaacgaatcttggtatcttgacgacaatatcaaaacgtactcggatcatcccgaaaaggtgaacaaagatgacgaagagtttattgaatccaataagatgcacgctatcaacggccgaatgttcgggaaccttcagggactgactatgcatgtgggcgatgaggtgaattggtaccttatgggtatgggtaatgaaattgacttgcacaccgtccatttccatggacactccttccagtataagcatagaggagtctactcctcggatgtgtttgacatttttcctggtacctaccagactctcgagatgtttccgcggacgccaggtatttggcttctccattgtcatgttacggatcatatccatgcaggcatggaaaccacctacaccgtgctgcaaaacgaggacaccaagagcgga

SEQ ID NO: 8498 - DNA, 3195 bp, Artificial Sequence
  Description of Artificial Sequence: Synthetic coding sequence
atgaagatcctgatcctgggtatcttcttgttcttgtgcagcaccccggcctgggccaaggagaagcactactatatcggtatcattgagactacgtgggactacgcctcagatcatggggaaaagaagttgatttccgttgataccgaacactctaacatctacctgcagaacgggcccgatcggattggccggctgtacaagaaagctctctacctccaatacacggacgaaaccttccggaccaccatcgagaagcctgtgtggttgggatttctggggccaatcatcaaggctgaaaccggagacaaggtctatgttcacctcaaaaatctggcgtctcggccatacacttttcactcgcacgggattacctactacaaggagcacgaaggcgcaatctacccggataacactactgatttccaaagggcagatgataaagtgtacccgggggaacagtacacctatatgctgctggccactgaagagcagtcccccggtgagggagacggaaactgcgtcacccggatctaccactcacatatcgacgcacctaaggacatcgcgtccggcctcatcgggcctcttatcatttgcaaaaaggacagcctcgacaaagagaaagagaaacatatcgaccgggagtttgtcgtgatgttctccgtggttgacgaaaacttctcgtggtacctggaagataacattaagacctactgctccgagcctgagaaagtggacaaagacaacgaagatttccaagagagcaacaggatgtactcagttaatggatacacgttcggatcgctccctggactgtcgatgtgcgcagaggaccgggtgaagtggtacctcttcgggatgggaaacgaagtggatgtccatgccgcgttctttcatggacaggcgcttaccaataagaactaccggatcgacaccatcaatttgttcccagccactctcttcgacgcatacatggtggctcagaaccctggtgaatggatgcttagctgtcagaacctgaaccatcttaaggccggactccaggccttctttcaggtgcaggaatgcaacaagtcgagctcaaaggacaacatacgcgggaagcacgttcggcactactacatcgccgcagaagagatcatttggaattacgcaccgagcggcatcgacatctttaccaaggaaaatctcactgcgcccgggagcgacagcgccgtattctttgaacagggcaccacgcgcattggaggatcgtacaaaaagctggtgtaccgcgaatacaccgatgcctcgttcactaatagaaaggagcgtggcccggaagaagaacatcttggaatcctgggacctgtgatctgggctgaggtgggagacaccattagggtcactttccataacaaaggagcctacccgctctcaatcgaaccaatcggggtcagattcaataagaataatgaaggcacctactactctcccaattacaacccgcagtcccggtcggtcccgcccagtgcgagccacgtggcacccaccgaaaccttcacttacgaatggactgtgccaaaggaagtcggacccaccaacgcggatccggtgtgtctcgcaaaaatgtattactcagcggtcgacccaactaaggacatcttcaccggccttatcggtcctatgaaaatctgtaagaagggcagcctgcacgcgaatggacgccaaaaggacgtggataaggagttttacctgttccctaccgtgttcgatgagaacgagtccttgctcctggaggacaacatcagaatgttcacgactgctccggaccaggtggacaaggaggatgaggacttccaggagagcaataagatgcattcgatgaacggattcatgtacggaaaccagcctggcctcaccatgtgcaaaggggattcggtggtctggtacctgttctctgcgggcaacgaggccgacgtgcatggaatctacttctccgggaatacctacctgtggcgcggagaaagacgcgataccgcaaatctcttcccgcaaacttccctgactctgcatatgtggccggataccgagggtaccttcaacgtcgaatgcttgactactgatcactacaccggtggaatgaaacagaagtacactgtcaaccaatgccgccgacagtccgaggactccactttttacctgggagagagaacttattacatagccgccgtagaggtcgaatgggattactcaccgcaaagagagtgggaaaaggaactgcaccatttgcaggaacagaacgtgtctaatgccttcctggacaaaggggagttttacatcggatcgaagtataagaaagtggtgtaccggcaatatactgattcgaccttcagagtgccggtggaaagaaaagccgaagaagaacaccttgggattctgggaccgcaactccatgcggacgtgggagacaaagtcaagatcatcttcaagaacatggctactcgcccgtactcaatccatgctcatggtgtccaaactgaatcttcaactgtgaccccaaccctgccaggcgaaacccttacttacgtgtggaaaatcccggagcgatcaggagccggaactgaagatagcgcctgtataccgtgggcatactattcaactgtcgatcaagtgaaggacttgtactcggggctcattgggcctctgatcgtgtgcaggcgcccgtacctcaaagtctttaacccaaggcgcaaactggagttcgccctgctcttcctggtatttgatgaaaacgagtcctggtacctggatgacaacatcaagacctactcggaccaccccgagaaggtgaataaggacgacgaagagtttatcgaatcgaataagatgcacgctatcaacggccggatgttcggaaacctgcagggactcacgatgcacgtaggcgatgaggtgaattggtacctgatgggcatgggtaacgaaattgatctgcacactgtgcacttccacggacatagctttcagtacaaacaccgcggggtctactcctcagacgtgttcgacatcttcccaggtacgtatcaaactttggaaatgtttcctagaacgcctggcatctggctcttgcactgccacgttactgaccatatccacgctggcatggagacgacctacacggtgttgcagaatgaagatactaagtccggg

SEQ ID NO: 8499 - DNA, 3195 bp, Artificial Sequence
  Description of Artificial Sequence: Synthetic coding sequence
atgaaaattctgattctcggaatctttctttttctctgcagcactcctgcatgggcaaaggaaaagcattactacatcgggattatcgaaacgacttgggactacgcatccgatcatggagaaaagaagctgatctcggtcgatacggagcactcgaacatttacctgcaaaatggaccggatcggatcggtcggctgtacaagaaagcactttatctgcagtacaccgatgagacttttagaactaccatagaaaagcctgtgtggctgggatttcttggacctatcattaaggctgagacgggcgacaaggtttatgtgcatcttaagaacctcgccagccgcccatacacctttcactcccacggaattacctactacaaggaacatgaaggggccatctacccggataataccactgactttcaaagggctgacgataaagtgtaccctggagagcagtacacttacatgctgctggccaccgaagaacaatcccctggagaaggcgacggtaactgtgtgaccagaatttaccattcgcacatcgatgccccaaaggacatcgcctcaggactcattggacctctgataatctgcaagaaagactccctggacaaagaaaaagaaaaacatattgatagggaatttgtcgtgatgttttcggtcgtggacgaaaacttctcctggtaccttgaagataacattaagacctattgttccgaacctgaaaaggtcgataaggataacgaagattttcaagaatctaataggatgtacagcgtcaacggatacacctttggctcgctgcccggattgtcaatgtgcgcagaagatcgcgtgaaatggtacctttttggaatgggaaatgaagtcgatgtccacgcagcgttttttcatgggcaggcactcaccaataagaactaccggatcgataccataaacctttttccggcaacgctgttcgacgcctatatggtggcgcaaaatcctggcgagtggatgctgtcatgccagaacttgaatcatctcaaggcaggcctgcaggcgttcttccaggtccaagagtgtaataagtcgtcatcaaaggataacattagaggtaagcatgtgagacactactacatagccgctgaagaaatcatctggaactatgcaccatcaggtatcgatatcttcactaaggaaaacctcaccgcaccagggagcgactctgcagtgtttttcgagcagggaaccaccaggatcggaggatcctacaagaagctggtctaccgggagtacaccgacgccagcttcactaatcgcaaggaacgcggtccagaagaggaacacctgggcatacttggacccgtgatttgggcagaagttggtgatacgatcagagtgacgttccataacaagggagcataccccctgtcgatcgagccaataggggtgcggtttaacaaaaacaacgagggaacttactactctccaaattacaaccctcaatcgagatctgtgcctccttccgcttcccacgtggcacctaccgaaacctttacgtacgaatggaccgtcccgaaggaggtcggaccaaccaatgccgacccagtgtgtttggcaaaaatgtactactccgcagtggatcccacgaaagacattttcactggactgatcgggccaatgaagatatgtaagaagggatccctgcatgcaaatggccggcaaaaggatgtggataaggagttttacttgttcccaactgtgtttgatgagaacgaatcgctgcttctggaggacaacattaggatgttcaccaccgcacctgatcaagtcgataaggaggatgaggactttcaagaaagtaataagatgcactcgatgaatggttttatgtatggtaaccaaccggggctcaccatgtgtaagggcgattccgtggtgtggtaccttttctcggcaggaaatgaggctgatgtccatggaatatacttctccggtaatacgtacctgtggaggggggaaagacgcgatacggccaacctctttcctcaaacttcccttacgcttcatatgtggccggatactgaaggaactttcaatgtggaatgcctgacgaccgatcattacactggcggaatgaagcaaaagtacacggtgaatcagtgtagacgacagagcgaggatagcactttttaccttggtgaaagaacttattacattgcagctgtggaggtcgaatgggattatagcccccaacgtgaatgggaaaaggaactgcaccacctccaagagcaaaatgtctccaacgcctttcttgacaaaggagaattctacattggatccaagtacaaaaaagtcgtgtaccggcaatacactgatagcacctttcgagtgcccgtggaacgaaaagctgaggaggaacatctgggaattcttggcccccagctccatgcggatgtgggtgacaaggtgaagatcattttcaaaaacatggccacccgcccatacagcattcacgcccatggtgtacaaactgagtcctcgaccgtgacccctacccttccgggtgagactctgacttacgtgtggaagatcccagagagatcgggagcagggaccgaagattcggcatgtattccttgggcctactactccactgtggaccaagtcaaggatctttactccggccttatcgggcctctcatcgtgtgtcgacgtccttatcttaaggtgttcaatccaaggagaaagttggaattcgcacttctctttttggtgtttgacgaaaacgaatcttggtatctcgatgacaacattaagacttacagtgatcacccagaaaaggtcaacaaagacgacgaagagtttatagagtcgaacaaaatgcatgcaattaacggcagaatgtttggtaaccttcaaggacttactatgcatgtgggcgatgaagtcaactggtacttgatgggaatgggtaacgagattgatcttcataccgtgcatttccacggacattcctttcagtacaaacatcgcggcgtgtactcaagcgacgtgtttgatatctttccaggtacgtaccaaactctggaaatgttcccaagaacccctggaatttggcttctgcattgtcacgtcaccgaccacattcatgccggaatggaaaccacttacacggtgcttcagaatgaagatacgaagagcggt

SEQ ID NO: 8500 - DNA, 3195 bp, Artificial Sequence
  Description of Artificial Sequence: Synthetic coding sequence
atgaaaattctgattttaggaatttttctttttctgtgctcaacaccagcctgggcgaaggaaaaacattattacatcggcattatcgagacaacctgggactacgcctcagatcacggagagaagaaactgatatccgtcgatacagagcactctaacatctacctacagaacggtccggacaggatcggcaggttgtacaagaaggccctctacttgcaatataccgatgaaacgtttcggaccaccatagaaaaaccggtctggctgggtttcctgggaccaatcataaaggctgaaacaggcgataaggtttacgttcatctgaaaaacctagctagcagaccatataccttccatagccatgggattacatactataaagaacatgaaggcgccatctacccagacaacactaccgacttccagagagctgacgataaagtctaccccggtgagcagtatacttacatgctgttggccactgaggaacagagtcctggcgaaggcgacggcaactgtgttactaggatatatcattctcatattgacgcacccaaagacatcgctagtggactcattggaccactgattatctgcaaaaaagactccctcgataaagagaaagagaagcacatcgatcgggagttcgttgttatgttcagcgtcgtcgatgagaatttctcttggtacctggaagacaatataaagacctactgttcagagcctgaaaaggttgataaggataatgaagacttccaggaaagtaaccgtatgtattctgtcaatggatacacattcggttccctacccggtctctcgatgtgtgccgaagatcgggtcaagtggtacctctttggcatgggcaatgaagtggatgtccacgctgcattctttcacggccaggcattgacgaacaaaaattatcgaatcgataccatcaacttattccctgccacattgttcgatgcgtacatggtcgcccaaaatcctggagaatggatgctgagctgtcagaatctgaaccatctcaaagctggtctgcaagcgttttttcaggtgcaggaatgcaataaatcatcttccaaagataacatccgggggaaacacgtgcggcattactatattgccgcggaggaaatcatctggaattatgctcccagtggaatcgatattttcacgaaggagaacctgaccgcgccgggaagtgattctgccgtgttcttcgagcaagggaccactcgcatcgggggatcttacaaaaagctggtgtatagagagtatacagatgcctcttttacaaaccggaaggaaagggggcccgaggaggagcacctcggcattctgggccccgtaatttgggctgaggtcggggatacaatacgagtgacattccacaataaaggggcctatcctttgtccatcgaaccaatcggtgtgcgcttcaataagaacaacgaggggacttactactctcccaattacaatccccagtccaggagtgttcctccctctgcctcacatgtggcccccaccgagaccttcacttatgaatggaccgtccccaaagaagtgggcccaacgaacgcagatcctgtatgcttggccaaaatgtattattccgctgtcgatccgacaaaggacattttcactggactaatcggacccatgaagatctgcaaaaaggggtcgttgcatgcgaatggccggcagaaggacgtcgataaggagttctacttgttccccaccgtgttcgacgagaatgaatctctgcttcttgaagataacattcgcatgttcacaacggccccagaccaggtggataaggaggatgaagacttccaggagtccaacaagatgcacagtatgaacggatttatgtatggaaatcagcccggcttgactatgtgcaagggtgattccgtcgtatggtatcttttctccgctggaaacgaggcagacgttcacggcatatatttttctggcaatacctatctctggagaggcgagcgcagagatactgctaacctgtttccccagacgtcccttactctgcacatgtggccggatacagagggcaccttcaatgtggaatgccttactacggaccactatacaggcggtatgaaacaaaaatacacggtgaaccagtgtcggcggcagtctgaagattcaaccttttatctcggagaacggacctattacatcgcggcggtcgaggtggagtgggattactcaccacagagggagtgggaaaaagaactccaccacttgcaggaacaaaacgttagcaatgctttcctggataaaggtgaattctacatcggaagtaagtacaagaaggtggtttatcgacaatacacagacagcacattcagagtccccgtggagcgaaaagccgaggaagaacacctggggattcttggcccccagttacatgctgatgtaggtgacaaggtgaaaatcatcttcaaaaatatggctacccgcccatactctattcatgcccacggcgtgcagaccgaatcatccacagtgacccctacactgccgggggagaccctgacatatgtttggaaaatcccagagcgttctggcgcgggcaccgaagactctgcctgtattccttgggcctattactctaccgtggaccaagtgaaagacctttattcaggtctgataggtccacttatcgtatgcagacgaccttatctaaaagtgttcaaccccagacgaaaactggaatttgctttgctgttcctggtgtttgacgaaaatgagagctggtatctggatgacaatattaaaacatactccgaccaccccgagaaggttaacaaggatgatgaggaattcatcgaaagcaacaagatgcatgccattaatggccgcatgtttggcaacctgcagggtttgacgatgcatgttggggacgaggtgaactggtatttaatggggatggggaacgaaatcgacttacacacagtgcattttcatgggcactcattccaatataagcatagaggagtgtattcaagcgatgtttttgacatttttccgggcacatatcaaaccttagagatgttccctcggacacctggaatatggctgttacactgtcatgtcacagaccacatccacgctggaatggaaactacttataccgtgctgcagaatgaggataccaaatctggc

SEQ ID NO: 8501 - DNA, 3195 bp, Artificial Sequence
  Description of Artificial Sequence: Synthetic coding sequence
atgaagatcctgatcctggggatttttcttttcctctgttcgacccctgcatgggcgaaggaaaaacattactatatcggcatcattgagactacctgggattacgcatcggatcacggagagaagaaattgatttccgtggataccgaacattccaatatctacctgcagaatggcccagatcgcattgggagattgtacaaaaaggccttgtaccttcaatatacggacgaaacctttcggacgaccatcgaaaagccagtgtggcttggatttcttggcccaataatcaaagcagaaaccggagataaggtgtacgtgcacctgaagaatcttgcatcgaggccctacactttccactcccacgggattacctactacaaagaacacgaaggagctatctaccctgataataccaccgatttccagcgggccgatgacaaagtctatccaggagaacagtacacctacatgctccttgccaccgaagagcaaagccccggggagggagatggaaattgcgtcactcgtatttaccattcgcatattgacgcacctaaggatatagcatcagggctgattggccctttgattatctgtaagaaggattcgcttgacaaggagaaggaaaagcatattgaccgggaatttgtcgtgatgttttcggtggtggatgaaaacttttcgtggtacctggaggataacattaagacctactgttcagaaccagaaaaggtcgataaggataatgaagatttccaggaaagcaatagaatgtattcggtcaatggttacacttttggctccttgcctggactttcaatgtgtgcagaagatagagtgaagtggtacctgttcggaatgggtaacgaggtggatgtgcatgccgccttttttcacggtcaagctcttacgaataagaattacagaattgatactattaaccttttccccgcaaccctgtttgatgcctatatggtggcccagaatccaggtgaatggatgctgtcgtgtcaaaacctgaatcatctgaaggcaggtctgcaagcgtttttccaagtgcaagagtgcaacaagtcctcatccaaagataacatccgaggtaagcatgtcagacactattacatagcagcagaagagataatctggaactacgctcctagcggcattgacatctttaccaaagagaatctcaccgcacctggatccgattcagcggtgttctttgaacaaggaaccactagaattggaggatcctacaagaaactggtgtacagagagtatactgatgcttcgtttaccaacagaaaggagagaggacctgaagaggaacatctcgggattttgggcccagtgatctgggcagaggtgggcgataccattagagtcacctttcataacaagggtgcttaccctctgtccatcgaacctataggggtcagatttaacaagaataatgaaggaacctactactcacctaattacaacccacaaagccgcagcgtgccaccctccgcgtcgcacgtggctccaaccgagacgtttacctacgaatggaccgtgccaaaggaggtcgggcccactaacgccgacccagtgtgtctcgccaagatgtactacagcgcagtcgacccgaccaaggacatattcaccggtctgattggacccatgaagatatgcaagaagggttcgctgcatgcgaacgggcgccagaaggatgtggataaggaattctacctgttcccaaccgtattcgatgagaatgagtccctccttctggaggacaacatccgtatgtttactaccgcgccagatcaggtcgacaaagaagatgaagattttcaagagtcgaacaagatgcattccatgaatggtttcatgtacgggaaccaacccggtctgaccatgtgtaagggtgattcagtcgtgtggtaccttttctctgcagggaacgaggccgatgtccatgggatttacttttcaggtaacacttatctgtggagaggggagcgcagagacactgctaatctgttccctcaaacttccctgactctgcatatgtggcctgacaccgagggcacttttaacgtggaatgcctgactactgaccattacaccgggggcatgaagcagaagtacactgtgaatcaatgtaggagacagagcgaagatagtacgttctacttgggagaacgaacctactacatcgcagcggtcgaagtcgagtgggattacagccctcaaagagaatgggaaaaggagcttcaccacctccaagaacagaacgtgtccaatgcgttccttgataagggagaattctacataggttccaaatacaaaaaggttgtgtacagacaatacacggatagcacctttcgagtgcctgtcgagcggaaggcggaggaagaacacctgggtattctcggtccccaactgcacgccgatgtcggcgataaagtgaagatcatctttaagaacatggcgaccaggccctacagcatccacgctcacggcgtgcaaaccgaatcctcgaccgtgaccccaactctgccaggagaaaccctgacctacgtgtggaagattcctgaaaggtcgggcgccggtactgaagattccgcatgtattccttgggcctactacagcaccgtcgaccaggtcaaggatttgtactcggggctcattggtcctctgatcgtttgtagacgtccttaccttaaagtgtttaaccctcggcgtaaacttgaatttgcccttctcttcctggtgttcgacgagaatgaatcctggtaccttgacgacaacataaagacgtactcggaccatccagaaaaggttaacaaagatgatgaagagttcatagaatcgaacaaaatgcatgcaattaacggacgcatgttcggtaaccttcagggcctgaccatgcatgtgggcgatgaagtgaactggtacttgatgggaatgggaaacgagatcgatctgcacaccgtgcattttcacgggcactcctttcaatacaaacatcgaggggtgtacagctcggacgtgtttgacatatttccgggtacctaccaaacgcttgagatgttcccacgcacgcccggcatttggctgcttcactgtcatgtcaccgatcatatccacgcaggaatggagactacctacactgtgctgcagaatgaggataccaagagcgga

SEQ ID NO: 8502 - DNA, 3195 bp, Artificial Sequence
  Description of Artificial Sequence: Synthetic coding sequence
atgaagatcctgatcctggggatcttcctctttctttgtagcaccccagcatgggccaaggaaaagcattactacattggtatcatcgaaacaacgtgggactatgccagcgaccatggcgaaaagaagctgatttctgtggacacagagcattcaaatatctacctccagaacggccccgatagaatcggcagactttacaaaaaagccctgtatctgcagtatactgatgaaactttccgcacgactatagagaagcccgtgtggctcgggttcctgggtcccattattaaagccgaaacgggcgacaaggtgtacgtccacctcaagaatttggccagcagaccctatacgtttcactcacacggcattacatactacaaagagcatgaaggcgcaatttatccagataacacgacagactttcagcgggcggatgacaaggtttaccccggtgaacagtatacatatatgctgcttgcaactgaggaacagtcccccggggaaggggatggcaactgtgtgacaaggatctaccacagccacatcgatgcacccaaggatatagcctctggattgatagggcccctgatcatatgtaagaaggattctttggacaaagagaaagagaagcacatcgatcgagagttcgtcgtgatgttctcagtggtggacgaaaatttctcctggtatctggaggataatattaaaacatactgcagtgagcccgagaaggtggacaaagataatgaggatttccaggaatctaatcggatgtactccgttaacggatataccttcggctccctgcctggcctctcaatgtgcgccgaggacagggtcaaatggtatttgttcggaatggggaatgaggtagatgtgcatgccgcctttttccatgggcaggcactgacaaataaaaactaccgaatagacaccattaatctcttccctgccactttgttcgatgcatacatggtagcacagaaccccggagagtggatgctgtcttgccagaacctgaaccatttgaaggccggtcttcaggctttttttcaagtgcaagaatgtaataaaagtagtagcaaagataacatcagggggaagcacgtgcgccactattacatagccgccgaggagatcatatggaactacgctccatctggtatcgacatcttcacgaaagaaaacctgacagccccagggtctgatagcgccgtgttttttgaacagggcacaacacgcatcggaggcagctacaagaaactcgtgtatagagagtacacagatgctagcttcaccaatagaaaggaacgggggccagaggaggagcatctgggaattctgggtccagtgatctgggcggaggtgggcgacactatccgcgtgacgtttcataacaagggagcctatcctctgtctatcgagcccataggcgttcggttcaacaaaaacaacgagggcacttactactccccaaattacaatcctcaatcaagaagcgtgccgccatctgcctctcacgttgcacccactgaaactttcacttatgagtggaccgtacctaaagaggtaggccccacgaatgcagatcccgtgtgcctggcgaagatgtactattcagccgtggatcccactaaggatattttcactggactgatcggcccaatgaagatctgtaaaaaaggttcccttcatgcgaacggaagacagaaggatgtggacaaggagttctacctttttcctaccgtgttcgatgaaaacgagtctctgcttcttgaggataacattagaatgttcactaccgcccctgaccaggtggataaagaggatgaggatttccaggaatcaaataaaatgcattccatgaatggtttcatgtacgggaatcaaccaggattgaccatgtgcaaaggagactctgtcgtttggtacctctttagtgccggcaacgaagccgacgttcatggcatttactttagcggcaatacatatctctggcggggcgagagaagggacaccgctaacctctttcctcagacttccctgacacttcacatgtggccagatacagaggggacattcaatgtcgagtgcctgacgacagaccattacaccggggggatgaagcagaagtataccgtgaaccagtgccggcgacagtctgaggattctaccttctacctcggtgagaggacatactatatcgccgccgtggaagtggagtgggattatagcccgcagagggagtgggagaaggagctccaccacctgcaagaacaaaatgtcagtaatgccttcctggacaaaggcgagttctacattggtagtaaatataagaaggtggtgtatagacagtacaccgactccacattccgagtacctgttgaacgcaaagctgaggaagagcatctgggcattctgggcccacagctccacgctgatgtgggagacaaggtgaagatcatcttcaagaacatggctacaagaccctattcaatccatgcccacggggtgcaaaccgaaagctccaccgtgacgcccacactgcccggcgagaccctcacatatgtgtggaaaattcccgaacgatcaggtgccgggactgaggacagcgcttgtattccgtgggcttattactccaccgttgatcaagtcaaggacctgtacagcggtctcataggccctctcatcgtgtgtaggcgcccttatctcaaggtgtttaacccgagacgaaagctcgaatttgcactcctgtttttggtgttcgatgaaaacgagtcttggtacctcgacgataatatcaagacgtattccgaccacccggaaaaggtgaacaaggacgatgaggaattcatcgagtctaataagatgcacgcaataaatggcaggatgtttgggaatctgcagggattgacaatgcacgtgggcgatgaggtaaactggtaccttatgggaatgggaaatgagatagatctccacaccgtgcactttcacggccactccttccaatacaagcaccgaggcgtgtattctagcgatgtgttcgacattttccccggcacttatcagacattggagatgttccctaggactccgggaatttggctgctccattgccacgtaacagaccatatccacgcaggtatggaaacaacctatactgttttgcaaaacgaggatacaaaaagcggg

SEQ ID NO: 8503 - DNA, 3195 bp, Artificial Sequence
  Description of Artificial Sequence: Synthetic coding sequence
atgaaaatcttaattctgggcatttttctgttcctctgcagcactccggcatgggccaaggaaaaacattattacatcggtatcatcgaaactacctgggactatgccagtgaccacggggagaaaaaactcattagtgtggacaccgagcatagtaacatctaccttcagaacggacccgacagaatcgggaggctctataagaaagccctctatttgcaatacactgacgaaaccttccgaacaactatcgagaagcctgtgtggttgggttttctgggacctattatcaaggctgagacaggagataaagtttacgtgcatcttaaaaatcttgcaagtcggccttatacatttcacagtcatggcattacttactacaaggagcatgaaggagcaatctacccagacaacaccaccgatttccagcgggctgacgacaaggtgtatccaggcgaacaatatacttatatgctgctggccactgaggagcagagccctggcgagggagacggtaactgcgtgactaggatttatcacagccatatagatgctcctaaggatatcgccagcgggttgattggccccttgataatctgcaaaaaggactcgctggacaaggagaaggagaagcacattgatcgtgaatttgttgtcatgttcagtgtagttgatgaaaacttttcatggtatttggaggacaacatcaagacctactgctctgaaccagagaaagtggataaggacaacgaggacttccaagagtctaatcgcatgtactctgtgaatggttacactttcggttccctgcccgggttatctatgtgtgcggaggaccgggtgaaatggtacctgtttgggatggggaatgaagtcgacgttcacgcggccttctttcacggtcaggcattaaccaacaaaaactatagaatcgataccataaaccttttccccgctacgctttttgacgcgtacatggtagcccagaatcccggcgaatggatgcttagctgtcagaaccttaatcatctgaaagccggactccaggcttttttccaagtgcaggagtgtaacaagagctcttcaaaagacaacatccggggaaaacacgtgcggcattactatatagccgcagaagaaatcatttggaattatgctccaagcggtatagacatttttaccaaggagaatctgacagccccagggtcagactctgctgtttttttcgagcaggggactaccaggattggcggctcttacaaaaagcttgtgtaccgcgagtataccgatgcaagcttcacaaaccgcaaagaacgagggcctgaggaggagcatctgggtattttgggtcccgtgatctgggccgaagtgggggacacaatcagagtaacctttcataacaagggagcctacccgctgagtatagagccaattggagttcggttcaataagaacaatgagggtacttactactcgcccaattataatccccagtcaaggagtgttcccccatccgcatcacatgttgcacccacggaaacttttacctacgaatggactgtgcctaaagaggtgggcccaaccaatgcagaccccgtctgtttggcaaagatgtattattcagccgtggaccctacgaaggatatctttacagggctgatcggacctatgaaaatatgcaaaaaggggtcccttcatgcaaatgggcggcagaaagacgtggacaaagaattctatctattcccaaccgtttttgatgaaaacgaatccttgctcctagaggacaacattcggatgttcaccacggcgcctgaccaagtggataaggaagacgaagacttccaggagtccaacaagatgcactcaatgaacggttttatgtacggcaatcaaccagggctgacaatgtgtaagggtgattccgtggtctggtacctcttctctgcggggaatgaggcagatgtccacggcatctatttcagcgggaacacttatttatggagaggggagcgcagagacacagccaatctgtttcctcagacttcactgacccttcacatgtggcccgatactgaaggcaccttcaatgtcgagtgtctcactaccgaccactataccggaggcatgaagcaaaaatatacagtaaaccaatgcaggcgacagagcgaagattctacgttctacctgggggagagaacctactatattgctgctgtcgaggtggagtgggattactcccctcagagagagtgggaaaaagagctgcaccatctccaagaacagaatgtaagcaatgccttcttggataaaggggaattctacatcgggtcaaaatataagaaagtggtataccggcagtacaccgattccacgtttcgcgtcccggtggagaggaaagcagaggaggagcacctgggcatcttgggcccccagctacacgctgatgtcggagacaaagtcaaaataatattcaaaaacatggctacgcggccgtattccattcacgcgcacggggttcagacagagtcaagcacggtgacacccacactgcctggagagaccctcacatacgtgtggaaaattcctgagcgaagtggggccggcactgaggatagcgcttgcattccttgggcttactattccacagtggatcaagtgaaggatctgtactccggattaataggcccattgattgtgtgtcgccgcccgtacctaaaggtgtttaatccgagacggaagctggagttcgcattgctgtttctggtattcgacgagaacgagtcctggtatctggacgataacatcaaaacctattccgaccatcctgagaaagtgaacaaggatgacgaagaattcatagaaagcaacaagatgcacgccataaatggacgtatgttcggaaatctgcagggcctgacaatgcacgtgggggacgaggttaattggtatttaatgggtatgggcaatgagatcgatttgcacactgtgcactttcatggccactccttccaatataagcaccggggcgtctatagctccgatgttttcgatatcttccctggcacatatcagacactcgaaatgtttcccaggacaccaggtatctggctgcttcactgccatgtcacagatcacatccacgctggcatggaaactacatatacagtgcttcagaatgaagacactaagtccgga

SEQ ID NO: 8504 - DNA, 3195 bp, Artificial Sequence
  Description of Artificial Sequence: Synthetic coding sequence
atgaaaatcttaattttgggcatctttctatttctttgcagtacaccagcctgggctaaggagaagcattattacatcggtatcattgagactacttgggactacgccagcgatcatggggaaaagaagcttatctctgtagatacggagcactccaatatctacctgcagaacggtccggaccgcataggcagactctataagaaagccctgtacctgcagtacaccgatgagacattcaggacaacgatagaaaaaccagtatggttgggattcctgggtcccataataaaggctgaaaccggcgataaggtgtatgtgcatttgaagaatctagcttcacgcccctatacctttcactcccacggcatcacttactacaaagagcacgagggggctatctatcctgataacactacagacttccagagggcagatgataaggtctaccctggcgaacagtacacctacatgctactagcgactgaagagcagagcccaggcgaaggagacggaaattgtgtcacccgaatctaccattcccatatcgacgcccctaaggacatcgcctctggcctgatcggtcctctgatcatatgtaagaaagactctttggacaaggagaaggagaaacacatagatagggaattcgttgttatgtttagtgtcgtcgacgaaaatttctcctggtacctggaagataatataaaaacatactgttctgagcccgagaaggtggacaaagacaacgaggattttcaagagtcaaatagaatgtactcggtcaatggatacacattcggttccttgcctggactgagcatgtgtgccgaagaccgcgtgaaatggtatttgtttgggatggggaatgaggtagatgtgcacgccgccttctttcacgggcaggcactcactaataaaaattaccgtatcgacacaattaacttgttcccagccactctctttgatgcgtatatggtcgcccagaaccccggagaatggatgctttcttgtcagaatctgaaccaccttaaggcagggctgcaggccttctttcaggttcaggagtgtaataaatcatcaagcaaggataacattaggggtaagcacgtgcggcactactacatcgcagccgaagagattatctggaattatgcaccgagcggcatcgacatattcactaaggaaaatttgacagctcctggctccgacagcgctgtatttttcgagcaaggcacaacacggatcggcggttcatataagaagctggtgtatagggagtacacagacgcgtctttcacaaatcgcaaggagaggggacctgaggaagaacatctgggaatactgggacccgtgatatgggctgaggtcggggacaccattagagtaactttccacaacaagggggcctacccactgtcaatcgagcctatcggcgtccgctttaacaaaaacaatgagggcacatattacagccccaactacaatccccaatcacgcagcgtcccccctagcgcgagtcacgtggccccgacagaaacctttacttacgagtggacggtgcctaaagaggtcggacccaccaatgcagaccccgtctgtctggccaaaatgtattacagcgcagtggatccaacaaaagacatctttacaggtctcatagggcccatgaagatttgtaaaaagggatccctacatgccaatgggagacagaaagatgttgacaaggaattctatctgttcccaaccgtcttcgacgagaacgagagccttctgctcgaagacaatatcaggatgtttacaaccgccccagaccaggtggataaggaggatgaggatttccaggagtcaaacaaaatgcattcgatgaatgggttcatgtacgggaatcaacccggactgacaatgtgtaaaggggatagcgttgtatggtaccttttctctgcaggaaacgaggctgacgtccatggaatctacttctcagggaacacttatctgtggcggggcgagcgccgcgacaccgctaacctgttcccgcagacatccttgactttgcacatgtggccggacaccgagggtacatttaatgtcgagtgcctgactaccgaccactatacagggggaatgaaacaaaagtacacagtgaaccagtgtcgcaggcaatctgaagattccaccttctatcttggtgagcgcacatactatattgccgccgtagaagtggagtgggactattcccctcaacgtgaatgggagaaggagcttcaccatctgcaggaacagaatgtctcaaatgccttcctagacaaaggggaattctatatcggcagcaaatacaagaaggtggtgtaccgccagtacactgattctaccttccgcgttccagttgaacggaaagcagaagaggagcacctaggtatactaggaccccagctccacgccgacgtgggtgataaggtaaaaataatattcaaaaatatggcaacccggccatactcaattcacgcccacggagtccaaaccgaaagctctaccgtgacccccaccctccctggggagactctaacatacgtctggaagatcccggagaggagcggggcaggaacagaggactccgcatgtataccatgggcttattacagtaccgtagatcaagtaaaggacttatattcagggctcatcggccctctcattgtgtgtcgtcgcccatatctgaaggtgtttaacccaaggcgcaaattggagttcgctctgctatttctggtcttcgacgagaacgagtcctggtacttggacgacaacatcaagacctatagtgaccacccagaaaaggtgaataaggacgacgaagaattcatcgaatccaacaaaatgcacgcgattaatggtagaatgttcggtaatttgcaggggctaactatgcacgtaggggacgaagtcaactggtaccttatgggtatgggaaatgagatcgatttgcatacagtgcatttccacggtcattcctttcaatataaacaccgtggcgtctactcttctgacgtcttcgacattttccccgggacatatcagactctcgagatgttccccagaacccccggcatttggctgctccactgccacgttacagaccacatccatgccggaatggaaactacctacactgtccttcagaacgaagatactaagagtggc

SEQ ID NO: 8505 - DNA, 3195 bp, Artificial Sequence
  Description of Artificial Sequence: Synthetic coding sequence
atgaaaattctcatactgggaatttttctattcctatgtagcacaccagcttgggccaaggaaaaacattattacatcgggattatcgaaactacttgggactacgccagcgaccacggggagaaaaaactgattagcgtagataccgagcactcaaacatttacctgcagaacggaccggaccggatcggccgcctgtataaaaaagctctctacctgcaatacacagacgaaacctttagaacaacaatcgaaaagcctgtgtggctcgggttcttaggcccaatcatcaaggcagagactggcgataaggtctatgtccatctgaaaaaccttgcgtccagaccatataccttccattcacatggaatcacttactataaggaacacgagggagctatctatccggataacaccaccgattttcagcgggcagacgacaaagtgtatcccggagaacagtacacatacatgctactggccaccgaggaacagagtcctggtgagggggacggcaactgtgtcactcgcatttaccattcccacattgacgctcctaaagacatcgcaagcggtctgatcggtccactcatcatctgcaagaaagatagtctggacaaggagaaggagaagcacatcgacagggagttcgtggtgatgtttagcgtggtggatgaaaatttctcttggtacctggaagacaacattaagacatactgtagtgagcccgagaaagtagataaagacaacgaggatttccaggagtctaatcgaatgtactccgtcaatgggtatactttcggctctctgccaggattgagcatgtgcgctgaggaccgcgtgaagtggtatctgttcggaatggggaatgaggttgatgtccacgctgccttctttcatggtcaggcgctgacgaataagaattaccggattgacactattaatctgtttccagcgacactcttcgatgcgtacatggtagcccagaatcccggcgagtggatgttatcttgtcaaaacttgaatcacttgaaggccggcttgcaggctttctttcaagtgcaagagtgtaacaagtcgagtagtaaggacaacatcaggggcaagcatgtgcgtcattattacatcgccgccgaggagattatatggaattacgcccctagcggcattgacatttttacaaaagaaaacctaacagctccaggcagcgattctgccgtgttttttgaacagggcaccacgcggataggggggagctacaaaaagctagtgtacagagagtacaccgatgcatctttcactaaccggaaagagcgtggccctgaggaagagcatcttggcatcctggggccagtgatttgggctgaagtgggggatacgatcagggtgacatttcataataagggcgcctacccactgtctatcgagcccattggagtccggtttaacaagaataatgagggaacttactacagtccaaattacaaccctcagtcaagaagtgtgccccctagcgcaagtcatgtggcacctacagaaacatttacctacgagtggactgtgccaaaggaggtcggcccgaccaacgccgatccagtgtgtctcgcgaaaatgtactacagtgctgtggatcctacaaaagacatcttcacggggctaattggccccatgaagatctgtaaaaaaggttccctgcacgctaacggccggcagaaagatgttgataaggagttctacctgttccctacggttttcgatgaaaacgagagcctgcttctcgaagacaatattcgtatgttcacaactgctcctgatcaggtggataaggaggacgaggattttcaggaatccaacaaaatgcactccatgaacgggtttatgtacggcaatcagccggggctgacaatgtgtaagggcgacagtgtcgtgtggtacctgttctctgctggtaatgaggctgatgtgcacggcatttacttttccggcaatacttacctgtggcgaggagagcggcgcgacacagctaacctgttccctcagaccagcttaacactacatatgtggcccgatacagagggcacttttaacgtggaatgtctgacgacggatcactacacgggcggcatgaagcagaagtatacagtgaaccaatgccgaaggcagagcgaagactcaactttttacctgggcgagcgtacgtattacatcgctgctgtagaggtggaatgggactactccccccagagagagtgggagaaggagctccatcatcttcaggagcagaacgtttcaaacgcttttctggataaaggagaattttatatagggtcaaagtacaaaaaagtcgtctaccggcagtacacagatagcacattccgggtgcccgtcgagcgaaaggctgaagaggagcacttagggatcctaggcccacagctgcacgccgatgttggagacaaggtcaaaatcatcttcaagaacatggctacccggccatacagtattcacgcacatggagtccagaccgagagtagcacagtgacccctaccctcccaggcgaaactttgacatacgtgtggaagatccccgaaaggtccggggcgggcaccgaggattcagcgtgtatcccctgggcctactactctactgtcgaccaggtcaaagacctctattctggacttattggccccttaatcgtttgtagacgcccctacctaaaggttttcaaccctcgcaggaagctcgagttcgccttgctattcttggtgttcgacgagaacgaatcttggtacctcgatgacaatatcaaaacttattctgatcaccccgagaaggtgaataaggacgacgaagaattcattgagtctaataaaatgcacgccatcaatgggcggatgttcgggaaccttcaaggcctgacaatgcatgtcggagatgaggtaaattggtaccttatgggaatgggtaatgaaatcgacctgcacacagtacatttccacgggcactcatttcagtacaagcatcggggggtgtactcaagcgacgttttcgacattttcccagggacataccaaactcttgaaatgttcccgcgcaccccagggatctggctgctgcattgccacgtgaccgatcacatccatgctggtatggaaacgacatatacagtgttacagaacgaggatactaagagcggg

SEQ ID NO: 8506 - DNA, 3195 bp, Artificial Sequence
  Description of Artificial Sequence: Synthetic coding sequence
atgaaaatccttatcttgggaatcttcctcttcctctgcagcacccccgcatgggcaaaggagaagcactattacatcggaattatcgaaaccacctgggactacgcgtccgatcatggcgaaaagaagctcatttccgtcgatactgagcactcgaatatctacctgcagaacggcccggatcgcatcggacggctgtataagaaagctctgtacctccagtacactgatgaaacctttcggaccactattgaaaagccggtgtggctgggattcctgggaccgatcatcaaggcggaaaccggcgataaggtctacgtgcacctcaaaaacctggcgtcccgcccgtacactttccactcacacggtatcacctactataaggaacatgagggagcaatctacccggacaacaccactgatttccagcgggctgatgacaaggtgtaccctggtgagcagtacacttacatgttgctggcgactgaagaacagtcgccaggagaaggcgacggcaattgcgtgacccggatttaccactcgcatatcgatgctcctaaagacatcgcatccggcctgatcggccccctgattatctgcaaaaaggattcactggacaaggaaaaagagaaacatattgacagagaattcgtcgtgatgttttccgtagtggacgaaaacttttcgtggtacctggaggacaatatcaagacttattgctcagaacctgagaaggttgacaaagacaatgaagatttccaggagagcaaccgcatgtactctgttaatggttataccttcggcagcctcccaggtttgtcgatgtgcgccgaagatcgcgtgaagtggtacctcttcggcatgggcaacgaagtggatgtccacgccgccttctttcacggacaagcgctcacgaataagaattaccgcatcgacaccatcaatctcttcccagccactctgttcgatgcatacatggtggcccaaaatcctggagaatggatgttgtcctgccagaacctgaaccacttgaaggccggtctgcaagccttttttcaagtgcaagagtgcaacaaatcaagcagcaaggacaacatcagagggaaacatgtcagacactactacatcgccgcagaggagatcatctggaactacgccccgtcaggtatcgacatctttaccaaggagaaccttactgcgccgggatcggactccgctgtgttctttgagcagggaaccactaggatcggcggaagctacaagaagctggtctaccgggaatatactgacgcgagctttaccaatcggaaggaacggggaccggaggaggagcatctgggaattctgggaccggtcatttgggcagaagtgggcgacactattagagtgacctttcacaacaagggcgcctaccctctgtcgatcgagccgatcggcgtcaggttcaacaagaataacgaaggaacctactactccccgaactacaatccgcagagccggtccgtgcctccgtcagcctcgcatgtggccccgaccgaaacgtttacttacgaatggaccgtcccaaaggaggtcggaccaaccaacgccgacccggtgtgcctggcgaagatgtactactcagcggtggatcctaccaaggatatcttcactggattgattggcccaatgaagatctgcaagaaaggttccctccatgccaacggacgccagaaggacgtcgacaaggaattctacctctttccgactgtgttcgacgaaaacgaatccctgctgctggaggataacatccgcatgttcactaccgcgccagatcaggtggataaggaggacgaggacttccaggaaagcaacaagatgcactcaatgaatggcttcatgtacggaaatcaacctggcctgaccatgtgcaaaggcgactccgtggtgtggtacctgttcagcgctggcaatgaggccgatgtgcacggtatttacttctcaggtaacacctacttgtggcgcggcgagcgccgcgatactgccaatctgttcccacagacctcgctgactctccatatgtggccggataccgagggaactttcaatgtggaatgcctgactactgaccattacactgggggcatgaaacagaagtacacggtgaaccagtgtagacgccagtccgaagatagcacgttttacctgggagaacgaacctattacatcgctgccgtggaagtggagtgggactactcccctcaacgggagtgggaaaaggaactccatcacctgcaagagcagaacgtcagcaacgcattcctcgacaaaggcgagttttacattggatccaagtacaaaaaggtggtgtaccgccaatacaccgactccacttttcgcgttcctgtggagaggaaggcggaggaggaacacctgggaatcctgggaccacaattgcacgctgacgtcggagataaggtgaagataatcttcaagaacatggcgactcggccgtactcgatccacgcccacggcgtccagactgagagcagcaccgttactccgactctccctggagagactctcacttacgtgtggaagatcccggaacgcagcggagccggaaccgaagatagcgcgtgcatcccatgggcttactactcaaccgtggatcaggtcaaggacctgtactccggactcatcggaccgctgatcgtgtgccgcaggccttacttgaaagtgttcaacccaagacggaagctggaattcgcgttgctgttcctggtgtttgacgaaaacgagagctggtacctcgatgataacatcaaaacctacagcgaccatccagagaaagttaacaaggacgacgaggaattcatcgagtcaaacaagatgcatgccatcaacgggcgcatgttcggcaatctgcaaggactgaccatgcatgtgggagatgaagtcaattggtacctgatgggaatgggcaatgagatcgacctccacaccgtgcattttcacgggcacagctttcaatacaaacatcggggagtctactcatcggacgtgttcgacattttccctggaacctaccagactttggagatgttcccgagaacgcccggtatctggctccttcattgtcatgtcactgaccatatccatgctggcatggagactacttacactgtgctgcagaacgaggacaccaagtcaggg

SEQ ID NO: 8507 - DNA, 3195 bp, Artificial Sequence
  Description of Artificial Sequence: Synthetic coding sequence
atgaagatattaatcctcggtatttttctcttcctgtgttctacccctgcatgggcaaaggagaagcattactatataggcatcatcgaaaccacttgggattatgccagcgaccacggggagaagaaactgataagtgtggatacagagcactctaatatctatctgcagaatggacccgatcggatagggcgcctgtacaaaaaagccctgtacctgcagtataccgatgagacctttcggaccacaattgaaaagccagtctggctgggattcctaggccccataatcaaggccgaaacaggcgataaggtttacgtgcaccttaagaacttggcctcacggccctacacattccacagtcatggcattacctactataaggagcatgaaggcgccatatacccggataacacgacagactttcagagagcagacgacaaagtctaccccggggagcagtacacgtacatgctcctggctacagaagagcagtctccaggagagggcgacggaaactgcgtgacccgcatctatcactcacatatcgacgctccaaaggatattgcttcaggactcataggccccttgattatatgtaagaaagattcccttgataaggaaaaggagaaacacatcgatcgtgaattcgtcgtcatgtttagtgttgtcgatgagaacttttcctggtatctagaagataatatcaagacatactgctctgagcctgagaaagtggataaggataatgaagatttccaggagagcaataggatgtatagcgttaacggatatacgtttgggagcctccccggcctgtctatgtgcgcagaagatagggtcaaatggtacctgttcggaatgggaaacgaggtggacgtccacgcagcattttttcatgggcaagccctgactaacaagaattatcggatagacaccatcaacctttttccggcaaccctcttcgacgcgtacatggtcgctcaaaaccctggggaatggatgctgtcatgccaaaacctcaaccacctaaaagcagggctgcaagctttttttcaggtccaagagtgtaacaagagttcgtctaaggacaacatcagaggcaagcatgtgcgccattactacatcgccgccgaagagattatttggaactacgccccttcagggatcgatatttttactaaagagaatctcactgctcccgggtccgatagtgcagtgttcttcgaacagggcaccactagaatcggcgggagctataagaagctggtgtaccgggagtacactgacgccagtttcacaaaccgcaaagaacgtggacctgaagaagaacatcttggcattctgggacctgtaatctgggccgaggtcggcgacacaatcagggtgacatttcacaataagggtgcctacccactttccatcgaaccaataggggtccgttttaataagaataacgagggaacatactattccccaaattacaatccgcagagtaggagcgtacccccaagcgccagccacgtggcgcccacggagacattcacttacgagtggactgtgccaaaggaggtcggaccaacgaatgctgacccggtatgtctagcgaagatgtactattcagccgtagaccctactaaggatatctttactggactgataggaccaatgaaaatctgtaagaaaggctccttgcatgccaatgggagacagaaagatgtggacaaagagttctacttgtttcctacagtgtttgatgaaaatgagtcccttctcctggaggacaatatccgaatgtttacgacggctccagatcaggtggataaagaggacgaagactttcaggagagcaacaaaatgcattctatgaatgggttcatgtatgggaaccaacccgggctcactatgtgcaagggcgactcagtcgtgtggtatcttttctctgctggcaacgaggcagatgtgcacggtatttacttctcaggtaatacttacctatggcgtggagaaaggcgggataccgccaacctgttcccacagacatccctgactctgcacatgtggccagacacagagggaacattcaatgtggagtgtcttactaccgaccattacacggggggaatgaagcagaagtacaccgtcaatcagtgtagaaggcaatccgaagactcaacattctacctcggggaacgcacatactatattgcagcggtggaggttgagtgggactattcaccacagcgggagtgggagaaggagctgcatcacctgcaggagcagaacgtgtcaaatgcctttttagacaagggagagttctatatagggtcaaagtacaagaaagtcgtctatagacagtataccgatagtacctttcgcgtgcccgtcgaacgaaaagcagaggaggagcacctcggaatcctgggcccacaattgcacgccgacgtcggagacaaggtgaagataatcttcaagaacatggccacaaggccatatagcatccatgcccacggagtgcagactgagtctagcaccgttacacctacactccccggagagaccctcacctacgtgtggaaaattccagagcggagtggtgcagggacggaagactccgcctgcatcccatgggcgtactacagcaccgtggaccaggttaaggacctgtatagtggcctcattggaccactgattgtgtgcaggaggccctacttgaaggtgtttaacccaaggaggaaactcgagtttgccctgttgtttttagtttttgatgaaaacgagtcatggtatctcgacgataatataaaaacatacagcgaccacccagagaaggtaaacaaggacgacgaagagttcatagagtctaacaaaatgcatgccattaatgggcgcatgttcgggaacttgcaaggactgaccatgcatgtcggagacgaggtgaactggtatctgatgggaatggggaacgagatagacctgcacaccgttcacttccatgggcactcctttcagtataagcaccgcggcgtttacagcagtgacgtgttcgacatctttcccggtacctatcagaccctggaaatgttccctcggactcctggtatctggttactacactgccatgtgactgatcacatccatgcaggcatggagactacatacacggtgttgcagaacgaagacaccaagagcgga

SEQ ID NO: 8508 - DNA, 3195 bp, Artificial Sequence
  Description of Artificial Sequence: Synthetic coding sequence
atgaagatcctcattcttggcattttcttgtttttgtgtagtacgccggcatgggcgaaggaaaaacactactatattggcatcattgagactacatgggattacgcctctgatcatggcgaaaagaaacttatctctgttgacacggagcattctaatatctaccttcagaatgggcccgaccgtatcggaagactttataaaaaagctttatatttgcagtatactgatgagacatttaggacaacaatcgagaagccagtctggcttggctttttgggacccatcataaaagctgagaccggtgacaaggtctatgtgcacctaaaaaacttggcatcgcgaccctatacgttccactcccacggcatcacatactacaaggagcatgaaggagctatttatccagataacactacagattttcagcgggcagatgacaaggtataccccggcgaacaatacacgtacatgttgcttgcgaccgaagaacagtcccccggagaaggggatggcaattgtgtgacacgtatttatcacagtcatatagatgcccctaaagatatcgcaagcggtcttattggacccctcatcatttgcaagaaggattccctagacaaggagaaggagaaacatatcgatagagagttcgtcgttatgttttccgtggttgatgaaaatttctcttggtatctcgaagataatatcaaaacctactgcagtgaacccgaaaaagtggacaaggataacgaagatttccaagaatcaaaccgtatgtattccgtcaacggctatacttttggttctcttccaggcctatcaatgtgcgcggaagaccgtgttaaatggtacctttttggaatggggaatgaagttgacgttcacgccgcattcttccatggtcaagcgctgacaaacaagaattatcggatcgatacaattaacctattccctgctacactcttcgatgcttacatggtcgcacagaatccgggggagtggatgctctcctgtcagaatttaaaccacctgaaggcaggcctccaagcttttttccaagtacaggaatgtaataaaagcagctccaaggataacatccgtggtaagcacgttcggcattactacattgcggcagaagaaatcatttggaactacgcgccatctggcattgatatcttcactaaagagaatctaactgctccgggttccgatagtgcagttttcttcgagcaaggaaccacacgaattggaggctcttataaaaagctcgtgtatcgagagtatactgacgcttcgtttacgaatcggaaggagcgcggccctgaagaagagcatctaggtatactaggcccagtgatctgggccgaggtaggggacaccatccgcgtgacctttcataataaaggcgcttaccccttatcgattgagcctatcggtgtgcgcttcaacaagaacaacgagggaacgtactatagccctaactataatcctcaatcgcggtccgtccccccgtcggcatcgcatgttgcaccaaccgaaaccttcacgtacgaatggaccgtccccaaagaggtcggcccaacaaatgcagatccagtttgtttggccaagatgtactacagcgccgtggatccaaccaaggatatattcacgggactcataggacctatgaaaatatgtaagaaaggatcgctccacgcaaacggacgccaaaaagatgtggacaaggagttttatttgtttccaaccgtcttcgatgaaaacgagagcttgttgctggaggataacattcgtatgtttaccaccgcaccggaccaagtagataaggaggatgaagacttccaagagtccaacaagatgcatagcatgaacggtttcatgtatggaaatcaaccaggcttgactatgtgcaaaggtgactcggtggtctggtatctctttagtgccggtaatgaagctgatgtccatgggatatacttttctggcaacacatacttgtggcgcggagagagacgcgacaccgccaacctgttcccccagacatctctgacccttcatatgtggcccgacaccgaaggcaccttcaatgtggagtgccttaccactgaccactacacaggcgggatgaaacagaagtataccgtaaatcaatgtagaaggcaatcagaggattccacgttctatctcggagagcggacctattatatcgcggcagtcgaggtagaatgggattattcacctcaacgtgagtgggagaaggaattacaccatttacaggaacagaacgtttctaatgcattcctagataagggtgagttctatattggttcgaagtacaagaaggtggtctataggcagtacacagactccaccttccgggttcctgtggaacgtaaggctgaggaggagcatctcggtatcttgggcccacaacttcacgccgacgtcggagacaaggtgaagatcatcttcaaaaacatggccactcgtccgtacagcattcacgctcatggagtccagacggagagctccaccgtaactcctacactcccgggggaaacactgacgtacgtctggaagatcccggaaaggtcgggtgcagggactgaagattctgcttgcataccatgggcatattattccactgtggaccaagttaaggatttatacagcggtctcatagggccgttaatcgtgtgtcgtaggccatatcttaaggttttcaatcctcgtcggaaacttgagtttgcgctgttgttccttgtttttgacgagaatgagtcgtggtacttggatgataacattaagacgtacagcgatcaccccgaaaaggttaacaaggatgacgaggagtttattgagtccaataagatgcatgcgataaacggtaggatgttcgggaacctacagggtttgactatgcacgtgggcgatgaggtcaattggtatcttatgggcatggggaacgaaattgaccttcatacggtgcacttccacggacattcctttcaatacaagcataggggtgtgtattcaagcgatgtgttcgacatttttcccggaacatatcagaccctcgagatgtttccacgcacgccaggcatttggttgcttcattgccatgtcaccgaccatattcacgcaggaatggagaccacgtatactgtcttacaaaatgaggatactaagtctggc

SEQ ID NO: 8509 - DNA, 3195 bp, Artificial Sequence
  Description of Artificial Sequence: Synthetic coding sequence
atgaaaatcctgatcctgggaatctttctgttcctatgttccactccagcttgggccaaagagaaacactattacattggtattatcgagacgacatgggactatgcatctgatcacggagaaaaaaaactcataagcgtggatacagaacacagtaacatctaccttcaaaacggtcctgaccggattggccgcctctataagaaagccctctacctccagtacaccgacgaaacattcagaaccactatagagaaacctgtttggcttggtttcctgggaccaattattaaggcggagaccggggataaggtgtacgttcacttgaaaaatttggcctcccgtccatatacatttcactcccacggtataacatattacaaagagcatgaaggcgctatctatccagacaacacaaccgattttcagcgcgccgacgataaagtatatcctggagaacagtacacttatatgttgctcgccacagaagaacagagtccaggcgagggagatggaaactgtgtcaccagaatttaccattctcatatcgatgctcccaaagatatcgcaagcggactgatcggaccattaatcatttgcaaaaaagatagcctggacaaagagaaggagaagcatatcgatagggaattcgtagttatgttttctgttgtcgatgaaaacttttcctggtacctggaagataacattaaaacgtattgcagtgaaccagagaaggtagacaaagacaacgaggatttccaggaaagcaaccggatgtactctgtaaacggatacacttttggatccctgccggggctgtctatgtgtgcggaggaccgagtcaaatggtacctcttcggcatgggaaatgaggtggacgtgcacgcagcttttttccacggccaggcgcttaccaataagaactacagaatcgatacaatcaacttgttccccgccaccctctttgatgcttacatggtcgctcagaaccccggcgagtggatgctctcatgtcaaaatctgaaccatttaaaggctgggcttcaggcattcttccaagttcaagaatgcaataagtcatcttctaaggataacataagaggaaagcatgtgcgccattactacatcgctgctgaggaaatcatctggaattacgcaccgagcggtattgatatctttaccaaagagaacctgaccgcccccggatcagacagcgccgtcttctttgagcaaggcacaacccgcatcggcggcagctataagaaactggtctaccgcgaatatacagacgcgtctttcaccaaccggaaagagcgcggacccgaggaggaacatctaggtatacttggccccgtgatctgggccgaggtgggagataccatccgtgtgacctttcataacaagggtgcttaccccctcagcatcgaacctattggtgtgcgcttcaacaaaaataacgaaggtacatactattctcctaattataatccacagtcccgctctgttcctccctccgcctctcacgttgctcctactgagacattcacctatgaatggaccgtacctaaggaagtgggacctacaaacgcagacccagtgtgcctggctaaaatgtactactcagcagtagaccctacaaaagatatttttaccggcctcatcggcccgatgaagatatgcaagaagggaagcctccatgctaacggccggcagaaggatgtcgacaaagagttctatctgtttccaaccgtctttgatgagaacgagtctctgctcctggaggataacatacggatgttcacgaccgctcctgatcaggtcgataaggaggacgaggactttcaggaaagtaataaaatgcacagcatgaacggctttatgtacggcaaccagcccggactgactatgtgtaaaggagactcagtcgtatggtacctgtttagcgcaggcaatgaagcagatgtgcacggaatctactttagcggcaatacttatctttggaggggcgaacggagggacacggctaatctttttccccagacttcactcactctgcacatgtggccagatactgaaggaactttcaacgtggaatgccttaccactgatcattatacaggcggaatgaaacagaagtacaccgtgaaccaatgcagaaggcagagcgaagatagcaccttttatctgggggagagaacctactacattgccgccgtggaagtcgagtgggactattcacctcagcgcgagtgggaaaaggaactgcatcatctacaggaacagaatgtgagcaatgcattcttggataaaggcgaattctacatcggatcaaaatacaagaaagttgtctatcggcaatacacagatagtaccttccgagtgccagtggagagaaaggcggaggaagaacacttggggatcttagggccccaactgcacgcagacgttggcgacaaggtcaaaatcatttttaagaacatggccactaggccttactcgattcacgcacatggcgttcagactgagagctctacagttacacctacccttccaggcgaaaccctcacctatgtgtggaagatccccgaaagaagtggtgcaggaactgaggatagcgcttgcatcccatgggcatattactctaccgtcgaccaagttaaagacctgtatagcgggttgatcggacctcttattgtctgtagaaggccatatctgaaagtcttcaatccaaggcgaaaactggaatttgcccttctcttcctggtgttcgatgaaaacgagagctggtacctcgacgacaacatcaaaacctatagcgaccatcccgaaaaagtgaacaaagacgacgaggagtttatcgagtctaacaagatgcatgcgattaacggaaggatgtttggaaacctccaagggctgaccatgcacgtgggcgacgaggtgaattggtacctgatgggaatgggtaatgagatcgacctgcacactgtgcattttcacggccacagcttccagtacaaacacaggggagtgtactcctctgatgttttcgacatctttcctggtacttaccagaccttagaaatgttccctcgcacccccgggatttggctcctgcactgtcatgtgaccgatcacatccatgcaggcatggagaccacctataccgtcctgcaaaacgaggataccaagtctggt

SEQ ID NO: 8510 - DNA, 3195 bp, Artificial Sequence
  Description of Artificial Sequence: Synthetic coding sequence
atgaaaatactgatcctcggaattttcctgttcctatgctccacccccgcctgggcaaaggaaaaacattattacatcgggatcatcgagactacatgggattacgcctcagaccacggggaaaaaaagctgatttccgtcgacactgagcactcaaacatatatctgcaaaacggaccagatagaataggccgcctgtacaaaaaggccttatatttacaatatacggacgaaacattcaggaccacaatcgagaagccggtgtggctaggattcctgggtcccatcattaaagcggaaaccggggacaaagtgtatgtgcaccttaagaatctggcctcacggccctacactttccattcccacggcattacctactataaggagcacgagggggccatttaccccgacaataccactgacttccagcgcgccgacgataaggtttatcccggagagcaatatacatatatgcttttggctacagaggaacagtcccctggcgagggcgacggtaactgcgtgacgcgcatttaccactcccacattgacgcacctaaagacatcgcgtcagggctgatcggccctctcattatttgcaagaaggacagcttagacaaggaaaaagagaaacatatcgacagggagtttgtagtgatgtttagtgtggttgacgagaatttttcttggtacctcgaggataatatcaaaacatactgctctgaaccagagaaagtggataaagataatgaagacttccaggaaagtaaccgcatgtacagtgtgaacggttacacgttcggttctctgcctggactgagcatgtgcgccgaggaccgggtcaagtggtatttattcggcatgggcaacgaagtggacgtgcacgccgctttcttccatggacaggcactgacaaataaaaactatcgtatcgacacaatcaatctcttcccagctacactgttcgatgcatatatggtagctcaaaatcccggcgagtggatgctatcatgccaaaatctgaaccacttgaaagccggactgcaagcgttttttcaagttcaagaatgcaataagtcaagctcgaaagataatattcggggaaagcacgtccgccactactacatcgccgctgaggaaataatatggaattacgcccctagcgggattgatatttttactaaagagaacctgaccgctcctggctctgatagtgctgtgttcttcgagcagggaactacacgcatcgggggaagttacaagaaactggtttacagggaatatacggacgccagcttcactaaccgaaaagagaggggcccagaggaggagcatctcggtatcctagggcccgtgatatgggccgaggtcggagacacgatacgcgtgaccttccacaacaagggggcgtatcctcttagcatcgaacccattggggttcggtttaataagaacaatgaaggcacttactactcaccgaactataatcctcagagtcggtccgtgcctccatcggccagtcatgtcgcccctactgaaacattcacttacgaatggacagtgcccaaggaggttggacctaccaatgcggatcctgtgtgcttggcaaagatgtactactccgcagtagatcctacgaaggacattttcaccggcctcattggccctatgaagatctgcaaaaaaggcagtcttcacgctaatggtcgacagaaggatgtagacaaggagttttaccttttccccacggtgtttgacgaaaacgagtcccttctgttggaggataacatcaggatgttcacgaccgcacctgatcaagtcgacaaagaggatgaagattttcaagaaagtaataaaatgcactccatgaacggtttcatgtatggcaaccaacctggcctgaccatgtgtaaaggcgatagtgtggtgtggtatctgttttccgctggcaacgaggctgacgtgcacggcatctatttcagtggaaatacatatttgtggaggggcgagcgccgcgacacagcgaacttgttcccccagacgtctctgaccttacacatgtggcctgataccgagggcacttttaatgtggagtgtctcacaaccgatcattacaccggcggtatgaaacagaaatacaccgttaatcagtgcagacgtcagtctgaagacagcaccttttacctcggcgagaggacgtactatattgccgctgtggaggtcgagtgggattattcaccccaaagagaatgggaaaaagaactgcaccacctgcaagaacagaacgtgagtaacgcgtttctggacaaaggtgagttctacatcggctctaagtacaaaaaagtggtatatcgccaatacaccgactcgacttttagggtccccgttgaaaggaaggctgaagaggagcatctaggcatccttggaccacaactacacgcggacgtcggggacaaagtgaagataatatttaaaaacatggccactaggccgtattcaatccatgcccacggggtccagaccgagagctccacagtgacccccaccttgccaggagagacactcacgtacgtatggaagattcccgagcggtccggggccggtacggaggactctgcttgcatcccttgggcatattattccaccgttgaccaggtgaaggatttatacagcggactgatcggcccactaatcgtctgcaggcgcccctatctgaaggttttcaaccctcggaggaagctggagtttgcactgttgtttctggtgtttgatgaaaacgaatcctggtatctcgatgataacatcaagacttattctgaccatccagagaaggtgaacaaagatgatgaggaattcatagaatctaataagatgcatgccatcaacggtcgcatgtttggcaatcttcagggcttgactatgcatgttggcgatgaggtcaattggtacctcatggggatgggcaatgagatagacctccataccgttcacttccacggacacagcttccaatataagcataggggcgtgtactcatcggacgtgttcgatatctttcctggcacataccaaacgcttgaaatgttccctcgtactccaggcatttggctgctgcattgtcacgttacggaccacatacatgctggcatggagaccacttacacagttttgcagaatgaagataccaagtccgga

SEQ ID NO: 8511 - DNA, 3195 bp, Artificial Sequence
  Description of Artificial Sequence: Synthetic coding sequence
atgaagatccttattctggggattttcttgttcctttgcagcacccccgcgtgggccaaagagaagcattactacattgggattattgagacgacttgggattacgcatctgatcatggggagaagaaactcatatccgtggacaccgagcactcgaacatctatctccaaaatgggcctgaccggattggtagattgtacaagaaggccttgtacctgcagtatactgatgagactttcaggactactatcgagaagcctgtgtggcttggttttctgggccccataatcaaagccgaaaccggcgacaaggtttacgtgcatctgaagaatcttgccagccgcccttacactttccattcgcatggtattacctactacaaggagcatgagggagcaatttacccagataataccaccgattttcaacgagccgatgataaagtgtaccccggagagcaatacacttacatgcttctggcaaccgaggaacagtcccctggtgaaggagatggcaattgcgtgactagaatttaccactcgcatatcgatgcaccaaaggacattgcatccggtctgatcggccccctgatcatctgcaagaaagattccctggataaggaaaaggagaaacatattgatagggagttcgtggtgatgttttcggtggtggatgagaatttctcctggtacctcgaagataacattaagacctactgttcagagccagaaaaggtggataaagacaacgaagatttccaagagtccaacagaatgtattcggtgaacggatatacttttggatcacttcccggactctcgatgtgcgcagaagatagggtcaagtggtacctttttggaatgggtaacgaagtggacgtccatgctgcattctttcatggccaggcactgaccaacaagaactacagaatcgatactattaacctgttcccagccaccctgttcgatgcgtacatggtggcacaaaaccctggtgagtggatgctgtcatgtcaaaacctgaaccatttgaaggcaggattgcaggcatttttccaagtgcaagaatgtaataagtccagcagcaaggataacattcggggtaagcacgtcagacactactacattgccgcagaggaaatcatatggaactacgcaccatcaggaatcgacattttcaccaaggaaaacctgacggcaccggggagcgattcagccgtattctttgaacagggtaccacccgtatcggagggtcatacaagaagttggtgtatcgagaatacactgatgcgtcatttactaaccgaaaggaaagaggtcccgaggaagagcatctgggaatcctgggccctgtgatttgggcagaggtcggagacaccatccgtgtgactttccacaacaagggtgcataccccctttcaatcgaacctatcggggtgagatttaacaagaacaacgagggtacctactactcgcccaactataatcctcagagcaggtccgtgcctccttctgcaagccacgtcgcacctaccgaaaccttcacttacgaatggactgtgcccaaggaggtgggccctactaatgcagacccggtgtgtctcgctaagatgtattacagcgcagtcgaccccaccaaggacatctttaccggtttgatcgggcctatgaagatttgtaaaaagggctcgcttcatgccaacggacgtcaaaaggacgtcgataaagagttttaccttttcccaaccgtgttcgacgaaaacgaatcacttctcctcgaggacaacatacggatgtttaccaccgcgccagaccaagtggacaaggaggatgaggactttcaagaaagtaacaagatgcattcgatgaacggttttatgtacggtaatcaaccaggtctgaccatgtgtaaaggggactcggtcgtctggtacctgttctccgcaggtaacgaagcagatgtgcacggaatatacttttcgggtaatacttacctctggcgaggagaacgtcgcgacactgcaaacctttttccacaaacgtcgctgaccctgcatatgtggccagatactgaaggaacttttaacgtggagtgtttgacgacggatcactacaccggcggtatgaagcagaagtacaccgttaatcagtgtcgtagacagtcagaagattccacgttttacctgggggaaaggacttactatatagcagcagtggaagtcgagtgggattactccccacagcgggagtgggagaaggaactccatcatctccaagaacaaaacgtctcgaacgcattcctggacaagggggaattctacatagggtcaaagtacaagaaagtggtgtacaggcagtacacggattcgacttttcgcgtgcctgtggaaagaaaagccgaagaagaacacttgggtattctgggacctcagctccatgctgatgtgggagacaaggtcaagatcattttcaagaacatggcaacccggccctactcgatccatgcccatggcgtgcagactgagtcatcaactgtgactccaactctccctggtgaaactctgacctacgtctggaagattccagaacggtccggagccggaaccgaagattcagcttgtattccttgggcgtactactccacggtcgaccaggtgaaggatctttactcaggtctgatcggaccactgatcgtctgtaggcgtccctacctcaaggtgtttaatcctaggagaaaactggaatttgcactgctctttctggtgtttgacgagaatgagtcgtggtaccttgatgataacatcaaaacctactcggatcatcctgaaaaggtcaacaaagacgatgaggagtttattgagtccaataagatgcatgctattaacggacgaatgtttggtaatcttcagggtctgacgatgcatgtgggggacgaagtgaactggtacctgatgggaatgggaaacgaaattgatcttcatactgtccacttccatggccattcctttcagtacaaacaccggggcgtctattcaagtgatgtgtttgatatcttccctgggacttaccagacgctggaaatgtttcctagaacccctgggatctggctgctgcattgccacgtgaccgatcatattcacgccggtatggaaaccacctacaccgtcctccaaaacgaggatactaaatcgggt

SEQ ID NO: 8512 - DNA, 3195 bp, Artificial Sequence
  Description of Artificial Sequence: Synthetic coding sequence
atgaagatcttaatactgggcattttcctttttttatgttccactcccgcttgggctaaagagaagcattactacatcggaataatagaaactacttgggactacgctagcgaccacggcgaaaaaaagctgatatctgtcgataccgagcacagcaacatatatctacaaaacggtcccgaccgcattggtaggttgtacaaaaaggccctgtatctccagtacactgatgagactttcaggaccaccatagagaagcctgtgtggttgggctttttaggcccaatcatcaaggcagaaacaggtgacaaggtatacgtgcacctgaaaaatctggcctcccggccatatacatttcacagccatggcatcacttactacaaagaacacgagggggccatctaccctgataacactactgacttccagcgtgctgacgacaaggtatacccaggcgaacagtacacatatatgctcctggctactgaggagcagtcacctggcgagggagacggtaactgtgtgacaaggatttatcatagccacattgacgccccgaaggatattgcgtcgggcttgatcggacccctgatcatctgcaaaaaagacagtcttgacaaggagaaagagaaacacattgacagagagtttgtagtgatgttctctgtggtggacgaaaactttagctggtacctcgaagataatattaagacatactgttctgagcccgagaaggttgataaagataatgaagatttccaggagtcgaatcggatgtactctgtaaatggatatacatttggctctctcccagggctttctatgtgcgccgaggacagggtgaagtggtatctgtttggtatgggcaatgaagtcgacgttcacgccgcctttttccacggacaggcgttgaccaacaagaactatagaatagacacgatcaatttatttcctgcaacactgtttgacgcctacatggtggcccagaaccctggagagtggatgctgtcctgtcagaatttgaaccatctgaaggcgggtttgcaggccttttttcaagtgcaggaatgcaataaatcctccagtaaggacaatataagaggcaaacacgtgcgacattactacatcgccgcagaggaaatcatttggaattatgcgccgtcaggaatagacatttttaccaaagagaacctgactgctccgggcagtgattcagcagtgttcttcgagcaagggactacacggatcgggggttcctataaaaaactggtttaccgcgagtacacggatgccagctttacgaatcgtaaagaaagggggcccgaggaagagcatctcggcatcctggggcccgtgatttgggccgaggtgggagatactatcagagtaaccttccataataagggagcctatcccttgtctatagaaccaatcggagtcaggttcaacaagaataatgagggcacctactatagccctaactacaatcctcagagccgatccgtgccaccttctgcttcgcatgtggctcctacggagactttcacgtacgaatggaccgtccccaaggaagtcgggccaacaaacgccgaccctgtctgtctagcgaagatgtattatagcgctgtcgacccgaccaaggacatattcacaggcttaatcggcccgatgaaaatttgtaagaaggggtccctgcacgcaaacggaagacagaaggacgtggacaaggagttttacctgtttcctacggtctttgacgagaacgagtcacttctgctggaggacaacattcgcatgtttacaactgcccctgaccaggtggataaagaggatgaagacttccaagaaagtaacaaaatgcactccatgaacgggtttatgtatggcaaccaaccaggactgaccatgtgtaagggtgactccgttgtctggtacctgttctccgctggaaacgaagcggatgtgcacgggatctattttagcggtaatacgtatctttggcggggagagagaagagacactgccaacctgtttccacagacctcccttacactgcatatgtggccagacactgagggtacatttaatgtggagtgccttacaaccgatcactacacgggcggaatgaagcaaaaatacactgtcaatcagtgtcgaagacagtcagaggattccacgttttaccttggcgaacgcacttattacattgcagcagtggaagtggaatgggactactctcctcaacgggaatgggaaaaggaacttcaccacctccaggaacaaaatgtcagcaacgcattcctggataaaggcgaattctacattggatccaagtataagaaagtggtgtaccggcaatacaccgactccacattcagggtgcccgtcgagcggaaagctgaagaagagcatcttggaattcttgggccccaactgcacgcggacgttggagacaaggtgaagatcatttttaagaatatggccacccgtccgtactcaatccacgcccatggagtgcagacagaatctagcactgtaacacccacactgcccggcgagacattaacgtacgtgtggaagatcccagaacgttctggcgctggaaccgaggactctgcttgcatcccctgggcatattactcgactgtggatcaggtgaaagatctgtactcaggtctgatcgggcccctgattgtgtgtagacgcccgtacctgaaagttttcaaccctaggcgcaagctggagttcgcgctcctgtttctggtgttcgacgagaatgagtcttggtatcttgacgacaacatcaaaacatattctgatcatccagagaaggtaaacaaggatgacgaagagttcatcgagagcaacaaaatgcatgcaattaatggacggatgttcggcaacctgcaagggctaactatgcatgtgggagacgaagtgaattggtatctgatgggaatggggaatgagattgacttgcacactgttcacttccatggccattcatttcagtacaaacaccgcggcgtgtacagcagcgatgtgttcgacatatttcccggaacctaccaaactttggaaatgttcccccgcactcccggaatatggctcctgcactgccatgttacagatcacatccacgctggaatggaaaccacatatacagtattacagaatgaagataccaagtccgga

SEQ ID NO: 8513 - DNA, 3195 bp, Artificial Sequence
  Description of Artificial Sequence: Synthetic coding sequence
atgaagatcctcatcctcgggatcttcctcttcctgtgctcgactcctgcatgggccaaggagaaacactactacatcggaatcatcgagactacctgggattatgcgtccgaccacggagaaaagaagttgatcagcgtggatactgaacactcgaacatctacttgcagaacgggccggaccggattggacgcctgtacaaaaaggctctctacctgcaatacaccgatgaaaccttccggacgaccatcgaaaagccggtgtggcttggctttctcggaccaatcatcaaggccgaaactggcgacaaagtgtacgtgcatctcaagaacctggcatccagaccatataccttccacagccatggaattacgtactacaaggagcacgaaggcgcaatttacccagataacactactgacttccagcgcgcagacgataaggtctacccaggagagcaatacacctatatgctgctcgccactgaagagcaatcaccaggggaaggggatgggaactgcgtcacccggatctaccattcccatattgatgctcctaaggatatcgcatcgggcttgatcggaccgctgataatctgtaagaaagacagcttggacaaggagaaggaaaagcacatcgacagagagttcgtcgtgatgttcagcgtcgtcgacgaaaacttctcctggtatctcgaagataacattaagacttactgctcagagcccgagaaggtcgacaaggacaacgaagattttcaggagtccaaccgcatgtactcggtcaatggttacactttcgggtcgctcccgggactgtcaatgtgcgccgaggaccgcgttaagtggtatcttttcggaatgggtaatgaagtggatgtgcacgctgccttcttccacgggcaggcacttaccaataagaattacagaatcgacaccatcaatctgttcccagctaccctcttcgacgcatacatggtggcccagaatcctggcgaatggatgctgtcatgccaaaatctgaaccatctgaaggcaggactgcaggcctttttccaggtccaggaatgtaataagtcctcgtccaaagacaacatccggggaaagcacgtgagacattactacatcgcggcagaggagattatctggaactacgccccttccggaatcgacatattcactaaggagaacctcaccgcccctggatcagacagcgctgtgttcttcgaacagggaaccactcggatcgggggatcgtacaagaagctggtttaccgcgagtacacggacgcctccttcaccaacaggaaagaacggggcccggaggaagaacacttgggtattctcggtcctgtgatctgggccgaagtgggcgacacgattcgcgtgaccttccataacaagggagcatacccgctgtccatcgaacctatcggagtgcggttcaataagaacaatgaaggaacttactactccccgaattacaacccacagtcgcgctccgtcccaccgtcagcatcgcatgtggcccctaccgagacttttacctacgagtggaccgtcccgaaggaagtgggaccaacgaacgcggaccctgtgtgtctggctaaaatgtattacagcgccgtggatcctactaaggacatctttaccggactgatcggaccgatgaagatttgtaagaaagggagtctgcatgctaatggacgccagaaggatgtggataaggagttctacctgttcccaactgtgttcgatgaaaacgagtccctgctgctggaggacaatattcgtatgttcaccacggcgccagaccaagtggacaaggaagatgaggacttccaagaatccaacaaaatgcactccatgaacggttttatgtacggaaaccaaccggggttgacgatgtgcaagggggacagcgtggtttggtatctgttctctgccggaaacgaggctgatgtccacggaatttacttctcaggaaacacttatctgtggagaggcgaaagacgcgacactgccaacctgtttccgcagacctccctcaccctccatatgtggccggacaccgaaggcacgtttaacgtggaatgtttgacgaccgaccactacaccgggggaatgaagcagaagtacactgtgaatcagtgtcgcagacagtcggaggactcgactttctacctgggagaacggacttactatatcgcggccgtcgaagtggaatgggattacagcccccaacgcgaatgggaaaaagaactgcaccacttgcaggagcagaacgtgtcgaacgcgttcctcgacaagggagagttctacatcggatccaagtacaaaaaagtggtgtacagacagtataccgactccaccttcagagtgccggtggagcgcaaggcggaagaagagcacctcggcatcctgggtccgcagctgcacgccgatgtgggggacaaggtgaaaatcattttcaagaatatggcgaccagaccttactccatccacgcccacggcgtccagaccgagtcgtcaactgtgactccgacgttgcctggagaaactcttacttacgtgtggaaaatcccagaacgctcgggtgcagggaccgaggacagcgcgtgcatcccatgggcctactactcaacggtggaccaagtgaaggacctctactccggacttatcggaccgctcatcgtgtgcaggcggccgtacttgaaagtgttcaatccccggcgcaagttggagttcgccctcctgtttctggtgtttgacgagaacgagtcgtggtacctcgatgataacatcaaaacctattcggaccatcctgagaaggtgaacaaggacgatgaggagtttatcgaatcgaataagatgcatgccattaacggacgcatgttcggcaacctccagggccttaccatgcatgtgggagacgaagtgaattggtatttgatggggatgggaaatgagatagacctccacactgtccactttcatggtcacagcttccagtacaagcatcgcggtgtctactctagcgatgtgtttgacatcttccctggaacgtaccagactctggaaatgttcccacgcaccccgggtatttggctgctgcactgccatgtgaccgaccatatccatgccgggatggaaaccacgtacactgtgctgcagaacgaggacactaagtcaggc

SEQ ID NO: 8514 - DNA, 3195 bp, Artificial Sequence
  Description of Artificial Sequence: Synthetic coding sequence
atgaagatcctgattctgggaatttttctgtttctgtgtagtacgccagcctgggccaaggagaagcattactacatcgggatcattgagactacctgggactacgcatctgaccacggagagaaaaagctcataagcgtcgacactgagcacagcaacatctatctccagaatgggccggataggataggccggctgtataaaaaggcactttacctgcaatacaccgatgagactttccgcactaccatcgagaaacctgtctggctgggtttcttagggccaatcataaaagccgagacaggagacaaggtctatgtgcacctcaagaatcttgccagccggccctacaccttccattcccacggaatcacttattataaagaacacgaaggagcaatctaccctgacaacaccaccgacttccagagagccgatgacaaagtctatcccggggaacagtatacatacatgttgctggccacagaagaacaaagccccggagagggggacggtaattgtgtaacgcggatttaccactcccatatagacgcgcccaaggacatcgcgtcaggcctgataggaccactgattatttgcaaaaaggattcccttgataaggagaaggagaaacacatcgaccgggaattcgttgtcatgttttctgtggtggatgagaatttcagctggtacctggaggacaatattaaaacgtattgttcagaacccgagaaggtagacaaagacaatgaagattttcaggagtctaaccgtatgtatagcgttaatggttatacgttcggatcactccctggtctgtccatgtgtgctgaagatcgtgttaagtggtatctgttcggaatgggtaacgaggtcgatgtgcatgccgctttctttcatgggcaagcactcaccaacaagaattataggatcgacacaattaatctgtttcctgctaccctatttgacgcatatatggttgctcagaatccgggcgagtggatgctatcctgccagaacttgaaccacctgaaagcaggactgcaggcattcttccaggtacaggagtgcaataaatcatcgtccaaagataacatacgaggcaagcatgtgcgccactactatattgctgccgaggaaattatatggaactacgccccatcggggatagatatttttaccaaggagaatctgacagccccgggcagcgatagtgccgtcttctttgaacagggtactactcggataggcggttcctataaaaagctagtgtatcgtgaatatacagatgctagttttaccaatcgcaaagagcgagggcctgaggaggaacacttgggcatcctaggacccgtgatatgggcagaagtgggggatacaataagagtcacattccacaataagggtgcttatcccctttctatagagccaatcggagtgcgttttaacaaaaataacgaaggcacatattactcacctaactacaacccacagagcaggtcggtgcccccatcagcctcccatgttgcccccacagaaaccttcacttatgagtggaccgtcccaaaagaagtggggcctacgaatgcggaccccgtgtgcctcgccaaaatgtactacagtgccgtcgacccaacgaaggatatctttactggtttaattggtcccatgaagatttgcaagaagggcagcttacacgcaaacgggagacaaaaggacgtggacaaggagttttacctgtttcctacggtatttgatgaaaatgaatccctactgctcgaagataacattcgcatgttcactaccgctcccgaccaagtggacaaagaggacgaagattttcaagaaagcaacaaaatgcactccatgaatggcttcatgtatggcaatcagccaggactgaccatgtgtaaaggtgactccgtcgtctggtatttgttcagcgcaggcaacgaggccgacgttcatggaatttacttctccgggaatacttatctgtggagaggggagaggcgagacactgctaacctgtttccccagacttctcttacactgcatatgtggcctgacactgaaggtacctttaatgttgaatgcctcactacagatcattatacagggggcatgaaacaaaagtacaccgtaaatcagtgtcgcaggcagagtgaggattctaccttctatctgggcgagcggacttactatattgcagctgtggaggtggagtgggattactccccacagcgggaatgggagaaggagctgcaccaccttcaggaacagaacgtgagcaatgcgttccttgataagggcgaattttacataggatctaagtacaaaaaggtggtatacaggcagtatacagattcaacatttagagtccccgtcgagcggaaggcagaggaggagcatctgggaatcctgggcccacagcttcacgctgacgtaggtgacaaggtgaaaataatttttaaaaacatggcaactcgtccatacagtattcacgcgcatggagtacagacggaaagctctacagtcacccccactctgcctggagaaactttgacctatgtctggaagattccagaacggtctggcgccggcactgaggattcagcctgtatcccgtgggcctattactctaccgttgaccaggtgaaggacctttactctggacttatcgggcctctaatcgtgtgtcgtaggccttacctgaaggtgtttaacccccgcaggaagcttgaattcgccttactgttcttagtcttcgacgagaacgaatcatggtacctggacgacaacatcaagacttactccgatcatccggaaaaagttaataaagatgacgaagagtttattgagtctaacaagatgcacgccatcaatggacggatgttcggcaacttgcaggggctcacaatgcatgtgggagatgaagtaaattggtaccttatgggaatgggcaatgagattgacctgcacactgtccatttccacgggcattcttttcagtacaaacatagaggtgtgtacagttctgacgtctttgatatattccctggcacttatcagacactcgagatgttcccccgtacaccaggaatttggttgctgcactgccacgttactgaccacatacacgcaggcatggagacgacctacaccgtgctgcaaaatgaggatactaagtctggt

SEQ ID NO: 8515 - DNA, 3195 bp, Artificial Sequence
  Description of Artificial Sequence: Synthetic coding sequence
atgaagattttaattctgggcatctttctcttcctgtgcagcacgccagcctgggctaaagagaagcactattatatcgggattatagaaactacatgggattacgcaagcgaccacggggaaaaaaagctgataagtgtggacaccgaacatagtaacatctatctccagaatggccccgatagaatcggccgcctctacaagaaggcactatacttacagtataccgacgagacttttaggactaccatcgagaagcctgtgtggcttgggtttctagggccgataatcaaggccgaaacaggcgacaaggtgtatgtacacctgaaaaacctggcttcccggccctacaccttccacagccacggaattacctactataaggagcacgagggcgccatatatccagacaacactactgacttccagagagctgatgacaaggtttatcccggggagcaatacacatatatgctattggctacggaggagcagtcccccggagagggggatggaaactgcgtgacgagaatataccattcacacatcgacgcaccaaaagacatcgctagtgggcttataggaccattgatcatctgtaaaaaagactctctggacaaagaaaaggagaaacacattgatcgggagtttgtggtaatgttcagtgttgtcgatgaaaattttagctggtatctcgaggacaacatcaaaacctactgctccgaacctgagaaggtggataaagataacgaagacttccaggagtcaaatcgtatgtactctgtaaatgggtacacgtttggtagtttgcctgggctgtcaatgtgcgccgaggacagagtcaagtggtacttatttggaatgggcaatgaagttgacgtccatgctgcgttctttcatggccaagctttgaccaataaaaactataggatagacacaatcaacctgttccctgccactctctttgatgcatatatggtggcccaaaatccgggcgaatggatgctgagctgtcagaatcttaaccacctgaaggccggtctgcaggccttctttcaagtgcaggaatgtaataagtccagctccaaagacaacattaggggtaagcatgtgcggcactattatatcgccgccgaggagattatttggaattacgccccatcgggcatcgacatctttaccaaggagaatctgacagctccaggcagcgacagcgcggtgttcttcgaacagggaactacccgcataggtgggagctacaagaaactggtgtatcgcgaatatacagacgcgtccttcactaaccggaaggagaggggccccgaagaggagcacctgggtatcctggggcctgtcatctgggccgaagtgggtgacactattagagtgacattccacaataagggcgcctaccccctgagcatcgagccaattggcgttcgctttaacaagaacaacgaaggcacctactattcgcctaattacaacccccagtcaagatccgtccctccctcagctagtcatgtggcacccaccgagacctttacttacgagtggaccgttccgaaagaagtgggccccaccaacgctgacccagtctgccttgccaaaatgtattattccgctgtggatcccactaaggacatctttaccgggctgatcggccccatgaagatctgtaaaaaaggtagtctgcatgcaaatgggcggcagaaggatgtggacaaggaattctacctctttccaactgtgttcgacgagaatgagagtttattgctcgaagacaatattcggatgtttactacagctcccgatcaggtcgataaagaagacgaggactttcaagaaagtaacaaaatgcacagtatgaacggttttatgtatggcaatcagcccggcctcacgatgtgtaaaggagactctgtggtctggtacctattttctgccggaaatgaagcggatgtccacggaatttatttttccggcaacacatacctatggcgtggggaaagacgggataccgccaatctgttccctcagaccagccttacactgcacatgtggccagacacagagggaacctttaacgttgaatgcctgactaccgatcactatacgggcggaatgaagcagaaatacaccgtaaaccagtgcaggagacaatctgaggactcgactttttacttgggggagaggacctattacatagcagccgtagaggtggagtgggactattcaccacagcgggagtgggagaaggagcttcaccatctgcaggagcagaacgtgtccaacgctttcctcgacaagggcgaattttatatcggctctaagtataagaaggtggtgtatcggcagtacacagactctacctttagggtgccagtggaaagaaaggccgaagaggagcatctcggtatcctgggcccacaattgcacgcagatgtcggtgataaagtgaagattatattcaagaatatggctactcggccatactcaatccacgctcacggagttcaaaccgagtcaagtacagtgactcctaccctaccaggcgagacattgacatatgtgtggaaaataccagaacggagcggcgcaggaaccgaggatagcgcatgtattccgtgggcgtattactccacagtagatcaggtgaaggacctgtattctggactgatcgggccactgatcgtgtgtagacgtccctacctcaaggttttcaacccacgcagaaagctggaatttgccttactgtttctggtctttgatgagaacgagtcatggtatctagacgataatatcaaaacatattcagaccatccagaaaaggtgaacaaagacgatgaggaattcattgaaagcaacaaaatgcacgctatcaacggcaggatgttcgggaacctccagggattaaccatgcacgtgggagacgaggtaaattggtatttgatgggcatgggtaatgagattgacttacacacagttcatttccacgggcactcattccagtataaacaccggggggtgtacagtagcgacgtctttgacatcttcccaggcacctaccagacactcgagatgtttccccggacacccgggatctggctcttacactgccatgttacagatcacattcacgcgggcatggagaccacatatacagtgctacagaatgaggacactaaatcgggc

SEQ ID NO: 8516 - DNA, 3195 bp, Artificial Sequence
  Description of Artificial Sequence: Synthetic coding sequence
atgaaaatcctcatcctgggcatcttcctgttcctatgctctacccccgcctgggcgaaggagaagcactattatattggtatcatcgaaacgacctgggactacgcaagcgaccatggagagaaaaagctcatctccgtggataccgaacacagtaacatctaccttcagaacgggcccgataggattggtcggttgtacaaaaaagcgttgtatcttcagtataccgatgagacctttcggaccactattgaaaagcccgtttggctaggattcttaggccccattataaaagcagagaccggggacaaggtctacgtgcatctgaaaaacctcgctagtcggccgtatacgttccacagtcacggaattacctattacaaagagcacgagggggccatctatccggacaatactacagatttccagcgcgcggacgataaggtataccccggcgaacagtatacgtatatgctcctggccacagaggaacaatccccgggggaaggggatggaaattgcgttaccaggatttatcattcccacattgatgcaccaaaggacattgcttctggtcttattggccccctcattatatgcaagaaggactcattggacaaggaaaaggagaaacatattgacagggaattcgtggttatgtttagcgttgtcgatgaaaacttttcctggtacttggaggataacatcaagacttactgttctgagccggagaaagtggataaggacaacgaggatttccaggaatcaaaccgcatgtacagcgtgaatgggtatacattcggaagcttacccggcctttccatgtgcgcggaagaccgcgtcaagtggtatcttttcggaatggggaacgaggtcgatgtccacgctgcatttttccacggacaggctttgaccaataagaactatcgcatcgacactatcaacttgttccccgctactttgttcgacgcctacatggtcgcccagaatcccggtgaatggatgctgagttgtcagaatctgaaccatctcaaggctggcctgcaggccttttttcaggtccaggaatgcaacaagtcttcttcaaaagataatattaggggcaaacacgtccgccattattacatcgcagcagaagagattatttggaactacgctccctcagggatcgacatttttaccaaggaaaacctgacagctccaggttctgatagcgcagtctttttcgaacagggtacaacaagaataggcgggtcctacaaaaagctggtttatagggagtatacagatgcgtcctttacaaacaggaaggagagaggcccagaagaggaacatcttggaattttaggaccggtcatctgggctgaagtgggagataccattcgggtgacgtttcataacaagggcgcctatccactgtccattgagcccatcggagtgcggttcaacaagaacaatgagggcacctattattccccaaactataaccctcaaagccggtctgtccccccatccgctagtcatgtggcccctaccgagacatttacctacgagtggacagtccccaaggaggtcggcccaaccaacgctgacccagtgtgcttggcaaaaatgtattactccgctgttgatcccacaaaagacatttttacgggcctgatcggcccaatgaaaatttgcaagaaaggaagcttgcacgccaatggccggcagaaggacgttgacaaggaattctacctgttccctaccgtctttgacgaaaatgagagcctcctgctggaagataatatccggatgttcacaacagccccagaccaggtggataaggaggacgaggatttccaggagagtaacaagatgcatagcatgaacggttttatgtatggtaatcaacccgggctgacgatgtgcaaaggggattccgtggtatggtaccttttttcggcaggaaacgaagccgatgtacatggaatttatttctctggcaacacctacctatggcgcggagagcgccgagatacagctaatttattccctcagacatccctcaccctccacatgtggcctgacacagaggggacctttaatgtagagtgtctcacaaccgatcactataccggaggcatgaagcaaaagtacactgtgaaccagtgcaggcgccaatctgaggactccaccttttacctgggcgagcgtacttattatattgccgcagtcgaggtagaatgggattattccccacagcgggaatgggaaaaagagcttcaccacctgcaggagcagaatgtgagcaatgcatttctcgacaaaggagagttctacatcgggtctaagtacaaaaaagtggtttataggcagtacactgatagcacatttcgcgtgcctgtcgagcgcaaagctgaggaagaacacttgggaattctaggtccccagctccacgcagatgtgggagataaggttaaaattattttcaaaaacatggcaacacgaccatattcaatccatgcacacggggtgcagactgaatccagtactgtgactcccaccttgcctggggagacactgacgtacgtgtggaagatcccagagcgatcaggagcgggcacagaagactctgcttgcataccatgggcctactatagcaccgtggaccaggttaaagacctttatagcggcctgattgggcctttgatagtgtgcagaaggccctatctaaaggtgttcaaccctcggcgcaagctggagtttgctctcctctttctggttttcgacgaaaacgagagttggtacctggacgataacattaaaacatattcagaccaccccgaaaaggtgaataaggatgatgaggagtttatcgagtccaataagatgcatgccatcaatggccgcatgttcggaaatctgcagggtttgacaatgcacgtcggggacgaggtaaattggtatctcatgggcatgggaaacgaaatcgacctgcacacagtgcattttcatggccactcctttcagtataagcatcgaggagtttattccagcgatgtttttgacatctttcccggcacataccaaaccctggagatgtttccacgcacacccggcatttggctgctccactgtcatgtgacggaccacatacatgcgggcatggaaacaacttacacggttcttcagaatgaagacaccaagagcgga

SEQ ID NO: 8517 - DNA, 3195 bp, Artificial Sequence
  Description of Artificial Sequence: Synthetic coding sequence
atgaagatacttatacttggtattttcctctttctttgttccacgccagcctgggccaaagaaaagcattactacattgggattatcgaaaccacttgggattacgcatcagaccatggagagaaaaagctgattagcgtggacacggagcatagcaacatttaccttcaaaacggtcctgatcgaattggtcgtctttacaagaaggcactttacctgcaatacactgatgaaaccttcagaaccactattgaaaaaccagtgtggcttggtttccttggtcctatcatcaaggcagaaaccggtgacaaagtctatgtgcatctgaaaaacctcgcatcgcgtccgtatactttccactcgcatggtattacctactacaaggaacacgaaggagcaatttaccctgataatacgaccgattttcaacgcgcggacgacaaggtgtacccgggcgaacaatatacgtacatgcttctcgcaactgaagaacagtcaccaggtgagggagacggaaactgcgtgacccgaatttaccattctcatattgatgcgcccaaggatattgcctcaggtctgatcggacccctgattatctgtaagaaagatagcctggacaaggagaaagagaaacatatcgatcgagaattcgtggtcatgttttcggtcgtcgatgaaaacttttcctggtacctcgaggacaacattaagacctactgttccgaacccgagaaggtggacaaggataacgaagattttcaagaaagtaacagaatgtactccgtgaacggatacacctttggcagcctcccaggcctttcgatgtgtgccgaggaccgtgtcaagtggtacttgtttgggatgggtaatgaagtggatgtgcatgcagccttttttcatggtcaggcactgaccaacaagaactaccgaatagataccattaaccttttcccggcgactctttttgacgcatacatggtggcacagaaccccggcgagtggatgctgtcttgtcagaatctcaaccatttgaaggcgggactccaggcattctttcaggtgcaggaatgtaacaagtcgtcctcaaaggataacattcgtggtaagcatgtgcgtcattactacatcgcagccgaagagatcatttggaattatgcaccaagcggaatagatatcttcaccaaagaaaacctgaccgccccgggctcagattccgcagtctttttcgaacaagggaccacccggattggggggtcgtacaagaagctggtgtaccgagaatataccgacgcatccttcaccaacaggaaagaaaggggtcccgaggaagaacatctcggtatcctcggtcctgtgatctgggccgaggtgggcgataccataagagtgacctttcataacaagggtgcatacccactctccattgagcctattggcgtccggtttaacaagaataatgagggcacttactactcacctaactataacccacaaagcagatcagtgccgcccagcgcctcacatgtggcaccgaccgaaacctttacttacgaatggaccgtgccaaaagaagtgggacctaccaacgcagatcctgtctgtttggcaaagatgtactactcggcagtggatccaactaaagacattttcaccggactgattggacctatgaagatttgtaaaaagggaagccttcacgccaacggacggcaaaaagatgtggataaggaattctacctctttccaactgtttttgatgagaatgaatccctcctgttggaggataacatccgaatgttcactaccgcacctgaccaagtggacaaggaagatgaagatttccaagaatcgaacaagatgcattcaatgaatggttttatgtacggaaaccaacctgggctgaccatgtgtaaaggtgattcagtggtttggtatcttttctcggctggaaatgaagctgatgtacatggaatctacttctcgggaaatacctacctgtggaggggagaacgaagagataccgcaaacctttttccacaaacctcgctgacccttcatatgtggcccgataccgaagggacctttaacgtcgaatgtttgactactgatcactacactggaggaatgaagcagaagtacactgtcaatcaatgcagacggcaatcagaagattccaccttttaccttggagaaagaacctactatatagcggcagtggaagtggaatgggactactcccctcagagagaatgggaaaaggaactccatcacttgcaagaacaaaacgtgagcaacgcatttctggacaagggagagttttacattggatccaaatacaagaaggtcgtgtacagacagtacactgattccacttttagggtgccagtggaaaggaaggccgaggaagagcaccttggtattctgggaccacagcttcacgcggatgtgggcgacaaggttaagattatcttcaagaacatggcgaccagaccatacagcattcatgcgcatggtgtgcaaactgagtcatcgaccgtgacccctaccctcccaggtgagactctgacttacgtgtggaagattcctgaaagatcgggggcggggactgaggattccgcatgcattccttgggcgtactactcgaccgtcgaccaagtgaaggatctgtactcggggcttatcggtcctcttatcgtctgtcgtagaccgtacctcaaggtgtttaacccccgcagaaagctcgagttcgccctgctttttctcgtgtttgacgaaaacgaatcatggtacctcgacgacaatatcaagacctactccgatcatccagagaaagtcaacaaggatgatgaggagtttattgagagcaataagatgcatgccatcaacggaagaatgttcggaaacctccaagggctcacgatgcatgttggagacgaggtcaattggtacctgatgggtatggggaacgaaattgatcttcacactgtgcatttccacggacactcgttccagtacaagcaccgcggtgtctacagctcagacgtgttcgatatctttcctggaacctaccaaactcttgaaatgtttcccagaaccccaggcatctggctgcttcactgtcatgtcaccgaccatatccacgcaggcatggaaactacttatacggtcctgcaaaacgaggacactaaaagcggc

SEQ ID NO: 8518 - DNA, 3195 bp, Artificial Sequence
  Description of Artificial Sequence: Synthetic coding sequence
atgaagattctgatcctggggatttttctgtttctgtgttcaaccccagcatgggccaaggagaagcattactatattggaattatcgaaaccacctgggattacgctagtgaccatggtgaaaagaagctgatcagcgtggacacggagcattcgaacatctaccttcaaaacggtccagaccgcattggacggctgtacaagaaggcactgtacctccagtacacggatgaaactttcaggaccaccattgaaaaacccgtgtggctcggattcctgggacctatcatcaaggcagagactggggataaggtgtacgtgcatttgaaaaacctggccagccggccttacacctttcactcgcatggaattacgtattacaaggaacatgaaggagcaatttacccagataacactaccgacttccaacgtgcggacgataaagtgtacccaggagaacaatacacttacatgctgcttgctaccgaagaacagtcccccggagaaggcgatggaaattgtgtgactcgaatttaccactcacacattgatgctccaaaagatattgcatccggccttataggtcctctgataatctgtaagaaggattccctcgataaggagaaggaaaagcatattgatagagagtttgtggtcatgttttcagtggtggatgaaaacttttcctggtacctcgaagataacatcaaaacctactgctcagaacctgaaaaagtggataaagacaacgaagattttcaagagtccaaccggatgtactctgtgaacggttacacctttgggtcactccccggtctgtccatgtgtgccgaggacagggtgaagtggtacctttttggaatggggaacgaggttgatgtgcatgctgccttctttcatggacaggccctcactaacaagaattaccggattgatacgatcaacctttttcctgcaactctttttgacgcatacatggtggcacaaaacccgggtgaatggatgctgtcgtgtcaaaatcttaaccatctcaaagctgggctccaagccttctttcaggtgcaagaatgtaacaagtcctcgtcaaaggataacatccgcggtaagcatgtgcgccactattacatcgcagcagaagaaatcatctggaattacgcaccttcaggaatcgatatctttacgaaggaaaacctgacggcccccgggagcgatagcgctgtgttttttgaacagggtaccacgagaatcgggggctcatataagaagttggtgtacagggagtacactgatgcctcgtttaccaatcgcaaagagcgcggacccgaggaagagcacctggggatcctgggacctgtgatttgggcggaagtgggcgataccattcgagttacttttcacaataagggtgcatacccactgtccattgaaccaattggtgtgagatttaacaaaaacaacgaaggaacctactactcgcctaactataacccacagtcaagaagcgtgcccccttccgcctcacatgtggccccaaccgaaaccttcacctacgagtggactgtccccaaggaggtgggtcctacgaacgcagacccagtgtgcctggctaagatgtattactcggccgtcgaccctactaaagatatcttcaccggtctgattgggcccatgaagatctgcaagaagggttcactgcacgccaacggtaggcagaaggacgtagacaaggagttttacctttttcctaccgtgtttgacgaaaatgagtcgcttcttctggaggacaacattcgcatgttcaccaccgcaccggatcaagtcgataaagaagatgaggatttccaggaatccaacaagatgcactctatgaacggttttatgtacggaaaccagcccggcctcaccatgtgcaagggagactcagtggtgtggtacctgttctcggcgggaaatgaagctgacgttcatggaatctacttctccggaaacacctacctttggagaggagagaggcgggacaccgccaacttgtttcctcagacttccctgactctccatatgtggcctgacactgaaggaactttcaatgtggaatgcctgaccactgatcattacaccggtggaatgaagcaaaagtataccgtgaaccaatgtaggagacaatcggaggacagcaccttctacctgggagagaggacctattacattgccgccgtggaagtggaatgggattacagccctcaacgggaatgggaaaaggagctgcatcatctgcaggaacagaatgtgtcgaacgcattcctcgataaaggggaattctacatcggttcgaaatacaagaaggtggtctacagacagtacactgactctactttccgcgtgcctgttgagcgaaaagccgaagaagaacatttgggaattcttgggccacaacttcatgcagatgtgggggacaaggtgaagattatcttcaagaatatggccacccgcccttactcaatccatgcgcacggcgtccagactgagagcagcactgtgacgccaactctccccggagagacgctgacttacgtctggaagattccagaaagatccggagccggaaccgaagattcggcgtgtattccatgggcttactactccactgtggatcaagtcaaggatttgtactccggactcatcgggccactgattgtttgcagaaggccttaccttaaagtgtttaaccctcgtagaaaacttgaatttgcgctcctgtttctcgtgttcgacgagaatgaatcgtggtatttggatgacaacataaagacctattccgatcacccagaaaaggtgaacaaggatgatgaggagtttatcgaatcgaataagatgcatgcaatcaacggaagaatgtttggcaatctccaaggactgaccatgcatgttggagatgaagtgaactggtacttgatgggcatgggtaacgaaatcgaccttcatactgtccattttcatggtcacagcttccagtacaaacatcggggagtctactcctcggacgtctttgacatttttcccggtacttaccaaaccctcgaaatgtttccgagaacccctggaatctggctgcttcactgccatgtgactgaccatatccatgcaggcatggaaactacctacactgtccttcaaaacgaagataccaaatcggga

SEQ ID NO: 8519 - DNA, 3195 bp, Artificial Sequence
  Description of Artificial Sequence: Synthetic coding sequence
atgaaaattttgatactgggcatctttctcttcctatgctctactcccgcctgggctaaagagaagcattattacataggaatcatcgaaaccacgtgggattatgcgagtgaccatggcgagaagaagttaatctcggtagacaccgagcacagcaatatttacttgcaaaatggacctgacagaataggacgcctgtataagaaagccctctaccttcaatacactgatgagacttttcgcacaacaatagagaagccagtttggctgggcttcctggggcctattatcaaggcagagacgggggataaagtctatgttcacctgaagaatcttgccagccggccctacacttttcacagccacgggattacatattacaaggagcatgagggcgccatttatccagacaatactacagactttcagcgtgctgatgacaaagtataccctggggagcaatacacatatatgctacttgccaccgaggaacagtcacctggggaaggagatggcaattgcgtgacaaggatataccatagccacatcgacgcccccaaagacatcgccagtggcctcatcggaccccttatcatctgcaaaaaagactctctggataaggagaaggagaagcatatcgaccgcgaattcgtcgtaatgttctccgtggtggacgagaacttttcttggtacctggaagataacattaagacttactgttcagagcccgagaaagtggacaaggataacgaggatttccaggaatcaaaccgtatgtattcagtgaacggatatacatttggcagcctgcccggtttgtccatgtgcgccgaggacagagtgaaatggtacctctttgggatgggaaacgaggtggatgtccatgcagcctttttccatggtcaggctttgaccaacaagaactacaggattgatacaattaatctgttcccggccaccctcttcgatgcttacatggtggcacagaatcccggggaatggatgctgagctgccaaaatctgaaccacctgaaggctggcttacaggccttctttcaggtgcaagaatgtaacaagtcctcatcaaaggacaacataaggggcaagcacgtcaggcactattacatcgccgccgaggaaatcatctggaactatgcgccttccggcatagacatctttactaaagaaaacttgactgcgccaggcagcgactccgccgttttctttgagcagggcacgactcgcattgggggtagctacaaaaaactggtctatcgtgagtacacagacgcctcatttaccaaccggaaggaacgcggtcctgaggaggagcatttaggcatcttgggacccgtaatttgggccgaggtcggggacacgataagggtgacctttcataataaaggagcttatcctctgtcaatagagccaattggggttagattcaacaaaaacaacgagggcacctactattcacctaattataatccccagagccgctcggtacccccctcagcctcgcacgtggccccaaccgaaacatttacatacgaatggaccgtccccaaagaagtggggccaactaatgccgacccagtctgtctggccaaaatgtactactcagctgtggacccaaccaaagatatttttacagggctgattggccctatgaagatctgcaagaaaggaagcttacacgccaacggccgacaaaaggacgttgataaagagttttacctcttccctactgtgttcgacgagaacgaatcccttctactggaggacaacatccggatgttcacaaccgcgcctgatcaagtagacaaagaagatgaagacttccaggaaagtaataagatgcacagtatgaacggctttatgtatggaaaccaacccggactgaccatgtgtaaaggtgattcagtcgtatggtatctgtttagtgcagggaacgaagccgatgttcacggaatttatttcagcggaaacacttatctgtggagaggcgagcgaagagacactgcaaacctgttcccccaaacaagtttgaccctgcatatgtggcctgacaccgagggcaccttcaacgtcgagtgtcttacgactgatcactataccggggggatgaagcagaagtatactgtgaaccagtgccgtcggcagtcagaggacagcacgttctatctgggagaaagaacatattacattgccgctgtggaagtggaatgggactacagcccacagcgcgagtgggaaaaagaattgcatcatctacaggagcagaacgtgtctaatgctttcctggacaaaggggaattctacatcgggagcaaatataagaaagtcgtctacaggcagtacactgactcaacgttccgggtcccagtggaacgcaaggctgaggaagagcacctgggcatactcggtccccagctgcacgccgacgtcggtgacaaggtcaagatcatcttcaaaaacatggcaacccggccatattctatccacgctcatggcgtccaaactgagtcttcgacagtaaccccgactctgcccggagagaccctgacctacgtttggaaaataccagaacgatctggggccggaaccgaagattctgcgtgtatcccatgggcttactactctacagtcgatcaggtgaaggacttgtatagtgggctgatcggaccattgattgtatgtagaagaccttacctgaaagtcttcaacccgagaaggaaactcgaatttgcgctcttattcctcgtgttcgatgaaaacgagagctggtatctcgacgataatattaaaacctattcagaccatcctgagaaagttaacaaagacgacgaagagttcatcgaatcgaacaaaatgcatgccataaatggccggatgttcggaaatctccagggactgactatgcacgtcggagatgaggtcaactggtatctgatggggatgggaaacgaaattgacctgcatactgtgcactttcatggtcatagcttccaatataagcacagaggagtgtatagctcagatgtcttcgatatctttccaggcacctaccagacactcgagatgttcccacgtacaccgggcatctggttactccattgccatgtgaccgaccacatacacgcagggatggagaccacctatacagtgctgcaaaatgaagacacgaaatccggt

SEQ ID NO: 8520 - DNA, 3195 bp, Artificial Sequence
  Description of Artificial Sequence: Synthetic coding sequence
atgaagatcctgattctggggatcttcctctttttgtgctccacgcccgcatgggctaaggagaaacactactacatcggaatcatcgaaactacttgggattacgcatcggaccatggcgaaaagaaattgatctcggtggataccgagcattcaaacatttatctgcagaacggaccagacagaatcgggaggctgtacaaaaaggcactgtacctgcagtacaccgacgaaactttccgcacgactattgaaaagccggtctggctgggatttctcggaccaattatcaaagcggaaaccggagacaaagtctacgtccacctgaagaatctggcgtcccgtccgtacactttccactctcatggaatcacctactacaaggagcacgagggagccatctaccctgataatacgactgacttccagcgcgcagacgataaagtgtacccaggagaacaatatacctatatgcttctggccaccgaagaacagagcccaggagaaggggacggaaattgcgtgacccgcatctaccattcgcatattgatgccccgaaagacatcgcttccggactgatcggcccactgatcatctgtaagaaggatagtctggataaagaaaaggagaagcatatcgatcgggaattcgtcgtgatgtttagcgtcgtcgacgagaacttttcgtggtacctggaggataacatcaagacgtactgttccgagccggagaaggtcgacaaggataatgaggacttccaagagtcaaaccgcatgtacagcgtcaatggttacacctttggctcactgccgggactgagcatgtgtgcggaggaccgggtgaagtggtacttgtttggcatgggaaacgaggtcgacgtccacgcagctttctttcatggccaagcgctgactaataagaactacaggattgataccatcaacctcttcccggccacccttttcgatgcctatatggtcgcacaaaatccgggagaatggatgctgtcatgtcagaatctgaaccatttgaaggctggcctccaggcattcttccaggtccaggaatgtaataagtcatcttccaaggataacatccggggcaagcacgtgcgccactattacatcgcagcagaggaaatcatttggaactacgccccgtcgggcatcgatatctttaccaaagagaaccttactgccccgggatcggacagcgccgtgttcttcgagcaggggactacccggatcggtgggtcgtacaagaagttggtgtatcgggagtacaccgatgcgtcatttactaacagaaaggagcgtggacctgaagaagagcatctgggaatccttggaccggtgatctgggccgaggtgggagataccatccgggtgactttccacaataagggcgcataccctctctccatcgaaccgatcggagtgcggttcaataagaataacgaaggaacctactactccccaaactacaaccctcagagcaggtccgtcccgccgagcgcgtcccatgttgctccaaccgagactttcacttacgaatggacggtcccaaaggaagtgggtccgacgaacgcggacccagtttgcctggcaaaaatgtactactcggccgttgacccgacgaaggacatcttcacgggactcatcgggccaatgaagatttgcaagaagggatccctgcacgctaacgggagacagaaagatgtggataaggagttctacctgtttccgacggtgttcgatgaaaacgagtcacttctcctggaggacaatatccgaatgttcaccactgcccctgaccaagtggataaggaagatgaagatttccaggagtccaataagatgcactcaatgaatggcttcatgtacggcaaccagccgggactgactatgtgcaagggggactccgtggtttggtatctgttctccgcaggaaacgaagctgatgttcacggaatttacttctccggaaatacttacctctggagaggggagcggagagacaccgcgaatttgttcccccagacctcgctcacgctccacatgtggccagacaccgaaggtactttcaatgtcgaatgcctcacgaccgaccactacaccggaggcatgaagcaaaagtacactgtcaaccagtgtcggcgccaaagcgaggactcgaccttttacctgggggaacgcacctactacatcgccgctgtggaggtggaatgggactactcgccacaacgcgagtgggaaaaggagcttcaccatcttcaggaacaaaacgtctctaacgccttcctcgacaagggagagttctacatcggatcaaaatacaaaaaggtcgtgtaccgccagtacactgactcgacgttccgggttcctgtggaacgcaaggcggaagaagaacacctgggcattttggggccgcagttgcacgccgacgtgggcgacaaagtgaagatcatctttaagaacatggcgacgcggccgtatagcattcacgcacacggagtgcagactgaatcaagcactgtcacccccaccctgcctggggagactctgacctacgtctggaagatcccggaacgctcgggagcaggcactgaagattccgcctgcatcccgtgggcctactactcgactgtggatcaggtgaaagatctgtatagtggcctcatcggaccactgatcgtctgcaggcggccgtacctgaaggtctttaacccgcggagaaagttggagttcgctctcctgttcctggtgttcgacgagaatgaatcttggtacctcgatgacaatatcaaaacttattcagatcaccctgaaaaggtgaataaggacgatgaagagttcatcgaatcgaataagatgcatgccatcaatgggagaatgttcgggaacctgcaagggttgacgatgcacgtgggagacgaagtcaactggtacttgatggggatgggcaatgagatagacctccacactgtgcacttccacggacattccttccaatacaagcatagaggagtatacagctcggatgtgttcgacattttccctggcacttaccagacgctggaaatgttcccaaggactccaggcatctggctgcttcactgccacgtgactgaccatattcatgccggaatggagacgacctacactgtgctgcaaaatgaagataccaagtcgggc

SEQ ID NO: 8521 - DNA, 3195 bp, Artificial Sequence
  Description of Artificial Sequence: Synthetic coding sequence
atgaaaatccttatccttggcatcttcctcttcttgtgctctacccctgcctgggctaaggaaaagcactactacatcggaattatcgaaaccacctgggactacgctagcgaccacggagagaagaaactgatctccgtggataccgagcacagcaatatctacctgcagaacggtcctgatagaattggacggttgtataagaaagccctgtacctgcaatacaccgacgaaacttttagaaccactatcgaaaagcccgtgtggctcgggttcctcggaccgatcatcaaggcggaaacgggagacaaggtgtacgttcacctcaagaacctcgcgtcgcggccatacacctttcactcccatgggatcacttactacaaggaacatgaaggagcgatttaccctgacaacaccactgacttccaacgcgcagatgataaagtttacccaggtgagcagtacacttatatgcttctcgcaactgaggagcaaagcccgggagagggtgacggaaactgcgtcactcgcatctatcactcccacatcgatgctccgaaggacatcgcatccggactgatcggacccctcattatctgtaagaaggactcgctggataaagaaaaggaaaaacacatcgaccgcgagttcgttgtgatgttctcggtggtcgacgaaaacttttcgtggtacctggaggacaacatcaagacttattgctccgaacctgaaaaggtcgacaaggacaacgaggacttccaggaatcgaatagaatgtactccgtcaatggatacaccttcggctcgctcccgggactctcaatgtgcgccgaagatcgcgtgaagtggtatttgttcggaatgggaaacgaggtcgacgtccatgctgccttcttccacggacaggcgctgactaataagaactatcgcatcgataccatcaatctgttcccggcgactctgtttgacgcgtacatggtggctcagaaccctggagaatggatgctgtcgtgtcagaacttgaaccacctgaaggctggactgcaagcatttttccaagtgcaagagtgtaataagagcagctccaaggacaacattcgcggaaaacacgtgcgccattactacatcgcggcagaagagatcatctggaattacgctccgtccgggatcgacattttcaccaaggagaatcttacggctcccggctcagactcggcagttttcttcgagcaagggaccactagaattggaggatcctacaagaagctggtctacagggagtacactgacgcatcgttcactaaccgcaaagagcggggaccggaagaagagcacctgggaatcctgggtcctgtcatttgggccgaagtcggagataccatcagagtgactttccataacaaaggtgcttaccccctctcgatcgaaccaatcggcgtccgctttaacaaaaacaacgagggaacctactattcgccgaactacaatccgcaatcacggtccgtcccgccttctgcctcgcatgttgcgccaaccgagacgttcacctatgaatggactgtgccaaaggaggtgggaccaaccaacgccgacccggtatgcctcgcgaagatgtactactccgccgtcgacccaacgaaggacatcttcaccggcctgattggcccaatgaagatctgcaagaagggaagcctccacgcgaatggacggcagaaagacgtggacaaagagttttaccttttcccgacggtgttcgacgagaacgagtcgctgttgctcgaggataacatccgtatgtttaccaccgcacctgaccaggtcgataaagaagatgaggatttccaggagtccaacaagatgcacagcatgaacggtttcatgtacggcaaccaaccgggtttgactatgtgcaagggcgactccgtggtgtggtacctgttcagcgcaggcaatgaagcggacgtccacggaatctacttcagcggtaacacctacctgtggagaggggaacgccgggacacggccaatctcttcccgcagacttcgctgaccctgcatatgtggccagacaccgaaggcacctttaatgtcgaatgcttgaccaccgaccactacacgggaggaatgaaacagaagtataccgtgaaccagtgccggcgccagtcggaggattcaaccttttacctcggggagcggacctactacatcgctgctgtcgaggtggagtgggactactcaccgcagagagagtgggagaaggaactccaccacctccaggagcagaacgtgagcaatgcctttctggacaagggagagttttacattggttcgaaatacaaaaaggtggtttacaggcaatacacggactcgacctttagggtcccggtggagcggaaggccgaagaggaacacctcggcatcctgggtccacagctccatgcagatgtcggcgacaaggtcaagatcatcttcaagaacatggccacccgcccttactccatccatgcgcacggcgtgcagaccgaaagttcaactgtgactcccacgctgccaggagaaaccctcacctacgtctggaaaattcctgaaaggtcaggagccggcaccgaggacagcgcgtgcatcccgtgggcgtactacagcactgtggaccaggtgaaagacctctactcgggtctgatcggaccgctgatcgtgtgccgccggccttacctgaaggtgtttaacccacggcggaagctggaattcgcgctgctgtttctggtgtttgacgagaacgaatcatggtatctggatgacaacatcaaaacttactcggatcatcccgaaaaagtcaacaaggatgatgaggaattcattgagtcaaataagatgcacgcgatcaacggaagaatgtttggcaacctgcagggactgactatgcatgtgggcgacgaagtcaactggtacctgatgggaatgggtaacgagatcgatctgcacaccgtgcactttcacggacactcattccagtacaagcaccggggtgtgtattcgtcggacgtgtttgacattttccctggaacctaccaaaccctggaaatgttcccgcggactccaggaatatggctgctgcactgccacgtgaccgaccacatccacgcgggtatggaaaccacctacactgtgttgcagaatgaggacaccaaaagcgga

SEQ ID NO: 8522 - DNA, 3195 bp, Artificial Sequence
  Description of Artificial Sequence: Synthetic coding sequence
atgaaaattcttatcctcggcatctttctttttctgtgctccactccggcatgggcaaaggaaaagcattactacatcggcattatagaaaccacctgggactacgcaagcgaccatggcgagaagaagttgatttcagtcgacactgaacattccaacatttatctgcagaacggacctgaccggatcggacgcctttacaagaaggccctttaccttcagtacaccgatgaaacgtttcgaaccaccatcgagaagccagtgtggctgggtttccttggacctattatcaaggcggaaacgggagataaagtgtacgttcaccttaagaaccttgcatcacgtccatacactttccatagccacgggattacctactacaaggaacacgaaggagcaatttacccagataatactacggattttcagagagccgatgataaagtgtatcctggagagcaatacacctatatgctgctcgcaaccgaagaacaatcaccgggtgagggtgatgggaattgtgttactagaatctatcattcacatatagatgcaccgaaagatattgcatctggccttattgggccactgataatctgtaagaaggacagtctggacaaggagaaggaaaaacatatcgatcgcgaatttgtggtcatgttcagcgtggttgacgagaacttttcctggtacctcgaagataacatcaagacttattgctcagaacccgagaaagtggacaaagacaacgaagatttccaggagtcaaatagaatgtactccgtcaacggatacaccttcggctcgttgcctggcctctcgatgtgcgcagaggatagagtgaaatggtatctcttcggcatgggaaacgaagtcgacgtccatgccgcattctttcatggacaagccttgactaacaagaattaccgcattgataccattaacctttttccagccaccctgtttgacgcgtacatggtggcacaaaaccccggtgaatggatgctgtcctgccagaaccttaaccatcttaaagcaggactgcaggcatttttccaggtgcaagaatgtaacaagtccagctcgaaggataacatccgcggtaagcatgtgcgtcactattacattgcagccgaggagatcatttggaactacgccccaagcggaattgacattttcaccaaggaaaacttgaccgctcctgggtctgattcggccgtgtttttcgagcaaggcactacccggattggagggtcatacaagaagctggtgtaccgtgaatacaccgatgcaagttttaccaaccgaaaggaaagaggtccagaagaagaacatcttggaatcctggggcccgtcatttgggcagaggttggggataccattagagtgacttttcacaacaaaggagcataccctctttcgatcgagcctattggggtgagattcaacaagaacaatgagggaacttactacagccctaactacaatccacagtcacggtcagtgccgccttcggcctcgcacgtggcaccaactgagacttttacttacgagtggaccgtgcctaaggaagttggaccgactaatgccgatcctgtgtgtcttgcaaagatgtattactcggctgtggacccgactaaggatatctttaccggtctgattggtcctatgaagatttgtaagaagggatcgttgcacgccaatggtcggcagaaggacgtggataaggaattctacctgtttccaactgttttcgatgagaatgaatcgcttctgctggaggataacatcaggatgtttaccacggcccctgatcaagtcgataaggaagatgaggacttccaggaatccaacaagatgcattcgatgaacggattcatgtacggaaatcagcctggtctgactatgtgtaagggagactccgtggtctggtaccttttttcagcaggaaacgaggcagacgtccatggaatttacttttcgggaaatacctacctgtggagaggtgaacgacgcgataccgcaaacttgttcccacagacctccctgaccctgcatatgtggcctgacaccgaggggacttttaacgtcgaatgtctgacgaccgatcattacaccggtggtatgaaacagaagtatacggtgaaccagtgccgccgacagtcagaagattccactttttacctgggggaaaggacttactacattgcagcggtggaggtggaatgggattacagcccccaacgtgaatgggaaaaagaacttcatcatcttcaagagcaaaacgtgtccaatgcctttctcgataaaggagagttttacattggaagcaagtataagaaggtcgtgtacagacagtataccgacagcacttttcgggtccctgtcgaacgcaaggctgaggaagagcacctggggatcctcggaccgcagctgcacgcagatgtgggggataaggttaagattatctttaagaacatggctacccgtccctactccattcacgcacacggagtgcaaacggaatcctcgactgtcacccctacgctcccaggagaaacccttacctacgtttggaagatccccgaaagatcaggtgctggcaccgaagattcagcttgcattccatgggcgtactactcgaccgttgaccaagtcaaggatctttactccgggctgattggccctctgatcgtgtgccggcgaccataccttaaagtgttcaacccacgcagaaagctggaattcgcactcctttttctcgtctttgacgaaaacgaatcatggtaccttgatgacaacatcaaaacttactcggatcacccagagaaggtgaataaggatgatgaagaattcattgaaagcaataagatgcacgcaattaacggtaggatgtttggtaacctccaggggctgactatgcatgtaggcgacgaagtgaactggtacctcatgggcatgggtaacgaaatcgatctgcatactgtccattttcatgggcactcatttcagtacaaacacaggggtgtctacagctctgatgtctttgacattttccctggtacttatcagactctggagatgttcccaaggactcccggaatttggctcctgcactgtcatgttactgaccacatccacgccggtatggaaacgacttacaccgtgctgcaaaatgaagataccaagtcgggg

SEQ ID NO: 8523 - DNA, 3195 bp, Artificial Sequence
  Description of Artificial Sequence: Synthetic coding sequence
atgaaaatcctcatcctgggaatcttcctttttctctgcagtactccggcttgggcgaaggagaaacactactacatcggaattatcgaaaccacctgggactacgcatcagatcacggcgaaaagaaacttatcagcgtggacactgaacattccaacatatacttgcagaacggaccggacagaatcggacggctgtacaagaaggctttgtacctgcagtacactgacgaaaccttcagaaccaccatcgagaagcccgtctggctcggatttctgggacccatcatcaaggcggaaactggtgataaggtgtacgtgcatctgaaaaacctggcctcccggccatacacgttccactcccacgggattacctactacaaggaacatgagggagcgatctacccagataataccactgactttcagagggcggacgacaaggtgtacccgggagaacagtacacttacatgctcctcgccactgaagagcagagcccgggcgagggagatggaaactgcgtgacccggatttaccactcgcacatcgatgccccgaaggacatcgcctcgggactgatcggccccctgatcatttgcaagaaggattccctggacaaggaaaaggaaaagcatatcgaccgcgagtttgtcgtgatgttcagcgtggtggatgagaatttctcgtggtacttggaagataacatcaaaacttattgctccgaaccggaaaaggtggacaaagataatgaagattttcaagagtccaaccgcatgtactcagtgaacggatacacttttggcagcctccctgggctctcaatgtgcgccgaagatagagtgaagtggtacctctttggaatgggaaacgaggtggatgtccacgctgcattctttcacggacaagctctgacgaataagaactaccggatcgatacgatcaatctctttccggcgactctgttcgacgcctacatggtcgcccagaatccgggtgaatggatgcttagctgtcagaatctcaaccatctgaaggcggggcttcaagccttctttcaggttcaggagtgtaacaaaagctcctccaaagataacatccgcgggaagcacgtgcgccattactacatcgcagccgaagaaatcatctggaattacgcccccagcggcattgatatcttcactaaggagaacctgaccgccccgggatcagattcggctgtattcttcgagcagggtactacccgcatcggcggatcctacaagaaactggtctaccgggagtacaccgacgctagcttcactaatagaaaggagcggggaccggaggaagaacatctcggaattctcggaccagtgatctgggccgaagtgggagacaccatcagggtcacgtttcacaataagggagcctacccattgtcgatcgagccgatcggagtcagattcaacaagaacaatgagggaacctactactcgccgaactataacccacagtcacggtcagtgcccccgagcgccagccatgtggccccaacggaaacctttacgtatgaatggaccgtcccaaaagaggttggaccaacgaacgccgacccggtctgcttggccaagatgtactactcggccgtggacccgacgaaagacatcttcaccgggctcatcgggcccatgaaaatctgcaagaaggggtccctccatgctaatggacgccagaaggacgtggataaagaattctacctgtttccgaccgtgtttgatgaaaacgagtccctgctgcttgaagataacattcggatgttcactaccgcgcctgaccaggtggacaaggaggatgaagatttccaggaaagtaacaagatgcactccatgaacggttttatgtacggcaaccagccggggctgaccatgtgtaaaggagacagcgtggtgtggtatctcttctcggcaggaaacgaggcagacgtgcacggtatttacttttctggcaacacctatttgtggcgcggagaaaggcgggacaccgccaaccttttcccgcaaaccagccttacccttcacatgtggcccgacaccgaaggaacgttcaacgtggaatgcttgactaccgaccattacaccggaggcatgaagcagaagtacaccgtgaaccaatgtcggcggcagtcggaggactcgactttttacctgggggaacgcacgtactacatcgcggccgtggaagtggaatgggattactctccacaacgcgagtgggagaaggagcttcatcacctgcaggaacagaatgtgtccaacgcattcttggacaaaggcgagttctacattgggtccaagtacaagaaagtggtctaccggcagtacaccgactcaactttcagagtgcctgtggagcggaaggctgaagaagaacatcttggcatcctgggaccgcaactccacgcagatgtgggtgacaaagtgaagatcatcttcaagaacatggcaaccagaccgtacagcatccacgcacatggcgtgcagactgagagctccactgtcactcctaccctcccgggcgagactctcacctacgtgtggaagatcccagaacgctcgggagccggtaccgaggacagcgcatgtatcccttgggcatactacagcaccgtggaccaagtgaaagacctctactccggtctgatcggacccctgatagtctgccggaggccgtacctgaaagtctttaacccacgccggaagttggaatttgctctgctgttccttgtgttcgacgaaaatgaatcatggtacctcgatgataacattaagacctactccgatcacccagagaaggtcaacaaagatgacgaggagttcatcgaatcaaacaaaatgcacgcgatcaacggacggatgttcggcaacctgcaaggcctgaccatgcacgtgggagacgaagtcaattggtacctgatgggcatgggtaatgaaattgacctgcacaccgtgcatttccatggccattcttttcagtacaaacaccgaggcgtctattcgagcgatgtgtttgacatcttcccgggcacttaccaaaccctggaaatgttcccgcgcactcctggcatttggctgctgcactgccacgtgactgatcacatccatgccggaatggaaactacttacactgtgctccagaacgaagatactaaaagcgga

SEQ ID NO: 8524 - DNA, 3195 bp, Artificial Sequence
  Description of Artificial Sequence: Synthetic coding sequence
atgaagatcctgatcctgggaatcttcctgttcttatgcagtacacccgcttgggccaaggaaaaacattactatatcggaatcatcgagaccacttgggattacgcaagtgaccatggtgagaagaagcttatcagcgtggacactgaacattctaatatatacctgcagaacgggcccgaccgaatcgggagactctacaagaaagccctgtacctgcagtatacggatgagacatttaggaccaccattgagaagccagtttggctggggtttctgggtcccatcattaaggccgaaactggggataaggtgtatgtccatctgaagaacctcgccagtaggccctacacattccactctcacggaataacatattacaaagaacacgagggagcaatttaccccgacaataccaccgacttccagcgagcagatgataaggtttaccctggcgaacagtatacctatatgctgctagcaacagaagagcagagtcctggggaaggggacggtaactgcgtcacccggatctaccactctcatattgatgctcccaaggacattgctagtggcctcatcggcccactgataatttgcaagaaggacagcctagataaagagaaggagaagcatatcgacagagaattcgtagtgatgttcagtgtggtcgacgagaacttctcctggtacctggaagataacatcaaaacctattgctccgaacccgaaaaggtcgacaaggacaatgaggatttccaggagtctaatcgaatgtattcagtcaacggctacacctttggcagtctacctggccttagtatgtgcgctgaagatagggttaagtggtacctgtttggaatggggaatgaggtggacgtgcatgccgccttcttccatggccaagcgttgaccaacaagaattataggatcgacacaataaatttgtttcccgctacactgttcgatgcctacatggtcgcgcagaatcccggcgaatggatgctgagctgtcagaacttgaaccacctgaaagccggattgcaggccttctttcaggtccaggaatgcaacaagtcctcatcaaaggacaacataagaggtaaacatgttaggcattattacatcgcagccgaagagattatctggaattacgccccttctggcatcgacatttttaccaaggagaatctgacagcacccggctccgacagcgccgttttttttgaacagggtaccaccagaatcggaggctcctataagaaacttgtgtaccgggagtacacagatgctagtttcaccaaccgcaaggaaaggggtccggaggaggagcaccttgggattctgggccctgtgatatgggctgaggtaggagataccattagggttactttccataataaaggggcttacccgctgtctattgaacccatcggagtgcggttcaataagaataacgaagggacctactattcccctaactacaacccacaatcgagatctgtgcctccgagtgcgtcccacgttgctccgacagaaacttttacgtacgagtggaccgtcccgaaagaggtggggcctacgaacgcggacccagtctgcttggccaagatgtactactccgccgtagaccccaccaaggatattttcacagggttaatcgggccgatgaagatctgcaaaaagggtagtctgcacgctaatgggcgccagaaagatgttgataaggagttctatcttttccccacggtgttcgacgaaaatgagtctctgctgctggaagataatattaggatgtttactacggcccccgatcaggtggataaggaagatgaagattttcaggagagtaataagatgcactctatgaatggatttatgtatggaaatcagccagggcttaccatgtgtaaaggcgacagcgtcgtgtggtatctcttctctgccggaaacgaggcagacgtgcatggtatctattttagtggcaacacatacctttggcgtggagaaaggcgggataccgccaatctcttcccccaaacatctttgacactgcacatgtggcccgatactgaaggaacattcaacgttgaatgtctgaccaccgaccactataccggcgggatgaagcagaaatataccgttaatcagtgccgtcgccagtcagaagattccaccttctatttaggtgaaaggacctactatattgcagccgtggaggtggaatgggactacagccctcaaagggagtgggaaaaggaactgcaccatctacaagaacagaacgttagcaatgctttcctcgataaaggcgagttctacattggctctaagtacaagaaggttgtgtatcgccagtacaccgattccacatttagagtccctgtggaacggaaggctgaggaggagcacctgggcatcctggggccccaactacatgccgacgttggggataaggttaaaatcatatttaaaaacatggccaccagaccctacagcatccacgcccacggagttcagactgagagcagtaccgtcacccctactttgccgggagaaacccttacatatgtgtggaaaattcccgaaaggtctggagccgggaccgaggattctgcctgcattccttgggcctactacagcacagtggaccaagtgaaagacctgtactccggtctaatcggccccctaatcgtgtgcagacgcccttatcttaaagttttcaacccgaggcgaaaattggaattcgcactgctgtttttggtgttcgatgaaaatgagagctggtacctggacgacaacattaagacgtactccgaccatcccgaaaaggtgaataaagacgatgaagagttcatcgagtcgaataaaatgcatgccatcaacgggcggatgtttggtaacctacaggggctgaccatgcacgtgggcgatgaagtgaactggtacctcatgggcatggggaacgagattgatcttcatacagtgcactttcacggacattcattccagtataagcatcgtggcgtttattctagcgatgtctttgacatcttccccggaacttaccagactttggagatgtttcccagaaccccaggaatctggttgctgcactgtcatgttactgaccacatacacgccggaatggaaaccacgtacactgtgctccaaaacgaggacaccaaaagcggg

SEQ ID NO: 8525 - DNA, 3195 bp, Artificial Sequence
  Description of Artificial Sequence: Synthetic coding sequence
atgaagattcttattcttggaatttttcttttcttgtgctctaccccagcctgggctaaggagaagcactattacattgggattatcgaaaccacatgggattacgcctcagatcacggagagaaaaaacttatttccgttgacacggagcatagtaacatctatctccagaatgggccggaccgcattggtcgcttgtacaagaaggctctgtatcttcagtataccgacgagacctttcgcacaacaattgaaaagccagtgtggcttggctttctcgggcccatcataaaagctgaaaccggggacaaagtgtacgtccacttgaagaacctggcttctcgtccatacacctttcattcacacggcatcacctactataaagaacacgaaggggctatctatcccgacaacactaccgatttccagcgcgcagacgataaggtttaccctggggagcagtacacctatatgcttctggccacagaggaacagagtcccggtgaaggagacgggaactgtgtcactcgcatttatcactcccatattgatgcccctaaggatattgcaagcggcttgatcgggcctctgattatctgcaaaaaggactcgctggataaggaaaaagagaaacacatcgaccgcgaatttgtggtcatgttctctgtagtcgacgagaatttctcatggtacctggaggataatatcaagacctactgttcggaaccagagaaggtcgacaaggacaacgaagacttccaagaatccaaccggatgtattccgtgaacggctatacattcggctcccttccgggcctgagtatgtgtgctgaagatcgggtaaaatggtacctctttggcatggggaacgaggttgatgttcatgcagctttctttcacggtcaagccctgactaataaaaattaccggattgatacaattaatctgttccctgcaactctgttcgacgcctatatggttgctcagaacccaggtgagtggatgttgtcctgccagaacttaaaccaccttaaagcaggcttgcaggccttttttcaggttcaggagtgtaacaaatcaagcagtaaggataacattcgcgggaaacatgtgaggcattactacattgcagcagaagagatcatatggaactacgctccatccggaatcgacatcttcactaaggagaacctgacggcaccgggctctgatagcgccgtgtttttcgagcaaggcacaacacgaatcgggggaagttataagaaactggtgtaccgagagtacacagatgcgagctttaccaatcgaaaagaaaggggccccgaggaggagcacctcggtattctgggcccggtgatctgggccgaagtgggagataccattagggttacctttcataacaaaggagcatacccactgtccatcgagcccatcggagtgagatttaacaagaacaacgagggcacttactacagtcccaattacaacccccaaagccgctcagtgccacccagtgccagccacgtggcaccaacagagacattcacgtatgagtggacggtgcccaaggaggtcggtcctactaatgcagatcccgtatgcttggcgaaaatgtactactccgctgtcgacccaacaaaggatatctttaccggcctcattgggcccatgaagatctgcaagaagggttctctacacgcaaatggccggcagaaagacgtcgacaaggaattctacttattccccactgtgtttgatgaaaacgagtccctgctgttagaggataatatcaggatgtttaccacagcacctgaccaggttgataaggaggatgaggactttcaggagagcaacaagatgcatagtatgaacggttttatgtacgggaatcaacccggccttacgatgtgcaaaggtgatagcgtcgtctggtacctgttttctgccggcaacgaggcggacgttcacggcatatacttctcaggaaacacctatctttggcgaggggaacgcagggatactgcaaacctgttccctcagacaagcctgaccctgcacatgtggcccgacaccgaggggacttttaacgtcgaatgtcttacgacagatcattatactggtggaatgaaacagaagtacaccgtaaatcagtgcagacgacaatcagaggactccacattttaccttggggagcgaacgtattacatcgcagcagttgaggtggagtgggactacagtccacagcgcgagtgggaaaaagagttgcaccatctgcaggagcagaacgtgagtaacgctttccttgacaaaggagaattttacattgggtctaagtataaaaaagtggtctatagacagtatactgactctactttccgcgttcctgttgagcgtaaagcagaggaagaacacctcggaatcctgggaccccagctgcatgctgacgttggagacaaagtgaaaatcatatttaaaaatatggctacaaggccttactcgatccatgcccacggggttcagaccgaatcgtccacggtgacaccgacgctgcccggggaaaccctgacctatgtatggaagattccggagcgcagcggggcaggcactgaagatagcgcatgtataccctgggcgtactacagcacagtggaccaagttaaggatctttactccggcttgattgggccattgattgtctgccgcaggccgtacctcaaggtctttaatccccgacggaaactggagtttgcccttttgtttttagtgtttgatgaaaatgagtcgtggtatttagatgataacattaagacatatagcgaccatcctgagaaggtgaacaaggacgacgaggagttcatcgagtccaacaagatgcatgctatcaatggccggatgttcggtaacttacagggactcacgatgcacgttggcgacgaggtaaattggtacctgatggggatgggcaacgagatcgatctgcacaccgtccacttccacggtcattcatttcagtacaagcataggggggtttacagctccgacgttttcgatatatttcctggaacctatcagacccttgaaatgtttcctaggacccctggaatttggttgctccactgccatgtgaccgatcacatccatgccggcatggaaaccacatacacagtgttacagaatgaagatacaaagagcggg

SEQ ID NO: 8526 - DNA, 3195 bp, Artificial Sequence
  Description of Artificial Sequence: Synthetic coding sequence
atgaagattctgatcctgggcatatttctgtttctgtgctccacccctgcgtgggcgaaagagaagcactattacattggtatcatcgagactacgtgggattacgcctccgatcatggagaaaagaaacttatttccgtggacaccgaacactcgaacatctacttgcagaacggacctgacagaatcgggagactgtataagaaggccctgtacctgcaatacacggacgaaactttccgcaccactatcgaaaaaccggtttggctcggattcttggggccgatcatcaaggccgaaactggtgacaaggtctacgtgcacctgaagaaccttgcttcaagaccatacactttccactcccacggaatcacctattacaaagaacatgagggcgccatctaccccgacaacacgacggatttccagagagctgatgacaaagtgtaccccggagagcaatacacttacatgctcctcgcaactgaagagcagtcaccaggagaaggcgacggtaactgtgtcaccaggatctaccactcacatatcgacgctccaaaagacatcgcttccggactgatcggtccacttatcatttgtaagaaggatagcctggacaaggaaaaagagaaacatatcgatcgcgagttcgtggtcatgttctccgtcgtggatgagaacttctcgtggtacctggaggacaacatcaaaacgtactgctccgagccggaaaaggtggacaaggataacgaagattttcaggagtccaaccgaatgtactccgtcaacggatacactttcgggagcctgcccggactgtccatgtgtgctgaggaccgggtcaaatggtaccttttcggcatgggaaacgaggtggacgttcatgcagcgttcttccacgggcaggctctgactaataagaactaccgcatcgacaccataaacctgttccctgcgactttgttcgacgcgtacatggtcgcacagaaccctggagagtggatgctctcctgccagaacctgaaccacctgaaagccggcctgcaggcgtttttccaggtgcaggagtgcaacaaatcatcgtccaaggacaacattagaggcaagcacgtgcggcattactatatcgccgccgaagagatcatttggaattacgctccttccggaattgatatcttcacgaaggaaaatctcaccgcgccgggatccgattcggccgtgttcttcgagcagggaaccacccggatcggtggtagctacaaaaagctggtctaccgcgaatacactgacgcctcgttcaccaaccggaaggagagaggaccggaggaggaacacctcggaatcctgggtccggtaatctgggccgaggtcggcgacaccatcagagttaccttccacaacaagggcgcctaccctctgagcatcgagccgattggagtgaggttcaacaagaataacgaaggcacttactactccccaaattacaacccgcaatcccggtcggtgccgccgagcgcctcccacgtcgcaccaactgagactttcacttatgagtggactgtgccaaaggaggtcggaccaactaacgcggaccctgtgtgcctggcaaagatgtactactcagctgtggacccgaccaaggatatcttcactggcctcatcggaccgatgaagatttgcaaaaagggatcgctgcacgccaacggtcggcaaaaggacgtcgataaagagttttacttgttccccaccgtgttcgatgagaacgaatccctccttctggaagataacattcggatgtttactaccgctcctgaccaggtggataaggaggatgaggattttcaagagagcaacaaaatgcactcgatgaacggattcatgtacggaaaccagccgggattgactatgtgcaagggggactcagtggtgtggtacctgttctccgccgggaacgaagcggatgtccacggcatctacttcagtggcaacacctacctctggcggggagagcggagagacacggcgaatctgttcccgcagacttccctcaccttgcacatgtggccggacaccgaggggacgttcaatgtggagtgtctcaccactgatcactacactggcggtatgaagcagaagtacaccgtgaatcaatgccggagacaaagcgaggattccactttctacctgggggagcgcacctactacatcgccgctgtcgaggtggagtgggactacagcccgcagagggaatgggagaaggaattgcaccacctccaagagcagaacgtgagcaacgccttcctggacaaaggagaattctacattggttcgaagtacaaaaaggtggtctaccggcaatacactgattcgaccttccgggtgcctgtcgagcgcaaggcagaagaagagcatctcggcatcctcggcccgcaactgcacgcggacgtgggggataaagtgaaaatcatctttaagaacatggcaacccggccttacagcatccacgcgcacggagtccaaactgaatccagcactgtgaccccaaccctgcccggggaaacgctcacgtacgtgtggaagatcccggagcgcagcggagccgggacggaggactctgcgtgcattccgtgggcttactacagcacggtggatcaggtgaaggatctgtactccggacttatcggacccctcatcgtgtgccgcagaccttatctgaaggtgtttaatccgcgccgaaagttggagttcgccctgctgtttctcgtgttcgacgaaaacgagtcctggtacctggatgacaacatcaagacttactcggatcacccagaaaaggtgaataaagatgacgaagaattcatcgaatccaataagatgcacgctatcaacggacgcatgttcgggaacctgcagggcctcaccatgcacgtgggggacgaagtgaactggtaccttatggggatggggaacgaaattgacctgcataccgtccatttccacggacacagcttccaatacaagcatcgcggagtgtacagctcggacgtctttgacattttcccaggtacctaccagacccttgaaatgttccctcgtaccccgggaatctggctgctccattgccacgtcaccgatcatatccatgcaggcatggagactacctacactgtgcttcagaacgaggacaccaagagcggc

SEQ ID NO: 8527 - DNA, 3195 bp, Artificial Sequence
  Description of Artificial Sequence: Synthetic coding sequence
atgaagatactgatcttaggtatattcctttttctgtgctcaacccccgcctgggctaaggaaaaacactactacataggcattattgagaccacctgggattatgcaagtgatcatggggaaaaaaagttgatttcagtggacactgaacactctaatatctacctgcagaatggtcccgaccgtatcggaaggctgtataagaaagctctgtatctccagtataccgatgagacctttcgcacaacgatcgaaaagccagtctggttaggctttttgggtcccataattaaggctgaaactggggataaagtgtatgtacatttgaagaatctcgcttcacgaccctacacctttcacagtcacggtatcacctattataaggaacatgaaggagccatttatcccgacaatacgacagatttccagcgtgcggatgataaggtgtaccctggggagcagtacacatacatgttgctagctaccgaggagcagagcccaggagagggtgacgggaattgtgtaaccaggatatatcatagtcacatcgacgcaccgaaagacatagcgtccggactgattgggcccctgatcatatgtaaaaaagattcgcttgacaaggagaaggaaaagcacattgacagagaattcgtggtgatgttctctgttgtcgatgaaaatttcagttggtaccttgaagacaacatcaagacctactgcagtgaacctgaaaaagtcgacaaggacaatgaagacttccaagagtctaaccgaatgtatagcgttaatggttacacatttgggtccctacccggtctgtctatgtgcgccgaagacagggtcaaatggtatctgttcggtatggggaatgaagttgatgtacatgccgccttcttccacggccaagctctcactaacaagaactatagaatcgataccattaacctgtttccggccacactgttcgatgcttatatggtggctcagaaccccggcgaatggatgctgtcttgccagaatctaaaccatctgaaggcaggccttcaggcattcttccaggtgcaggagtgtaataaatcctcttccaaagacaacatcagaggaaaacatgtgcgccattattacatcgcagcagaagaaataatttggaattatgcaccttccggcattgatattttcaccaaggaaaatctgaccgcgccaggctctgacagcgctgtgtttttcgaacagggaacgactcgaattggcggatcctataaaaagctggtctaccgagagtacaccgacgcaagcttcaccaaccgcaaagagagaggtcccgaagaggagcacctcgggattctgggccccgtgatttgggccgaggtgggagacacaatcagggtaactttccacaataagggcgcctatcccctgagtatagagccgataggagtcagattcaataagaacaacgaaggaacttattattcccctaactataatccccaatctcggtccgtgcctccaagcgcgagtcatgttgctcccactgaaacgttcacctacgaatggacagtgcctaaggaagttgggcccacgaacgccgatccagtctgccttgctaagatgtactatagcgccgtggaccctaccaaggacatttttaccggtctcataggccccatgaagatttgcaaaaaggggagtctccacgctaacgggagacagaaagatgttgacaaagaattttatctgtttcccacagtgttcgacgaaaacgagagcttgctcctggaggataatataaggatgttcacaactgcaccggaccaggtggataaggaagatgaagattttcaggagagcaacaagatgcactctatgaatgggttcatgtacggcaatcagccaggactgactatgtgcaagggcgactcagtggtttggtatttattctctgctgggaatgaggccgacgtacacggcatctattttagtgggaatacctatttgtggcgcggggaacgtcgtgacactgcaaatctttttcctcagacaagccttacactgcatatgtggccagatactgagggaacattcaatgtggagtgcctgactaccgatcattacaccggggggatgaagcagaagtatacggtgaaccagtgccgacgacagagtgaagactccacattttaccttggcgaaagaacgtactatatcgcagccgtcgaagtggagtgggattacagcccccagcgagaatgggagaaggaactgcaccacttacaggagcaaaacgtgtcgaatgcatttttagacaagggggaattctatattgggtctaagtataaaaaggtcgtgtatcggcagtataccgactctacttttagagtacccgtcgagaggaaagcggaggaggagcatctgggtattctggggccacagttacacgcagatgtgggcgacaaagtgaagatcatctttaaaaacatggcaactcgaccctatagcatccatgcacacggcgtgcagacagaatccagtacagtgactccaactctgcccggggagaccctgacctacgtttggaagattccagagcgcagcggcgccggtactgaagactctgcatgtatcccgtgggcatactactcgaccgtggaccaggttaaggatctatattctgggctgattgggccgctaattgtatgcaggcgaccctacctgaaagtgtttaacccacgacgaaagcttgaatttgccctgctgtttttagttttcgatgagaacgaatcttggtacctggacgataatattaaaacctactctgatcatcctgagaaagtgaacaaagacgatgaagaattcattgaaagcaataaaatgcacgctataaatggaagaatgtttgggaatttacaaggactgactatgcatgtgggggacgaagtcaattggtatctgatgggaatggggaatgaaatagacctgcatacagtccattttcatggacactcgttccagtataagcatcgaggggtctattctagcgacgtatttgatatcttccccggcacctaccagacgttagaaatgttcccccgaacaccagggatctggctgctgcattgccatgttacagaccacatacatgcgggcatggaaacaacttacactgtgcttcagaatgaggatactaagtctggc

SEQ ID NO: 8528 - DNA, 3195 bp, Artificial Sequence
  Description of Artificial Sequence: Synthetic coding sequence
atgaagatccttatccttggcatatttctgttcctctgttccactccagcgtgggccaaggaaaaacattactatattggaattatcgaaactacttgggactacgcttcggaccacggtgagaaaaagctgatttcggtggatactgaacatagcaacatctacctgcaaaacggtccagatcggattggacgactgtacaagaaagccctttaccttcagtacaccgatgaaacctttcgcaccactattgagaagcctgtgtggctcggctttctgggaccaatcatcaaggcagagactggagataaagtgtacgtgcatctgaaaaaccttgcgagccggccttacacgtttcattcgcatggaattacttactacaaggaacatgaaggtgccatctacccagataataccaccgattttcaacgcgctgatgacaaggtgtatccaggagagcaatacacttatatgcttttggcaaccgaagaacaatcccctggagaaggtgatgggaactgtgtcacccgtatataccattcacatattgacgcccctaaggacattgcctcgggactgatcggtccactcattatctgtaagaaagatagcctggacaaggagaaggaaaagcacatcgatcgcgaattcgtggtcatgttttcggttgttgacgagaacttttcctggtatctggaagataacattaagacgtactgtagcgaaccagagaaagtcgataaagataatgaggactttcaagagtcgaacagaatgtactctgtgaacggttacacctttggttccctgcccggtctttccatgtgtgcagaggatagggtgaaatggtatctgttcgggatgggaaacgaggtcgacgtgcatgcagcattcttccatggacaggcacttactaataagaattatcggatagacactattaacctctttcccgcgacgctgtttgatgcctacatggtggcacaaaaccctggggagtggatgctttcgtgccaaaacttgaatcacctgaaagccggacttcaggcatttttccaggtccaggaatgtaacaagtcatcctcgaaggataacattcgaggaaaacacgtgcgacactactatatcgcagcagaagaaatcatatggaactacgcaccatccggcatcgatatctttaccaaggaaaatcttactgcacctggctcagattcggcagtcttttttgaacagggaaccaccaggataggtggatcatacaagaagctcgtctaccgcgaatacaccgatgcatcttttaccaacaggaaagagcgaggcccagaggaggagcatctgggtattctcggtcccgtgatttgggcagaagtgggtgataccattcgcgtcacttttcataacaagggcgcatacccactgtcgattgagccgattggtgtgcggttcaataagaacaacgaggggacttactactcccccaactacaatcctcaatcaaggtccgttccaccatctgcgtcgcatgtcgcaccaaccgaaaccttcacctacgaatggacggtgcccaaggaagtgggtcccacgaatgcagatcccgtgtgtttggcaaaaatgtactactcagcggtggatcctaccaaggatatcttcaccggcctgattggaccaatgaagatctgcaagaaaggttcacttcacgccaacggtaggcagaaggacgtggataaggagttttacctgtttcctactgtgtttgacgaaaacgaaagccttctgctcgaggataacattagaatgtttacgacggcaccagatcaagtcgataaggaggacgaggacttccaagaatccaacaagatgcacagcatgaacggttttatgtacggaaatcagcctggtcttaccatgtgtaaaggggactccgtggtttggtacttgttttccgcaggaaacgaagcagatgtgcacgggatctacttctcgggtaatacttacctctggcggggcgagcgacgtgatacggccaaccttttcccccaaacctcgcttaccctccacatgtggccagacaccgagggaacctttaacgtcgagtgtctgaccaccgatcattacaccgggggaatgaagcaaaagtacactgtgaaccagtgtcgccgccaaagcgaagattcaactttttacctgggagagagaacctactacatcgctgcagtcgaagtggagtgggattactcgcctcagcgagaatgggagaaggaacttcaccatcttcaagagcagaatgtttccaatgcttttcttgataagggggaattctacataggatcgaagtacaaaaaggtggtctacagacagtataccgatagcacttttagagtccctgtcgaaagaaaggcagaggaagaacaccttggtattcttggaccacaactgcacgcagacgtgggcgataaggtgaagatcatctttaagaacatggccactcgcccctacagcattcatgcacatggtgttcaaactgaatcctcgactgttactcccaccctcccaggtgaaaccctgacctatgtctggaagatcccggaaagatcaggggccggaactgaggactcggcatgtatcccgtgggcgtactacagcacggtggaccaggtgaaggatctttactcaggactcatcggccccctgatagtctgtaggcggccttatctcaaggtgtttaacccccggaggaaattggaattcgcgctcctgtttcttgtttttgatgaaaatgaatcctggtaccttgacgacaacatcaaaacttactccgatcatccggagaaagtgaacaaggacgacgaggagtttatcgaatcgaataagatgcacgcaataaacggacgaatgttcggtaacctccaaggacttaccatgcacgtgggcgatgaagtgaattggtacctgatgggaatgggtaatgagattgatcttcacaccgtccactttcatggacactcctttcagtacaaacaccgaggtgtgtactcgtccgatgtgtttgacattttcccggggacttaccaaaccctggagatgtttccacggacccccggaatttggcttctccactgtcatgtcaccgatcacattcacgcgggtatggaaaccacctacaccgtgctccaaaacgaggacactaagtcagga

SEQ ID NO: 8529 - DNA, 3195 bp, Artificial Sequence
  Description of Artificial Sequence: Synthetic coding sequence
atgaaaatattaatattaggtatatttttatttctatgttcgacgccggcgtgggcgaaagaaaaacattattatataggtataatagaaacgacgtgggattatgcgtcggatcatggtgaaaaaaaactaatatcggttgatacggaacattcgaatatatatttacaaaatggtccggatcgaataggtcgactatataaaaaagcgttatatttacaatatacggatgaaacgtttcgaacgacgatagaaaaaccggtatggctaggttttttaggtccgataataaaagcggaaacgggtgataaagtatatgtacatttaaaaaatctagcgtcgcgtccgtatacgtttcattcgcatggtataacgtattataaagaacatgaaggtgcgatatatccggataatacgacggattttcaacgagcggatgataaagtttatccgggtgaacaatatacgtatatgttactagcgacggaagaacaatcgccgggtgaaggtgatggtaattgtgttacgcgtatatatcattcgcatatagatgcgccgaaagatatagcgtcgggtttaataggtccgttaataatatgtaaaaaagattcgttagataaagaaaaagaaaaacatatagatcgtgaatttgttgttatgttttcggtagtagatgaaaatttttcgtggtatttagaagataatataaaaacgtattgttcggaaccggaaaaagtagataaagataatgaagattttcaagaatcgaatcgtatgtattcggtaaatggttatacgtttggttcgttaccgggtctatcgatgtgtgcggaagatcgtgttaaatggtatctatttggtatgggtaatgaagtagatgttcatgcggcgttttttcatggtcaagcgctaacgaataaaaattatcgaatagatacgataaatttatttccggcgacgttatttgatgcgtatatggtagcgcaaaatccgggtgaatggatgctatcgtgtcaaaatctaaatcatttaaaagcgggtctacaagcgttttttcaagttcaagaatgtaataaatcgtcgtcgaaagataatatacgaggtaaacatgtacgacattattatatagcggcggaagaaataatatggaattatgcgccgtcgggtatagatatatttacgaaagaaaatttaacggcgccgggttcggattcggcggttttttttgaacaaggtacgacgcgaataggtggttcgtataaaaaattagtttatcgtgaatatacggatgcgtcgtttacgaatcgaaaagaacgaggtccggaagaagaacatctaggtatattaggtccggttatatgggcggaagtaggtgatacgatacgtgttacgtttcataataaaggtgcgtatccgttatcgatagaaccgataggtgtacgttttaataaaaataatgaaggtacgtattattcgccgaattataatccgcaatcgcgttcggttccgccgtcggcgtcgcatgtagcgccgacggaaacgtttacgtatgaatggacggtaccgaaagaagtaggtccgacgaatgcggatccggtatgtctagcgaaaatgtattattcggcggtagatccgacgaaagatatatttacgggtctaataggtccgatgaaaatatgtaaaaaaggttcgctacatgcgaatggtcgtcaaaaagatgttgataaagaattttatctatttccgacggtatttgatgaaaatgaatcgttattattagaagataatatacgaatgtttacgacggcgccggatcaagtagataaagaagatgaagattttcaagaatcgaataaaatgcattcgatgaatggttttatgtatggtaatcaaccgggtttaacgatgtgtaaaggtgattcggtagtttggtatttattttcggcgggtaatgaagcggatgtacatggtatatatttttcgggtaatacgtatctatggcgtggtgaacgacgtgatacggcgaatctatttccgcaaacgtcgctaacgttacatatgtggccggatacggaaggtacgtttaatgtagaatgtctaacgacggatcattatacgggtggtatgaaacaaaaatatacggttaatcaatgtcgacgtcaatcggaagattcgacgttttatctaggtgaacgaacgtattatatagcggcggttgaagttgaatgggattattcgccgcaacgtgaatgggaaaaagaattacatcatctacaagaacaaaatgtatcgaatgcgtttttagataaaggtgaattttatataggttcgaaatataaaaaagtagtatatcgtcaatatacggattcgacgtttcgagtaccggtagaacgaaaagcggaagaagaacatttaggtatattaggtccgcaactacatgcggatgtaggtgataaagtaaaaataatatttaaaaatatggcgacgcgaccgtattcgatacatgcgcatggtgtacaaacggaatcgtcgacggtaacgccgacgttaccgggtgaaacgttaacgtatgtatggaaaataccggaacgatcgggtgcgggtacggaagattcggcgtgtataccgtgggcgtattattcgacggttgatcaagtaaaagatttatattcgggtctaataggtccgctaatagtttgtcgtcgaccgtatttaaaagtatttaatccgcgtcgaaaattagaatttgcgttattatttctagtatttgatgaaaatgaatcgtggtatttagatgataatataaaaacgtattcggatcatccggaaaaagtaaataaagatgatgaagaatttatagaatcgaataaaatgcatgcgataaatggtcgtatgtttggtaatctacaaggtttaacgatgcatgttggtgatgaagttaattggtatttaatgggtatgggtaatgaaatagatttacatacggtacattttcatggtcattcgtttcaatataaacatcgtggtgtatattcgtcggatgtatttgatatatttccgggtacgtatcaaacgctagaaatgtttccgcgaacgccgggtatatggttactacattgtcatgtaacggatcatatacatgcgggtatggaaacgacgtatacggtactacaaaatgaagatacgaaatcgggt

SEQ ID NO: 8530 - DNA, 3195 bp, Artificial Sequence
  Description of Artificial Sequence: Synthetic coding sequence
atgaaaatcttgatattgggtatcttcttattcctttgtagcacgcctgcctgggctaaggaaaagcattactacatcgggattattgagaccacctgggactacgcttccgaccatggcgagaaaaagttgatctccgttgacacggaacactccaacatctacttgcagaacggccccgaccgaatcggtcgattgtacaaaaaggctctctacctccaatacaccgatgaaaccttccggaccacaatcgagaaacctgtgtggctaggcttccttggtcctattatcaaggctgagaccggtgacaaggtgtacgtgcacctgaagaacctagcttcacgtccttacaccttccactcccatggcattacctactacaaagagcacgagggcgctatttaccccgacaatacgaccgatttccagcgtgcagatgataaggtctatccaggagagcaatacacctacatgttgctggctactgaagaacagtcgccgggtgagggtgacggtaattgtgtgacccgaatctaccacagtcacattgatgcacccaaggatatcgcctctggactcatcggtcctttgattatttgtaagaaggatagcttggacaaggagaaggagaagcacatcgatcgcgagttcgtcgttatgttctctgttgttgatgagaatttcagttggtatctggaggacaacatcaaaacatattgctccgagcccgagaaggtggacaaggacaatgaggacttccaggagagcaacaggatgtattcagtgaacggctacaccttcggctctctgcccggtctatccatgtgtgctgaagatcgcgtcaaatggtaccttttcggtatgggaaacgaggtggatgtccatgcggccttcttccatggccaggcgttgaccaataagaactaccgcattgatactatcaacttgttccctgctacgttgttcgatgcgtacatggtcgcacaaaatcccggcgagtggatgctgtcgtgtcagaatctcaaccatctcaaggctggtctgcaagcgttcttccaggtgcaggagtgcaacaagtccagctccaaggacaatatccgtggcaagcacgtgcggcattactacatcgcggctgaagagataatctggaactacgctcccagtggtatcgatatatttaccaaagagaacttgactgcacccggctccgattccgccgtgttctttgagcagggcacgactcgtatcggaggctcctacaagaagctcgtgtaccgtgagtacaccgatgcttcgttcaccaacagaaaggaacgcggacctgaggaagagcacttgggcatccttggtcccgtcatatgggccgaagttggcgacaccatacgcgttaccttccacaacaaaggcgcctaccctctttctatcgagcctatcggcgtccgcttcaacaagaataatgaggggacctattattcgccaaactacaatcctcagtctagaagcgttcctccttccgcctcccatgtagcgcctaccgagactttcacctatgagtggacggtaccgaaagaggtgggccccaccaacgccgaccccgtctgcctggccaagatgtactactcggctgtggaccccacgaaggacatattcaccggcctgatcggacccatgaagatctgtaaaaagggaagtttgcacgcgaacggtcggcagaaggatgtcgacaaggaattctacctgtttcctaccgtttttgatgaaaatgagagcttgctacttgaagacaacatccgcatgttcactaccgcccctgatcaagtggataaggaggacgaggacttccaggagtccaacaagatgcatagtatgaacggcttcatgtacggaaaccaacccggtcttactatgtgtaagggagacagcgtggtatggtatttgttttcggccggtaacgaggcggatgttcacggcatttatttctcgggaaacacgtatctttggcgaggcgagaggcgagacacagctaacctttttcctcagacttcgctgacattacatatgtggcccgacaccgagggcacattcaatgtcgagtgcctgaccaccgaccattacactggcggcatgaagcagaagtatacagtgaaccagtgccgtcggcagagtgaggattcgaccttctatcttggagagcgaacctactacatcgcggccgtcgaggtcgagtgggactactcacctcagcgtgagtgggagaaagaactccaccacctccaggagcagaacgtgtcgaatgccttcctcgataagggcgagttctacattggaagtaagtacaaaaaagtcgtataccgtcagtacacggactccacgttcagggtccccgtcgagcgaaaggcggaggaggagcaccttggcattcttggaccccaactgcacgctgacgttggtgataaggtcaagatcattttcaaaaacatggccacgcgcccttactccatccacgcacacggagtgcagacagaatccagtaccgttacgccaactctgcccggtgagaccctcacctacgtatggaagatcccggaacggtctggtgctggcaccgaagactccgcgtgtattccgtgggcctactactccaccgtcgaccaggtgaaggacttgtatagcggtctcattggacctctgatcgtgtgcagacgcccctatttaaaggtttttaatccccgccgtaagcttgaattcgccctgttgttcttggttttcgatgaaaatgagagctggtacctggacgacaatatcaagacttactccgaccaccctgagaaggtcaacaaggacgacgaagagttcattgagtctaataagatgcacgccataaacggccgtatgttcggtaatctccagggcctgaccatgcacgttggagacgaagtcaattggtaccttatgggtatgggcaacgagatcgacctccataccgtccacttccacggccactcattccagtacaagcaccgcggtgtgtacagttctgacgtcttcgacatctttccgggtacgtatcagacccttgagatgttcccgaggacacctggtatctggttgctccattgccacgtcaccgatcatattcatgccggcatggaaacgacttataccgtgctccaaaatgaggataccaagtctggc

SEQ ID NO: 8531 - DNA, 3195 bp, Artificial Sequence
  Description of Artificial Sequence: Synthetic coding sequence
atgaagatccttattctgggtattttcctgtttttgtgcagtacacctgcatgggcaaaggagaagcattactacatcggtatcattgagaccacctgggactacgccagtgatcacggtgagaagaagctgatttccgtggacactgaacacagcaacatctacctacagaatggtccggacagaattggtcggctgtacaagaaagccctatacttgcaatataccgatgaaactttccgtaccaccattgagaagccggtttggcttggcttccttggacccatcatcaaagccgagaccggcgataaggtgtacgttcacttgaagaacctggcctcacggccctacaccttccacagccacggcataacatattacaaggagcatgagggtgctatttaccccgataacaccacagatttccagcgcgccgatgataaggtgtatcccggcgagcagtacacctacatgcttctggctacagaggagcagagcccaggagagggcgatggcaattgcgttaccaggatctatcattctcatatcgacgccccgaaggatattgcttcgggtttgatcggacccctgatcatttgcaagaaagattcactcgataaggaaaaagagaagcacatcgatcgcgaatttgtcgtgatgtttagtgtggtcgatgaaaacttcagttggtatttggaagataacattaagacctactgctcggaacccgagaaggtcgataaagacaacgaggacttccaggagagtaatcgcatgtatagtgtcaacggatatacgttcggatctctgcccggactttccatgtgcgccgaggaccgtgtgaaatggtatttgttcggcatgggaaacgaagtggatgtccatgccgccttcttccacggccaggcactcacgaacaagaattatcgcatcgacaccataaacctctttcctgctacactttttgacgcttatatggtcgcacagaaccccggcgagtggatgttatcgtgccagaatctgaatcacctgaaggccggcttgcaggccttcttccaggtccaagaatgcaataagtctagttccaaggacaacatccgcggaaagcacgttcgccactattacatagccgctgaagagatcatatggaattacgcaccgtcaggaattgatatattcacgaaagaaaacctgactgccccaggaagcgatagcgccgtgttcttcgagcaaggaaccaccagaataggcggatcatacaagaagctcgtgtaccgggagtacacagatgcctccttcaccaaccgcaaggagagaggaccggaggaagagcacctcggcatcctgggaccggttatttgggccgaggtgggagatacgatcagagttacattccataacaagggtgcctacccattgtcaatcgagccgatcggcgtgcgctttaacaagaacaatgagggtacttattactccccgaactataatccacagtcacgaagtgtgccccccagtgcgagtcacgtcgcgccgaccgaaactttcacttatgaatggactgtgccgaaggaagtgggtcctactaacgccgatccggtgtgcctggccaaaatgtactactccgccgtggaccctacaaaggatatctttaccggtctgatcggcccgatgaagatctgcaaaaagggctccctgcatgctaacggacgacagaaggacgttgacaaggagttctacctcttcccaactgtgtttgacgagaatgagtctttgctgctggaggataacattcgaatgttcaccactgcccccgatcaggtagataaggaagacgaagactttcaggaaagcaataagatgcacagcatgaatggctttatgtatggaaatcagccaggtttgaccatgtgtaagggggactctgtggtctggtacttgttttccgccggaaacgaggccgatgtgcatggcatatatttctccggaaacacgtacttgtggcgcggtgagcgccgagatactgcgaatctgtttcctcagacgagccttaccctgcatatgtggccagacaccgaggggacgttcaacgtggaatgcctgacaacagatcactataccggaggtatgaaacagaaatacaccgtcaatcagtgccgtcgccagagcgaggactcaacattttacctgggagaaagaacgtattacattgccgcagtcgaggtggagtgggactatagcccccagcgggaatgggaaaaggagttacaccatctccaggaacagaacgtatccaatgccttcttagataagggagaattttacatcggtagcaaatacaagaaggtcgtataccgccaatatacggattctactttccgggttcccgtggaacgaaaggccgaggaggagcacttggggatcctgggtccccagctgcacgctgatgtcggtgacaaggtgaagattatcttcaaaaatatggcgacacggccctactccattcacgcccatggtgtccagactgagtcatcgaccgtcaccccgaccttgccgggagaaaccttgacatatgtttggaagattccagagcgctcaggcgccggcactgaagactcggcgtgcatcccatgggcgtactactcgacggttgaccaggtgaaggatttgtactcgggcctaatcggcccattgatagtttgccgtcgtccttacttgaaggtttttaacccacggcgcaagctggaattcgctctgttgtttctagtgttcgacgagaacgagtcctggtacctagatgacaacattaagacctactccgatcatccagaaaaagttaataaggacgatgaggagtttatagagagcaataagatgcatgccatcaacggacgtatgttcggcaatctccaaggtctcactatgcacgtgggcgatgaggtgaactggtacctgatgggcatggggaacgagattgatttacacacggtccacttccatggtcactcattccagtacaagcaccggggggtgtactcctcggacgtgtttgatatttttcctggtacctatcagaccctggagatgttcccacgaacacccggcatctggctgttacactgccatgtcaccgaccatatccacgccggcatggagactacctatacggttctacaaaacgaggatacaaaatcgggc

SEQ ID NO: 8532 - DNA, 3195 bp, Artificial Sequence
  Description of Artificial Sequence: Synthetic coding sequence
atgaaaatactgatcctagggattttccttttcttatgctctacaccagcatgggctaaggaaaaacattactatatcggaataattgagaccacttgggattacgcttctgatcacggggagaaaaagcttatctctgtcgataccgaacactcaaatatctatttgcagaacggaccggatcgaatcggaagactttataaaaaggctctctaccttcaatatactgatgagacatttagaactacaatcgagaagccggtttggttaggattccttggacctataatcaaggctgagacaggagacaaggtctatgttcacctgaagaatttggcttccagaccttatacattccacagtcacgggatcacatattataaggaacatgagggtgctatttacccagataacacaacagacttccagcgtgctgacgacaaagtctatcctggggagcagtacacgtacatgcttcttgctaccgaggaacaatcacctggtgagggcgatgggaattgtgttactcgaatctaccattcccacatcgatgcaccgaaggatatagcgtccggtctcatagggccattgattatctgcaagaaagactcgttagataaggaaaaagagaaacatatagatagagaatttgttgttatgtttagtgttgttgatgaaaattttagctggtatctcgaagacaacattaagacttactgttccgaacctgagaaggtagacaaggataacgaggatttccaggagtctaaccgtatgtactcagttaacggatatacatttggctctcttccaggtctgtctatgtgcgccgaagatcgtgtaaagtggtaccttttcggaatgggtaatgaggtagacgttcacgctgcattctttcatggtcaggcacttactaataagaattataggattgatactataaatctgttccctgctacattattcgatgcttatatggtagcacaaaatccgggagaatggatgttgtcatgccaaaatttaaaccacctgaaggcaggtcttcaagcttttttccaagttcaagagtgtaataagtcctcgtctaaggacaacattcgaggtaagcatgtcaggcattattatatcgctgctgaggagatcatctggaattacgccccttctggtatcgacatattcaccaaggaaaaccttacggcacccggctcagactctgctgtgttcttcgagcagggtaccacacggattggtggttcttacaaaaagcttgtttaccgagagtacacagatgcttcctttacaaatagaaaagagagggggcccgaggaggagcatcttggtatcctgggccctgttatttgggctgaagtcggagacacgataagagtcacctttcataacaaaggtgcttatccattgtccattgagcctatcggtgtgcggttcaacaaaaacaacgagggcacttactattcaccaaactacaatccacagtctcgctcggttccaccatccgctagccacgttgctcccaccgaaacttttacctatgagtggacagtgcctaaagaggttggtccaacaaatgccgaccctgtatgcctggctaagatgtactactcggctgttgaccccactaaagacatttttacaggtcttataggtccaatgaaaatttgcaaaaagggatctttgcatgccaatggtagacagaaggatgttgacaaagagttttacctgttccctactgttttcgatgaaaacgaatcactattgttggaggataacattagaatgtttacgacagctccagaccaggttgataaggaagacgaagattttcaagagtcaaacaaaatgcattctatgaatggattcatgtacggcaaccagcctggtctgactatgtgcaagggagattcagttgtttggtacctcttctcagccggtaatgaagctgatgtccatggcatctacttctcagggaatacctacttgtggagaggagagaggcgtgatacagcaaacctttttccacagacaagtcttacgctccatatgtggcctgacacagaaggtactttcaatgttgagtgccttactacagatcattatactgggggtatgaaacagaaatatacggttaaccagtgtagacgacaaagtgaagatagtactttttatctgggggaacgtacatactacattgcagccgttgaagtggaatgggattactccccacagagggaatgggaaaaggaacttcaccatcttcaagagcaaaacgtgagcaatgcattccttgataaaggggaattctacattgggagcaagtacaaaaaagtcgtgtaccgccaatacacagatagcactttcagagtaccagtcgaaagaaaggcggaagaggagcatcttgggattcttggtccgcagttgcatgcagatgtgggagacaaggttaagatcatatttaagaacatggctactcgtccttattccattcatgcacacggagttcagactgagagctctacagttactcctacgctcccaggagagacattaacctacgtttggaagatcccggagcgctcgggagctgggactgaggattcggcctgcatcccatgggcctactactcaactgttgaccaagtaaaggacctatactcagggctaatcgggcctcttattgtttgccgacgtccttatttgaaggtctttaatccacgtcgtaagcttgaatttgcccttcttttcttggtcttcgatgagaatgaatcttggtatctagacgataacatcaaaacttattctgatcatcctgagaaggtaaataaggatgatgaagaatttatcgagtcaaataagatgcacgctatcaacggaagaatgttcggcaacctgcagggcttgaccatgcatgtaggtgatgaggttaattggtatctcatggggatgggtaatgagatcgatttacataccgttcattttcatggacactccttccagtataagcataggggggtttattcctcagatgttttcgatatattcccaggaacctaccagacactggaaatgttccctagaacacctggaatatggttgcttcactgtcatgtgacggatcacattcatgctggtatggaaactacttatacagtgttgcaaaacgaggatactaagtccgga

SEQ ID NO: 8533 - DNA, 3195 bp, Artificial Sequence
  Description of Artificial Sequence: Synthetic coding sequence
atgaagattctcattctcggaatctttctgtttctctgcagcacccctgcgtgggcaaaagagaaacattactacattggtatcattgaaaccacctgggattacgcatcggatcatggagaaaagaagttgatttcagtggatactgagcattcaaatatctacctgcaaaacggaccagatagaatcggacgactttacaagaaagcgctgtacctgcaatacaccgatgagacttttagaaccaccattgaaaagcctgtatggttgggcttccttggaccgatcattaaagcagaaactggagataaagtgtacgtccatcttaagaaccttgccagccgcccttacacttttcatagtcacggaattacttactacaaggagcatgaaggggcgatttaccctgacaatactacggatttccaacgtgccgatgataaggtctaccccggcgaacaatatacctacatgctccttgcaactgaagagcagtcaccaggggaaggtgatggaaattgcgtgactcggatttaccattcgcatatcgatgcccctaaggatatcgcctccggactgattggtccactgatcatttgtaagaaggattcgctggacaaggagaaagaaaagcatattgaccgcgagttcgtcgtgatgttctcggtcgtggatgagaatttcagctggtacctggaagataacatcaagacctactgctcggagccagaaaaggtggataaggataacgaggatttccaagaaagcaaccgtatgtactccgtgaacggctacactttcggtagcctgcctggcctctcgatgtgcgcagaggatagggtgaagtggtacctgtttgggatgggaaatgaagtggacgtgcacgcagcgttttttcatggacaagccctgaccaataagaattaccggattgataccattaatctttttccagcgactctctttgacgcctacatggtcgcacagaacccgggagaatggatgctctcctgtcagaaccttaaccacctcaaggcaggactccaagcattctttcaggttcaagagtgcaataagtcatcatctaaggacaacatacgaggaaagcacgtccgccactactacattgcagcggaagaaatcatctggaattatgcaccaagcggaatcgacatctttactaaagaaaatctcactgcccccggtagcgactccgccgtcttttttgaacagggaaccactcggattggaggatcatacaagaaactggtgtacagagagtacactgatgcatcattcaccaatcgcaaggagcgtggtccagaagaagagcatctgggaatccttggcccagtcatttgggcagaagtgggagataccattagggtgactttccacaacaaaggtgcataccctttgtccattgagccgattggagtgcggttcaataagaacaatgaggggacttactactcgcctaactacaacccccagagcagatcagtgccgccatctgcatcccacgtcgcacccaccgagactttcacctacgagtggaccgtgccgaaagaagtcggcccaactaacgcagatcccgtgtgtcttgcaaagatgtattactccgccgtggaccctaccaaggacattttcaccggtcttataggtcccatgaagatttgtaaaaaggggagcctgcacgcaaatggtcgccagaaggacgtggataaggaattctaccttttcccaactgtgtttgatgaaaatgagagcttgctccttgaagataacatacggatgtttactactgcacctgaccaagtggacaaagaagatgaagatttccaagagtcaaacaagatgcatagcatgaacggtttcatgtacggtaaccaacccgggctgactatgtgtaaaggtgactcggtggtgtggtacttgttttccgcaggaaacgaagcggacgtccatggcatttacttctccggtaacacttatctttggcgaggggagagaagagataccgcaaacctgttcccccaaacctccctgacccttcatatgtggccagataccgagggaacctttaacgtggagtgcctcaccaccgatcactataccggaggaatgaagcagaagtacacggtcaatcagtgtcggaggcagtcagaggactcgaccttctaccttggtgagcgtacgtactacattgccgcggtcgaggtggagtgggactactcacctcagagggaatgggagaaggaactccaccatctccaagaacaaaacgtgtctaacgcgtttttggataagggtgagttctatattggttccaagtataagaaagtggtgtaccgtcagtacaccgactcaacctttcgggtgccagtggaacgaaaggcagaggaagagcaccttggaatccttggaccccagcttcatgccgacgtgggagacaaagtcaagattatcttcaagaacatggcgactagaccctattcgatccacgcacatggagttcaaactgaatcgagcaccgtgactccgactcttccaggggaaactttgacttacgtgtggaagattccagagcgcagcggggcaggtaccgaggactcggcgtgtattccatgggcatactattcaactgtggaccaagtcaaggacctgtactccggcctcattggtcctctcatagtgtgtagaaggccttacctcaaagtgtttaaccctagaagaaaacttgaatttgcattgctgttccttgtgttcgacgaaaatgagtcatggtacctggacgacaacatcaaaacctactcagatcatccagagaaggtcaataaggatgatgaagagttcatcgaaagcaataagatgcatgcaatcaatgggcggatgtttgggaaccttcagggactgactatgcacgtcggtgatgaagtgaattggtaccttatgggtatgggtaacgagattgatctgcataccgtccacttccacgggcattcatttcaatacaaacacaggggagtgtactcatctgacgtgtttgatatcttccctggaacttatcagaccctggaaatgtttcctcgcacccctggtatatggctgcttcactgtcacgtcactgatcacatccatgctggaatggaaactacctacactgtgcttcaaaacgaggatacgaaatcggga

SEQ ID NO: 8534 - DNA, 3195 bp, Artificial Sequence
  Description of Artificial Sequence: Synthetic coding sequence
atgaagattctgatattgggcattttcctgtttctgtgtagcacgccagcatgggcgaaggagaaacattactacatcggtatcatcgaaaccacttgggactacgcatcggatcatggcgaaaagaagctcatctcggtggatactgaacactcaaacatatacttgcaaaacggacctgaccgcatcggacggctttacaaaaaggcattgtacctgcagtacactgatgaaaccttcagaactaccattgaaaaacctgtgtggcttggattcctggggccgatcattaaggctgaaaccggtgacaaagtgtacgtccatctgaagaacctggcatcacggccttacacgttccactcccacggcatcacttactacaaggaacatgaaggggcaatttacccggataatactaccgattttcagcgagcagatgataaggtctacccaggggaacaatacacttacatgctgctggctactgaagagcaatcccccggagaaggagatggaaactgcgtcacgagaatataccacagccatattgatgcaccgaaggatattgcaagcggtttgatcgggccattgattatctgtaagaaggattcgctggataaggaaaaagagaagcacattgatagggaatttgtcgtgatgtttagcgtggtggatgaaaacttctcgtggtaccttgaggataacattaagacctactgcagcgaacccgaaaaagtggacaaggacaacgaagatttccaagaaagcaacagaatgtacagcgtcaacggatacacctttggtagcctgccgggactctctatgtgtgcagaagatcgggtcaaatggtacctttttggtatgggaaacgaggtggatgtgcatgccgcctttttccacggacaggcgcttactaacaagaattacagaatagatactattaacctgttcccagcgaccctgtttgacgcatatatggtggcccaaaatcctggcgaatggatgctgtcctgccaaaatctcaatcatctgaaagcaggcttgcaagcgttctttcaagtccaggagtgtaataagtcaagctcaaaggacaatatacgtggaaagcatgtgcgtcactattacattgcagctgaggagatcatttggaactacgctccctcgggaattgacatattcaccaaagagaaccttaccgcgccgggttcagactcggcggtgttctttgaacaaggaaccactagaatcggcggatcgtacaagaagctggtctacagagaatacaccgatgcatcgttcacgaaccggaaggagaggggtcccgaagaggagcatctgggaatcctcgggcctgtgatttgggccgaagtgggcgacaccattcgcgtcacctttcacaataagggggcgtacccgctgtccatcgaaccgataggagtgcgctttaacaagaacaatgagggcacctactactcccccaactacaacccacagtcacggtcggtccctccttcggcatcacatgtggccccgactgaaaccttcacgtatgagtggaccgtgccaaaagaggtgggcccaaccaacgcagacccggtttgtctggccaaaatgtactactcggcagtcgatcccactaaagacattttcaccggactgattggtcctatgaagatttgtaagaagggctcgctgcatgcaaacggtaggcaaaaagatgtggataaagaattctacctttttccaactgtctttgatgaaaacgaatccctgctgctggaggacaatattcgtatgtttacgaccgcgccagatcaggtggacaaagaggacgaggattttcaagagagcaataagatgcactccatgaatggcttcatgtacggtaaccaacctggacttactatgtgcaaaggcgactcagtggtgtggtacctgtttagcgcaggaaacgaagcagatgtgcatggcatctacttttctggtaatacttacttgtggagaggggaaagacgagataccgccaacctgtttcctcaaacctccctcaccctccatatgtggccggatactgagggtactttcaacgtggaatgtcttactaccgatcactataccgggggtatgaagcagaagtacactgtgaaccaatgtagacggcagtccgaagattcgactttctatctgggggaacggacgtactacatcgctgctgtcgaagtggaatgggattattctcctcagagagagtgggaaaaggagcttcatcatctccaagagcagaatgtgagcaacgcattcctcgacaagggagagttttacatcggaagcaagtacaaaaaagtggtctaccgccagtacaccgattctacttttcgggtgccagtcgaaaggaaagcagaagaagagcatctgggcatactgggcccccaactccatgccgatgtcggggacaaggttaagatcatctttaagaatatggcaacgcggccttactcaatccacgcccacggggttcagactgaatcgtcaaccgtgacgcctactctccccggagaaactctcacctacgtttggaaaattccggagagatccggagccggcaccgaggactccgcatgtatcccttgggcctactactcgactgtcgatcaagtgaaggacctttactccgggctcattggacctctcattgtttgccgcaggccataccttaaggtctttaacccgcgacgtaagctggaatttgctcttctctttctggtgtttgatgagaacgaatcatggtaccttgatgataacatcaagacctattccgatcatcccgagaaggtgaacaaggacgatgaagaattcatcgaatcgaataagatgcatgcgattaatggccgtatgtttggaaatctccaaggactgaccatgcatgtgggtgacgaggtgaactggtatcttatgggtatgggaaatgagatagacctgcacaccgtgcattttcacggtcattcgtttcagtacaagcacagaggagtgtacagctccgacgtgtttgacattttcccgggtacttatcaaaccctcgaaatgtttcctcgaacgcctggaatttggctgctgcattgccacgtgactgatcacatccatgcaggtatggaaactacgtacaccgttcttcagaatgaggacactaaatccggt

SEQ ID NO: 8535 - DNA, 3195 bp, Artificial Sequence
  Description of Artificial Sequence: Synthetic coding sequence
atgaagatccttatactcggaatcttcctgtttctgtgctcgaccccagcatgggcaaaagaaaaacattactacatcggaatcattgaaaccacctgggattatgcatccgatcacggtgagaaaaaactgatttctgtggatactgagcattctaacatttacctgcagaatggccccgatagaattggacgcctttacaagaaggcactttacctgcagtataccgatgaaacctttcgtaccaccattgaaaaaccagtttggctgggctttctggggcctataatcaaggcagagactggagacaaggtctacgtacacttgaaaaaccttgcgagccggccatacaccttccattcccacggcattacttactataaggaacatgaaggtgctatttacccggataacaccaccgattttcaaagagcagacgacaaggtgtacccaggagagcagtacacgtacatgcttctcgcgactgaagaacagtcaccgggcgaaggagacggaaactgtgtgaccagaatttaccatagccacattgacgccccaaaggatatagcctcgggtctgattggacctcttatcatttgtaagaaagattctctggataaggaaaaggagaagcacatcgaccgtgaattcgtcgtgatgttttccgtcgttgacgaaaacttctcctggtacctggaggacaacattaagacttactgttccgaacctgaaaaggtcgataaggataacgaagatttccaagagtcgaaccgcatgtacagcgttaacgggtatacttttggatctctcccaggactgagcatgtgcgcagaagatagagtgaaatggtacctgtttggtatggggaacgaagtagacgtgcatgcagcattcttccacggccaggcactgactaataagaactacagaatcgacactattaacctctttccagcaactctgttcgacgcctacatggtggcccagaatcctggagaatggatgttgtcgtgccagaacctgaatcatctgaaggcaggcctgcaagcatttttccaggtgcaggaatgcaacaagagctcgtccaaagataacatccgcggtaagcatgtccgtcactactatattgcggcagaggaaatcatttggaactacgcccctagcggaattgacattttcactaaggagaatcttacggctccaggttcggatagcgccgtgttctttgaacagggtaccacgcgcattggcggtagctacaaaaagctcgtgtaccgggaatacactgacgcttccttcacgaaccgcaaggaacgcgggcctgaggaggagcatctgggcattctgggccctgtgatttgggcagaggtgggggatactatccgagtgaccttccataacaagggagcataccccctgtctattgagcccataggtgtgcggttcaataagaacaatgaaggaacctactacagtcctaactacaatccacagtcgaggtccgtgcccccatcggcttcccacgtggcacctactgagactttcacctacgagtggaccgtacctaaagaagttgggcccaccaacgccgatcccgtgtgcctggctaagatgtattactcagcggtggaccctaccaaggacattttcacgggactcataggaccaatgaaaatctgtaagaaaggatcgctgcatgcaaatggtcgccaaaaggatgtggataaggagttctacctctttcccaccgtctttgacgagaacgaatcccttctccttgaagataacatcaggatgtttaccactgcgcccgaccaggtggataaagaagatgaggattttcaagagagcaacaagatgcactcaatgaacggatttatgtacggtaatcagcccgggcttaccatgtgtaagggagattctgtggtctggtacctcttttcagcgggaaatgaagcggatgtgcatggaatatacttttcaggtaacacctacctgtggaggggagagcgtcgagacactgccaacctgtttccccagacctcactcacccttcatatgtggccagacactgaaggaacctttaatgtggaatgcctgactaccgatcactacaccggaggcatgaagcagaagtacaccgtcaatcaatgtaggagacaaagcgaagattccacgttctaccttggggagcgtacctactacatagctgcggtcgaagtcgagtgggattactcccctcaaagagaatgggagaaggaattgcatcatctgcaagaacaaaatgtctctaacgcattcttggataagggggaattctacataggttctaagtacaagaaagtcgtctaccgccagtatactgactcaaccttcagagtgccagtcgagagaaaggcagaagaagagcacctgggtattctcggacctcaactgcacgcagacgtcggtgataaagtgaagatcatattcaagaatatggccactaggccctactccatccacgcgcatggggtgcagactgaatcctcaactgtgacccctacccttccaggagaaaccctcacctatgtgtggaaaataccggaaagaagcggagcaggtacggaagattccgcctgtattccgtgggcatattactcaactgtggatcaggtgaaggatctctattccggacttatcggtcctttgattgtctgtagaaggccttacctcaaagtgtttaatccacgaagaaaacttgagtttgcacttctttttctcgtgttcgacgagaatgagtcgtggtacctggatgataacataaagacttactcagaccatccggagaaagtgaataaagatgacgaagagtttattgagtcgaataagatgcatgctatcaacggtcgcatgtttggaaaccttcaaggcctcactatgcatgtgggtgacgaagtcaactggtacctgatgggaatggggaatgaaatcgatctgcacactgtgcatttccatggccactcatttcaatacaagcataggggcgtgtactcatcagatgtgtttgatatctttccaggaacgtaccagacccttgaaatgtttccacggacgccaggaatttggttgcttcattgtcatgtgacggatcatatccacgcaggtatggaaaccacgtacaccgtgctgcaaaacgaggacacgaaaagcggg

SEQ ID NO: 8536 - DNA, 3195 bp, Artificial Sequence
  Description of Artificial Sequence: Synthetic coding sequence
atgaagattctaatcctagggatcttcttgttcctgtgtagcactccggcttgggctaaagagaaacactattacattggcataatcgagaccacgtgggattatgccagcgaccacggcgaaaagaaactcatttccgtcgatacagagcatagtaatatctacctgcagaacggcccggaccggatcggcaggctttataaaaaggcactgtacctgcagtacacagacgagacattccggacaacaattgaaaagccggtatggctgggtttcctcggtcccattattaaggcagaaactggcgataaggtgtacgtacacttgaagaatctggcatccaggccatatactttccattctcacgggataacctattataaggaacacgaaggcgccatttacccagacaacacaactgactttcagagagcagatgataaagtttaccccggggaacagtacacgtatatgctactagcaacagaggagcagagtcctggagagggagacggaaactgtgttaccaggatttatcacagccacatcgacgctcccaaagatatcgcatccggcctgatcggtccactgattatttgcaagaaggactccctggacaaggagaaagagaagcacatcgatcgggagttcgtggtcatgttctcagtagtggatgaaaatttttcttggtatttggaggacaatataaaaacctattgctcagagccggagaaggtggacaaggacaacgaggatttccaagagtctaatcggatgtattcagtcaatggatatactttcggctccctgccaggactgtccatgtgcgctgaggaccgggtcaaatggtacttattcgggatgggcaatgaagtggacgtgcacgccgcattcttccacggacaagcactgacgaacaagaattataggatcgatacaattaaccttttcccagctacactcttcgacgcatacatggtagcccagaaccccggagagtggatgttgagctgccagaatctgaaccacctcaaggcaggcctccaggcattcttccaggtccaggagtgcaacaaatcttcaagtaaagataatatccgtgggaaacatgtgagacactactatatcgccgcagaggagatcatctggaactatgccccatccgggatcgacatcttcactaaggagaatctgaccgctcctgggtccgattcagcagtgttttttgaacaagggaccacccggataggcggttcttacaagaagctggtgtacagggagtacaccgacgcctcctttacaaaccgaaaggaacggggccctgaagaagaacaccttgggatactgggccctgtgatctgggccgaagtgggagatactattagggtgactttccacaacaaaggggcttatcctctgagcatagagcctatcggagtgaggttcaataagaacaacgagggcacctattattcgccaaactataatccacagtctcgcagcgtgcctccctccgcgagtcacgttgcacctacagagacgttcacctacgagtggaccgtgcccaaagaagtaggacccaccaatgccgaccccgtgtgtctggccaaaatgtattattctgctgtagatcccactaaagatattttcacaggtctgataggacctatgaagatctgcaagaagggatcgctccacgccaatggacgacagaaggatgtggacaaggagttctacctgtttcctacagtgtttgatgaaaatgaatctcttctgctggaggataacatcaggatgtttactaccgcaccagatcaggtcgacaaagaagatgaggactttcaagaaagtaataagatgcactcaatgaacgggtttatgtatggaaatcaaccaggcctcactatgtgcaagggcgactccgtagtatggtatctattttccgccggcaacgaggctgatgtgcatgggatttacttcagcggcaacacttacctgtggaggggggaaaggagggataccgcaaatctattccctcagacttcacttacactgcacatgtggcctgacaccgaagggacattcaacgtggagtgcctgaccacagaccactacacaggaggtatgaagcagaagtatacagtaaatcagtgtcggaggcaatctgaagactcaacgttttacctgggagagcgaacttactatattgctgctgtggaagtggaatgggattactcccctcaaagggagtgggagaaggagctgcatcacttgcaagagcaaaacgtatcaaacgcatttttggacaaaggggaattctatattggttccaagtacaagaaggtggtctaccgccagtacaccgatagtacttttagggttccggtggagagaaaagccgaagaagagcatctgggcatcctggggccgcagctacacgctgacgttggcgataaagtgaagataatctttaagaacatggctacccggccctattccatccatgctcatggggtccagaccgagagttccaccgtgacacccacccttccgggcgagacgctgacctacgtttggaagataccagaacgttctggagccggtactgaggactccgcatgcatcccgtgggcctactacagtacagttgatcaggtaaaggatttgtatagcggcctgataggtccgttgatcgtctgcaggaggccatatctgaaggtattcaacccacggcggaagttagagtttgctcttctgttccttgtattcgacgaaaacgaatcctggtacctggacgacaacataaaaacatatagcgatcaccccgagaaggttaacaaggatgatgaggagtttatagagagcaacaagatgcacgccataaacggccgtatgttcgggaatctacaagggctaacaatgcacgtcggtgacgaggtgaactggtacctgatggggatgggtaacgagattgacctccacacggttcatttccacggtcacagcttccagtacaagcatcggggtgtttattcctccgacgtgttcgatatatttccaggtacttaccagacgctggagatgtttccacgaacaccaggcatctggctactgcactgccacgttactgatcacatccacgccgggatggagactacctatacagtactgcaaaacgaggatacaaagtccgga

SEQ ID NO: 8537 - DNA, 3195 bp, Artificial Sequence
  Description of Artificial Sequence: Synthetic coding sequence
atgaagatcctcatactcggaatcttcctcttcctgtgctccaccccggcgtgggcgaaggaaaaacattactacatcgggatcatcgaaactacctgggactacgcgtcagaccacggagaaaagaagctcatctccgtggacactgagcacagcaacatctacctgcaaaacggccccgacagaatcgggaggctgtacaaaaaagccctgtacctgcagtacaccgatgaaaccttccggactaccatcgagaagccggtctggctggggttcctggggcctattatcaaggccgagactggtgataaggtctacgtgcacctgaaaaacctggcttctaggccgtacacgttccactcgcatggaatcacctactacaaggagcacgagggagccatatacccggataacaccaccgacttccaaagagccgatgataaggtgtacccgggcgaacagtacacctacatgctgctggcaactgaggagcagtcccccggggaaggggacggcaactgcgtgacccgaatctaccactcacacatcgacgcccctaaagacatcgcctcgggcctgatcggcccgctgatcatctgcaaaaaggattccctggataaagagaaagaaaaacacattgatagagagttcgtggttatgttctccgtcgtagatgaaaatttctcgtggtaccttgaggacaatattaagacctactgttccgagcccgagaaagtcgacaaagacaatgaggacttccaggaatcgaaccgcatgtactcggttaacggctatactttcggaagcctgccgggtcttagtatgtgcgcagaagatagggtgaagtggtacttgtttggtatgggaaacgaagtcgacgtccatgcggcattcttccacggacaggccttgactaacaaaaactacagaatcgatactatcaatcttttcccggcgaccctcttcgacgcttacatggtggctcaaaaccctggcgagtggatgctgtcatgtcagaacctcaatcacctcaaggccggattgcaggccttcttccaggtccaagagtgcaacaagagctcgtcaaaggataacatcagaggaaagcacgtcagacactactacattgcagctgaagagatcatctggaactacgcgccgtccggaatcgacattttcactaaggaaaatctgactgctcccggatcggactccgccgtgttctttgaacaaggtactacccgcattggaggatcatacaagaagctcgtgtaccgcgagtacactgacgcatctttcaccaaccggaaggagcgcggccctgaggaagaacatcttggaatcctcggaccggtgatctgggcggaagtcggcgataccatccgcgtgacgtttcacaacaagggcgcataccctcttagcatcgaaccgatcggagtgcgcttcaataagaataatgaaggtacttactactcacccaattacaacccacaatccaggtcggttccaccaagcgcctcgcatgtggccccaactgaaacgttcacctatgagtggaccgtcccgaaagaagtgggtccaactaacgcggaccctgtgtgcctggccaagatgtactacagcgccgtcgacccgaccaaggacatctttaccggattgattgggccgatgaagatctgcaagaagggctcgctccacgcgaatggtcgccagaaggatgtggacaaagaattctacctgtttccaactgtgttcgacgagaatgagtccctcctgttggaagataacattagaatgttcactaccgctcctgatcaagtggacaaggaggacgaagattttcaggagagtaacaagatgcattcgatgaacgggttcatgtacggtaaccagccaggacttaccatgtgcaagggagactcagtggtgtggtacctcttctcggccggtaatgaagccgacgtccacggaatctacttctcaggaaacacgtacctgtggcggggagagcgtagagataccgcaaacctcttcccacagacctctctcactctgcacatgtggcctgataccgaaggaactttcaatgtggaatgcctgaccaccgaccattataccggcggcatgaagcagaagtacaccgtgaatcagtgtcggcgccagtcggaggatagcaccttttaccttggagagcgaacttactatatcgcggccgtggaagtggaatgggactactcgccgcaacgggaatgggaaaaggaactgcaccacctgcaagaacaaaacgtgagcaacgctttcttggacaaaggcgaattctatatcggctcaaagtacaaaaaggtggtgtaccggcaatataccgacagcacttttagggtgccagtcgagcggaaagccgaggaagagcacctcggaattctcgggccccagctccacgctgatgtgggagataaagtgaagatcatcttcaagaatatggcgactcggccgtactccatccatgcacatggagtgcagactgagtcgagcaccgtgactccgactctgccgggagagactctgacttacgtgtggaagatccctgaacgctccggggcaggaacggaagattcagcctgcatcccgtgggcatactacagcactgtcgaccaggtcaaggacctgtacagcggactgatcggacctctgattgtgtgtcgccggccatacctgaaggtgttcaacccgcgccggaaactcgaatttgccctgcttttcctggtgttcgatgaaaatgaatcatggtacctcgatgacaacatcaaaacgtatagcgaccatccagaaaaggtgaataaagacgatgaggaatttattgaatccaataagatgcacgctatcaacgggcgcatgtttggcaacttgcagggactgaccatgcacgtcggcgacgaggtcaactggtatctgatgggcatgggtaatgagatcgacttgcacaccgtgcattttcatggacattcctttcaatacaagcatcgcggagtctactcctcggacgtgttcgacatctttccgggaacctaccagaccctggagatgtttccccggactccaggcatttggctgctccactgccatgtcacggaccatatccacgcggggatggaaaccacgtacactgttctccagaacgaggatacgaagtccgga

SEQ ID NO: 8538 - DNA, 3195 bp, Artificial Sequence
  Description of Artificial Sequence: Synthetic coding sequence
atgaagatcctgattctgggaatctttctgtttctgtgctcaacgccggcatgggcgaaggaaaaacactattacatcgggatcattgaaactacttgggattacgcgtcggaccatggagagaaaaaactgatctccgtggatactgaacacagcaacatctaccttcagaacggacctgatcggatcggaaggctgtacaagaaggctctctacctccaatacaccgatgagacgtttcggaccaccatcgagaagccggtgtggctgggattccttggccctatcatcaaggctgaaactggcgacaaggtctacgtgcatctgaaaaacctggcttcacgcccctacaccttccactcacacggaatcacctactacaaggaacacgagggagctatctacccggacaacaccaccgactttcagcgggccgatgataaggtgtacccgggagagcagtacacttacatgctgctggctactgaggagcagtccccgggtgaaggcgacggcaattgcgtgactcgaatctaccacagccatatcgacgcgcctaaggacatcgcgtcaggcctgatcgggccgttgatcatctgtaagaaagattcgttggacaaggagaaggagaagcacatcgaccgcgaatttgtcgtcatgttctccgtggtcgatgagaacttctcatggtacctggaagataacatcaagacctactgttccgagcctgaaaaggtggacaaggacaatgaggacttccaagagagcaatcggatgtacagcgtgaacgggtacactttcggatcgttgccaggactgtccatgtgtgccgaggaccgcgtgaagtggtacctgtttggcatgggaaatgaggtggacgtgcacgcggccttcttccatggacaggcgctgactaacaagaactaccggatcgatacgattaatctgttcccagcaaccctgttcgacgcctatatggtggcccagaatcctggagaatggatgctgtcatgccagaacctcaaccatctgaaggctggactgcaagccttcttccaagtgcaggaatgcaacaaaagcagcagcaaggacaacatccgtgggaagcacgtgaggcattactatattgccgcggaggagatcatatggaactacgctccgtcaggcattgatatcttcactaaggagaacctgaccgccccaggttccgacagcgcagtctttttcgaacagggaacgactcgcatcggcggatcctacaaaaagttggtgtaccgcgaatacaccgacgcttccttcactaatcggaaagagcgcggtcctgaggaggaacatttgggcatccttggacccgtgatctgggcagaagtgggagatactatccgagtcacttttcacaataagggagcatatccattgtccatcgaacctatcggagtgcgcttcaacaaaaacaacgagggcacctactattctcctaattacaacccgcagtcgcgcagtgtgccaccgtctgcctcgcatgtggcgccaacggagacttttacctacgagtggactgtccccaaggaagtgggaccgactaacgcagaccctgtctgtctggctaaaatgtactactcagcggtcgatccaaccaaggacatctttaccggactcatcggaccgatgaagatctgcaaaaagggtagcctgcacgcaaatggacgccagaaagacgtggacaaagagttctaccttttcccgaccgtgttcgatgagaacgagtccttgcttctcgaggacaatattcgtatgtttacgactgccccagaccaggtcgacaaagaagatgaggatttccaggagtcgaataagatgcactcgatgaacggctttatgtacggtaatcaacccgggctgaccatgtgtaaaggcgattcagtggtctggtacctgttcagcgccggcaatgaggcggacgtgcacgggatctacttctcgggaaacacttacttgtggagaggagagcgtcgcgacactgcgaatctcttcccgcaaactagtctgactctgcatatgtggcccgacactgagggtacttttaacgtggaatgcctcactaccgaccactacaccggcgggatgaagcagaaatacaccgtgaaccaatgcagacggcagtccgaagattcgaccttttacttgggggaaagaacttactacatcgcggccgtcgaagtcgaatgggactactcgcctcagcgggaatgggagaaggaactgcaccacctccaggaacagaacgtgtccaacgcatttctcgacaagggagagttctatattggatcgaagtacaagaaggtcgtgtacagacaatacacggattctactttccgcgtgccggtggagcgcaaggccgaagaagaacatctgggaatcctgggaccgcagttgcatgcggacgtcggagacaaagtgaaaatcatcttcaagaatatggctacccgcccctacagcattcacgcccacggcgtgcaaactgaatcgagcacggtgactccgacccttcctggcgagactctgacttatgtgtggaagatcccagaacgctcgggcgctggaaccgaggactcggcatgcattccatgggcgtactactccaccgtcgaccaggtcaaggatctctactccggactgattggccccctgattgtgtgtcgccgcccatacctgaaagttttcaacccgcgcagaaagctcgagttcgccctgctgttcttggtgttcgacgaaaacgaatcctggtacctcgacgacaatatcaagacttacagcgaccacccagagaaggtgaacaaggacgatgaggagttcatcgaaagcaacaaaatgcacgctatcaatggacgcatgttcggaaacctgcagggactgaccatgcacgtgggagatgaggtgaactggtacctgatgggaatggggaatgaaattgatctccacactgtccacttccacggacactcattccagtacaaacaccggggtgtctactcgtcagacgtctttgacattttcccaggtacttaccagaccttggaaatgtttcctcggaccccaggaatctggctcctgcattgccatgtgactgatcacatccacgccgggatggaaactacttacaccgtcctccagaacgaagatactaagtcgggc

SEQ ID NO: 8539 - DNA, 3195 bp, Artificial Sequence
  Description of Artificial Sequence: Synthetic coding sequence
atgaagatactcatcctgggcatatttctgttcttgtgcagtactcccgcctgggcaaaggagaaacactattacatcggcatcattgaaacaacctgggattacgcttctgaccatggcgagaagaaactgatcagcgttgatacagagcacagcaatatatatctgcagaatggaccagatagaataggtcggctgtacaagaaagcgctgtatctacagtacacggatgagaccttcagaactactatagagaagccggtctggctcggattcctggggcctatcatcaaggcggagaccggcgacaaggtttacgtacacctgaagaatcttgcctccaggccgtacaccttccattcccatggaatcacatactacaaggagcacgaaggggcaatttacccagataatacaacagatttccagcgggctgacgataaggtgtatcccggggaacagtacacttacatgctcctggctactgaggaacagtccccaggggagggcgatggtaactgtgtgacccgtatctaccattctcacatcgacgctccgaaggacatcgcatcaggtctcatcggaccactaatcatctgcaagaaggacagcctggataaagaaaaagagaaacacattgatagggagtttgtcgtgatgttctcagtggtggatgagaacttcagctggtatcttgaggacaatataaagacctactgttctgagccagaaaaggtggataaggataatgaggattttcaagagtctaacagaatgtattccgtgaatgggtacacattcggatctctaccaggcctcagcatgtgcgctgaggaccgtgtgaagtggtacctctttggaatgggcaacgaggtggatgtgcatgcagcctttttccacggccaggccttaactaacaagaactataggatagatacaatcaacttgtttcctgctacattgtttgatgcttacatggtagcacaaaacccaggtgagtggatgctttcctgccagaatctgaaccatctgaaggccggtctgcaggcattctttcaggtacaggagtgcaacaagagttctagtaaggataatattagagggaagcacgtgaggcattattacatcgccgccgaagagattatctggaactacgccccctctggaatcgatatcttcaccaaggagaacctgaccgcacccggctcagatagtgctgtgttctttgagcaggggactactcgcattggaggcagctataagaagttggtgtaccgagaatacaccgatgctagtttcacaaatagaaaggaacggggacccgaggaagagcacctggggattctggggcctgtgatttgggcagaagtgggcgatacgattcgcgtaacattccacaataaaggcgcctatcctctgtccatcgagcctattggcgtcagatttaataagaacaacgaaggaacctactacagtcctaactataatccacaaagtaggagcgttccaccatccgccagccatgtggctcctaccgaaacgttcacatacgagtggacagttcctaaggaggtcgggccgacaaacgcagaccctgtttgtctagccaagatgtactatagcgcagtcgatcctactaaagacattttcaccggcctcattggccccatgaagatctgtaaaaagggaagcctccacgctaatggcaggcagaaggacgtggacaaagaattttacctgtttcccacggtgtttgacgaaaacgagtctcttttgcttgaagacaatatcagaatgtttaccaccgcgcccgatcaggttgacaaggaagacgaggactttcaagagagcaacaagatgcactccatgaatggcttcatgtacggcaaccagcctggactgacaatgtgcaaaggtgattcagtagtatggtatctgtttagtgctggcaacgaggctgacgtacacgggatatatttctccgggaacacgtacttatggcgcggggagaggagagacaccgctaatctgttcccacagacttcattaaccctgcacatgtggcccgacaccgaaggtacgttcaatgtcgagtgtctcaccacagatcactataccggtggcatgaaacagaaatacaccgtgaaccagtgcaggcggcaatctgaagactctactttttacctcggcgaaagaacatactatattgcagcggtagaggttgaatgggactactcacctcagcgggagtgggagaaggaactacaccacttgcaggagcagaatgtctctaatgccttcttggacaagggagagttttacatcgggtccaagtataaaaaggtggtttataggcaatacacagattcaaccttcagggtccccgtcgaaaggaaagcggaagaagagcatctcggaattctcgggccacagctgcatgccgatgtaggagacaaggttaagataatttttaagaatatggccacacgcccctactctatacacgcccacggggttcagacagagagctcaacagtgactcccactctccccggagagacgcttacctatgtatggaaaatacctgaacgctccggcgctggaactgaggattctgcttgtattccctgggcctattattccaccgtggaccaagtcaaggatctgtactccggattgattgggcctctcattgtctgtaggcgcccgtatctgaaggtcttcaatccgaggcggaagttggagtttgcactactcttcctcgtatttgacgagaacgagtcttggtatctcgacgacaacattaagacttacagcgaccatcccgagaaagtgaataaggacgacgaagaattcatcgagagcaataagatgcacgctataaatggacgaatgttcggcaatctacaagggctgacaatgcatgtaggggatgaagtgaattggtaccttatgggcatgggcaacgaaattgatctccacaccgtgcactttcatggtcactctttccagtacaaacaccgcggcgtgtactctagtgacgtcttcgacattttccccggcacatatcaaactctggagatgttccctcgaacgccgggcatatggcttctccattgtcacgttacagatcacattcatgctgggatggaaacaacttatacagtactgcagaacgaagacactaagtctggc

SEQ ID NO: 8540 - DNA, 3195 bp, Artificial Sequence
  Description of Artificial Sequence: Synthetic coding sequence
atgaagatcctgatactgggcatcttcctattcctctgctcaaccccagcttgggcaaaggagaagcactactacatcggcattatcgagaccacatgggactatgctagcgaccacggcgaaaaaaaacttatctccgtcgatacggaacatagcaatatttatcttcagaacggaccggatagaatcggacgactgtataagaaggcactgtaccttcagtacaccgacgagacattcagaacaaccattgagaaacccgtatggttgggcttcctggggcctatcatcaaagcggaaacgggagataaggtgtatgtccacctcaagaacctggcaagtcggccatacactttccatagccacggtataacatactacaaggaacatgaaggcgcaatatacccagacaacaccacagatttccagcgagccgacgacaaggtttaccctggggagcagtacacctacatgcttcttgctaccgaagagcaatcacccggggaaggcgatggtaactgcgtgacccgtatttaccactcacatatcgatgcgcctaaagatatcgccagcggactgatcgggcccttaattatctgcaagaaggatagccttgacaaagagaaagagaagcacatcgatcgcgaattcgtcgtcatgttcagcgtcgtcgatgagaacttcagctggtacctggaggacaacatcaagacttattgtagcgaacctgaaaaggttgataaggacaacgaggacttccaggagagcaacaggatgtatagcgtcaacggctacacatttggctcactgcccggtctgtctatgtgtgcagaagaccgagtcaagtggtatctgttcggcatgggcaatgaggtggacgttcacgccgcttttttccacggacaggccttgaccaataaaaactataggatcgacaccataaacctctttcctgcaaccctcttcgatgcctacatggtggctcagaaccctggggagtggatgttaagctgtcagaacttgaaccacctgaaagccggtctgcaggcattcttccaagtccaggagtgcaacaaaagttcttcaaaagacaatatccggggcaaacacgtgaggcactactatatcgccgcagaggaaatcatctggaactacgcaccaagcggaatcgatatcttcacaaaggagaacttaactgcccctggtagtgattctgcggtgtttttcgagcagggaacaaccaggattggggggagttacaaaaaattggtctaccgggagtacacagatgccagcttcactaacagaaaggaaaggggccctgaggaagagcacttgggtatcttagggcccgtgatttgggcagaagttggtgataccattcgtgtgacctttcacaacaaaggagcttatcccttgagcattgagccaattggtgtcaggtttaataagaacaacgagggcacatactactcccctaattataacccccagagtagaagcgttccaccttcagcaagccatgttgcaccaaccgaaacttttacttacgaatggaccgtcccaaaggaggtggggcctaccaacgcagacccagtttgcttggcaaaaatgtattactccgccgtcgaccctaccaaagatatttttacagggcttatcggacctatgaagatctgcaagaaggggagcctacacgctaacggcaggcaaaaggacgtcgataaggagttctacctgttcccaacagtcttcgatgagaacgagtcccttctgctcgaagacaacattaggatgttcaccactgctccagaccaagtggataaagaggacgaggacttccaggagagcaacaaaatgcatagtatgaacggctttatgtacggtaaccagccagggctcaccatgtgcaaaggcgatagcgtggtttggtatctctttagcgctgggaacgaagcagatgtgcacggaatatattttagcggtaatacctacctgtggcggggcgagagaagggatactgctaacctgttcccccagacctcactgacactgcatatgtggccagatacggaaggcacctttaatgtggaatgcttgactaccgatcactataccggcggcatgaaacaaaaatacactgtgaatcagtgcagacgccagtctgaagattccaccttctaccttggagaaagaacctactacattgcggctgtggaagtggagtgggactattcgccccagagggaatgggagaaggaactgcatcatctgcaagaacaaaatgttagtaatgcattcctggataaaggagaattttacatcgggtcaaagtacaaaaaagtggtgtacaggcagtatacagatagcaccttccgcgttcctgttgaacggaaggctgaagaagagcacctgggaattctgggtccacagctacatgccgacgtcggtgataaagttaagattatctttaagaatatggccacacgtccatacagcatccatgcgcatggcgtacagaccgagtctagtaccgtcactccaacacttccaggagagacacttacttacgtctggaagattccggagagaagcggcgcaggtactgaggatagcgcttgcatcccctgggcctactattctacagtggaccaggttaaagatctctatagcggcctaatcggacctcttattgtctgtcggagaccttacttaaaggttttcaaccccaggcggaagttggagtttgcgctgcttttccttgtgtttgacgaaaatgagtcatggtacctggatgacaacatcaagacatacagcgaccaccctgagaaggtgaacaaggatgacgaagagttcatagaatcgaacaaaatgcacgcgattaacggtaggatgtttggtaacttgcaagggttgaccatgcatgtaggagatgaggttaactggtaccttatgggaatggggaatgaaattgacctgcataccgtgcactttcatggccatagtttccagtacaaacaccgcggggtgtactcttcagacgtattcgatatattccccggcacctaccagactctcgaaatgttcccccgcacacctgggatttggctgcttcattgtcacgtgaccgatcacattcacgcaggaatggaaaccacctatactgtgcttcaaaacgaggacaccaaaagcggg

SEQ ID NO: 8541 - DNA, 3195 bp, Artificial Sequence
  Description of Artificial Sequence: Synthetic coding sequence
atgaagatcctcatcctgggaatattcttgtttctctgctcaaccccggcctgggcaaaagagaaacattactatatcggcataattgaaactacttgggactacgcatccgatcatggcgaaaagaaactcatctcagtggataccgaacactccaatatctacctccagaacggaccggaccgaatcggaaggctctacaagaaggcgctgtaccttcaatacaccgatgagacttttcggactaccatcgagaagccagtttggttgggatttctgggtcctatcatcaaggctgagactggagataaggtatacgtgcatctgaagaaccttgcctccaggccgtatacttttcacagccatggaatcacgtactataaagaacacgagggagcaatctaccctgacaacaccactgatttccaacgggccgatgacaaagtgtaccccggcgaacagtacacctacatgctgctcgccacggaggagcagagtcccggagaaggagatgggaattgcgtcacccggatctatcactcgcacatcgacgcaccgaaggacatcgcgagcggactcattggccccctgatcatctgcaagaaggactccctcgataaggaaaaagagaagcatattgacagagagtttgtggtcatgttctctgtggttgatgagaatttcagttggtatctcgaggacaacatcaagacttactgcagcgaacccgagaaggtggacaaggacaacgaagatttccaagagtcaaatagaatgtactccgtcaatggctacaccttcggctccctgccggggctgtccatgtgcgctgaggaccgggtgaaatggtatctgtttggaatgggcaatgaagtcgatgtgcacgccgcgttctttcacggtcaagcgctgaccaataagaactacagaatcgacactatcaaccttttccctgcgaccctgttcgacgcctacatggttgcgcaaaaccctggagaatggatgttgtcctgccaaaatctgaaccatctgaaagctggattgcaggccttcttccaagtgcaggaatgcaacaagtcctcgtcgaaggacaatatccgggggaaacacgtgcgccactactacattgccgcagaagaaatcatttggaactacgctccgtcgggaatcgacatattcacgaaagaaaacctcactgcgcccggctcagattcggccgtgttcttcgagcagggaactacccggattggtggctcgtacaagaagctggtctaccgcgagtacactgacgcatcattcaccaatcgcaaggaacgggggccagaggaagagcacctgggaatcctcggaccggtgatctgggctgaggtcggagatacgatcagagtgaccttccacaacaaaggagcctacccactctctatagagcccattggagtgcgcttcaacaagaacaatgaaggtacctactacagcccgaactataatcctcagtcaagatctgtcccaccttcggcatcccacgtcgctccgactgaaaccttcacttatgaatggactgttccgaaggaggtgggaccgactaacgcggacccggtgtgtttggcaaagatgtactactcggccgtggacccgacgaaagacattttcactgggctgatcggaccgatgaagatttgtaagaaaggaagcctgcacgctaacggacgccaaaaggatgtggacaaggaattctacctgttcccgaccgtgttcgacgaaaacgagtcgttgctgctcgaggataacatccgcatgtttaccaccgccccggaccaggtcgacaaggaagatgaggattttcaggaaagcaacaaaatgcattccatgaatgggttcatgtacggcaaccagccaggcctgaccatgtgcaaaggtgactccgtggtctggtatcttttctccgcaggcaacgaggctgatgtgcatggcatctacttcagcggaaacacctacctgtggcggggtgaacggagagacaccgccaacctgtttccacagacctccctgaccctgcatatgtggccagatactgaaggaacctttaatgtggaatgccttactactgatcattacaccggaggaatgaagcagaaatacactgtgaaccagtgtcggcgccagtcagaagattccactttctacctgggtgaacgcacctattacatcgcagcggtggaggtggagtgggactacagcccacaacgcgaatgggagaaggagctccaccacctgcaggagcagaatgtgtcaaacgcgttccttgacaaaggcgagttctatataggatccaagtacaaaaaggtcgtgtacagacagtacactgacagcacctttcgggtcccggtcgaacgtaaggcggaagaagagcatctgggaatcctgggcccgcaactgcatgctgacgtgggtgacaaggtgaagatcattttcaagaacatggcgaccagaccgtactcgatccacgcccacggggtgcagactgaatcatccactgtgacccccaccctcccgggggaaacgctgacttacgtctggaagatcccagaacgctcaggtgcagggacggaagattcagcatgcatcccgtgggcctattactcaactgtggaccaggtcaaagatctgtactcgggactgatcggtccattgatcgtgtgcaggcggccatacctcaaggtgttcaatccccgaaggaagctggaattcgccttgctgtttctggtgttcgacgagaacgagtcctggtaccttgacgacaacatcaaaacgtatagcgaccatcctgaaaaggtgaataaggacgatgaggaattcatcgaaagcaacaagatgcacgccattaacggtagaatgttcgggaacctccaaggattgaccatgcacgtcggggacgaggtcaactggtacctcatgggcatgggtaatgagatcgatctgcacacggtccactttcatggtcacagcttccaatacaagcatagaggcgtctacagctcggatgtgttcgacatctttccgggcacgtaccaaaccttggaaatgttcccgcgcacccctggaatatggctcctgcattgtcatgtgaccgaccacatccacgcaggaatggaaaccacgtatactgtgttgcagaacgaggacaccaagtctgga

SEQ ID NO: 8542 - DNA, 3195 bp, Artificial Sequence
  Description of Artificial Sequence: Synthetic coding sequence
atgaagatccttatcctcggcatcttcttgtttctgtgctcaaccccagcttgggcaaaggagaagcactactacattggaatcatcgagactacctgggattacgcatccgatcacggagagaaaaaactgattagcgtggatactgaacatagcaatatctatttgcaaaatggacctgatagaattggaaggctgtacaaaaaggcactttacctccaatacactgacgaaacttttcggactaccatcgagaagccggtctggcttggcttcctggggccaatcatcaaagcagaaactggagataaggtctatgtgcacctgaagaacttggcctcgcgcccatacaccttccattcgcatggaataacttattacaaggagcacgagggggcaatctacccagacaacacgactgatttccagcgagctgacgacaaagtgtaccctggggagcagtacacttacatgcttctggcaactgaggaacagtcgcctggagaaggagatgggaactgcgtcactcgcatctaccactcacacattgatgcgcctaaagatattgcatcaggacttatcggtcctctgattatctgtaagaaggacagcctggataaggaaaaggaaaagcatattgatcgggagttcgttgtcatgttttcggtggtggacgagaacttttcgtggtaccttgaagataacatcaaaacgtactgttcagaaccagaaaaggtcgataaagataacgaggattttcaggaatccaatagaatgtacagcgtgaatggttacacgtttggatccctccctggcctcagcatgtgtgcagaagatagagtcaagtggtaccttttcggaatgggtaacgaagtggatgtgcatgcagccttttttcacggtcaagcactgactaataagaattacaggattgataccattaatctcttccccgcaactctttttgacgcttacatggtggcccagaaccctggagaatggatgctttcctgccagaaccttaaccatcttaaagcagggcttcaagccttctttcaagttcaagagtgtaacaagagcagttccaaggataacattcgaggcaagcatgtgcggcattactacattgccgctgaagagattatctggaattacgcaccaagcggaatcgacattttcactaaggaaaacctgacggcccctggctcggattcggcggtgtttttcgaacagggaaccacgagaattggcgggtcgtacaaaaaacttgtgtaccgagaatacactgatgcgtcgtttactaatagaaaagaaaggggcccggaagaagaacaccttggtatactcggtcctgtgatttgggcagaagtgggtgatacgataagggtcacctttcacaacaagggagcgtatccgctctcgatcgagccaatcggggtgcggttcaataagaacaacgaaggaacctactacagcccaaattacaacccacagtcgcgttcagtgccgccatcggcatcccatgtggctccaactgaaactttcacttacgagtggacggtgccaaaggaggttggtccaactaatgcagatcctgtctgtctggcaaaaatgtactactcagcggtcgatccaaccaaggacatattcactggtttgataggaccaatgaagatatgtaaaaaggggtcactgcatgcgaatggtagacaaaaggatgtggataaagagttttacctgtttcccacggtgtttgacgaaaacgagtcccttcttctggaggacaacatacgaatgtttactaccgcaccagaccaggtcgacaaggaggacgaagatttccaagaatctaacaagatgcactctatgaatggctttatgtacggtaaccaacctggccttaccatgtgtaagggggactcagtggtgtggtacctgttttccgcaggtaatgaagccgatgtgcatggtatctactttagcggaaacacctacctgtggcgaggtgaacgccgagacaccgcaaatctgtttcctcaaacgtcccttactctgcatatgtggcctgataccgaaggtacttttaacgtcgaatgtcttaccaccgatcactacactggtggcatgaagcagaagtacactgtgaatcagtgcagacgtcaatcggaagattccaccttttaccttggagaacggacctactacatcgcggcagtggaagtcgaatgggattactcaccacaaagagagtgggaaaaggaattgcaccacctccaagagcagaatgtctcaaacgccttcctggataagggtgagttctacattggatcgaagtacaagaaagtggtgtaccggcagtacaccgattcgacttttagagtgccggttgaacgtaaagcagaagaggaacatctgggcatacttggtcctcaactccacgcagatgtcggagacaaggtgaagatcatattcaagaatatggccactcgtccttactcgatacacgcccatggagtgcagactgagtcatcgacggtgactccaaccctgccaggtgaaacccttacttacgtctggaagattcctgaaagaagcggcgcagggaccgaggacagcgcctgtatcccatgggcctactacagcactgtcgatcaagtgaaagatctgtactccgggcttatcggtccacttattgtgtgccgccgtccataccttaaggttttcaatcctcggcgcaagttggagtttgccctgctctttctggtattcgacgagaatgaatcctggtatttggatgataacatcaagacttattctgatcatccagaaaaggtgaataaggatgatgaggagttcatcgaaagcaataagatgcatgccattaacggacgaatgtttgggaacctgcaaggactgactatgcacgtgggggatgaagtcaattggtaccttatgggaatgggcaacgaaattgacctgcacactgtacactttcatggacattcctttcagtacaagcataggggagtgtactcgtcggacgtctttgacatttttcccggaacctaccagactcttgagatgtttccgcggactcccgggatctggcttcttcattgtcatgtgaccgatcatattcatgccgggatggagactacctacactgtgcttcagaatgaggataccaagtccgga

SEQ ID NO: 8543 - DNA, 3195 bp, Artificial Sequence
  Description of Artificial Sequence: Synthetic coding sequence
atgaagattctcatcctcggaatcttcctgtttctatgcagcacccctgcatgggctaaggagaaacattactatattgggattatcgagaccacctgggactatgctagcgaccatggcgaaaaaaagctaatttcagtggataccgagcattcaaatatttatcttcaaaacgggccggatcggatcgggcggttgtacaaaaaggcgctgtatctgcagtacaccgatgaaaccttccggacaaccattgagaaaccggtgtggttaggctttctcgggcccatcattaaggcagagacaggggataaggtttatgtccacttaaaaaatttggcctctcggccatacacatttcactcgcatggaatcacctactacaaggaacatgagggcgctatctaccctgacaacacaacagattttcagcgtgccgacgacaaggtgtatcccggggaacagtacacctacatgttgctagcaacggaagaacagtctcccggcgagggtgacggcaattgtgtgactcgaatctaccattcccacattgatgcacccaaggatattgcttcggggctgattgggcccctgatcatctgtaaaaaggacagtctggataaagagaaagaaaagcatattgaccgggagtttgtcgtgatgttcagcgtggtggatgagaacttttcttggtacctcgaggacaatataaaaacttactgttccgagccggagaaagtggataaagataatgaggacttccaggagagcaacaggatgtattccgtaaacggctacacctttggatccctgccaggcctgagcatgtgcgccgaagaccgcgtcaaatggtacctatttggtatgggcaacgaggtggacgtccacgccgctttttttcacgggcaagccctcaccaacaagaactacagaattgataccatcaatctgtttcctgctaccctctttgatgcctacatggtagctcaaaaccccggagagtggatgctgtcatgccagaacctaaaccaccttaaagccggtctgcaagccttcttccaagtgcaggagtgcaataaaagcagttccaaggataacattagggggaaacacgttagacattattacatcgccgccgaagagatcatttggaactacgcgccatccggcattgatatattcactaaagagaacttgactgcgccaggttcagatagcgccgtctttttcgaacaaggtaccaccaggattggagggtcttacaaaaagctggtctacagagagtacaccgatgcctcttttacaaatagaaaagagcgcggcccagaagaggagcacctcggaattctcgggcctgtgatttgggccgaagtaggtgacactattagggtgacctttcacaacaagggtgcctatcccctaagtatcgagcccattggcgtgagattcaacaaaaataacgagggcacctattattcgcctaactacaatccacagtctagaagtgtgcctccttctgcatctcatgtggccccaacggagacattcacttacgaatggacagtgcctaaggaagtggggcctactaacgctgaccctgtctgtcttgccaaaatgtactattcagcggttgatccaactaaagatattttcaccgggctgattgggcctatgaagatttgtaagaagggtagtcttcatgcaaacgggcggcaaaaagatgtggataaggagttctatctcttcccaactgtgttcgacgagaacgagagcttactgctcgaggataacatccggatgttcaccaccgcgcccgatcaggtggataaagaggacgaggattttcaggagagcaataaaatgcacagtatgaacggtttcatgtacggtaatcaacccggactcactatgtgcaaaggtgactcagtggtttggtatctcttctctgctgggaatgaggccgacgtgcacggaatctacttttccgggaatacttatctttggagaggcgagcgtagggacacagcgaacctcttccctcagacctctctgactctgcacatgtggcctgatacggaggggacgttcaacgtggaatgtctcactaccgaccactatacagggggaatgaaacagaagtacactgtcaatcagtgtagacgccaaagtgaagatagcacattctacttgggagagagaacatattacatagccgccgtcgaagtggaatgggattactcaccccagagggaatgggaaaaggaactgcaccatctccaggagcagaatgtgagtaacgcatttctagacaaaggagaattctatatcgggtctaagtacaagaaggtagtgtatcgtcagtataccgactccactttcagggtacccgtggagcgaaaagccgaagaagagcatctggggattttggggcctcaattgcacgccgatgtgggggataaagtcaaaatcattttcaagaacatggctacccgtccatactctattcacgcccatggagtccagacagaatcaagtaccgtgactcccacacttcccggagagacattgacctacgtgtggaaaatacctgagcgctctggtgccggcacggaggacagtgcctgcattccatgggcctactactcaaccgtggaccaggttaaggacctctattctggtctaatagggccgcttatagtgtgtagacggccctatttgaaggtcttcaaccctagacggaaactcgagtttgcacttttgttcctagttttcgacgagaatgaaagttggtacctggacgacaacataaagacttattccgaccatcccgaaaaggtgaacaaggacgatgaggagtttattgagtcaaataaaatgcacgctattaacggaagaatgttcggcaatctgcagggactgacgatgcatgtgggcgatgaagttaactggtacctgatggggatggggaatgagattgacctccacaccgtacattttcacgggcattcttttcaatataaacaccgcggagtgtacagcagcgacgtgttcgacatttttccaggaacctatcagacgcttgagatgttccctagaacccctgggatctggctgctgcattgccatgttactgaccacattcatgctggcatggagacaacatatacagtgttgcagaatgaagataccaagagtgga

SEQ ID NO: 8544 - DNA, 3195 bp, Artificial Sequence
  Description of Artificial Sequence: Synthetic coding sequence
atgaagatattgattctaggtatcttcctctttctgtgctccacaccggcatgggctaaggaaaaacactactatatcggaatcattgaaaccacatgggattacgcaagtgatcatggggagaaaaagttgattagtgtggacaccgaacatagtaacatttacctgcagaacggccctgatcgcatcgggcgactttataaaaaagctctgtacctgcagtataccgacgaaactttccgaactaccattgagaagcctgtctggttggggtttcttgggcctatcatcaaagctgaaacgggtgataaggtatatgttcatttgaagaatttggcttctaggccatacactttccatagccatggcatcacctactacaaggagcatgaaggcgcaatatatcccgacaacacgacggacttccagagggccgatgacaaagtctaccctggagagcagtatacctatatgctactggctaccgaggaacagtcccccggtgagggagacggcaactgcgtgaccaggatataccactcacacatcgacgccccaaaggacattgcctcaggactgattgggcccctgatcatctgcaagaaggactcccttgacaaggagaaggagaagcacatcgaccgggagttcgtggtcatgtttagcgttgttgatgagaacttctcttggtatttggaagacaatataaaaacctattgttcagagcccgagaaggtagacaaggataatgaagattttcaggaaagcaacagaatgtattccgtaaatggctacactttcggcagcctccctggcttatcaatgtgtgccgaggacagggtgaagtggtatctctttggtatggggaatgaggtagatgtgcacgcggccttttttcacggccaagcactcactaacaaaaattatcgcatcgacacaatcaatctgttcccggccactctgtttgacgcatatatggtggcccagaacccaggagaatggatgttgagctgccagaatttaaatcacctgaaagcaggtcttcaggcctttttccaggtgcaggagtgtaacaaaagcagctcaaaggataatattcgaggcaaacacgtgcgacattactacatcgccgcagaggagatcatttggaactacgctccatcaggcattgacatcttcacaaaggagaacctcactgctcccggatccgattccgcagtatttttcgaacaaggcacgacacgaatcggcggtagctacaaaaagctagtttatcgtgaatacaccgatgcgtcatttacaaacaggaaggaaaggggacccgaggaagagcacctcgggatactgggtccagtcatctgggcagaggtgggcgatacgatccgggtgacattccacaacaagggggcttacccactcagtattgagcctattggagtgcggtttaacaaaaataacgagggcacttattactccccaaattacaatccccagtctaggagcgtgcccccttccgcctcacatgttgctcctaccgagacatttacatatgagtggactgtcccaaaagaagttggcccaacgaacgctgaccctgtatgtctcgctaagatgtattatagcgctgttgaccccaccaaggatatcttcaccgggctgattggccccatgaagatctgtaagaaggggtcactgcatgccaacggccgccaaaaagacgtggacaaggagttctatttgtttcctaccgtgtttgatgagaacgagtcactgttgctggaggataacatcaggatgtttactacggctcccgaccaggtcgacaaagaggacgaagatttccaggaatccaataaaatgcacagcatgaatggcttcatgtacggcaatcagcctggcctcaccatgtgtaaaggtgatagcgttgtgtggtacttgttcagcgcgggaaacgaggcagacgtgcacggtatctacttcagtggaaatacatacctgtggagaggagaaaggcgcgacacggcaaatcttttccctcaaaccagcctgacgctacacatgtggcccgacaccgagggcacgttcaatgtggaatgtcttaccacagatcactacacaggcggaatgaagcagaaatatacagtgaatcaatgtcgccggcaaagcgaggactcaacattttatctcggagaacgtacttattatatcgccgcagtcgaagtcgaatgggactattcgccacaacgggaatgggagaaagagctgcaccatctacaagaacagaatgtcagcaatgcctttctggacaagggagagttttacatcggctccaaatacaaaaaagtagtttatcgtcagtacactgatagcacgtttcgggtacccgtggagcgtaaagcagaagaagaacacctgggaattctaggaccccagttgcacgcggatgtaggcgataaggttaaaatcatatttaagaatatggctaccagaccgtactctatccatgcccatggagttcagaccgagagcagtacggtgaccccgaccctacctggggagactttaacatacgtttggaagatacccgagcgctccggcgctggcaccgaggactccgcatgtatcccctgggcctactactccacagtagaccaggtgaaggatctgtacagcggactcataggaccactcatagtttgtagaaggccatatcttaaagtgtttaatcctaggcggaaattagagttcgcgctcctcttcctagtttttgatgaaaatgagtcatggtacctagatgacaacatcaaaacatacagtgaccaccccgagaaagtaaacaaggatgatgaggaattcatagaaagtaacaagatgcatgctatcaatggccggatgttcgggaatcttcaggggctcaccatgcatgtgggcgatgaagtgaattggtatctgatgggaatgggaaacgaaatcgacttgcacaccgttcactttcacggacatagtttccagtacaagcaccgtggcgtctatagtagtgacgtgttcgatatctttccaggcacataccagactcttgagatgttcccccgaactcctggcatttggctcctgcattgtcatgtgactgatcacatccatgctgggatggaaaccacttatactgtcttacagaacgaggacaccaagtccgga

SEQ ID NO: 8545 - DNA, 3195 bp, Artificial Sequence
  Description of Artificial Sequence: Synthetic coding sequence
atgaaaattctgattctcggaatctttctgttcctgtgttccacgccagcttgggcaaaagagaaacattactacatcgggatcatcgagaccacctgggattatgcttcagatcatggtgagaagaaacttatctccgtcgacaccgagcactcaaatatatacctgcaaaacggccctgataggatcggccggctgtataagaaggcgctgtacctccagtatacagatgaaactttcagaactaccatcgagaaacccgtttggctaggattcctgggccccattatcaaggcggaaacaggcgacaaagtgtacgtccaccttaagaaccttgcgtccaggccgtacacattccattcccacggaataacctattacaaggaacatgaaggagccatctaccctgataacaccaccgatttccaaagggcggacgacaaagtttatccaggcgagcagtacacctatatgctacttgccacagaagagcaatcgcccggtgagggcgacggcaactgcgtgacccgcatataccattcccatattgacgcaccaaaggacatcgcaagtggtctgatcggcccattaatcatttgcaagaaggattccctagataaggagaaagagaaacacatcgatagggagtttgtggtcatgttcagcgtggtggacgagaacttcagctggtacctagaggacaacatcaagacatactgctccgagcccgaaaaagtggataaagataacgaagacttccaggaatccaaccgtatgtatagcgtcaacggatacacctttgggtctctaccagggctgagcatgtgcgccgaggatagagtgaagtggtatctctttggtatgggcaacgaggtcgacgtgcatgccgcctttttccacggacaggctctcaccaacaagaactatcgcattgacacaattaacctcttccctgctaccttgtttgatgcctacatggtggcccagaatcccggggagtggatgttgagctgccagaacctgaaccacctgaaggcaggcctgcaggctttctttcaagtccaggaatgcaataaatcatcctccaaagacaacattagagggaaacacgtgcggcattactacattgcagctgaggagatcatttggaactatgccccatccgggattgacatatttaccaaggagaacctgacagctccaggttctgacagcgctgtgttcttcgagcagggtactacaagaattggtggctcttacaaaaaactagtgtaccgcgagtacaccgacgcttcctttaccaatcggaaggagaggggcccggaggaggagcacctgggaatactcggaccagtcatatgggccgaggtcggagatacgattcgagtaaccttccataataagggggcgtaccccctgagcatcgagcccattggagtccgcttcaacaagaacaatgagggcacctactactcccccaactataacccacagtcaaggagcgtgcccccatcggctagccacgtcgcgcctactgagactttcacatacgagtggacagtgcccaaagaagttggacctaccaatgctgatccagtgtgtctcgcaaaaatgtactactctgcggtggaccctacaaaggatatctttaccgggctgatcggtcccatgaaaatctgcaagaaaggtagtctacacgccaatggccggcagaaggatgtggataaagagttttacctatttcctaccgtcttcgacgaaaatgaatcgctgctgctcgaggataacatcaggatgttcactaccgcaccggaccaggtggacaaagaagacgaggattttcaggaatcaaacaagatgcattccatgaatggattcatgtatggcaaccagccaggtctcactatgtgcaaaggggacagcgtcgtgtggtacctgttctccgccggcaacgaagccgatgttcacggcatttatttctctggaaacacgtacctctggagaggtgagaggagagataccgcaaacctttttccacaaacctccctaacactccatatgtggcctgatactgaagggacctttaatgtcgagtgcctgactaccgatcattacactggcggcatgaaacagaagtacaccgtaaaccaatgccgccggcagagcgaggattcgaccttctatctgggcgaacgcacctactatatcgccgcagtggaggtggaatgggactattcgccgcagcgcgagtgggagaaggagcttcaccacctgcaggaacagaatgtctccaacgctttcctggacaaaggcgaattctatattggatcaaagtacaagaaggtcgtgtatagacagtatacagactccaccttccgcgtgcccgtcgagcgcaaggctgaagaggagcatctgggcatcttaggtccgcagctccacgccgatgttggcgacaaggtcaagattatcttcaagaacatggctacgagaccgtactctattcatgctcacggagtccagacagagtcatcaacggtgactcctaccttgccaggagaaacattaacgtacgtctggaagattcccgagagaagcggagcagggacggaggactccgcttgtattccctgggcttactattccactgttgaccaggtgaaagacctgtattccggcctgatcggcccgctgattgtgtgcagacgaccatatctgaaggttttcaatcctagacgcaagttggaattcgctttattgttcctagtgtttgatgagaacgagtcttggtacctggatgataacatcaagacctactcggaccaccctgagaaggttaataaagacgacgaggagttcattgagtcaaacaagatgcacgccatcaacggccgcatgtttgggaatctgcagggtctaaccatgcacgttggagacgaagttaattggtacctgatggggatgggaaacgagatcgaccttcacacagtgcacttccatggacactccttccaatataagcatcgaggcgtctactccagcgatgtcttcgacatcttccccggcacatatcagacactcgagatgttccccagaacccccggtatatggttgctgcactgtcacgttactgaccatattcacgcaggcatggagaccacttacactgtcctgcaaaacgaagacacaaagtctggg

SEQ ID NO: 8546 - DNA, 3195 bp, Artificial Sequence
  Description of Artificial Sequence: Synthetic coding sequence
atgaagattttgatcctgggaatcttcctctttctgtgcagcacccccgcctgggcgaaggaaaagcactactacattggtatcattgaaacgacctgggactacgcatcggaccatggtgaaaagaagctcatctcggtggatacggaacattcgaatatctacctccagaacggccctgatcggattggtcgcctttacaaaaaggcactgtacctgcaatacacggacgaaacgtttagaactacgattgagaaacccgtctggctcggatttctcggccccattatcaaggccgaaaccggtgacaaagtgtacgtccaccttaagaatcttgcatcccggccctacacgttccattcgcacggtataacctactacaaagaacatgagggggcaatctaccctgacaatactaccgattttcagcgtgcagacgataaggtatacccaggggaacagtacacttacatgcttctggcgaccgaggagcaatcacctggagaaggtgatggaaactgcgtcacgcgcatctaccatagccatattgacgctccgaaagacatagcatctggacttatcggacctctcatcatatgcaaaaaggactccctggacaaggagaaagagaagcacattgatagagaatttgtggtgatgttttcagtggtcgacgaaaacttctcctggtaccttgaagataacatcaaaacgtattgttccgaaccagaaaaggtggataaggataatgaagattttcaagaaagtaaccgtatgtactcggtgaatggatacacttttggaagccttcccggtctgtcgatgtgtgcagaggacagagtgaaatggtacctgtttgggatgggaaatgaagtggacgttcatgcagcttttttccatggtcaggctcttaccaataagaattaccggattgacaccatcaacctctttccggccaccctgttcgacgcatacatggtggcccaaaatcccggtgagtggatgctctcctgtcaaaacctgaaccatcttaaggcaggtttgcaagcatttttccaggtgcaagaatgtaacaaaagctcgtccaaggacaacattagaggaaagcatgtcagacattactatatcgcagcagaggagatcatttggaactacgctcctagcggaattgacatctttacgaaggagaaccttactgcacccggatcggatagcgcggtcttttttgagcagggtactactagaattggaggctcttacaagaagctggtctacagagagtacactgatgcatccttcaccaaccgcaaggagcgaggaccggaagaggagcatctgggaatacttggaccagtgatttgggcagaggtgggagataccatacgcgttacctttcataacaagggtgcatacccactctccattgaacctataggtgtcagatttaacaaaaacaacgagggtacctactacagcccaaactataacccccaaagcaggagcgtgccaccatcggcgtcccatgtggctcctaccgagacttttacctacgaatggactgtccctaaggaagtcggccccactaacgccgatccagtgtgtctggccaaaatgtactactccgcagtggatccgactaaagacatctttaccggtcttattggacctatgaagatctgtaagaagggttcccttcatgccaacggaaggcagaaggatgtggataaggaattctatctgtttccaactgtctttgatgagaatgagagcttgcttctcgaggataacattagaatgttcaccaccgcccccgaccaagtggacaaagaagatgaggacttccaagagtctaacaagatgcattcgatgaatggatttatgtacggaaaccaacccggactgactatgtgtaagggtgattcggtggtctggtacttgttttctgcgggaaatgaagccgatgtccatggtatctatttcagcggaaatacttacctctggagaggagaacgccgtgataccgcaaacctgtttccgcagacgtcacttaccctccatatgtggcctgacaccgagggcactttcaatgtggaatgtctcaccactgatcattataccggcggaatgaagcaaaagtacaccgtgaaccaatgtagacgccagtcggaggacagcactttctaccttggtgaaaggacttactacatagcagccgtagaggtcgagtgggattactcccctcagcgcgaatgggagaaagaactgcaccacctccaagaacagaatgtgtcgaacgcatttcttgataagggcgaattctacattggaagcaaatacaagaaagtggtctaccggcagtacaccgacagcacttttagagtgcctgtggagcggaaagcagaagaagaacatcttggcatactgggaccgcaacttcacgcggacgtcggagataaggtcaagattatctttaagaatatggcaacccggccatactccattcatgcacacggggtccagaccgagtcaagcactgtcacccctaccctcccaggagaaaccctcacttacgtctggaagatccccgaacgctcgggagcaggtactgaagattcggcctgcatcccttgggcatattactccaccgtggatcaagtgaaggacttgtactcagggcttattggtccattgattgtgtgtcggcgcccctacttgaaagtgtttaacccgaggcgcaaactggaatttgcacttctttttctcgtgttcgatgaaaatgaatcgtggtacctcgatgacaacattaagacgtatagcgaccacccagagaaagtcaataaggatgacgaggagtttattgagagcaataagatgcatgcaattaacggtaggatgtttgggaaccttcagggactgaccatgcacgtgggggatgaagtgaactggtacctgatgggtatgggaaatgagattgatcttcacacggtgcattttcacggccattcgtttcaatacaaacaccggggtgtgtatagtagcgacgtgtttgatatcttcccaggaacttaccagactctggaaatgtttccaagaactcctggaatatggctgcttcattgccacgtcaccgatcatatccacgccgggatggagactacctacaccgtgctccaaaacgaggatactaagagcgga

SEQ ID NO: 8547 - DNA, 3195 bp, Artificial Sequence
  Description of Artificial Sequence: Synthetic coding sequence
atgaagattcttattctgggcattttcttattcctctgcagcacacccgcatgggccaaggagaagcactactacatcggcataattgaaaccacatgggactatgcttctgaccatggagaaaaaaagctcatctccgtagacaccgaacactccaacatctatctgcaaaatggacctgaccgcataggtaggctgtacaagaaggcactgtatctgcagtatacggatgaaacatttcgcactacaatcgagaagccggtttggctgggatttctagggcccattattaaggcagagaccggcgacaaagtgtacgtgcatctcaagaacctggcaagcagaccttatacattccacagccacggaattacatactacaaggaacacgagggcgccatctatccagacaatacgacagatttccagcgagcagatgataaagtgtacccaggtgaacagtatacctatatgctgctggcaacagaagagcaatcccccggcgagggggatggcaactgcgtcacaagaatctaccacagccacatagatgctcccaaagatatcgcctcaggccttatcggtcctctcattatctgtaagaaggactctttggataaggagaaggaaaaacatatcgatcgggagttcgtggtgatgtttagtgtggtcgacgagaatttctcttggtatctggaggacaacattaaaacttattgttcagaaccagagaaggtggataaggacaacgaagattttcaggagtcaaatcgcatgtactctgtcaatggatacacattcgggagtctgccaggattatctatgtgcgcagaagacagagtgaaatggtatctgttcgggatgggaaatgaggtagatgtacacgctgctttcttccacggtcaggcactaaccaataagaattaccgcatagatacaattaacttgttccccgctacactgttcgacgcttacatggtggcccaaaacccgggggagtggatgctctcttgtcagaacctcaaccacttgaaggcagggctgcaggccttctttcaagtgcaagagtgcaataagtcatccagcaaggataacatccgcggaaagcatgtacgccactactatatcgctgctgaagagatcatctggaattacgccccatcgggaatagacatatttacaaaggagaatttgacagccccaggatctgattcagcggtgttttttgaacagggaaccaccagaatcggaggcagctacaaaaaattggtgtacagagaatatacggatgcatccttcactaacagaaaagagcggggccctgaggaggaacacctgggaattctgggccctgttatttgggccgaggtcggtgatactatcagggtgaccttccataataagggggcctacccgctgagcatcgagcctataggggtgcggtttaacaagaacaatgagggcacatattacagccccaattacaacccgcagtctcggtccgtgccaccctccgcctcccatgtggcaccaaccgagacttttacctacgagtggacagtgccaaaagaagtcgggccgacaaatgcagatccagtctgtctcgctaagatgtattacagcgcagtagaccctactaaagatatttttaccggactaataggtccgatgaagatttgtaaaaagggtagcctgcacgctaatggtcgacagaaggacgtggacaaggagttttacctcttcccgacagtgtttgatgaaaatgagagtttgttgctagaggataacatcagaatgttcacaaccgcccccgaccaggtggataaggaagatgaggactttcaagagagcaataaaatgcactccatgaatgggttcatgtatggcaatcaaccaggcctgacaatgtgcaagggagactccgttgtgtggtatctgttttctgcaggtaacgaggccgatgtgcatggcatttattttagcggaaatacatacctgtggcgcggtgagaggcgcgataccgccaatctgtttccgcagacatccctcaccctccatatgtggccagatacagaaggcacattcaatgtggaatgtctgacaaccgatcattataccggggggatgaagcagaagtacaccgtgaatcagtgcaggagacaaagtgaagacagtacattctatctgggcgaacggacatactatattgccgcggttgaagtagagtgggactattcccctcaacgcgagtgggagaaggaacttcaccacttgcaggagcaaaacgtcagtaatgccttcttagacaaaggtgagttctacatcggctcaaagtacaaaaaggtggtgtatcggcaatacaccgattcgacttttcgggttcctgttgagaggaaggcagaagaagaacacttggggatcctaggaccccagctgcacgctgacgtcggggacaaggtgaaaattatattcaagaacatggccacccggccgtatagcatccatgcccatggcgtgcaaacagaatcctcaacagtgacaccaaccctcccgggagaaactcttacctacgtgtggaaaattcctgagcgctctggcgcaggcacggaggacagcgcctgcatcccatgggcgtactactcgacggtggaccaggttaaagacctttatagcggacttatcgggccactgatcgtttgtaggcggccctacctcaaggtctttaatccccgacgcaaactggagttcgccctgctctttctcgtgttcgatgaaaatgagtcttggtacctggacgacaacatcaagacctattcagaccatccggagaaggttaacaaagacgatgaagaattcatcgaatctaataaaatgcacgccattaacggacgaatgtttgggaatcttcagggattaaccatgcatgtgggggacgaggtcaactggtatctaatgggaatgggaaatgaaattgatctgcacacagtgcatttccacggccattcctttcagtacaaacatagaggtgtgtactcatctgacgtttttgatattttcccaggcacataccagactttagaaatgttcccacgtacacccggcatctggctgctccattgtcacgtcaccgatcatatccacgctggcatggagacaacctataccgtgttgcagaacgaagacactaagagcggc

SEQ ID NO: 8548 - DNA, 3195 bp, Artificial Sequence
  Description of Artificial Sequence: Synthetic coding sequence
atgaagatactgatcttgggaatctttctctttctgtgctctaccccggcctgggctaaagagaaacactactacatcggcatcatcgaaacgacttgggactacgctagtgaccacggagagaagaaactcatcagcgtggataccgaacattcaaacatttaccttcagaacggacccgatcgcattggacgcctctacaagaaagcactgtacctgcagtatacggacgaaactttccgcactactatcgagaagcctgtatggttgggttttctcggcccaattatcaaggccgagacgggcgataaggtctatgtgcatttgaaaaacctggctagtcggccgtacactttccattcacacggcattacgtactacaaggaacatgagggagccatctaccccgacaacactactgacttccaaagagccgacgataaggtgtacccgggagaacagtatacttatatgctgctggcgacggaagaacagtcgcctggagagggagacggaaattgcgtgacccgcatctaccattcgcacatcgacgcgccgaaggacattgcctccggattgatcggtccactgatcatttgcaaaaaagattcattggacaaagagaaggagaaacacatcgacagagaattcgtggtgatgttttcggttgtcgacgagaatttctcatggtacctggaggacaatatcaagacttactgttccgagccagagaaagtggataaggacaacgaggacttccaggaatcgaaccgcatgtattcggtgaacggttacaccttcgggtcactgcccggattgtcgatgtgcgcggaagatcgcgtgaagtggtacctgttcggaatggggaatgaagtggacgtgcatgctgcctttttccacggtcaggctctgactaataagaattaccgcatcgatactattaacctgttcccggcaaccttgttcgacgcgtacatggtcgcccaaaaccccggggagtggatgctttcctgccagaatcttaaccacctgaaggcgggattgcaggcattcttccaagtgcaagaatgcaacaaatcctcttcgaaggataacatcagaggaaaacatgtgcgccactactatatcgccgcagaggagatcatttggaattacgccccatcgggaatcgatatcttcactaaggagaatcttaccgctccgggatcggactcggctgtattctttgaacaaggaaccactcggatcggcggttcgtacaagaaactggtgtacagggaatacacggacgcgagctttacgaacagaaaagagcggggcccagaggaagagcatctgggaatcctggggccggtgatctgggcggaagtcggcgacaccatccgcgtgactttccacaacaagggagcttacccattgtccatcgaaccgatcggcgtgcgcttcaacaaaaacaacgaaggaacctactactccccgaactacaatcctcagagcagatctgtgccgccgtcggcctcgcacgtcgcccccactgaaaccttcacttacgaatggactgtgccaaaggaagtgggcccgaccaacgccgacccggtctgcctcgccaagatgtactactcggccgtggatcctaccaaagacatattcaccggtctgatcggaccgatgaagatatgcaagaagggatcactgcatgcaaacggacggcagaaggacgtcgataaggagttctacctgtttccgaccgtgtttgatgagaatgagtccctgttgctggaggacaacatcaggatgtttaccactgccccagaccaggtggacaaggaagatgaagatttccaggagtcaaataagatgcattccatgaacgggttcatgtacgggaatcagccagggctcaccatgtgtaagggtgacagcgtggtgtggtatctcttctccgcgggaaatgaggccgatgtccatggaatctacttctctggcaatacctacctctggcgtggcgaacgacgcgataccgcgaacctgtttccgcaaacctcccttaccttgcacatgtggccggatacggaaggcaccttcaacgtggaatgtctgaccaccgaccactatactggaggaatgaagcaaaagtacactgtgaatcagtgccgacgccaatccgaagatagcacgttttacttgggagaaagaacctactatattgctgccgtcgaagtggagtgggactacagcccccaacgcgaatgggagaaggagctccaccacctgcaggaacagaatgtctcgaatgctttcctggacaaaggcgagttctacatcggcagtaagtacaagaaggtcgtgtacagacagtatactgacagcaccttcagggtccctgtcgaaagaaaggcagaggaggaacacttgggcatcctgggaccacaactgcacgctgatgtgggcgacaaggtgaagatcattttcaagaacatggccacccgcccatactccattcatgcgcacggcgtccaaactgaatcctccactgtgactcccaccctcccgggggaaactcttacctacgtgtggaagatcccagagcgctccggggcaggaaccgaggattctgcgtgcatcccctgggcctattacagcactgtggaccaagtcaaagacctctactcaggactcatcgggccactgatcgtgtgcaggcgaccctacctcaaagtgttcaacccgcgtcggaagttggagtttgcgctcctgttcctcgtattcgatgaaaacgagtcctggtacctggatgacaacatcaagacctactcagatcaccctgaaaaagtcaataaggatgacgaagaattcatcgaaagcaacaaaatgcatgcaatcaacgggcggatgttcggaaatctgcagggccttactatgcacgtgggggacgaagtgaactggtacctcatgggcatgggaaatgaaattgacctgcacaccgtccactttcatggccacagcttccagtacaagcatcggggagtttacagctcggacgtgttcgatatcttcccaggaacctaccagaccctggagatgttcccgagaactccgggaatctggttgctgcattgtcatgtcaccgaccatattcacgcaggaatggagactacttacactgtgctccagaacgaagatactaagtccgga

SEQ ID NO: 8549 - DNA, 3195 bp, Artificial Sequence
  Description of Artificial Sequence: Synthetic coding sequence
atgaagatcctgatactgggcatctttctttttctatgcagtaccccggcatgggctaaggagaaacactattatattggcatcatcgaaaccacttgggactatgctagcgaccatggtgagaagaaactgatcagtgtggatacagagcatagcaacatctacctacagaacgggccagacaggataggcagactatataagaaagccctgtacctccagtacaccgacgaaaccttccgaacaacaatagaaaagcctgtgtggctgggttttttgggccccatcattaaagccgagactggagataaagtttatgtacacctgaaaaatctagccagccgcccatatacatttcatagccatggtatcacttactacaaggaacacgagggagctatatacccagataacaccacagactttcagagggctgatgacaaagtgtatcctggagagcagtatacatacatgctgctggcaacagaggagcaatctccaggagagggcgacggcaactgcgtgacccgtatttatcacagtcatattgatgcccccaaggacatcgcttctggtctgattggccctctgattatatgtaaaaaagacagcctggacaaagaaaaggaaaaacacatcgatcgggaatttgtggtcatgtttagcgttgtggatgagaatttctcttggtacctagaggataatataaagacctattgtagtgagccagagaaggtggacaaagacaatgaggactttcaagagtctaacaggatgtatagtgtgaatggatacacattcggctcactccctggcctgtcaatgtgtgccgaggatcgcgttaagtggtacctctttgggatgggaaacgaggttgatgtgcatgccgcctttttccacggccaggctctaacaaataaaaattatcggattgacacaataaatttatttcctgcaaccctatttgatgcatatatggttgcccagaaccccggagagtggatgttatcttgtcagaatctgaatcatctgaaggccggacttcaggccttcttccaagtgcaagaatgtaacaagagtagctccaaagataatatcagaggtaaacacgtacgtcattattacattgccgccgaagagattatatggaactacgcccctagtggtatcgacatctttactaaagaaaatctcacagcaccaggctcagattcagccgttttctttgaacagggcacaactaggatcggcggctcctacaagaagctagtgtatagggagtatactgacgcctccttcaccaaccggaaggagcgcggtccagaggaggagcacctgggcatcctgggccctgtcatttgggctgaggtgggagacaccatccgagtgacatttcacaataaaggagcttatccactgtccatagagcccatcggcgtgagatttaacaaaaataatgagggaacatactactccccaaactataacccccagtcacgaagcgtcccacccagcgcctctcacgtggcacctacagaaacctttacctatgagtggaccgtgccaaaagaagtgggcccaaccaacgctgacccagtttgcctggccaaaatgtactatagtgctgtggatcctaccaaggacatattcaccgggctgattggccccatgaagatttgcaagaagggcagtctgcacgcaaatggtcgccagaaggatgtcgacaaagaattttatctttttcctacagtgttcgatgaaaacgagtccttgcttctggaagataacatcaggatgttcactacagcccccgatcaggtggataaggaagatgaagactttcaagaatctaataagatgcattctatgaatggcttcatgtacggcaatcagccagggctgaccatgtgtaagggcgattcagtggtgtggtatctgtttagtgctgggaacgaggcagacgtccacggtatttacttcagtgggaacacatacttgtggagaggcgaacgacgcgataccgccaacctatttccccagacttcactgacattacacatgtggcctgacactgaagggacatttaacgtggaatgtcttactactgaccactataccgggggaatgaaacaaaagtataccgtcaaccaatgtcggcggcaaagcgaggattccaccttctacctgggtgagagaacctactatattgccgcagtcgaggttgagtgggactatagtccacagagggagtgggaaaaagaactgcatcacctgcaggaacagaacgtgagcaacgccttcctggacaaaggggagttttatattggaagtaaatataagaaggtggtgtacagacagtacactgacagcacctttcgcgtgccagtcgagcggaaagctgaggaggagcacctgggcattctgggcccacagctccacgccgatgtgggcgataaggttaaaattatttttaagaatatggccacccgcccttactccattcacgcccacggggtccagaccgaatccagcactgtgactcccactctgcccggggagactctgacctatgtgtggaaaataccagaaaggagtggagccggaaccgaggacagcgcctgcattccatgggcctactatagtaccgttgaccaggttaaagacctatattctggactgataggccctctaattgtgtgtagaaggccatacctaaaggtctttaacccaaggaggaagctcgagtttgcactgctattcctggtcttcgacgagaatgagagttggtatctggatgacaacatcaaaacttattctgatcaccctgagaaagtcaacaaggacgatgaagagttcatagaaagcaataagatgcacgccatcaacggtagaatgttcggcaatttacaagggctaacaatgcacgttggcgacgaggtcaactggtatctaatgggcatgggcaatgaaattgacctgcacaccgttcattttcatgggcattcttttcaatataaacaccgaggagtgtacagttccgatgtgtttgatatattccctggaacctaccagacccttgaaatgttccctcgcacccccggcatctggctactacattgtcacgtcacagaccatatccacgccggcatggagacaacctataccgttctacagaatgaagacaccaagagcggc

SEQ ID NO: 8550 - DNA, 3195 bp, Artificial Sequence
  Description of Artificial Sequence: Synthetic coding sequence
atgaagattttaatcttgggcatttttctgttcctgtgtagtaccccagcttgggccaaggagaaacactactatatcgggattatcgaaaccacctgggattacgcttcagaccacggggagaagaagctgatttccgtggacaccgagcattccaacatttatttgcagaatgggcccgatcgcattggacgactgtacaaaaaggctctgtatctgcaatacaccgacgagaccttcagaactacaatcgagaagcccgtgtggctaggatttttggggccaattattaaggctgaaaccggtgataaggtgtatgtccacctgaaaaatttggcaagccgaccgtacacattccactcacacggtataacatactacaaagagcatgagggggctatctaccctgacaacacaaccgacttccagagagccgacgacaaagtttaccccggagaacagtacacctacatgcttctggccacagaagaacagtcccctggcgaaggcgatgggaactgcgttaccagaatctatcattcacacatcgatgcccctaaggacatcgcctccggattaattggtccgctgatcatctgcaaaaaagacagtttagacaaagagaaggaaaagcatattgacagagaattcgtcgttatgttctctgtggtggacgaaaacttctcctggtacctcgaagacaacatcaagacgtattgttccgaacccgagaaggtggacaaggacaacgaagattttcaagagtcaaatagaatgtattccgtgaacggatatactttcggcagcttacccggtctcagtatgtgtgcggaggatcgtgtgaagtggtatttatttgggatgggtaatgaagtggatgtccacgcagcctttttccatggtcaggccttgactaacaagaactaccggatagataccatcaatctgttccctgccacactgttcgacgcatacatggtcgctcagaatcctggcgaatggatgctgtcttgtcaaaacctgaaccatctcaaagctgggctgcaagcattcttccaggtgcaggaatgcaataagtcttcaagcaaggataatatccgcggaaagcacgttcgtcactattacatcgcagcagaagaaatcatctggaattacgcaccgagcggcatagacatttttaccaaagagaatctgacggcccctggaagcgatagcgcggtcttcttcgaacaggggaccacgagaattggcggctcctacaaaaagttagtgtatcgagaatacactgatgcttcatttacaaatcggaaggagcgcggtccagaagaagaacatttgggcatactgggaccagtgatctgggccgaggttggcgatactatccgcgtaacttttcacaacaagggagcctaccctctgtcaatagaacctatcggcgtgagatttaacaaaaacaacgagggtacgtactatagcccaaactataacccacagagcagatccgtgcctccctccgcatcacatgtagcgccaacggaaacgttcacatacgagtggaccgtgcccaaggaggtgggacccactaacgctgatccggtgtgccttgcaaagatgtactattccgcggttgacccaaccaaagatattttcaccgggttgatcggacccatgaaaatttgcaaaaaaggaagcttgcacgccaacggccggcagaaggacgttgacaaggaattctacttgtttccgaccgtgtttgatgagaacgagtctttgctgctagaagataatatacgaatgttcacgacagctcccgaccaggtcgataaggaagatgaggatttccaggagagcaacaaaatgcatagcatgaatggtttcatgtatggaaatcagccagggctcaccatgtgtaagggggacagcgtggtgtggtaccttttctccgcagggaatgaggcagatgtgcacggcatctacttttctgggaacacttacttgtggcgcggggagaggcgggatactgccaacctattccctcaaactagtctgaccctgcacatgtggcctgacacagagggtaccttcaacgttgagtgcctgacaacggaccactataccggagggatgaaacaaaagtatactgttaaccagtgcaggcgccagtctgaagactccactttctacctgggtgagcgcacatattacattgccgcagtggaggtcgagtgggattatagcccacagcgggaatgggagaaagagttgcatcatttacaggagcagaatgttagcaacgcattcttggacaagggcgagttttatatcggttctaaatacaaaaaggtggtgtaccgtcaatatacagacagcacattccgagtgcctgtggagcggaaggcggaggaagagcacttggggatcctgggtcctcagctgcacgcggatgttggtgacaaggttaagatcattttcaagaacatggctacccggccatattccatacacgcacatggagtgcaaactgaatcctcaaccgtgacgccgacgctgcccggcgaaacgctgacttacgtgtggaaaattccagaaaggagcggggcaggtacagaagactctgcctgtatcccctgggcatattactcaacagtggatcaagtcaaagacctctatagcggcctcatcgggcccctcattgtgtgcaggcgaccctatctgaaggtgtttaatcctcgaagaaagctggagttcgcactcctctttttagtttttgatgagaatgagtcctggtatctggatgataatattaaaacctacagcgatcaccccgaaaaggtgaacaaagacgacgaagagttcatcgaatccaacaaaatgcatgccatcaatggacgaatgttcggcaaccttcagggcctcaccatgcacgtaggcgatgaggtcaactggtacctgatgggcatgggcaatgagattgacctacatacagttcacttccatggtcacagctttcagtacaaacatagaggagtttactccagtgatgtgtttgacatcttccccggcacgtaccagaccctggagatgttccctaggaccccaggaatctggctcctccattgccacgtgacggaccacatccacgctggcatggaaacaacttatacggtgctgcagaacgaggacaccaagagcgga

SEQ ID NO: 8551 - DNA, 3195 bp, Artificial Sequence
  Description of Artificial Sequence: Synthetic coding sequence
atgaaaatcctgatccttgggatcttcctgtttttatgctctacccctgcctgggcaaaagagaagcattattacatcggtatcatcgaaactacctgggactatgccagcgaccacggtgaaaaaaagctaatctctgttgatactgaacacagcaacatctacctccagaacggcccagacagaattggtaggttatataaaaaggctctgtatttgcagtacacggatgagacatttcgcaccacgatcgagaagcccgtgtggctaggattcttgggccccatcataaaggcagaaaccggtgataaagtgtacgtccacctgaagaatcttgcatcccggccatacacattccatagccacgggattacctactataaggaacatgagggcgctatttaccctgacaatacaactgacttccaaagagctgacgataaggtctaccccggtgagcagtatacatacatgcttttagcaacagaagaacagtcccccggggagggagacggtaactgcgtgactcgcatctaccactctcacatagacgcaccaaaggatatagccagcgggctgatagggcccctgatcatctgcaaaaaggattccctggacaaagagaaagagaagcacatagacagggagttcgtcgttatgttcagtgtcgtggatgagaacttcagctggtatcttgaggacaatatcaaaacttattgctccgagccggaaaaagtcgacaaagataacgaggattttcaggagtctaatcggatgtacagtgttaatggatacacctttggatctctgcctggcctctcaatgtgcgccgaggatagggtgaagtggtacctgttcgggatggggaacgaggttgacgtccatgccgcatttttccacggccaggccctcactaataaaaattaccgtatcgatacaattaacctctttcctgcgacgctcttcgatgcttatatggtggctcagaacccgggggagtggatgttatcatgtcagaatcttaatcacctgaaggccgggctacaggccttctttcaggtgcaggagtgtaataaatccagtagcaaagataacatccgcggcaagcatgtgcgccactactatatcgctgccgaggagatcatatggaattacgcgccctcagggatcgacatttttaccaaagagaatctgacagcacctgggtcagattccgccgtattttttgaacagggtacaacccggatcggcggatcctacaagaaactggtgtaccgagagtatactgatgcctctttcaccaatagaaaagaacgcggcccagaggaagaacatctgggtattcttggacccgtgatctgggcagaggtaggtgacacaatccgagtcactttccacaacaaaggcgcgtatcctctcagcatagagcccattggggtgcgtttcaacaagaacaacgagggcacttattattccccaaattataatccgcaatcgagaagcgttcctcccagcgcctcccacgtcgcccccaccgaaacattcacatacgagtggaccgtcccaaaagaggttggtcctaccaacgctgaccccgtgtgtttagccaaaatgtactactcagctgtcgatcccacgaaagatatcttcaccggactcatcggccctatgaaaatatgcaaaaagggcagcctacacgcgaacggcagacaaaaagacgttgacaaggaattttaccttttccccacagtgtttgacgagaatgaatctctgctgttagaagataacatacgtatgtttactacagcccccgaccaggtggataaggaagacgaggacttccaggagtccaacaagatgcatagtatgaacggatttatgtatggtaatcagcctgggctgacgatgtgcaagggagactctgtggtgtggtatctgttttccgcggggaacgaggccgatgtgcacgggatctatttctcgggaaatacctacctgtggagaggagagaggcgagacaccgctaatctttttccccagacatcactgaccctgcacatgtggcccgatactgaaggaacatttaatgttgagtgtctcactacagatcactatactggagggatgaaacagaagtatactgtcaatcagtgccgaagacagtctgaggacagcactttctaccttggagagcggacctactatatcgcagccgtggaagtagaatgggactactctccccaacgagagtgggagaaggaactccaccatctccaggaacagaacgtctctaatgctttcttggacaagggagagttttacataggaagtaagtataagaaggttgtctaccgacagtacacggattccaccttcagggtccccgtggaacggaaggccgaggaggaacacttggggattctggggccacagctgcacgcagatgtgggcgataaggtcaagattattttcaagaacatggcaacccgcccatactccattcacgctcacggagtgcagaccgagtcaagcacagtgacacctaccctgcctggggaaacattgacgtacgtatggaagattccggagagaagcggagccgggacagaggatagtgcctgcatcccgtgggcttattacagtactgttgaccaggttaaagacttgtattcaggcctcatcgggccattgatcgtatgccgccgtccatatctcaaggtttttaatcctcggcgcaagcttgaatttgctctgctatttctggtgttcgatgaaaatgaaagctggtatctcgacgacaacattaagacatactctgatcatccggagaaggtgaacaaagatgacgaggagtttatcgagagtaacaagatgcacgccattaacggccggatgtttggaaatctgcaagggctgactatgcatgtaggagacgaagtcaactggtaccttatgggaatggggaatgagatagaccttcacaccgttcattttcacggccactcattccaatacaagcatcgcggcgtctattcttctgatgtgtttgacatcttcccagggacttatcagaccctggaaatgtttccccggacccctggaatctggctgttacattgccacgtgacggaccatatccacgccgggatggagacgacttacacagtgctacaaaatgaggatacaaaatccggg

SEQ ID NO: 8552 - DNA, 3195 bp, Artificial Sequence
  Description of Artificial Sequence: Synthetic coding sequence
atgaagatcctgatccttggaatcttcctgtttctctgcagcacaccagcgtgggcaaaggagaagcactactacattggtattatcgaaacaacatgggactacgcctcggatcacggggagaagaaattgatctcggtggacactgagcatagcaacatttacctccagaatgggcccgacaggatcggaaggttgtataagaaagctctgtatcttcagtacacagacgagacattccgaaccactatcgagaaaccagtgtggctggggttccttggaccgatcattaaggccgaaaccggcgacaaagtgtatgttcacctaaagaacctagcttcaagaccttacacttttcactctcatggcatcacatactataaagagcacgaaggcgccatataccctgacaataccaccgactttcagagagccgatgataaggtttatccaggcgaacagtacacttacatgctcctggctactgaggagcaaagcccaggcgaaggggacggaaattgcgtcacacgtatctaccattctcacatagacgctccgaaagacattgcgtccggactgatcggtcccctgatcatctgtaagaaagattccttggacaaggaaaaggagaaacatattgaccgggaattcgtagtcatgttttctgtagtggacgaaaactttagttggtatctcgaggataatatcaagacatactgttctgaacccgagaaagtcgacaaggacaacgaagactttcaagagtcgaataggatgtattccgttaatgggtacacgtttggcagcctcccgggactgagcatgtgcgcggaagatcgagtcaaatggtacctttttggcatgggcaatgaggtggacgttcacgccgcattctttcatggtcaggcccttactaacaaaaattataggattgataccataaatctctttcctgcgaccctcttcgatgcttatatggtcgcgcaaaacccaggagaatggatgctgagctgccagaacctgaaccatctaaaggccggcctgcaggcgttcttccaggtccaagagtgcaataaaagcagtagtaaagataatattcgtgggaagcacgtgaggcactactacatcgccgccgaagaaatcatttggaactacgctcccagcggaattgacatctttacgaaggagaaccttactgccccagggtcagactctgccgtctttttcgagcaaggcactacccggatcggcggtagttacaaaaagctcgtctaccgtgaatatacagacgcctcttttacaaatagaaaggagcgtggcccagaggaggagcatctgggcattctgggaccggtcatctgggccgaggtgggggacaccattcgtgtcaccttccacaataagggcgcttaccccctgagtattgagcctatcggggtgcggtttaacaaaaataatgagggcacctattactccccaaactataacccacagagtcgctccgtccctccctcagcatctcatgtggccccaacagaaactttcacctatgaatggaccgtgccaaaggaagttggacctacaaatgctgaccctgtgtgtctcgctaaaatgtactactcagccgtggaccccaccaaggatatcttcaccggattgatcggtcccatgaagatatgcaagaaggggtcgctccacgccaacggcagacagaaggatgtagacaaggagttctacctatttcctaccgttttcgatgagaatgaatcactattgctcgaggacaacattcgcatgtttacaactgccccagaccaggtcgacaaagaggacgaggactttcaggaatcaaacaagatgcacagtatgaatggctttatgtacggaaaccagcccgggctgaccatgtgcaaaggtgattcagttgtgtggtatctgtttagcgcaggcaatgaggccgatgtgcatggtatctacttcagcggcaatacctatttgtggcgaggtgagcggcgcgacaccgccaacctgttcccacagacttctctgactctacacatgtggcctgataccgagggaacgtttaatgtggaatgcctcacaactgatcattataccggaggcatgaagcagaaatacaccgtaaatcagtgcaggagacagtccgaggattccacattttacctcggggagcggacctattacatcgcagcggttgaggtggagtgggactactcaccacagagggaatgggaaaaagagctccaccacttgcaggagcaaaatgtaagcaacgcctttttggataaaggcgagttttatattggcagcaagtacaagaaagtcgtatatcggcagtacactgactctacattcagagtccctgttgagaggaaagccgaggaagagcacctagggatcctgggaccacaactccacgccgacgtgggcgataaagtcaaaatcatattcaagaatatggcaacacgcccatacagcatccatgcacacggagtacaaacagagtcttcgacagtgacgcccacactccccggagaaactctgacgtatgtgtggaaaattcctgagcgctctggagctggcaccgaggactcagcctgtatcccctgggcttattactccacggtggatcaggtgaaagatctttatagcggccttattggccctctgattgtttgccggcgcccttaccttaaggttttcaacccacgacgcaaactcgaattcgctctgctgttcctagttttcgatgagaatgaatcctggtatctggatgataacataaaaacctatagcgatcacccagagaaagtgaacaaggacgacgaggagttcattgagtccaataagatgcatgccatcaacggcagaatgtttggtaatctgcagggattgacaatgcacgtcggcgatgaagtgaattggtacttgatgggcatgggaaacgagatcgatctgcatactgtccatttccatggccactcattccagtacaaacatagaggagtttacagctccgatgtgtttgacatctttccaggaacctaccaaacactagaaatgtttccgagaacgcctggtatttggctacttcattgccatgtgactgatcatatccatgctggcatggaaacgacttatacagtactgcagaatgaagatactaagtccgga

SEQ ID NO: 8553 - DNA, 3195 bp, Artificial Sequence
  Description of Artificial Sequence: Synthetic coding sequence
atgaagatcctcattctcgggatctttctttttctctgtagcacaccggcctgggcgaaggagaaacactattatatagggattatagagaccacctgggattacgctagcgatcacggggagaaaaagctgataagtgtggataccgagcattccaatatatatttgcaaaacggccctgacaggattggcagactgtacaagaaggcattatatcttcagtataccgacgaaacgtttagaacaaccattgagaaaccagtttggctgggttttttgggacccattattaaggcagaaaccggtgataaggtgtacgtccatctgaagaatcttgcttccaggccatacacgtttcacagccacgggatcacttactacaaggagcacgagggcgccatttacccagataatacgactgatttccagcgagccgatgacaaggtgtatccaggcgagcagtacacctacatgctgctggccacggaggaacagtctccgggggaaggagatggcaactgtgttacccggatctaccacagccatattgacgctccaaaagatatagccagtggcctgatcggccctctgatcatttgtaagaaagatagtctcgataaggaaaaggaaaagcatatcgacagagagtttgtggtgatgttttccgtcgtggatgagaacttttcttggtatctcgaagacaacataaaaacctattgctccgaacctgaaaaggtggataaagataacgaagacttccaggaaagcaaccgcatgtacagcgttaatggatacaccttcggaagtctgcctgggctatccatgtgcgccgaggacagggtcaagtggtaccttttcggaatgggtaatgaagtcgatgtgcacgctgcgttcttccacggtcaggcccttactaataaaaattaccggatcgatacaatcaacttgttccccgccaccttattcgacgcttatatggtcgctcaaaacccgggcgagtggatgctcagctgtcaaaatctcaatcaccttaaggcgggccttcaggctttctttcaagtgcaagaatgcaacaagtcttctagcaaagataatatcagaggcaagcatgtcaggcattattatatcgcagccgaggagattatctggaactacgcaccctcaggcattgacatattcaccaaagaaaatctgactgcacctggatccgactctgccgtcttcttcgagcagggcactaccagaattggagggtcgtacaagaagttggtgtaccgcgagtatacggacgcttccttcactaataggaaagagcgcggccccgaagaggagcatcttggaatactagggccagtgatctgggccgaggtgggagatacgatccgggttaccttccataataaaggtgcctaccctctctccattgagcccatcggagttcgtttcaataagaacaatgagggcacctattattccccgaactacaatcctcagagccgctccgttccaccatccgcatctcacgtggcgccaacagagaccttcacttatgagtggaccgtcccaaaggaggttggcccgacgaacgccgatcccgtgtgcctggccaagatgtattactcagccgttgaccctaccaaggacattttcacaggtttaatagggccaatgaaaatctgcaagaagggctctctccacgccaatggtagacagaaagacgtggataaagagttttacctgttccctacagtgttcgacgaaaacgaatctctgctgctggaagataatattcgcatgtttactacagctcctgaccaggtggataaagaggatgaggatttccaggaaagtaacaaaatgcactctatgaacgggtttatgtacggcaatcagcctggtctaacaatgtgtaagggggactcggtggtgtggtaccttttcagtgccgggaatgaagctgacgtccacggtatatatttcagcgggaacacctatttgtggagaggcgagaggcgggataccgccaacctctttccgcagaccagccttactttacacatgtggcctgacaccgagggtacttttaacgtggaatgtctaacaaccgatcactacacggggggaatgaagcaaaagtatacggtgaaccagtgcaggcgccaatctgaggactccacattttatttaggggagcgcacttactacatagccgccgtcgaggtggagtgggactacagcccccagcgggaatgggaaaaagagctccaccatttgcaggaacaaaacgtttccaacgcctttcttgacaagggcgaattctacatcggaagcaagtataagaaggtagtataccgccagtacacagattccacattccgggtgccggtggaaagaaaggccgaggaggagcatctgggcatactggggccccaattacatgcggacgttggggataaagtgaaaatcatctttaagaatatggccacaagaccatactccatccacgcccacggcgtccagaccgaaagctctacagtgactccaaccttgcccggcgagacccttacgtatgtgtggaagatccctgagcggagtggtgcaggcaccgaggatagtgcttgcataccttgggcctattactcaaccgtcgatcaggtgaaagatctctacagtgggctgattgggcccctcatcgtgtgcaggcggccctatcttaaggtgtttaacccgagaaggaagctcgaatttgccttgctgttcctggtgttcgatgagaacgaatcatggtatctggacgataacatcaagacctactctgatcacccagagaaagtcaataaagatgatgaagagttcatcgaaagcaacaaaatgcacgcaataaacgggagaatgttcggaaacttacagggacttacgatgcacgtgggagacgaggttaattggtaccttatggggatgggaaatgaaattgacttgcacacagtgcacttccacggacacagcttccagtacaaacaccgtggggtctactcctctgacgtattcgatatattcccagggacctaccaaacactggagatgttccccagaactccaggcatatggctgttgcattgtcacgtgactgaccacatccacgccggtatggagaccacatacacagtgctgcaaaatgaggacacaaaatctgga

SEQ ID NO: 8554 - DNA, 3195 bp, Artificial Sequence; identical to SEQ ID NO: 8507
  Description of Artificial Sequence: Synthetic coding sequence

SEQ ID NO: 8555 - DNA, 3195 bp, Artificial Sequence
  Description of Artificial Sequence: Synthetic coding sequence
atgaaaatcctgatactcgggatctttctgtttctttgctccacccccgcgtgggccaaggaaaaacactactatattggcattatcgaaacaacttgggactatgcgtccgaccacggggaaaagaaacttatatctgtggatacggaacacagcaacatctacttgcagaacggccccgaccgcatcggacgcctgtataaaaaggccctgtacctccagtacaccgacgagaccttccggacgacaattgagaagcccgtgtggctggggttcctgggaccgattatcaaggcggagactggagataaggtgtacgtccatctgaagaacctggcctctcgcccatatacttttcactcacacgggattacctattataaggagcatgagggggctatttaccctgacaatactaccgattttcagcgggcagatgataaagtatatcccggcgaacagtatacatacatgcttctcgcaactgaggaacagtcccccggggagggagacggtaactgcgtgaccagaatataccactcacatattgacgcccccaaagatatagcatccggcctcattgggccacttattatttgtaagaaggatagccttgataaggagaaggagaaacatattgacagggagttcgtggtgatgtttagtgtggtcgacgagaacttttcttggtatctggaagacaacataaaaacctactgtagcgaacctgaaaaagttgacaaagacaatgaagatttccaggagtccaaccgaatgtacagtgtgaacgggtacacgtttgggtcccttccaggcctgagcatgtgcgcagaagatcgggttaagtggtatttgtttggtatggggaatgaggtggatgtacacgcggcatttttccacggtcaggccctgacaaataaaaattacagaatcgatacgatcaatcttttcccggctaccctgttcgatgcttacatggtcgcacagaatcccggcgagtggatgttgtcatgccaaaacctgaatcatctcaaggccggactgcaagcttttttccaggttcaagagtgtaacaaatcatcttcaaaagacaacatacggggaaagcacgtccgccactactatatcgcagcagaggaaattatttggaactacgctccctcaggcatcgacatcttcacaaaagaaaaccttacagcccctggcagcgacagcgctgtcttcttcgaacaagggaccactaggatcggagggagctacaaaaaattggtgtacagggagtacacggatgcctccttcactaaccggaaggaacggggtcccgaagaagagcatctgggtattctcgggcccgtcatatgggctgaggtcggagacaccatccgggtgaccttccacaacaaaggcgcctatcccctctccatcgagcccattggagtcagattcaataaaaataatgaagggacttactatagccccaattataacccccagagccggtccgtgccacctagcgcctcccacgtggctccaacagaaacatttacttatgagtggacggtacccaaggaggtgggacccacaaatgcagacccagtgtgtctggccaaaatgtattactcagcggtcgatccaacaaaggatattttcactggtctgatcgggcctatgaaaatatgcaagaagggaagcctgcatgccaatggacgccaaaaggatgtcgacaaggaattttacctgttccccacagtcttcgatgagaacgaatcattgctcctggaggacaacattagaatgtttactactgccccagaccaggtcgacaaggaagacgaggactttcaggagagcaataagatgcactctatgaacggcttcatgtacgggaatcagcccggcctcacaatgtgtaagggtgacagcgtcgtgtggtacctcttcagcgcaggcaatgaggccgatgttcacggcatctatttctccggaaatacgtacctctggaggggggagcggcgagacaccgcaaacctcttcccgcagacatctctcacacttcacatgtggcccgataccgaaggcaccttcaacgtggaatgtttgaccactgatcattacacaggcggaatgaaacagaaatatactgtgaaccagtgcaggaggcagagcgaagatagcacattttacctgggtgaacggacttattacattgcagccgttgaagtggaatgggattattcacctcaaagagagtgggagaaagaattgcatcacctccaagagcagaatgtctccaatgccttcctggacaaaggggaattttatattggttcaaagtataagaaggtggtatacaggcagtataccgacagcactttcagggtgcccgtagagaggaaggccgaggaagagcatcttggtattctcggcccccagctccacgccgatgttggcgacaaagtcaagatcatcttcaagaacatggctactcgaccttatagcattcacgcccatggggtccagacagagagttccaccgtcaccccgactctcccaggggaaaccctgacctatgtttggaagatccccgaaagatccggagctgggactgaagattccgcttgcatcccttgggcgtattattccaccgtggatcaggtgaaggacctgtactctggattgattggcccacttattgtttgccgacggccttacctgaaagtttttaacccccgacgcaaacttgagttcgctcttctcttcctcgtgtttgacgagaacgagtcttggtatctggacgataacataaaaacttattccgaccatcctgagaaggtgaacaaagacgacgaggaattcattgagagtaataagatgcacgccattaatggcagaatgttcgggaaccttcagggactgacgatgcatgtgggtgatgaggtcaactggtacctgatgggaatggggaatgagatcgacctgcataccgtgcacttccatggccactcatttcagtacaaacacaggggggtgtactcaagtgacgtcttcgacatcttccccggcacgtatcaaaccctggagatgttcccgagaactccaggaatatggctgctgcactgccacgttactgatcatattcatgctggcatggagacaacctatacagtactgcagaatgaggacacaaagtctggg

SEQ ID NO: 8556 - DNA, 3195 bp, Artificial Sequence
  Description of Artificial Sequence: Synthetic coding sequence
atgaagatcctcatcctgggaatcttccttttcttgtgtagcacacctgcctgggccaaggaaaagcactattatatcggaatcatcgagacaacctgggactacgccagcgatcatggcgagaagaagctgatttctgtggacacagaacattccaatatatatctgcaaaacggccccgatcgtattggaaggctgtacaagaaggccctgtatcttcaatacaccgacgagactttcaggaccactattgagaaacccgtctggctgggtttcttgggtcccatcatcaaggcagagaccggtgacaaagtctacgtccatcttaagaatctggctagtagaccctatacattccattcccacggcattacatattataaggagcacgaaggtgccatataccctgacaacactactgactttcagagagctgacgataaggtgtacccaggcgaacagtacacctacatgctcctggcaaccgaggaacagagtcccggagagggtgatggaaactgtgtgaccagaatttaccacagccatatagatgcacccaaagacatcgctagcggcctcataggacccctcatcatatgtaagaaggacagtttggacaaggaaaaagaaaagcacattgatagggaattcgtggtgatgttctccgtagtcgacgaaaatttctcctggtacctggaggacaacattaagacatattgttccgaacccgagaaggtggacaaggataatgaggattttcaggaaagtaaccgcatgtactcagtgaatggatatactttcggatctttgcctggactttctatgtgtgctgaagacagggtaaaatggtatcttttcggaatgggtaatgaagtggacgtgcacgcagccttcttccatggccaggcactcacaaacaaaaactacaggatcgacactataaatctgtttcctgccacactctttgatgcatacatggttgcacaaaatcccggcgagtggatgctgtcatgtcagaacctgaaccacctgaaagccggactgcaggccttcttccaggtacaggagtgcaataagtcttcatctaaggacaacatcaggggtaagcacgtccgtcactactatatcgccgctgaggagatcatctggaattacgccccaagcggcatcgacatctttacaaaggagaacttgactgctcctggcagcgactctgctgttttctttgaacagggaactacccgtatcggaggatcatacaagaagttggtgtacagagaatataccgatgcttccttcaccaataggaaggaaaggggacccgaggaagagcacctcggaattctcggtcccgtgatttgggcagaagtgggagataccattcgtgtgacatttcacaataaaggagcttaccctttgtccatcgagccaataggtgtgaggtttaacaagaataacgagggtacctactattctccaaactacaacccacagagccgctccgtcccccccagtgctagtcatgtggctcccaccgagactttcacatacgagtggaccgtacccaaagaggtaggtcccacaaacgcagatcctgtctgtctcgccaagatgtattatagcgccgtcgaccccaccaaagatatcttcacaggcctcattggtcctatgaagatctgcaagaagggaagcctgcatgctaatggtcgccagaaggacgtggataaagagttctatttgtttccaactgtgtttgacgagaatgagtctttgctgctggaagataacatccgcatgttcaccactgctcccgaccaggtcgataaggaggatgaagatttccaggagagtaacaaaatgcactctatgaacggttttatgtacggaaatcaacctggattgaccatgtgcaagggtgactcagtcgtgtggtatctttttagcgccggcaatgaggctgatgtgcacggcatctatttttccggaaatacttatttgtggcgtggcgagcgtcgcgataccgccaacctcttcccacagaccagtttgacacttcacatgtggcctgacacagagggtaccttcaacgtagagtgtcttacaacagaccattataccggaggcatgaaacagaaatataccgtgaaccagtgcaggaggcagtctgaggattccacattctatcttggcgagcgtacctattacattgccgctgtcgaagtagagtgggactactctccacagcgtgagtgggaaaaagaactccatcatctgcaagagcaaaacgtatctaatgcatttctcgacaagggcgagttctacatcggcagtaagtataagaaggtcgtctacaggcaatacaccgactccacattcagagtgcctgtggaaaggaaggctgaggaagagcaccttggtattttgggaccccaactgcatgctgacgtgggcgacaaggttaaaatcatcttcaagaacatggcaactaggccctactccatacacgctcatggtgtccaaacagagtctagcactgtgactccaaccctgccaggcgagacactcacctacgtgtggaaaattccagaaaggtctggtgctggcactgaagattccgcttgtatcccatgggcctactactcaaccgtggatcaggtgaaggatctgtattcaggtttgatcggaccactcattgtttgtaggaggccctacctgaaagtgttcaaccctcgcaggaaacttgagtttgcactgttgtttctcgtgttcgatgagaacgagagctggtatctggatgacaacatcaaaacatactctgaccaccctgagaaggtgaataaggacgatgaggagttcattgaaagcaataagatgcatgctattaatggtcgcatgtttggcaatctgcaaggactcaccatgcatgttggtgacgaagttaactggtacctgatgggtatgggcaatgaaattgatctccatactgtgcattttcacggccattcattccagtacaagcacaggggcgtgtactccagtgatgttttcgatatcttccccggaacctaccagacccttgagatgttcccaaggacccccggcatatggctgcttcactgtcacgtgaccgatcacattcacgccggcatggaaaccacatacaccgtgttgcaaaacgaagatactaagtccggc

SEQ ID NO: 8557 - DNA, 3195 bp, Artificial Sequence
  Description of Artificial Sequence: Synthetic coding sequence
atgaagattctgattcttggtattttcctattcctatgttctactccagcatgggcaaaggagaagcactattatatcggtataattgaaactacgtgggattacgcatcagaccatggcgagaagaaattaatcagcgtagatacagagcactctaatatctacctccagaatggtccagaccgcatcggtcgactgtataagaaggctttgtatttgcaatatacagacgaaacatttcgcacgaccatcgagaagccggtgtggttgggcttcctggggcctattattaaggcagaaaccggcgataaggtgtacgtccatttaaaaaatctggcttcaaggccatacacgttccacagtcatggcattacatactacaaggaacacgagggtgcgatataccccgataatacaaccgattttcagcgggcagacgataaggtgtaccctggtgagcagtatacttatatgttgctggctactgaagagcagtcccctggtgagggtgatgggaactgcgtgaccagaatctaccactctcacatcgacgccccgaaagatatcgcatctggcctaatcggtcccctgataatctgcaaaaaagatagcctggataaggaaaaggaaaagcacatcgatagggagttcgtggtcatgttctctgtggtggatgagaacttcagctggtatctggaggacaacatcaaaacatactgctccgagcccgagaaagtggataaagataatgaggacttccaggaatccaaccgtatgtattcagtgaacggatatacattcgggagcttaccaggtctctccatgtgtgcagaagatcgcgtcaaatggtatctgttcggtatgggaaacgaagtagatgtgcacgctgcattttttcacgggcaggcattaacgaataagaattaccggattgacacaattaacttattccctgctaccctgttcgatgcatatatggtggctcagaacccgggggaatggatgctgtcctgccagaacctgaaccatctaaaggcaggtctgcaggctttcttccaggtgcaggagtgcaataaaagcagctcaaaggacaacatccggggtaagcatgtccgtcactactatatcgctgcagaggagatcatctggaactacgccccaagtggaatcgatatttttactaaggagaacctcaccgctcccggaagcgactccgccgtgttctttgagcaaggcaccaccaggatcggaggaagctataaaaagctcgtgtaccgggagtacactgatgcttcctttaccaaccgtaaggagcggggacctgaagaggaacacttaggaatcttgggtccggtgatctgggcggaggttggcgataccatccgcgtgacattccataataagggagcttaccccctgtccattgagcccatcggggttagatttaacaaaaataacgaggggacatattattccccgaattataatccgcagtcccgatctgtgccgcctagtgcatcccacgttgcacccaccgagacctttacctacgagtggactgtgcctaaagaagtcggccccaccaatgccgatccagtctgtcttgcaaagatgtattactcagccgtggaccccacaaaggatatctttacggggctcatcgggccaatgaagatttgtaagaaggggagcctgcacgccaatggacgccaaaaggatgtggacaaggagttttatctattccctactgtatttgatgaaaacgagtccttactgctggaggataacattaggatgttcaccacagcgcccgatcaggtggacaaagaggacgaagacttccaggaaagcaataaaatgcactccatgaatggcttcatgtacggaaatcagcccggccttacaatgtgcaagggggatagtgtggtctggtacctgttcagcgccgggaacgaagcggacgtccacgggatctacttttctggcaacacctacctatggcgcggcgaacgacgtgacaccgctaacttattccctcagacatcactgacgctgcatatgtggccagatacagaggggacattcaatgtggagtgccttactactgaccactacaccggcgggatgaaacagaaatacacggtcaatcagtgcaggcgccagtcagaggattcaactttctacctcggagaacggacctactacatcgctgcagtagaggtggagtgggattacagtccacagcgcgagtgggagaaagagctgcaccatctgcaagagcagaacgtgtcaaatgcgttcctagacaaaggagagttctacattggcagcaagtataaaaaggtggtgtacagacagtacacagactctacctttagagtgccagtggaacgaaaagccgaagaggagcaccttggtatcttgggcccccagctacacgccgatgtaggggataaggtcaagataatctttaaaaatatggccactaggccctactctattcatgcccacggagtgcagactgagtcatcaaccgtcacacccaccctgcctggggagaccctgacatacgtgtggaagatccctgagcgctctggagccggtactgaggactccgcctgcatcccctgggcatattatagcacggtcgaccaagttaaggatctgtattccggtttgattggacctctgatagtctgccggcgaccatatctgaaggttttcaaccccagacgtaaacttgaattcgcgctgctgtttctcgtgtttgatgaaaacgaaagctggtatttggacgacaatattaagacttactcagatcatccagaaaaagttaacaaggatgacgaagaattcattgaatctaacaagatgcatgccataaatggtagaatgttcggcaacctgcagggcctgactatgcacgttggagacgaggtgaattggtatcttatgggtatggggaatgagattgacctgcacacagtacactttcacgggcatagctttcagtataagcaccgcggagtgtatagctccgatgtgttcgacatctttcctggcacctaccagaccctggagatgtttcctaggactcccggtatatggctcctgcattgccacgtgaccgaccacattcatgccggcatggagacaacttacaccgtgctgcagaatgaggatacgaagtcaggg

SEQ ID NO: 8558 - DNA, 3195 bp, Artificial Sequence
  Description of Artificial Sequence: Synthetic coding sequence
atgaagatcctcattctggggatatttctcttcttatgtagcacccccgcgtgggccaaagaaaagcattactatattgggataattgagacaacctgggactacgccagcgatcacggagaaaagaagctgatcagcgtggatacggaacacagtaatatctatctgcagaatggccccgacagaattggtcggctgtacaaaaaggcgctgtacctgcagtacacagacgagacctttcgaactaccatcgagaagcccgtctggctcggctttttgggtccgataattaaggctgagaccggagataaagtgtacgtgcacttgaagaacctcgcctctaggccctacactttccattcccatgggatcacctactacaaagagcacgagggagctatctacccggataatacaacagattttcagcgtgctgacgataaggtgtacccaggtgaacagtatacttacatgctgctggcgacagaggagcagtcacccggtgagggcgatggcaactgcgtgactcggatctatcactcccacatcgacgcgccgaaggacatcgcaagcgggctgatcggccctttaattatttgcaagaaagatagcctggataaggaaaaagaaaagcatatcgacagggaattcgttgttatgttttctgtcgtagatgaaaacttttcctggtacctggaggataacataaaaacttactgttccgagcccgaaaaagtggacaaggacaacgaggactttcaggagagtaatcgcatgtactcggtgaatgggtacacattcggttctctccctgggctcagcatgtgcgctgaggaccgggtgaaatggtatctgttcgggatggggaatgaggtcgacgtgcacgctgcgttctttcacggtcaggcactgaccaataagaactaccgcatcgatacaattaacctgtttcccgctacacttttcgatgcctacatggttgcacagaatcctggtgaatggatgctatcgtgccagaatctgaaccatttgaaggcaggtctgcaagcgttctttcaagttcaggagtgcaataagtcaagctctaaagacaacatccgagggaagcacgtgagacattattacattgccgccgaagagatcatatggaactatgccccctccggcatcgacatttttactaaagagaatctcactgcccctggaagcgactcggccgtgttcttcgaacaggggacgacacggattggcggttcctacaaaaagttggtgtatcgcgaatacaccgatgcctcattcactaacagaaaggaacgcggcccggaagaggaacatcttggcattctgggtccagtgatctgggctgaggtgggcgatacgattcgagtcaccttccacaacaaaggagcatacccactgagtatagagcctattggagtgagatttaacaagaacaacgagggcacatattatagccccaactataatcctcagagtagatccgtaccccccagcgcaagccatgtggcaccaactgagacattcacctacgagtggacggtcccaaaggaggtcggccccaccaacgcggatcccgtgtgtctggcaaaaatgtactatagcgctgtggacccaaccaaggatattttcacaggcctcatcggccccatgaaaatttgcaagaaagggtctttacacgctaacgggagacagaaggacgtggacaaggagttttacctgtttcctacggttttcgacgaaaatgagtccttgctccttgaagacaacattcgcatgtttacaaccgccccggatcaggtggataaagaagacgaggattttcaagagtctaataaaatgcatagcatgaatggctttatgtatggcaatcaacctggtttgacaatgtgcaaaggagactctgtggtttggtatttgttcagcgcagggaacgaggccgatgttcatggcatctatttcagtgggaacacctatctatggcgaggcgagaggagagacaccgccaacctgttcccacagacctccttaactctacacatgtggcctgacaccgagggcaccttcaatgtagagtgcctgaccactgatcattacaccggaggtatgaagcagaagtacaccgtaaatcaatgccgccgccagtcagaggatagtacattctaccttggggaacggacctattacattgcagctgtcgaagtcgagtgggattacagccctcagagagagtgggaaaaggaactgcaccatttgcaggagcaaaacgtctccaatgccttcctggataaaggcgagttttacataggatctaaatacaaaaaagtcgtctatcggcaatacacagactccacgtttcgggtgcccgtggagcggaaagctgaggaggaacatttgggaatactgggccctcagctacatgctgatgttggggacaaagtcaagatcattttcaagaatatggccaccagaccctacagcattcatgcgcatggggtgcagacagaaagtagcaccgtgaccccgacgctgccaggggagaccctcacatatgtttggaagatcccagagagatctggcgcaggcactgaagattctgcatgtattccctgggcttattattccaccgtggatcaggtcaaagacttatactcaggtctcatcgggccgctaatagtgtgtagaaggccctatctgaaagtgtttaatcccaggcggaaactcgaatttgccctcctgtttctggtcttcgacgaaaatgaatcttggtacctcgacgacaatatcaagacatattcagatcacccagagaaggtcaacaaagatgacgaagagtttatagaaagtaataagatgcacgccattaatgggcgaatgttcggcaacctgcagggactgaccatgcatgttggcgacgaggtgaattggtacctaatgggtatggggaacgagatagaccttcacaccgtccatttccacggccattcttttcaatacaagcatcggggagtctattctagcgacgtgtttgatatttttcccggaacctaccaaactcttgaaatgttcccccgaaccccaggaatatggcttctgcactgccacgtgactgatcacatccatgcaggcatggagacaacttacacagtcctgcagaacgaagacaccaagagcgga

SEQ ID NO: 8559 - DNA, 3195 bp, Artificial Sequence
  Description of Artificial Sequence: Synthetic coding sequence
atgaagatcctgatcttgggcatcttcttgttcctgtgttccactccagcttgggctaaggagaaacattactacattgggattattgagactacctgggattacgcctccgaccacggagaaaagaagctgatctcagttgacaccgaacattcgaatatctacttgcagaatggacctgatagaattgggagattgtacaagaaggccttgtacctgcagtacacggatgagacatttcgcacaaccattgagaagccagtgtggctggggttccttgggcctatcattaaagcggagactggggacaaagtgtatgtgcatctcaagaacctcgcttcccgcccgtacactttccattcccacgggatcacctattacaaggaacatgagggcgctatctatcccgacaacactaccgatttccagcgtgcagatgataaggtctatccaggagagcaatatacctatatgctcctggccacagaagaacagagcccaggggaaggagacgggaactgtgtgacacggatctatcactcgcatatagatgctcccaaggacattgcttcgggtctgattggacccctgatcatttgcaaaaaagactccctggacaaggagaaagagaagcatatcgacagagaattcgtggttatgttctctgttgttgacgaaaacttttcttggtaccttgaagacaacattaagacctactgttccgagcccgaaaaggtcgataaggacaatgaagattttcaggaatcgaatcggatgtatagcgtgaacggatatactttcgggtccctgccaggactgagtatgtgcgccgaggatagggtgaaatggtatttgtttggtatggggaacgaagtagatgttcatgccgcatttttccatgggcaggctctaaccaataagaactaccgaatcgacaccataaatctattccccgccaccctgtttgacgcgtatatggtggctcagaaccccggggagtggatgctatcctgtcaaaatctaaaccatctgaaggcggggctgcaagcgttttttcaggtacaggaatgtaacaagtcatcctcgaaagacaatattcgagggaagcacgtgaggcattactatattgcagctgaggagatcatttggaactacgcaccaagcggcatagacatcttcaccaaggaaaatcttactgctcccggttctgacagcgccgtgttttttgagcagggcacgacccgtatcgggggctcgtataagaagctggtataccgtgagtatacggatgcgagctttaccaatcgcaaagaaagagggcctgaggaagagcaccttggaatccttggccctgtcatatgggcagaagtcggcgacaccatccgagtcacgtttcacaacaagggagcctaccccctgagcatcgaaccgattggagtgagatttaacaagaataatgaaggtacttactatagtccaaattataatcctcagtctagatctgtgccaccttccgcttcccacgtagctcccactgaaaccttcacatacgagtggacagtacccaaagaagttggccctaccaacgccgatcccgtctgtctggctaaaatgtattattctgctgtggatcccactaaggatatctttaccgggctgatcggacctatgaaaatatgcaaaaagggaagtctgcacgccaatggccggcaaaaggacgtagacaaagagttttaccttttccctaccgtgttcgacgaaaatgaatccctgctcctggaggataatatccgcatgtttaccacagcccccgaccaagtggacaaagaggatgaagattttcaagaatccaacaaaatgcattcgatgaatggtttcatgtacggcaaccagccaggcctgactatgtgtaagggggattcagtcgtctggtacctgttttcagcaggcaacgaggcggatgttcacggtatctacttttctggtaatacttatctgtggagaggtgagcggcgtgacactgctaacctgttcccccagaccagtttgaccctccacatgtggccggatacagaggggacatttaatgttgaatgcttgacaacggatcactatactggtgggatgaaacagaaatatacagtcaatcagtgcaggagacaatcggaggattctaccttttatctaggcgagaggacttactatatagcagcagttgaagtggagtgggactactcaccgcagcgcgagtgggaaaaagaattacaccatctacaggagcagaatgtgagcaacgccttcctcgacaagggggagttttatatcggtagtaagtataagaaggtcgtgtatcggcaatacacagattctacatttcgagtccccgtagagcgcaaggccgaggaagagcacctaggaatcttaggtcctcagctgcacgctgatgtcggcgacaaagtcaaaattatctttaagaatatggctacgcgaccctattcgattcatgctcatggcgttcagacagagtccagtacagtcaccccgactcttccaggtgagacactgacatatgtgtggaagatacccgagcggtccggagccggtacggaagacagcgcctgcattccctgggcatactattctacagtggaccaagtcaaggacctctattccggtttgattggcccgttaattgtgtgccgccggccatatcttaaagtgtttaacccccgccgcaagctggaatttgcgctcctgttcctggtgttcgacgaaaatgaaagctggtacttggacgataacatcaaaacatattctgaccatccggaaaaggtcaataaggacgatgaggagttcatcgaaagcaataaaatgcacgcaattaacggtcgtatgttcggcaatcttcagggacttactatgcacgttggagacgaagtcaattggtatctgatgggtatgggcaatgagatcgatttgcataccgttcatttccatggccattcctttcagtacaagcatagaggcgtatactcctcagacgtgttcgatattttcccgggaacgtaccaaactctggagatgttcccccgtacccccgggatatggcttctgcactgtcacgtgactgaccacatccacgccggcatggagactacctacaccgtgctgcagaacgaggacacaaaatcaggc

SEQ ID NO: 8560 - DNA, 3195 bp, Artificial Sequence
  Description of Artificial Sequence: Synthetic coding sequence
atgaagattcttattttaggaatctttctttttttatgttcaacaccagcatgggctaaagaaaaacattattatataggaattattgaaacaacatgggattatgcatcagatcatggagaaaaaaaattaatatcagtagatactgagcattctaatatatatcttcaaaatggtccagacagaattggaagactttataaaaaagctttatatttacaatatactgacgaaacttttagaactactattgaaaaaccagtttggttaggatttttaggtccaattattaaagcagaaactggagataaagtttatgttcatcttaaaaatttagcaagtagaccatatacatttcattcacatggtataacttattataaagaacatgaaggagctatctatccagataataccacagattttcaacgtgcagatgacaaagtttatccaggtgaacaatatacatacatgttattagctacagaagaacagtctccaggagaaggagatggtaattgtgtaacaagaatttatcattcacatattgatgctccaaaagatattgcttctggtttaattggtcctttaattatttgtaaaaaggacagtttagataaagaaaaagaaaaacatattgatcgagaatttgttgtaatgttctctgttgtagatgaaaatttttcttggtatttagaagataatattaagacatattgttcagaaccagaaaaagtagataaagacaatgaagattttcaagaatctaatagaatgtattctgttaatggttatacgtttggttctcttccaggattaagtatgtgtgctgaagatagagttaagtggtatctttttggaatgggaaatgaagttgatgttcatgctgcattctttcatggacaagctctaacaaataaaaattacagaattgatacaattaatctttttcctgctacattatttgatgcttatatggttgcacaaaatccaggagaatggatgttatcttgtcaaaatttaaatcatttaaaagcaggattacaagcattttttcaagttcaagaatgtaataaatcttcatctaaagataatataagaggaaaacatgttagacattattatattgcagctgaagaaataatatggaattatgctccttcagggattgatatttttacaaaagaaaaccttactgcacctggaagtgattctgctgtatttttcgaacaaggaactacaagaattggaggtagttataaaaaattagtttatagagaatatactgatgcatcatttacaaatagaaaagaaaggggaccagaagaagaacatttaggaattttgggaccagtaatttgggctgaagtaggtgatactattagagttacatttcataataaaggagcttatcctttaagtattgaacctattggtgtaagatttaataagaataacgaaggtacttattattctccaaattataatccacaatcacgatcagttccacctagtgcaagtcatgtagctccaactgaaacattcacttatgaatggactgtaccaaaagaagtagggccaacaaatgctgacccagtttgtttagcaaaaatgtattattctgctgttgacccaactaaagatatatttactggattaattggaccaatgaaaatttgtaaaaaaggatcattacatgcaaatggtagacaaaaagatgtcgataaagaattttatctatttccaacagttttcgacgaaaatgagtcattattattagaagataatattagaatgtttacaacagcaccagatcaagtagataaggaagacgaagatttccaggaatcaaacaaaatgcatagtatgaatggatttatgtacggtaaccaacctggtttaacaatgtgtaaaggtgatagtgttgtttggtacttattcagtgcaggtaatgaagctgatgtacatggaatatattttagtggtaacacttatttatggagaggggaaagacgtgatactgctaatctttttccacaaacatcacttactttacatatgtggccagataccgagggtacttttaatgtagaatgtcttactaccgatcattatacaggtggtatgaaacaaaaatatactgtaaatcaatgtagacgtcaatcagaagattctactttttatcttggtgaaaggacttattatattgctgcagttgaagttgaatgggattatagtccacaaagagaatgggaaaaggagttacatcatcttcaagaacaaaatgtttcaaatgcatttttagataaaggagaattttatataggatcaaaatataaaaaagttgtttacagacaatatactgattcaacatttagagttccagttgaacgtaaagctgaagaagaacatttaggtattcttggaccacaattgcatgcagatgtaggagataaagttaaaattatttttaaaaatatggctactagaccatattcaattcatgctcatggagttcaaacagaatcttcaactgttacaccaactttaccaggagaaactcttacatatgtttggaagattccagaaagaagtggtgctggaactgaagatagtgcttgtataccatgggcatattactcaactgttgaccaagttaaagatttatattcaggtttaattggaccattgattgtttgtagaagaccatatcttaaagttttcaatccaagacgtaaacttgaatttgctcttttattccttgtttttgatgaaaatgaatcatggtatttagatgataatattaaaacatattctgatcatccagaaaaagttaataaggatgatgaggaattcatagaatctaacaaaatgcatgcaattaatggtagaatgttcggtaatttgcaaggattaacaatgcatgtaggagatgaagtaaattggtatttaatgggaatgggaaatgaaatcgatttacatactgtacattttcatggtcattctttccaatacaaacatagaggagtttattcttcagatgtttttgacatttttcctggaacttatcaaactttagaaatgtttccacgtactcctggaatttggcttttacattgtcatgttacagatcatattcacgctggtatggagacaacatatactgttcttcaaaatgaggatacaaaatcagga

SEQ ID NO: 8561 - DNA, 3195 bp, Artificial Sequence
  Description of Artificial Sequence: Synthetic coding sequence
atgaagatcctcatcctcgggatctttctctttttgtgctccactccggcctgggccaaggagaagcattactacatcggaatcatcgaaactacgtgggactacgcttccgaccacggagagaaaaagctgatctcagtcgacactgagcatagtaacatctatctccagaacggaccggatcgcatcggaaggttgtacaagaaggctctgtacctccagtataccgacgaaaccttcagaaccaccatcgagaagccggtttggttgggattcttggggcccatcatcaaggccgaaactggcgataaagtttacgtgcatttgaagaatctcgcttcgcgaccatacaccttccacagccacggtatcacctactacaaggaacacgagggagccatctacccagacaacactaccgatttccagcgcgcggatgacaaggtgtacccgggcgagcagtacacttatatgttgcttgccaccgaagaacaaagcccgggagagggcgatgggaattgcgtcacccggatctaccacagccacatcgacgcgccaaaggatatcgcgtcaggactgattggacctctgatcatctgcaagaaggactcgctggataaggaaaaggaaaaacacattgatcgggaatttgtggtcatgttctccgtggtggacgagaatttctcatggtacttggaggataacattaagacgtactgctcggagccagagaaggtcgacaaggataacgaagattttcaagaaagcaaccgcatgtactccgtaaacggttacacctttggttcgctgccggggctgagcatgtgcgccgaggacagagtgaaatggtacctcttcgggatgggcaatgaagtggatgtgcacgcagcttttttccatggccaggctctgaccaacaagaactaccggattgataccatcaacctcttccccgccacgctgtttgatgcatacatggtggcgcagaacccaggagagtggatgctgagctgtcagaatctgaaccacctgaaggccgggttgcaggcattcttccaggtccaggaatgtaacaagtcatcgagcaaggacaatattcggggaaagcacgtcaggcactactacatcgccgcggaggagattatctggaattacgcccctagcggaatcgatatcttcactaaggagaacctcacggcacccggatcggattctgcggtgttcttcgagcaaggaactactagaatcggaggatcctacaagaaactcgtctaccgcgaatacaccgacgcgtcgttcactaatcggaaggaaagaggaccggaagaggaacacctcggtatactcggcccggtgatctgggccgaagtgggagatactatcagagtgacttttcataacaaaggagcctacccgctgtcaatcgaacccatcggagtgagattcaacaagaacaatgaaggaacgtattactcccccaactacaacccacaatcccgcagcgtcccgccatccgcatcacatgtcgcgcctactgaaacttttacttacgagtggactgtgcctaaggaggtgggaccaactaacgcggaccctgtctgcttggctaagatgtactacagcgcggtggacccgaccaaggacatcttcaccggactcatcggtccaatgaaaatctgtaagaaggggtccctgcacgccaacggacgacagaaggacgtcgataaggaattctaccttttcccaaccgtgtttgacgagaacgaatcactcctgctcgaggacaacataagaatgttcaccaccgcgccggatcaagtggacaaggaggatgaagatttccaagagtcaaacaagatgcactcaatgaacggattcatgtacggcaatcagccgggactcaccatgtgtaagggtgactccgtggtgtggtatctgttctcagcaggtaacgaagccgacgttcatgggatctacttcagcggcaatacgtacctttggcgcggcgaacgccgcgacaccgcgaacttgtttccgcagacctcactgaccctgcatatgtggccggacaccgagggcacctttaacgtcgaatgcttgactaccgaccattacactgggggaatgaaacagaagtacaccgtgaaccagtgccgtcggcaatctgaagattccaccttctacctgggtgaacgcacttactacattgctgctgtggaggtggagtgggattactcaccacaaagagaatgggaaaaagagctgcatcacctgcaagagcagaatgtgagcaacgctttcttggataagggagagttctatatcggatccaagtacaaaaaagtcgtgtatcgccaatacaccgactccacctttcgggtgccggtcgaacggaaggcagaggaggagcacctgggcatcctgggcccgcagctgcacgcagacgtgggagataaggtgaagatcatcttcaagaacatggccactcggccatactccatccatgctcatggtgtgcagaccgaatcatctaccgttactcccactctgccgggcgagacgctgacctacgtgtggaagatccccgaacgaagcggggccggaaccgaagattcggcctgcatcccttgggcatactactcaaccgtggaccaggttaaggatctgtactccggactgatcggaccactgatcgtgtgtcggcgaccgtatcttaaagtctttaacccgagacgcaagttggagttcgctctgctcttcctggtctttgacgaaaacgaatcctggtatcttgacgacaacattaagacttactccgatcatccagaaaaggtgaataaggatgatgaggagtttatcgagagcaacaagatgcatgccattaacggccggatgttcggcaacctccaaggactcactatgcacgtgggagacgaggtgaattggtacctgatgggtatgggaaacgaaatcgacctccacaccgtgcacttccatggacactccttccaatacaagcacagaggagtgtattcctcggacgttttcgacatcttcccaggaacttaccaaaccttggagatgttcccgcggaccccaggaatctggctgctccattgtcacgtgaccgaccacatccacgcaggaatggaaactacttacaccgtgcttcaaaacgaggatactaaatccggt

SEQ ID NO: 8562 - DNA, 3195 bp, Artificial Sequence
  Description of Artificial Sequence: Synthetic coding sequence
atgaaaatactcatcttgggaatattcctgtttttatgctcaacgccagcgtgggcgaaggaaaagcattactatatcggcatcatcgaaactacatgggattatgcatcggatcatggggaaaagaagcttatttccgtcgacacagaacattctaatatctaccttcagaatggtccagaccgtataggacgtctgtacaagaaagcattatatttacagtatacagatgaaacatttagaacgacgatcgaaaaacctgtatggctgggctttcttggcccgatcataaaagccgagacgggcgataaagtttatgtccacttgaaaaatcttgcgtccagaccttatacatttcatagccatggaattacgtattataaagaacatgaaggcgctatttatccggataacactacagattttcaaagggcagatgacaaggtttatcctggagaacaatatacgtatatgctgttagccaccgaagaacagtctcctggcgagggtgacggcaattgtgtaacacggatttatcatagccatattgacgctccgaaggacatagcaagtgggctgattggcccccttattatttgtaagaaagattcattagataaagagaaagaaaagcatatagatagggagtttgttgtcatgttttcggttgtagatgaaaatttcagctggtacctggaagataatatcaagacatattgctctgaaccggaaaaagtcgataaagacaacgaggactttcaagaaagcaatcggatgtattccgtaaacggttatacattcggctcattaccgggtctttccatgtgcgccgaagatcgagttaaatggtatctttttggaatgggaaacgaagttgatgttcatgccgccttcttccatggtcaggcattaacaaataagaactatcgcattgatacaataaatctttttcctgcgacattatttgacgcgtatatggtggcccaaaatccgggtgagtggatgctctcatgccaaaatcttaaccatttaaaggcggggttgcaagcattttttcaagtacaggaatgtaacaaatcttcatccaaagataacatccggggcaagcatgtccgacattattatatcgcagcagaggaaatcatctggaactatgcaccttcgggcattgatatctttacgaaagaaaacctgactgcgccaggatcagactcggccgtgttttttgaacaaggtacaacgcgaattggcggaagctataaaaaacttgtttacagggagtacacagatgcgagcttcacgaatcgaaaggaacgtggcccagaagaagaacatctgggaatactaggtccggtgatttgggccgaggtgggagatacaattagagtgacgttccacaataagggggcttatcccttgtccattgaacctatcggagtacgatttaataaaaataatgagggcacttactatagcccaaactataacccgcaaagtcgctccgtaccaccttcagcgtctcatgtcgcgccgacagagacattcacatacgaatggacggttcctaaagaagtgggtccgactaacgcggaccctgtctgcctggccaaaatgtattactcggcagtagatccaacaaaagatatcttcacggggctgatcggccccatgaaaatctgtaaaaaaggctccttgcatgcgaatggccgtcagaaagatgtggacaaagaattttacctgtttccgactgttttcgatgagaatgagagcctattattagaagataacatacgcatgttcacgacagctcctgaccaagtggataaggaagatgaggattttcaagaatctaataaaatgcactctatgaacggatttatgtatggtaatcagcccggtctgacgatgtgtaagggtgactcagttgtttggtacctattttccgcaggcaacgaggcggatgtgcacgggatttatttttcaggcaatacatatctctggcgtggcgagcgtcgggatactgctaacctttttccgcagacaagtttaacgcttcatatgtggccagataccgaaggaacattcaatgtcgaatgccttaccacagaccactatactggggggatgaaacaaaaatacacagtgaaccaatgtcgcagacagagcgaggattcaacattttatttaggcgagagaacttactacatcgcagcagtggaagtcgaatgggattactcacctcagagagaatgggaaaaagagttgcatcacctgcaggagcagaacgtctccaatgcattcctcgataaaggagaattctatattgggtctaaatataaaaaagtggtctatagacagtataccgattcaacgtttcgtgtgccggttgaacggaaagcggaagaggagcatttgggtatccttggaccacagcttcatgcagatgttggcgacaaagtgaaaattatttttaagaatatggcaacaaggccgtactctattcatgcacatggcgtccaaacagaatcatcgactgtgacccctacactcccaggcgaaacacttacatatgtttggaaaattccagaacgctccggagcaggcacagaagactcagcatgtatcccgtgggcttattacagcaccgtagatcaagtcaaggatctttattcgggattaattggtcctctaattgtctgtagacgtccgtatctgaaagtctttaaccctcgtagaaaactcgaatttgcgttactgttcctggtatttgatgaaaatgagagttggtatctggatgataatatcaagacatattccgaccaccctgaaaaagttaacaaagatgatgaagaatttattgaaagtaataagatgcatgctattaatggccgcatgtttggcaatctgcagggccttacaatgcacgtgggcgatgaagtcaactggtacctcatgggaatgggaaatgaaattgacttgcacacggttcactttcatgggcacagttttcaatataaacaccgtggagtctattcttctgatgtatttgatattttcccgggaacttatcaaacattagagatgtttccgcgcactcccgggatctggctgcttcactgtcacgtgaccgaccatatccatgcgggtatggaaactacatacacggtcctccagaacgaagacacgaagtcaggt

SEQ ID NO: 8563 - DNA, 3195 bp, Artificial Sequence
  Description of Artificial Sequence: Synthetic coding sequence
atgaagatcttaattctgggcatatttctatttctgtgttccacgcccgcttgggccaaggaaaaacactattacatcggcattattgagacgacatgggactatgcttcagatcatggggagaagaaactcatctctgtggatacagaacacagcaacatctacctgcaaaatggcccagatcgcatcggacggttatacaagaaggcactatatctacagtacaccgacgaaaccttccggaccacaattgaaaagcccgtctggctgggattcctcggccctatcattaaagccgaaacaggcgacaaggtgtacgtacacctcaagaacctggcgtctaggccctacaccttccattcgcatgggataacatattataaagagcatgagggagccatatatcctgacaacacaacagatttccagcgcgcggacgataaagtttacccaggcgaacagtatacatatatgctgttagccaccgaggaacagtctcccggagagggagacggcaactgtgttacacgcatttatcactcccacattgatgcccctaaagacatagccagcggcctgattggtcctctgataatatgcaaaaaagattccctggacaaggaaaaggaaaaacacatcgatagagagttcgtagtcatgttcagcgtggtggacgagaacttctcttggtatttggaagataacatcaaaacatattgttccgaacccgaaaaagtggataaagacaacgaagatttccaggaatccaataggatgtactccgtgaacgggtatacctttggtagcttacctggtctgtctatgtgtgccgaggatcgagtcaaatggtatctgtttggaatgggaaatgaggtcgatgtgcacgctgccttcttccacgggcaggccctgacgaataagaattacagaatagacactataaatcttttccccgcgacactgttcgatgcttacatggtcgctcaaaatcccggtgagtggatgctctcctgccagaacctgaatcacctgaaagccgggctgcaagcctttttccaagtgcaggaatgtaacaagtcttccagcaaggataatattcggggaaaacatgtgcgacactactatatcgcagctgaggagatcatctggaactacgcacctagcggaattgatatattcaccaaagagaaccttaccgcgcctggttctgacagcgcggtgtttttcgagcagggaacgacgcgaataggaggctcttacaagaaactagtttaccgtgaatacacagacgcttccttcacaaatagaaaggagcggggacctgaagaggaacaccttggaattctggggcccgttatctgggccgaagtcggcgacactattagggtgacctttcacaacaaaggagcatatcctctctcaattgagcccatcggggtgagattcaataagaacaacgagggcacatactacagtcccaactataatccacagtccaggtccgtccccccgagcgcttcccacgtcgctcccaccgaaacgttcacctatgaatggactgtgcccaaggaggtgggacctaccaatgcagacccagtgtgtttagccaagatgtattattccgccgtggatcccaccaaggacatcttcaccggtcttatcggccccatgaagatctgcaagaagggctcactgcacgcaaatgggcggcagaaggacgttgataaagaattttatctcttccccacagtgtttgacgagaacgaaagtctcctgctggaagataacatccggatgttcacaaccgcgcctgaccaggttgataaagaagatgaggatttccaggaaagcaacaaaatgcacagtatgaacggctttatgtacggtaatcaaccgggattaaccatgtgtaagggggatagcgtcgtgtggtatctcttctctgccggtaacgaagctgacgtacatggtatctacttctctggaaacacatatctgtggagaggggaaaggcgtgatacagccaacttgttcccgcaaacttcactcacactgcacatgtggccagataccgaaggaacattcaacgtcgagtgtctgactaccgaccattataccggcggtatgaaacagaaatatactgtaaaccaatgccgcaggcagagtgaagacagtaccttttatctcggggagaggacctattacattgcagctgtggaggtcgagtgggactactcccctcagcgagagtgggaaaaggagctgcatcatctgcaagagcagaacgttagtaacgcctttttggacaaaggcgagttttacatcgggtccaagtacaagaaggtagtctatcgtcaatatacagattcaacctttcgggtgcccgtagaaaggaaagccgaggaagagcacctgggtatattgggaccgcaattgcacgcagacgtgggtgataaggtcaagatcatctttaaaaacatggccaccagaccctatagtatccacgcccacggcgtgcagactgagagtagtaccgttacccccactcttcctggtgagactctaacatatgtttggaagataccagagcgcagtggagcaggcactgaggactcagcctgtattccttgggcatactattccacggtggaccaggtgaaagatctttacagcggactaattggacctctcattgtatgtcggcgaccctacctcaaggttttcaacccgagacggaaactggagttcgccctgctctttttggtcttcgacgagaatgagagctggtatctggatgacaacattaagacgtactcagatcatcctgagaaggttaacaaggacgatgaagagtttatcgagagtaataagatgcacgcgatcaacggaaggatgtttgggaacttgcagggactgacaatgcatgtcggcgacgaggtcaattggtatcttatgggaatggggaatgagatcgacctgcacacggtgcactttcacggtcactcctttcagtataagcaccgcggagtttatagttctgacgtttttgacatctttcccggcacttatcagacattggagatgttccctcggacacctggcatctggctcctgcattgccatgtaactgatcacatacacgccgggatggagactacctacacggtgcttcagaatgaggatacaaagagcggg

SEQ ID NO: 8564 - DNA, 3195 bp, Artificial Sequence
  Description of Artificial Sequence: Synthetic coding sequence
atgaagatcttgattctgggtatcttcctgttcctctgttcaaccccagcctgggctaaggaaaaacactactacatcgggattatcgagacgacctgggactacgcttccgaccacggtgaaaagaagttgataagcgtggataccgaacactcgaacatttatctgcagaacgggccggataggatcgggcgcctctacaagaaagcactgtacctgcagtacaccgatgagacttttcgcactaccattgagaagccggtctggctgggattcctcgggccaattatcaaagcagaaactggagataaagtctacgtgcatctgaaaaacctcgcatctcgcccttatactttccacagccacgggatcacgtactataaagaacacgagggcgctatctacccagataatacgactgattttcaacgggccgatgacaaggtgtacccgggcgaacagtacacttacatgcttctggcgaccgaggagcagtcaccgggagagggcgacggcaattgcgttactcgcatttaccattcacacatcgatgccccgaaggacatcgcttcggggcttatcggacccctgataatctgcaagaaggattccctcgacaaggaaaaggaaaagcatattgaccgggagttcgtggttatgtttagcgtggtggacgagaacttctcctggtacctcgaagataacatcaagacctattgctcagaaccagagaaagtcgataaggataacgaggactttcaagaatctaaccggatgtactcagtgaatggttatacctttggaagcctcccgggactgtcaatgtgcgccgaggatagagtgaagtggtacttgttcggcatgggtaacgaggtggatgtgcatgccgctttctttcacggacaggccctcacgaacaagaattatcggatcgataccatcaacctgtttccagcgacgctgtttgacgcctacatggtcgcccagaacccaggcgaatggatgctgtcatgccaaaacctcaaccacttgaaggcgggacttcaggccttttttcaagtccaagagtgcaataagtcctcgagcaaagacaacatccgcggaaagcatgttcggcactactacattgccgcagaggagatcatctggaactacgctcctagcggcattgacatctttaccaaggagaatctcactgcgccggggagcgactccgccgtctttttcgagcagggaacgacccgcatcggaggatcctacaagaagctcgtgtacagggagtacaccgacgcgtcattcactaaccggaaggaacggggaccggaagaggaacatcttggaatcctcggccccgtcatctgggcggaagtgggcgacactatccgggtcaccttccacaataagggagcctacccgctgtccatcgagccaatcggagtgcgcttcaataagaacaacgagggcacttactactctcccaattacaacccgcagtcacgctcggtgccaccgtcggcgtcgcatgtggcccctactgagacttttacctacgaatggaccgtgccgaaagaagtgggaccaaccaacgcggatccagtgtgtcttgccaagatgtattactcagcggtggatcctaccaaggacatcttcactggcctgatcgggcctatgaaaatctgcaaaaagggatctctgcatgcaaatggaaggcagaaggacgtggacaaggagttttacctgttccccacggtctttgacgaaaacgaatcacttctgctggaggacaatatcaggatgttcactaccgccccggaccaggtggataaggaggacgaagatttccaagaatccaacaaaatgcacagcatgaatggtttcatgtacggaaaccagcctggactgacgatgtgcaaaggcgactccgtggtgtggtacctcttttccgccggaaacgaagccgacgtgcacggaatttacttctcgggaaatacctacctctggaggggagagagacgcgacaccgcgaacctcttcccgcagaccagcctgactcttcacatgtggccagatacggaaggaacttttaacgtcgaatgcctgaccaccgaccattacactggcgggatgaaacaaaagtacaccgtcaatcagtgccggagacaaagcgaggatagcacgttctacctcggagaacggacttactacattgcggcggtcgaagtcgaatgggattactcgccccagagggaatgggagaaggagcttcaccatttgcaagagcaaaacgtcagcaacgcattcctcgacaagggtgaattctacattggctcgaagtacaaaaaagtggtgtaccgccagtacactgactccacttttcgcgtgccggtggagagaaaagctgaagaagaacatttgggtatactgggaccacagctgcacgctgatgtgggcgataaggtgaaaatcatcttcaagaatatggcgaccagaccttactcgatccacgcgcatggagtccagaccgaaagctccaccgtgactccgaccctgcctggcgagactcttacctacgtgtggaagatcccggagcgttcgggcgccggtactgaagattccgcatgcatcccttgggcgtactactcaacggtggaccaagtcaaagatctttactcgggattgatcggtccactgatcgtctgtagacgcccgtacctcaaggtctttaaccctcggagaaaactggagtttgccctcctgtttttggtgttcgacgagaacgaatcatggtatctggacgacaacattaagacttactccgaccatccggaaaaagtgaataaggatgacgaagagttcatcgaaagcaacaagatgcatgctatcaatggaagaatgttcggaaatctgcaaggtctgactatgcacgtcggggacgaagtcaattggtacctgatgggtatgggcaacgaaatcgacctgcacactgtgcactttcacggtcactccttccagtacaagcatcgtggagtctactcgtcggacgtgtttgacatttttccgggcacctaccagaccctcgaaatgtttcccagaaccccgggaatctggctgctgcactgtcacgttactgaccatatccacgccgggatggagactacttacaccgtgctgcagaacgaagatactaagtcggga

SEQ ID NO: 8565 - DNA, 3195 bp, Artificial Sequence
  Description of Artificial Sequence: Synthetic coding sequence
atgaaaatcttgatcctcgggatcttcctcttcctgtgctcgacccccgcttgggccaaggagaaacactactacataggaatcatcgagactacttgggactacgcatccgaccatggagagaagaaacttatttcggttgacactgaacactccaacatctacctccaaaacggcccagataggatcggacgcctctacaagaaggcactgtacctccaatacacggatgaaacctttaggaccaccatcgagaagccagtgtggctgggattcctgggtcccatcatcaaggcggaaaccggcgacaaagtgtatgtgcacctgaagaacctggccagccgtccttacaccttccattcgcacgggatcacctactacaaagaacatgaaggagctatctacccggataataccaccgatttccaacgggccgacgacaaggtgtaccccggtgaacagtacacctacatgcttttggccaccgaagagcagagcccgggagaaggtgatggcaactgcgtgacccggatctatcactcccacatcgacgcgccaaaggatatcgcatcggggcttatcggaccacttatcatctgtaagaaagactccttggacaaggagaaggagaagcatatcgatcgcgagttcgtggtcatgttctcggtggtggatgagaacttttcctggtacttggaagataacatcaagacttactgctcagagcccgaaaaggtggacaaagataacgaagattttcaagagagcaaccgcatgtacagcgtgaatggttacactttcggctctctcccgggcctcagcatgtgcgcggaggaccgcgtgaaatggtacctgttcggaatgggcaatgaagtggatgtgcacgccgccttctttcacgggcaggcattgactaacaaaaactaccgcatcgatactatcaacctgttccccgcaacccttttcgacgcgtacatggtggcacagaatccgggtgagtggatgctgtcgtgtcaaaatctgaatcatttgaaggcggggctgcaggccttcttccaggtccaggaatgcaacaagtccagttcgaaggacaatatcagagggaagcacgtccggcactactatatcgccgccgaggagatcatttggaattacgccccgtcggggatcgacatcttcacgaaggaaaatctgactgcgcccggaagcgacagcgcagtctttttcgaacagggtactacccgcatcggcggaagctacaagaagctggtgtacagagaatacacggacgcatcgttcaccaacagaaaagaacgcggtcctgaagaggaacaccttggtatcttgggaccggtgatctgggcagaagtgggcgataccatcagagtgacgttccataacaagggggcctacccactgagcatcgaacctatcggtgtgcgcttcaataagaacaacgaaggaacgtactactcaccaaactacaacccacagtcgcgcagcgtgccgccatcggcctcacatgtggcaccgaccgaaaccttcacctacgagtggacggtgccgaaagaagtgggtccaactaacgccgatccggtgtgtctggcaaagatgtactatagcgcggtggaccccaccaaggatatcttcacgggcctgatcggaccaatgaagatctgcaagaagggatccttgcacgccaatgggaggcagaaagacgtggacaaggaattctatctcttcccgacggtgttcgatgaaaacgaatctctgctgcttgaggacaatattcggatgttcaccaccgccccggaccaagtggataaagaggacgaggatttccaggagtccaacaagatgcattcgatgaacggattcatgtacggcaaccaaccgggactcaccatgtgcaagggagattccgtggtgtggtacctcttctcggcaggaaacgaggccgacgtccatggaatctacttttccggcaatacctacctgtggcggggagaacggagagataccgctaatctcttcccccagacctcgctcaccctccacatgtggccggacactgaaggaactttcaacgtggagtgtctgactactgaccactacaccggaggtatgaaacagaagtacaccgtgaaccagtgccgccgccaatctgaagattccactttctacctcggcgaaagaacgtactacatcgcggcggtcgaggtcgagtgggactactcgccgcagagggagtgggaaaaagaactgcatcatctccaagagcaaaatgtgtcgaacgcttttctggataagggagaattctatattggtagcaagtacaaaaaggttgtctaccgccagtacactgactcaacctttcgggtgccagtggaacgcaaggcagaagaagagcacctgggaatcctgggaccccagctgcacgccgacgtgggagacaaagttaagatcatcttcaagaatatggcgacccggccgtacagcatccacgcgcatggagtgcagactgaatccagcactgtcaccccgactctgccgggtgaaaccttgacttacgtgtggaagatccctgaaagatcaggagcgggcaccgaggactcagcgtgtatcccgtgggcgtactactcaactgtggatcaggtcaaagatctgtactccggacttatcggtccgctcatcgtgtgccggcgaccgtacctgaaagtctttaatccaagacgcaaactggaatttgctctgcttttcctcgtctttgacgaaaatgagtcctggtacctggatgataacattaagacttacagcgatcatccggagaaggtcaacaaggatgacgaagagttcattgagtctaataagatgcatgctatcaacggaagaatgttcggaaatcttcagggactgacgatgcacgtgggagacgaggtgaattggtacctcatgggcatgggtaatgaaatcgatctgcatacggtccacttccacgggcactcctttcagtacaagcatcgcggggtgtacagcagcgacgtgttcgacatttttccgggaacctaccagaccctggagatgttccccagaactccagggatctggctcctgcattgccacgtgactgaccatatccacgccggcatggaaactacctacaccgtgctgcagaacgaggacaccaaaagcgga

SEQ ID NO: 8566 - DNA, 3195 bp, Artificial Sequence
  Description of Artificial Sequence: Synthetic coding sequence
atgaagatcctgattttgggaattttcctgtttctatgtagtacaccggcctgggctaaggaaaagcattattatatagggattattgagacgacttgggattacgcctctgaccacggcgagaaaaagctaatctccgtggacaccgaacattcgaacatctacttgcagaatgggcccgatcgcatcggccgcctgtacaagaaggcactgtacttacagtatactgatgagacctttaggactactatagagaagccagtgtggctgggattcctgggtcccattattaaagctgaaacaggggacaaagtgtacgtccacctgaaaaacctcgctagcagaccgtacacatttcacagccacggaattacgtactataaggagcacgaaggggcgatctaccccgacaatacgacagactttcagcgcgcagacgacaaggtctatcccggggagcagtacacttacatgctcttagccaccgaggaacagtcaccaggtgagggagatggcaattgcgtgactaggatttatcactcccatattgacgcacccaaggacatcgctagtggtttgatcggacccctgattatctgtaaaaaggactcactggataaagaaaaagagaaacacatagatagagaatttgtcgtcatgttctccgtggtcgatgagaacttctcgtggtacttggaggataatatcaaaacctactgctcggaacctgagaaggtggacaaagacaacgaagatttccaagaatcaaatcgcatgtactccgtgaacgggtacacctttgggtctcttcctgggctctccatgtgcgcagaggatcgggtaaaatggtacctattcggtatgggcaatgaagtcgatgttcacgcagccttctttcatggtcaggcactgaccaataagaattacagaatcgatacaatcaatctctttcctgcaactctctttgatgcttatatggtggcccagaatcccggtgaatggatgttgtcatgccagaacctaaatcaccttaaagctggcctgcaggctttcttccaggtgcaagagtgcaacaaaagctctagcaaagacaatattcgaggcaaacacgtgcggcactactacattgctgccgaagagattatctggaattacgcgccgagtggtatcgacatttttaccaaagaaaaccttaccgcacccggatctgactctgccgtgttttttgagcaaggtaccactagaatcggaggatcctacaagaagctggtatacagggagtacactgatgcttctttcacaaacaggaaggaaagggggcccgaggaggagcatctgggaatcttaggtcccgtgatttgggcggaggtcggcgacaccatcagagtgacatttcacaataaaggggcctaccctttatctatagaacccatcggtgtgcgctttaacaagaacaatgaggggacatactacagccctaattacaacccacagtcacgtagcgtacctccctccgcgtcgcatgtggcaccaaccgagacctttacctacgaatggaccgtgcctaaggaagtggggcccactaatgcagaccccgtgtgcttggcaaagatgtactattccgccgtggaccctaccaaggatatatttaccggactgatcggcccaatgaagatttgcaagaaaggcagcctgcacgcaaacggaagacagaaggatgtagacaaagaattctacttgtttcccacagttttcgatgaaaacgagagtttgctgcttgaagacaatattcgcatgttcactactgcccccgaccaggtggataaggaggacgaggatttccaggagtcaaacaaaatgcatagcatgaatggctttatgtatggtaatcagccagggctcacaatgtgcaagggtgattctgtggtgtggtaccttttctctgcggggaatgaagccgacgtgcacggaatatacttctctggcaatacctacttgtggcggggcgagaggcgtgacaccgccaacttattccctcagaccagcctgactctgcatatgtggcccgatacagagggcaccttcaatgtggagtgcctgaccacagatcattataccggcggcatgaaacagaaatacactgttaaccagtgcagaaggcagtcagaggacagcacattttatttgggcgagcggacttattatattgccgccgtagaagtggaatgggactactctccgcagagagagtgggagaaggagctgcatcatttgcaagaacagaatgtctcgaacgcattcctggacaagggggaattctatatcggctccaaatacaagaaggtggtgtaccgacagtacactgattccaccttcagagttcctgtggagcgcaaggccgaggaggaacatctgggaattctgggtccccaactgcatgctgacgttggagacaaggttaagattatatttaagaatatggcgactagaccttactccatacacgctcacggggtccagaccgaatcttccacagttactccaactcttccaggcgagacactgacgtatgtgtggaagattcctgagagatcaggcgccggcacagaagatagtgcatgtatcccttgggcatactatagtacagtagatcaggtgaaggatctatatagcggccttatcggacccctgattgtttgcaggcggccttaccttaaagtattcaatccaaggcgaaagctcgagtttgctctgctatttctggttttcgatgaaaatgagagttggtacttagacgataacatcaagacttactctgaccaccccgagaaggtgaataaagacgatgaagagtttatcgagagcaataaaatgcatgcaatcaatggccggatgttcggcaaccttcaggggctcacgatgcatgtgggcgacgaagtcaattggtacttgatgggaatgggaaacgaaattgacctccacaccgtgcacttccatggtcacagcttccagtacaagcatcgcggtgtgtattcctcagacgtgttcgatatcttcccagggacttatcagacactggagatgttcccccggacccctggaatatggctcctgcactgccacgtgaccgatcacatccacgctggcatggagactacatataccgtgttgcaaaacgaagatacaaaaagtggc

SEQ ID NO: 8567 - DNA, 3195 bp, Artificial Sequence
  Description of Artificial Sequence: Synthetic coding sequence
atgaaaatcttgattcttgggatcttcctgttcctgtgctcaacccctgcatgggccaaggaaaaacactattatattggaatcatcgagacgacatgggactatgccagtgaccacggcgagaaaaagcttatctccgtagacacagagcacagcaacatctaccttcaaaacggccctgacagaatcggccgactgtacaagaaggccctttacctgcagtatacagatgaaactttccggaccactatcgaaaagcccgtctggctgggatttttgggaccgattatcaaagctgaaactggggacaaggtgtacgtgcacctgaaaaacctcgctagtcgcccatacaccttccattcccacggtattacatactacaaggagcacgaaggggcgatttatcccgataacaccaccgactttcagcgggccgacgataaggtataccccggcgaacagtacacctatatgctgttggctacggaggagcagtcccctggggaaggagacggcaactgtgttactaggatttaccacagtcacatcgatgctccaaaggacattgcgtctgggctgattggacccctgattatatgcaagaaggatagcctggataaggagaaggaaaaacatattgacagagagtttgttgttatgttctctgtggtggacgagaactttagctggtatctggaagacaatatcaaaacgtattgtagcgaacccgagaaagtggataaagataatgaggacttccaagagagcaacaggatgtacagtgtaaacggctatacctttggtagcctgcctggtctctcaatgtgcgccgaggacagagtcaaatggtatctcttcggaatgggcaacgaagtggacgtacatgcagcgtttttccacggtcaggcgctgacaaacaaaaactataggattgacacaattaacctgttccccgcaaccttgtttgacgcttatatggttgcccagaaccctggcgaatggatgctgtcctgtcagaatctgaatcatctcaaggccgggctgcaggctttcttccaagtgcaagagtgcaataaatcttctagcaaagataatataaggggcaaacatgtccggcactactatatcgcggccgaggaaatcatctggaactacgccccctccggcatagacatatttaccaaagaaaatttgactgcgccggggtctgatagcgctgtctttttcgagcaaggcactacccggatcggagggtcttacaagaagctggtgtaccgggaatatacggacgcttccttcaccaacaggaaggaacggggacccgaggaggaacatctgggcatcttgggtcccgttatatgggctgaagtaggtgatacaattcgagttaccttccacaacaagggcgcctatcccctctccatagagccgatcggcgtgaggttcaacaaaaataacgaaggaacttactactctccaaactacaatcctcagagccggtccgtgccacctagtgcctcccatgtcgcccctacagagacatttacgtatgagtggaccgtacccaaggaagtggggccaaccaatgctgatcccgtgtgcctggccaaaatgtactacagtgccgtcgatcctaccaaggacatcttcacagggttgatcggaccaatgaagatttgcaagaaggggtcactgcatgccaacggacggcagaaggatgtcgataaagagttctatctgttcccgacagtgttcgatgagaacgagtctcttctgttggaggataatattcggatgttcacaacagctccggaccaagtggacaaggaggatgaggactttcaagagtctaataagatgcatagcatgaatggcttcatgtacggaaatcagccgggcctgaccatgtgcaaaggagactcagttgtgtggtaccttttcagcgccggcaacgaagctgacgtccatggaatatacttttcagggaacacttacctttggcggggagaaagaagagatactgcaaatctgttcccacagaccagtttgacacttcacatgtggccagacacagaaggcaccttcaacgtggaatgcctcaccacggatcactatacaggcggaatgaagcagaagtatacagtaaatcaatgtcgaaggcagtctgaagattccactttctacctcggcgagcgaacgtattatatagccgcggtggaggtcgagtgggattactctccccaacgggagtgggagaaggaactgcaccaccttcaggagcagaacgtaagcaacgcgtttttggacaagggcgagttctacattggtagcaaatacaagaaggtggtgtaccgccagtacaccgacagtacatttcgggttccagtggagcgaaaggccgaagaggagcacctcggcatcctcgggccccagctgcatgccgatgtaggggataaggtcaagattatcttcaagaatatggccacgaggccttatagtatccatgcccacggcgttcaaacagagtcatctaccgttacgcccacacttccaggcgaaacattgacatatgtctggaaaatcccggagcgctcaggcgctggcaccgaggactcagcatgtatcccttgggcctactacagtacggtggaccaagtaaaggacctgtacagtggcctgatcggtcctctgattgtttgcaggcgaccctacctgaaagtattcaaccctagaaggaagctcgagttcgctctgctgttcttggtattcgacgagaatgaatcttggtacctggacgacaatattaagacatatagtgaccaccccgaaaaggtaaacaaggacgacgaggaatttatcgaatctaataagatgcatgcaattaacggaaggatgtttggaaacctccaaggtcttacgatgcacgtgggggatgaagtcaattggtatctcatgggtatgggcaacgagatcgaccttcatactgttcattttcatggccactcttttcagtacaaacatcggggagtgtattcaagtgatgtctttgacattttcccgggaacttatcagactctcgagatgttcccaagaacgcctggcatatggttgctccactgccacgttactgaccatattcatgcgggcatggaaaccacctatacagtgctgcaaaacgaagacacaaagtccggc

SEQ ID NO: 8568 - DNA, 3195 bp, Artificial Sequence
  Description of Artificial Sequence: Synthetic coding sequence
atgaagattttgatcctagggatcttcttatttctttgctccactccagcatgggccaaggaaaagcattactatattggcattatcgagaccacctgggattatgccagtgatcacggagagaagaagttaatttccgtagatactgaacactcaaatatatatctgcagaacggccccgatcgcataggcaggctgtataaaaaagcattgtacctgcagtatacggacgaaacattcaggacaaccatcgagaagccggtgtggctcggttttctcggtccgatcatcaaggccgagaccggagacaaggtgtatgtacatctcaagaatttggcctctagaccctatacgtttcactctcacggcataacctattataaggagcatgagggagctatctatcctgataatacgactgattttcagagggctgatgataaagtgtatccaggtgaacaatacacttatatgttacttgcaactgaagaacagagccctggcgagggagacggaaattgcgtgacccgaatctaccacagccatatcgatgcaccaaaagacatcgcaagcgggctgattggacccttaattatttgcaagaaagacagcctggataaagagaaagagaaacacatcgatcgagagttcgtggtgatgttttcggtagtggatgagaactttagttggtacctggaagacaatattaagacttattgcagcgaacccgaaaaagtggataaggacaatgaggatttccaggagagtaatagaatgtatagcgttaacgggtacaccttcgggtcactgcctgggctcagcatgtgcgctgaggaccgcgtgaaatggtacttattcgggatgggaaacgaagtagatgttcacgcagcgttcttccacggacaggcattaacgaataaaaactaccggattgatactattaacttatttcctgcgacactgtttgacgcatatatggtagcacaaaacccgggggagtggatgttgagctgtcagaatctcaaccacttaaaggccggattgcaggctttcttccaggtgcaagaatgtaataagtcttcctcaaaagacaatattagggggaagcacgtccgacactattatatagcggctgaggagatcatatggaattatgccccgagtggtatcgacatctttactaaggagaatcttactgcacctggttctgacagcgctgtgttctttgagcagggcaccaccagaattggcgggtcctataaaaagttagtgtatcgcgaatataccgatgcctccttcacaaacaggaaagaaagaggccccgaagaagagcacctcggcattctcggaccagtcatttgggctgaggtcggggacacgatcagggtcactttccataataaaggagcatatccactgtccatagaaccaatcggggtgaggttcaataagaacaatgaaggtacgtactactctcccaattacaaccctcagagcagaagtgtcccgccatctgctagccatgtcgctccgaccgaaacgttcacttatgagtggacggtgcccaaagaggttggacctaccaacgctgaccctgtctgtttggccaagatgtactacagtgccgtggatccaactaaagacatcttcacaggactaatcggaccaatgaaaatctgtaagaagggctcactccatgcaaatggccgacagaaagacgtcgacaaggaattttatctctttcctacggtgtttgacgagaacgaatccttactgcttgaggacaacatccgaatgttcactacagcccccgaccaggtcgataaggaagatgaagattttcaggaaagcaataaaatgcatagcatgaacggctttatgtacggcaatcagcctgggctaacaatgtgcaagggcgactctgttgtgtggtacttgttctcagcgggtaacgaggcagatgtgcatggtatatacttttcaggaaatacatatctgtggagaggggaaagacgcgacacagccaatttgttcccccagaccagtcttacgctgcatatgtggcctgacacagaagggacattcaacgtagaatgtctgacaaccgatcattacaccggcgggatgaaacagaagtataccgtgaaccagtgtcgacgacagtctgaagacagcactttttacctcggggagcgaacatactatatcgccgcggtggaggtagaatgggattacagtccgcagcgtgagtgggagaaagaacttcaccatttgcaggagcagaacgtatcaaacgccttcctggacaaaggagagttctacatcgggtccaaatacaaaaaggttgtctacaggcagtacactgattctacgttccgagttcctgtagagcgaaaagctgaggaggaacacctcggcattctgggtccccagcttcacgcagatgtgggcgataaagtcaagataatattcaaaaacatggcaacccgaccatatagcattcacgctcatggtgtgcagactgagtcatcaaccgtgacgcctaccctccccggagaaacactcacctatgtttggaagattccagaaaggagcggcgccggaactgaggattcagcgtgtattccctgggcctactactctaccgtggatcaagtgaaggacttgtatagtggactgattggtccactgattgtctgccgcaggccctacctgaaggtattcaatcctaggcgaaagctggaattcgctctcctgttcttagtgtttgacgaaaatgagagctggtacctagatgacaacataaaaacatactccgaccacccagagaaggtgaataaagacgatgaagaattcattgagagtaacaagatgcacgccataaacgggagaatgtttggtaaccttcagggattgacaatgcatgtgggggacgaggtgaattggtacttgatgggcatgggcaatgagattgatctgcacactgtgcactttcacggccacagcttccagtacaagcaccgtggtgtgtactccagcgatgtgttcgatatttttccaggaacctaccaaaccttggaaatgttccctagaacacctgggatatggctgctgcactgtcacgtcacagaccatattcacgctggaatggaaacaacttacacggtgttgcagaatgaggataccaaatccggg

SEQ ID NO: 8569 - DNA, 3195 bp, Artificial Sequence
  Description of Artificial Sequence: Synthetic coding sequence
atgaaaattctgatcttgggcatctttttgttcctttgcagtacgccggcctgggccaaggaaaagcactactacattggcattattgaaacaacttgggattacgcgtcggaccacggggaaaaaaagctcatctccgtcgacaccgagcacagcaacatctacctccagaacggcccggaccggatcggccgcttgtataaaaaggcgctgtatctgcagtacacggacgagaccttccgcactaccatagagaaacccgtatggctgggctttctggggccgattataaaagcggaaacgggtgacaaagtttatgtacacctgaaaaatctggcgagccgtccatataccttccactcccacggtattacctactacaaagagcatgagggtgctatttatccggataacacgaccgactttcaacgtgcggacgataaggtgtacccgggggagcagtacacttatatgctgctagcaaccgaagaacagagcccgggtgaaggggacggtaactgcgtgactcgcatctaccactctcacattgacgcgcctaaggatatagctagcgggcttatcggtccattaatcatctgtaagaaggattccctggacaaagaaaaggagaagcacattgatcgggaattcgttgtcatgttctctgttgtggacgaaaatttctcttggtatctggaggacaacatcaaaacatactgtagcgaaccagaaaaggtcgataaagataatgaggactttcaggagtcaaaccggatgtattcagtgaatggttataccttcggctccctgcccgggttaagcatgtgcgccgaagaccgggttaaatggtatctttttggtatggggaacgaggttgacgtccatgccgcgttctttcatggtcaggcactgaccaacaagaattatcggatcgacactatcaatttgttcccggcgaccctgttcgatgcttatatggtggcacagaatcccggcgagtggatgctgagctgccagaatctgaaccacctgaaggcgggtctgcaagccttcttccaggtgcaggagtgcaataagagctccagcaaagataatatacgtgggaaacacgtaaggcactactatattgctgcagaagagattatctggaattacgcgccgtccgggatcgatattttcaccaaagagaatctgacagcgcctggttccgacagcgctgtgttttttgagcagggcactacccgtatcggcggcagttataagaaactggtttatcgcgagtacacagacgccagctttactaaccgcaaggagcgaggcccagaagaggagcatctcggaattctgggaccggtcatatgggcagaagtgggtgacactattcgtgtcacctttcacaataagggcgcgtaccctctcagcatagagcctattggtgtacgtttcaacaaaaataacgagggcacctactacagcccaaactacaacccccaatcccgctccgttccgccgagcgcgagccatgtcgccccaaccgagaccttcacctacgaatggaccgtgccaaaagaagtgggtccaaccaatgcggatccagtttgcctggcaaagatgtactatagcgcggttgacccaactaaggatatcttcactggccttattgggcctatgaagatatgcaagaaagggtcactgcacgccaacggtaggcagaaagatgtggacaaggagttttatctgttccctaccgtgtttgatgagaacgagagccttcttctggaggataatattagaatgttcaccacagccccagatcaagtcgacaaagaagatgaggattttcaggagtctaataagatgcatagcatgaacggattcatgtatggcaaccagcctggcctgactatgtgtaagggtgatagcgtcgtgtggtacctgttcagcgcaggcaacgaagctgatgttcacggcatctatttctccggtaacacctatctttggcgcggggagcgtcgtgatactgcaaatctgtttccgcagacgagcctaacgcttcacatgtggccggacactgaaggtacctttaatgtggaatgcctgacgactgaccattacaccggcggcatgaagcagaaatataccgtgaatcaatgccgtcgtcaaagtgaggacagcaccttctacctcggcgaacgcacctactacattgccgctgttgaagttgagtgggattatagccctcagcgggagtgggagaaagagctacaccacttgcaggagcagaatgtctctaatgcattcctggataaaggcgaattttatatcggttctaagtacaaaaaggttgtctacaggcagtacacagattccaccttccgcgtccctgtagaacgtaaagcggaggaagagcacctgggtattctgggcccgcagttgcatgcggatgtaggggacaaggtgaagatcattttcaagaacatggcaacccgtccatacagcattcacgctcacggtgtgcagaccgaatcttccactgttaccccaactttgcctggcgagaccttgacatatgtgtggaaaatacctgaacgcagcggtgcaggaaccgaggacagcgcctgcatcccgtgggcctattatagcaccgtagatcaagtgaaagacttgtacagcggccttattgggccgctgattgtgtgcagaaggccatatctgaaagttttcaacccacgccgcaagctggaatttgcgctgctcttcttggtttttgacgaaaacgagtcctggtatctggatgataatattaagacctacagcgatcacccggagaaagttaataaggacgacgaggagtttattgaaagcaataaaatgcatgccatcaatggtcgcatgttcggcaacctgcagggcctgaccatgcacgtgggagacgaggtcaattggtacctgatgggtatgggtaatgagatcgacctgcatacggttcacttccacgggcatagtttccagtataaacatcgcggcgtctactccagcgatgtctttgatatcttccctgggacttaccaaaccctcgagatgtttccgcgtaccccaggaatttggctgctccactgccatgttacggatcatatacatgcgggcatggagacgacctataccgttctgcagaacgaggacactaagtctggt

SEQ ID NO: 8570 - DNA, 3195 bp, Artificial Sequence
  Description of Artificial Sequence: Synthetic coding sequence
atgaaaatcctgattctagggatcttcctattcttatgttctacacctgcgtgggccaaagagaaacactattacatcgggataatagaaacgacatgggactatgcctctgaccacggggaaaaaaaacttatttccgttgatacagaacatagtaacatatatttgcagaacgggcctgatcgtattggacgactgtataaaaaggccttatacttacagtatacagatgaaacttttagaactactatcgagaaacccgtttggctggggtttctgggaccaatcatcaaagccgaaacaggagataaagtgtatgtccacctgaaaaatctggcatctcggccatatacattccattcccatggaattacttattacaaagaacatgaaggagccatatatcctgacaacacaacagacttccagcgcgccgatgataaagtttaccccggagagcagtatacatacatgctattagcaacagaagaacaatcacctggagagggggacggaaactgcgtaacgaggatctatcactcccatatcgatgctccaaaagatatagcttctgggctgattggacccctgattatatgcaaaaaagattctctggacaaagaaaaagagaaacatattgatcgggagtttgtagttatgttcagtgttgtagatgagaatttttcctggtatctggaggataatatcaagacttattgctctgaacccgagaaagtcgataaggataacgaagatttccaggaatcgaaccggatgtattcagtgaatggatatacttttggatcattgccagggctcagtatgtgtgcagaggatagagtaaaatggtacctctttggaatgggaaatgaagtggatgttcatgctgccttctttcacggacaggctctaacaaacaaaaattatcgcattgatactatcaacctgttccccgcaacacttttcgatgcctacatggtggcacagaatccaggagagtggatgctctcttgccaaaatctcaaccatctcaaggctggactccaggcttttttccaggtccaggaatgcaacaaatcctcttcgaaggataatatacgtgggaaacatgtgcggcactattacatagcagctgaagagatcatatggaactacgccccatctgggatagatatatttactaaagaaaacctgactgcccccggatccgattctgccgtgttcttcgagcagggaactacaaggattggagggtcttacaaaaaactcgtgtatcgggaatatacggatgcttcctttactaaccgcaaagaaaggggaccagaggaagaacacctgggaatactcggacctgtaatttgggccgaggtgggagatacgatcagagtgacattccacaataaaggggcctaccctctttcaatagaacctatcggagtaagattcaataaaaacaatgaggggacttattactctcccaattataatcctcagtcacgatccgtgcctccaagtgctagtcacgtggcccccactgagacttttacatatgaatggacagtgcctaaagaagtggggcccacaaatgcagatcccgtttgtcttgccaagatgtactattctgcagtggatcctacaaaagatatcttcactgggcttatcggacctatgaagatatgtaaaaaaggatcactgcacgccaacggacgacagaaagatgttgataaagaattctatctatttcctacagtattcgatgaaaatgaaagtctactactggaagataacatacgaatgttcactactgcccccgatcaggtagataaagaagatgaggatttccaggaatcaaataagatgcattctatgaacgggtttatgtatggaaatcagcctgggttgactatgtgcaagggagattcagtcgtctggtatctattctctgcggggaatgaagctgatgtacatgggatatatttttcggggaacacatatctttggcgcggggagagacgcgatacagccaatctcttccctcagacatccttaactctgcacatgtggcccgatactgaagggacattcaatgtggaatgtctcactactgatcattacacagggggaatgaaacagaaatatactgttaatcagtgtcgcaggcagtctgaggacagtacgttctacttgggagaaaggacttactacattgcagctgtggaagttgagtgggattattctccccagcgggaatgggaaaaggaattacaccatttgcaggaacagaacgtgtccaacgccttcctcgataagggggaattctatatcggatccaaatataaaaaggtggtttacagacagtatacagactctacattcagggtaccagtggaacggaaagccgaagaagaacatcttgggatccttggaccacagctccacgccgatgtcggggataaagtaaaaatcatattcaaaaatatggcaacacgaccatattctattcatgcacacggggttcagactgaatcctcaactgtgacaccaactctacctggagaaacactaacttacgtttggaaaataccagagcggtctggggccggaacagaagatagtgcctgtataccgtgggcatattactcaacagtcgatcaggtgaaagatctctattcagggttaatcggaccgctaatagtttgcaggcggccctatctcaaagtgtttaatccccggagaaaactcgaatttgcacttctcttcttagtgtttgatgaaaatgaatcttggtacctggatgacaatattaaaacatattctgatcaccctgaaaaagtcaataaagacgatgaagaattcatagaatctaacaaaatgcacgcaataaatggaagaatgttcggaaatctccaggggttgacaatgcatgttggggatgaagtaaattggtatctgatgggaatgggaaacgaaatcgatctacacacggtgcacttccacggacacagttttcagtataaacatcgcggggtatattccagtgatgtgtttgacatatttcccgggacatatcagacactagaaatgttcccgagaacaccaggaatctggctcctccactgtcatgtgacagatcatatacacgccggaatggaaacaacttatacagtgctgcagaatgaggatactaagtccgga

SEQ ID NO: 8571 - DNA, 3195 bp, Artificial Sequence
  Description of Artificial Sequence: Synthetic coding sequence
atgaagatccttatccttggaattttcctctttctctgttcgaccccagcctgggctaaggagaagcactattacatcggcatcatcgaaaccacctgggattacgcctcagaccacggcgaaaagaagctgatcagcgtcgacactgaacactccaacatctacttgcaaaatggaccggaccggatcgggcgcctctataagaaagctctttatctgcagtacaccgatgagactttccgaactaccatcgaaaaaccggtgtggctcggttttctggggccgatcattaaggccgaaacgggcgacaaagtgtatgttcatctgaaaaacctcgcctccagaccatacactttccactcgcatggaataacctactacaaagaacacgagggagcgatatacccagacaacactactgattttcagagggccgatgacaaggtgtaccctggtgagcaatacacctatatgttgcttgccaccgaggaacagtcgccaggagaaggcgacgggaattgcgtcactcgcatttaccactcgcacattgacgctcctaaagatatcgcctccggcttgatcggacctctcatcatttgtaagaaagattccctggataaagaaaaggaaaagcatatcgatcgcgaatttgtggtgatgtttagcgtcgtggacgagaacttctcctggtatctggaggataacatcaaaacctattgctccgagccggaaaaggtcgacaaggacaatgaggactttcaagagtcaaaccgcatgtactccgtcaacggatacacgttcggatccctgcccgggttgtctatgtgcgcggaggacagggtgaagtggtaccttttcggaatgggcaacgaagtcgatgtgcacgcagccttcttccacggtcaggcactcactaacaagaattacaggatcgatactatcaatctgttcccggcgactctgttcgacgcctacatggtggctcagaaccccggagagtggatgctctcctgccagaacttgaaccatctgaaggcggggttgcaagcattcttccaagtccaggaatgtaacaagagctcaagcaaagacaacatacggggaaagcatgtgcggcactactacatcgcagccgaggaaatcatctggaattacgccccctcgggaatagacatattcacgaaagaaaatctcaccgcgccaggatcagactctgcggtgttctttgaacaaggaactactagaatcggagggtcctacaagaaactcgtgtaccgggaatacaccgacgcgagcttcaccaatcggaaagagcggggcccggaggaggaacatctgggaattctgggacccgtgatctgggccgaggtcggagacaccatcagagtgacgttccacaacaagggggcatacccgctgagcatcgaaccgattggcgtccggttcaacaagaacaatgaggggacctactattcgcctaactacaatccacagagcagatctgtgccgccgagcgcctcgcacgtggcgccgaccgagacgttcacctacgaatggactgtgcctaaagaagtgggtcccaccaacgccgatcccgtctgcctcgccaaaatgtactactccgccgtggacccaacgaaggatatctttactggtctgatcggaccgatgaagatttgcaagaagggaagcctgcacgctaacggaaggcagaaggatgtggataaagagttctacctgtttcctaccgtgtttgatgagaatgagtccctgctgcttgaagataacatccgaatgttcaccaccgctcctgaccaagtcgacaaggaggacgaggacttccaagaatcgaacaaaatgcattccatgaatgggttcatgtacggaaatcaacctggtttgactatgtgcaagggtgattcggtggtctggtacctgttctcagccggtaacgaggccgacgtccacggaatttacttctcgggcaacacctatctctggcggggagaaagacgggacacggccaacctcttccctcagactagcctcactctgcatatgtggccggacaccgaaggcaccttcaacgtcgagtgcctgactaccgatcactacaccggaggtatgaagcagaagtacactgttaatcagtgccgcagacaatcagaggattcgaccttctacttgggcgagcgaacttactatatcgcggctgtggaagtggagtgggactactccccacaaagagagtgggaaaaggaactccaccatctgcaagaacagaacgtgtctaatgcattcctggataagggagaattctacattggttcaaagtacaaaaaggttgtgtaccggcagtacacggacagcaccttccgggtcccggtggaacgcaaggcagaagaagaacatttgggcatcctgggtccccagctgcatgcggacgtgggagacaaggttaagatcatcttcaagaatatggcaactcgcccctactcgatccacgcccacggcgtccagaccgaaagcagcaccgtgactccgaccctcccgggagaaaccctgacttatgtgtggaagattccagaaaggtccggagcaggaaccgaggactcagcttgcatcccgtgggcctattactcgactgtggaccaggtgaaggatctgtactcgggactgatcggcccgttgattgtgtgccgccggccttacctcaaagtctttaacccgaggcggaagctcgagttcgctctcctgttcctggtttttgacgaaaacgagtcatggtacctggatgacaatatcaaaacctactccgaccacccggagaaggtgaataaggacgacgaagaattcatcgagtcaaacaaaatgcacgcgatcaacgggagaatgttcggaaatctgcaagggcttactatgcacgtgggagacgaggttaactggtacctcatgggaatgggaaacgaaatcgatctgcacactgtccactttcatggccactcgttccagtacaagcatcgcggggtgtactcgtcggacgtgttcgacatctttccgggaacctaccagacgctggaaatgtttccgcgcactcccggaatctggctcctgcactgtcatgtcactgatcacatccatgccgggatggaaactacctacaccgtgctgcagaatgaggataccaagagcggc

SEQ ID NO: 8572 - DNA, 3195 bp, Artificial Sequence
  Description of Artificial Sequence: Synthetic coding sequence
atgaagattctaattcttggaatctttttgttcctgtgttccacccctgcctgggcaaaggaaaaacattattatatcggaataattgaaaccacctgggattatgcctcagatcacggtgaaaaaaagctaatctcagtcgacacagaacactcaaacatctaccttcaaaatggacctgatcgtattggtagactctacaaaaaagctttgtaccttcaatatactgatgaaacattccgaacaactattgaaaaaccagtttggctgggatttcttggacctattattaaagctgaaactggagacaaagtgtatgttcatttgaaaaaccttgcaagcagaccctatactttccatagccatggaattacttattataaggaacacgaaggagctatctacccagataacactacagatttccagagagcggacgataaagtgtatcctggagagcaatacacttacatgcttctggctacagaggaacaatcgccgggagaaggtgatggaaattgcgttacaagaatctatcatagtcatattgacgcaccgaaggatatagcgtctggacttatcggaccactgatcatctgcaagaaggattctcttgataaagagaaagaaaagcacatagatcgtgaatttgtggttatgttctccgtcgtagacgagaattttagttggtacttagaagataatataaaaacatattgtagcgagcctgaaaaagttgataaggataatgaagattttcaagagtcaaatcgaatgtattcggtgaatggatatacttttgggagtttgccaggactttccatgtgtgctgaggaccgtgttaagtggtatctctttggaatgggaaatgaagtcgatgttcatgctgctttcttccacggacaagctttaacgaacaagaactatcgtattgatactatcaatctcttccctgctactttgtttgacgcttacatggtcgcacaaaatcccggagaatggatgttgtcatgccagaatcttaatcacttgaaggctggtcttcaggccttctttcaagtccaggagtgtaataaatcatcaagtaaggataatattcgaggaaaacacgtgcgacattactacatagcagctgaagaaattatatggaactatgcaccatcaggaatcgatattttcactaaggagaatttgacggcaccgggatctgattcagctgtcttctttgagcaaggaactacccgaattggtggtagctacaaaaagctcgtttatcgagaatatactgatgcaagtttcactaatagaaaagaaaggggtccagaagaggagcaccttggaattctgggaccagttatttgggccgaagttggtgatacaatccgcgtgacatttcataacaaaggagcatacccgctttctatcgaaccgatcggagtaagattcaataaaaataatgagggaacttactattctccaaattataacccacagtctagatctgtgccaccatctgcgtcccacgtagccccaacagagacgtttacgtacgaatggaccgttcccaaagaggtgggcccaacaaacgccgacccggtttgtttggcaaaaatgtattactctgcagtcgatccaactaaggacatatttactggacttataggtccgatgaagatctgtaaaaagggtagtctgcatgccaacggacgtcaaaaggatgtggataaagaattttacctttttcctactgtcttcgatgagaatgaatctctacttttagaagataacataaggatgtttactacagcccctgatcaggttgataaagaagatgaagattttcaagaaagtaacaagatgcacagtatgaatggtttcatgtacggaaatcaaccaggtctgactatgtgtaaaggagatagtgtagtatggtatctgtttagcgctggaaatgaagcggatgttcatggaatttattttagcggtaatacatatctgtggcggggtgagaggcgcgatacggccaatctgtttccgcaaacatctctgactttgcatatgtggccagatactgagggcactttcaatgttgagtgccttaccacagatcattacacaggaggtatgaaacagaagtatacagtgaatcagtgtagacgacaatcagaagattcgactttctacttgggtgaaagaacctattacattgcagctgtggaagtcgagtgggactattccccacagcgagagtgggaaaaggaactacatcatctacaagaacagaatgtgtccaacgcgttcttggataaaggggagttctacatcggttcaaaatataaaaaagttgtctaccgtcaatacactgattctaccttccgcgttccagttgaacgtaaggctgaagaggaacaccttggaattcttggaccccagctgcatgctgatgtaggagataaggtgaaaattatctttaaaaacatggctacacgtccgtattccattcatgcacatggggttcaaacagaatcgtcaactgttacaccgaccctgccaggagaaacattgacgtatgtttggaaaatcccggaaaggtccggagccggcacagaggattctgcttgtatcccttgggcgtactattctacggtcgaccaagttaaagatctttacagcggattaataggaccgttgattgtttgtagacgtccttacttaaaggtattcaatccgcggcgaaagctggaatttgcattgttgtttttggtctttgacgaaaatgaatcatggtatcttgatgataacataaagacatactccgatcaccctgagaaggtcaataaggatgatgaagaattcattgagtctaataagatgcatgccatcaatggcagaatgtttggaaatctacagggattgacgatgcatgtaggtgacgaggttaattggtacttgatgggaatgggaaacgagatcgacctccatacagtacatttccacggacatagctttcaatataaacaccgtggggtttattcctcggacgtgtttgatatcttccccggaacgtatcagacattggagatgttccctcgcaccccaggcatctggctcttgcactgtcatgtcactgatcatatacatgcgggaatggaaactacctatacggtgttacaaaatgaggacactaagtcggga

SEQ ID NO: 8573 - DNA, 3195 bp, Artificial Sequence
  Description of Artificial Sequence: Synthetic coding sequence
atgaaaatactgatacttggtattttcctgttcctctgcagcacccccgcctgggcaaaggaaaagcattactatattggtatcattgaaacgacgtgggactacgcaagcgaccacggcgagaagaagctgatctccgttgatacggagcattccaacatttatcttcaaaacggtcctgatagaattggtcgattgtacaagaaggcactttatctgcaatataccgatgaaacctttcggaccaccattgagaagccagtctggcttgggtttctgggacctatcatcaaggcagaaaccggagataaggtgtacgtccatcttaagaatctcgcatctcgaccttacacttttcattcccacggcattacctactacaaggagcatgaaggagcgatttacccggataataccaccgattttcaacgagcggacgacaaggtttacccgggtgaacaatacacttacatgcttctggccaccgaagaacagtcgcccggtgagggagatggaaactgcgtgacccgaatctaccactcccatatcgatgcacccaaggacattgcatcgggtcttataggtcccttgattatctgtaaaaaggattcgcttgataaggaaaaagagaaacacattgatcgcgaatttgtcgttatgttttcggtggtggatgagaatttctcatggtatctcgaggacaacataaagacttattgttcggagcccgaaaaggtggacaaggataatgaagatttccaggaatcgaacagaatgtactccgtgaacggatacacttttggaagtttgcctggtctgtccatgtgtgcagaggatagagtcaaatggtacctcttcggaatgggaaatgaagtggatgtccacgcggcattctttcatggacaagctctcactaacaaaaactacaggatcgataccataaatctgtttcctgctacgctttttgatgcatacatggtggcacagaacccaggagaatggatgctctcatgtcagaacctgaatcatctgaaagcaggtctgcaggcgtttttccaagtgcaggaatgtaacaagtccagcagcaaggacaatattcgaggcaagcatgtccgccattactacatcgcagccgaagaaatcatatggaattacgccccctcaggcattgacattttcacgaaggaaaaccttaccgcacccggaagcgactctgcagtcttttttgaacagggaaccaccagaatcggggggtcgtacaaaaaactggtgtacagggagtacaccgatgcatccttcaccaacagaaaagagcgtggtcctgaggaggagcacctgggtattttgggaccagttatatgggcggaagtgggtgataccatcagagtcacctttcataacaagggtgcgtacccgctgtcaatcgaaccgattggtgtgagatttaacaagaacaacgagggtacgtattacagcccgaattacaatccacagtcgcgatccgtgcctccatcggcatcgcatgtggcccctaccgaaacctttacctacgaatggaccgtgccaaaggaagtgggaccaaccaacgccgatcctgtttgtctcgcaaaaatgtactattcagcagtcgatcccaccaaagatatcttcactggacttattggaccaatgaagatatgtaaaaagggtagcctccacgcaaacggacgccagaaggacgtggacaaggagttttacctgtttcccaccgtctttgatgaaaatgagagcctgcttctcgaagataacattagaatgtttaccactgcaccagaccaagtggataaagaggacgaagatttccaagaatcaaacaagatgcactcgatgaacggatttatgtacggaaaccaacctggattgaccatgtgtaagggagactctgtcgtgtggtacctgttctcagccgggaacgaagcagatgtgcacggtatatacttttccggtaacacctacttgtggcggggagaaagaagagataccgcaaatcttttcccacaaacctcccttaccctgcatatgtggcctgatactgagggtaccttcaacgtagaatgtctcaccaccgatcattacaccggcggaatgaagcagaagtacactgtgaatcagtgcaggaggcaatcagaagattcaacgttttaccttggagaaaggacctattacatcgcagctgtggaagtcgaatgggactactccccacaacgcgaatgggagaaggagctccatcatcttcaggagcagaatgtatcaaacgcattccttgataaaggcgagttctatataggctcaaagtacaagaaagtggtctaccgccaatacaccgactcgacctttagagtgccagtggagaggaaggccgaagaagaacaccttggtatactcggaccacagctgcatgcagatgtgggcgataaggtgaagatcatattcaagaacatggcaacccgtccatactcgattcatgctcacggcgtgcagactgaatcttccactgtcactccaaccctcccaggggaaacccttacttacgtgtggaaaatccctgaaaggagcggagcgggtaccgaggattcggcatgcattccgtgggcatactactcaactgtcgaccaggtgaaggacctctactctggtttgattggacctctgattgtgtgtagacgcccctaccttaaagtgttcaatccacggaggaagctcgaattcgctctgctctttcttgtctttgatgagaatgaatcctggtacctggacgataacattaagacttattcggaccatccagagaaggtgaataaagatgacgaagaattcattgaaagcaataagatgcatgccatcaatggaaggatgtttggtaacctccagggacttaccatgcatgtcggagatgaggtgaactggtacttgatggggatgggcaacgaaatcgacctgcacactgtgcactttcacggccactccttccaatacaaacacagaggggtgtactcgtcagacgtgtttgacatcttcccgggcacctaccaaactcttgaaatgtttcctcgtacccctggtatttggctgctgcattgccatgtcactgatcatatacatgcaggcatggagacgacttatactgtcctccagaatgaggatactaagtccgga

SEQ ID NO: 8574 - DNA, 3195 bp, Artificial Sequence
  Description of Artificial Sequence: Synthetic coding sequence
atgaaaattctgatcctagggatatttttgtttctatgttctactccagcttgggccaaagaaaaacattactacataggaattattgaaactacttgggattatgcatctgaccatggggaaaaaaaacttatctccgtggatactgaacactccaacatatacttgcagaatgggcctgatagaatcggacgcctttataaaaaggccctttatttgcagtacacagatgaaacattccgaactactatcgagaaacccgtttggttagggttcctcgggccaatcatcaaagccgagactggggataaagtgtacgtgcacctgaagaacctcgcctctcggccatacacgttccatagtcatggaatcacatattacaaggaacatgagggagccatatatcctgacaatacaactgatttccagcgagctgatgataaagtttatcccggggaacagtatacttatatgttactcgctacagaagaacagtcacctggagagggggatgggaactgcgttactaggatatatcactctcatatcgatgcaccaaaggacatcgcttccggactcatcggacctctcattatatgcaaaaaagattccttggataaagaaaaagaaaaacacatcgatcgggaattcgtggttatgttctcggtggttgatgaaaacttttcttggtatctcgaagataatatcaaaacttactgttccgagcccgaaaaagttgataaagataatgaagattttcaggaatccaaccgaatgtattcggttaacgggtacacttttggatctttgccaggactgtcgatgtgcgccgaagatcgggtaaagtggtatctctttggaatggggaacgaggtcgatgtgcacgcagcctttttccacgggcaggccctcactaataaaaactaccggatcgatactattaaccttttccccgctactctgttcgatgcttatatggtagcacagaatccaggggaatggatgctctcctgccaaaatctcaatcatttaaaagccggactgcaggctttcttccaggtacaggaatgtaataaaagttcttctaaagacaacattaggggaaaacatgttagacactattacatagcggccgaagagataatttggaactatgctccctcaggaatcgatatcttcactaaggaaaacctcacagctcctgggtccgattccgccgtctttttcgaacagggaactacaagaatcggagggtcctataaaaaactggtgtatcgagaatatacagacgcttcgttcactaaccgcaaggaaagaggacctgaagaggagcatttggggattttggggcctgttatctgggccgaggtgggagatactatacgagtgacatttcacaacaaaggggcctatcccctgtctatcgaaccaatcggagttaggtttaacaaaaacaacgaaggaacatattattctcccaattataacccacagtctaggtcagtacccccatctgcttcacacgtagcacccacagagacttttacgtatgaatggacagtgccaaaagaagtggggcccacaaacgccgatcccgtgtgtctggcaaaaatgtattatagtgccgtggatcccacaaaagatatatttactggactgatagggcctatgaaaatatgcaaaaaagggtccctgcacgccaacgggaggcagaaagatgttgataaagaattttatctgttccccactgtgtttgatgaaaatgaatcactcctcctggaagataatattcgaatgttcactacggcccccgatcaggtggataaagaagatgaagattttcaggagagtaataaaatgcactctatgaacggatttatgtatggaaaccagcccggactaacaatgtgtaaaggagattccgtggtctggtatttgttttccgccgggaacgaagccgatgtacacgggatatatttctccggaaacacatatctctggcgcggagaaaggcgggacacggctaacctcttcccccagactagtctcactctacacatgtggcccgatacagaagggactttcaatgtggaatgcttgacgacagatcattacacaggagggatgaagcaaaaatacacagtgaatcagtgtagacggcagtcggaagattccactttctatcttggggaacgcacttactatatagccgccgtggaagtcgagtgggattatagtcctcagcgggagtgggaaaaagaacttcaccatctccaggaacagaatgtgtctaatgcattcctagataaaggggaattctatatcgggtcgaaatacaagaaagtggtttacaggcagtatacagattctacttttagggtccctgtggaacgcaaagctgaggaagagcatcttgggatcctgggacctcagcttcatgctgatgtcggagataaagtaaaaattatcttcaagaatatggccacaaggccttactctatacatgctcatggggtccagacagagtcatcaacagtcacaccaactctgccaggggaaactctaacttatgtgtggaaaatacctgagcgatccggagccgggactgaagactctgcgtgtattccctgggcatattactctacggtggatcaggttaaagatttgtattctgggttaataggacccctgatagtgtgcagaagaccatacctgaaagtcttcaaccccagacggaagctggagtttgctcttctttttcttgtgtttgatgaaaacgaatcctggtatttagacgataatatcaaaacttattcagaccacccagaaaaagtcaacaaagatgacgaggagtttatcgagtcaaataaaatgcacgccataaacgggcggatgtttggaaatcttcaggggctcacaatgcacgttggagacgaagtcaactggtatcttatgggaatggggaatgaaatagacctccatacagtgcatttccacgggcactcattccagtataaacacaggggggtctattccagtgatgtctttgatatctttccagggacatatcagactctggaaatgtttccacgtacacctgggatatggctcctgcattgccatgtcactgatcacatacatgctgggatggaaacaacatatactgtattacagaacgaagatactaaatccggg

SEQ ID NO: 8575 - DNA, 3195 bp, Artificial Sequence
  Description of Artificial Sequence: Synthetic coding sequence
atgaagatcctgattcttggcatctttctgtttctttgcagcactcctgcttgggcaaaggaaaagcattactacataggtatcattgaaactacctgggattacgcatcggatcatggagagaagaagctcattagcgtcgatactgaacactcgaacatctaccttcagaacggaccagatcgaattgggagactgtacaagaaggcactgtacctgcaatacactgatgagacgttcaggactactattgaaaaacctgtgtggcttgggtttctcggtccaataatcaaggctgaaactggcgacaaggtgtacgtccatctgaagaatctcgccagcagaccttacaccttccatagccacggaatcacttactacaaggaacatgaaggtgcaatctaccctgacaacaccaccgactttcagcgagccgatgataaagtgtaccccggtgaacagtacacttacatgcttctggcgaccgaagaacagtcgccaggagaaggtgacggcaattgcgttactcgtatttaccactcgcatatagatgcaccaaaggacatcgcatccggactgatcgggccactgattatctgtaagaaggattccctcgataaggaaaaagaaaagcacattgatagagagttcgtggtgatgttttcggttgttgacgaaaacttttcatggtatctggaagataacatcaagacctactgttccgaacccgaaaaggtcgacaaggataacgaggatttccaagaaagcaacaggatgtattccgtcaacgggtacactttcggatctcttcctggactttccatgtgcgccgaggacagggtcaagtggtacctgttcggaatgggcaatgaggtggatgtgcatgccgcattctttcatggacaagcactgaccaacaagaactaccgaattgacacgattaatctgtttcctgcaactcttttcgacgcatacatggtggcacaaaatccgggcgagtggatgctgagctgtcagaacctcaaccatctcaaagccggtttgcaagccttctttcaagtgcaagaatgtaacaagtcctcctcaaaagataacattagagggaagcacgttcgtcactactacatcgcggccgaagagattatctggaattatgcgccatcgggaattgacatattcaccaaggaaaaccttactgccccaggtagcgactcagcggtctttttcgagcaaggtactactcgtattggaggatcatacaagaagctcgtctaccgggagtataccgacgcatcctttactaataggaaagagcgcggccccgaagaagaacatctcggaattctcggtcctgtgatatgggccgaagtgggtgataccataagagtgacctttcataacaaaggtgcataccccctgtccatagagccaataggcgtccggttcaataagaacaacgaaggaacctactattcccctaactacaaccctcagtccagatccgtgccgccttcagcctcacatgtggcacctactgaaacctttacctacgaatggacggttcctaaggaggtgggaccaactaatgctgatcctgtgtgcctggccaagatgtactatagcgccgtggatccgaccaaggatatcttcactggcctcatcggtccgatgaagatttgtaagaaagggtcgcttcacgcaaacggaaggcaaaaggatgtggacaaggagttttacctttttccaactgtgttcgatgagaacgaatcgctcctccttgaggataacatacgcatgtttacgaccgcccctgaccaagtcgataaggaagatgaagattttcaagagtcgaacaaaatgcattcgatgaatggtttcatgtacggtaatcagcctggtcttaccatgtgtaaaggagactccgtcgtttggtaccttttctcggcagggaacgaagcagacgtgcacggaatctacttctccggcaatacctacctgtggcgcggtgaaagacgggacaccgcaaatctgttccctcaaacgtcgctgaccttgcatatgtggccagatactgaaggcacctttaacgtggaatgtcttactactgatcactacaccggagggatgaaacagaaatacactgtcaatcaatgtaggagacagtcggaggattccactttctatcttggagagagaacgtactacatagcagcagtggaagtcgaatgggactactcccctcagagggaatgggagaaggaactgcatcatttgcaagaacagaacgtctccaatgcattcctcgataaaggtgaattctacattggatccaagtacaaaaaggtggtgtaccgccaatacaccgattccacttttagagttccagtggagaggaaagcagaagaagagcacctgggcatcctcggaccgcagcttcatgcggatgtcggagataaagtgaagatcatattcaaaaacatggcgaccagaccatattcgattcacgctcatggagtgcagaccgaaagctcgactgtcacgccgaccctgcctggcgaaaccttgacttatgtgtggaaaattcctgagcggtcgggcgcaggtacggaggactcagcctgcattccttgggcatactacagcaccgtggatcaggtgaaagacctttactccggactcatcggtccactcattgtttgtcgccgaccataccttaaggtctttaatcctcggcggaagctggagtttgccctgttgtttcttgtctttgatgagaatgagtcctggtacctggatgataacatcaaaacctattctgaccacccggagaaggtcaacaaggatgacgaggaattcatcgaatccaacaagatgcatgcaatcaacggaagaatgttcggaaatctgcaaggtctgactatgcatgtgggagatgaggtcaactggtaccttatgggcatggggaacgaaattgatctccatactgtgcattttcacgggcactcctttcaatacaaacatcgtggggtgtacagctccgatgtgttcgatatcttccccgggacttatcagacccttgaaatgtttcccagaactccaggtatttggttgctgcactgtcacgtgactgatcacattcatgccggaatggaaaccacctacactgtgctccaaaacgaagataccaagagcgga

SEQ ID NO: 8576 - DNA, 3195 bp, Artificial Sequence
  Description of Artificial Sequence: Synthetic coding sequence
atgaagattctcattctgggcatcttcctgtttctctgcagcaccccagcctgggccaaagaaaagcactattacatcggaatcatcgaaactacttgggactatgcgtccgaccatggagagaaaaagctgatctcggtcgataccgaacactccaatatctatcttcaaaacggccccgaccggatcggacgcctctacaagaaagcgctgtacttgcagtacaccgatgagacttttcggactactatcgaaaagccggtgtggttgggcttcctggggccgatcattaaggctgaaaccggagataaggtctacgtccatctgaagaatctggcaagccggccatacactttccacagccacggaatcacttattacaaggaacacgaaggtgctatttaccccgacaacaccactgacttccaaagagccgacgataaagtctaccctggggagcaatacacgtacatgctgttggcgacggaggagcagtccccgggcgagggtgacggcaactgcgtgacccgcatctaccattcgcatatcgacgcccctaaagatatcgcgtccgggctgataggaccacttatcatttgtaaaaaagattctttggataaggagaaggagaagcatatcgaccgcgagtttgtcgtgatgttttccgtcgtggacgaaaatttctcgtggtatctcgaggataatatcaagacctactgctcggagccagagaaggtggacaaggacaatgaggacttccaagaatcgaaccggatgtactcagtcaacggctacaccttcggatccctgcccggtctgtcgatgtgtgctgaagatcgcgtaaagtggtacctcttcgggatgggcaacgaagtggatgtgcacgccgcgttcttccatggacaggcgctgactaacaagaattacagaatcgacactataaacctgttcccggccactctgtttgatgcatacatggtggcccaaaatcctggggaatggatgctgagttgccagaatcttaaccacttgaaggcaggtcttcaagcgttttttcaggtccaggaatgcaataaatcatcaagcaaggacaacatccgcggcaagcacgtgcgacactactacatcgccgctgaagaaatcatctggaactacgccccctccggtatcgacatcttcaccaaggagaacctgactgcaccaggatcggacagcgctgtgttcttcgaacaagggaccaccaggattggaggctcgtacaaaaagctcgtgtaccgggaatacaccgatgcctcgtttaccaatagaaaggagcggggaccggaagaagagcacctcggaattctcggtcctgtcatctgggccgaggtcggagataccattagagttaccttccacaacaaaggagcctaccctttgagcatcgaaccgatcggcgttagattcaacaagaacaatgagggaacctactattcgccaaactacaacccccaaagccggtcggtgccgccatcagcaagccatgtggcaccgaccgaaacgtttacctacgagtggactgtgccgaaggaggtcggcccgaccaacgccgatccggtttgtcttgcgaagatgtactacagcgcagtggacccaactaaggacatctttactggccttatcggaccgatgaagatatgcaaaaaaggatcactgcacgccaacggcaggcagaaggacgtcgacaaggaattttaccttttcccgaccgtgtttgacgaaaacgagagcctgctgctggaagacaacatcaggatgtttactactgccccggaccaggtggataaggaggatgaagacttccaggaatcgaacaagatgcactcgatgaacggcttcatgtacggcaaccagccgggcctgactatgtgcaaaggagacagcgtagtgtggtacctgttcagcgcaggaaacgaagccgatgtgcatggtatctacttctcgggaaacacttacctctggcggggggaaaggcgtgacaccgcgaatcttttcccgcagaccagccttactctccacatgtggcccgataccgaaggaacctttaacgtggagtgtcttaccaccgaccactacaccggaggtatgaaacagaagtacactgtcaatcagtgccggcggcaaagcgaggatagcacgttctacctgggagaaagaacctattacatcgctgcggtggaagtggaatgggactattcacctcagcgcgaatgggaaaaggagctccaccatctgcaggagcagaacgtgagcaacgccttcctggacaagggcgagttctacatcggatcgaagtacaagaaggtcgtctaccgccagtacaccgactccactttcagggtacctgttgagcggaaggccgaggaagaacatctcggaatactcgggccacaactgcatgcagacgtgggggacaaagtgaaaatcatcttcaagaacatggccacccgaccgtactccatccacgcccacggtgttcagaccgagtcgtccaccgtgaccccgactctgccgggagaaactctgacttacgtttggaagatccctgaacggtcgggagcagggaccgaagattccgcgtgtatcccctgggcttactactcaactgtggaccaggtgaaggacctgtatagtggacttattgggccgctgattgtctgcaggcgcccgtatcttaaagtcttcaatccgcggcgcaagctggaatttgctctcctgttcctggtgttcgacgagaatgagtcctggtacttggacgataatatcaaaacctactcagaccatcctgagaaggtgaacaaggatgacgaggaatttatcgaatccaacaaaatgcatgctatcaacgggcgcatgttcggaaacctccaaggtttgaccatgcatgtgggcgacgaagttaattggtacctcatgggaatgggaaatgaaatcgaccttcacactgtgcatttccatggtcactcgtttcagtacaaacacagaggcgtgtacagcagcgacgtgttcgatatcttcccagggacctaccagaccctggaaatgttcccacggaccccgggaatttggctgctccactgccacgtgactgatcacatccacgctggaatggagactacgtataccgttttgcagaacgaagacactaaatccggg

SEQ ID NO: 8577 - DNA, 3195 bp, Artificial Sequence
  Description of Artificial Sequence: Synthetic coding sequence
atgaaaattctcattctggggatttttctttttctgtgctccacccccgcgtgggcgaaggagaaacattactacataggtatcatagaaaccacctgggactacgcttcggaccatggtgagaagaaactcatctcagtggatactgagcatagcaacatttacctccaaaatggtccagatagaattggacgcctttacaaaaaagccctttaccttcagtacaccgatgaaacttttcgaaccactattgagaaaccggtgtggcttggttttctcggtccaatcatcaaggcagaaaccggagacaaagtgtacgtgcacctgaagaacttggcctcacggccgtacacctttcatagccatggtattacttactacaaggaacacgagggggccatttacccagataacactaccgactttcaaagagccgatgataaggtttatcccggtgagcaatacacgtacatgcttctggcaaccgaagaacaatctcctggagaaggcgacggaaattgcgtcactcggatttaccactcccatattgatgcacctaaagatattgcaagcggtctgattggtccactgatcatctgtaagaaggattcccttgataaggaaaaggaaaagcatattgacagggaattcgtcgtgatgttttcagtggtcgatgaaaacttttcctggtaccttgaagataacattaagacttactgttcggagcctgaaaaggtggataaggataacgaggattttcaagaatccaacagaatgtactcagtgaatggctacaccttcggaagcctgccaggacttagcatgtgtgcagaagatcgggtgaagtggtacttgttcggcatgggcaacgaagtggatgtgcatgctgccttttttcacgggcaagcactgaccaataagaactaccgtattgataccattaaccttttcccagccacgctctttgatgcatacatggtggctcagaatccaggggaatggatgctttcgtgtcaaaacctcaatcacctcaaggctggactccaggcctttttccaagtgcaagaatgtaataagtcgtcgagcaaggataacataagaggcaagcacgtgcgtcattactacatcgctgcagaagaaatcatatggaactatgcaccttcgggaattgacatattcactaaagaaaatctcactgccccaggaagcgattcggcagtgttcttcgaacagggaaccacccggatcgggggatcgtacaagaagctcgtgtaccgtgagtatactgatgcatcgtttactaacaggaaggaaagaggaccagaagaggaacatctgggaatactggggccagtgatatgggctgaagtgggcgataccattcgagtgacctttcataacaaaggagcttacccactgtccatagagccaattggtgtcagatttaacaaaaacaacgaaggcacttactactcgcccaactacaacccccaatcaaggtccgttcctccctcggcgtcgcacgtcgcaccgactgaaactttcacttacgaatggactgtgcccaaggaagtcggacccaccaacgcggaccctgtgtgtctggcaaaaatgtactactcggcagtggatcctaccaaggatatcttcactggactgattggtcctatgaagatatgcaagaaaggaagcctccatgccaacggccgtcaaaaagacgtggataaggaattctacctcttcccaaccgtgtttgacgaaaacgagtccctccttctggaagataacatacggatgtttaccactgctcctgatcaagtggacaaggaggacgaggactttcaggagtcgaacaaaatgcactcgatgaacggcttcatgtatggtaaccagccaggccttaccatgtgtaagggcgacagcgtcgtctggtacctcttttccgcgggaaacgaagcagatgtgcatggaatctactttagcggaaatacgtacctgtggagaggagagcgacgggatactgcaaacctgttcccacaaactagcttgactctccatatgtggcctgacaccgaagggacctttaatgtggaatgccttaccactgatcactacactggtggtatgaaacaaaagtacacggtgaatcaatgtcggcgacaatccgaagattcaaccttttaccttggagaacggacgtattacatcgccgctgtggaagtggagtgggactactccccacaaagagaatgggaaaaggagctgcatcacctgcaggagcaaaacgtgtccaacgcattcctggataagggcgagttttacatcgggtcgaaatacaagaaagtggtgtacagacaatacaccgactcgacgttccgcgtgccggtggagaggaaggccgaggaggagcatcttggaattcttgggccccaactccatgccgatgtcggcgataaggtcaagatcattttcaagaacatggcaactcggccctactcgatccatgcacatggtgtgcagaccgagtcgtcgaccgtgaccccaactctgcctggagaaaccctcacctacgtgtggaagatccctgaacgctccggagcaggaaccgaggattcggcatgtattccctgggcgtattactccaccgtggatcaagtcaaagatctctactcgggtctgatcggtccgctcattgtttgcaggaggccatacctgaaagtgtttaatccaaggagaaaactcgaatttgctctgctgtttctcgtgttcgacgaaaatgaatcctggtacctggatgataacataaagacctactcagaccatcctgaaaaggtcaacaaggatgatgaagagttcattgagtcgaacaagatgcacgcgattaatggtcgcatgtttggcaacctgcagggactgaccatgcatgtgggagacgaggtcaactggtacctgatgggaatgggaaacgaaattgacttgcataccgtccattttcatggacacagcttccagtacaagcatagaggagtgtacagctccgacgtgtttgacattttccccggaacttaccaaacccttgaaatgtttccgcgcactcctggaatctggcttcttcactgtcacgttactgatcatatacatgcgggcatggaaaccacctacaccgtcctccagaatgaagatactaaatcggga

SEQ ID NO: 8578 - DNA, 3195 bp, Artificial Sequence
  Description of Artificial Sequence: Synthetic coding sequence
atgaagatccttattcttggcatcttcctgtttctgtgttccactccggcgtgggctaaggaaaaacactattacatcgggataattgaaactacctgggactacgcatcagaccacggcgagaaaaaacttatcagcgtggatactgagcactccaacatttacctccagaacgggccagatagaatcggacgcctgtacaagaaagcactctaccttcagtacacggacgaaacctttaggaccaccatcgaaaagccggtgtggcttggattcctggggcccatcatcaaggcagaaactggagacaaggtgtacgtgcacctcaaaaacctggcctctcgcccatacacttttcacagccacggcatcacctactataaggaacacgagggagcgatctacccagacaacactacggacttccagagagccgacgacaaggtatacccaggagaacaatacacttacatgctgctggccaccgaggaacagtctcctggtgaaggcgacggcaattgcgtgactaggatctatcactcacatatcgatgctccaaaggacattgcgagcgggctcattggaccgctgatcatctgtaaaaaggatagcctggacaaggaaaaggaaaagcacatcgatagagagttcgtggtgatgttctcagtcgtggacgagaacttctcgtggtacttggaagataacatcaaaacttattgctcggaaccggaaaaggtggataaagataacgaagatttccaggaaagtaacagaatgtacagcgtgaacggatacacctttgggtcactcccgggcctctccatgtgtgcagaagatcgggtcaaatggtaccttttcggaatgggtaatgaagtcgacgtccatgctgcattcttccatggtcaggcgctgaccaacaagaactaccgcatcgacaccatcaacctcttcccagcgactctgtttgacgcttacatggtggcgcagaatcctggggagtggatgctgtcctgccaaaatctcaaccatctgaaggcaggcctgcaggctttcttccaagtgcaagaatgtaacaagagcagtagcaaagacaacattcgcggaaagcacgtccggcattactatatcgcagccgaggaaatcatctggaattacgccccctcagggatcgacatctttactaaggaaaatctcaccgctccgggttcggactcggccgtgttctttgaacaaggcactacccgcatcggaggctcatacaagaagctggtctaccgcgagtacaccgatgcatcgttcactaacagaaaggagcgcggaccagaggaggagcacctgggcatcctggggccggtgatctgggccgaggttggagacactattcgggtcaccttccacaacaaaggggcgtatccacttagcatcgaaccgatcggagtgcggtttaacaagaataatgaaggcacttactacagcccaaactataacccgcaaagtcggtcggtgcccccttcggcctcccacgtggccccgaccgaaacctttacgtacgaatggacggtcccgaaggaagtcggccccaccaatgctgatccggtgtgcctcgccaaaatgtactactcggccgttgacccaacgaaggacatcttcactggattgatcggaccgatgaagatatgtaaaaaggggtcactgcatgccaatgggcgccagaaggatgtcgataaagaattctacttgtttccgactgtgtttgacgagaatgagagcctgctcctcgaggataacatacggatgttcactactgctccggaccaagttgacaaagaggacgaggattttcaggaatccaataagatgcactcgatgaatggattcatgtacggcaatcaaccaggactcactatgtgcaagggggatagcgttgtttggtacttgttctctgcgggaaacgaagccgatgtccatggaatttacttctcgggcaatacgtatctgtggcggggtgaacggagagataccgcgaatctgttcccacagactagcctgaccctccatatgtggcccgacaccgagggtactttcaacgtggaatgccttactaccgaccactacaccggcggaatgaagcagaagtacaccgtgaatcagtgcagacgacagtcggaggactccaccttttacttgggagagagaacttactacatcgcggcagtggaggtcgaatgggactactcaccgcaacgagagtgggagaaggaactgcaccacctccaggaacagaatgtgtcgaatgccttcttggataagggcgaattctacataggaagcaagtacaaaaaggtggtgtacaggcaatacaccgacagcactttccgcgtgccagtggagcgtaaagcggaagaagagcatctgggaattctgggacctcagctccatgccgacgtcggggacaaagtgaaaatcatctttaagaacatggccacccgtccgtactcgatccacgcccacggcgttcagaccgagtcgtcaacggtgacccctaccttgccgggagagactttgacctacgtgtggaagattccggaacgctcaggcgcaggcaccgaggacagcgcctgcatcccttgggcgtactacagcaccgtcgaccaagtgaaggacctgtactctggtctgatcggacctctgatcgtgtgccggaggccgtacctgaaggtctttaatccgcgacggaaactcgagttcgcgctgttgtttctggttttcgacgaaaacgaatcgtggtacctcgatgataacattaagacctactcagatcacccggagaaagtcaacaaagacgacgaagagttcatcgaatcaaacaagatgcatgccattaacggacggatgttcggtaatctgcagggtctgactatgcatgtgggcgacgaggtgaactggtacctcatggggatggggaacgagatcgatcttcacactgtccacttccacggacattccttccagtacaaacatcggggagtatactcatcagatgtgttcgacatcttccctggtacgtatcagactctggaaatgttcccccgcactccaggaatctggctgctccactgtcatgtgacggaccatatccacgctggtatggagactacgtacactgtgctgcaaaacgaggacaccaagtccggg

SEQ ID NO: 8579 - DNA, 3195 bp, Artificial Sequence
  Description of Artificial Sequence: Synthetic coding sequence
atgaagattttgattctcggaatcttcctttttctgtgttctaccccagcctgggcaaaagaaaagcattactacattggcatcatcgaaaccacctgggattacgcatcggatcatggagaaaagaagctgatttcagtggacaccgagcacagcaacatctaccttcagaatgggcctgatcgaattggacgcctctacaagaaggccctctaccttcagtacactgatgaaaccttccgtaccactattgaaaagcctgtctggttggggttccttggaccgattatcaaggcagaaaccggagataaggtgtacgtccatctcaaaaacctggcatcacggccttacacctttcatagccacgggattacctactacaaggaacatgaaggagctatctaccctgacaacactaccgattttcaacgagcagatgataaagtctacccaggtgaacaatatacttacatgctgcttgctactgaagaacagtcacctggtgaaggtgatgggaactgcgtgactagaatttaccattcccatatcgatgcccctaaggatattgcgtccggcctgatcggacctctgatcatctgtaaaaaggactcacttgataaagaaaaggagaagcatattgatcgagaattcgtcgttatgttctctgtcgtggacgagaactttagctggtaccttgaggacaacattaagacttactgttccgagcccgagaaggtggataaggataacgaagattttcaggagtccaatagaatgtactcggtgaacggatatacctttggtagccttcccggcctttccatgtgcgcagaagatagagtcaagtggtacctgttcggaatgggtaatgaagtggacgtgcatgcagcttttttccatggccaagcgctcactaacaaaaactaccgtattgataccattaatctgtttcctgcaaccctttttgatgcttacatggtcgcgcaaaatcccggggaatggatgctcagctgccagaacctgaaccaccttaaggccggcctgcaggcgttctttcaggtccaggagtgtaataagtcatcctcaaaggataacatccgggggaagcatgtgagacactattacattgccgcagaggagataatctggaactacgcgccatccgggatcgacatctttaccaaggagaacctcactgcaccaggatccgatagcgcagttttctttgaacagggaactacgagaatcggtggttcctacaagaagctcgtgtatagagagtatactgacgcatccttcactaatcggaaggaaaggggtccagaagaagaacatctgggcattctcggaccagtgatttgggcagaggttggcgacaccattagagtgaccttccataacaaaggcgcttacccgctgtcgatcgagcctattggcgtccggtttaacaagaacaacgaagggacttactactcaccaaactacaacccccaatcgaggtcggtgccacccagcgcatcgcacgttgccccaaccgagacttttacctacgagtggactgtgccaaaagaagtgggacctaccaacgcagatcctgtgtgtcttgcaaagatgtattactcagcagtggatccaactaaggacattttcactggtctgataggaccgatgaaaatctgtaagaagggatcgctgcacgccaacggcaggcaaaaagacgttgataaggagttctacctctttcccaccgtgtttgacgaaaacgagtcccttctgcttgaagataacatcaggatgtttaccactgcacctgaccaagtcgataaggaagatgaggattttcaagaatccaacaagatgcactcaatgaatggatttatgtacggtaatcagcccggacttaccatgtgcaagggagactcggtggtgtggtaccttttttcagcagggaacgaggcagatgtccatggaatttacttttccggaaatacctatctgtggagaggagagcgtagagatacggcgaatctctttcctcagacttccctgactctccatatgtggccggacactgagggcacttttaacgtcgaatgtctcaccactgaccattacaccggtggaatgaagcagaagtacaccgtgaaccagtgtaggcgacagtccgaagattcgaccttttacctcggcgaacgtacctactacatagccgcagtcgaagtggaatgggattattcgccacagcgggagtgggagaaggaacttcatcatctgcaagaacagaacgtctcgaacgcctttctcgataagggagagttctatattggatccaagtacaaaaaggtcgtctaccgccaatataccgattcaaccttcagagtccctgtggaaaggaaagcagaggaagaacaccttgggatacttggtcctcagcttcatgccgacgtgggcgataaggtgaagattatctttaagaatatggcaacccgaccatactcgatccacgcacatggggtccagaccgaatcttcgaccgtgactccgaccctgccaggtgaaaccctgacttacgtatggaagatccccgaaagaagcggggcaggtacggaggactccgcttgtattccttgggcatactatagcaccgtggaccaagtgaaggacctgtactcgggtcttattggccctctgatcgtctgccgcaggccctacctgaaggtgtttaatccccgtcggaagctggagtttgcacttctttttcttgtattcgacgagaacgaatcttggtacctggatgataacataaagacttactctgatcatcctgaaaaggtgaacaaggatgatgaggagttcatcgaatcgaataagatgcacgccatcaatggacgcatgttcggtaacctgcaaggccttactatgcatgtgggagacgaagtcaattggtacctcatgggcatgggtaatgagatagatctgcacactgtgcatttccacgggcattcattccaatacaaacataggggagtctacagttcggacgtattcgacatatttcctggaacctaccaaactctggaaatgtttcctaggaccccaggaatttggctcctccactgtcacgtgacggaccatatacatgctggcatggaaacgacctacaccgttctgcaaaacgaagataccaagtcggga

SEQ ID NO: 8580 - DNA, 3195 bp, Artificial Sequence
  Description of Artificial Sequence: Synthetic coding sequence
atgaaaatcttgatcctggggatatttttgttcctttgcagtacccctgcttgggcgaaagaaaagcactattacattggcataatcgaaaccacatgggactacgcctccgaccacggcgaaaagaagctcatttcggtcgacacggagcatagcaatatttatctacagaatggccccgacagaattgggcggctttacaaaaaggcgctctatctgcagtacacagatgagacctttagaactacaatcgagaaaccagtgtggctcggatttctcggcccgatcatcaaggctgaaacgggagacaaagtttacgtgcatttaaaaaacctcgcgagcagaccctacactttccattcgcatggtatcacatattacaaggaacacgaaggggcgatctacccagataatacgacggactttcaaagggccgatgacaaggtgtacccaggagaacagtatacttatatgctgctggcaacagaagaacagagtcctggagaaggtgacggtaattgcgtgacccgtatataccattcccacatcgatgccccaaaagatatagcctccgggttaatcggacctcttatcatttgtaaaaaggattcactggacaaagagaaggagaagcacatcgaccgcgagttcgttgttatgttttcagtcgttgatgagaacttctcttggtaccttgaggataacattaagacctactgttcggaaccagagaaggttgacaaggataatgaagactttcaggaatcgaataggatgtactcagtcaacggatacaccttcggatctcttccagggctatcaatgtgtgcagaggacagagtgaaatggtaccttttcggaatgggcaacgaggtggacgtgcatgctgcattctttcatggccaggctcttaccaacaagaattacagaatcgacacaatcaatctttttcctgccaccctgttcgatgcatacatggtggcccagaaccctggggagtggatgctgtcctgccagaatttaaatcacttgaaggccgggctgcaggctttttttcaggtgcaggaatgtaacaagtccagctcaaaggacaatattaggggaaaacacgtgaggcattactacattgctgcagaggaaatcatctggaactacgctccttctggaattgatatcttcactaaggaaaatttgacagcccccggatctgatagcgccgtgttcttcgaacagggcaccacccggatcggaggctcgtacaagaagctggtgtacagggagtatacagatgcctcttttactaatcgcaaggaaaggggccccgaagaagagcacctggggatactgggtccggtgatctgggcagaagtgggcgacaccatcagggttacgtttcacaataaaggagcctatccactgagcattgagcctatcggagtccgcttcaacaaaaacaacgaaggaacctattatagtcctaattacaacccacagagccgttcagtgcctccatcagcaagtcatgtcgctcctacagaaaccttcacttatgaatggacagtgcccaaggaggtaggccccacgaacgctgatcctgtgtgtctggcaaagatgtactactcagcagtggatcctacaaaagacatatttaccggactcatcggaccaatgaagatctgtaaaaaaggctctcttcacgcaaacggtcggcagaaggatgttgacaaagagttttatctgtttcccacagtattcgatgaaaacgaatctctgctgctggaagacaacattaggatgttcacgactgcaccggaccaggtagacaaagaggatgaggactttcaagagtcaaacaaaatgcactcaatgaacggcttcatgtacgggaatcagccaggactcaccatgtgtaagggggacagcgtagtgtggtatctgttctctgcgggtaatgaagcggatgtccacggcatctatttttccggcaatacctacctgtggagaggtgagcggcgagataccgcaaacctcttcccgcagacaagtttgactctccacatgtggcctgatactgaaggaaccttcaacgtggagtgcctaaccaccgaccactatactggcggcatgaaacaaaagtacacagtgaaccagtgcaggaggcagagcgaagactcaacgttttatttaggagaacgcacatattacattgccgctgtggaggtggaatgggactattccccacagcgggagtgggaaaaggagcttcatcatctacaggagcaaaacgtcagcaacgcgtttctcgataagggcgagttttacatcggttcgaagtacaaaaaggtggtttaccgccagtacaccgattccacctttcgcgttccagtggagagaaaggctgaagaagagcacctggggatcctgggacctcagctacacgccgatgtgggggacaaagtgaagataatcttcaaaaacatggctaccagaccatacagcatccatgcccacggagtgcaaaccgagagtagcacagtgacccctacgctgcctggcgagaccctgacttatgtgtggaagatccctgagcggtccggggccggaacggaagacagtgcctgtatcccctgggcctactacagcaccgtcgatcaggtcaaagacttgtactccggactgattgggcctttgatcgtttgccggagaccctacctaaaggtgttcaaccccaggaggaagttggaattcgccttactctttctggtttttgacgagaatgagagctggtacctggacgataatatcaaaacctattctgatcatcctgagaaggttaacaaggacgatgaggagttcatcgaatcaaacaagatgcacgccatcaacgggaggatgttcggcaacttgcagggcctcacgatgcacgtgggcgatgaggttaactggtatttaatgggaatgggtaacgaaatcgacctgcataccgtgcacttccatggacattcatttcagtacaagcatcggggtgtatatagttcagacgtcttcgatatctttcccggcacatatcagaccttggaaatgtttccacgcacacctggtatctggctcctgcactgtcacgtaaccgaccatatccatgctgggatggagactacttatacggtgctgcaaaatgaggacaccaaatctggc

SEQ ID NO: 8581 - DNA, 3195 bp, Artificial Sequence
  Description of Artificial Sequence: Synthetic coding sequence
atgaagatactcattcttgggatcttcttgttcctgtgctccactccggcatgggcgaaggagaaacactactatatagggatcatcgaaaccacctgggattacgccagcgaccacggagagaagaaattgatctcagtggacaccgaacactcgaatatctacctgcagaacggccctgacaggatcggacgactttacaagaaagcactctacctgcagtacactgacgaaaccttccgcaccaccatcgagaagccagtgtggctgggattcctgggaccgatcatcaaggcagagactggcgataaggtgtacgtccacttgaagaatctcgcctcccggccgtacaccttccattcacatggtatcacctactacaaggagcatgaaggagcaatctaccctgacaacaccactgacttccagcgggcggacgacaaagtgtaccctggagaacagtacacgtacatgctcctcgctactgaggagcagtccccaggtgaaggcgatggcaattgtgtgacccgcatctaccatagccatatcgatgccccaaaagacattgcatcaggcctcatagggcctctcatcatctgtaaaaaggactccttggataaggaaaaagagaagcacattgatcgcgagtttgtggtgatgttttccgtggtcgatgagaacttctcttggtacttggaggacaatatcaaaacttactgcagcgaaccggaaaaggtcgataaagataatgaggacttccaagagagcaatcggatgtactccgtgaacggatacacgttcggttccctgccgggactcagcatgtgcgctgaggatcgcgtgaaatggtatctcttcggaatggggaacgaagttgacgtgcacgcggccttttttcatggacaggcgctgactaataagaattaccggatcgacacgatcaacctgttcccagcaaccctcttcgacgcttacatggtggcccagaacccaggagaatggatgttgtcgtgccaaaatctgaaccacctcaaagcaggcttgcaggcctttttccaagtgcaagaatgcaacaagtccagcagcaaggataacatccgagggaagcacgtgcgtcactactacatcgcggctgaagaaatcatctggaattacgctccgtcggggattgacatcttcaccaaggaaaacctgaccgccccaggctccgattcggctgttttcttcgagcagggcacgacccggatcggaggcagctacaagaaactggtataccgcgaatatactgacgcctcgtttactaaccgcaaggagcggggtccggaggaggagcacttgggcatcctgggaccagtgatctgggcggaagtcggagacactatcagggtcactttccacaacaaaggagcctaccccctctccatcgaaccgattggtgtgcggttcaataagaacaatgaaggtacttactactccccaaattacaatccgcagagccggtcggtcccgccttccgcctctcacgtcgcccctactgagactttcacgtacgagtggactgtgccaaaagaggtcggcccgacgaacgccgacccggtgtgcttggccaagatgtactactcagcagtcgaccctactaaggacatcttcactggacttatcgggccaatgaaaatctgcaagaaggggtcgctgcacgccaacggacggcaaaaagatgtggacaaagagttttacctgttcccaaccgtgttcgatgagaacgagtcattgctcctggaagataacatcagaatgtttactactgcgccggaccaggtggataaggaagatgaggactttcaagaaagcaacaagatgcacagcatgaacggattcatgtacgggaatcagccaggactgaccatgtgcaagggagactcagtggtgtggtatctgttttcagccggaaatgaagccgacgtgcatgggatctacttttctggaaacacctacctgtggcgcggcgagagacgcgacaccgctaacctgtttccgcagacgtcgctgacgctgcatatgtggccggatactgaaggaactttcaacgtcgaatgtctgactaccgaccactacaccgggggaatgaagcagaaatacaccgtgaaccaatgcaggcgccagtcagaagatagcaccttctatctgggggaacgcacttactacatcgctgctgtcgaggtggaatgggactactcacctcagagggagtgggaaaaggagctgcaccatctccaggaacagaacgtgtctaatgccttcctggacaagggagaattctacatcggatccaagtacaagaaagtggtgtacaggcagtatactgatagcacctttagggtccccgtggaacggaaggcagaagaggagcatctgggaatcctcggaccgcagctgcacgccgatgtgggagataaggtcaagattatctttaagaacatggcaaccagaccgtactcaatccatgcccatggagtgcaaaccgagagctcaacggtgactcccacgctgcccggggaaaccctcacttatgtttggaagattccggaaaggtctggagccggaactgaagatagcgcttgcatcccatgggcgtactactccactgtggaccaagtgaaagatctgtacagcggacttatcggaccacttattgtgtgtcggcggccgtacctgaaagtctttaacccgcgccggaaactggagttcgcgctgctgttcctggtgttcgacgagaacgaatcatggtacctggatgacaacatcaaaacctacagcgatcaccctgaaaaagtcaacaaagatgacgaagaattcatcgagtccaataagatgcacgccatcaatggtcggatgttcgggaacctccagggactgactatgcatgtcggagacgaggtcaattggtacctcatgggaatgggaaacgaaatcgatttgcatactgtgcattttcatggtcactcatttcagtacaagcatcggggagtgtactcgtcggatgtgttcgatatcttcccggggacctaccagacgcttgaaatgtttccacgcactccgggaatctggctcctccactgtcatgtgaccgaccatatccatgcaggcatggaaactacctacacggtgctccagaatgaggatactaagtccgga

SEQ ID NO: 8582 - DNA, 1866 bp, Artificial Sequence
  Description of Artificial Sequence: Synthetic coding sequence
atggcacacgtgcgcgggcttcagctgccaggttgcctcgcgctcgcagcactgtgttccctggtgcattcccaacatgtgtttctcgcaccgcaacaggcgcgctcactgctccaaagagtccggagagcaaatactttccttgaggaagtgaggaagggtaacctggaaagggagtgtgtcgaagaaacttgttcatacgaggaagcatttgaggccctggaatcgtcaaccgcaaccgacgtgttttgggcaaagtacacggcctgcgagactgcgcggacccctagagataagctggccgcatgtctggaggggaattgtgcagaagggctgggtaccaactatagaggtcatgtcaacattacccggtcgggaatagaatgtcaactttggcgcagccgctatccgcataagcctgagattaactcaactacccatcccggtgctgacctgcaagaaaacttctgccgtaaccccgacagctcaactaccggaccttggtgttacaccactgatcccaccgtgcgcagacaagaatgctccattcctgtctgtggtcaggaccaggtaacggtcgcaatgacccccaggtccgaaggatcgtcggtcaacttgtcgccacccctggagcaatgtgtccctgatagaggacagcaataccaaggtaggctggcagtgaccactcatggattgccatgtctggcatgggcgtccgcgcaagcgaaggctctttcaaaacatcaggatttcaactcagcggtccaacttgtcgagaacttttgccgtaaccctgatggagacgaagaaggggtctggtgttatgtggcaggaaaacctggtgatttcggctactgtgacctgaattactgcgaagaagcagttgaagaggaaaccggagatggtcttgacgaagattcagaccgtgcaatcgagggccggactgccacgtccgaatatcaaacctttttcaatccacgtaccttcggctccggcgaggctgattgcggtctgcgacccctctttgagaagaagagcctggaggataagactgaacgggaactgctggaatcttacatcgacggtcggattgtggaaggtagcgatgccgaaattggcatgtcgccctggcaagtcatgctgtttagaaaatcgcctcaagaactgctgtgtggagcatcacttatttcggatcgatgggtcctgaccgcggcgcactgccttctgtacccgccatgggacaagaactttacggaaaatgacctcctggtgagaataggtaagcatagcaggacccgttacgaaagaaacatcgaaaagatctcaatgcttgaaaagatttacatacatccgcgatacaattggcgtgaaaacctggatcgcgatattgcacttatgaaactgaagaagccagtggctttctccgattacattcatcccgtgtgcctcccagatcgtgaaaccgctgcaagccttcttcaagcgggttacaaagggcgcgtgaccggatggggaaaccttaaggaaacctggactgccaacgtgggtaaggggcagccgagcgtgcttcaagtggtgaatctgcccatagtggaacggccagtctgtaaggattcgaccagaatcagaattactgataacatgttttgcgccggatacaagcctgacgaaggcaaacgcggggatgcatgtgaaggtgactccggtggaccattcgttatgaaatccccattcaataacagatggtaccaaatgggaatagtgagctggggtgagggatgcgacagagacgggaagtacgggttctacacccatgtctttaggcttaagaaatggatccagaaagtgatcgaccagttcggagaa

SEQ ID NO: 8583 - DNA, 1866 bp, Artificial Sequence
  Description of Artificial Sequence: Synthetic coding sequence
atggcccatgtgagaggtttgcagttgcccggatgtcttgcactggccgccttgtgcagcctggtgcacagccaacatgtctttctggcaccccagcaagcaagatcacttcttcaaagggtcagacgggcaaatacgtttttggaagaagtgagaaagggaaaccttgaacgggagtgcgtagaagaaacttgctcgtacgaagaggcatttgaggccttggaatcatcaactgcaaccgacgtgttttgggccaaatacacggcatgtgaaacggcccgaactcctcgagataaactggcagcatgtctggaaggaaattgtgcagaaggactcggaaccaactatagaggacatgtgaatatcactcgcagcgggatcgagtgccaactgtggagaagccgctatccgcacaaacccgaaatcaactccaccactcacccaggtgccgatttgcaggaaaacttctgtcggaaccccgattcgtccaccaccggtccttggtgttacactaccgaccccactgtgagacgacaagaatgcagcatacctgtctgcgggcaagatcaggtcactgtggcaatgactccaaggtctgagggttcaagcgtgaacttgagcccccctctcgaacagtgtgtgccagatcgtggccaacagtaccaagggcgacttgcagtcactacgcatgggctcccttgtctggcatgggcatcggcgcaagctaaggcactgagcaagcatcaagacttcaattccgccgtgcaactcgtggagaacttttgccgcaatccagatggggacgaagaaggtgtgtggtgctacgtggccggcaagccaggcgactttggatattgcgatctgaactattgcgaagaagcagtcgaggaagaaactggagatggtctggacgaggatagcgaccgtgcaattgagggacgcaccgcaacttcggagtaccagacgttctttaacccacgtacttttggttccggtgaggctgattgtggactcaggcccctctttgaaaagaagtcgcttgaggataagaccgaaagggaacttcttgagtcctacatagatggacggattgtcgagggaagcgatgcagaaattggaatgtccccgtggcaagtgatgctcttcagaaagtccccacaagaactgctttgtggagcttctcttatctccgaccgttgggtcttgaccgccgcacattgtttgctttaccctccctgggacaagaatttcaccgaaaacgaccttttggtcagaattggcaagcactcccgtacccgctacgagagaaatatcgaaaagatttcgatgctcgagaagatctacatccacccgagatacaactggcgagaaaatctggatagagacattgcacttatgaaacttaagaaaccagtggccttttcggactacatccatcctgtgtgtctgcctgatagagagactgcagcgtcattgctccaggcaggctacaagggacgcgtgaccggatgggggaacctgaaggaaacctggaccgcaaacgtgggtaagggacagcctagcgtcctgcaggtcgtgaacctgccgatcgttgaacggcctgtgtgtaaggactcaacgcgaattcgaatcaccgataacatgttttgtgccggttacaagccagatgaagggaagagaggagatgcatgtgaaggagattccggaggaccatttgtcatgaagtccccatttaacaaccggtggtaccagatgggtatagtgtcgtggggtgagggttgtgaccgcgatggtaaatacggcttctacacgcatgtgttccgacttaagaaatggatccagaaagtgatagatcaattcggtgaa

SEQ ID NO: 8584 - DNA, 1866 bp, Artificial Sequence
  Description of Artificial Sequence: Synthetic coding sequence
atggcccacgtgcgaggcttgcaattgcctggatgcctggcccttgctgccctttgctccttggtgcacagtcaacacgtcttcttagccccccagcaggcgaggagcctattgcagcgggtgcggagagcaaatacattccttgaggaagtcaggaagggtaacctcgaaagagaatgtgtcgaggagacctgtagttatgaggaagctttcgaagctctcgaatcttccacagcaacagacgttttctgggccaaatataccgcctgcgagacagcccggacaccgcgggataagttggcagcatgcttggagggcaactgcgccgaaggacttggaactaactatagagggcacgtgaatataactagatcgggcatagagtgccagttgtggcggtcccgttatcctcacaaacctgaaatcaacagcactacacaccctggcgccgatctgcaagagaacttttgcaggaatccagatagcagcactaccggcccttggtgctacactacagatcccaccgtgcgcagacaggagtgttcgatcccagtatgcggacaggaccaagttacagttgctatgactccgaggtcagagggtagttccgtgaatctgagtccgcctctcgagcaatgtgtgcctgaccgtgggcaacagtaccaggggcggctagctgtcacgacacacggcctgccatgcctggcatgggcatccgctcaagctaaagcactgagcaaacatcaggattttaacagtgctgtccaattggttgagaatttctgtaggaacccggacggagatgaagaaggagtatggtgctacgtagctgggaagccaggcgattttgggtactgcgacctgaactactgcgaagaggcagtggaggaagagacaggcgatgggctggacgaggatagtgaccgggccatcgaaggccggaccgctaccagcgagtaccagacattttttaaccctcgaaccttcgggtcaggagaagctgattgcggactacggccgcttttcgaaaaaaaatccctggaggataagacagagagggaactgttagagtcatacattgacggccggatcgtagaggggtcagacgccgagattggtatgtccccttggcaggtaatgctgtttcgtaaatccccccaagagttgctgtgcggtgctagtttaatatctgaccgatgggtgctgactgctgcccactgtcttctgtatccaccttgggataagaacttcaccgaaaatgaccttcttgtccgaattgggaaacactctaggacgagatacgaaaggaacatagagaaaatttccatgctggagaagatttatattcatcctaggtacaactggcgcgagaatctcgaccgtgatatcgcactgatgaagctcaagaagccagtggcattcagcgattacattcaccccgtttgcttgccagatcgggaaactgcggccagcctattgcaggctggttataaggggcgggtgaccggctggggcaacttaaaagagacctggacggcaaatgtaggaaaagggcagccatctgtgctccaggtcgtaaatctgccaatcgtggagagacctgtttgtaaggactcaactcgtattcgtataaccgacaacatgttctgcgcgggctacaagcctgacgagggcaagagaggcgatgcttgcgagggggattctggtggcccattcgtgatgaaatcacctttcaataaccgctggtaccagatgggtatcgtcagctggggcgaggggtgcgaccgggacggcaagtacggcttttacacccatgtatttcgtcttaaaaagtggattcagaaagtgattgatcagtttggagag

SEQ ID NO: 8585 - DNA, 1866 bp, Artificial Sequence
  Description of Artificial Sequence: Synthetic coding sequence
atggcgcatgtccgcggactgcagctgcccggttgcctggcactagccgcgctttgctcactcgttcattctcaacacgtcttcttggctccccagcaagcgcggtctctgcttcagcgcgtccgtagggctaatacctttctggaggaagtgaggaagggcaaccttgagcgtgagtgcgtcgaggagacctgttcctatgaagaggctttcgaggccctggagagtagtaccgccaccgacgtgttctgggcaaagtacacggcctgtgagaccgctagaaccccccgcgacaaattggccgcctgcctggagggtaactgcgccgagggactgggtaccaactaccgcggtcatgtcaacattacccgtagtggtatcgaatgccagctgtggcgctcacgatacccgcataagcctgagatcaactcgacgacgcacccgggagccgacttacaggagaacttctgccgtaatcccgactcttcgaccactggaccctggtgctacaccactgacccaacggtccgtcgtcaagagtgttcgatcccggtgtgcggtcaagaccaggttacagtcgccatgacacctagatcagagggcagctccgtgaatctctccccacccctggaacaatgcgttcccgatagaggccagcagtaccagggcagactggccgttacaacccatggcctcccctgcctggcttgggcgagtgctcaggccaaggcccttagcaaacaccaggacttcaactcggccgtccagctggtggagaacttctgccgcaaccccgatggcgatgaagagggagtgtggtgttatgtcgccggcaagcccggtgacttcggttactgcgatcttaactactgtgaggaggccgtcgaggaggagactggagacggactcgacgaggacagcgacagagctatagagggcaggacagctacctccgagtaccagacctttttcaacccccgcaccttcggtagcggcgaggctgattgcggtcttcgtccccttttcgaaaaaaagtccctggaggacaagaccgagagggagctcctcgagagttacatcgacgggcgcattgttgagggctccgatgctgaaattggcatgtccccctggcaggttatgctattccgcaagtccccccaagagctcctctgtggggcctctctgatttccgaccgttgggtcctgacggctgcgcattgcctgctctaccctccgtgggataagaatttcaccgagaacgacctgctagttcgtattggcaagcattccaggacccgctacgagcgtaacatcgagaaaatctcgatgctggagaagatctatatccatcccaggtacaattggcgcgaaaacctcgatcgcgacatcgcccttatgaagctgaagaagccggtagccttttcggactacatccacccggtgtgcctgccggatagggaaaccgccgcctctcttcttcaggccggctacaagggccgagtaacaggctgggggaacctcaaggagacctggaccgctaacgtcggtaagggacagccctccgtcttgcaggtcgtcaatctgcctatcgttgagcggcccgtctgcaaggattctacccggattcgcattaccgataatatgttctgcgcgggttataagcctgatgaaggaaagcgcggagacgcttgcgaaggcgattctggtggaccctttgtcatgaagtcccctttcaacaaccgatggtaccagatgggcatcgtctcctggggtgagggttgcgaccgggacggtaagtatggtttctacacgcacgtgttccggcttaagaagtggatccaaaaggtcatagaccagttcggtgag

SEQ ID NO: 8586 - DNA, 1866 bp, Artificial Sequence
  Description of Artificial Sequence: Synthetic coding sequence
atggcacacgttagaggactccagctgccaggatgtctggcactggcagccctgtgcagtctagtccattcgcagcacgtgttcctagctcctcagcaggcacggtccttgctccagcgagtgcggcgggccaatacattcctcgaggaagttagaaaagggaacctagaaagggagtgtgtggaggaaacatgctcttatgaagaagcatttgaggccctagaaagttcgacagcaacagatgtattttgggctaagtatacagcctgcgaaacagcaaggactccacgggataagcttgctgcttgcctcgaaggaaactgtgcagaagggcttgggactaactacagaggacatgttaatattactaggtctgggatagagtgtcagctttggaggtctcgctaccctcataagccagaaatcaactcgacaactcacccaggggctgatcttcaggaaaacttttgtcggaatcccgattcatctactacagggccctggtgttacactacagatcccacagtgagacggcaggaatgttcaataccagtatgtgggcaggatcaggttactgtggcgatgactcctaggtccgaaggatcctccgtgaatttatcacccccactagaacagtgcgtgcccgatcgagggcagcagtaccagggaagactcgcagttactactcacggactaccatgtctagcatgggcttctgcccaggccaaagctttaagtaagcaccaggacttcaactccgccgttcagttagtagaaaatttttgccgcaatcccgatggagacgaggaaggggtgtggtgttatgtggctgggaaacctggggattttgggtattgcgatttaaattattgtgaggaagcggtggaagaggaaactggggatggattagatgaagatagtgatcgcgccatagaagggcgcactgcaactagtgaataccagactttcttcaacccaagaacattcggatctggagaagccgactgcgggttgcggccactctttgaaaaaaaatcattagaagataaaacagaaagggaactgcttgagtcatacattgatgggcgaatagttgaaggatctgacgcagaaattggaatgtctccttggcaggtaatgctgttccgaaagtctccacaggaactgctttgtggggcctcactcatatctgaccggtgggtgctgacagcagcacactgtttgctgtatcctccctgggataaaaacttcactgaaaacgatctgctcgttaggattggaaaacattcccgaacacgatatgaacgcaacatagagaagatatcaatgctagagaaaatatacattcaccctcgatataattggagggaaaaccttgaccgggacattgcactgatgaagctgaaaaaacccgtagcattttccgactatattcatcctgtctgtctccctgacagagaaacagcagcctctctcctgcaggctgggtataaaggaagggtaactgggtgggggaaccttaaagaaacttggacagccaatgtgggaaaagggcagcctagtgtactccaggttgtgaatttacccatcgtcgagcgcccagtatgtaaggactctacacgaataagaattactgacaacatgttttgtgcggggtataaacccgatgaaggaaaaaggggagatgcctgtgaaggggactccggagggcctttcgtaatgaagtccccctttaataatagatggtaccagatggggatcgtgtcatggggggaggggtgtgatagggatgggaaatacggattctatactcacgtgttcaggctcaagaagtggattcagaaagtgatcgatcagtttggagaa

SEQ ID NO: 8587 - DNA, 1866 bp, Artificial Sequence
  Description of Artificial Sequence: Synthetic coding sequence
atggctcacgtgcgcggcctccagttgccaggatgcctggccctggcggcgctgtgcagcctggtccattcacagcatgtgttcctggcaccgcaacaggctcggagcctgctgcagcgcgttcgacgggccaatacgttcctcgaagaggttaggaaagggaaccttgaacgggagtgcgtagaggaaacctgctcctatgaggaggcattcgaggctctggagtcctcaaccgcaaccgacgtgttctgggccaagtacactgcatgtgagaccgcacgcacgccacgcgataaactggcagcctgtcttgagggcaactgtgcggagggtttaggcaccaactatcgtggccatgtgaacattaccagaagcggcattgagtgccagctgtggcgctcacgttacccgcacaagccggaaattaacagcacaactcacccaggagccgacctgcaagagaatttctgccgcaacccagatagcagcacaacgggcccctggtgttacactacggatcctaccgttaggcggcaggaatgttcaatcccggtgtgtggccaggatcaggtgaccgtggccatgacccctcgatccgagggtagcagcgtgaacctgagcccgccattggaacagtgcgtccctgataggggccaacagtatcaaggtcgcctcgcggtcaccactcacggcttgccatgtctcgcgtgggcatccgcgcaagcgaaagcgctgtcaaaacaccaggactttaactccgctgtgcaactggttgagaatttctgtcgaaacccggatggggatgaggaaggtgtgtggtgctacgttgcaggtaagcctggcgattttggttattgtgacctgaattactgcgaggaagcagttgaagaagagacaggcgacgggctggatgaggacagcgatagggctattgaaggacgcaccgccacttcagagtaccaaactttctttaacccacgcacttttggcagcggggaagccgattgcggcctcaggccgctttttgaaaaaaaatcgctggaggataaaaccgagagggagctgctggagagctacatcgacggtagaatagtggagggtagcgacgcagaaattggtatgtctccgtggcaggtgatgttgttccggaagagtcctcaggaacttctgtgcggagccagcctgatcagcgatcgttgggttctgacggctgcgcactgcctgttgtacccgccatgggacaagaactttacggaaaacgacctcttagtacgcattggaaagcacagccgcacgcgctacgagcgtaacatcgaaaaaatatctatgctagaaaagatttatatccatccgcggtacaactggcgagaaaaccttgaccgagatatcgcactgatgaagctgaagaagccggtcgctttttcagactatatacatccagtttgtttacctgaccgggaaacagccgctagcctcctacaggctggatacaagggccgcgtgacgggctggggaaatttgaaggagacctggaccgcgaatgtcggtaagggtcaaccatccgtcctgcaagtggttaacctgccgattgttgaacgcccggtttgcaaagatagtacgcgtatacgaatcacggacaatatgttttgtgccggttacaagccggacgaaggtaagcgaggtgacgcgtgcgaaggtgatagcggcggcccgttcgtgatgaagagcccgtttaataaccggtggtatcagatgggtatcgtgagctggggcgagggctgtgaccgcgacggtaagtacgggttttacacccacgtctttcgtctgaaaaaatggatccaaaaggttatcgaccagtttggtgag

SEQ ID NO: 8588 - DNA, 1866 bp, Artificial Sequence
  Description of Artificial Sequence: Synthetic coding sequence
atggcacacgtgcgggggctccagctgcccggctgccttgccctggcagccctgtgctccctcgtacactcacaacatgtcttccttgcacctcagcaagcacgatctttgttgcaaagagtgcgaagagcaaacacgttcttggaagaagtgcggaaaggtaatttggagagagaatgcgtggaagaaacctgcagctacgaagaggccttcgaggctctcgaaagtagtaccgcaactgatgtcttctgggctaagtacacagcttgtgaaactgccagaacccctcgcgacaagctcgcagcctgtcttgagggtaattgtgccgagggacttggaacgaattatagaggacacgtgaacatcaccagatcagggattgaatgtcagctgtggagaagtcgctatccacacaagccagaaattaactctacgactcaccccggtgcagacctccaggagaacttttgtcggaatcctgatagcagtaccacagggccatggtgctacacgacggacccaacggtgagacgccaggagtgttcaatccctgtatgcgggcaagatcaagttacagttgctatgacaccacgctctgagggctccagcgtgaaccttagtccgcccctggaacagtgtgtacctgatcggggccaacagtaccagggaagattggccgttaccacacatggcttgccttgcctcgcttgggcctcagctcaggccaaggccctttctaaacatcaggacttcaacagtgcagtgcaactggtagagaatttttgtcggaacccagacggggatgaagaaggtgtctggtgttatgtggcggggaagccaggcgatttcgggtattgtgacctgaattactgtgaagaggcggtggaagaagaaacgggggatggcctcgacgaagattctgaccgcgctatcgaaggtcggacggcgacctccgaatatcagacgtttttcaatcctcgaacattcggtagtggggaggcagactgtggcttgaggcctctcttcgagaagaagtcactggaggataaaacagagagagagctgcttgagtcctacatcgatgggcgaatcgttgagggctcagatgctgagattggcatgagtccgtggcaggtgatgttgttccgcaagtcaccacaggaacttctgtgcggggctagcttgatcagtgacagatgggtcctgaccgcggcacactgtcttttgtatccaccttgggacaaaaatttcaccgaaaatgatctcctcgttagaatcggcaaacattcacggaccaggtacgaacgaaacatcgagaagatctccatgctggagaagatctacatccatcctcgctacaattggagagagaacctggacagagacatagctctcatgaagctgaaaaaacccgtggctttctcagactatattcaccccgtgtgcttgccagatagggagaccgctgcctctctgcttcaggcagggtataaaggccgggttactggatgggggaacctcaaggaaacctggaccgcaaatgttgggaagggtcagcctagtgtactccaggtcgtgaacctgccaatcgtggagcgaccagtgtgtaaggattcaacccgcattcgaatcaccgataatatgttttgcgctggatacaagcccgacgaaggcaagagaggcgatgcttgtgaaggcgactccggcggaccattcgttatgaagagcccattcaacaataggtggtaccagatgggaattgtgtcctggggagagggttgtgatagagatggcaaatacggcttttatacacacgtgttcagactcaagaagtggattcagaaggtgatcgatcagttcggggag

SEQ ID NO: 8589 - DNA, 1866 bp, Artificial Sequence
  Description of Artificial Sequence: Synthetic coding sequence
atggctcacgtcaggggactccaactgccaggctgcctcgcacttgcggccctgtgctcactggtgcacagccagcacgtgttcctggccccacaacaggcaagaagcctgctccagcgcgtccggagggccaatacatttctggaagaggtgagaaaaggaaacttggagagagagtgtgtggaggagacgtgcagttatgaagaggctttcgaggcactggaatcgtctacagccactgacgtattctgggccaagtataccgcttgtgagacagcgcgcacaccacgggataagctggccgcttgtttggaaggaaactgcgccgaaggcctgggcacaaactataggggtcacgtgaacattacccgcagcggcattgagtgccaactgtggcggagcaggtacccgcataagcccgagattaacagtactacccatccaggggcagacctccaggagaatttctgcaggaacccggacagtagcacaacagggccatggtgctatacaacagaccctacagtgagaaggcaggagtgctctattcccgtgtgcggacaagatcaggtcacagtagcgatgactccccgttcagaaggatcttcagttaatctctcaccccctttggagcagtgtgtgccagaccgcgggcaacaataccagggtagattggctgttactactcatggcctcccatgtcttgcttgggctagcgcccaggcaaaagcccttagtaagcaccaagacttcaactccgcagtgcaactggtggagaacttttgcagaaaccctgatggcgatgaagaaggcgtgtggtgctatgtggccggaaaaccaggtgatttcggatattgtgacctcaattattgcgaggaagctgtcgaagaagaaaccggagacggtctggatgaagacagcgatagagctatcgaaggtagaacagctaccagtgaatatcagacattctttaaccctaggacatttggctctggagaagccgactgtgggctgcgcccgctgtttgaaaaaaaatccctcgaagacaagacagagcgagagctcctcgagtcttacattgatggacgaattgtagagggaagcgacgctgaaatcggaatgtctccgtggcaggtgatgctgtttcggaaaagcccccaagaactgttgtgcggtgctagcctcatctctgatagatgggtcctcacagcagctcattgccttctgtacccaccctgggacaaaaattttacagaaaacgaccttttagtgcgcatcggcaaacatagtagaacccgctatgagagaaatatcgaaaagattagcatgctcgagaaaatctacatccacccaagatacaattggagggaaaacttagacagggacatcgctcttatgaaactgaaaaagcccgtggctttcagcgattatatacaccctgtgtgtctccctgacagagagacagccgcatcacttctgcaggccggttacaagggcagggttacaggctgggggaatctgaaggaaacttggacagcaaacgtgggaaaaggccaaccgagtgttttgcaggtggtgaacctgccgatcgtggaaaggccagtatgtaaggatagcacacgcatccgaattactgacaacatgttttgtgctggatacaaaccagatgagggaaaacgcggagacgcttgtgagggagacagcggcggaccctttgtgatgaagagtcctttcaataatcgctggtatcagatgggaattgtgagctggggcgaaggatgtgatagggatggaaaatacggattctatactcacgtgttcaggttgaagaagtggatccaaaaagttatcgatcaattcggcgaa

SEQ ID NO: 8590 - DNA, 1866 bp, Artificial Sequence
  Description of Artificial Sequence: Synthetic coding sequence
atggcgcacgtgcgagggcttcagcttcccggttgtcttgcactcgcggcactctgctcgctggtgcattcgcaacatgtgtttcttgccccacaacaggcaagatcgttgctgcagagggtgcgccgagcgaacaccttccttgaagaggtgcgcaagggaaacctggaacgtgagtgtgtggaagaaacttgttcttacgaagaggcattcgaggcactggaatcgtccaccgcaaccgacgtcttttgggcaaagtacactgcatgcgaaaccgcacgcaccccgagagataaactggcagcatgcctcgaaggtaactgcgccgaaggcctgggtacgaactaccgtggacatgtgaacattactcgctcgggtattgaatgtcagctctggcgctctcggtacccacataagccagaaatcaattccacgacccacccgggagcagatttgcaggaaaacttttgtcgtaaccctgattcctccactaccggaccttggtgctacaccactgaccctactgtgcgccgtcaagaatgtagcatcccagtgtgcggtcaagatcaggtgacggtggcaatgactcctcggtcggaaggatcatcagtgaacctgtcaccgcctctcgaacaatgcgtgcctgacaggggccaacaataccaggggcggctcgcagtgactacccatggactgccttgccttgcttgggcttcggcacaggccaaagcactctccaaacatcaagactttaacagtgcagtgcaactcgtcgaaaacttctgcagaaatccagatggagatgaggagggagtgtggtgctacgtggccggaaagccaggggattttgggtattgtgatctcaactactgcgaggaggcagtggaagaggaaaccggggatgggcttgatgaggattcggatcgggcaatcgaaggccggactgccaccagcgaataccagacctttttcaaccccagaactttcggttccggcgaagctgactgtggacttagaccactttttgaaaagaagtcacttgaagataaaaccgagagagaactcctcgaaagctacattgatgggaggatcgtggaagggagcgatgccgagatcggaatgagcccgtggcaggtgatgctttttcgcaagtcgcctcaagagcttctgtgtggtgcaagcctgatcagcgatcggtgggtgctcacggccgcacattgcctcctgtacccaccttgggataagaacttcaccgagaacgaccttctggtgcggatagggaaacatagccgtactcgctacgaacgcaacattgagaagattagcatgttggagaagatatacattcatcctcgttacaactggcgggagaaccttgatcgcgatattgcactgatgaagctgaagaagccagttgcgttttcggactacatccatcctgtgtgccttcctgacagagaaaccgcagcctcgctgcttcaggcgggatacaaggggcgggtgactggatggggaaacctgaaggaaacttggactgccaatgtgggaaagggtcagccctccgtcctccaagtcgtgaatctgccaattgtcgaacgaccagtgtgcaaggatagcacccgcataagaattactgacaatatgttctgtgccggttacaaaccagacgaagggaagagaggagacgcgtgtgaaggggatagcggtggtccctttgtcatgaaaagcccttttaacaacagatggtaccaaatgggtattgtgtcctggggagagggatgcgaccgtgatggaaagtatgggttctacacccacgtgttcagacttaagaaatggatccaaaaggttattgaccaatttggtgag

SEQ ID NO: 8591 - DNA, 1866 bp, Artificial Sequence
  Description of Artificial Sequence: Synthetic coding sequence
atggcccatgtgaggggcctgcaacttcctgggtgcttagccttagccgccctttgtagcctggtccactcacaacacgtatttctcgccccccagcaggcacggtctctgctgcagagagttagaagagctaacacattcctggaagaagtgagaaagggaaatctggagagagagtgtgtggaggaaacctgtagctatgaagaggcgttcgaggccctggagtcctcgactgctacggatgtcttctgggcgaagtatactgcttgcgagaccgccaggacaccaagagacaagttagccgcctgtcttgaggggaattgcgcggaagggctgggaactaactaccgagggcacgtgaatattacgcgcagtggcattgagtgccaactgtggcggtctagatatccacacaaacctgagatcaactccactactcacccgggcgccgatcttcaggagaatttctgccgtaatcctgactcgtctacaactggcccatggtgttacaccacagaccccaccgttcgcaggcaggaatgttctatccccgtgtgcggtcaagatcaagtgacagtcgctatgactcccaggagcgagggatccagtgtcaatttaagccccccacttgaacagtgcgtgcccgacagaggtcagcaataccagggccggcttgctgtgaccactcatgggctcccttgtctggcatgggctagcgcacaggccaaggcgctcagcaaacaccaggatttcaatagcgcggtccaacttgtggaaaacttttgtcggaatcctgatggagacgaagaaggagtgtggtgctacgtggctgggaaacccggcgactttgggtactgcgacctgaattactgcgaggaagccgtcgaggaggagacaggtgatggactggatgaggacagcgaccgggcaatcgaagggcggaccgccaccagcgagtaccagacattcttcaacccaaggacatttgggagtggggaggcggactgcggactgaggccgctgttcgagaagaaaagcctagaggataaaaccgaaagagaattattggaaagctacattgacggtaggatcgttgaaggttctgatgccgagataggaatgtccccctggcaagtgatgctatttaggaagagtccgcaagagctactatgtggagcttcactaatcagcgaccgttgggtgctcacggcggcacattgcctgctgtaccctccttgggacaagaattttacagagaacgatctactcgtgcgaatcggcaagcactctcgcacgcgctacgagagaaatattgagaaaatatccatgctggagaaaatttatatacacccacgatataactggcgcgaaaacctcgatagagacatcgctttgatgaagctgaagaagcccgtcgccttctcagactatatccacccggtgtgtttgcctgaccgcgaaacggccgcctcgctcttacaggccggatacaagggtcgggtgacgggttggggcaacttgaaggagacatggaccgcgaatgttgggaaagggcagccatccgtattacaagtggtcaacctgccaatagtggagcgtccggtttgcaaggactctactagaattagaattacagacaacatgttttgcgccgggtacaagcctgacgagggcaagagaggggatgcctgcgaaggcgattcaggcggcccatttgtcatgaagtctccctttaacaatcgatggtaccagatgggtattgtgtcgtggggggaggggtgtgaccgagacggaaagtatgggttctatacccacgtatttcggctcaaaaaatggattcagaaagtgattgatcagttcggggaa

SEQ ID NO: 8592 - DNA, 1866 bp, Artificial Sequence
  Description of Artificial Sequence: Synthetic coding sequence
atggcacatgtccggggcctgcagctgccgggttgcctggccctggctgcgctgtgttcactggtgcactcacaacacgtctttcttgcacctcagcaggcgagatcactcctgcagcgggtgcgcagggcgaatacctttctggaggaagtccgcaaaggaaacctcgagcgggaatgcgtggaagaaacttgttcatacgaagaggcttttgaggcactggagtcgagcaccgcgactgacgtcttttgggcaaaatacactgcttgcgagactgccagaaccccccgcgacaagctcgcggcctgcctggaaggaaactgtgccgaaggccttgggaccaactaccgcgggcatgtgaacattacccgctccggaatcgaatgtcaactgtggcgctcgcgttatccacacaagccggagatcaactccaccacccatcccggagccgacctgcaagagaatttctgtcgcaatcccgactcctcgaccacgggaccatggtgctacacgactgaccctactgtgcgccgccaagaatgcagcattccagtctgtggacaagaccaggtgactgtcgcgatgaccccaaggtccgagggctctagcgtgaacctgagcccgccgctggaacagtgcgtcccggatcggggacaacaataccaggggcgtttggcggtaactacccacggtctgccgtgcctcgcatgggcgagcgcacaagccaaagcactgtccaagcatcaggacttcaacagcgccgtgcaactcgtggaaaacttctgccgcaatccggatggagacgaagagggagtgtggtgttacgtggctggcaagcccggagattttgggtattgcgacctcaactactgcgaagaggcggtcgaagaggagactggagacggactcgatgaggattcagatagagcaatcgagggccgcaccgccacctctgaataccaaacctttttcaacccacgcaccttcgggtcgggggaagccgattgcggtttgcgcccgctcttcgagaagaagtcgctggaagataagaccgaacgcgaactcctggagtcgtacatcgacggacggattgtggagggcagcgacgccgaaatcggtatgtccccctggcaggtgatgctgttccggaagtcccctcaggagctgctctgcggggcatcgctgatttcggaccggtgggtgctgactgctgcgcactgcctgctgtacccgccgtgggacaagaacttcaccgagaacgatcttctcgtgcgtattggaaagcactcaaggactaggtacgagcggaatatcgaaaagatttcaatgctggagaagatctacattcaccctaggtacaattggcgggagaatctggacagagatatcgccctcatgaaacttaagaaacctgtcgctttctcggactatatccatccggtgtgcctcccagatcgggagactgctgccagcctgctgcaagcgggctacaagggccgcgttaccggctggggaaatctgaaggagacgtggaccgcgaacgtgggcaagggacaaccttctgtgcttcaggttgtgaatctgccgattgtcgaaagaccggtctgtaaggactcgaccagaatacgcatcacggacaacatgttctgcgccggatacaaaccggacgaaggaaagagaggcgatgcatgcgaaggagattccgggggccccttcgtgatgaaatcgccgttcaacaaccgatggtaccaaatgggaatcgtctcgtggggagaaggatgtgacagggacggaaaatacggtttttacactcacgtattccgtctcaaaaagtggatccagaaggtgatcgaccagttcggggag

SEQ ID NO: 8593 - DNA, 1866 bp, Artificial Sequence
  Description of Artificial Sequence: Synthetic coding sequence
atggcccacgtgcgcggcttgcagctacctggatgtcttgccctagctgccctatgctccctggtccacagtcagcacgtatttttagctccgcagcaggcaaggtctttactgcagagagtgcgccgtgccaatacgttccttgaggaggtgaggaaaggcaacctggaaagagaatgcgtggaggagacatgctcctatgaagaggccttcgaggccctcgagagttccacagccacggatgttttttgggctaagtatacagcctgtgaaaccgcaagaactcctagggacaaacttgcagcctgcctcgagggtaattgcgcagaagggctcggcactaactaccggggacatgttaatataactaggagcggtattgaatgccagctgtggcgctcccggtacccccataagccggaaataaacagcactactcatcccggcgcggatctccaggagaacttttgtaggaacccggacagtagtacaacagggccatggtgctacacgacagatcccaccgttaggcgccaggagtgtagcattcccgtctgcggccaagatcaggttacagtggctatgacaccgagatcagagggatcttccgtgaatctaagtcccccgctggagcagtgtgtacccgatcgcggccagcagtatcaaggacgactggccgtgactacacacggcctgccttgcttggcctgggcatccgcacaggctaaagccctctctaagcatcaggactttaactctgctgtccagcttgtagagaacttttgccgcaacccggacggagacgaagaaggggtgtggtgttatgtcgccggcaaacctggagactttggatactgcgacctgaactactgcgaggaagctgtcgaggaagaaaccggagacggcctggacgaggactcagacagggctatcgaaggacgaacagccacaagcgaataccagacattcttcaatcccagaaccttcggcagcggtgaggctgactgcgggctccgccccctgttcgaaaaaaagagcctggaagacaagactgagagagaactcctggaatcctatatcgatggccgtattgtggagggatccgacgccgagattggaatgagtccctggcaggtaatgctttttagaaaatctccccaggaactcttatgcggagcttcgctgatcagtgatcgctgggtcttaacggccgcccattgtctgctttatcccccctgggacaagaacttcacggagaatgacctcctggttaggattgggaagcacagtagaaccaggtatgagagaaacattgagaagatcagcatgttagagaagatttacatccacccaaggtataattggagggaaaacctggacagagacattgcgttgatgaagcttaagaagccagtcgctttcagcgactatatccaccccgtgtgcctgccagacagagagaccgccgcctcactgcttcaggcagggtataaggggcgcgtgaccggctggggcaacctgaaagaaacttggaccgctaacgtggggaaggggcagccttcagtcctgcaggtggtcaacctgcccatcgtagagcgtccagtttgtaaagattccacacggatacgcatcaccgacaacatgttctgcgcgggctataaacctgatgagggaaagaggggggacgcctgcgagggggactcagggggcccattcgtaatgaaaagcccatttaacaaccgctggtaccagatggggatcgtcagctggggagagggatgtgatagggacggtaagtatgggttttatacccacgtgtttcgtctgaaaaaatggattcagaaggttattgatcagttcggagag

SEQ ID NO: 8594 - DNA, 1866 bp, Artificial Sequence
  Description of Artificial Sequence: Synthetic coding sequence
atggctcacgtccgggggctgcagcttccgggttgtcttgcgctcgccgccctctgctccctggtccactcgcaacatgtgtttctggccccacagcaggcccgtagcctgctgcagcgcgtccggcgcgctaatacctttcttgaggaagtccgcaaaggcaacctggagagagagtgcgtggaggaaacctgtagctacgaagaagcattcgaagcactggaatcaagcaccgccactgacgtcttttgggccaagtataccgcttgtgaaaccgcccgcacccccagagacaagctcgcggcgtgtctcgaaggaaactgcgctgaggggctggggaccaactacagaggacacgtgaacatcactcgcagcggaatcgaatgtcagctgtggcggtcgcggtacccgcacaagcctgagatcaactcgaccacccatcctggagccgacttgcaagagaatttctgccgcaacccggactcatccacgacgggaccctggtgctacactacggatccaactgtgaggcggcaagagtgttctatcccggtgtgcggacaggaccaagtgaccgtggcaatgaccccgcgctcagaaggttcatccgtgaacttgtcgccgccgttggagcagtgcgtcccagatagaggacagcaataccaggggcgtctggcggtgactactcatggactgccgtgcctggcctgggcctccgcccaagcaaaagcgctctcaaagcaccaagacttcaactccgctgtgcagctcgtggagaacttttgccggaatcccgacggagacgaggagggagtgtggtgttacgtggcaggaaagccaggggatttcggctactgcgacttgaactactgcgaagaagctgttgaagaagagactggtgacggactcgacgaggactctgatcgggccattgaaggccggactgcgacgagcgaataccaaactttcttcaatccgcgcaccttcggttcaggtgaggcggattgcggcctcagaccgctcttcgagaagaaatccctcgaagataagaccgaacgggaactgctggagtcatacatcgacggccgcatcgtggaagggtcggatgccgaaattggcatgtccccctggcaagtgatgctctttagaaaatcgccacaggagctgctttgcggcgcctccctgatttccgaccgctgggtgctgactgcagcgcattgcctcctgtacccaccttgggacaagaacttcaccgagaacgacctgcttgtgcgaatcggaaaacactcgcgcactaggtacgaacggaatattgagaagatcagtatgctcgaaaaaatctatatccatccgagatacaattggagagaaaatttggaccgggacatcgcgctgatgaagctgaagaagcctgtggcgttctcggattacatacaccctgtgtgcctgccagatcgcgaaactgctgcaagcctgctccaggccggttacaagggcagggtcaccggatggggaaacctgaaagagacttggactgcaaatgtcggaaagggacagccgagcgttctgcaagtggtgaacctgccgatcgtcgagaggcccgtctgcaaagattcgacccgaatcaggatcaccgacaacatgttctgcgccggatacaagccagatgaaggcaagcgcggtgatgcctgcgagggagatagcggcggacctttcgtgatgaagtcgccgttcaataaccgctggtatcagatgggaatcgtctcctggggagaaggctgcgacagagacggcaaatacgggttctacactcacgtgtttcggctcaagaagtggatccagaaggttatcgatcagttcggagaa

SEQ ID NO: 8595 - DNA, 1866 bp, Artificial Sequence
  Description of Artificial Sequence: Synthetic coding sequence
atggcccacgtgaggggactgcaactcccgggctgcctcgccctggctgccctgtgttcacttgtgcattcacagcacgtctttctcgccccacagcaagcgagatccctgctccaaagggtccggagagccaacacctttttggaggaagtgagaaaggggaatctggaacgcgagtgcgtggaagaaacttgttcgtacgaggaggcgtttgaggccctggagagcagcaccgccaccgatgtattctgggctaaatacaccgcctgcgagactgcgagaacgccgcgggacaaacttgcagcgtgcctcgaagggaactgtgcagagggcctgggaaccaactaccgcggccatgtgaatatcacgagatccggcatcgagtgccagctctggcgatcacgctacccgcacaagcccgagatcaattcaaccacccacccaggagccgaccttcaggagaatttctgtcgaaacccggactcatcgactaccggcccgtggtgctacactaccgacccaaccgttcgcaggcaagagtgcagcattccggtgtgcggtcaagatcaggtgaccgtggccatgactccgcgcagcgaaggctcctcagtgaacctgagccccccgctcgaacagtgcgtgccggatagaggtcaacagtaccagggacggctggccgtgaccactcacggactgccttgcttggcatgggccagcgcgcaggcaaaggcccttagcaagcaccaagacttcaattcggccgtgcaattggtggagaacttctgtaggaacccagacggagatgaggagggagtgtggtgctacgtggcaggaaagcctggcgatttcggatactgtgacctcaattactgtgaagaggcagtcgaagaagaaaccggagacggactggacgaagatagcgatagagcgatcgagggaaggactgcgacttcggaataccaaactttcttcaatcctcggaccttcggctctggcgaagcggactgcgggcttcgccccctgttcgagaagaagtccctggaggacaaaactgagcgcgagctgctggaatcgtacatcgacggccgcatagtggaaggcagcgacgccgaaatcggaatgtccccatggcaagtgatgctgttcagaaaatcaccgcaggaattgctgtgtggagcaagcctcatctcggacagatgggtgctgacggccgcccattgcctgctctacccgccctgggacaaaaactttactgaaaacgatctcctcgtgaggattggaaaacattcaagaacccggtacgagcgcaatatcgagaagatctcaatgttggagaagatctacattcatccgcggtacaactggcgggagaacctcgaccgcgacatcgctctgatgaaactgaaaaagccagtggccttctcggactacatccacccggtgtgcctccctgaccgggaaactgccgcctcgctcctgcaggcgggctacaagggacgggttaccggatggggaaacctgaaggaaacttggactgccaacgtgggcaagggacaaccatcggtcctccaagtggttaacctgcctatcgtcgagcgcccggtctgcaaagattcgactcgcattagaatcaccgacaacatgttctgcgcgggatataagcctgatgaggggaagcgaggagacgcatgcgagggagactcgggaggacctttcgtgatgaaatcgcctttcaacaaccggtggtaccagatggggatcgtgagctggggcgaaggatgcgatcgagacggaaagtatggcttctacactcacgtgttcagactcaagaaatggatccaaaaagtcattgaccaattcggcgag

SEQ ID NO: 8596 - DNA, 1866 bp, Artificial Sequence
  Description of Artificial Sequence: Synthetic coding sequence
atggcacatgtgagggggctccagctgcctggatgtttggcgctggcggcgctttgttcactcgtccatagccagcacgtgttcttggccccgcaacaagcgcggagcttgttgcagcgtgtgcggcgggccaacaccttcctcgaggaggtgcgaaaggggaacctcgagagggaatgcgtcgaggaaacttgtagctacgaagaggcattcgaggcgctggagtcatccaccgctacggacgtgttctgggccaagtacacggcgtgcgagactgcccgcaccccgcgcgataagctcgcggcatgcctcgaagggaattgcgcggaaggactggggaccaactaccgaggccacgtgaatatcactcgctctggcattgaatgtcagttgtggcgctcgcgctacccccacaaaccggagataaactcaaccactcatccaggagcagatttgcaagagaacttttgtcgcaaccctgactcatcgaccaccgggccttggtgctacaccaccgacccgaccgtgcggcgccaggagtgctcgattccggtgtgcgggcaggaccaggtgactgtggccatgactcctcggagcgagggctcgtcggtgaatctctcaccaccattggagcagtgtgtccctgacaggggacagcagtaccagggacggctcgccgttacgacccacgggctgccatgccttgcctgggcctcggcgcaagcaaaagccctgagcaagcaccaagacttcaattcagctgtccagctggtcgaaaacttctgccgcaacccggacggcgacgaagaaggcgtctggtgttacgtggctggcaagccgggagacttcggatactgcgatctcaattactgcgaagaagcggtggaagaagaaaccggagatgggctggatgaggactccgaccgggcaattgaagggagaactgccacttcagagtaccaaaccttctttaatccacggaccttcggatcaggggaagcagactgtggactgcgtccactgttcgaaaagaagtcgctggaggacaaaactgaacgggagttgttggaatcctacatcgacgggagaatcgtggagggttcggacgcagaaatcggaatgtccccttggcaagtgatgctgttccgcaagtcaccacaagaactgctgtgcggagcttccttgatctccgacagatgggtgctgaccgccgcgcattgcctcctttacccaccttgggataagaacttcaccgagaacgacttgctcgtgagaatcgggaagcactcccggacgcgctacgaaagaaatatcgaaaagatctcgatgcttgaaaagatctacatccacccccggtacaattggcgcgaaaacctggacagagatatcgccctgatgaaactgaaaaagccggtggccttttcggattacatccacccggtttgcctgccggaccgcgaaactgccgcttccctgctgcaggccggatacaagggacgcgtcactggttggggaaatctgaaagaaacctggactgcgaacgttggaaagggccagccgagcgtgcttcaagtggtgaacctgcccatcgtcgagcgcccggtgtgcaaggattccacgaggatccgcatcaccgataacatgttttgcgcgggatacaagcctgatgaagggaagcgaggagatgcatgcgagggagactcgggcggccccttcgtcatgaagtccccattcaacaaccggtggtaccagatgggaatcgtctcttggggagaaggatgcgatcgcgacggaaagtatggtttctatactcatgtttttcgcctcaaaaagtggatccagaaggtcatcgaccagtttggcgag

SEQ ID NO: 8597 - DNA, 1866 bp, Artificial Sequence
  Description of Artificial Sequence: Synthetic coding sequence
atggcgcatgtgcgcggcctgcagctgccgggatgcctggcgctcgccgcgctctgcagcctggtgcactcccagcacgtgttcctggcaccacaacaggctagaagcctgttgcaacgcgtgcgccgtgccaacacttttctcgaagaagtgaggaagggcaaccttgagcgcgaatgtgtggaggagacgtgttcctacgaagaagcattcgaagctctcgagtcctcaactgcaaccgacgtattctgggccaaatacaccgcgtgtgaaaccgcgcgcaccccgcgtgacaaactcgccgcttgtctggagggaaactgcgcagaaggactcggaaccaattaccggggacatgtcaacatcactaggtcagggatcgaatgccagctctggcggagccgctacccccacaaacccgaaatcaacagcactacccacccaggcgctgacctccaggaaaacttctgccgtaaccctgattcgagcaccaccgggccgtggtgttacaccaccgatcccaccgtccgccggcaggagtgctcgatcccggtctgcggccaggaccaagtgactgtggcaatgaccccaaggtcggaagggagctccgtgaatctgtcgccgccattggaacagtgcgtgccggatcggggtcaacagtaccaggggcggctcgcggtgaccacccacggcctgccttgcctcgcctgggcctcagcccaagcgaaggccctctccaagcaccaggactttaacagtgcggtccagctggtggagaatttctgcaggaacccggatggggatgaagagggagtgtggtgctacgtcgcaggcaagcccggggatttcgggtactgtgatctcaactactgcgaggaagccgtggaagaggagactggcgacgggctggacgaggactccgatagagccatcgaaggcaggacggccacctcggaataccagactttctttaacccgcgcacttttgggtcaggggaagcagattgcggactgcggcccctgttcgagaaaaagtcactggaggacaagactgagagagaactgctcgaaagctacatcgatgggcgcatcgtggaagggtctgacgccgaaattggaatgtccccgtggcaggtgatgcttttccggaagtcgccgcaagagctgctgtgtggagcatcgctgatctcagacagatgggtcctgaccgccgcgcactgtctgttgtacccgccgtgggacaagaatttcaccgaaaacgatttgctcgtgagaattggtaagcactcgcggacgagatacgagagaaacatcgaaaagatttccatgctggagaaaatctatatccatccgcggtataactggcgcgaaaatctcgaccgcgacattgccctgatgaagctgaagaagccggtcgccttttcggattacatccatcccgtgtgcctcccggaccgcgagactgcggccagcctgcttcaagccggatacaaagggcgggtcaccggatggggcaatctgaaagaaacttggaccgctaatgtgggaaaaggtcagccttcggtcctgcaagttgtgaatttgccgatcgtcgagcggccggtgtgcaaggattcaaccagaatccgaatcaccgacaacatgttctgtgcgggatacaagccggatgagggcaagcgcggcgatgcgtgcgagggagactccggaggacctttcgtgatgaagtccccgtttaacaaccggtggtaccaaatgggaatcgtgagctggggcgaaggatgcgacagggatggcaagtacggattctacacccacgtgttcaggctgaagaaatggatccaaaaggtgattgatcaattcggagag

SEQ ID NO: 8598 - DNA, 1866 bp, Artificial Sequence
  Description of Artificial Sequence: Synthetic coding sequence
atggcccacgtgaggggcctccaactccccggatgcctggcactcgctgctctatgttcgctggtgcactcccaacatgttttccttgccccacagcaggctcgctccctgctgcagagggtccggagggctaatactttccttgaggaagtacgaaagggaaacctggaacgcgaatgcgttgaggagacctgcagctatgaagaagcctttgaagctctagaaagtagcaccgcgactgacgtcttttgggcaaagtacaccgcctgtgaaactgcacgaacccctcgggacaaactcgccgcctgtttggaaggcaactgcgctgagggtctggggacgaactatagggggcacgtgaacatcacgagatccggcatcgaatgccagttatggagatcacgttacccccacaaacctgagataaactcaacaacgcatccgggcgctgatctgcaagaaaatttttgtcggaaccctgattcctcgacaacggggccttggtgctataccaccgacccgacagtcagacgacaggagtgttctatccccgtgtgcggtcaggaccaggtcaccgtggcaatgacgcctcgctccgagggttcgtcagtcaatttgagccccccactagaacagtgcgttcctgacagggggcagcagtatcagggtcgcctggccgttacaactcatggactgccatgtctcgcgtgggcctccgcacaggcaaaggcattgtcaaagcaccaagatttcaatagcgctgtacagctggttgagaatttctgccggaatcctgacggcgatgaggagggggtgtggtgttatgtcgcaggcaagcccggcgacttcggctactgtgatctcaactattgcgaagaggctgtggaagaagagacgggggatggactggacgaggactccgaccgggccatagagggaagaacagctacctcagagtatcagaccttcttcaatccaaggacattcgggtccggagaggcagactgcggactgcggcctctgtttgaaaagaagtcactggaggacaagaccgaacgggaacttctcgaatcttacatcgatgggcggattgttgaagggtcagacgccgagattggaatgagcccctggcaagtgatgctgtttcgaaaaagtccccaggagcttctttgcggcgcctccctgatatctgaccggtgggttctaacggctgctcactgtctcttataccccccctgggacaaaaacttcaccgagaatgatctgctagtccggattggaaaacacagtcgcacccggtacgaaagaaatattgagaagatatccatgctcgaaaagatttacatccacccaaggtacaattggcgcgagaatctcgaccgcgacatcgccttgatgaagctgaaaaaaccggttgccttcagtgactacatccaccctgtgtgtctgcccgatcgcgagactgctgccagcctcttgcaggccggatacaagggacgggtcacaggttggggtaatttgaaggagacttggacagccaatgtgggaaaaggccaaccatctgtacttcaagtggtgaatttacctatagtggagcggcctgtgtgcaaagacagcacgagaatcagaataacagacaacatgttctgtgctggttacaagcccgatgagggaaagaggggagacgcttgcgaaggggatagcgggggtccattcgtgatgaaaagtccctttaacaaccgatggtatcagatggggatagtttcatggggagaaggctgcgacagggatggtaagtatggattttacacacatgtgtttcgcctgaaaaagtggattcaaaaggtgatcgaccagttcggggaa

SEQ ID NO: 8599 - DNA, 1866 bp, Artificial Sequence
  Description of Artificial Sequence: Synthetic coding sequence
atggcacacgtgcgaggcctacaactacccgggtgcctcgccctggctgctttgtgctccttggtgcatagccagcatgtgttcctagccccccagcaggcaaggagtctccttcaaagggtgcgacgcgccaatacttttctagaagaagttcgcaagggaaatcttgagagggagtgcgttgaggagacctgttcatatgaagaagcctttgaggccctggaatcaagcactgctaccgacgtgttctgggccaagtatactgcttgcgagacagcaagaacccccagggacaaactggccgcttgcctcgagggcaactgcgccgaggggctggggactaactaccggggccatgtcaatatcactagatcaggaatagaatgccaactgtggagaagccggtacccccacaagcccgagataaacagcaccacacaccccggcgctgacctacaggagaacttctgtcgtaatcccgactctagcaccacaggtccatggtgctacacaacagaccctaccgtgcggcgccaggaatgtagcattcctgtgtgcggccaggatcaggttactgtggctatgacccctcgcagtgaaggcagttctgttaacctgtctcctcccctcgaacaatgcgttcccgaccgcggacaacagtaccagggtcgattagccgtgaccacccatggcctgccgtgcttagcctgggctagtgcccaggctaaagcactgtccaagcatcaggattttaatagcgcagtccagctagtcgagaacttttgtcgcaacccagatggcgacgaagaaggtgtttggtgctatgtggcaggcaagcctggagacttcggctactgcgacctgaattactgtgaggaggccgtggaggaggagaccggcgatggcctagacgaggattcagatcgggccatagaagggagaaccgccacctcagaataccaaacttttttcaaccctcggacttttgggtcaggtgaagcagactgcgggctgcgccctctgtttgagaagaagtccctggaagataagaccgagcgcgagctgctggagtcatatatagatgggcgcattgtggagggtagtgacgccgaaattggtatgagtccttggcaggtgatgttattcaggaaaagcccccaggagctcctatgcggagcttctcttatttctgatcggtgggtcttaacagccgcccactgcttattatatcctccttgggacaagaatttcaccgagaatgatttactagtcagaataggcaagcatagccgaacccgctacgagcgcaatatcgagaaaattagtatgctggaaaaaatttatattcacccaagatataactggagagagaatttagaccgggatatcgccctaatgaagctgaagaaaccagtggccttttccgactacatccaccccgtgtgtcttcccgatcgcgaaaccgctgctagcttgctgcaagcaggatataaaggcagagttactggatggggcaacttaaaagaaacttggacagcaaatgtgggcaaaggccagccatcagtgctgcaagtggtcaacctccccatcgttgaacgcccagtttgcaaggactctacaagaatacggatcaccgataatatgttttgtgcagggtataagcccgatgagggtaaacggggggatgcttgtgagggcgattcagggggtccattcgtaatgaaatcccccttcaacaatcgatggtaccagatggggattgtatcctggggcgaagggtgtgacagagacggcaagtacggcttttacacccacgtgtttaggctgaagaagtggatacagaaggtcatcgaccagttcggggag

SEQ ID NO: 8600 - DNA, 1866 bp, Artificial Sequence
  Description of Artificial Sequence: Synthetic coding sequence
atggcacacgtgcggggactgcagttgcccggctgccttgccctggcggcgctctgctccctggtccattcccagcacgtgtttctcgccccgcaacaggcgcgcagcctcctccagcgagtgagacgcgccaacacgtttctggaagaagtgcgcaagggaaatctggagcgggaatgcgtggaggagacttgttcatacgaagaggcgttcgaagccctggaatctagcaccgcgactgatgtgttctgggccaagtacacggcctgcgaaaccgcacgcactccgagggacaagttggccgcgtgcctggaggggaactgtgccgagggactcggcaccaattaccgcgggcatgtgaacatcacccggtctggaatcgaatgtcagctctggcgctcccggtacccacataagccggagattaactcgaccacgcacccgggggccgaccttcaagaaaacttctgccgaaaccccgattcctcgactaccggaccatggtgctacactaccgatccgactgtgagacgacaggagtgctcgatcccagtctgcggacaagatcaggtcaccgtggctatgactcctagatcggaaggctccagcgtcaatctctctccgccacttgagcagtgcgttccagaccgcggccaacagtaccagggacgcctggccgtcactacccacgggttgccttgcctggcatgggcgtcggcacaagcgaaagccttgagcaaacaccaggatttcaactcggccgtgcagctcgtcgagaacttctgtcggaaccctgatggtgacgaggagggagtctggtgttacgtggcaggaaaacctggagacttcggatattgcgatcttaactactgcgaggaagctgtggaggaagaaacgggagatgggctcgacgaagattcagatcgcgccatcgagggacggacggctaccagcgagtaccaaaccttctttaatccgcggactttcggatcaggggaagcagactgcggattgcgcccgttgtttgagaagaaatctctcgaggacaagactgaaagagaactcttggaaagctacatcgatggacggatcgtcgagggaagcgacgcagagatcggaatgtccccctggcaggttatgctgttccggaagagcccacaggaattgctgtgcggcgcctccttgatctcggaccgctgggtgctgaccgcggcacattgcttgctctacccaccgtgggataagaatttcactgaaaacgatctgctggtgcggatcggaaagcactcacggacccggtatgaacggaacatcgagaagatatctatgttggagaaaatctacatccacccgcgctacaactggagggagaatctggacagagatattgcgctgatgaaactgaagaagccggtggccttctccgattacatccatccggtgtgcctgcctgatcgcgagactgcagcttccctgctccaagctggatacaaaggtcgggtgaccggatggggaaatctgaaggaaacctggactgccaacgtggggaaaggacagccgagcgttctccaggtcgttaacctgccgatcgtcgagcggcctgtctgcaaggactccacccgcattagaatcaccgacaacatgttttgcgccggttacaagccggacgagggtaagaggggggacgcttgtgaaggtgactcgggcggaccgttcgtcatgaagtccccgttcaataatcgttggtaccaaatgggaatagtgtcgtggggagaaggctgtgatagggacgggaagtacggcttttacacccacgtgttccgcttgaaaaagtggatccagaaggtaatcgaccagttcggagaa

SEQ ID NO: 8601 - DNA, 1866 bp, Artificial Sequence
  Description of Artificial Sequence: Synthetic coding sequence
atggctcatgtacgaggtctccagctcccaggatgccttgccttggctgcgctttgcagcctggtccattcccagcacgtgtttttagcgccgcagcaggcccgatcccttttgcagcgggtacgacgcgcgaacacatttcttgaagaggttagaaaagggaatcttgagagagaatgtgtggaggagacttgttcttacgaagaggctttcgaggccctggaaagctcaacagctaccgacgtgttctgggcaaaatacaccgcgtgcgagacggcgagaacacctcgagataagcttgccgcttgtcttgaaggaaattgtgctgagggtttaggaactaactatagaggtcacgtcaatatcactcggagtggtattgagtgtcagctgtggcggagccgatatcctcacaaaccggaaataaattcaactacgcacccgggcgcggatctacaggagaatttttgccgtaacccggactcgagcacgacaggcccttggtgctacacgaccgacccgacagtaaggcgacaggaatgttccatcccagtgtgtgggcaagaccaggtgaccgtggcgatgacccctcgatctgagggtagcagtgttaatctgagtccgcctctggagcagtgcgtgcctgaccgtggacagcaatatcaaggccgtcttgctgttacgactcacggactcccctgcctggcttgggcatctgcgcaggcgaaggccctctccaaacaccaagacttcaattccgctgttcagcttgtggaaaacttttgtcgaaatcccgatggtgacgaggagggcgtttggtgctatgtggcaggaaagccaggcgactttggctactgcgatcttaactactgtgaagaagctgtggaggaggaaactggagacggcctagacgaagatagcgaccgcgcgattgagggtcggaccgcaactagcgagtatcagacttttttcaatcccagaacattcggaagtggggaggcagactgcggccttaggccattattcgagaagaagagcctcgaggacaagaccgagcgtgagttgttagaatcatacatcgatggccgcatcgtcgaaggttctgatgccgaaattggtatgtccccctggcaagtcatgctcttccggaaatcgccccaggagcttctttgcggcgctagcctgatttcagaccgctgggtgctcacagctgcacactgtctcctctatccgccttgggacaagaactttactgagaatgacctgctagttcgcataggtaagcatagtcgaacgcgatacgagcgaaacatagagaagatctcgatgctggaaaagatctacattcacccgcgatacaattggcgcgaaaacttggatcgggacatcgccctcatgaagttaaagaagccggttgccttcagcgactatatccaccccgtgtgtctccctgacagagagacagcagcgagccttctccaagcaggatacaaaggccgggtgaccggatggggcaatttgaaagagacgtggactgccaacgtgggtaaggggcagccaagcgtcttgcaggtcgtcaatctgcctattgtagagcgtcccgtctgtaaagactctacacgaatccgaattacagataacatgttttgtgctggctacaaaccagacgaaggaaagaggggcgatgcttgcgagggagactccggcggtccttttgttatgaagtctccgtttaataaccgttggtaccaaatgggtattgtgagttggggtgaaggttgcgatcgtgacggcaaatacggcttctacacacatgttttccgtttgaagaaatggattcagaaggtgatcgatcaattcggcgaa

SEQ ID NO: 8602 - DNA, 1866 bp, Artificial Sequence
  Description of Artificial Sequence: Synthetic coding sequence
atggctcacgtgcgtggacttcagctgccaggttgcctcgcactcgcagcactttgctcactcgtccattcacaacatgtgtttcttgcaccccaacaagccagatccctgctgcaaagagtgaggcgggccaacacctttcttgaggaagtcaggaaggggaatcttgaaagagaatgcgtggaggagacttgctcctacgaggaagcatttgaggccctggaatcgtcgacggcgactgatgtgttctgggcgaagtacaccgcgtgtgaaactgcacggactcctagagataaacttgcagcatgtctggaaggaaactgtgctgaaggactgggtaccaattatcggggacacgtgaacattacccgttccggtatagagtgtcaactttggcgttccaggtaccctcataagccagagatcaattccaccacccaccctggggcagacctgcaggagaatttctgtagaaacccagattcatctaccaccgggccttggtgctacactactgaccctaccgttaggcgccaggaatgctccatcccagtgtgtggacaagatcaggtgaccgtggcgatgaccccacgtagcgaaggatcgtcagtgaacctcagccctccactggaacaatgtgtgcctgatagaggccagcagtaccaaggacggctggcggtcaccactcacggactgccatgtctcgcgtgggccagcgcacaagcaaaggcactctccaagcaccaagacttcaactccgccgtccaactcgttgagaacttttgtagaaatcctgacggtgacgaagagggggtgtggtgttacgtggcgggaaagccaggcgattttggttactgtgacctgaactactgcgaggaagcagtggaagaagaaaccggggatggactggatgaggacagcgatcgagcaatcgagggtcggaccgcaacttcagaataccaaacgttctttaatccgcgcacttttgggtccggagaagctgattgtggcctgcgccctctttttgaaaagaagtccttggaagataagacggaacgcgaacttctcgaatcatacatcgacggccggatcgtggaaggcagcgatgccgaaattggaatgtcaccatggcaagtgatgctttttagaaagtcgcctcaggagcttctgtgtggcgcgtccctcatttcagatcgttgggttctcactgccgcccattgtttgctgtacccgccatgggacaagaactttaccgaaaacgacctgctggtgcggatcggaaagcattcaagaaccagatacgagaggaacatcgagaaaatctcaatgcttgaaaagatttacattcacccccgctacaattggcgcgaaaatctcgacagagacattgctcttatgaagctgaagaagcctgtggcttttagcgactatattcacccagtgtgtctgccggaccgtgagactgccgctagcctcctccaagcgggatacaaaggaagggtcaccggctgggggaacctgaaagaaacctggactgcgaacgtgggaaagggccaacctagcgtccttcaagtggtgaaccttccgatcgtggaacggcccgtgtgtaaagattcgacgagaatcagaattactgataacatgttctgcgctggatacaaacctgatgaggggaaaagaggggatgcatgcgagggtgacagcggaggtccgtttgtcatgaagtcgcctttcaacaacaggtggtaccaaatgggtattgtgtcttggggtgagggctgtgaccgcgatggcaaatacgggttctacactcatgttttccgacttaagaaatggatacaaaaggtcatcgaccagtttggtgag

SEQ ID NO: 8603 - DNA, 1866 bp, Artificial Sequence
  Description of Artificial Sequence: Synthetic coding sequence
atggcgcatgtgcggggacttcagctgccagggtgcctggcgctggccgccctctgctcactggttcattcacagcacgtgtttttggccccccaacaagcgaggtcgctgctgcagcgagtccggcgcgccaacacctttctggaagaggttcggaagggcaacctggagcgggaatgcgtcgaagaaacttgctcgtacgaggaggcgttcgaagctctggagagttcaaccgctactgatgtcttttgggccaaatacactgcttgcgaaacggcccgcacccctcgggacaaattggccgcctgcctcgagggaaactgcgcggaaggactgggaaccaactaccggggccatgtcaatatcaccaggagcggtatcgagtgccaactgtggagatcccgctaccctcacaagcctgaaatcaactcgaccactcacccgggggcggatctgcaggaaaacttctgcagaaatcccgactcgtctaccacgggaccttggtgttacactactgacccaactgttcgccggcaagaatgttccatccctgtgtgcgggcaagaccaagtgactgtcgcaatgaccccaagaagcgaagggtcgtcagtcaacctgtcgcctcctttggaacagtgcgtgcctgacaggggacaacagtaccaaggccggctggcggtgactactcacggactcccttgtctcgcatgggcctccgcccaggcgaaagcgctctccaagcatcaggatttcaactccgcagtgcagcttgtcgagaacttctgccgcaatccggacggcgacgaggaaggagtctggtgctacgtggccggcaagccgggagatttcggctactgtgacttgaactactgtgaggaagccgtggaagaagaaactggggatggactggacgaggattccgaccgggcgattgaaggacgcactgccacctcggagtaccagaccttctttaacccgaggaccttcggaagcggtgaagcggattgcggactgcgtccgctgttcgaaaagaagtcgctggaggataaaaccgaacgggaacttcttgaaagctacatcgacggccgcattgtcgaaggttcggacgccgaaatcgggatgtccccctggcaggtgatgctcttccggaagtcaccacaagaactgctctgcggagcgtcactgatttcggacagatgggtgctgactgctgcccattgcttgttgtacccaccgtgggataagaatttcaccgaaaacgatctcctggtgaggattggcaagcattccagaacccggtacgagcgcaatattgaaaagattagcatgctggagaagatctacatccacccacggtacaactggcgcgagaacctggatcgcgacattgcgctgatgaaactgaaaaagccggtggccttctccgattacattcacccggtgtgcctgccagatcgcgaaaccgccgcctccctgctgcaggcaggatacaaaggtcgcgtgactggctggggcaatctcaaggaaacttggaccgccaacgtgggaaaaggacaacccagcgtgttgcaggtggtgaacctgccaatcgtggaaagacccgtctgtaaagactccacccgtatccgcatcaccgacaatatgttctgtgccggatacaagcctgacgaggggaagcgcggggacgcgtgtgagggagattccggtggaccattcgtgatgaagagcccgttcaataacagatggtaccagatgggaattgtgagctggggtgaaggatgtgatcgcgatggaaagtacggtttctacacccacgtgtttaggctgaaaaagtggatccaaaaggtcatcgaccagttcggggaa

SEQ ID NO: 8604 - DNA, 1866 bp, Artificial Sequence
  Description of Artificial Sequence: Synthetic coding sequence
atggcacatgtgcggggcctgcagcttccaggctgccttgccctcgcagcgttgtgcagtctcgtgcacagtcaacatgtctttctcgctccacagcaggcgagatcactgctgcagagagtgaggcgggccaacacatttctggaagaggttaggaagggcaatttggaacgggagtgcgtggaggaaacttgtagctacgaagaagcatttgaagccctcgagagcagcaccgctaccgatgtcttctgggctaagtacaccgcgtgcgagactgcaagaactccaagagacaagcttgccgcttgtctagaaggaaactgcgctgaagggttaggaactaactaccgcggtcacgtcaacatcacgcgcagtgggatcgagtgccaactttggcggtctaggtatccccataaacctgaaatcaatagcaccacacatcctggggccgacctgcaagagaatttttgtcgcaacccagactcgagtactaccgggccctggtgttacactactgatccaacagtcagaaggcaagaatgttctatccctgtttgtggtcaggaccaggtgacagtcgcaatgacccctcgctcagaaggctcctcggtgaatctctctcctccccttgaacagtgtgtgccagaccgaggacaacaatatcagggccgcctggccgtgaccacacacggattgccttgtcttgcgtgggcatctgcacaagcaaaagctctgagtaagcatcaggactttaattctgctgttcagctggtcgagaatttctgcagaaaccctgacggggacgaagaaggagtgtggtgctatgtcgctggcaaacctggcgattttggatattgcgatcttaattattgcgaggaggccgtggaggaagagaccggagacggattggacgaggatagtgatagagccattgagggaagaaccgcaacctctgaataccagacatttttcaatcctcgcactttcggaagcggggaggccgactgcggtctgagacccctgttcgagaagaagtctttggaggacaagacagagagagagcttttagagagctacatcgacgggaggatcgtggagggcagcgacgcagagatcggcatgagtccatggcaggtgatgctcttccgcaagtcgccccaggaacttttgtgcggtgctagcctgatctctgataggtgggtattgaccgccgcacattgtctgctctatccgccttgggacaaaaactttaccgagaacgacctcctggtgaggattggaaagcattcgagaactcggtacgagaggaatatcgagaagataagcatgcttgagaagatttacatccatcctcggtacaactggagagagaaccttgatagagacattgcattgatgaaacttaagaagcccgttgcattttctgactacatccacccggtttgcctgcccgaccgcgaaaccgctgcttctttgttacaggcaggttacaagggtagggtgacaggatggggcaaccttaaggagacctggacagctaacgttggcaagggccaaccatctgtgctgcaagtggttaacttgccaatcgtggaaaggcctgtgtgcaaagattcgacaaggatccggatcactgataacatgttttgtgccggatataaaccggacgaaggaaaaaggggagacgcttgcgaaggcgactctgggggcccctttgttatgaagtcccctttcaacaacagatggtaccagatgggaattgtgtcttggggtgaaggatgtgatagagatggaaagtatggcttttacacccacgtttttagacttaagaaatggatccaaaaagtcatagaccagtttggcgag

SEQ ID NO: 8605 - DNA, 1866 bp, Artificial Sequence
  Description of Artificial Sequence: Synthetic coding sequence
atggcccacgtcaggggactgcagttgcctgggtgtcttgcactcgctgctctgtgctctcttgttcacagtcaacacgtattcctggcacctcagcaagctcgatcacttctccagcgcgtccggagagctaatacattcctggaggaagtcaggaaggggaacctcgagagagagtgcgtggaagaaacctgctcctacgaggaagcatttgaggcccttgagagcagtaccgccacagatgttttctgggctaaatatactgcttgtgagaccgcccggaccccccgcgataaactggccgcttgtctcgaaggtaactgcgccgaaggactgggcacgaactatcgggggcacgtaaacattacacgatcaggtattgagtgccagttgtggaggagccgctatccacataagcccgaaattaacagcacgacacacccgggggcagacttgcaggaaaacttttgtaggaacccggactcctctacaacaggaccctggtgctacacaactgatccgaccgtcagacgacaagagtgcagcatcccagtgtgcggacaggaccaagtgacagttgctatgaccccccgtagcgaggggagttctgttaatcttagtccccccctggagcagtgtgtcccagatagaggtcagcagtatcaagggagattagcagtgaccactcacggcctcccttgtctggcttgggccagtgcacaggctaaggctctgagcaaacatcaggatttcaattctgcagtgcagctggtagagaacttctgccgcaaccctgacggagatgaggaaggtgtgtggtgctatgtggcaggaaagcctggcgatttcggctactgcgacctcaactactgcgaggaggcagtcgaggaggagaccggtgacggccttgacgaggacagcgaccgcgctatcgaaggccgcacagccacgtctgagtaccagacctttttcaatccaagaacctttgggtccggggaggccgattgcggacttcggcccctatttgagaagaaatctctggaggataagaccgagcgagagttgctggagtcctatattgatggaaggatcgttgagggctctgatgcagagatcggcatgagcccctggcaggtgatgctgttccggaaatcccctcaagaactgctctgcggcgctagcctcatctcagacaggtgggtccttaccgctgcccactgtctactgtatcccccttgggacaaaaatttcactgagaatgatctattggttcgtatcggcaagcatagcaggactaggtacgagcgcaacatcgagaaaatcagtatgcttgaaaaaatatacattcatcccaggtacaattggagggaaaacttggaccgagacatcgctctgatgaaactgaaaaaacctgtggcatttagcgactacatccaccccgtctgcctgccagaccgggaaaccgctgcatctctgctgcaggccggatacaagggccgagtaaccggctggggtaacttgaaggagacttggacagccaacgtggggaagggccagcccagcgtactccaggtggtgaatctccccatcgttgagaggcccgtttgcaaggactcgactaggattagaatcaccgataacatgttctgcgctggttataaaccagacgagggcaagagaggtgacgcctgcgaaggggactcgggcggacctttcgttatgaaaagcccatttaacaatagatggtaccagatgggtatcgtctcctggggcgaagggtgcgatcgggacggtaagtatgggttttacacccacgtctttcgactgaaaaaatggatacagaaggttatagaccagttcggggaa

SEQ ID NO: 8606 - DNA, 1866 bp, Artificial Sequence
  Description of Artificial Sequence: Synthetic coding sequence
atggcacacgtaagaggactccaattgcccggctgcctggctctggctgcactgtgtagcctggtgcactcacagcacgtattcctggctccacagcaagcgagaagcctgcttcaacgggtgcggcgagcaaacacgtttttggaggaagtgcgcaaaggcaacttggagcgggagtgtgtggaagagacgtgctcatatgaagaggcctttgaggcattggagagcagtacagccactgatgttttctgggcaaagtacacggcctgcgagacagcgcggacccctagggataagctcgccgcctgtctcgagggcaactgcgccgaggggctcgggacgaactaccgaggccatgtcaacattacccggtctggtatcgagtgtcagctttggaggtcccggtatccacataaacctgagatcaatagcacaactcatcctggtgcagatcttcaggaaaacttctgcaggaaccccgactccagcactacaggcccttggtgctacacgacggaccccaccgtgcgccgccaggagtgtagtatacctgtgtgtggccaggatcaggtgactgtggctatgactccacgcagcgagggatcctccgtgaacctgtccccaccactggaacaatgtgtcccggatcgggggcagcagtaccagggtaggctggcggtcacgactcatggcctcccgtgtttggcctgggcgtccgcacaggccaaggcattgtccaagcatcaggacttcaatagtgcggtccagttggtggaaaacttctgtaggaatcccgacggggatgaggaaggcgtgtggtgttacgtggcggggaagcccggggattttggctattgcgacctgaattattgcgaggaggcagtggaggaggaaaccggggacggcctggatgaagacagcgatcgggccatcgagggaagaacagcaacttctgagtatcagacattcttcaacccacggacttttggctctggcgaggctgactgtggtctgagacctttgttcgagaagaaaagccttgaagataaaacagagcgcgagctgctggagtcttatatcgacggcaggatcgtcgaaggctcagacgctgagatcggaatgtccccctggcaggtgatgctgtttcgaaaaagcccacaggagctgctgtgcggcgcatctctgatctctgatcgctgggtcctgaccgccgctcattgccttttgtatccgccttgggataagaacttcaccgaaaacgaccttctcgtgcgcattgggaaacattctcggaccagatacgagcgcaacatcgaaaaaatcagcatgctggaaaaaatttatatccatccacgatataattggcgcgaaaatttggaccgagacatcgctctgatgaagctgaaaaagcctgtggccttctctgactacatccacccagtttgcttgccagacagggagacggctgcctccctgctgcaggcaggctacaaggggcgagtcaccggttggggcaatctcaaggagacttggactgcgaacgtgggtaagggccagcccagtgtgctgcaggtcgtgaacctgccgattgtcgaacggccagtctgcaaagacagtaccaggataagaattacagataacatgttctgcgccgggtacaagccagatgaaggaaaacgcggcgacgcttgtgagggggattccggaggtccatttgttatgaagtctccctttaacaaccgatggtaccagatggggatcgtatcctggggcgagggctgcgacagagatggtaaatacggcttctatacacatgtatttcggcttaagaagtggattcagaaggtgattgatcagttcggcgag

SEQ ID NO: 8607 - DNA, 1866 bp, Artificial Sequence
  Description of Artificial Sequence: Synthetic coding sequence
atggcgcacgtgagaggactgcagctgccaggatgcttggccctggcggcgctgtgtagcttggtgcactcccagcacgtctttctggccccacagcaagcgaggtccctgttgcagcgcgtcagacgcgccaatactttcctggaagaagttaggaaaggaaacttggaacgggagtgcgtggaggaaacgtgcagctatgaggaagcgttcgaagcgctggagtcgtccaccgccaccgatgttttttgggctaagtacaccgcatgtgagacggccagaactccacgggacaaactcgcggcctgtctcgaaggcaactgcgcggagggactgggaaccaattaccgcggacatgtgaacatcactcgctcgggcattgagtgccagctgtggcggtcgcgttacccgcataaaccagaaatcaactcgactacccacccaggagcagacctccaggagaacttctgtcggaacccggacagctcgaccaccgggccgtggtgctacacgaccgacccgaccgtgcggagacaggaatgcagtatccctgtgtgcggacaggaccaagtgactgtggccatgaccccgagatccgaaggatcatctgtcaatctgagcccgccgcttgaacaatgtgtgccggatcggggacagcaataccaagggaggctggcggtcacgacgcatgggctgccttgcctcgcctgggcatctgcacaggccaaggcgctgtcgaagcaccaggacttcaactccgctgtgcagttggtggagaacttttgtaggaacccggacggggatgaagaaggagtctggtgctacgttgcgggcaagcctggagactttggctattgcgacttgaattactgcgaggaggctgttgaagaagaaactggagatggcctggatgaggacagcgaccgcgcgattgaaggacggaccgctacttccgaataccagacgttctttaacccgcggacctttggcagcggagaggcggattgtgggctgcgccccctgttcgagaagaaatccttggaggataagactgaaagagagctgcttgaatcatacatcgacggaagaattgtcgagggctcggatgccgagatcggtatgtccccgtggcaagtgatgctgttcaggaagtccccacaggagttgctctgcggagcctcgctgatctcggacagatgggtcttgaccgcagcgcattgcctgctctaccctccgtgggacaaaaacttcactgaaaatgatctgctcgtgcgcatcggtaaacactcccgcactcggtacgagaggaacatcgagaaaatctccatgctcgaaaagatctacatccacccgcggtataactggcgcgaaaatctggaccgcgacatcgcgctcatgaaacttaagaagcctgtggccttctccgactacatacatcccgtatgcctgcccgatcgagaaacggccgcttcgcttttgcaggcgggatacaaggggcgggtcactgggtggggaaacctgaaagagacgtggaccgcgaacgttgggaaaggacagccgtcagtcctgcaagtggtgaaccttccgatcgtggagcgccccgtgtgcaaggactccacccgcatccgcattactgataacatgttctgtgccgggtacaagccagatgaggggaaaaggggtgatgcttgtgaaggagactcaggaggtccgtttgtgatgaagtcgccgttcaacaatcgctggtaccaaatgggtatcgtctcctggggagaaggctgcgaccgcgatggcaaatacggtttctacacccatgtgttccgcctgaagaaatggatccaaaaggtgatcgaccagttcggagaa

SEQ ID NO: 8608 - DNA, 1866 bp, Artificial Sequence
  Description of Artificial Sequence: Synthetic coding sequence
atggctcacgtgagggggctccagctgcccggatgcctggccttggcagcactgtgctcgctggtacactcacagcatgttttcctagctccccagcaggccaggtccctcctccagcgggtgcgccgcgctaatactttcctcgaagaagttcgcaaagggaacctcgagagagaatgcgtggaagaaacatgctcatatgaagaagccttcgaagcccttgagtcatccacagctactgacgtattctgggcaaaatatacagcatgcgaaacagcccggactccccgggataaactggccgcctgtctggaagggaattgtgctgaaggactagggacaaattatcgaggacacgtaaatatcacacggtctgggatagaatgtcagctctggcggtcacgctatccacacaaaccggaaatcaactccacaacacacccaggggcggatcttcaggagaacttttgtcggaaccctgatagttctacaactgggccatggtgttacactacagatcctacagttcgacgacaggagtgttctattcccgtttgtggacaggaccaggtcacagtggctatgactccccggtccgaagggagttccgttaatctctcgccaccccttgaacagtgtgtgcctgatagaggacagcagtatcaggggagactggccgtgactacacatggattgccatgtttagcctgggccagtgcccaggccaaagcacttagtaaacaccaagatttcaactcagccgttcagttagtcgaaaatttctgccgaaatccagatggagatgaagagggagtttggtgttacgtggctggaaaaccaggagattttgggtattgtgatcttaactattgcgaggaagctgttgaagaagagactggagatgggctggatgaagactccgatagagccatcgaagggagaacagctacatctgagtatcagactttcttcaaccctaggacattcggatctggggaagcagattgtggattgaggccactctttgaaaagaaatctcttgaagataaaacagaaagagaacttctggaatcttatatcgacgggagaatagtagaaggatctgatgcagaaatcgggatgtccccttggcaggtcatgctgtttaggaaatctccccaggaactactctgtggagcttctctcattagtgatcggtgggtcctaactgccgctcattgtctactctaccccccctgggataaaaatttcacggaaaacgatcttttggtccggatagggaagcacagtcgcacacggtacgagcggaatatcgagaaaatttcaatgcttgagaagatatatattcatcccaggtataactggagggaaaacctcgatcgagatatagctcttatgaaactaaaaaaacctgtggcctttagtgattacatacaccccgtgtgtctacccgatagggaaactgccgcgtccctattacaggccggatataaagggcgggtaactggatggggaaacctaaaagagacttggacggcaaacgtggggaaagggcagccaagtgtgctccaagtggtcaatctgcctattgtcgaaaggcctgtgtgtaaagattctacaaggattagaataactgataatatgttttgtgcgggatacaagcctgatgaggggaaacggggagatgcttgcgaaggggattccggagggccttttgtaatgaaaagtccattcaacaataggtggtatcaaatggggattgtttcatggggagaaggatgcgaccgggatgggaaatatgggttctacacacacgtttttcggcttaaaaagtggatacagaaggtgatagatcagttcggagaa

SEQ ID NO: 8609 - DNA, 1866 bp, Artificial Sequence
  Description of Artificial Sequence: Synthetic coding sequence
atggcgcacgtgcgaggtcttcagctgcccgggtgcttagcactagcggccctttgctcattggtgcacagtcagcacgtgtttcttgccccccagcaggcacgttccctgttgcagagggtgagaagagctaacactttcctggaggaggtacggaaaggaaaccttgagcgggaatgtgtggaggagacctgtagttacgaggaggcattcgaggccctggagtccagtaccgccacagacgtcttttgggcaaaatataccgcatgcgagactgcgcggactcctcgcgataagctggccgcttgtttggaaggtaactgtgccgaggggctaggaaccaattatcgtggacacgtgaacattactcggtcgggcattgagtgtcagttatggagaagtcgctacccacacaaacccgagattaacagtacaacccaccccggcgcggatttacaggaaaacttctgccgcaaccccgactcctccacaactggtccttggtgttataccacggatccaaccgtcaggcggcaagagtgctcaattcctgtgtgcggccaagaccaggttaccgtcgcaatgactccgcggtccgagggctcctccgtgaacttgtcacccccactcgagcagtgcgtgcccgaccgcgggcaacagtaccagggtcgtctcgctgtcacgactcacggcctaccatgtctggcatgggctagcgcccaggccaaggcattgtctaaacatcaggattttaattcggcagtccagttggttgaaaatttctgtagaaatcccgatggcgatgaggaaggggtgtggtgctacgtggcaggaaaaccgggcgacttcgggtattgcgatcttaactattgcgaagaggccgtggaggaagagactggggacggacttgacgaagactccgacagggctatagaaggccgcacagcaacgagcgaatatcagacattcttcaatccgagaacgttcggctctggcgaggccgattgcggccttcgcccattgtttgaaaaaaagtcgctggaagataaaaccgagcgggagctgctggagtcatatattgacggaaggatcgtcgagggcagcgatgcggagataggaatgtccccctggcaggtcatgctgttccggaagagcccacaggaactcttatgcggtgccagtcttatatctgataggtgggtgcttacggccgcccactgtctcctataccccccctgggacaaaaactttacagagaatgatctgttggtgagaatcggcaaacattcgcggacgagatacgagcgcaacatcgagaaaatctctatgctcgaaaaaatttatattcatccaaggtacaattggagagaaaatttagacagggatattgcattgatgaaactcaagaaacccgtcgctttttcagattatattcatccagtctgtctgcctgaccgtgagaccgcggcaagccttttgcaggccggctataagggccgagtgaccggctgggggaacctgaaagaaacttggacagctaatgtgggaaaggggcagccttcggtacttcaggtcgttaacttgccaatagtcgagaggcccgtgtgcaaggactccactaggatcaggatcacagacaatatgttctgtgcaggatataagccagatgagggcaagcggggagacgcatgtgagggggattctggcggacctttcgtgatgaaatcgccgtttaataaccggtggtatcagatgggcattgtctcatggggggagggctgcgacagagatggaaagtacggcttctatactcatgtgtttaggctgaaaaagtggatccagaaggtgattgaccagtttggagag

SEQ ID NO: 8610 - DNA, 1866 bp, Artificial Sequence
  Description of Artificial Sequence: Synthetic coding sequence
atggcacatgtgagaggactccaactcccgggatgcctggctcttgccgcactgtgcagcctcgtgcattcacaacatgtgtttcttgcaccccaacaggcacgttcgctgcttcaacgggtgcgcagggccaacacgttccttgaagaggttcgcaagggaaacctggaacgagaatgtgtggaggaaacctgttcgtacgaagaagcgtttgaagctctggaatcctccaccgccacggatgtcttttgggcaaaatacactgcatgcgaaactgcccgtacgccacgggataagctcgcagcgtgtctggagggtaattgtgccgagggtctgggtacgaactacagaggacatgtcaacattacccgttcgggcatcgaatgtcaactgtggcgctctcgttacccgcataagcccgagatcaactccacgactcatccaggggcagaccttcaagagaacttttgtcggaacccggattcctcgaccactggtccttggtgttacaccactgatcctactgtgaggaggcaggagtgctccattcctgtgtgtggacaggaccaggtgaccgtcgctatgacccctaggtccgaaggatccagcgtgaacttgtcgccgcccctggagcaatgcgtgcctgatcggggccagcaatatcaaggacgactcgcggtgaccactcatgggctcccttgtctggcctgggcatcggcacaagcaaaggccctttctaaacatcaagatttcaattctgcagttcagctggtcgagaacttctgtagaaaccccgatggtgatgaggaaggtgtgtggtgctacgtcgcgggtaagcctggcgactttgggtactgcgaccttaactactgtgaagaggcagtcgaggaggaaacgggggatggccttgatgaggactcggaccgagcaatcgaaggacgaactgcaaccagcgaataccagactttctttaacccacgtactttcggcagcggagaggctgactgtggtcttagacccctcttcgagaaaaagtcgctggaagataagactgagcgcgaacttttggaaagctacatcgatgggaggattgttgaaggatccgatgcagaaattggtatgtctccgtggcaggtgatgcttttccgaaagtcaccacaggaacttctttgcggcgcgagcttgatatcggatagatgggtgctcaccgcagcccactgcttgctctatcccccttgggataagaatttcaccgaaaatgacctgttggtcagaatcggaaagcactctaggacccggtacgaacggaacattgaaaagatatcgatgctcgaaaagatctacattcaccctaggtacaactggcgtgaaaacctggatagagacatcgcgcttatgaaacttaagaagcctgtggcgttttcagactacattcatccggtgtgtctcccggatagagaaaccgccgcctcactgctccaagcgggttacaaagggagagtgactggatggggaaatcttaaggaaacctggactgcaaacgtcggaaagggacagccttcggtgctgcaagtcgtcaaccttcctatcgtcgaaagacccgtgtgtaaagactccactaggattagaattacggacaacatgttttgtgcgggctataaacctgatgaaggtaagcgcggcgatgcatgtgaaggtgattcgggaggcccttttgtgatgaaatcaccattcaacaatcgctggtaccaaatgggaattgtgagctggggtgagggatgcgacagagacgggaaatacggtttttacacccacgtctttcgtctgaagaagtggattcagaaagtgatagatcagtttggcgaa

SEQ ID NO: 8611 - DNA, 1866 bp, Artificial Sequence
  Description of Artificial Sequence: Synthetic coding sequence
atggcccatgtccgaggacttcagctgcctggatgtcttgccctggcagcgctgtgctccttggtgcactcccagcatgtgtttctcgcacctcagcaagcaagatcactccttcagcgcgtgcggcgcgccaacacctttctggaggaagtgcggaaggggaacctggagcgcgaatgcgtggaggaaacgtgttcgtacgaggaagcattcgaggcccttgaatcctcgactgcgaccgacgtgttctgggcaaagtataccgcatgcgaaaccgcccggacccccagagataagctggcggcctgcctggagggcaattgtgcagaaggtctgggaaccaactaccggggtcatgtcaacatcaccagaagcgggattgaatgtcaactgtggagatcccgctaccctcataaacctgagattaactcaacgacccacccgggtgccgatcttcaggaaaacttttgcagaaatccagatagctccacgaccggaccgtggtgttacaccaccgacccaaccgtgcggagacaagagtgttcaattcctgtctgtgggcaggaccaagtgaccgtggccatgacgcctcgatccgagggctcgtcggtgaacctgtcgccaccgctcgaacagtgtgtgccagatcggggacagcaataccaaggtcgtctggctgtgacgacccatgggcttccatgccttgcatgggcaagcgctcaggcaaaggcactttcaaagcaccaagactttaactcggcggtgcagctcgtcgagaacttttgtcgcaatcctgacggcgatgaagaaggggtgtggtgttacgtggcaggcaagcccggtgactttggatactgtgatctcaactactgtgaagaagcagtcgaagaagaaaccggtgatggactggatgaagattcagaccgcgcgatcgagggcaggaccgctaccagcgaataccaaaccttctttaacccacgtaccttcggatccggcgaggcggattgtggacttagacccctttttgaaaagaagtccctggaagataagacggaaagggaacttttggaaagctacatcgatggtcgtattgtggagggatccgacgctgagatcggaatgtcaccatggcaggtgatgctttttagaaaatccccccaagaacttctttgtggagccagccttatttcagaccgctgggtactcactgccgcacactgtttgctttaccccccttgggataagaactttactgaaaacgatcttcttgtccgtattggaaagcattcaaggaccaggtatgaacggaacatcgaaaagatatccatgctggaaaagatttacatccatcctagatacaattggagggagaacttggatcgcgacattgcactgatgaaattgaagaagcccgtggctttctccgactacatccatcccgtatgcctgcctgatcgcgagacggccgcatccctcctgcaagcgggttacaagggccgcgtcactggctggggtaaccttaaggaaacttggactgccaatgtgggaaagggccaaccatcggtgcttcaagtcgtgaaccttcccatcgtcgagcggccagtgtgtaaggactcaaccagaattcgaattaccgataacatgttctgcgcaggttacaagccagatgaaggaaagcgaggagatgcatgtgaaggggattcggggggaccttttgtgatgaagtcgcctttcaacaaccgttggtaccagatgggaattgtgagctggggcgaggggtgcgacagagatgggaaatacggattttacactcatgtctttagactgaagaagtggattcaaaaagtgatcgaccagtttggagaa

SEQ ID NO: 8612 - DNA, 1866 bp, Artificial Sequence
  Description of Artificial Sequence: Synthetic coding sequence
atggcccatgtccgaggcctgcagctgcccgggtgcctggcgctcgctgcactctgctcactggtccatagccaacacgtgttccttgctccccagcaggccagatccctccttcagcgcgtgaggagagccaatacttttttagaggaagtgaggaagggcaacctggagcgggaatgtgtggaggagacctgctcctacgaggaagctttcgaagccctcgaaagctcaacagccaccgatgtattttgggctaagtacacagcgtgcgaaactgcccgaacgccaagggataagcttgccgcctgtcttgaaggtaactgtgccgagggcctgggaacaaactaccgaggccatgtgaacatcaccagatccggcatcgagtgccaactctggcgaagcagatacccgcacaagccagagatcaactcaaccacacatcccggcgctgacctgcaggagaatttttgcagaaatcctgatagtagcaccacaggtccgtggtgttataccacagaccctacggttaggaggcaggagtgctctatcccagtttgtggtcaggatcaagtgaccgttgccatgacacctaggagcgaggggagctcagtcaacctcagccctcccctagaacaatgcgttcccgatagggggcagcagtaccaggggaggctggccgtgacaacccacggccttccttgcctggcatgggcctctgctcaggcgaaggcactaagcaagcaccaggactttaactccgccgtgcagctggtggagaatttctgtaggaaccccgacggggatgaggaaggtgtgtggtgttatgtcgccggcaaaccaggggatttcggctattgcgatctgaactattgtgaggaagcagtggaggaggaaactggagatgggctggatgaagattccgaccgagcaatcgagggaagaacagcaacctctgaataccaaaccttttttaatccccgaacctttgggtcaggggaggcagattgtggcctgaggccactgtttgaaaaaaaatccttggaggacaaaacagaaagggaactgctagagtcctacattgatggaaggatcgtggagggttcggatgccgagataggtatgtccccgtggcaggtaatgctctttagaaagtcgccacaggaactgctgtgtggggccagcctcattagcgacagatgggtgctcacagcagctcactgtctattataccctccttgggacaaaaatttcactgaaaacgatctgttggttagaataggaaagcactcccgcaccagatacgaacgtaacatcgagaagatttcgatgcttgagaagatttatatccatcccaggtacaactggcgtgaaaatctcgacagagatatcgcccttatgaagctgaaaaagcctgtggccttctctgactacattcatcctgtttgcttgcccgacagagaaactgccgcttcactgttacaggcgggctacaagggcagagtgaccgggtgggggaatttaaaggagacatggacagcgaatgttggcaagggtcagcccagtgtgctccaggttgtgaatcttccaatcgtggaacgacctgtctgcaaagacagtaccagaatcagaatcacggacaacatgttttgcgcagggtataaaccagacgaaggtaaacgaggtgacgcttgtgagggcgacagtggtggcccatttgtgatgaagagcccgtttaataaccgatggtatcagatgggcatcgtcagctggggcgagggatgtgatagagatggcaagtatggattttacacccacgtgtttcgcctgaaaaaatggattcaaaaggtaattgaccaattcggagaa

SEQ ID NO: 8613 - DNA, 1866 bp, Artificial Sequence
  Description of Artificial Sequence: Synthetic coding sequence
atggcgcatgtacgaggtttacaattaccgggttgtctagcgctagcggcgttatgttcgttagtacattcgcaacatgtatttctagcgccgcaacaagcgcgatcgttattacaacgtgttcgacgagcgaatacgtttttagaagaagtacgtaaaggtaatttagaacgagaatgtgtagaagaaacgtgttcgtatgaagaagcgtttgaagcgctagaatcgtcgacggcgacggatgttttttgggcgaaatatacggcgtgtgaaacggcgcgtacgccgcgagataaactagcggcgtgtttagaaggtaattgtgcggaaggtttaggtacgaattatcgtggtcatgttaatataacgcgttcgggtatagaatgtcaattatggcgttcgcgttatccgcataaaccggaaataaattcgacgacgcatccgggtgcggatctacaagaaaatttttgtcgaaatccggattcgtcgacgacgggtccgtggtgttatacgacggatccgacggtacgacgtcaagaatgttcgataccggtatgtggtcaagatcaagtaacggtagcgatgacgccgcgatcggaaggttcgtcggtaaatttatcgccgccgttagaacaatgtgtaccggatcgaggtcaacaatatcaaggtcgtttagcggttacgacgcatggtctaccgtgtctagcgtgggcgtcggcgcaagcgaaagcgttatcgaaacatcaagattttaattcggcggttcaactagtagaaaatttttgtcgaaatccggatggtgatgaagaaggtgtttggtgttatgtagcgggtaaaccgggtgattttggttattgtgatttaaattattgtgaagaagcggttgaagaagaaacgggtgatggtctagatgaagattcggatcgagcgatagaaggtcgaacggcgacgtcggaatatcaaacgttttttaatccgcgaacgtttggttcgggtgaagcggattgtggtttacgaccgttatttgaaaaaaaatcgctagaagataaaacggaacgtgaattactagaatcgtatatagatggtcgtatagttgaaggttcggatgcggaaataggtatgtcgccgtggcaagttatgctatttcgaaaatcgccgcaagaattattatgtggtgcgtcgctaatatcggatcgttgggtattaacggcggcgcattgtctattatatccgccgtgggataaaaattttacggaaaatgatttattagtacgaataggtaaacattcgcgaacgcgttatgaacgtaatatagaaaaaatatcgatgctagaaaaaatatatatacatccgcgatataattggcgagaaaatttagatcgtgatatagcgttaatgaaactaaaaaaaccggtagcgttttcggattatatacatccggtatgtttaccggatcgtgaaacggcggcgtcgctattacaagcgggttataaaggtcgtgtaacgggttggggtaatctaaaagaaacgtggacggcgaatgtaggtaaaggtcaaccgtcggttctacaagttgtaaatttaccgatagtagaacgaccggtttgtaaagattcgacgcgtatacgtataacggataatatgttttgtgcgggttataaaccggatgaaggtaaacgtggtgatgcgtgtgaaggtgattcgggtggtccgtttgtaatgaaatcgccgtttaataatcgatggtatcaaatgggtatagtatcgtggggtgaaggttgtgatcgagatggtaaatatggtttttatacgcatgtttttcgtttaaaaaaatggatacaaaaagtaatagatcaatttggtgaa

SEQ ID NO: 8614 - DNA, 1866 bp, Artificial Sequence
  Description of Artificial Sequence: Synthetic coding sequence
atggctcatgtcagaggactacagctgccaggctgcttagcgttagctgccctgtgctcactggtccactcacagcatgtcttccttgccccccaacaagctagaagcctgctccaacgggtccggcgggcaaataccttcctggaggaggtgcgcaagggtaacctggaaagggagtgtgtggaagaaacttgttcttatgaggaagctttcgaagctctggaatccagcactgcaacagacgtgttttgggcaaaatacacagcgtgtgagacagctcgcaccccgagagataaactggccgcttgtctagagggaaactgtgccgaaggcctgggcacaaattatcggggtcacgttaacataacaaggtctggcatcgagtgccagctgtggcgtagtaggtatccacacaaaccagaaatcaactccacaacccatcccggggccgatctccaagagaatttctgtcggaaccccgacagcagcacaacaggtccctggtgttatacgaccgatcctactgtgagaagacaggagtgctcgatccccgtgtgcgggcaggatcaggtgactgtcgccatgacaccgaggagtgaggggagtagcgtgaacctgtctccccccttggaacaatgtgtcccagaccgtggccaacaataccagggcagactggcagtgaccacccacggcctgccctgcctggcctgggcatctgcgcaggcgaaagcgctgtccaagcatcaggactttaatagcgctgtgcagctggtggagaacttctgtcgtaaccctgacggcgatgaggagggagtgtggtgctacgtggcaggtaagccaggtgacttcggttattgcgatttgaactattgtgaagaggccgtcgaagaagagaccggtgacggactggatgaagacagtgatcgggccattgaagggagaacggctacgagcgagtatcagactttttttaatcccaggacatttggctccggggaagccgactgtggactgcgccccctcttcgagaagaagtcattggaagacaagaccgagagagagctgcttgagtcctacattgacggccggatcgttgaggggtctgacgcagagatcggcatgagtccctggcaggtcatgctgtttagaaagtcaccacaagaactcctgtgtggagccagcctaatttcggatcgctgggtccttaccgccgcacactgtctactttaccccccatgggataagaacttcactgaaaatgatctcctagtaagaataggaaaacattcccgtactcgctacgaaagaaacatcgagaaaatatcaatgctggagaagatctatattcatcctcgctacaattggcgtgagaacctggaccgggacattgcgctgatgaaactgaagaaacctgtagccttctctgactatatccacccagtctgcctgcctgaccgggagaccgccgcaagcctcctccaggcaggctataaaggtcgggtgaccggctggggtaacctgaaggagacctggacagccaacgtgggcaaggggcagccctcagtgctgcaggtcgttaatttgcctattgtggaaagacctgtgtgtaaggattccaccagaattaggattacagacaatatgttctgtgccggctacaaaccagacgaaggtaaaaggggcgatgcatgcgagggggactctggaggcccctttgtcatgaagtcgcccttcaataataggtggtaccagatggggattgtgtcatggggcgagggctgcgacagggacggcaaatacggattctacacgcacgtcttccgactgaaaaagtggatccagaaggtgatagaccagttcggggag

SEQ ID NO: 8615 - DNA, 1866 bp, Artificial Sequence
  Description of Artificial Sequence: Synthetic coding sequence
atggcccacgtgagaggactgcaactgccagggtgcctggcactggctgcactctgctccctcgtgcactcgcagcacgtgttcctggcaccgcagcaggcacggtcgctcctccagagagtgcggagggccaacacctttctggaggaagtgaggaagggaaacctggaaagagaatgcgtggaggagacttgcagctacgaagaggcgttcgaggccctggagtcgtcgacggccaccgacgttttttgggctaaatacaccgcgtgcgagactgctcgcaccccacgcgacaagctggcagcttgcctggagggcaattgcgctgaagggctcggcacgaactaccgcggtcacgtcaatatcacccggtcgggcatcgagtgtcagctgtggcgatcccggtaccctcataagccggagatcaattctacgacccacccgggcgcggatcttcaggagaacttctgccggaaccccgactcatcgaccactggaccgtggtgctacaccactgacccgacggtgcgcagacaagaatgctccatcccggtgtgcggccaggaccaggtgactgtggccatgactccaagatcagaagggtcgtccgtgaacttgtcacccccacttgaacaatgcgtgccggatcgcggacagcaatatcaaggtagactcgccgtgaccactcatggactgccgtgcctcgcttgggcgtctgcgcaagcgaaagcactgtccaagcatcaagacttcaacagcgccgtccagctggtggaaaacttttgtcgaaaccctgatggggacgaagaaggagtgtggtgctacgtggccggaaagcctggtgacttcggatactgtgacttgaactactgcgaagaggccgttgaggaggaaactggagatggactcgatgaggactcagatcgggcaatcgagggacgaaccgccacctctgagtatcaaaccttcttcaaccccaggaccttcggctccggagaagccgattgcggcttgcgccctttgttcgagaaaaagagcctcgaagataaaactgaacgcgaattgcttgaaagttacatcgacggtcgcatagtggaaggaagcgacgcagagattggcatgagcccatggcaagtcatgctcttccggaagtccccccaggagttgttgtgtggagcatcgctgatctcagacagatgggttctcaccgccgcccactgcctgctgtaccccccttgggacaagaacttcacggaaaatgatctcctggtcaggattggaaagcacagccggacccgctacgaacgaaacatcgagaagatcagcatgttggagaagatatacatacacccgcgttacaattggagggaaaatctggatcgcgatatcgccctgatgaagctgaagaagccggtggctttctcggactacatccatccggtttgcctccctgacagagaaaccgcagcgagcctccttcaagccggctacaaaggaagggtgactgggtggggtaacctcaaggaaacctggactgctaacgtgggaaagggacagccgtcggtgctccaagtggtcaatcttccaatcgtggaaagaccagtctgcaaggactcgacccgcatccgcatcactgacaatatgttctgcgccggctataagccagacgaaggaaagcgcggagatgcttgtgagggggactcaggagggccattcgtgatgaaaagcccgttcaacaatcgctggtaccagatgggtattgtgtcttggggcgaaggctgcgaccgggacggaaagtacggcttctacacccatgtgttccgcctgaagaagtggatccagaaggtgatcgatcaatttggtgaa

SEQ ID NO: 8616 - DNA, 1866 bp, Artificial Sequence
  Description of Artificial Sequence: Synthetic coding sequence
atggctcatgtgcgaggactccagcttccgggatgcctcgctctggctgccttgtgcagtctcgtgcactcgcagcatgtctttctggccccacaacaggcgcgttcgctgctgcaaagggtacggcgagccaacaccttcctggaggaagtccgcaagggaaaccttgaacgggaatgcgtggaagaaacctgcagctacgaagaggcgttcgaggcccttgaatccagcactgccacggacgtgttctgggccaagtacactgcatgcgaaaccgcccggactccccgggataagttggccgcctgtctggaaggaaattgcgctgaaggtctgggaactaactatcgggggcatgtcaatatcacccgctcgggaatagaatgccagctctggagaagccggtaccctcacaagccggaaatcaatagtaccactcacccgggggcagacctgcaggagaacttctgccggaaccctgacagctcaaccactggtccatggtgctacactactgatccgaccgtgcggaggcaggaatgctcaatccccgtgtgcgggcaggaccaagtcaccgtggcgatgaccccaaggtcagaaggctcgagcgttaacctctcgcctccactggagcagtgtgtgcctgatcgcggccagcaataccagggccgcctggcggtcaccacgcacggcctcccgtgtctggcatgggcaagcgcccaagcaaaagctctttctaaacatcaagacttcaattcggcggtgcagctggtggaaaacttttgccgcaaccctgacggcgatgaagaaggtgtatggtgctatgtggccgggaagccgggcgactttggctactgcgatctcaactactgtgaggaggcagtggaagaggagactggagacggtctggacgaggacagcgatcgggcgatagagggacgcactgccacgtctgaataccagactttcttcaacccgaggaccttcggctctggtgaagcggactgtgggcttcggccgctcttcgagaaaaagtcactcgaggataaaacggagagagaactgcttgagtcctacattgacggacgcatcgtggaagggtccgacgccgaaatcggcatgtctccttggcaggtgatgctgtttcggaaatccccacaggaactgttgtgcggcgcttccctgatttcagatcgctgggtgttgacggccgcgcactgccttctgtaccctccatgggacaagaatttcactgagaacgacctgctggtccgtatcggaaagcactcaaggaccaggtacgagaggaatatcgaaaagatctcgatgctggaaaagatctacatccacccgcgctacaactggcgcgagaacttggatcgcgatatcgcactcatgaaactgaagaagccggtggcattctcggattacatccatcccgtctgtctgccagatcgagaaaccgcggcgtcgctgctccaggcaggatacaaaggccgcgtgaccggatgggggaacctgaaagagacttggacggcgaatgtcggaaagggccagccgtccgtgctgcaggtcgtcaatctccccatcgtggaacggccggtgtgcaaggattccacccggatcagaatcaccgacaacatgttttgcgcgggatacaagcctgatgagggaaagcgcggagatgcgtgtgagggagactcgggtggaccattcgtgatgaagtcccccttcaataacagatggtaccaaatgggcatcgtctcatggggagagggttgcgaccgggacggtaagtacggattttacacccacgtgtttaggttgaaaaagtggatccaaaaagttattgaccaattcggagaa

SEQ ID NO: 8617 - DNA, 1866 bp, Artificial Sequence; identical to SEQ ID NO: 8614
  Description of Artificial Sequence: Synthetic coding sequence

SEQ ID NO: 8618 - DNA, 1866 bp, Artificial Sequence
  Description of Artificial Sequence: Synthetic coding sequence
atggcccacgtgcggggactgcagctgccaggatgcctggcacttgccgcactgtgttccctggtgcattcacagcatgtgttcctggcacctcagcaggcaagatcgctcctgcaacgcgtgcgcagagccaacacgttcctggaggaagtgcggaagggaaatctggaacgggaatgtgtcgaggagacttgctcatacgaagaagcctttgaagcactcgaaagctccaccgccaccgacgtgttctgggctaagtacaccgcgtgcgagactgcccggacccctcgggacaaactggccgcgtgtctggagggaaactgtgcagaaggactgggtaccaattaccggggccatgtcaatatcacccggtcaggaatcgagtgtcaactttggagatctcgctacccgcacaaaccagaaatcaactcgactacccaccctggcgccgatctgcaggaaaatttctgtcgcaatccggattcctccaccaccggaccgtggtgctacacgaccgaccctactgtgcgccgccaagaatgctctatcccggtctgcggacaggatcaagtgactgtggccatgactccacggtcggagggaagctccgtcaacctgtcacctccactggaacagtgtgtgcccgaccgcggacagcagtaccaagggcgcctggctgtgaccacccacggcctcccttgtttggcctgggcgtctgctcaggctaaggctttgagcaagcaccaagacttcaactccgccgtgcagctcgtggagaacttctgccgcaatcccgatggagatgaggaaggggtgtggtgctatgtggcgggtaagccaggtgacttcggctactgcgatctcaattactgcgaagaagctgtggaggaagaaaccggcgacgggctggacgaagactcggacagagctattgaaggacggactgccacttcggaataccagactttcttcaatcctcgcaccttcggctccggagaagcggattgcggcctgcggccgctctttgaaaagaaatcactggaggataagaccgaacgggaactgcttgaatcgtatatcgacgggagaatcgtcgagggttcggacgcagagatcggcatgtcgccgtggcaggtgatgctgtttcggaaatcaccgcaggaactgctctgtggtgcgtccctcattagcgaccggtgggtgcttaccgcggcacactgcctgctttaccccccatgggacaagaacttcacggagaacgacttgctggtccgcatcggtaaacactcccgcaccaggtacgagcggaacatcgagaagatctccatgctggaaaagatatacatccatccaagatacaactggagagagaatctcgatagggacattgctcttatgaagctgaagaagccagtggccttcagcgattatatccatcccgtgtgtttgccggacagagagactgccgcgtcgctcctccaggccgggtacaagggaagagtaactggatggggaaacctgaaagaaacttggactgctaatgttggaaaagggcagccttccgtcctgcaggtggtgaatctgccgatcgtggaaagacccgtgtgcaaagactcaactcgcatcaggatcactgacaacatgttctgcgccggttacaagccggacgagggaaagaggggagacgcgtgtgaaggagacagcggtggaccattcgtgatgaaatcacctttcaataacagatggtaccaaatgggaatcgtgtcttggggagagggatgcgatagggatggaaagtacgggttttacactcatgtgttccgcctcaagaagtggattcagaaagtcatcgaccagttcggagag

SEQ ID NO: 8619 - DNA, 1866 bp, Artificial Sequence
  Description of Artificial Sequence: Synthetic coding sequence
atggcacacgttagagggctgcagttgccaggatgtttagctcttgccgctctgtgctccttagtccattcccagcatgtgtttcttgcccctcagcaagccagatcattgttacaacgtgtgagaagggcaaatacctttcttgaggaagtgaggaagggaaacttggaacgggagtgtgtggaggaaacatgcagttacgaggaggccttcgaggccctggaaagctctactgccacagatgtgttttgggccaagtataccgcttgtgaaacagcacgcactccaagggacaaattggctgcctgcttggaggggaattgcgcggagggcttgggcacgaattatcgagggcacgttaatatcactcgcagcggtatcgaatgtcagctctggagatccaggtatccccataagcccgagatcaacagtaccacacaccctggggctgatctccaggaaaatttctgcagaaaccccgacagctccacaacaggaccatggtgttatactacagaccccactgttcgcagacaggagtgttctatccctgtgtgtggtcaggatcaggttactgtagctatgaccccaagatctgagggatcaagcgtcaacctgtccccgcccctggagcagtgtgtgccggaccggggacagcagtaccagggacgcctggcggttacaacccatggcctgccgtgtctggcctgggcgtcggcccaggccaaggccttaagcaagcatcaggactttaatagtgcagtccagcttgttgagaacttttgtaggaatcctgacggcgacgaggagggggtctggtgttatgttgccggaaagcctggggactttgggtactgcgacctgaactactgtgaagaagccgtcgaggaggagactggagatggtctcgatgaagactcggatcgggccatcgagggccggaccgctacttcagagtatcagactttctttaacccaaggacatttggaagtggcgaggcggactgcggacttcgccccctgtttgaaaagaaatctctggaggacaagacggagcgggagctacttgaatcatacatcgatggcaggattgtggaggggtccgatgccgaaattggaatgtctccctggcaggtgatgttgtttagaaaatccccccaggagctcctgtgcggagcctcactaatttcagatcggtgggtgcttactgccgctcactgcctgctgtatcctccatgggacaaaaactttactgaaaatgatctcctggtacggattggtaagcacagccggacccggtatgagcggaacattgagaaaatcagtatgctcgagaaaatatatattcaccctcgttacaattggagagagaacttggacagagacatagccttgatgaaattgaaaaaacccgtcgcattttccgattatatacacccagtgtgtctgcccgacagggaaacagctgcttccctgctgcaggccggatataaaggccgcgtcaccgggtggggcaacctcaaagagacatggacagccaatgtaggcaagggccagcccagtgtattacaggttgtcaatcttccaatcgtcgagagacccgtgtgcaaggatagcacccggattaggatcacagacaatatgttttgtgccggctacaagcctgatgaaggcaagaggggcgacgcgtgcgagggagactccggcggaccctttgtgatgaagagccctttcaataaccgctggtaccagatggggattgttagctggggggaaggctgtgatcgggacgggaagtacggattttatacacatgtgttcaggctcaagaaatggatacaaaaggtgattgaccaattcggtgag

SEQ ID NO: 8620 - DNA, 1866 bp, Artificial Sequence
  Description of Artificial Sequence: Synthetic coding sequence
atggcccatgtgcgcggcctgcagcttcccggttgcctcgcactggccgccctctgctctctcgtacactcgcaacatgttttcctcgcaccacagcaagccaggtcgctgcttcagagggtgcgcagggccaacaccttcctagaggaggtgcggaagggcaacctggagcgggaatgcgtcgaggaaacatgtagctacgaagaggcatttgaggctctggagtctagcaccgctactgacgtattttgggctaaatataccgcgtgtgaaactgcccggacgccacgcgataagctggcggcctgcctggagggaaattgtgcggagggcctgggtacaaactatcggggacacgtcaatataacccggagcggtatagagtgccagttgtggcggagcaggtacccgcataagcctgagattaatagtactacgcacccgggggccgatttgcaggagaacttctgccgcaacccggattcgagcacaaccggcccgtggtgctacaccaccgaccccacagtacggcgccaggagtgcagcatcccggtgtgcggtcaggaccaggtgaccgttgccatgaccccccgcagcgaaggaagctcggtgaatctatccccccccctcgagcagtgtgtccctgatcgaggccagcagtatcagggacggttggcggtgactacccacggcttgccctgcctggcctgggccagcgcgcaggcaaaggccctctccaagcaccaggatttcaattcggcggtccagcttgtggagaacttctgcaggaaccccgatggagacgaggagggcgtgtggtgctacgtggcgggcaagcctggcgatttcggatattgcgatctcaactattgtgaggaagctgtggaagaggagaccggcgatggcctggatgaggattccgaccgcgcgatcgaggggcgaacagctacttccgagtaccagacgttttttaacccacgaacatttggttcaggcgaggccgactgcggattgcgccccctgtttgaaaagaagagcctggaagataaaacggagcgcgagctccttgagagctatatagatggacgaatagtggaggggtctgatgccgagatcggaatgtccccctggcaagtaatgctgttccgcaaatcaccacaagaactcctgtgcggcgcgtcgctgattagcgaccgttgggtcctcaccgcggcccactgcctactgtaccccccatgggacaagaattttacagagaatgatctgctagtgcgtataggtaaacattcgcgtacgcgatacgaacgtaatatcgagaagatttcaatgctggagaaaatctatatccatccaagatacaattggcgtgaaaatctcgacagggacatcgccctgatgaaactgaagaagcccgtcgcctttagtgattacatacatccggtctgcctaccagatcgggaaacggccgcgagcctgttgcaagccggctacaagggacgggttaccggctggggaaatctcaaagagacatggacggcgaatgtaggaaagggccagccctccgttctgcaggtagttaacctccccatagtcgaacggccggtatgcaaagatagtacgcgtatccgcatcacggataacatgttctgcgctggatacaagccagatgagggtaagcgaggcgacgcctgcgagggtgattctggtggaccattcgttatgaagagcccatttaacaaccgctggtatcagatgggcattgtgtcctggggcgagggctgtgatagagatggcaagtacggcttctacacccacgtgttccgcctgaagaagtggattcagaaggtaatagaccagtttggcgag

SEQ ID NO: 8621 - DNA, 1866 bp, Artificial Sequence
  Description of Artificial Sequence: Synthetic coding sequence
atggcccatgtgaggggtttgcagctgccgggatgtctcgctcttgcagctctttgtagcctggtgcattcacagcacgtctttctggcaccgcagcaggcaaggagcctgttgcagcgggttcgcagagcaaatacctttctcgaggaagtccgcaaaggtaatctggaacgcgaatgtgtggaagagacttgttcgtacgaagaggcatttgaagccctggaatcctccacggcaaccgacgtcttttgggccaagtacaccgcgtgtgaaaccgcacggacgcctagggataagctggccgcgtgtcttgaaggaaactgtgcagagggactgggtaccaattacaggggtcatgtgaatatcactaggtcaggtattgagtgtcaactttggcgttcgcgttacccacataaacctgagattaacagcactacccatcccggggcagatctccaagagaacttttgtcggaaccctgattcaagcactaccggtccttggtgctacactaccgacccaaccgtgcgcagacaggaatgttccatccccgtgtgcggacaagatcaggtgactgtcgcaatgactcctcggagcgagggttccagcgtgaaccttagcccgcccctggaacaatgtgtgcccgatagaggacagcaataccagggccgcctcgctgtgactacccacggattgccatgtctcgcatgggcgtcggcccaagcaaaggccctgtcgaagcatcaagatttcaattccgcggtccaattggtggaaaacttttgtagaaatcccgatggagacgaagagggcgtgtggtgttacgtcgctggaaagcctggcgatttcgggtattgtgatctgaactactgtgaggaggcagtggaagaggagactggagatggattggatgaagattcggatagagcgatagagggtcgaaccgcaacctcagagtaccagacgttctttaaccctcgtacgtttggttccggcgaggcggattgtggactccggccgctttttgaaaagaagtcacttgaggataagactgagagggaactgcttgagtcctacatcgatggacggattgtggaagggtccgacgcggagatagggatgagtccttggcaagtgatgttgtttcgcaagtccccccaggaacttctttgcggagcttcgttgatttccgacagatgggtgctgactgcagcacattgtctgctctacccaccgtgggacaaaaacttcaccgagaatgaccttcttgtcagaatcgggaagcactcccggacccgatatgaaagaaacattgaaaagatctcgatgcttgaaaagatttacattcatccacgctacaattggcgcgagaacctggaccgagacatagcacttatgaagctgaaaaaacccgtggcgttttcggactacattcacccagtgtgtctccctgatcgtgaaaccgctgcatcactgctgcaagccggatacaaaggaagggtgaccggttggggaaatttgaaggaaacctggactgcaaacgtgggaaagggtcaaccgtcagtgctccaagttgtgaatctgccaatcgtggagcgcccagtgtgtaaagactcgaccagaattagaatcaccgataacatgttttgtgccggatacaagcctgacgaaggtaagaggggtgatgcatgtgaaggtgactccggtggtccattcgtcatgaagagcccttttaacaacagatggtatcaaatgggtattgtctcatggggcgagggttgcgatcgggatggcaagtacggtttttacactcatgtgttccggctcaagaagtggattcaaaaagtgatcgatcaatttggtgaa

SEQ ID NO: 8622 - DNA, 1866 bp, Artificial Sequence
  Description of Artificial Sequence: Synthetic coding sequence
atggctcacgtccggggcctgcagcttcccgggtgtctcgcactcgctgcactgtgctcgctagttcattcccagcacgtttttctcgccccccagcaggcgaggtctctgctgcaacgagtccgaagggctaacacttttctagaggaagtaagaaaaggcaatcttgagcgcgaatgtgtcgaggaaacctgtagctatgaggaagcttttgaagctctggagtcgagtacggctacagatgtcttttgggccaaatacacagcctgcgagaccgcccgtaccccccgagacaagttggctgcgtgcctagaaggaaattgcgccgaggggttagggactaattatcgtggacacgtcaatatcacccgctccggtattgaatgccagctgtggagaagcagatatccgcacaaacccgagatcaactccaccacccaccccggcgcagacctccaggaaaatttttgtcgaaatccggatagttccaccacaggcccctggtgttataccaccgaccctaccgtgcgaaggcaggaatgttctattccagtctgcggacaggaccaggtaacagtcgctatgacccctaggtcagagggttcctctgttaatctctctcccccactcgaacagtgcgtgcccgatagggggcaacagtaccaggggcgcttggcagtgacaacccatgggcttccatgcctcgcctgggcatccgcccaagccaaggccttgtcaaagcatcaagacttcaactctgcagtacagcttgtggaaaacttttgcagaaatccagacggtgacgaagaaggtgtgtggtgctatgtggctggcaagccgggggatttcggatattgtgatctgaattactgcgaggaggcagtggaagaggagactggcgatggactagacgaggattcggatcgagccatagagggtcgaaccgctactagtgagtaccagacctttttcaatcctcgcacctttggctccggcgaggcagattgtgggctgaggccgctcttcgagaaaaagagcctggaggataagactgagagggaattgctggagtcctacatcgacgggcggatcgtggaaggctcagatgccgagatcggcatgtcaccctggcaggtcatgctgttcagaaaatccccccaggaacttttgtgcggtgcttccctaataagcgacaggtgggtgctgaccgcagctcactgcttgctttacccaccatgggataagaactttactgagaacgacttgctcgttcggattggtaagcatagccggacgagatatgagcggaacatcgaaaaaatcagcatgctagaaaaaatctatatccacccccgatacaactggcgagagaatctggaccgagacatcgccctcatgaaacttaaaaaacctgtggcgttttcagactatattcacccagtgtgtctccccgacagggaaaccgcagcgtctctgcttcaggcaggttacaaggggcgtgtcaccggctggggcaacttgaaggagacctggaccgcgaacgtgggtaagggtcaaccctctgtcctacaggtggtcaatctgccaattgttgaaaggcctgtctgtaaggattcaacgcgcatccgtattacagacaatatgttttgtgccggttataaacccgatgagggtaaaaggggtgacgcgtgcgaaggagactctggaggaccattcgtcatgaagagtccattcaataacaggtggtaccagatgggcatcgtctcttggggtgagggatgcgaccgtgacggaaaatatgggttctacacccatgtatttaggcttaaaaagtggatccagaaggtgatcgaccagtttggtgag

SEQ ID NO: 8623 - DNA, 1866 bp, Artificial Sequence
  Description of Artificial Sequence: Synthetic coding sequence
atggctcatgtgcggggtctgcagctccctggatgtttggccctggccgcgttgtgcagccttgtgcactctcagcacgtgttcctggccccccagcaggctcggagcctgttgcagcgggttcgcagagccaacacctttttggaggaggtgaggaagggcaacctggagagggagtgcgtggaggaaacctgtagttacgaggaggctttcgaggctttggagtcgtccaccgctacggacgttttctgggctaagtatactgcttgcgagaccgcccgcaccccccgcgataagcttgcagcctgtctagaggggaactgcgcggaaggtctcgggactaactaccgcggccatgtgaatatcaccaggagcggcatcgagtgccaactttggcgctcgaggtaccctcataagccagagatcaattcaaccacccatcccggcgcggatctgcaggagaatttctgtcgaaaccctgactcatctactaccgggccctggtgctataccacggatccaacagtgcgccggcaggagtgcagtatccctgtctgcggccaggaccaggtgaccgtggccatgacccctcgatccgagggatcctcagtcaatttgtctccccctttggaacagtgtgtacccgaccgcggccaacagtatcaggggcgtctggcagtgaccactcatgggttgccatgcctagcctgggcctccgcccaggctaaggccctgtccaaacaccaagattttaactcagccgtccagctcgtggaaaatttctgtcgcaaccccgatggcgatgaggagggcgtgtggtgttacgtggctggtaaaccgggagactttggctactgtgatttgaattactgcgaggaggccgtggaggaggagacaggtgacggactagacgaggatagcgaccgggccatcgagggtcgaaccgccacatcggaatatcagacattttttaacccccgtaccttcggaagtggagaagccgactgtgggcttcgaccccttttcgaaaagaaatccctcgaagataagactgagagggagctcctcgaatcatacatcgacggcaggatagtggaaggctctgatgccgagattggtatgtctccttggcaggtgatgctgttccggaagagccctcaggagctgctctgtggcgcctctctgatttccgatagatgggtactaaccgctgcccactgcctactgtatccaccctgggacaagaactttaccgaaaatgacttgctggtgagaataggcaagcacagtcgcacgaggtatgagcgtaatatcgaaaagatcagtatgctagagaagatatacatacatcccagatataattggagggagaatctggaccgtgacattgctctcatgaagctgaagaagcccgtagccttctcggactacattcatcccgtgtgcctgccagaccgcgaaacagccgcctcgttgctgcaggccggctacaagggcagggtaacaggctgggggaacctgaaggaaacgtggacggccaatgttggaaaaggccagcctagtgtcttgcaggtggtgaatctgcccatcgtagaacgccccgtctgcaaggatagcacccggatccgcataacagacaatatgttttgcgcgggctacaagcctgacgaagggaaaaggggagacgcctgcgagggcgactctggaggccctttcgtgatgaaatcccctttcaacaacaggtggtatcagatgggcatcgtgtcctggggggagggctgtgatagggacggcaagtacgggttttatacacatgtctttcggcttaaaaaatggatccaaaaggttatagaccagttcggcgag

SEQ ID NO: 8624 - DNA, 1866 bp, Artificial Sequence
  Description of Artificial Sequence: Synthetic coding sequence
atggcccacgtccgtggactgcagttacctggctgcctggctcttgcagccctatgctcactggttcatagccagcacgttttcctggcaccccaacaggccagaagtctgcttcaaagagtaaggcgcgccaatacatttttggaggaggtacgaaagggcaacctggagagggagtgcgttgaggagacctgcagctatgaggaggcgttcgaggccttagagagtagtactgctacagacgtgttttgggcaaagtacaccgcttgtgaaaccgcaaggacgcctcgcgataagctcgcagcttgtcttgagggtaactgcgcagaaggcctgggcaccaattacaggggtcacgtgaacattaccagatccggcattgaatgtcaactttggcggagcaggtacccacataagccggagataaattcaaccacacacccgggtgccgacctgcaggagaatttttgtaggaaccctgattcaagtacaactggcccttggtgctatacaacagatcctacggtgaggaggcaagagtgttccatcccagtctgtggacaagatcaggtgaccgtggcaatgacgcccaggagcgaagggagttccgtgaacctttctccccctctagagcagtgtgtaccagatcgaggccagcagtatcagggacgcttggccgtgactactcacgggcttccatgcctcgcctgggcatcggcccaggccaaggcgctatcaaagcaccaggattttaacagcgcagtccagctggtcgagaatttctgccgaaatcccgacggggacgaggagggcgtgtggtgttacgtagcgggtaagccgggtgacttcggttactgtgatttaaactattgtgaggaggccgttgaggaggaaaccggcgacggactggatgaggactccgacagggccatagagggtcgcaccgcaaccagcgagtaccaaacttttttcaaccctcgtacgtttgggtctggagaggcagattgcggtcttcgacctctgttcgaaaaaaagagcctcgaagacaaaacagagagggagcttttagagtcatacatcgacggcaggatcgttgaaggaagcgatgccgagataggcatgtccccctggcaggtcatgctgtttagaaagtcacctcaggagctactttgcggcgccagcctcatttctgaccggtgggtccttactgcggctcattgcctgttgtacccaccatgggataagaatttcactgagaacgacctcctggtgcgaatcggcaagcactcgcgaacccgatacgaacgcaacatcgaaaagatatcaatgctcgagaagatctatatccaccctaggtacaactggagagaaaacctggacagagacatcgccctgatgaagctcaagaagcccgtcgctttcagcgattacatccatccagtgtgccttccggatagggaaactgctgcgtccctgctgcaagctggatacaagggtcgggttacagggtggggcaatctgaaagaaacatggacagccaatgttggcaaagggcaaccctccgtgttacaggtcgtgaaccttcccattgtggaacgccctgtatgcaaggacagtacccggattaggatcacagataatatgttttgcgcgggttacaagcccgacgaggggaaaaggggcgacgcctgcgagggagatagcggcggccctttcgtgatgaagtcaccgttcaacaaccggtggtatcagatggggattgtgtcttggggggaaggctgtgatagggatggaaagtacggattttatacacacgtttttagactgaaaaagtggatccagaaggtaatcgaccagttcggagaa

SEQ ID NO: 8625 - DNA, 1866 bp, Artificial Sequence
  Description of Artificial Sequence: Synthetic coding sequence
atggctcatgtccggggcctacaacttccagggtgcctggcactcgcagcgctatgtagtctcgtgcattcgcaacacgtctttctggcaccgcagcaggcgcggtcactgttgcagcgcgtgcgaagggcaaacacctttctagaggaggtacggaaggggaacttagagcgggagtgtgtggaagagacctgcagttatgaagaggccttcgaggccctcgagagcagtacagccaccgacgtcttttgggccaaatacacggcctgcgagaccgccagaaccccccgggataaactagcagcctgcctggagggcaattgtgctgagggacttggtaccaattacaggggccacgtcaatataacccgtagcggaattgaatgccaactgtggcggagcagataccctcacaagccagaaataaattcaacgacacatccgggggcagacctgcaagagaatttttgcaggaaccccgattcctccacgactgggccctggtgctatacaacggaccctaccgtaaggcgccaggagtgttccattcccgtgtgcggccaggaccaggttactgtcgcaatgaccccgagaagcgaaggctcatctgtgaacctttctccccccctggaacagtgtgtccccgatagggggcagcagtatcagggccgtctcgccgttaccacacacggtctcccctgccttgcctgggcgagcgctcaagccaaggccttgagtaagcaccaggacttcaacagcgctgttcagctggtagagaacttttgcaggaaccccgacggtgatgaggaaggggtgtggtgttatgtggccgggaaacctggggacttcgggtactgtgacctgaattactgcgaggaggcagtggaggaggagactggagatggactggacgaggactctgatcgagcaattgaaggtcgcacagccacgtccgagtaccaaacttttttcaatccaaggacctttggttctggagaagcagattgtggactgcgacctctgtttgagaaaaagtctctggaagacaagacagagagggagcttttggaatcatatattgatggcaggatcgtagagggctcagacgcggagatcggaatgtccccatggcaagtaatgctgttccgaaaatccccccaggagctgctgtgcggtgcatcactgatctccgaccggtgggtgctgaccgctgcacattgccttttgtaccccccctgggacaagaatttcacagagaacgacctgcttgtgaggatagggaagcacagccgcacccggtatgagcgaaatatagagaaaatttccatgctggaaaagatatacatccaccctcggtacaactggcgtgagaatctcgatagagatatcgctctgatgaagctcaagaaacctgtggccttctcagactatatccaccctgtgtgtctgccggatcgtgaaaccgccgctagcctgctgcaggctggatataaaggcagagtgactggttggggcaatctgaaagaaacctggactgctaatgtgggaaagggccagccatcagttctccaggtggtgaatctgccaatagttgaaaggccagtttgcaaagactctacacgtatccgaatcaccgacaatatgttctgtgccggttacaagccggatgaaggtaagagaggggacgcttgtgagggggactccggcggcccattcgtgatgaagtcaccctttaacaatcggtggtaccagatgggtattgtaagttggggagaaggatgcgaccgagacgggaaatatggcttctacacccatgttttccgccttaagaagtggatccagaaggtgatagaccaattcggtgag

SEQ ID NO: 8626 - DNA, 1866 bp, Artificial Sequence
  Description of Artificial Sequence: Synthetic coding sequence
atggcccacgtcagaggactgcagttgcctggctgcctggcgcttgcagccctctgctcactcgtccactcccagcatgtgtttttggctccccagcaagcgcgctcactgcttcagagagtccggcgggcaaacacctttctggaagaagtccggaagggaaacctggaacgcgagtgcgtcgaagaaacgtgttcttacgaggaggcgttcgaagctcttgaaagcagtaccgccactgacgtgttctgggccaaatacaccgcctgcgagacggcgaggaccccgcgcgataagctggccgcatgcctggaaggtaattgcgccgagggcttggggaccaactatcgcggccacgttaacatcacccgaagcgggattgaatgccagctgtggaggagcagatacccacataagccggaaatcaattcgactacccacccgggggctgacctgcaggagaatttctgccgtaatccggactcgtcaactaccggaccatggtgttacactacggacccgaccgtgcgacggcaagaatgctccatccccgtgtgcggccaagatcaggtgactgtggctatgaccccgagatctgaaggatcgagcgtgaacctgtcacctccgctcgaacaatgtgtgccggaccgaggacaacaataccaggggcgcctggcggttacgactcacggacttccatgcctggcctgggcctccgcccaagcgaaagccctgtccaagcatcaagatttcaactccgctgtgcagctggtagaaaacttctgtcgcaatcccgacggcgacgaagagggagtgtggtgttacgtggcaggcaagcctggcgactttggatactgcgatctgaactattgcgaagaggcagtggaagaggagacgggcgacggactggatgaggactcggaccgcgcaatcgaaggaagaaccgccacctcggagtaccagaccttctttaacccaagaactttcggatccggagaagcggattgcggactgcggccactctttgagaaaaagtcactcgaggacaaaactgagcgggaactcctcgaaagctacatcgatggacggatcgtggaaggatccgacgctgagattggcatgagcccttggcaggtgatgctgttcaggaagagcccccaggaactcctttgtggggccagccttatcagcgatagatgggtgctcacggcggcccattgtctgttgtacccgccatgggataagaatttcactgaaaacgacctgctcgtacggatcggcaagcactcgagaactagatacgaacggaacattgaaaagatctcgatgctcgagaagatctacatccatccgcgttacaactggagagagaacctggacagggacatcgctttgatgaagctgaagaaaccggtggcattttcggattacatccacccggtgtgcctcccggacagagaaaccgcggccagcctgttgcaggcaggctacaagggacgggtgactggctggggtaacctgaaggagacttggactgccaacgtcggtaagggacaaccatcggtgttgcaagtcgtaaacctccctatcgttgagcgccccgtctgcaaggattccacccggatcagaatcactgacaatatgttctgcgccggatacaagccggatgagggcaaaagaggcgacgcctgcgaaggggactcgggcggccctttcgtcatgaagagcccgtttaacaatcgctggtaccagatgggtatcgtgtcgtggggtgagggatgcgaccgggatggaaagtacggtttctacacccacgttttcagactgaagaaatggatccagaaagtgattgaccaatttggagag

SEQ ID NO: 8627 - DNA, 1866 bp, Artificial Sequence
  Description of Artificial Sequence: Synthetic coding sequence
atggcacatgtgaggggactgcaattaccaggctgcctcgctctggcagcattatgctcactggtccatagtcagcacgtgttcctggcaccccagcaggctaggtcgctgttgcaaagagttcgcagagcaaatacattcttggaagaagtgaggaagggaaacctcgagagggagtgcgtggaggagacttgcagttatgaagaagcgttcgaagctctcgagtctagcacagctactgacgtcttctgggccaagtataccgcttgtgagaccgctagaactcctagggacaaactggcagcttgccttgaaggtaactgcgctgaaggtctgggcaccaactaccgcggtcacgtaaatattacgcgtagcgggatcgagtgtcaactgtggaggtctaggtatccccacaaacccgagatcaactccactactcatcctggcgccgacctccaggaaaacttttgtcggaacccggactccagcactacggggccgtggtgttacaccacggaccctacagtaaggcgccaggaatgtagcattcctgtgtgcgggcaggaccaggtcacagttgccatgaccccaagaagtgaaggttcctctgtcaatctttcccctcctctggaacagtgcgttcctgaccgtggtcaacaataccaggggcggctggcagtaactacccacggactgccatgcctggcctgggcttccgctcaagccaaggccctgagcaagcaccaggattttaactcagctgttcagttggttgagaatttctgtcggaatccggatggcgacgaggagggagtgtggtgctacgtggctggcaagcctggagattttggctactgcgacctgaactattgcgaggaggcagttgaggaagaaaccggcgatggactagacgaggactccgacagggcgatagaaggacggaccgccacaagtgagtatcagactttcttcaacccgaggacattcggctccggcgaggctgattgcgggctgagacccctatttgaaaaaaagtcactggaagacaaaaccgagcgggaactgctggagagctacattgacgggcgcatagtggagggatcagacgcggaaatcggtatgtctccttggcaggtcatgttgtttcgaaagtcaccccaggagctcttgtgcggcgccagcttaatttccgatcgctgggtcctgaccgccgcccactgtctgctgtaccctccttgggataaaaatttcaccgagaatgacttgctggtgaggataggtaagcacagccgaacaagatatgagagaaacatcgaaaagatttccatgctggaaaaaatttatattcacccccgctataattggcgggagaatctcgaccgcgacattgcattaatgaagcttaagaagcctgtcgccttctcggactacatacacccagtctgcctccctgatagggagacggccgcttccctactgcaggctggatacaagggccgagtcacaggatggggcaacctcaaggaaacatggaccgccaacgtagggaaggggcagccttccgtgctgcaagtagtgaacctgccaattgtggaacggccagtctgtaaagactcgacccggatcaggatcacagacaatatgttctgcgccggatacaagccggacgaaggcaagaggggtgacgcttgtgaaggagattccggcggcccctttgtgatgaagtcacccttcaataacagatggtatcagatggggattgtgtcttggggtgaggggtgtgaccgggacggaaagtacggattctatacccacgtcttccgtcttaaaaaatggatccaaaaagttattgatcagtttggcgag

SEQ ID NO: 8628 - DNA, 1866 bp, Artificial Sequence
  Description of Artificial Sequence: Synthetic coding sequence
atggcacacgtgcggggcctccagctgcccggatgtctcgccctggccgcactgtgttcccttgtccatagccagcacgtctttctggcaccgcaacaggcgcgctcgctgcttcagcgagtgcgaagagcaaacacttttcttgaagaggtgcggaaagggaatctggagcgggaatgcgttgaagaaacttgtagctacgaggaagccttcgaagcactggaatcgtccactgcaaccgatgttttttgggcaaagtacaccgcatgtgaaaccgcccggacgccgcgcgacaagctggctgcatgccttgaagggaactgcgcagaaggcttgggaaccaactaccgcggtcatgtgaatatcacccgatccgggatcgagtgccagctgtggcggtccagatatccacacaagcccgaaatcaattcgactacccatcctggagcagatctccaagaaaacttctgtagaaacccagattcgtccaccactggaccttggtgttataccactgatccaacggtgcggcgacaagagtgctcgatcccagtgtgtggtcaggatcaggtcactgtggctatgaccccgagaagcgaaggctcaagcgtgaatctgtcaccaccgcttgagcagtgcgtgccagatcgtggacagcaataccaaggtcgcttggcagtgactacgcatggcctgccttgtcttgcatgggcgtcagcacaagctaaagcccttagcaaacatcaggatttcaattctgcagtgcaactcgtggagaatttctgtcgcaaccctgacggcgacgaagagggagtctggtgttacgtggcaggcaagcccggtgattttgggtactgtgatctgaattactgtgaggaggcagtggaagaagaaacgggcgacggtcttgatgaagattcagatagggcaatcgaaggtcgcactgcaacctctgaataccaaaccttctttaaccctcgtactttcggatccggagaggcggactgtggacttaggcctctttttgaaaagaagtctctggaggacaagaccgaaagagaactgctcgagagctacattgacgggcgaatagttgaaggctcagatgccgaaataggtatgagcccttggcaagtgatgcttttcagaaaaagcccgcaagagttgctctgtggagcgtccctcattagcgacagatgggtgctgaccgcggctcattgtttgctgtaccccccttgggataagaacttcactgagaacgacttgcttgtccgcatcggtaaacactccagaactagatacgaacgtaacatcgagaagatctccatgctcgaaaagatttacatccatccaagatacaattggcgcgaaaacctggatagggatatagcactgatgaaacttaagaagcctgtggcatttagcgactacatccatcctgtgtgcttgcccgatagagagactgcggcctcgcttctccaagcaggctacaagggacgtgtcaccgggtggggtaatctgaaggagacttggacggcaaatgtcggaaagggacaaccttctgtccttcaagtcgtgaacctcccgattgtcgaaaggccagtgtgcaaagacagcacccgcataaggattaccgataacatgttttgcgcggggtataaaccagacgagggaaagcggggggacgcgtgcgagggtgactccggtggaccgtttgtgatgaagagcccatttaacaaccgatggtaccaaatgggaatagtgagctggggggaaggttgtgatcgagacggtaaatacggtttttacactcatgtctttcgtctgaagaagtggattcagaaggtcattgatcaatttggagaa

SEQ ID NO: 8629 - DNA, 1866 bp, Artificial Sequence
  Description of Artificial Sequence: Synthetic coding sequence
atggcacacgttcggggcttgcagttgccaggatgcctcgctctcgccgccctttgttctttggttcactcacagcatgtgtttctcgcgccacagcaggcgcgaagtttactccagcgcgtccgtagagctaacacttttctcgaggaagtgagaaaagggaacttagaacgcgagtgtgtcgaggagacgtgttcctacgaagaagctttcgaagcactcgagtcttctaccgcaaccgatgttttctgggctaaatacaccgcatgcgaaacagcgcgcacgcctagagataagctcgcagcctgtctggaagggaattgtgcggaaggactggggactaattatcgcggccacgtcaatatcacacgttcgggcatcgaatgtcagctctggaggtcacgatacccccataaaccagaaatcaatagtacaacgcatcccggcgccgatcttcaggagaacttttgtcgtaatcccgactcatcaaccactggaccttggtgttacaccacagacccaaccgtacgaagacaagaatgttcaatccccgtgtgcggacaggatcaggtgaccgtcgccatgactcccaggtcagaaggcagttccgtgaatctctcaccgccgctcgaacagtgcgtgcccgatcggggacagcaataccaaggaagactcgccgtaacaacacacggacttccctgtttggcttgggcatccgcgcaggccaaggcgctttccaaacatcaagatttcaactcagccgttcagctggtcgaaaacttttgtcggaaccccgatggcgatgaggaaggcgtgtggtgctacgtggctgggaaacctggagatttcgggtactgcgatcttaattactgcgaggaggcagtcgaggaagaaacaggagacggactggacgaggattctgatagagccattgaaggccgtacggccacgtcggagtaccaaacattctttaatccgaggaccttcggctcaggggaagcagactgcgggctgcgcccactcttcgagaaaaaatcactggaggataaaaccgaaagggagctgctggagtcctacatcgacggcagaattgtcgaaggatctgatgcagagatcggaatgtctccctggcaggtcatgttatttcggaagtctccccaggaactactgtgcggcgccagtcttatttcggatagatgggtgcttacagccgcccactgtctactctatccgccctgggataagaactttacggaaaacgatctcttagttagaatcggcaagcacagcagaacgaggtatgaaaggaatatagagaaaatctccatgcttgagaagatctacatacatcctcgttataattggagggagaacctggatagagacatagccttgatgaaactcaagaagcccgtcgccttttccgattatatacatcccgtgtgcctgcctgaccgggaaactgcagcaagtctgctgcaggctggttataaaggaagagtaactggttggggcaacctgaaggaaacttggactgctaatgtgggtaaaggtcagccctcagtcctccaggtggtgaatctgcctatcgttgagagaccggtttgtaaggatagcacacgcatccgaattaccgataatatgttctgtgccgggtataagccagacgagggcaaacgcggcgatgcgtgcgaaggggattcaggaggcccctttgtgatgaaatccccctttaataacaggtggtaccagatgggtattgtctcttggggggaggggtgtgacagagatggcaagtacgggttctacacccacgtgtttagactgaaaaaatggatccagaaggtgatcgatcaattcggtgaa

SEQ ID NO: 8630 - DNA, 1866 bp, Artificial Sequence
  Description of Artificial Sequence: Synthetic coding sequence
atggcccatgttcggggactccagttaccaggatgcctcgcgttggctgcattatgctctctggttcattcccaacatgtgtttcttgcaccacaacaagcgcggtcattacttcagcgtgtcagacgcgctaacacttttttggaagaagtgcgaaaaggcaatctggaacgggaatgtgttgaagaaacttgttcgtacgaagaggctttcgaggctctcgaaagtagtacagctacggacgttttttgggctaagtacacagcatgcgagacggcgagaaccccacgagataaactcgcagcatgcctggaaggaaattgcgccgagggattagggaccaattaccgtgggcatgtgaatatcacaagaagtggaattgagtgtcaactttggagatctcgctatcctcataaaccagaaattaatagtactactcatccaggtgctgatttgcaggaaaacttttgtcgaaatccagattcgtcaaccacaggtccttggtgttataccactgatccaacagttagaaggcaggagtgtagcatcccggtctgtggacaagaccaagtgactgtcgctatgaccccacgctcagaaggatcgagtgtgaatctaagcccaccccttgagcaatgtgttccagaccgtggacaacaatatcaaggaagactcgcagtcacaactcacggccttccctgccttgcctgggcctccgcacaggcgaaagcattatcgaagcatcaagatttcaattctgctgtgcagctcgttgaaaatttctgtcgcaacccagatggtgacgaagaaggagtttggtgttacgttgctggaaagccaggagatttcggatattgcgatttgaactactgtgaagaggctgttgaggaggaaaccggagatggacttgatgaggatagtgatagagctattgaaggacgaactgctacttctgagtaccaaacttttttcaatccgcgtacattcggttctggagaagcggattgcggcctaaggccgcttttcgagaaaaaaagcctagaagataagactgagagagagttgctagaatcatacattgatgggcgtatcgtagaaggttctgatgctgaaataggaatgtccccatggcaagtcatgctcttccgtaaaagtccacaagagttgttgtgcggagcttctctgatttcagaccgatgggtgttaacggctgcgcattgcttactttacccaccatgggataaaaattttactgaaaacgatcttcttgttcggattgggaagcactctcggacgaggtatgagagaaatatagaaaaaatttcaatgctagaaaagatttacatacatccacgatataattggcgtgaaaacttggacagagacattgccttgatgaaattgaaaaagcccgttgctttttctgattacattcacccagtctgcctcccagatcgagaaactgctgccagcttactacaggcaggttacaaaggacgtgtaacaggttggggaaatctaaaagaaacttggacagctaatgtgggtaaaggacagccatctgtccttcaggttgtcaatttaccaatagtcgagcgaccagtctgtaaagattccactcgaatccgaattacagataatatgttttgcgctggttataagcctgacgaaggaaagcgcggagatgcatgtgaaggggactctgggggaccatttgtaatgaagtcgccattcaataatcgctggtaccaaatgggaatagtgtcatggggagaaggttgcgatagagatggaaaatatggtttctacactcacgtgttccgtcttaagaagtggatacaaaaagtaattgatcaatttggagag

SEQ ID NO: 8631 - DNA, 1866 bp, Artificial Sequence
  Description of Artificial Sequence: Synthetic coding sequence
atggcgcatgttcgcggtctgcagctccccggctgcctcgccttagcagccctgtgttctcttgttcattcccagcacgtattcttagcgcctcagcaggcccggtcactgcttcagagggttaggcgcgcaaatacattcctggaggaagtgcgaaagggcaacctcgaaagagagtgtgtcgaggagacgtgtagctatgaggaagcgtttgaagctctcgagtcaagtaccgcaacagacgtattctgggccaaatacactgcttgtgaaacagctaggactcctagagataaactggccgcctgcttagagggtaattgcgctgagggtctcgggacaaactacaggggccatgtgaatatcaccaggagtggcatcgagtgccagctttggaggagtagataccctcacaagccagagattaatagtaccacccaccctggcgccgaccttcaagagaatttctgtagaaacccggactccagtactactggaccttggtgctacacaaccgacccgaccgtacggagacaggagtgctccattcccgtgtgcggacaggaccaggtgaccgtggcgatgaccccaaggtccgagggtagttctgtcaacttgagcccccccctggagcagtgcgtgccagacaggggacagcagtatcaggggcggctggccgttactactcacgggctcccttgcctggcttgggccagcgcccaggcgaaggccctcagcaagcaccaggactttaatagcgccgtccagctggttgagaatttctgtcggaaccctgacggagatgaggaaggggtatggtgctatgtcgcaggaaagccaggcgactttgggtattgtgatctaaattactgcgaagaggccgtagaagaagaaactggggatgggttggatgaggattctgatagggcgatcgagggcaggaccgcgacttcagagtaccaaactttttttaacccacgcacctttggaagcggcgaagccgactgcggcctaagaccacttttcgagaaaaaatccctggaagataagaccgaacgcgaactgctggagagttatatcgatggacgcattgtggagggatccgatgccgagatcggcatgagtccctggcaggttatgctcttcaggaagagtcctcaggagctactttgtggcgctagcttgatttctgacaggtgggtcctgacagctgcccactgtctgctttaccccccttgggacaagaactttacagagaacgacctgctagtccgtatcggaaagcactccagaacacgttacgagaggaatatagagaagattagcatgctggaaaagatctacatccaccccagatacaattggagggaaaacctggatagggatattgcgctgatgaaactcaagaagcctgtggcgtttagtgattacattcaccctgtgtgcctgcccgaccgcgaaacagcagctagcttgttgcaggctgggtataagggacgcgtaaccggttggggtaaccttaaggagacctggactgctaacgtcgggaaaggacagccgagcgttctccaggtggtgaatttaccgattgttgaaagacctgtctgtaaagatagcactagaatacgcataacagataatatgttttgcgctggctacaaacccgatgaaggcaagaggggagatgcctgcgaaggggatagtggcggcccctttgtcatgaagtcccccttcaataacaggtggtatcagatgggcatcgtgtcttggggagaggggtgcgatagggatggcaagtacgggttctacactcatgtgtttcggcttaagaaatggatccagaaggttatcgaccagttcggcgag

SEQ ID NO: 8632 - DNA, 1866 bp, Artificial Sequence
  Description of Artificial Sequence: Synthetic coding sequence
atggctcatgttcgtggattgcaattacctgggtgtttggctttggctgccctgtgttcccttgtacatagccaacatgtgttcttggctccccagcaggcaaggtctttacttcagcgagtccgtcgggctaacactttcttggaagaagtaagaaaagggaatttggagcgcgaatgcgttgaagaaacttgttcttatgaggaggcattcgaggccttggagtcttcaacagctaccgatgtattctgggctaagtacacggcttgtgagacagcaagaacgcccagagataaactggccgcttgcctggaaggaaattgtgctgaagggctaggcactaattaccgaggacatgttaatatcacaagaagcggaattgagtgtcagttgtggcggtcacgttatccacataaaccggaaatcaattccaccactcaccctggggccgacctccaagagaatttttgtagaaatcccgacagttcaacaacagggccatggtgctacaccaccgatcctacagtgagacgacaagagtgttcgatacctgtttgcggtcaagaccaggtaacagtggctatgactcctcggagcgagggcagctccgtcaatcttagccctcctcttgagcaatgtgtccccgatcgtggtcagcaatatcaggggagattggcagtgacgactcatggtcttccttgtctcgcatgggctagtgcacaagctaaggctctctcaaaacatcaagatttcaattcagccgttcaattggtagaaaatttctgccgcaaccctgatggagatgaagaaggtgtgtggtgctacgtcgccggtaagcctggtgactttggctattgcgacttgaactattgtgaggaagcagtggaagaggaaaccggcgacggactggatgaagatagcgatcgtgcaattgaaggtcgcactgctacctcggagtatcaaacattttttaacccaagaacattcggcagcggtgaggctgattgtggacttcgtcctcttttcgaaaagaagagtctcgaagataaaaccgaacgtgaactcctagagtcatatatagacgggcgaattgttgaaggaagtgacgctgaaatcggtatgagcccttggcaagttatgctcttccgtaagagtccccaagaacttttgtgcggcgctagcttgatttctgaccggtgggtgctgactgctgcgcattgtttgctttatcctccatgggacaaaaatttcaccgaaaatgacctgctcgttcgcataggaaagcattctagaactcgatatgaacgtaatattgagaagatttctatgttggagaaaatctacatccatcctaggtacaattggagagagaacctggatagagatattgcattgatgaagctcaaaaaaccggttgccttctctgactatatacacccagtttgccttcctgatagagaaactgccgcttcactcctgcaagctggatataaggggagagttacaggttggggcaacctcaaagaaacctggacagccaatgtcggtaaggggcagccttcggtacttcaagtggtgaatctgcccattgtcgagcgtcccgtatgcaaggattcaactaggattcgtattacagataacatgttctgtgccggttataagcctgatgaaggaaagagaggagatgcgtgcgagggggatagcgggggtccttttgttatgaaatctccattcaacaatcgttggtatcaaatgggaatcgtgagttggggggagggttgcgacagggatggtaagtacggattctatacacacgtgttccgtttgaaaaagtggatacagaaggtgattgaccaatttggggaa

SEQ ID NO: 8633 - DNA, 1866 bp, Artificial Sequence
  Description of Artificial Sequence: Synthetic coding sequence
atggcacatgtgcggggcctgcagctccctggttgcctggccttggctgctctgtgttcgttagtgcattctcagcatgtgtttttggcgccacaacaggcgagaagcctgttgcagcgagtgcggagagccaacacatttttagaggaggtgcgcaaagggaatttggaacgagagtgtgttgaagagacatgctcatatgaggaggctttcgaggccctggagtcttccaccgccactgacgtgttctgggccaaatacaccgcctgcgagacagcacgcacgccacgggacaagcttgcggcgtgcctggaaggtaattgtgccgaggggctgggcactaattatcgaggtcacgtgaatatcaccaggagtggtatcgagtgtcagctctggcgctcacggtatccacacaagcctgagatcaatagcacaactcaccctggtgctgacctgcaggagaacttctgtcgtaatcccgacagctccaccacaggtccgtggtgttacactactgacccaaccgttcgccgtcaggaatgttctattcctgtctgcggccaggatcaagtgaccgtcgcgatgacaccccgttccgaaggatcctccgtcaacctcagcccccctctcgagcaatgcgtgccagataggggacagcagtatcagggccggctggctgttacaacccacggactgccatgtctggcttgggcctccgctcaagcgaaggctctctcgaaacaccaggacttcaactcagccgttcagctggtggaaaacttctgccgaaacccagatggcgatgaggaaggcgtgtggtgttatgtcgctggaaagccaggagatttcggctactgcgacctgaattactgcgaggaggccgtagaggaagaaactggcgacggtctggacgaggattcagaccgggctatcgaaggacggaccgccaccagcgaataccaaaccttttttaacccacgcacattcggaagcggcgaggccgactgcggtctcagacccctgtttgagaaaaaatccctggaggataaaaccgaaagagaattgctcgagtcttacattgacgggagaattgtggaaggctccgatgctgaaattggcatgtccccttggcaggtgatgctcttccgcaagtctcctcaggagctgttgtgcggcgcaagtctcattagtgaccggtgggttctcaccgctgcccattgtcttttgtaccctccatgggataagaatttcacagaaaacgatcttctggtgcgaatagggaagcacagtcggactaggtatgagcgaaatatagaaaaaatctctatgcttgagaagatttatatccatccgcggtataactggcgggagaatctggaccgtgatattgcgttaatgaaattgaagaagcctgttgcgttctctgactatattcaccctgtgtgtttgccggatagagagaccgcagcatctctgttgcaggctggatacaagggaagggtgaccggctggggaaacctaaaagaaacttggactgcgaatgttggcaaggggcaacctagtgtgctgcaggtagtgaacctacccatcgtagagcgtccagtatgtaaggactctactcgcatcagaataaccgacaatatgttttgcgctggctacaaacctgatgagggcaaaaggggcgatgcctgcgaaggcgactcaggcggcccattcgtcatgaaatctcctttcaacaataggtggtaccagatgggtatcgtatcgtggggagagggctgcgaccgcgatggcaagtacggattctatacccatgtttttcgccttaagaagtggatccagaaagtcatagatcagtttggtgag

SEQ ID NO: 8634 - DNA, 1866 bp, Artificial Sequence
  Description of Artificial Sequence: Synthetic coding sequence
atggctcatgttagaggattacaattaccaggttgtcttgctttagcagctctttgtagcttagttcattcacaacatgtttttcttgctccacaacaagctagatcattacttcaacgtgttcgtagagcaaacacattcttagaagaagttagaaaagggaatttagaaagagaatgtgttgaagagacttgttcatatgaggaagcttttgaagcacttgaatcttcaacagctactgatgttttctgggcaaaatatacagcatgtgagacagcaaggacacctagagacaaattagcagcttgtttagaaggaaattgtgctgaaggtttaggaacaaattatagaggacatgttaatattactagaagtggaattgaatgtcaattatggagatcacgatatccacataaaccagaaattaattcaacaacacatccaggagcagatttacaagaaaatttttgtagaaatcctgacagttcaactactgggccatggtgttacactactgatccaacagttagaaggcaggaatgctctataccagtttgtggacaagatcaagttactgttgcaatgactccaagatcagaaggatcttcagttaatttatctccacctttagaacaatgtgttcctgatagaggacaacaatatcaaggtcgtcttgctgttacaacacatggactaccttgtttagcttgggcaagtgcacaagcaaaagctctttctaaacaccaagattttaatagtgcagttcaattagttgaaaatttttgtagaaatccagatggtgatgaagaaggagtgtggtgttatgttgctggaaaaccaggggatttcggttattgtgatcttaattattgtgaagaagctgttgaagaagaaactggagatggattagatgaagatagtgatagagcaattgagggaagaacagcaactagtgaatatcaaacttttttcaatccacgaacatttggttcaggagaagctgattgtggtttaagaccactttttgaaaaaaaaagtttagaagataagacagaaagagaacttttagaatcatatattgatgggagaattgttgaaggatcagatgctgaaattggtatgagtccatggcaagttatgctattcagaaaaagtccacaagaacttttatgtggagcaagtcttattagtgatagatgggtattgactgcagctcactgtttactttatccaccatgggataagaattttactgaaaacgatttacttgttagaattggtaaacattcaagaactagatatgaacgtaatattgaaaaaatttctatgttagaaaagatttatattcatccaagatataattggagggaaaacttggatagagatattgctcttatgaaacttaaaaaacctgtagctttttctgattacattcatccagtatgtttaccagacagagaaactgcagcaagtttattacaagctggatataaaggaagagtaactggatggggtaatttaaaggaaacttggactgcaaatgtcggaaagggtcaaccaagtgttttacaagtagttaatcttccaattgtagaaagacctgtttgcaaagatagtacaagaattagaattactgataatatgttttgtgctggatataaaccagatgaaggaaaaagaggtgatgcatgtgaaggagattctggaggaccattcgttatgaaatcaccatttaataatagatggtatcaaatgggtattgtttcatggggtgaaggatgtgacagagatggaaaatatggattctatactcatgtatttcgtttaaaaaaatggattcaaaaagttattgatcaattcggtgaa

SEQ ID NO: 8635 - DNA, 1866 bp, Artificial Sequence
  Description of Artificial Sequence: Synthetic coding sequence
atggcgcacgtacgcgggttgcagttaccggggtgcctagcgctggcagctctgtgcagtctcgtccatagtcagcacgtttttttagctccgcagcaagcaaggagcttgcttcagcgggtgcggcgtgcaaatacgttcctggaagaagtacgtaaaggcaatcttgagagagaatgtgttgaagaaacatgctcatatgaagaagcgtttgaagcgcttgaatcaagcacagcaaccgatgttttctgggccaagtacacagcgtgcgagactgctcggactccgagagacaaattggccgcctgcctagagggaaattgcgcggaagggcttggcacaaactatcgcgggcatgtaaacattaccaggtctggaatcgagtgtcagctctggcggagcaggtatcctcataaacctgagataaactcaacaacgcacccgggggcagatctgcaagaaaatttttgcagaaatccggattcaagcacaacaggcccttggtgctatacgacggatcccacagtgaggcgccaagaatgttcaattccggtgtgtgggcaggatcaagtcacagtcgcgatgacaccgcgttccgaaggctcgagcgtgaatctttcgcctcctcttgaacaatgcgtgcccgatcgtggccagcagtatcaaggaagactggccgttacaactcatggacttccgtgcctggcctgggcttctgctcaggcaaaagcattaagtaaacatcaggacttcaattcagcagtccagctcgttgaaaatttctgccgtaatccagacggggacgaagaaggggtttggtgctatgtggcagggaaaccgggcgattttggttactgcgatctcaactactgcgaagaggctgttgaggaggaaacaggagatggattagatgaggattctgatcgtgcgattgaaggccgcacggctacaagcgaatatcaaacgttttttaatccgagaacgttcggctctggcgaagccgactgcggccttcggcctctttttgaaaaaaaatcacttgaagataaaacagagcgcgagttgttggaatcatacatcgacgggcggattgtagaagggtctgacgcagaaattggaatgtcgccatggcaagtcatgttgttccggaagtcaccacaagagcttctgtgcggagcttcactgattagcgaccgctgggtgctgacggcagcacactgtttgttgtatccaccgtgggacaagaacttcacagagaatgaccttcttgtgcgtatcggcaaacattctaggacaagatacgaacgtaatatcgagaaaatttcaatgctggaaaaaatctatattcaccctcgctacaactggcgtgaaaacttagacagagacattgctcttatgaaactgaaaaagccagtcgccttttccgattacatccatccggtgtgtttaccagatagggaaacggcagcatcactactgcaagccggttataaaggcagagtaacaggctggggtaatctcaaggaaacatggaccgccaatgtgggaaaaggacagccttccgtcttacaagtggtaaaccttccgatagtagaacgtcctgtctgcaaggattccacgagaattcggataactgataatatgttctgcgctggttataaaccagatgagggcaaacggggtgatgcatgtgagggtgacagcgggggaccgtttgtaatgaaatcaccttttaacaacaggtggtaccagatggggatcgtatcttggggtgaagggtgtgaccgcgatggaaaatatggattttatacgcacgtgtttagattgaagaaatggattcagaaagtgattgatcagtttggggaa

SEQ ID NO: 8636 - DNA, 1866 bp, Artificial Sequence
  Description of Artificial Sequence: Synthetic coding sequence
atggcacatgtgcggggcttgcagcttcctggctgtctggcgctggcagccctgtgttccctggtgcacagccaacacgtgtttctcgccccccagcaagcaagatcactccttcagagagtgagacgggccaacacttttctcgaagaggtccgcaagggaaatcttgaaagagaatgtgtcgaagaaacctgctcctacgaggaagcatttgaagcactggaatcgtcgactgctacggacgtgttctgggcaaagtacaccgcatgtgaaaccgcaagaactccgagagataagctcgcagcctgcctggaaggtaactgtgctgaaggactggggaccaactacagaggacatgttaacatcactcgatcaggtatagagtgtcaactctggcgaagccgatacccccataaaccagaaatcaactccacgactcaccctggcgcagatctgcaagaaaacttctgccggaaccctgattcgtccacgaccggaccgtggtgttacaccaccgatcccactgtccgtaggcaggagtgctcaattcctgtgtgtggacaggaccaggtgactgtggcaatgacccctcgatcggagggatcatcggtcaacttgtcgcctccccttgaacaatgtgtgcctgaccggggacagcaataccagggtaggctcgcagtgaccactcatggacttccttgtctggcatgggcctccgcgcaagcgaaggcccttagcaagcatcaagatttcaatagcgcagtgcaactggtggaaaacttttgtagaaaccccgatggagatgaggaaggagtctggtgttacgtggcaggcaagccaggagacttcggttactgtgacctgaactattgcgaggaagcagtggaagaagaaaccggcgacgggctggacgaagattcggatcgcgctattgagggccgtactgcgacttcagaataccaaactttctttaaccccagaaccttcggttcgggggaggcagactgtggactccggccactctttgagaaaaagtcccttgaggacaagaccgagcgcgagctcctcgaatcctacatagatggacggattgtggaaggctcggatgcagaaatcggcatgtcaccctggcaggtcatgctgttcagaaagtccccacaagaacttctgtgcggggcgtcactgatttcggataggtgggtgcttaccgcggcacattgtctcttgtaccctccttgggataagaactttaccgaaaacgacttgcttgtccggatcgggaagcattccagaactcgatacgagagaaacattgaaaagatctcgatgcttgagaagatttacattcatccaagatataactggcgtgaaaatcttgatcgagatattgcccttatgaaactgaagaagccggtggccttctcggactatatccaccctgtctgtctcccagaccgagaaaccgctgcgtcactgcttcaggccggatacaagggacgtgtgaccggctgggggaacctcaaggaaacctggaccgccaacgtgggtaaggggcaaccgtcagtcctccaagtggtgaatctgcctatagtggaaagacctgtgtgtaaggattccactagaatacgcattaccgataacatgttttgcgccggttacaagcctgatgaaggtaaacgcggagatgcgtgtgaaggtgactctggaggacctttcgtgatgaaatctccattcaataaccgctggtaccagatgggaatcgtgtcatggggagagggttgcgatagagacggaaagtatggtttttacacccacgtgttccggctgaagaagtggattcaaaaagtgatagatcagttcggagag

SEQ ID NO: 8637 - DNA, 1866 bp, Artificial Sequence
  Description of Artificial Sequence: Synthetic coding sequence
atggcccatgtgcgtggcttgcagctccctgggtgtttagctctggctgccctgtgttccctggtacattcccagcacgtgtttctggcccctcagcaggcacggagcctgctgcagagggtcaggcgtgcaaacacgtttctcgaagaagtgagaaaggggaatcttgagagggagtgtgtggaggagacttgctcctacgaggaagcgttcgaagccttggaatcctctacggccacagacgtgttctgggccaagtatactgcctgtgagaccgctcgcacgcccagggataaactagctgcatgcctggagggaaactgtgccgaagggctagggacaaattatcgcgggcacgttaacatcactagatctggaatagaatgccagctctggcggagtaggtatccacacaagcctgagattaactccaccactcacccaggagccgatctgcaggaaaatttttgtagaaaccctgacagctcaactacaggcccctggtgctatacaacagatccaactgtgcgacgtcaggaatgtagcatacccgtgtgtgggcaggaccaggtaaccgtcgctatgacgccccgcagcgaaggctcaagtgtgaacctctccccgccacttgaacagtgcgtgccagatcggggacagcagtaccagggacgcctcgccgtgactactcatggactgccttgtctcgcctgggcatccgcacaagctaaggctttatctaaacatcaggacttcaactcagcagtacagctggtagagaatttctgcaggaatccagatggggacgaggagggagtttggtgctacgtggctgggaaaccaggggactttggctactgcgacctcaactactgcgaagaagccgttgaagaagagactggtgacggtctcgatgaagattcagaccgcgcgatcgaaggcagaaccgcaacatctgaataccagacttttttcaaccctagaacttttggatccggcgaagcagattgtggtctaaggcctctgtttgaaaagaaatccctcgaggataagaccgagcgagaactcctggagagctacatcgatggaagaatcgtagagggaagtgatgctgagatcgggatgtcaccctggcaagttatgctgtttcggaagtccccacaagagctcctctgcggagcctctcttattagcgaccgatgggttctaaccgctgcacattgtttgctgtatccaccgtgggacaaaaacttcacggagaacgacttactcgtgcggatcggcaagcattccaggacccgatatgagcggaatatagagaagatctcaatgctcgaaaaaatttacattcaccctcgctacaattggcgagaaaacctcgacagggatatcgcgctgatgaagctcaaaaaaccagtggccttttcggattacattcatccggtttgtcttccagacagagagaccgcggcgtctctgttgcaggcggggtacaaggggagagtgacgggatggggaaacttgaaggaaacctggaccgctaacgtcggcaaaggccagccaagtgtacttcaggttgttaatttgccaattgtggagcgccccgtctgtaaagacagcacaaggatccggatcacggataatatgttttgtgccgggtataagcctgacgaggggaaacggggagacgcatgtgagggggactcaggcgggccctttgtgatgaagtctccctttaacaatcgttggtatcagatggggatagtgtcctggggagaggggtgcgatcgggatggtaaatatggcttctacacacacgtctttagattaaaaaagtggattcagaaggtgatcgaccagtttggcgag

SEQ ID NO: 8638 - DNA, 1866 bp, Artificial Sequence
  Description of Artificial Sequence: Synthetic coding sequence
atggcgcacgtgaggggtttgcagctgcccggatgcctggccctggcagcgttgtgctcgctcgtgcattcccagcacgtgttcctcgcgccccagcaggcgaggtctttgctgcagcgcgtgagacgcgccaatactttcctggaagaggtccggaaaggcaaccttgaaagagaatgcgtcgaagaaacctgctcgtacgaagaagcatttgaggctcttgagtctagcacggccactgacgtgttctgggcgaagtacactgcctgcgagactgctcgcactccacgcgacaaactggcggcctgcctcgagggaaactgtgccgaaggcctggggaccaactaccgcgggcatgtcaacatcactcgctccggcattgaatgccagctgtggagatctcgttacccgcataagccagagatcaatagcaccactcacccgggcgccgacctgcaagaaaacttctgcaggaaccctgactcgtcaaccacgggtccctggtgctacactactgatcccacggtgcgccggcaagaatgctccatcccagtttgcggccaagaccaggtcacggtcgcaatgacgccccgcagcgaaggatcctcagtcaatctgagccctccactcgaacaatgtgtgcctgatcggggccagcagtatcagggcagactggcggtgacgacccatggactcccgtgcctggcctgggcctcggcccaggctaaagccctgtcaaagcatcaggacttcaacagcgcagtgcaactggtggagaacttttgtaggaaccccgacggagacgaagagggggtgtggtgctacgtcgctggcaagccgggggactttggatactgcgatctgaactactgcgaggaagccgtggaagaagaaactggagacgggctggatgaagatagcgacagagccatcgagggtcgcaccgcgacgtcggaataccaaactttcttcaacccaagaacctttggctccggagaggcggactgtggactccggccgctgttcgaaaagaagtcgttggaagataagaccgaacgcgaactcctcgaatcgtacattgatggacgcatcgtggagggctctgatgcagaaatcggaatgtcaccttggcaagtcatgttgttcagaaagtcaccgcaagaactgctgtgcggagcctcgctgatctcagaccggtgggtgttgaccgctgctcactgcctgctctaccctccatgggacaagaatttcactgaaaacgacctcctggtgcgcatcgggaagcacagccggactcggtacgagcgtaacatcgaaaagattagcatgcttgaaaagatctacatccatcccaggtacaactggcgcgaaaatctcgaccgggatatcgccctcatgaagctcaaaaagccggtggctttctctgactacatccaccctgtctgccttccggatcgcgaaaccgcggcgtcgctgctccaggcgggatacaagggtcgggtgactggttggggaaacctcaaagaaacctggaccgccaatgtcggcaaggggcagccttccgttctgcaggtggtcaacctgccaatcgtggagcggccggtgtgcaaggattcgactcgaatcaggatcaccgacaacatgttctgcgcgggctacaaaccagacgaaggaaagcgcggagacgcgtgtgaaggagactcaggcggaccattcgtgatgaaatcacccttcaacaaccggtggtaccaaatgggaatcgtctcatggggggagggctgcgatcgcgatggcaagtacggattttacacccacgtgttcaggctgaaaaagtggattcagaaggtgatcgaccaatttggagag

SEQ ID NO: 8639 - DNA, 1866 bp, Artificial Sequence
  Description of Artificial Sequence: Synthetic coding sequence
atggctcacgtcagaggacttcaacttcctggatgtctcgcactggctgcactgtgctccctggtccacagccaacacgtctttctggcaccgcaacaggcgcggtcccttcttcaaagagtgcgaagggctaatactttccttgaagaagtgcgaaaaggaaatcttgaacgggagtgcgtcgaggagacttgtagctacgaggaagcatttgaagcactcgagtcctccaccgcaactgacgtgttctgggcaaagtacaccgcttgtgaaaccgcacgcactcctagggacaaactcgcggcatgcctggaagggaactgcgcagaaggactgggaactaattacaggggacacgtgaatatcactagatccggtattgaatgccagctctggcgctccagatacccccataaaccggaaatcaactcaactactcaccccggcgcagatctgcaagaaaacttttgtcgtaatccagattcctccaccaccgggccatggtgctacaccactgaccctaccgtgcgcagacaggaatgttcgataccggtgtgtggtcaagaccaggtcactgtcgcaatgactccccgatccgagggctcttcagtcaacctctcacctcctctggaacagtgtgttccagatcgcggccagcagtaccaaggacgacttgccgtgaccacccatggattgccttgtctggcatgggcatctgcccaagctaaggcattgagcaagcatcaggacttcaatagcgccgtccagctggttgaaaacttttgcaggaaccccgacggggacgaagaaggtgtgtggtgctacgtggcgggaaagccaggtgactttgggtactgtgatctgaactactgtgaagaagcggtggaagaagagactggagacgggcttgatgaggactccgatcgcgcaatagagggacgcacggccacctccgaataccagacctttttcaacccgagaaccttcggatcgggtgaggctgactgtggcctcagacctctgttcgaaaagaagtcacttgaggacaagaccgagagggagctgcttgagagctatattgatggtcgcattgtggagggtagcgatgcagaaatcggtatgtcaccctggcaagtaatgctgttcagaaagagccctcaagaactgctttgcggagcctcattgattagcgatagatgggtccttactgcagcacattgccttctttaccctccttgggacaagaactttaccgaaaacgacctgctggtgagaatcggtaagcattcacgaactagatacgagaggaatattgagaaaatctccatgctggaaaagatttacatacaccctcggtacaactggcgggagaacctggacagagacattgcgcttatgaaactgaagaaacccgtggcattcagcgattacattcaccctgtctgccttcctgaccgagaaaccgccgcgtcacttctgcaagcaggatacaaaggacgcgtcactggatggggcaacctgaaagaaacgtggaccgcaaacgtgggaaaaggacagccgtcagtgcttcaggtggtgaatttgccaatcgtcgaacgccctgtgtgcaaggatagcacgcgtatccgcattactgataacatgttttgcgcaggttacaagcccgatgaagggaagagaggggatgcctgtgagggagattcgggaggaccttttgtgatgaagtcaccatttaacaaccgttggtatcaaatgggaattgtgtcgtggggtgaaggatgcgatagagatggtaagtatggattttacacccatgtctttcgcctgaagaaatggattcagaaggtgattgatcaattcggagaa

SEQ ID NO: 8640 - DNA, 1866 bp, Artificial Sequence
  Description of Artificial Sequence: Synthetic coding sequence
atggcccacgtgagaggcctacagctaccgggctgtctggccctcgctgccctttgcagcctggtgcatagccagcacgtgtttctggcaccacaacaggctaggagtcttctgcagagggtgcgtcgggctaacacattcttggaagaggtacgaaaaggaaacctggaaagagagtgcgtcgaagagacctgcagttacgaagaagcctttgaggcccttgaatcttccaccgccaccgacgtgttttgggctaagtatacggcatgcgaaaccgcccgaactccaagggacaagctagctgcgtgcctggaagggaattgtgccgagggcctgggtacaaactaccgcggacatgtgaatatcaccagatctggcatagaatgtcagttatggagatcccggtatccccacaagcccgaaattaactctaccacacaccctggtgcggatctacaggaaaatttctgccggaacccagactccagcaccactgggccttggtgttacactactgatcccacagttcgccgacaggaatgttcaattccagtgtgtggtcaggatcaagtgaccgtggccatgacaccaaggtccgagggtagctctgtgaatctgtccccaccgctcgaacagtgtgttcctgacagagggcagcagtatcaggggaggcttgccgttaccacccacggtctgccatgtctggcatgggcttcggcccaggctaaagcactgagtaagcatcaggacttcaatagcgccgtacagctcgtggagaatttttgcagaaatcccgacggcgatgaggagggcgtgtggtgctacgtcgctgggaaacctggagatttcggttactgtgaccttaactactgcgaagaagctgtcgaggaggagaccggagatggcctggatgaggactctgatagagccatcgagggccgaactgcaacatccgaataccaaactttttttaatccaagaacgtttggtagcggcgaagccgactgtggactcagaccactgtttgagaaaaaatccttggaagataaaacagagagggaattgttggagagttatatcgacggcaggattgtggaagggagcgacgcggagataggaatgtccccatggcaggttatgctgttccgaaaaagcccccaggaacttctctgcggtgcaagccttatcagcgacagatgggttctaacagccgcacactgcttactgtatcccccttgggacaaaaacttcaccgaaaacgatcttctcgtcagaattggcaaacacagtaggacccgatacgaaagaaatatcgagaagatctcaatgctggaaaagatttacatacatccccgatataactggcgagaaaacctggaccgagacatcgcactcatgaagctgaagaagccagttgctttcagtgattacattcaccctgtctgtctacccgacagggagactgctgcgtctctgcttcaagctggctacaaaggcagggttactggatggggtaaccttaaggaaacttggacagcaaatgtgggcaagggccagccctctgtgctgcaggttgttaaccttccaattgtggaaagaccagtttgtaaggactcaacgaggatccgcatcactgataatatgttctgtgctgggtacaagccagatgagggtaaaagaggcgatgcatgtgaaggtgacagcggcggccctttcgtaatgaaatcgcccttcaacaacagatggtaccagatggggatagtcagttggggtgaaggttgcgaccgagacgggaagtatgggttttacacgcacgtgttcagattgaagaagtggatccagaaagtcatagatcagttcggagaa

SEQ ID NO: 8641 - DNA, 1866 bp, Artificial Sequence
  Description of Artificial Sequence: Synthetic coding sequence
atggcccatgtccgtggcctccagctgccgggatgcctcgccttggccgcgctttgctccctggtgcactcccagcatgtgttcctggcgccacagcaggcgcgaagcctgcttcagagagtccgacgcgctaacacttttctggaggaggtccggaaaggaaacctcgagagagagtgcgtggaagaaacgtgctcgtacgaggaggcgtttgaagcactggaatcctccactgccactgatgtgttctgggccaagtacaccgcctgtgaaactgcccgaaccccgcgggacaagttggcggcatgccttgaaggcaattgcgccgaaggcctgggaactaactaccgcggacatgtgaacatcacccggtccggaatcgaatgccaactgtggcgctccagatacccccacaaacccgaaatcaacagcaccacccatcctggcgccgacttgcaagagaacttctgcagaaaccctgacagctccactaccggaccgtggtgctacactaccgaccccaccgtccgcaggcaagagtgttcgatccccgtgtgcggacaggaccaagtgacggtggccatgaccccgcgctccgaaggcagctccgttaacctgtctccaccgctcgagcaatgcgtgccggaccgggggcagcagtaccagggacgcttggcggtcactacccacggacttccgtgcctggcatgggcctcggcacaggccaaggcactgtcgaagcaccaggatttcaattccgctgtgcagttggtggagaacttctgtcggaacccggacggagacgaagagggcgtctggtgctacgtcgctggaaaaccaggtgatttcggatactgcgacctgaattactgcgaagaagctgtggaagaagagactggagatgggctcgacgaagattccgaccgcgccatcgagggcagaacggcgacctcggagtaccaaacttttttcaatccgcgcaccttcggatcaggtgaggcggactgcgggctcaggcctctgttcgagaagaagtcgctggaggacaagactgaaagagaactcctggagtcatacatcgacggccggatcgtggaaggctccgatgcggaaatcggtatgtccccgtggcaagttatgcttttccggaaatcgccgcaggagctgctctgtggcgcatcgctgatctcggatcgctgggtgttgacggcagcacactgtttgctctatcctccatgggacaaaaacttcactgagaatgatctgctcgtgagaatcgggaagcactcccgcacccggtacgaaagaaacattgaaaagatctccatgctcgaaaagatctatatccaccccagatataactggcgggaaaacctcgaccgcgatatcgctctgatgaaactgaaaaagcccgtggcattctccgattacatccatcccgtctgccttccagaccgggaaaccgcggcgtccctgctgcaggcgggatataaggggagggtgaccgggtggggaaatctcaaagagacttggacggccaacgtgggaaaggggcagccttcggtcctccaggtggtgaatctgccaattgtggaacgccctgtgtgtaaggactcgactagaattcgcatcaccgataacatgttctgtgccggctacaagcctgacgaaggcaagcgcggcgatgcatgcgaaggagacagcgggggacccttcgttatgaagtcccctttcaataaccggtggtaccagatgggaatcgtctcctggggtgaaggatgtgaccgggacggcaaatacggattttacacccatgtgttcagactcaagaagtggatccagaaggtgatcgaccagtttggagag

SEQ ID NO: 8642 - DNA, 1866 bp, Artificial Sequence
  Description of Artificial Sequence: Synthetic coding sequence
atggcacacgtcagaggccttcagctccctggatgtctcgccctagctgccctgtgttctctcgtccactcgcagcacgtctttttggcgcctcagcaggcccgctcactactgcagagagttcgcagggccaacacatttctggaggaggtccggaaggggaacctggaacgggagtgtgtcgaagagacttgttcgtatgaagaggctttcgaagcgttggagagctcaacagccaccgacgtgttttgggcaaagtacacagcatgtgagaccgccagaactccgagggacaagctggctgcctgcctggagggcaactgtgcggagggcctgggaaccaattatagaggtcacgtcaatatcactcggagtgggattgaatgccaattatggaggagtcggtatccccacaaaccagaaatcaactcaaccacgcatcctggcgccgaccttcaagaaaatttctgccgaaatcccgattcatctaccaccgggccttggtgttataccaccgatccaaccgtcagacggcaggaatgctccatcccggtgtgcggacaggaccaggtgacagtggcaatgacacctcgtagtgaaggcagctctgtgaatctgagtcctcctctggaacaatgcgtcccggaccgcggacagcagtatcagggacgacttgctgtgacaacccatggactgccatgcctggcatgggcttccgcccaagccaaggcactgagcaagcaccaggacttcaattccgccgtacagttggtcgaaaacttctgcaggaaccctgacggagacgaggaaggcgtgtggtgttatgtggccggcaaacctggtgattttggttactgtgacctgaactattgtgaagaggctgtagaagaggaaacaggagacggattggatgaggacagcgatagggccattgaggggaggacggcaaccagcgagtatcagacattcttcaaccccaggacatttgggtccggtgaggccgattgcggtttacggcctctgtttgagaagaaatccctggaggataagacagagcgagagctgttggagtcctacatcgatggtcgcatagtggaggggagtgatgcggagattggtatgagtccatggcaggttatgctctttcggaaatctccccaagagctactttgcggcgcttcattgatttcagatagatgggtgctaacagctgctcactgtctcctgtaccctccttgggacaagaattttacggaaaatgatctcctagtgcggatcgggaaacactcccgtactaggtatgaacgaaatatcgagaaaataagcatgctcgagaagatatatatacatccacgctacaattggcgggagaatttggacagagacattgccctgatgaagcttaagaagccggtcgcattctctgactatatacatcctgtgtgtctgcctgacagggagacagccgcctcgctattgcaggcaggctacaagggtcgggtcactggatggggtaatttgaaggagacctggacagctaacgtggggaagggccagccaagcgtgctccaggtggtgaacctacccatcgtggaaaggccagtgtgcaaggactccacaaggatcaggattactgacaacatgttttgcgcaggctacaagcccgatgaaggcaagagaggcgatgcttgtgaaggtgattctggcggcccctttgtgatgaaatcaccatttaataatcggtggtaccagatgggtatagtcagctggggagagggatgtgatagagatggcaagtacggcttctacacacacgtctttcggcttaagaaatggatccaaaaggtaatcgatcagttcggcgag

SEQ ID NO: 8643 - DNA, 1866 bp, Artificial Sequence
  Description of Artificial Sequence: Synthetic coding sequence
atggcacacgtccgcggcctgcaacttccagggtgtctggctcttgcagcactttgttcacttgtgcattcacagcatgtgtttttggcgccacagcaagcacggtcgctgcttcaaagagtccgccgggcaaacaccttcctggaagaagtgaggaagggaaaccttgagagagaatgcgtggaggaaacctgctcgtacgaggaagccttcgaggcactcgaatccagtacggccacggatgtgttttgggcgaaatacactgcatgtgagactgcccggaccccccgagataagctggcagcatgcctcgaaggaaactgtgctgagggcttggggactaattaccgcgggcatgtgaacattacccgctccggaatcgagtgccaactttggcggagccgataccctcacaaaccagagataaactccacgacgcatccgggcgctgacctgcaagaaaacttctgtaggaatcctgatagcagcaccaccggtccttggtgttacaccacggaccctactgtgcgcagacaggagtgctccatccctgtgtgtggtcaggatcaggtgactgtcgcaatgaccccgcgcagcgagggatcgtcggtgaacctttctccaccactggagcaatgtgtgcccgatcgggggcagcagtaccagggtcgcctggccgtgactacccacggactgccctgtctcgcgtgggcctcggcacaggcgaaggcccttagcaagcaccaggactttaacagcgccgtgcaactggtggaaaacttctgcagaaacccagacggtgatgaagaaggggtgtggtgctatgttgctggcaaacctggcgactttggctactgcgacctcaactactgcgaggaagcagtcgaagaagaaactggtgacggactcgatgaagattcggatcgagctattgagggaagaactgcgacttcagagtatcagactttcttcaatccccggaccttcgggtctggagaagcagattgtggacttcgtccattgttcgaaaagaagtcacttgaggataagactgaacgtgaattgctcgaaagctacatagatggacggattgtggaaggttcagacgcagaaatcgggatgtcaccttggcaagtcatgctgtttagaaagtcgcctcaggagcttctttgtggggcgtcacttatttccgaccggtgggtgctgaccgcggcacattgtctgctgtaccctccatgggacaagaactttaccgagaatgatctgcttgtcagaattggcaaacattcgagaaccagatacgaaagaaatatcgagaagataagtatgctggaaaagatttacattcaccccaggtacaactggagagagaaccttgacagggatatcgcactgatgaagctgaagaaacctgtggcattttccgattacattcatcctgtgtgcctgcccgacagagaaactgcggctagcctcctgcaagcggggtacaagggacgggtgacgggatggggaaacctcaaggagacttggactgcgaacgtgggcaaaggacagccatcagtgcttcaagtggtgaatttgccgattgtcgaaaggccagtgtgtaaggattcgactagaattagaataaccgataacatgttttgtgcaggttacaagccagatgaaggaaagcgcggcgacgcgtgtgaaggagatagtggaggacccttcgtgatgaaatcaccctttaacaacagatggtaccaaatgggaattgtctcatggggagaaggttgtgatcgcgatggaaagtacggattttacacccatgtgttcagattgaagaagtggattcaaaaggtcatcgatcagtttggagaa

SEQ ID NO: 8644 - DNA, 1866 bp, Artificial Sequence
  Description of Artificial Sequence: Synthetic coding sequence
atggcacatgtcagaggtttgcaacttccagggtgtctcgctctggcagcactttgttcattggtccacagccagcacgtctttctggctccccaacaggcaaggtccctcctgcagagggtgaggcgagcaaatacctttctggaagaagtgagaaagggcaacctggaacgtgagtgcgtggaagaaacctgctcgtacgaggaggcctttgaggctcttgagtcctccacggcaaccgatgtgttctgggccaaatacaccgcatgcgaaaccgcaagaacccctcgcgacaagctcgccgcatgcctggaggggaattgcgcagaaggactgggaactaactacagaggacatgtcaacattactcgcagtggaatcgagtgtcaactttggcggtcgagatacccccacaagccagaaatcaacagcaccactcacccaggagcagatctgcaagagaacttttgtaggaacccagattcgtccaccactgggccttggtgttacactactgaccctactgtcagacgtcaggaatgttcgattcccgtctgtggccaagatcaagtgaccgtggcaatgactccaagaagcgaaggaagctcagtgaacctttcccctccactggaacaatgtgttccggatcgcggtcagcaataccaagggcgtctcgccgtgactactcatggtttgccttgccttgcatgggcttccgcccaggccaaggcattgagcaagcaccaagacttcaattcagcggtgcaacttgtcgaaaacttttgcaggaaccctgacggggacgaagaaggagtgtggtgttacgtcgcaggcaagcccggagattttggttactgtgacctgaattactgtgaagaagccgtggaagaagaaactggggatggattggatgaggactcggatcgcgcaattgaaggacgaaccgccacttctgagtatcagacctttttcaatccaagaacctttgggagcggagaggcagattgtggccttaggcccctttttgagaagaaatccctggaagataagaccgaacgtgaattgttggagtcatacatagatggtcggattgtggaaggatcggatgcagagattggcatgtccccgtggcaagtgatgctttttagaaagtcacctcaagagcttctctgtggtgcttccttgatttccgatcgctgggtcctcaccgcagcacattgcctgctgtatccaccatgggacaaaaactttactgagaacgacctgctcgtgaggatcgggaagcactcacggacccgatacgagcgcaacatcgaaaagattagcatgctggagaaaatctacattcatcctagatacaattggcgggagaacctggaccgtgacattgcacttatgaaacttaagaagcccgtggccttttcggattacattcatccagtctgtctgccagatagagaaaccgcagcctcgctccttcaagcagggtacaaaggtagagtgactggatggggaaatcttaaggagacgtggaccgctaatgtggggaagggccagccctcggtgctgcaggtcgtgaaccttcctattgtggaaagacctgtgtgtaaggatagcactcgcatcaggatcactgacaacatgttctgtgcgggatacaagcccgacgaaggaaaacggggagacgcgtgtgaaggggactcgggtggtccttttgtgatgaaatccccgtttaacaacagatggtaccagatgggcattgtgtcatggggcgagggatgtgatagagatggtaagtacggattttacacccatgtgttcaggcttaagaagtggatccaaaaggttattgatcaatttggagaa

SEQ ID NO: 8645 - DNA, 1866 bp, Artificial Sequence
  Description of Artificial Sequence: Synthetic coding sequence
atggcccatgtaaggggtctgcagctgcccggatgtttggccctggccgctctctgttccttggttcattcacagcatgtgtttctggcacctcagcaggcccgcagtctgttgcagagggtgagaagagccaatacattcctggaggaagtgaggaaggggaatctggagagagagtgcgtggaggagacctgtagttatgaagaagcatttgaggcacttgagtcctccactgcgacagacgtattttgggccaaatataccgcttgtgaaaccgctagaaccccaagggataagctggccgcgtgtttggagggcaactgtgcagagggactcggcaccaactaccgggggcacgtcaatattactcggagtggaatcgagtgtcagctgtggagatctaggtatcctcacaaacccgagatcaattcaacaacacatcccggggctgaccttcaggagaatttctgccgaaaccccgacagctctacaactggcccatggtgctacaccactgatcccacagtccgaagacaggagtgtagtattccagtgtgcggacaggaccaggtgacagtagcaatgaccccacggtctgaggggtcaagtgttaacctgtccccacctctcgagcaatgtgtgcccgatagaggtcagcagtatcaggggagactggccgtcacaacgcacgggctcccctgcttggcttgggcgtcagcacaagccaaagccctttccaaacatcaagatttcaattccgctgtgcagttggtggagaatttttgccggaaccccgatggggacgaggaaggtgtgtggtgctacgtagccggcaagccgggagactttggatactgcgacctcaactattgcgaggaagcagtggaagaggagaccggcgatggattggacgaagattctgatagggccattgaaggaaggaccgccacctccgaatatcaaacctttttcaatccaagaaccttcggctctggcgaggctgattgtgggctgcgcccactgttcgaaaaaaaatccctggaagacaaaactgagcgggagctgctggaatcctacattgacggaagaatcgtggagggatcagacgcagagattgggatgtccccatggcaagtgatgctttttcgcaaaagccctcaggaacttctgtgcggtgccagcctcatcagcgacaggtgggtgctcaccgctgctcactgcctgctctatccaccttgggataagaacttcaccgagaacgacctgctcgttcggataggtaagcacagccggacgaggtacgaacgcaatatcgaaaagatctccatgctcgagaaaatttacatccaccccaggtacaattggagagaaaacctggatagagacatagccctgatgaagttgaagaaaccagtcgccttcagtgactatatccaccccgtttgcttgcctgacagggaaactgcagctagtctccttcaggctggctacaaggggcgggtgactggatggggcaatctcaaggaaacctggacggccaatgtgggcaagggacagccttcagtgctgcaagttgtcaacctccctatcgttgaaaggccggtgtgcaaggactcaactcgcattagaataacggataacatgttctgcgccgggtataaacctgatgagggcaaaagaggggacgcgtgcgagggagactccggggggccctttgtgatgaagtctccgtttaacaaccggtggtaccagatgggtattgtaagttggggtgaaggctgtgatagagacgggaagtatggattttacactcacgtgttccggcttaagaagtggattcagaaggtcattgatcaattcggtgag

SEQ ID NO: 8646 - DNA, 1866 bp, Artificial Sequence
  Description of Artificial Sequence: Synthetic coding sequence
atggcgcacgtacgaggcttgcagctcccgggatgtctggcactggcggcgctctgctccctcgtccactcccagcacgtgtttctcgccccccagcaggctagatcactgttgcagagagtgcggagggccaataccttccttgaggaagtccggaaaggaaacctggagcgcgagtgcgttgaggagacttgctcgtacgaggaagcattcgaggctctggagtcgtcgaccgccactgatgtcttttgggccaaatacactgcctgtgagactgcacgtaccccacgcgacaagctggcagcctgtctcgagggcaactgcgctgagggtcttggaaccaactaccgcggccacgtgaacattactcggtcgggaatcgagtgccaactctggagaagcaggtaccctcacaagccggaaatcaactccacgactcacccaggagcagatctccaagagaatttctgccggaaccccgacagctcgactactggaccgtggtgctacactaccgatcctactgtgcggaggcaagaatgctcgatcccagtctgtggtcaggaccaagtgactgtggccatgacgccgcgcagcgagggctccagtgtgaatctgagccctccactcgaacagtgcgtcccggatcgggggcaacagtaccaggggcgcctggcggtcacgactcatggactgccgtgcctggcgtgggcctccgcccaagccaaagctctctcgaagcatcaagacttcaactcggcggtgcagctcgtcgaaaacttctgtcgcaacccagacggagacgaagagggcgtctggtgctacgttgccggaaagccgggagattttggctactgcgacctcaattactgcgaggaagccgtcgaagaggagactggagacggactcgacgaggattctgacagagcaatcgagggacggaccgcgacctccgaataccagacgttcttcaacccgcggactttcggctcgggcgaggccgattgcggcttgcgcccgctgttcgaaaagaagtcattggaggacaagactgaaagagagttgctggagtcctacatcgatggtagaatcgtggaaggctcagacgccgaaatcggtatgagcccgtggcaagtcatgctcttccgcaaaagccctcaggaactgctctgtggtgcctcgctgatctcagacaggtgggtcctgactgccgcacattgcctgttgtacccaccctgggacaagaatttcactgagaatgatctgctggtgcgcattgggaagcacagccggacgagatacgagcggaacatcgagaagatctccatgctggaaaagatctacatccacccgcggtacaactggagagaaaacctggacagagatatcgctctgatgaagctgaaaaagccagtcgcgttctcagattacattcacccagtgtgcctgcccgatcgcgagacggccgcctcgctgttgcaagctgggtataaaggacgggtaacgggatggggaaacctgaaagaaacttggactgcaaacgtgggaaaaggccagccaagcgtgctgcaggtggtcaacctgccgattgtggaaagaccggtgtgcaaggactccaccagaattcgcatcactgacaacatgttctgtgcgggttacaagccagacgaggggaaacggggggacgcgtgcgaaggagattcaggtggcccgttcgtcatgaaatctccttttaacaatcggtggtaccaaatgggtatcgtgtcatggggagaaggatgcgaccgggatggcaagtacggattctacacccacgtgttccggttgaagaaatggatccaaaaggtgattgaccagtttggcgag

SEQ ID NO: 8647 - DNA, 1866 bp, Artificial Sequence
  Description of Artificial Sequence: Synthetic coding sequence
atggcacacgtacggggtttgcagctcccgggctgtctggctctcgcagctctgtgctcgctggtgcacagtcagcacgtatttctcgccccgcaacaggccagatccttactgcagagggtaaggcgagctaacacctttctcgaagaagtgcggaaggggaatctggagcgagagtgtgtggaggaaacgtgctcctacgaggaggcgttcgaggccctggaatcctcaacagctaccgacgtgttctgggcaaaatacaccgcttgcgaaacggctcgtacaccgcgggataagctcgcagcttgtctcgaggggaactgcgctgaaggactggggactaattatcgtgggcacgtgaatataaccagatctggcattgaatgtcaactgtggcgctcgcgctacccccacaagcccgagatcaattcgacaacacatcctggagcggatttacaggaaaacttttgtcgtaaccccgattccagcacaacagggccatggtgttataccacagaccctaccgtcaggagacaggaatgcagcatacctgtctgcggacaggatcaagtcactgtggccatgacacctcgtagcgaaggctcaagcgtaaatttgtctcccccactcgaacagtgtgtgccggataggggccagcagtatcagggccggctagctgtgacaacccacggcctgccttgtctggcctgggctagtgctcaggcaaaagcactgtctaagcaccaagactttaactcagcagtacagttagttgagaatttttgccgtaatcctgatggagatgaggagggcgtatggtgctacgtggccggaaaacccggtgatttcggttactgtgatctgaactattgcgaagaggctgttgaagaggaaaccggggacggcctggatgaggattccgaccgcgcaatcgaagggcggactgcaacctccgaataccagaccttttttaatccccggacttttggatccggggaggcggattgcggcctgagacctctgtttgagaagaagagcctggaggataaaaccgaacgggaactattggaatcatatatcgacggccgtatcgtcgaaggttctgacgccgaaattggaatgtcaccatggcaggttatgctttttaggaaaagccctcaggaactcttgtgcggcgcatcactcatctctgatcggtgggtactcactgccgctcattgcctgctctatcccccttgggacaaaaacttcacagagaacgacctgctggtgcggattggtaagcatagcaggaccagatacgaacggaatatcgagaaaattagtatgctggaaaaaatctatatacaccctcggtacaactggagagagaaccttgatcgggacatcgctctgatgaagctcaagaagccagtggccttctctgactacatccatcccgtttgcttaccggatcgtgagacagcagcttccctgctccaagctggctataaggggagagttactggatggggaaacctcaaggaaacctggacggcaaatgtgggcaaaggtcaaccttcagtgttacaggtggtgaatctgcccatcgttgagagaccagtgtgtaaagattccacacgtatacgtatcacggacaatatgttttgcgcgggctataagcccgatgaggggaaacgaggcgatgcctgcgaaggagactctggaggtccctttgtgatgaagtcgcccttcaacaaccggtggtatcagatggggatcgtttcctggggggaagggtgcgaccgggatgggaagtacggcttctatacacacgtctttagactgaaaaaatggatacaaaaggtcatagaccagttcggtgag

SEQ ID NO: 8648 - DNA, 1866 bp, Artificial Sequence
  Description of Artificial Sequence: Synthetic coding sequence
atggcacatgtgaggggccttcagctgcctgggtgtcttgcactggcggccctctgctccctggtgcattcgcaacatgtgtttctcgctccacaacaagcgcggtccctgcttcagagagtgagaagagccaataccttcttggaggaagtcaggaagggaaacttggaacgggagtgtgtcgaagaaacctgttcgtacgaagaagcattcgaggcactggaaagctccactgccaccgatgtgttctgggctaaatacactgcatgtgaaactgcccgtaccccaagagataagctggcagcatgtttggaaggcaactgcgccgaaggattgggtaccaactacaggggacatgtcaacattactcgatcaggaatcgaatgccaactgtggagatcgcgttaccctcataagcctgagataaactccaccacccatcctggcgcagatctccaggagaacttttgcagaaatccagactcgtccactaccggaccatggtgttacactaccgatcctactgtgagaaggcaggaatgctccatccctgtgtgtgggcaggatcaagtcactgtggcaatgacccctagatcggagggttcatcggtgaatctgagcccaccactggaacaatgtgtgcctgatcgaggccaacaataccaaggacgcttggcagttactacccatggactgccatgtctcgcttgggcctcagcacaggcaaaagcactctcgaagcatcaggatttcaatagcgcagtccaacttgtggaaaacttttgtaggaatccagatggtgatgaggaaggggtgtggtgctacgtggccggaaaacctggtgactttggctactgtgatctcaattactgtgaagaggctgtggaggaagaaaccggggacggcctggacgaggattcggatcgggcaatagaaggtcgaaccgcaacttcggagtaccaaacgttcttcaatccacggacgtttggatccggtgaagccgattgcggtctgcggccattgtttgagaagaagagcctggaagataagacggaaagagaacttctggaatcttacattgacgggcgaattgtggagggttcggatgcggagatcggaatgtcaccatggcaggttatgcttttcagaaagtccccccaggaactgctgtgtggagcgtcacttatctctgacaggtgggtgcttactgctgcgcattgccttctgtacccgccgtgggacaaaaacttcactgaaaacgatctgctcgtgcggattggtaagcattcaaggactcggtacgagagaaacatcgaaaagatttcaatgctggaaaagatctatatacatcctcgctacaattggagagagaaccttgaccgcgacatagcgctgatgaagttgaaaaagccggtggcattttcagattacatccatcctgtctgtctgccagatagggaaaccgcagcgagccttttgcaggcaggatataagggcagagtgactggctggggtaatctcaaggagacgtggaccgccaacgtcggtaaaggtcagcctagcgtacttcaggtggtgaatctgccgattgtggagcggcccgtgtgcaaggattcgactcggatcagaatcactgacaacatgttttgtgccggctacaagcctgatgaaggtaagaggggagacgcatgtgagggggactcaggtggaccattcgtgatgaaatccccattcaacaatcgttggtaccaaatgggcattgtcagctggggcgaaggatgcgatcgagacggaaaatacggattttacacccacgttttcaggctgaagaagtggatccaaaaggttattgaccaattcggggaa

SEQ ID NO: 8649 - DNA, 1866 bp, Artificial Sequence
  Description of Artificial Sequence: Synthetic coding sequence
atggctcatgttaggggacttcagctgcctggctgcctggccctggctgcgctatgctccctagtgcactcacagcacgtgttcttagcaccacagcaggcgcggtccctcctacagcgagtgcgcagagctaacacatttctggaagaagtacggaaaggtaatctcgagcgggagtgcgtcgaggagacatgctcctatgaagaggcattcgaggccctcgagagcagcactgccacagatgtgttttgggccaaatacacagcctgcgagacagcccggaccccaagagataagctggccgcgtgcttggaaggtaattgtgcggaaggtctgggcacaaactaccgaggccatgtaaacattacgcggtctgggatcgagtgtcagttgtggcgtagccgctatccccacaagcccgaaattaattctaccactcatcccggtgccgatttgcaggaaaatttctgccgtaatccggattcctccaccacagggccttggtgttataccaccgacccgaccgtgaggcgacaggaatgctcaataccagtctgtggtcaggaccaggttacggtggccatgactccaagaagcgagggaagttcggtcaacctgtcacccccactggaacagtgcgtgcctgaccggggacagcagtaccagggacgcctcgccgtgacaacccatgggctgccgtgcctggcttgggctagcgcccaggctaaggcactttccaaacatcaagattttaatagtgccgtgcagctggtggagaacttctgccggaacccggatggcgatgaggagggggtttggtgctacgtagcagggaagcctggagatttcggttattgtgatctgaactattgcgaggaagccgttgaagaggagacgggggacggtctggacgaggattcagatagagcaatagaaggtcggacagctacttccgaatatcagactttttttaaccctcgcactttcggtagtggcgaagccgactgtggccttcgtccattgttcgagaaaaaaagcctggaagataaaacagagcgtgaactgctggagagctacatcgacgggaggatcgtcgagggcagcgacgccgagatcggaatgtccccctggcaggtcatgctgtttagaaaaagcccgcaggaattactgtgtggggccagtttgatttcagatagatgggtcctgacggccgcccattgcctgctttaccctccttgggacaagaactttactgaaaacgacctgctcgttagaataggcaagcacagtcgcactcggtatgagcgaaatatagaaaagatttcaatgcttgagaaaatttacatccacccgaggtacaattggcgggagaacttggacagggatatcgccttgatgaagctcaaaaaaccggtagcattttcagattatatccacccggtatgcctccccgaccgggaaactgcagctagcctacttcaggcggggtacaaaggaagagtcacaggttggggcaaccttaaggaaacttggaccgccaatgtcggcaagggtcagccaagtgtcttgcaggtggtgaaccttcctatcgtcgagcggccagtgtgtaaagactcaactagaattcgaatcaccgacaacatgttttgtgctgggtacaaacccgacgagggcaagcgaggcgacgcgtgcgaaggtgattccggcggaccatttgtgatgaagtcaccattcaacaacagatggtatcagatgggtatcgtgagttggggagagggctgtgaccgtgacggtaagtatggcttttacacccacgtgttccgactcaagaagtggattcagaaagttattgatcagttcggagag

SEQ ID NO: 8650 - DNA, 1866 bp, Artificial Sequence
  Description of Artificial Sequence: Synthetic coding sequence
atggcacatgtcaggggcttacagctaccaggctgccttgcgctggctgctctgtgcagcttagtgcattctcaacatgtgtttctggctcctcaacaggccaggtcactcctgcagcgtgtgcggcgagccaatacctttttggaagaagtcagaaaaggcaacttagagagagagtgcgtggaggagacttgttcctatgaggaagcatttgaagcactcgaatcctctacagctacagacgttttctgggctaagtacaccgcttgcgagaccgccagaacaccgcgggataaactggccgcttgtctagaggggaattgtgccgagggactaggcacaaattaccgcggccatgtcaatatcaccagaagcggaatcgagtgtcagctgtggcgctcgaggtatccacacaaaccggaaatcaattcaaccacgcatccaggtgcagatctgcaagagaacttttgtcgaaaccccgatagctccactaccggtccctggtgctatacgaccgaccctactgtcaggcggcaggaatgttctatacccgtgtgcgggcaggaccaggtgacggttgctatgacccctaggtcagagggctcaagtgtgaatcttagtccacctctcgaacagtgcgtcccagatcgagggcaacagtaccaagggagactggcagtgaccacacatgggttgccatgcctagcatgggcctcggctcaggctaaagctctttcaaaacaccaagacttcaacagcgccgttcaactggtagaaaatttctgtaggaacccagatggcgatgaagagggagtgtggtgctacgttgcgggaaaacctggtgactttggctattgcgatctgaactactgtgaggaagccgtagaggaggaaactggtgacggtttagatgaggactctgaccgcgcaattgaaggccggactgctaccagcgaatatcaaacgttttttaatcctagaacgtttggcagcggtgaggcagattgcggcctcagacccctgttcgagaagaaaagtcttgaggataaaacagaaagggagctgctcgagtcctatatcgacgggcgtatagttgaaggtagcgatgccgagataggaatgtctccctggcaggtcatgctcttccggaagtccccacaggagctgctctgtggagcgtcactgattagcgaccgctgggtcttgacggcagcgcactgtttgctgtatcccccctgggataagaatttcactgagaatgacctcttggtacgaatcggcaagcattcgagaacccggtatgagaggaacattgagaagattagtatgctcgagaagatctatatccatccgagatacaactggcgggaaaaccttgatcgcgatattgctcttatgaaactaaaaaaacccgtggcattctctgactacattcaccctgtgtgcctgcctgaccgggaaaccgcggcctcactacttcaggcggggtacaaggggcgcgtcacaggctggggaaatttgaaagaaacatggactgctaacgtcgggaagggccaaccttcagtgctgcaggtggtgaatctcccaatcgtggagagacccgtttgtaaagattcaacgaggattaggatcaccgacaatatgttctgtgccgggtataagcctgacgagggcaaacgaggagatgcatgcgaaggtgattcagggggcccattcgtgatgaaaagtcctttcaacaacagatggtatcagatgggcatcgtgtcctggggcgagggttgcgaccgagacggaaagtacggcttctacacccacgtgtttcggctgaagaaatggatccagaaagtgatcgatcagtttggcgag

SEQ ID NO: 8651 - DNA, 1866 bp, Artificial Sequence
  Description of Artificial Sequence: Synthetic coding sequence
atggcgcacgtgagaggccttcagctgcctggctgtctggccctcgcggcactgtgttccctggtgcactcacaacatgtgtttctggcacctcagcaggcacgatcacttcttcaacgtgtcaggagagccaatacctttttggaagaggtgcgtaaggggaatttggaaagagaatgtgtggaagaaacttgttcatatgaagaggcctttgaagcactcgaatcgtcgactgcaaccgatgtgttctgggccaagtacaccgcgtgcgaaaccgcacggactcccagagataagctcgcggcctgtctggaaggcaactgtgccgaaggcctcgggaccaattatcgagggcatgtgaacataacgcgctcgggtatcgaatgccaattgtggcgaagcagatacccgcataaaccggagatcaacagtacgactcatcccggcgcagacttgcaggaaaacttctgcagaaacccagactcctccaccactggaccttggtgttacacgaccgacccgactgtccgccggcaagaatgttcgatacctgtgtgcggacaagaccaagtgactgtggcgatgaccccgcgctccgaaggtagcagtgtcaacttgtcaccaccgctggagcagtgtgtgccagatagagggcagcaataccagggtcgattggcggtgaccacccacggtctgccttgcttggcatgggcctcggcgcaggccaaagcacttagcaagcatcaggacttcaacagcgctgtgcagcttgttgagaacttttgccgcaatcctgatggcgatgaagaaggagtgtggtgttatgtcgcaggcaagccgggagattttggttactgcgacctgaattactgtgaggaggcggttgaggaggagactggtgacggcctggatgaggactcggaccgagcaatcgaaggtcgcactgcaacgtcagaataccagaccttctttaatccgaggacttttgggagcggagaggccgattgcggactgaggcctctctttgaaaagaagtcccttgaagataagaccgaacgggagcttctggaatcctacattgacggacggattgtcgagggatctgacgctgagattggtatgtctccatggcaagtaatgctttttcgcaagtcgcctcaagaacttctgtgcggagcatcgcttatttccgacaggtgggtgctcaccgctgcacactgtctcttgtaccccccatgggataagaatttcacggagaacgatcttttggtgcgcattggtaaacactctcggactcgttacgaacggaacattgagaaaatctcgatgcttgaaaagatttacattcatcctcgctacaattggagagagaacctcgatagggatatcgccctgatgaaacttaagaagcctgtcgcattttccgattacatacatcctgtctgtctgcctgacagagaaaccgccgcatcgcttctgcaagcaggctacaaaggtagggtgactggctggggaaatctgaaggaaacgtggactgcaaatgtcggtaaaggacaacccagcgtcttgcaagtggttaacctccctatcgtcgaacggccagtgtgcaaggatagcaccagaattcggataactgacaacatgttttgtgcaggatacaagccagatgagggaaaacgaggcgatgcatgtgagggagactcaggaggacccttcgtgatgaaatcgccctttaacaaccggtggtaccaaatggggattgtctcctggggggaagggtgtgatcgcgatggaaagtacggattttacactcatgttttccgactcaagaagtggatccagaaggtaattgaccagttcggcgaa

SEQ ID NO: 8652 - DNA, 1866 bp, Artificial Sequence
  Description of Artificial Sequence: Synthetic coding sequence
atggcccatgtgcgcgggctgcaacttccagggtgtcttgccttggcggcactctgctccctggttcactctcagcatgtattcctcgctccgcaacaagcaaggtctctcctccagcgtgtccgacgggccaacaccttcctggaggaggtgagaaaggggaatctggagagggaatgcgtggaagagacgtgttcttatgaggaggctttcgaggccctggagtccagtaccgccaccgatgtattttgggcgaagtacaccgcctgtgagacagcccggaccccccgtgacaaactggcagcctgcctggaaggtaattgtgcagaaggactggggactaactaccgcgggcatgtcaatatcacgcgctcaggcatcgaatgtcagttgtggcgctcacgctacccccacaagccggagatcaactccactactcatcctggggccgatctgcaggaaaatttttgccgcaacccagactcttcaacaactgggccatggtgttacacgacagatcccacggtccgtaggcaggaatgttcaatccccgtttgtggtcaggatcaagtgacggtggcaatgaccccccgtagtgagggcagttcagtcaacctgtctccccctttggagcagtgtgtgccagataggggccagcaatatcaagggaggctcgctgtgaccactcatgggttgccttgtctggcttgggcctccgcccaggccaaggcattaagcaagcaccaagattttaattctgccgtccagttagtggaaaatttttgtcggaatcccgatggagatgaagaaggagtctggtgctacgtggcagggaagccaggtgactttggatactgcgacctcaattattgtgaggaggcagtcgaagaagaaacgggggatggcctggacgaggactcggaccgagctatagaggggcgaacggctacatcggagtaccagaccttcttcaatcctcgtacattcggatcaggtgaagctgactgcggcctgagaccgctattcgaaaaaaaatccctggaagacaagacagagcgggagttgctggagtcatacattgatggccggatagtcgaaggaagtgacgccgaaatagggatgtctccctggcaggtcatgctgttcagaaagtcgccccaagagctgctgtgtggggcctcgctgattagtgataggtgggtccttactgccgcccactgcctcctttaccctccgtgggataagaatttcacagagaacgacctactggtgcgcatcggtaaacactcacgcacccgttacgaaagaaacatcgagaaaatttccatgctggaaaaaatctacatccacccccgttataactggcgggagaatctggaccgagatatcgctctgatgaaactgaagaagccggtcgcgtttagtgattacattcaccctgtgtgcctcccggaccgtgagaccgcagccagtcttctgcaagccggctacaaaggcagggtgacaggatggggcaatctgaaagaaacctggacggccaacgtggggaaggggcagccatctgtgctgcaggttgtcaacctcccaattgtagagcgccccgtttgtaaggatagtacgagaattcgcatcaccgataatatgttctgtgccggttacaagcctgacgagggaaaacggggggacgcatgtgagggagatagtggtggcccctttgtgatgaaaagcccgttcaataacagatggtatcaaatggggatcgtaagttggggggaggggtgtgatcgggacgggaaatacggtttttacacccacgtctttcgcctaaaaaagtggattcagaaagttatagaccaatttggggaa

SEQ ID NO: 8653 - DNA, 1866 bp, Artificial Sequence
  Description of Artificial Sequence: Synthetic coding sequence
atggcccacgtaaggggtctgcagctcccagggtgcctggctctggctgccctgtgttctctcgtgcattcccagcatgtctttctggcaccacaacaggcacgttcgctgctccagcgggtgcgcagggccaacacattccttgaggaggtccggaaaggcaacctggagagagagtgtgtcgaagagacttgcagctacgaagaggccttcgaggccctggaatcttccaccgcaacggatgtattctgggccaaatacaccgcttgtgagactgcaagaaccccacgcgataagctggccgcatgtttagagggaaattgcgccgaagggctgggcacaaattaccgagggcatgtgaacatcactaggtcaggcatcgaatgccagctgtggcggtccagatatcctcacaagcctgagatcaacagcacaactcatccgggtgcagatctgcaggagaatttttgcaggaaccccgactctagcacgacagggccctggtgctacacaacagatcccacggttaggcgacaagagtgtagcatccccgtgtgtggacaggatcaggtcaccgtcgccatgacacctcgtagtgaaggaagttctgtcaacttgagtccaccattggagcaatgtgtccctgaccgtggccaacagtaccagggaagactggctgtgaccacccacggcttgccttgcctcgcctgggctagcgcgcaggctaaggcgctttcaaaacaccaagacttcaatagtgcggtgcagcttgttgagaacttttgtcggaaccccgatggggatgaggaaggggtgtggtgttatgtggccggaaaacctggagacttcgggtattgtgacctcaactactgcgaggaagctgttgaagaagaaaccggggatggattagacgaggactctgatagggccatcgaagggaggaccgccaccagtgaataccagacattttttaatcccagaaccttcgggagcggcgaggccgattgcggactgaggccactgttcgagaagaaaagtctggaggacaaaactgaacgggagctgctggagtcttacatcgacggcagaattgtagagggatcagatgcagagatcggaatgagcccctggcaggttatgctctttcgcaaaagcccacaggagttgttgtgcggtgcaagcttgatcagtgatagatgggtgctcactgcagcccactgcctcctgtaccccccctgggacaaaaacttcaccgaaaatgatctgctggtacgaatcggcaaacattccagaacgcgctacgagcgcaacatcgagaagatctccatgttagagaagatatatattcatcctcgctacaactggcgagagaacctggatcgggatatagccttgatgaagctcaagaaacccgtcgccttttctgactacatccatccagtgtgcctccccgatcgcgagaccgccgctagcctgctgcaggctggctacaaaggacgtgttaccggttggggcaatctcaaagagacatggactgctaatgtggggaaaggacaaccatctgtgttgcaagtggttaacctgcccattgtcgagcgcccagtttgtaaagattctacaaggatcaggatcaccgacaacatgttttgtgctgggtacaagcccgatgaagggaaaaggggcgatgcttgcgagggagattccggtgggccgttcgtgatgaagtccccctttaacaatcgatggtaccaaatgggcatcgtaagttggggggagggctgcgaccgggatgggaaatatggtttttacactcacgtgttcagactcaaaaaatggattcagaaggtgatagaccagtttggagaa

SEQ ID NO: 8654 - DNA, 1866 bp, Artificial Sequence
  Description of Artificial Sequence: Synthetic coding sequence
atggcacacgtcagggggctgcaattgccaggatgccttgccttagccgctctctgctccctggtacattctcagcatgtgtttctagccccgcagcaggcgcgctctcttctgcagagggtgcgacgagccaatacctttttggaggaggttcgcaaaggtaacctagagagggagtgcgtggaggagacctgcagttacgaggaggcttttgaagctctcgagtcatcaaccgccacagacgttttctgggccaagtacacagcctgtgagacagctaggactcccagggataaattggcggcctgtctcgagggcaattgtgccgagggcctgggaaccaattacagggggcacgtgaatatcacccgttccggcatcgagtgtcagctctggcggtcccgctacccccataagccagagattaactcaacaactcacccaggagccgatctgcaggaaaacttctgtagaaaccctgactcgtccaccacagggccatggtgctataccaccgacccaaccgtgaggcggcaagaatgttccattcccgtgtgtggacaggatcaggttacggtcgccatgaccccacgttcagagggctcctcggtgaacctgagcccaccactggaacagtgcgtgccagatcggggacagcagtatcagggtcggctggctgtaactacacatggtcttccttgtctggcctgggcatcagcccaagcaaaagctttgagcaaacatcaggatttcaactccgcagtacagttagtcgaaaatttctgtagaaatcccgatggcgatgaggagggggtttggtgttacgtggcaggaaagccaggcgacttcggatactgcgacctgaattactgcgaagaggctgtcgaagaggagacaggagatgggctggatgaggattctgaccgtgccatcgagggaagaaccgccacgtcggaataccagaccttctttaaccctcgaacattcgggtctggtgaggccgactgcggccttcgacccctgttcgaaaaaaaaagcctcgaggacaaaaccgaaagagagctgctggagtcttacatagatgggaggatagttgagggatccgatgccgagattggcatgtccccctggcaggtgatgctatttcgcaaatcaccccaagagctcttgtgtggcgcttccttgatcagcgatagatgggttctcaccgccgcgcactgcctgctgtacccaccatgggacaagaactttacagagaatgatttgttggtgcggatcgggaagcacagtcggacccgatatgagcgcaacatcgagaagatctcaatgctggaaaaaatatacatccacccgcgatataactggcgggaaaaccttgacagagatattgcactcatgaagctgaaaaagcctgttgccttttccgattacatacatccggtatgcttaccggaccgcgaaactgcagctagtctactgcaggctggctacaagggcagagtgaccggctggggtaacctaaaagaaacctggactgctaacgtcggcaaaggacaacccagcgtactccaagtggtgaacctacctattgtcgagaggcccgtgtgcaaggattctactaggataaggatcaccgacaatatgttttgcgcaggatacaaacccgacgaggggaagaggggggatgcctgtgagggggactcaggtgggccttttgtcatgaagtccccttttaataaccgatggtaccagatggggattgtcagttggggtgaagggtgcgaccgggatgggaagtatgggttttatacccatgtcttcagattgaagaaatggattcaaaaagtgatagatcagtttggagag

SEQ ID NO: 8655 - DNA, 1866 bp, Artificial Sequence
  Description of Artificial Sequence: Synthetic coding sequence
atggctcacgtgagaggattgcagctgcctggctgccttgccctggctgcactgtgctccctggtgcactctcagcacgttttcttggcacctcagcaagcacgttccctgctccaacgtgttcgcagagcaaatacattcctggaagaggtccgtaaaggtaatctcgagagagagtgtgtggaggaaacttgcagctacgaggaagccttcgaagccctggagagctccaccgccaccgatgtcttctgggctaagtacacagcttgtgagactgcccgcacaccacgcgataaactggctgcctgcctcgaaggtaattgtgccgaaggactcggtaccaactacaggggacatgtgaacattaccaggtccggaatcgaatgccagttgtggaggtcaaggtatcctcataagcccgagatcaactctaccactcacccaggcgcagatttgcaggagaatttctgtaggaacccagatagcagtacaactggaccctggtgttatactacagacccaactgtcagacgtcaggaatgctctatacctgtgtgtggacaggatcaggtaacagtggccatgacacctcgctccgagggatctagtgtcaacctctctcctccccttgaacaatgtgtccccgaccgtggccagcaataccagggaagactcgctgtcaccactcacggtctgccctgcctcgcatgggcttctgcccaagctaaggccctgagtaaacaccaggattttaattctgccgttcaactggtggaaaatttctgcagaaaccctgacggcgatgaggagggtgtctggtgttacgtagccggaaagcccggcgacttcggttattgcgacctcaactactgtgaggaagctgtggaggaggagactggcgacggcctggacgaggattctgatagagcaattgagggcagaaccgccacctccgagtaccaaactttctttaacccccgcacttttggatctggtgaagccgactgcggactgcgtcccctgtttgagaagaagtctctcgaagataaaaccgagagggagttgctcgagtcctacatcgacggaaggatagtggaaggatccgatgctgagataggcatgagtccctggcaggttatgctgttccgcaagtctccacaagagctcctgtgcggagcctcactcatcagcgaccgttgggtgctcaccgcagcccactgtctgctgtatccaccttgggacaagaactttactgagaacgacttgttggtacgcattggcaagcactctagaacaaggtacgagcgcaatattgagaagatttccatgttggagaaaatctacatccatcctcgttacaattggagggagaacctggacagggatatcgcactgatgaagctgaagaagccagtcgcattctcagactacatccaccccgtgtgtctgcctgatcgcgagaccgccgccagcctcctgcaggccggttacaagggaagggttactggttggggaaatttgaaagagacctggaccgctaatgtgggtaagggacagccatccgtcctgcaagtggtgaatctccccattgtggagcgcccagtctgcaaggatagcacaagaatcaggatcactgataacatgttctgcgcaggctataagcctgatgaaggaaaacgcggtgacgcatgcgaaggagattctggaggaccctttgtgatgaagtcccctttcaacaacagatggtatcaaatgggtattgttagttggggtgagggttgtgatagagatggaaaatatggcttttatacccatgtgttccgcctgaagaagtggatacagaaagtgattgatcagtttggagaa

SEQ ID NO: 8656 - DNA, 1866 bp, Artificial Sequence
  Description of Artificial Sequence: Synthetic coding sequence
atggcccatgtccgagggctgcaactcccaggttgtttggcactggccgcgctctgttccctggtgcattcgcagcacgtctttcttgcaccccagcaggcccgtagcttgctgcagcgtgtgaggcgagccaacacttttctggaagaggtgcgcaaaggtaacctggaacgggaatgtgtggaggaaacctgcagctacgaagaagcgttcgaagcactggaaagctcaaccgcaactgatgtattctgggcaaagtacaccgcatgtgagactgcccgcacccctagagataaactggcagcatgtcttgaggggaattgtgccgaagggttgggaaccaattacagaggtcacgttaacatcactaggtcagggattgagtgccaactgtggcgttcgcggtacccacacaaaccagaaatcaacagcactactcatcctggtgcagatcttcaggaaaacttttgccgcaaccccgactcctccacgacgggcccatggtgttacactaccgatcccaccgtgcgccggcaagagtgctcgattccggtgtgtgggcaagatcaagtgacggtagctatgaccccaagatcagaaggttcgagcgtgaatctcagtccaccccttgagcaatgtgtccctgaccggggccagcagtaccagggacgtctcgcggtgaccacccatggtttgccttgcctcgcgtgggcaagcgctcaagcaaaggcactgagcaaacatcaggatttcaattccgctgtccaactggtggagaacttttgtcgtaacccggatggcgatgaggaaggagtctggtgctacgtggccggaaaaccgggcgactttggttactgcgatcttaactactgtgaagaagcggtggaggaagaaactggggatggtcttgatgaggattccgacagagcaattgaaggacggactgcaacttccgaataccagacctttttcaaccctagaaccttcggcagcggcgaggcagattgtggtcttaggcctctgtttgagaagaagtctcttgaagataagactgaaagagagctcttggaatcctacattgacgggaggattgtggaaggatcggatgcggagattggtatgagcccatggcaagttatgctgtttagaaagagcccacaagagctgctttgcggagcgtcgcttatatcagaccgttgggtgctgaccgctgctcactgtctgttgtaccctccctgggacaagaactttaccgagaatgaccttctcgtcaggatcggtaaacatagcagaacgagatacgaacgcaacatcgaaaagatatcaatgctggaaaagatctatatacaccctagatacaattggagagagaacctggatagggatatcgccctgatgaaactcaaaaagcccgtggcattttctgattacatccatcctgtgtgtctcccagaccgtgagactgcagcctcactccttcaagcaggatacaagggtagggtgactggctggggaaaccttaaagaaacttggactgcgaatgttggaaaggggcaaccgtccgtgttgcaagtcgtgaacttgcctattgtcgaacgtccagtctgcaaggattcgacgagaatacgcattactgacaacatgttttgtgcaggttacaaacctgacgagggaaagcggggagacgcctgtgaaggggactccgggggcccctttgtcatgaagtcacctttcaataatcgatggtatcagatgggcatcgtatcatggggagaaggctgcgatcgagatgggaagtatggattttacacccatgtgttccgtcttaagaagtggatccaaaaggtcattgaccagtttggagag

SEQ ID NO: 8657 - DNA, 1866 bp, Artificial Sequence
  Description of Artificial Sequence: Synthetic coding sequence
atggcacatgtgcgtggtctgcaactgccaggatgtcttgcattggcagcgctgtgctcacttgttcactcccagcatgtctttctggcaccacagcaggcaagatccctcctgcaaagagtgaggcgggcaaataccttcctggaggaagtgcgcaagggaaacctggagagagaatgtgttgaagaaacctgttcctatgaagaggcgtttgaggcccttgaatcgtctaccgcaactgatgtgttttgggcaaagtacactgcttgcgagactgctagaacgcccagggacaagttggccgcatgccttgagggtaattgtgctgagggactcggaactaattaccggggtcacgtgaacatcactagaagcggaatagaatgtcagctttggagatcgcgctaccctcataagccagagataaacagcactactcatccaggagcagatctccaagaaaacttctgtagaaacccagactcctcaaccaccggcccttggtgctacaccaccgaccccacggtgcgcagacaagaatgttctataccagtgtgcggtcaggatcaagtcaccgtggcaatgactcctagatctgaaggatcctcagtgaacctctcgcctccgctcgaacaatgcgtgccggatagagggcagcaataccaaggccgcctggcggtgactacgcacggcctgccctgcctcgcatgggcatcggcacaagcaaaagccctctcgaaacatcaggatttcaactccgcagtgcagctcgtggaaaacttttgccgaaatccggacggggacgaagaaggcgtgtggtgttacgtggctggaaagccaggagactttggatactgtgatcttaactattgtgaagaagcagtggaggaagagactggagacggactggacgaagattccgaccgagcgatcgaagggagaactgctacctccgaatatcagaccttcttcaatccacgcacctttgggtcaggagaagcagattgtggactgcggcctctcttcgaaaagaaaagccttgaggacaagactgagcgggaacttcttgagtcgtacatcgatgggcgcattgtggagggatccgacgcagaaatcggtatgtccccatggcaagtgatgcttttcaggaagtccccacaagaactcctgtgtggggcatcactgatctccgatcgctgggtccttaccgctgcacattgtctgttgtaccctccgtgggataagaacttcaccgagaatgatctcctggtcagaatcggaaagcactcccggactagatacgaacgcaacatcgagaagattagcatgcttgagaagatctacatccatccaaggtacaattggcgggagaatcttgacagagatattgcactcatgaaacttaagaagcctgtcgccttctcagattacattcacccagtctgcctgccggacagagaaaccgcagcctcgcttctgcaagccggctacaagggaagagtgactggctggggaaatctgaaggaaacttggaccgcaaacgtgggcaaggggcagccctcagtccttcaggtggtgaatctgccaattgtggaacggcctgtgtgtaaggattcgactaggatccgcatcactgataacatgttttgtgcaggatacaagcctgatgagggcaaacgcggtgacgcatgtgagggggattcgggtggaccatttgtcatgaagagtccgttcaacaatagatggtaccagatggggattgtaagctggggcgaagggtgtgatcgggatggcaagtacggattctacactcacgtctttcgacttaagaaatggatccagaaagtgatcgaccaatttggagag

SEQ ID NO: 8658 - DNA, 1866 bp, Artificial Sequence
  Description of Artificial Sequence: Synthetic coding sequence
atggcacatgtgcggggcctccagcttcccggttgcctcgccctggcggctctttgttcacttgtgcattcgcaacatgtgtttctggcccctcaacaagcacgctccctgctccagagagtgcgccgggcaaataccttcctggaggaagtcagaaagggaaacctggagagggagtgtgtggaagaaacgtgctcgtacgaagaagcgtttgaggcccttgagagctcgactgccaccgacgttttttgggccaaatacaccgcatgtgaaactgcacgcacccctagagacaagctggccgcttgccttgagggtaactgcgcagaaggcttgggaacgaattacaggggtcatgtgaacatcacccgtagcggaattgaatgccagctttggaggagcagataccctcataagccagaaatcaactcaacgactcaccctggagcagacctgcaagaaaacttctgcagaaatcccgattcctccactaccggaccctggtgttacaccaccgaccctaccgtccgcaggcaagagtgttccataccggtgtgtggacaggatcaagtgactgtggccatgactccacgctcagaaggctcatcggtgaacttgtccccgcctctggaacagtgtgtgcctgatcgtggtcaacagtaccaaggacgtcttgccgtcaccactcatggtctgccatgcctcgcttgggcctcggctcaagcaaaggcacttagcaagcatcaggactttaactcagccgtgcaactggtggagaacttctgtcgcaacccagatggagatgaagagggcgtctggtgttacgtggcaggaaaacctggagattttggatactgcgatttgaattactgtgaggaggccgtggaggaggagactggtgatggactggatgaagattcggatcgcgcgattgaggggcgcaccgcaaccagcgaatatcagaccttctttaaccctcgtacgttcggatcgggtgaggcagattgcggtctgcgacctctgtttgaaaagaaatcactggaagataagaccgaacgggagcttctggaatcatacattgacgggaggattgtggaaggatccgatgcagagattggtatgtcgccatggcaagttatgctgtttcggaagtcgcctcaggagcttctctgcggtgcatcactgatctcggatagatgggtgcttacggcggcacattgcctgttgtaccctccttgggacaagaactttaccgaaaacgatttgctggtcaggatcggtaagcattcccggacccgttacgaaagaaacattgagaagattagtatgcttgaaaagatctacattcatccgcgatacaactggcgcgagaacttggaccgcgatattgcactcatgaaacttaagaagccagtggccttttcagactacatccatccagtgtgtctgcccgatagagaaactgcagcttcgcttctgcaggccggttataagggacgggtcacgggctgggggaacctcaaggaaacctggactgctaacgtgggaaaaggacagccaagcgtgctgcaagtggtgaacctccccatcgtggaacgtccagtctgcaaggacagcaccagaattaggattactgacaacatgttctgcgcaggatacaagccagacgaaggaaagaggggtgacgcatgcgagggcgactcgggcgggccctttgtgatgaagtcgccttttaacaatcgctggtaccagatgggcatcgtgtcctggggcgaaggttgtgatcgggatggtaagtacggcttctacacccacgtgtttagacttaagaagtggattcagaaggtgatcgatcaattcggagag

SEQ ID NO: 8659 - DNA, 1866 bp, Artificial Sequence
  Description of Artificial Sequence: Synthetic coding sequence
atggcccatgtgcgaggcctccagttgcctggctgtctcgcgctggcggcgctttgcagcctggtccactcccaacatgtctttctggcgccacagcaggcacggtccctcctgcaacgcgtgcggcgggccaacactttcttggaagaagtgagaaagggaaacctggagcgggagtgcgtggaggaaacctgctcgtacgaagaggccttcgaggccctcgaatcgtctactgcgaccgacgtgttttgggccaaatacaccgcgtgcgaaactgcgagaacgccgcgagataagctggcagcttgtctggagggcaattgcgctgagggactgggcactaactaccgcgggcacgtgaacattaccaggtccggaatcgagtgccaactttggcggtcccggtaccctcacaagccagagatcaactcgaccacccacccaggtgccgacttgcaagaaaacttctgccggaacccggactccagcactaccggaccgtggtgctataccaccgatccgactgtgcgcagacaggaatgttccatccctgtctgcgggcaagatcaagttaccgttgcgatgactccgaggtccgaaggatcatcagtcaatctgtcaccgcccctcgagcagtgcgtcccggacagaggccagcagtaccaggggcggctggccgtgacgactcatggactcccatgtctggcctgggcatccgctcaagccaaagcgctgtcaaagcatcaagacttcaacagcgccgtccagctggtcgagaacttctgccgcaacccagatggggatgaggaaggagtgtggtgttatgtggctggaaaacctggtgacttcggttactgtgatctcaattactgcgaagaagcggtcgaagaagagacgggggatggattggacgaggactcagatcgtgcgattgagggccggacggcgacttcggaataccagaccttcttcaatccgcgcacgttcggcagcggcgaggctgattgcggcctgcggccgctcttcgagaaaaagtcattggaggacaagaccgaaagagagctcctggaatcctacattgacggtcgcatcgtggagggttcagacgcagagatcggaatgtcaccgtggcaagtgatgctgttccgcaaatcaccacaggaactgctgtgcggagccagccttatctcggaccggtgggttcttaccgcggcgcactgcctgctgtacccaccctgggacaaaaactttactgaaaatgatctcctggtgcgcatcgggaagcactccagaactagatacgagcgcaatatcgaaaagatatcaatgcttgaaaagatctacattcatcctcgctacaactggcgcgaaaacctggacagagacatcgcgttgatgaaactgaaaaagcctgtcgccttctccgactatatccatcccgtctgcctgcccgatcgggaaactgctgcctcattgctgcaggcgggctacaaaggacgggtgaccggctgggggaacctcaaggaaacctggaccgcgaatgtgggcaagggccagccatcggtgcttcaggtggtgaacctgcccatcgtggagcgacctgtctgtaaggacagcactaggatcagaatcaccgataacatgttttgcgccggctacaaacctgacgaaggtaagagaggagacgcttgtgagggcgatagcggaggaccgttcgtgatgaagagccccttcaataacagatggtaccagatgggaatcgtgtcgtggggagaggggtgcgatagagatggaaagtatggcttttacacccacgtgttccggctcaagaagtggatccagaaggttatcgatcaatttggagag

SEQ ID NO: 8660 - DNA, 1866 bp, Artificial Sequence
  Description of Artificial Sequence: Synthetic coding sequence
atggcccacgttagagggttgcagttacctggctgtttagccctggccgccctgtgtagcctggtccactcacaacacgtctttctggcccctcagcaggcccgttcgctgcttcagcgagttagaagagccaatacgttcctagaagaggttagaaagggcaatttagagcgagaatgtgtagaggaaacatgtagttacgaggaggccttcgaggcactcgaatcttctacagctacagacgtgttttgggcgaaatatactgcttgcgagaccgcccgaactccaagggataaactcgccgcctgtctcgagggcaactgcgccgaaggcctgggcactaattaccgtgggcacgtgaatataactcgcagcgggatcgagtgccagctatggcgcagcaggtacccacataaacccgagattaacagcactactcaccctggcgcggatctgcaggaaaatttctgcaggaatccagattcaagtactaccgggccttggtgctatactacagatcccaccgtgcggcgacaggagtgctctatccctgtgtgcggacaggaccaggtgactgtcgccatgacaccccggtcggagggcagttcagtgaacttgagcccccctttggaacagtgtgtcccggacagggggcaacagtaccaagggcggctggccgtcaccacgcatggactgccatgcctagcttgggcgagtgctcaggccaaagctttaagtaagcatcaggacttcaatagcgcggtacaactagtcgagaacttttgccgcaacccagatggggacgaagagggcgtgtggtgttacgtggctgggaagcccggcgactttggctattgtgacctgaattattgcgaagaagctgttgaagaagaaacaggagatggtctggatgaggatagcgatagagctatcgaggggcgcaccgccaccagtgagtaccagacctttttcaacccgaggacgttcggcagcggggaggccgactgtggactcaggccccttttcgagaagaagtcactcgaggacaaaacggaaagagaactgctcgagagttatatcgacggccggattgttgagggctctgatgccgaaataggcatgagtccgtggcaggtgatgctgtttcggaagtccccgcaggaactgttgtgcggtgccagcctaatttcggatcggtgggtcctgaccgccgcacactgccttctttacccgccctgggacaaaaatttcacagaaaatgacctgctagttagaataggcaaacacagcagaacccggtacgagcgcaatatcgaaaaaatttcaatgctggagaaaatctatatccatcctagatacaactggcgcgaaaatctagacagagatatcgctctgatgaaactcaaaaaacctgtcgctttctccgattacattcaccctgtttgcctgcccgaccgggaaaccgcggccagtctcctgcaggcgggatacaaaggaagagtgacaggttgggggaacctgaaagaaacgtggactgctaatgtgggcaagggacaaccttctgtgttgcaggtggtgaatctacccatcgtggagagacctgtttgcaaggactctacaaggattcggatcacggacaacatgttttgcgccggctataaacccgacgaagggaagcgcggtgatgcatgtgagggggacagcggcggaccttttgttatgaagtccccatttaacaacagatggtatcaaatgggtatcgtaagttggggcgagggatgcgatcgggatggcaaatacggattctacacgcatgtgttccgacttaagaaatggattcagaaagtgatcgaccagttcggagaa

SEQ ID NO: 8661 - DNA, 1866 bp, Artificial Sequence
  Description of Artificial Sequence: Synthetic coding sequence
atggcgcatgtccgcggactccaactgcccggatgcctggcactggccgcgctgtgctccctcgtgcactcgcaacacgtgttcttggcgccgcagcaggcccggagcctgctccaaagagtgagacgcgccaacactttcctggaagaagtccgtaagggaaacctggaacgggagtgtgtcgaggagacttgctcgtacgaagaggctttcgaagctctcgaatcgtcaactgcgacggatgtgttctgggcaaaatacaccgcctgcgagactgcccggaccccgagggacaagctcgcagcatgcctcgaaggaaactgtgccgaaggactgggcaccaattacagggggcacgtgaacattactcggtccggtattgaatgtcagctgtggcgctcgaggtacccacacaagcctgagattaactcaaccacccatccgggagccgacctgcaggaaaacttttgtaggaaccctgactcgtcaactaccggcccgtggtgttacacgacggatccaaccgtgcggcggcaggaatgctcgatcccggtgtgtggtcaggatcaagtcaccgtggcgatgactccgagatcggagggttcatccgtgaatctgagccccccactcgagcagtgtgtcccagacagaggccagcagtaccagggacggctcgcagtgaccacgcatggtctgccttgcctcgcgtgggcgtccgctcaggccaaagcactctcgaagcaccaggacttcaactccgcggtgcagcttgtggagaacttttgccgcaacccagatggcgacgaggaaggagtgtggtgctacgtcgccggaaagccaggcgacttcggatactgtgacctgaattactgcgaagaagcagtggaggaagagactggggatggactggacgaagattcggacagagctatcgagggacgaaccgcaacgtcggagtaccaaacttttttcaacccccgcacctttggaagcggtgaagcagattgcggcctgcgcccactgttcgagaagaagtccctcgaggacaagaccgagcgcgagctcctcgaatcatacattgatggtcggattgtcgaaggatcggacgcggagatcgggatgtcgccttggcaggtcatgctgttccggaagtcgccccaggagctcctttgcggtgcgtcgcttatcagcgaccggtgggtcctgaccgctgcgcactgcctgctctacccgccctgggacaagaactttactgaaaacgacctgctggtcagaatcggcaagcactcgcgcactcggtacgaaagaaacatcgaaaagattagcatgctggaaaagatatacattcacccacgatacaactggcgggaaaacctggatagggatatagcactgatgaaactgaaaaagccggttgccttcagcgactacatccaccctgtgtgcctcccggacagagagacggctgcgtccctgctgcaagccggatacaagggacgcgtcaccggttggggaaatttgaaagagacgtggactgccaacgtgggtaagggccagccgtcggtccttcaggtggtgaatctgccgatcgtggaacggccagtgtgcaaggatagtactagaatccgcatcactgacaatatgttctgcgctgggtacaagcctgacgaagggaaaagaggagacgcatgtgagggagactcaggcggccctttcgtgatgaagtcgccgttcaataatcgctggtaccaaatgggcatcgtgtcctggggagagggctgcgatcgcgacgggaaatacggattctatacccacgtgttccggctgaagaagtggatccagaaggtcattgatcagttcggagaa

SEQ ID NO: 8662 - DNA, 1866 bp, Artificial Sequence
  Description of Artificial Sequence: Synthetic coding sequence
atggcgcacgtgaggggcctgcagcttcctggatgccttgcccttgccgcactgtgctcactggtgcattcgcaacacgtgtttttggcgccacagcaagcccgctcgctcctgcaacgggtcaggcgagccaatactttcttggaagaggtgaggaagggaaacctcgaacgcgaatgcgtcgaagaaacctgctcctacgaggaagccttcgaggctttggagtcatcgaccgcgactgacgtgttctgggccaaatacaccgcgtgtgaaaccgccagaactccgagagataagctggcggcgtgtctggaggggaactgtgcggaaggactggggactaactatcgcgggcatgtgaacatcaccaggtcgggcattgagtgccagttgtggcggtcgaggtacccccacaagccagagatcaactccactacccatccgggggctgacctgcaggagaacttctgccgcaacccggattcaagcaccacggggccgtggtgctacaccactgaccccaccgtccgcaggcaggagtgctccatcccagtgtgcggacaagatcaggtgaccgtcgcaatgaccccaagatccgaaggaagcagcgtcaatttgagcccgccgctcgaacagtgcgtgcctgacagaggacagcaataccaggggcgcctcgctgtgacgacccacggactgccatgcctcgcctgggcgtctgcccaagcgaaggccctgtccaaacaccaggacttcaactccgccgtgcagctcgtcgaaaacttttgccgaaacccagatggtgatgaggagggagtatggtgctacgtggcaggtaaaccaggagacttcggatactgtgacctcaattactgcgaggaggcggtcgaagaggaaaccggtgatggcctggacgaggattctgaccgggccatcgaaggacgaacggccacttcggaataccagactttcttcaaccctcgtaccttcggatcgggggaggcagactgtggactgcggcccttgtttgagaagaagtctcttgaggataagactgaacgggaactgctggagtcttacatcgatggaaggatagtggaaggaagcgacgcagagatcggcatgtccccgtggcaggtgatgctcttccggaaaagtcctcaggaactgctgtgtggcgcttccctgatctccgacaggtgggtgctgactgcagcccactgccttctgtaccctccgtgggacaagaatttcaccgagaacgaccttctcgtaaggatcggaaaacattctcgtactagatacgaacgcaatatcgagaagattagcatgcttgaaaagatctacatccatccacggtacaattggcgcgaaaatctggaccgggatatcgcactgatgaagctgaagaagcctgtcgcattctcggattacatccaccctgtctgtctgcccgaccgtgaaaccgcggcttcgctccttcaagcgggctacaaaggacgggtgacgggctgggggaatcttaaggaaacttggactgctaacgtcggaaaaggccagccatcagttctccaggtcgtcaacctgccgatcgtggaaagacctgtgtgcaaggactcgaccagaatccgcattaccgataacatgttttgcgctgggtataagcccgacgaaggaaagcgcggggacgcatgcgaaggtgactccggaggaccgtttgtgatgaaatcgccgttcaacaatcggtggtaccaaatgggcatcgtgtcctggggagagggctgcgaccgcgacggtaagtatggattttacactcacgtgttcagactgaagaaatggattcaaaaggtcattgaccagttcggtgag

SEQ ID NO: 8663 - DNA, 1866 bp, Artificial Sequence
  Description of Artificial Sequence: Synthetic coding sequence
atggcccatgtccggggcctccagcttccgggatgcctcgccctcgccgctctgtgtagcctggtccactcgcagcacgtgtttctggctccgcagcaggcgcgctccctcctgcagcgggtgagaagagctaataccttcctggaagaagtgagaaagggaaacttggaaagggagtgcgtggaggaaacctgcagctacgaggaggcgttcgaagcattggaaagttccaccgcgacggatgtcttttgggctaaatacaccgcctgcgagactgcccgcactccgcgggataaactcgctgcgtgcctggaaggaaactgtgccgaaggtctgggtaccaattacagagggcatgtgaacataacgcggtcaggaatcgaatgtcagctgtggaggtcacgctacccacacaaaccagagatcaactcaaccacccatccgggtgcagacctccaggagaatttctgccggaacccagattcgtccactactggcccatggtgctacacgaccgatcccaccgtcagacgccaggaatgttccatcccagtgtgcggccaggatcaggtgaccgtggcgatgaccccaagatcggaagggagctcagtcaacctgagcccgccactggagcagtgcgtcccagatcgcggacagcaataccagggccgcctcgcggtgaccactcatggcctgccgtgcctggcctgggcttcggctcaagcgaaagccctgtccaagcaccaagacttcaactccgcggtgcaactggtggagaacttctgcagaaaccccgatggagacgaggaaggcgtgtggtgctacgtggctggaaagccaggagacttcggatactgtgatctcaactactgcgaagaagctgtggaagaggaaactggagacggactggatgaggactccgatagagcgatcgaaggaagaaccgcaacgagcgaatatcagaccttctttaaccctagaaccttcggaagcggtgaggccgactgcggactcagacctctcttcgaaaagaagtcattggaggacaagactgaaagagaattgctggagtcgtacatcgacgggcggatcgtggagggatcagatgcggaaatcgggatgagcccttggcaggtcatgctgttccggaagtcgccgcaggaacttctgtgtggagcctccctgatctctgaccgctgggtgctcactgccgcacactgcttgctgtacccgccttgggacaagaacttcaccgagaatgatctgctggtgcggatcggaaaacactcccggactcgctacgaacggaacatagaaaagattagcatgcttgagaaaatctacatccacccgcggtataactggcgcgagaatctggaccgcgatatcgcactgatgaaactcaaaaagcctgtggccttttccgactacatccatccggtgtgccttcctgatagggaaactgcagcttcgctcctccaggccggatacaagggaagagtgactggctggggaaaccttaaggagacttggaccgcgaatgttggtaagggacagccatcagtgctgcaggtggtgaatctgccaattgtcgagcggccggtgtgcaaggactcaactagaatccgcatcaccgataacatgttttgcgcgggctacaagccggacgaagggaagagaggggatgcatgcgaaggggacagcggtggtccatttgtgatgaagagccccttcaacaaccggtggtatcaaatgggaatcgtgtcatggggcgagggatgcgatagggatggcaagtacggcttctacacccacgtgttccgactgaagaagtggattcagaaagtgattgaccagttcggtgaa

SEQ ID NO: 8664 - DNA, 1866 bp, Artificial Sequence
  Description of Artificial Sequence: Synthetic coding sequence
atggctcacgtgaggggcctgcagctgccaggttgcctcgccttggctgcattgtgtagcctggtgcatagtcagcatgttttcttagctccacagcaggcgaggagtctactgcagcgggtccgtcgtgccaatacgtttctagaagaagtgcgcaagggcaaccttgaaagagaatgtgtagaagaaacatgtagctatgaagaggctttcgaggcccttgagagtagcaccgctacagacgtgttttgggcgaaatacaccgcatgtgagacagccaggactcctagagacaagctcgcggcatgccttgagggcaattgcgccgaagggctgggcaccaactatcgaggacatgtgaacattaccaggagcggcattgagtgccagctttggaggtcaaggtacccccacaaacctgagatcaattcaactacgcatcctggggccgaccttcaggagaatttttgcagaaacccggacagtagcaccactggcccgtggtgctacacgactgaccccacagttcggagacaggagtgctccattccagtttgcggacaggatcaggttacagtggcaatgactcctaggtccgaaggttcaagcgtgaacctgtcccctcctttggagcagtgtgtccccgatcgcgggcagcagtatcagggcaggttggccgtgacgacccacggcttgccttgcctggcctgggccagcgcacaggcaaaggccctctccaagcaccaggatttcaactccgccgtccaattggtggagaatttttgcaggaaccctgatggggatgaagaaggagtgtggtgctacgtggccggtaagcccggtgatttcgggtattgtgacctgaattactgcgaagaggccgtcgaggaggagacaggagatggtctcgacgaagacagcgaccgagccattgaagggcgtactgctactagcgaataccaaacattttttaacccacgaaccttcggaagcggtgaggcagactgtggactgcgacccctatttgaaaagaagtccctagaggataagacggaaagagagttgctggagtcatacattgatgggcgcattgtggaggggtcagatgccgaaatcgggatgagtccttggcaggtgatgctgttccgcaagtctccccaggaactgctgtgcggcgcttccctgatcagtgatagatgggtgctcaccgcagcccactgccttctgtatccaccctgggacaagaatttcaccgagaatgacctcctcgtgcgcataggtaaacactctcgcactcgctacgagaggaatatcgaaaagatcagtatgctggagaagatttatattcacccccggtataactggcgtgagaatcttgacagggatattgccttaatgaagctcaagaagcctgtggccttctcagattacattcatccggtttgcctgcccgatagagagactgccgcgtcactgctgcaggcagggtataaggggagggtgactgggtggggcaatctgaaggaaacttggaccgccaacgtcggaaaaggccagccaagcgttttacaggtggtgaatctgcctatcgtggagcggcctgtgtgcaaggatagcactcgaataagaattacagacaacatgttttgtgctggatataaaccggacgaagggaagagaggagacgcctgtgagggtgattccggtggtcctttcgtgatgaagagtccattcaataaccgctggtaccagatggggatcgtgtcttggggggagggatgtgaccgagatggtaagtatggcttttatacgcatgttttccgcctgaaaaaatggatacaaaaagtaatcgatcaattcggagag

SEQ ID NO: 8665 - DNA, 1866 bp, Artificial Sequence
  Description of Artificial Sequence: Synthetic coding sequence
atggcacatgtgcgcgggctgcaactccctggctgcttggcactcgctgctctgtgcagtctcgtccactcacagcacgtgttcttagccccacagcaggctcgctcattattgcagagagtcaggcgggccaatacttttctcgaggaagtacggaagggcaacctagagcgcgaatgcgttgaggagacatgttcctacgaggaggcttttgaagctctcgagtcatctaccgctacagacgtcttctgggcaaaatacacagcttgcgagaccgctagaactcctcgggataagcttgccgcttgtttggaggggaattgtgcggagggtcttggcacaaactaccgaggacacgtcaatattacacggtccggcatcgagtgtcagttatggcgctccagatatccccataaaccggagatcaattcaacgacccatcccggagcagatcttcaggagaacttctgcaggaaccctgattctagtactaccgggccttggtgctacacaacagatcccaccgtaagacggcaggaatgtagcattcctgtgtgcggccaggaccaggtgaccgtagccatgacgcctagatcagagggatcgtccgtgaatctgagtccccctttggagcagtgtgtgcccgatcgcgggcaacaataccagggacgattagctgtaaccactcacggtctaccctgtctggcctgggcatctgctcaagcaaaggcgctaagcaagcaccaggacttcaactccgcagtccaactggtggagaacttctgcagaaatcctgacggcgacgaggaaggcgtctggtgttacgtggcagggaaaccgggcgactttgggtactgtgatctgaactactgcgaggaggccgtggaagaggaaaccggagatggcctggatgaagactcagaccgtgccatagagggacgaaccgcaaccagtgagtatcagaccttttttaacccgcgcaccttcggctctggagaagccgactgcggtctgaggccactcttcgagaaaaaaagcctcgaagataagacggagagggagctactcgaaagttacatcgatggcagaatcgttgagggctctgacgcagagatcggtatgtctccctggcaggtgatgctcttccgcaaatctcctcaggagctgctgtgcggagcgagccttatctctgataggtgggttctgaccgcagcccattgcctgttatatccaccctgggataaaaactttaccgagaatgatctattggtgcgcattgggaaacacagcaggacccggtatgaaagaaacatcgaaaagatttccatgctcgaaaagatatatattcatcccaggtataattggagggaaaacctcgacagggacattgcgctcatgaagctgaaaaagccagttgccttctccgattatatacacccagtctgcctaccggacagggagaccgcagcatcgctactacaggcggggtacaaggggcgagttacaggctgggggaaccttaaagagacatggactgcaaatgttggcaaggggcagccgagtgtgctgcaagtggtcaacctgccaatagtagagaggcctgtttgtaaagacagcacaagaatcaggatcaccgataatatgttctgtgctggttataagccagacgaaggaaagagaggagatgcgtgcgaaggagattcggggggaccctttgttatgaaatctcctttcaataacagatggtaccagatgggcatcgtaagctggggggaagggtgtgatagggacgggaaatacggcttctatacccacgtgtttcgcctgaaaaagtggatccagaaggtaatcgatcagtttggggag

SEQ ID NO: 8666 - DNA, 1866 bp, Artificial Sequence
  Description of Artificial Sequence: Synthetic coding sequence
atggcccatgtcaggggcctgcaactccctgggtgcctcgcgctggcagccctgtgctctctcgtgcattcacagcacgtttttctcgccccccagcaggccagaagcctgctgcagagggttaggagagccaacacatttcttgaggaagtccgcaaaggtaaccttgagcgtgaatgtgtggaggagacctgttcctacgaagaagccttcgaggccctggagtcgtccactgccaccgatgtgttttgggccaaatatacagcttgtgaaaccgctagaacaccgcgcgataaactggctgcttgtctcgagggtaattgcgcagaggggctggggaccaattaccgtggccacgtgaatattaccagatcaggaatcgagtgccagctctggcgatcccgttaccctcacaagcccgagattaatagcaccacacaccctggggcggacctgcaagaaaatttttgcagaaacccagactcttctacgaccggaccatggtgctatactacggatccgaccgtgcgccggcaggagtgttctatcccggtgtgtggacaagatcaggtgactgtcgctatgactccaaggtcagaagggtcatctgtgaacctgtcccccccgctggagcagtgtgtgcccgatcgcgggcaacagtaccagggccggttagcagtcaccacccatggcctcccctgcctcgcctgggcgtctgcgcaggccaaagctctgtctaaacaccaggacttcaacagcgccgtgcagctcgtggaaaacttctgtaggaacccagatggagacgaggagggagtctggtgttacgtggccggaaagcccggcgatttcggctattgtgacctcaactactgtgaagaggccgtggaggaagaaacaggagatggactcgatgaggactctgaccgagcaatcgagggacggaccgctaccagcgaatatcagaccttcttcaatcctagaacttttggaagtggagaggcagactgcgggctgcgaccattgtttgagaagaaatccctggaagacaaaactgagcgtgagctactcgagtcctatattgatggccgcatcgtagagggaagtgatgcggaaattggtatgtctccctggcaggtcatgctgtttagaaaatcgccacaggagcttctgtgcggagcctctctcatcagcgacaggtgggtgctcaccgctgcgcactgcctactgtaccccccatgggataagaacttcaccgaaaacgaccttctggtgaggatcggcaagcattccagaacacggtatgagcgcaacatcgaaaaaatatcaatgttggagaagatatatattcatcccagatacaactggcgggaaaacttggaccgggacatcgctctgatgaagctgaaaaagcccgttgccttctccgactatattcacccagtgtgccttccagacagagaaacagctgcgtccctgctacaggcaggctacaaaggccgggtgaccgggtggggaaacctgaaggagacctggactgctaatgtgggaaaaggccaaccgtctgtgttgcaggtggtcaacctccccatcgtggagcggcccgtatgcaaggacagcaccagaattcggattaccgacaatatgttctgtgctggatacaagcctgacgaagggaaacgtggtgacgcttgcgagggcgattcaggaggccctttcgtgatgaagagcccttttaacaacaggtggtaccagatggggatcgttagctggggagagggctgcgaccgggacgggaaatatggtttttacacacatgtgtttagattgaagaaatggatccagaaagtgatcgaccagttcggagag

SEQ ID NO: 8667 - DNA, 1866 bp, Artificial Sequence
  Description of Artificial Sequence: Synthetic coding sequence
atggctcacgtgaggggattgcaactacctggatgtttagcccttgccgccttatgctcgctggttcacagtcagcatgtgttcctggccccccaacaagctagatctttgctgcagcgcgtgcgcagggcgaatactttcctggaagaagttcgcaagggaaacctcgagagggagtgtgtggaagagacgtgctcctatgaagaagcatttgaagcactcgaatcttctacagcaacggacgtgttttgggctaagtatacggcctgcgagaccgcacgcaccccgagagacaaattagctgcttgtcttgaagggaactgtgccgaggggcttggaaccaattaccgcgggcatgtcaacataacaaggtcaggcattgagtgtcagctctggaggagcagatacccacacaagcctgagatcaatagcaccacgcacccaggggccgacctgcaggaaaacttctgccgtaatcccgactccagcaccaccggcccttggtgttacaccactgacccgaccgttcgacgtcaggagtgcagtatccccgtgtgtggtcaagatcaagtgaccgtggccatgacccccagatcagaagggtctagcgtaaatttatcgcctccattagagcagtgcgtgcccgatagaggacaacaataccagggacggcttgcagttacgacccacggactgccctgcttggcctgggccagcgcccaggctaaggctctgtcaaagcatcaggacttcaatagcgctgtgcagctggtggagaatttctgcaggaatcccgacggcgacgaggagggggtatggtgctacgttgccggtaagcctggcgattttgggtattgcgacttgaattattgcgaggaggccgtggaggaagagactggtgatggcctggacgaagacagtgatcgcgctattgaaggcaggaccgctacctcggagtatcagactttcttcaacccacgcacatttggtagcggggaagccgactgcggccttcggccactgttcgaaaaaaaaagtctagaggacaagactgagagagaattgttggagtcttacatagacgggagaattgtggaggggagtgatgcagagattgggatgagtccttggcaggtcatgctgtttcgcaagtcgccacaagaactcctctgtggggcctcactgattagtgatcgatgggtactcacagccgcgcactgtttactctaccccccctgggataaaaacttcaccgagaatgatttgctcgtcaggataggaaagcactcgagaacgcgatatgaaagaaacatcgaaaagatatctatgcttgaaaagatatatatacacccccggtataattggcgcgagaatctagacagggatatcgctctgatgaaattaaaaaagccagtggcattcagcgactatatccaccccgtgtgcctacccgatagggagacggcggcatcactcttacaggcgggctataaaggaagagttacagggtggggtaatctcaaagagacctggactgctaatgtgggcaagggccagccatcagttctgcaggtggtgaatttgccaatcgtcgaacgacctgtatgcaaagacagcactcgtataagaattacagataacatgttctgtgctggctataagcccgatgaggggaagagaggcgacgcgtgcgagggggattccgggggccctttcgtgatgaagagcccatttaacaaccgctggtatcagatggggattgtgtcctggggagaggggtgcgacagggacggcaagtatgggttttacacgcatgttttccgcctgaaaaaatggattcaaaaagttattgaccagtttggtgag

SEQ ID NO: 8668 - DNA, 1866 bp, Artificial Sequence
  Description of Artificial Sequence: Synthetic coding sequence
atggctcacgtgcgcggactccagctgcccggatgtctcgccctcgctgctctgtgcagcctggtccactcacagcacgtgttcctcgctcctcagcaggcgagatccctgctccagcgcgtgagaagagccaacactttcctcgaagaagtcaggaagggcaatctggaacgcgaatgtgtggaagaaacctgctcctacgaagaggctttcgaggccttggagagcagcaccgccacggacgtgttctgggccaaatacacggcatgcgaaacagcccgcaccccgagggacaagctggctgcctgcttggagggcaattgcgctgagggtttgggtactaactatagaggtcatgttaacatcactagatccggtatcgaatgccagttgtggagatctaggtacccccacaagcctgagatcaacagcaccactcacccgggcgcagatttgcaggagaacttctgcaggaatcccgactctagtaccaccggcccatggtgctacacaaccgacccaaccgtaaggcgccaagagtgcagtatccctgtatgtggtcaagaccaggtgaccgttgcaatgaccccaagatccgaaggttcatcagtgaatctctcccctcctctggaacagtgtgtgcctgaccgcggccagcagtaccagggacgcctggcagtcaccacccacggcctgccatgtctggcttgggcctccgcacaggctaaagccctgtccaaacaccaggatttcaacagcgccgtgcaactggtggaaaacttttgcaggaaccctgacggagatgaggagggtgtttggtgctacgtagccggcaagcccggtgactttggatactgcgacctgaactattgtgaagaggcagtggaggaagagacaggcgatggtctcgatgaggacagtgacagagctatcgagggacgcactgccacttccgagtaccagaccttcttcaatccgaggaccttcggttctggtgaggcagactgcggtctgagaccactgttcgagaagaagtccctggaagacaaaacagaacgcgaactgttggaatcctacatagacggtcgcatcgtagagggatctgacgctgagattggcatgtctccatggcaggtgatgctctttaggaagagtccccaggagctgctgtgtggtgcttccctgatttccgacaggtgggtgctgacagccgcccactgcttgttgtaccccccctgggacaaaaacttcactgagaacgatctgttggtgaggattggcaagcactcacgcacacgctatgagagaaatatcgaaaagatttccatgctcgaaaagatctacattcatcccagatataactggcgcgaaaacctggaccgcgatatagcattgatgaagctgaaaaagcccgtggctttctcagattacattcatcccgtgtgtctccccgacagggaaactgccgcttctctgttgcaggctggttataagggtcgcgtgacgggctggggtaatctgaaggaaacttggaccgctaacgtgggaaaaggacagcctagcgtcctccaagtggtaaacctgcctatcgtggaaaggcccgtctgcaaagactctaccagaatacgcattacagacaacatgttttgcgccggctacaaaccagacgagggtaagcgcggcgatgcctgtgagggcgactctggaggcccattcgttatgaagtccccatttaacaataggtggtaccagatgggtatcgtgagctggggtgaaggttgcgacagagatggaaagtatggattctacacacacgtgttcagactcaagaagtggattcagaaagtgatcgatcagtttggcgag

SEQ ID NO: 8669 - DNA, 885 bp, Artificial Sequence
  Description of Artificial Sequence: Synthetic coding sequence
atggagactcctgcatggccaagagttccgcgtcctgaaacagctgttgcacgaactcttcttctaggatgggtgttcgctcaggttgctggagcttcgggtactacgaatacagtagcagcctacaatttgacatggaagtctacaaattttaaaacaatcctggaatgggaacctaaaccagttaaccaagtctatacagttcaaattagcactaaaagtggtgattggaaaagtaaatgtttttacacaacagataccgaatgtgaccttaccgatgaaatcgtgaaagatgttaaacaaacttatcttgctcgtgtgttctcatacccagcaggcaatgttgaatcgacaggaagtgctggagaaccgttgtacgagaattcaccagagtttacgccatatcttgaaaccaaccttggtcaacctactattcagtcatttgagcaagtaggaactaaagtcaacgtaactgtggaagacgaaagaacactggtgcgaagaaataatacttttttatcacttagagacgtttttggaaaagatcttatctacacattgtactattggaaatcgtctagttctggaaaaaagactgccaagacgaatactaatgaattccttattgatgtagataaaggcgaaaattattgtttttcagttcaggcagttattccatctagaactgttaaccgaaaatctacagattcaccagtggaatgtatgggacaggagaaaggagaattccgagaaatcttttatataatcggtgctgttgttttcgttgtcatcatccttgtcattatactggccatttcgttgcataaatgtagaaaggcgggagtgggtcaaagctggaaagaaaactcaccactgaacgtttca

SEQ ID NO: 8670 - DNA, 885 bp, Artificial Sequence
  Description of Artificial Sequence: Synthetic coding sequence
atggagacccccgcctggcccagggtgccacgccctgagacagcagtggccaggactttgctgctcggatgggtttttgctcaagttgccggagcttctggtaccaccaatacggtcgctgcatacaatctgacttggaagagcacaaacttcaagaccatcctggaatgggagccgaaaccggtgaaccaggtgtacacggtccagatcagcacgaagagcggagactggaagagtaagtgcttctacaccacggataccgaatgcgatctgaccgatgagattgtcaaggacgtcaagcaaacttacctcgcccgcgtcttcagttaccccgcaggaaatgtggaatcaacaggaagtgctggagagcccctttatgaaaattccccagagtttaccccttacctggagaccaatctgggccaaccaaccatccagagctttgaacaggtaggcaccaaagtaaacgtcacggtggaagatgagaggacacttgtgaggagaaacaatacctttttgtcactgagggatgtattcggaaaggacctgatatatactctgtattactggaagtcaagctcttccggtaagaaaaccgctaaaactaacactaacgaattcctcatcgatgtagacaagggcgaaaattactgcttctccgtgcaagcggtaatcccctctagaactgtcaacagaaagagcacagattctccagtagagtgtatgggacaggaaaagggcgagttccgcgagatcttctacattataggagctgttgtgtttgtcgtcatcatcctggtgatcatcctggccatatccctccacaagtgtcgcaaggccggagtgggacagagttggaaggaaaattcccctcttaatgtgtcc

SEQ ID NO: 8671 - DNA, 885 bp, Artificial Sequence
  Description of Artificial Sequence: Synthetic coding sequence
atggaaactcctgcctggcctcgcgtgcctcggcccgaaaccgcggtcgcaaggaccctgcttctgggctgggtgtttgctcaggtggcgggcgcctccggaactaccaatactgtggcggcttacaacctgacttggaagtcaaccaatttcaaaaccatcctggagtgggaacctaagccagtcaaccaggtgtacaccgtgcaaatctccaccaagtccggagattggaagtcgaaatgcttctacaccactgacaccgaatgcgacctgacggacgaaatcgtgaaggacgtgaaacagacctacctggcccgcgtgttcagctacccagcaggaaacgtggagtccacgggatcagcgggagaaccactgtacgagaactcgccggaattcaccccttacctggagacgaacttgggacagccaactatccagtcctttgaacaggtgggaaccaaggtcaatgtcaccgtggaggatgagcggactcttgtgcgcagaaataacactttcctttcactcagagacgtgttcgggaaggacctcatctacaccctttactactggaagagctcctcgagcggtaagaaaactgccaaaaccaacactaacgaattcctgatcgatgtggacaagggagaaaactattgcttctcggtgcaggctgtgatcccgtcccggaccgtcaaccgcaagtcgaccgacagtcccgtggaatgcatgggccaggagaagggcgaattccgggagatcttttacatcatcggcgcggtggtgtttgtggtcatcatcctggtcattattcttgcgatctctctgcacaagtgtcggaaagccggcgtgggacaatcttggaaggaaaactctcccctcaacgtctcc

SEQ ID NO: 8672 - DNA, 885 bp, Artificial Sequence
  Description of Artificial Sequence: Synthetic coding sequence
atggagactccagcatggccacgcgtgccaagaccagagactgccgtggccaggaccttgcttctcggatgggtgttcgcccaagtggcaggcgctagcgggaccaccaataccgtggccgcttacaacctgacttggaaatcaactaatttcaagactatcttggagtgggaaccgaaacccgtgaaccaggtgtacacggtgcagatctccacgaagtcgggcgactggaagtcgaagtgcttctacaccaccgacaccgagtgcgacttgactgacgagatcgtgaaggacgtcaagcagacctacctggccagggtgttctcgtatccggcggggaacgtggaatccactgggtccgcgggagagccgctgtacgaaaactcccctgaatttaccccttatctggagactaacctggggcagccgaccattcagtcctttgaacaagtgggaacgaaggtgaatgtgactgtcgaagatgagcggacgctcgtccggcgcaacaacaccttcctgtccctccgggacgtgttcggaaaagatctgatttacaccctgtactactggaaatcaagctcgtcaggaaaaaagaccgcaaagacgaacaccaacgaatttctcatcgatgtggataaaggagagaattactgtttttcagtccaagctgtgataccctcccgcacggtgaacaggaagtcgaccgacagcccggtggaatgcatgggacaggaaaagggagaattccgggagattttctacatcatcggcgccgtcgtgtttgtggtgatcatcctggtgatcattctcgctatctccctccacaagtgcagaaaggcgggagtgggtcagtcgtggaaggaaaacagcccgctcaacgtctcc

SEQ ID NO: 8673 - DNA, 885 bp, Artificial Sequence
  Description of Artificial Sequence: Synthetic coding sequence
atggaaaccccagcgtggccacgggtgccacggccggagactgccgtggcaaggaccctgctgcttggttgggttttcgcgcaggtggctggcgcatccggcactaccaatacggtggctgcttacaacttgacgtggaaatccaccaactttaagactatcttggaatgggaaccgaaaccagtcaaccaggtgtacactgtgcagatctctactaagtcaggagactggaagtcaaaatgcttttacacgaccgacaccgaatgtgacctgaccgatgaaatcgtgaaggacgtcaaacaaacctacctcgcacgcgtgttctcgtatccggctgggaatgtggaaagcactgggtcagcgggggagccactgtacgaaaattcgccggagtttactccgtatctcgagactaatctgggtcaaccaacgatccagtcgttcgagcaggtgggtaccaaggtcaatgtgaccgttgaggacgaacggaccctggttagacggaacaacacttttctcagcctgcgggacgtctttggaaaggatctgatctacactctgtactactggaagtcgagctcctcgggcaagaagaccgccaagaccaacactaacgaattcctcatcgatgtggataagggcgagaattactgtttttcggtccaggcagtgattcctagccgcactgtcaatcggaagagcactgactcgccagttgagtgcatgggacaagaaaagggtgaatttagggaaatcttctacattatcggtgcagtggtgttcgtcgtgatcatcctcgtcatcatccttgccatatccctgcacaagtgccgaaaggcgggagtcggacagagctggaaagaaaattccccgctcaacgtttcc

SEQ ID NO: 8674 - DNA, 885 bp, Artificial Sequence
  Description of Artificial Sequence: Synthetic coding sequence
atggaaacccccgcttggccacgggtgcctcgccctgagacagccgttgcacgtacgctcttgctcggttgggtgttcgcccaggtggccggggcctccggcacgacaaacactgtagctgcttataatctgacctggaaatccaccaattttaaaacaatcttggagtgggaaccgaaaccagtgaatcaagtctataccgtacagattagcaccaagagcggagattggaaatccaagtgtttttacacgaccgacactgaatgtgatttgactgacgagattgtgaaggacgtgaaacagacgtacctggcccgggtgttttcctatccggctggtaacgtggagagcactggatctgctggggagcccctatacgaaaactcaccggaatttacaccatatctagaaaccaatcttggccaacccaccatccagtcttttgaacaagtcgggaccaaggttaatgtcaccgtcgaggatgagaggacactcgtacgcaggaataacactttcttaagcttgcgtgacgtcttcggcaaagacctgatttacaccttgtattattggaagtcttccagtagtggcaagaagactgcaaaaacaaacacaaatgaattcttgatcgacgtggacaagggtgagaattattgctttagcgttcaggcagttattcctagtcggactgtgaaccgcaagtccactgattcacccgtcgaatgtatgggtcaggagaagggtgagttcagagaaattttttatatcattggcgccgtggtctttgtggtgattatcctggtgatcatcctggcaatatctctccacaagtgtcgaaaggcgggggtgggacagtcatggaaggagaatagcccactaaacgtgtcc

SEQ ID NO: 8675 - DNA, 885 bp, Artificial Sequence
  Description of Artificial Sequence: Synthetic coding sequence
atggagactccagcctggccaagagtcccccggcccgaaaccgcggtggcacgcacccttctgctcgggtgggtgttcgcccaagttgcaggagcatcagggaccactaacaccgtggctgcatacaaccttacttggaagagcactaatttcaagaccattcttgaatgggaaccgaagccggtgaaccaggtgtatacggtccagatctcaaccaagtcaggcgactggaagtcgaagtgtttttacactaccgatacggaatgcgacttgaccgacgagatagtgaaagatgtcaagcaaacttacctcgctagggtgttttcctacccagcagggaacgtggagtccacgggaagcgccggcgaaccactgtacgaaaactccccagagtttaccccttacctcgaaactaatctgggacaacctaccattcagtcgttcgaacaggtgggtaccaaggtgaatgtcactgtggaagatgaaagaacgcttgtccggcgtaacaatactttcctttccttgagagatgtgtttggaaaggatttgatatacacgctctactattggaaaagctcgtcgtcgggaaaaaagaccgcaaagactaatacgaacgagttcctgattgacgtcgataaaggggaaaactactgttttagcgtgcaagccgttattccatccagaacggtcaatagaaagagcacggatagccccgtcgaatgtatgggacaggagaaaggagaattcagagagatcttttacattatcggagcggtcgtgtttgtggtgattatcctggtcataattctggcgatttcgctgcataagtgtagaaaagcaggtgtgggacaatcttggaaggagaacagccctcttaacgtctcc

SEQ ID NO: 8676 - DNA, 885 bp, Artificial Sequence
  Description of Artificial Sequence: Synthetic coding sequence
atggaaactccagcgtggcctcgcgtccctcgtccggagactgcggtcgccagaactctgctgcttggttgggtctttgcacaggtggccggggcctccggcactactaatactgtggctgcatacaacctgacctggaagtctaccaatttcaagaccatccttgagtgggagccgaagccggtgaatcaggtgtacaccgtgcaaatcagcacgaagtctggagattggaaatcgaagtgtttctacactaccgataccgaatgtgacctgaccgacgaaattgtcaaggacgtgaagcaaacttacctcgcgcgggtgttcagttacccagcgggaaacgtggagtcaaccgggtctgccggcgaacctctctacgagaactcccccgaattcaccccatacttggaaactaaccttggacagccgacgatccaatccttcgaacaagtgggtaccaaggtcaatgtgaccgtcgaggacgagaggaccctggtcaggcggaacaatacttttctgagcctcagagatgtgtttggtaaggacctgatctacaccctctactactggaaatcctcctcatccggaaaaaagacggcgaaaacgaacactaacgaattcctgatcgacgtggacaagggagagaactactgcttttcggtacaggctgtaattccgtcgcggactgtcaatcggaagtcgaccgattcgcccgtggaatgcatgggccaggagaaaggagaattccgggaaatcttctatatcatcggagcagttgttttcgtcgtcattatcctggtgataatcttggccatctccttgcacaagtgcagaaaagccggcgtgggccagagctggaaggaaaattcgccgctgaacgtgagc

SEQ ID NO: 8677 - DNA, 885 bp, Artificial Sequence
  Description of Artificial Sequence: Synthetic coding sequence
atggagacgcctgcgtggccccgagtgccgcgacccgagactgccgtcgccagaacattgctgttgggctgggtcttcgctcaggtggccggtgcctccggaaccaccaatacagtggcagcttataaccttacttggaaaagcaccaatttcaagacgatcctggagtgggagcctaagcctgtgaatcaggtgtatactgtgcagatcagcacaaagtccggggactggaaaagtaaatgcttctacacaacagataccgagtgtgatttgacggacgaaatagttaaagacgttaaacagacttacttggcaagagtgtttagctatcctgcaggcaatgtcgaatcaacaggatccgctggggaaccactgtatgagaattctcccgagttcacaccatatttggagacaaatctgggacaaccgactattcagtcattcgagcaagtgggaaccaaggtgaatgttactgtcgaagatgaacgaactctcgtgcgaagaaataacactttcctaagcctcagggacgtgttcgggaaggacttgatctataccctgtactactggaagtcaagtagcagtggcaagaagacagctaagactaataccaatgagtttctgatcgatgtggataagggcgagaattactgtttcagcgtacaggctgttatcccctcgaggacggtaaatcgcaagtccacagactccccagttgaatgcatggggcaggagaagggggaattcagggagattttttatatcattggcgccgtggtttttgtggtgatcatccttgttattatcctggccatatctctccataaatgtagaaaagccggggtgggacaatcttggaaagagaactctccactgaacgtgtcc

SEQ ID NO: 8678 - DNA, 885 bp, Artificial Sequence
  Description of Artificial Sequence: Synthetic coding sequence
atggaaacccctgcatggcctagagtgccacggcctgagactgcagtggcacggactctgcttctgggatgggtctttgcacaggtggctggtgcatcagggaccaccaacaccgtggcagcgtacaaccttacctggaagtctactaacttcaaaactattctcgaatgggaacctaagcccgtgaaccaggtgtataccgtgcaaatttccacgaagagcggagattggaagtccaagtgtttttacaccactgataccgaatgcgacttgaccgatgaaatcgtgaaagacgtcaagcaaacttatcttgcaagggtgttttcctacccggcggggaatgtcgagtcgaccggttcggcaggagaaccactttacgagaactcacccgagttcaccccgtacctcgaaaccaatctgggacaaccaaccatccaatcatttgaacaagtgggaaccaaagtgaacgtgaccgtggaggacgaaagaacgctcgtccgtcgcaacaacaccttcctgtcgctcagggacgtgttcggtaaggatttgatttacaccctctactactggaaaagctcgtcaagtgggaaaaagacggcaaagactaacacgaacgaattcctgattgatgtggacaaaggggagaactactgttttagcgtgcaagcagtgattccctcacggaccgtgaataggaagtccaccgattcaccagtggaatgtatgggacaggaaaagggcgagttccgcgagatattctacattataggtgcggtggtctttgtagtgatcatcctggtgattatacttgccatctcgcttcacaagtgcaggaaggctggggtgggacaaagctggaaggagaactcaccacttaacgtgtcc

SEQ ID NO: 8679 - DNA, 885 bp, Artificial Sequence
  Description of Artificial Sequence: Synthetic coding sequence
atggagacgcccgcttggccacgtgtaccacgacccgaaaccgccgttgcccggaccttactcctgggttgggtgtttgcccaagtggccggggcttccggcacaaccaacaccgtagctgcatataatctgacttggaagagcacaaactttaagacaatcctcgagtgggaaccaaagccagtcaatcaggtgtacaccgtccagatctctacgaagtccggcgattggaaatctaaatgtttttacaccactgacacagaatgcgatctgactgatgagatcgtgaaggacgtcaaacaaacctatcttgcacgcgtattctcatatccagctggcaacgtggaatccacgggttccgcaggggagcccctgtacgagaactcaccagaatttacaccctacctggagacaaaccttgggcagcccacaattcagtcattcgagcaggtgggtacaaaggtcaacgtgacagtggaagatgagcgaaccttagtgaggcggaacaacacattcctttccctgagggatgtctttggcaaggacctgatttacacattgtattactggaaatctagcagttccggaaaaaaaacagctaagaccaataccaatgagttcctcatcgatgttgataagggtgagaactactgtttcagtgtccaggcagtgattccatctcggaccgttaatcgcaagagcaccgattcccctgtggaatgtatggggcaggagaagggggagtttcgtgagatcttttatattatcggagccgtggtgttcgtggtcatcatcctcgtcatcattctcgcaattagcctgcataaatgcagaaaggcaggagttgggcaatcatggaaggagaattctcccctcaacgtgagc

SEQ ID NO: 8680 - DNA, 885 bp, Artificial Sequence
  Description of Artificial Sequence: Synthetic coding sequence
atggagacacctgcctggccaagagtgcccagacctgaaacggctgtagcacgcaccctgctcctgggctgggtgttcgcccaggtggcaggagcttcagggaccacaaataccgtggctgcatataatctgacttggaagagcacaaactttaagactatactcgaatgggaaccaaagcccgtaaaccaggtttatactgtccagatctccaccaagagtggggactggaaatccaagtgcttctacaccacggatactgagtgcgacctgacggatgagatcgtcaaggatgtcaaacagacatacctggcacgagttttctcttatccagctggcaacgtggagagtacagggtcggcgggagagccactgtatgaaaactctcctgagttcaccccgtacctcgagactaatctgggccagcccaccatccagtcttttgaacaggtcggtaccaaagttaacgtgaccgtggaggacgagcgcaccctcgttcggagaaacaacaccttcctctcgcttcgcgatgtgttcgggaaagacctgatttacacactgtactactggaagtcatcttctagcggtaaaaaaacagccaagacaaacactaatgaatttctgattgatgttgataagggggagaattattgttttagtgtgcaggccgtgattccgagccggaccgttaaccggaagtcaaccgattctccagtggaatgcatgggccaagagaaaggggagttcagggaaatattctacatcatcggcgccgtcgtgttcgttgtaattatcttggtcatcatcttggctatatccctgcacaaatgcagaaaagctggagtggggcagtcttggaaggagaactcgccactaaacgtgtca

SEQ ID NO: 8681 - DNA, 885 bp, Artificial Sequence
  Description of Artificial Sequence: Synthetic coding sequence
atggagacgcctgcgtggccgcgtgtcccgagaccggaaaccgccgtagcaagaacattactgttaggttgggtgtttgcacaagtagctggagcaagtggaactacaaacaccgtagccgcttataatcttacgtggaagtcaacaaatttcaagactatcttagaatgggagcctaagccggtcaatcaggtatatacagttcaaatatctacaaagagcggagattggaagtccaaatgtttctatacgacggatacggaatgtgacttaacagacgagattgttaaggatgtgaagcaaacctatctcgcccgtgttttctcttatccggccggcaacgttgaatcaactgggtctgccggtgagcctttatatgaaaactctcctgaattcacaccttatttggagaccaatttggggcagccgaccatacagagttttgagcaagttggaaccaaggtaaacgtgaccgtagaagatgagaggacccttgtacgcaggaacaacacatttttgtcactgagggatgtgtttgggaaagacctcatctataccctctattactggaaatcgagtagttctggcaaaaaaacggccaagacaaatacaaatgaattccttattgatgtcgataagggagagaattattgcttctcagttcaagcagtcattccgtcaaggaccgtaaatcgcaagtcaacagatagtccggtggaatgcatggggcaggaaaagggcgaatttcgtgaaatcttttatatcattggcgctgtagtctttgtagtcataattctggttattattttagcaatttcgttacataaatgtcggaaagctggagtcggtcagtcgtggaaagaaaactccccattgaatgtctct

SEQ ID NO: 8682 - DNA, 885 bp, Artificial Sequence
  Description of Artificial Sequence: Synthetic coding sequence
atggagacgccagcttggccgcgggtgccccgccctgagacggccgtggcacggaccctgctgctgggttgggtgtttgcccaagtcgcgggggcgtccggaaccactaatactgtcgccgcttacaatctcacttggaagtctaccaacttcaagaccatcctcgaatgggaacccaagccggtgaatcaggtgtacacggtgcagatctcgaccaagtccggagattggaagtcgaagtgtttctacaccactgacaccgaatgcgacctgactgacgaaatcgtcaaagacgtcaagcagacctacctggcgagagtgttcagctacccagcagggaatgtggaatcgactggatcagccggcgaacctctgtacgaaaacagccctgagtttaccccgtacctggagactaaccttggccagccgactatccaaagtttcgagcaggtcggaaccaaagtcaacgtgaccgtggaggacgagcgcactctcgtgagacgcaacaacactttcctgtccctgcgagatgtgttcggaaaggaccttatctacaccctctactactggaaatcatcctcctcgggaaagaaaacggctaagaccaacactaacgaatttctcatcgatgtggacaaaggagaaaactattgcttctcagttcaagccgtcatcccgtccagaaccgtgaataggaaaagcactgattcgccagtggaatgcatggggcaagagaagggagaattccgggaaattttctacatcatcggtgccgtggtgtttgtggttattatcctcgtcatcattttggcaatctcgttgcacaagtgccgcaaggcgggcgtcggccagagctggaaggagaacagcccgctgaatgtgtca

SEQ ID NO: 8683 - DNA, 885 bp, Artificial Sequence
  Description of Artificial Sequence: Synthetic coding sequence
atggagacgcccgcgtggcctcgagtaccccgtcctgaaactgcggttgcgcgaacactactgttaggatgggtcttcgcccaggtggcgggtgctagcggcacaaccaacacggtcgcggcctacaaccttacatggaagagcaccaactttaaaaccattctggagtgggagcctaaacccgtgaaccaggtgtacaccgtacaaatcagcaccaagtcgggggactggaaatctaaatgtttctatacgaccgacaccgagtgcgacctcacagacgaaattgtaaaggatgtgaaacagacctacctggcgcgggtgttctcttatcccgccggtaatgtggaatccactggctctgctggagaacctctgtacgaaaattctccggagttcactccctacttagaaaccaaccttggtcagcctaccatacagtcatttgagcaggtggggacgaaggtaaacgtcaccgtcgaggacgagcgaactctcgtacgcaggaataatacattcctaagcctaagagatgtgttcggcaaggatctgatttatactctgtattactggaagtcctcgagttccggcaagaagacagcaaaaaccaacaccaatgagtttctgatagatgtggataagggagagaactactgttttagcgtgcaggccgtgatcccaagtcgtaccgtcaacagaaagagcacagattccccagttgagtgtatgggtcaggagaaaggggaatttcgcgaaatcttttacattataggagcggtggtcttcgtcgtgataattttggtgattattttggccatcagtctgcacaagtgtagaaaggctggcgtcggccagtcctggaaggaaaatagcccactgaatgtgtct

SEQ ID NO: 8684 - DNA, 885 bp, Artificial Sequence
  Description of Artificial Sequence: Synthetic coding sequence
atggagacaccagcctggccaagagtccctcggcccgagactgccgtggctcggactctacttctggggtgggtgtttgcacaggtcgccggggcatccggaactactaatacagtggcagcctataatcttacatggaaatcaactaacttcaagacaatcctagagtgggaacccaagcctgttaaccaggtatacacagtgcagatatcaacaaagtccggagattggaaatcgaaatgcttctatacaacagatacggaatgcgatctgacagatgaaatagtcaaagatgtgaaacagacttatttggcaagagtgttttcttatcccgctggaaacgtggaaagtacagggtcagccggggaacccttatatgagaattcccccgagtttacaccttacctagagacaaatctagggcagcctacaatccagtcctttgaacaggtgggaacaaaggtaaacgttactgttgaagatgaacgaacactggtgcgccgcaataacacatttctctccctacgcgatgttttcggaaaagatctaatctatacactatattattggaaaagttcgagttccgggaaaaaaacagccaaaactaatactaatgaatttcttatcgacgtggataaaggagaaaactactgcttctcagtgcaggccgttatccccagtaggacagttaacaggaaatctacagattctcccgttgaatgcatggggcaagaaaaaggggagtttcgagaaatcttctatatcatcggggctgttgtatttgtagttataatactggtaatcatcttagcaatttccttacacaaatgtaggaaagcaggagtggggcagtcctggaaagaaaactcccccttgaatgtaagt

SEQ ID NO: 8685 - DNA, 885 bp, Artificial Sequence
  Description of Artificial Sequence: Synthetic coding sequence
atggaaactccggcctggcctcgagtgcctagacctgaaaccgcagtggcccgaaccctgttgctgggatgggtgttcgcgcaagtcgccggagcatccggaactaccaataccgtggctgcttacaatcttacctggaaatccactaactttaagacgattctcgagtgggagcctaaacctgtgaaccaagtctacaccgtgcagatctccactaagtccggcgactggaagagcaagtgtttctacaccaccgataccgagtgtgacctgaccgatgagattgtgaaagatgtgaaacaaacttatcttgcccgggtcttttcctaccctgcaggtaatgtggaatcaactggatctgcaggggaacctctttacgagaattcacctgaatttactccgtacctcgaaactaacctgggacaacctaccattcagtcgtttgagcaggttggaaccaaagtgaacgtcaccgtggaggacgaacgtacccttgtgcgccgaaacaatacttttctgagcctgagggatgtgtttggaaaggacctcatttacacgctgtactactggaagtcgtcatcgtcgggaaagaaaacggccaagactaacacgaatgaattccttatcgacgtggacaaaggtgaaaactactgtttttcggtgcaagccgtcattccctcgcggaccgtgaaccgcaaatcaaccgatagccctgtcgagtgtatggggcaggaaaagggtgagttccgggaaatcttctacatcattggggcagttgtgtttgtggtgattattctggttatcattctcgctatatcccttcataagtgtcggaaggcaggcgtgggacagtcgtggaaggaaaactctcctttgaatgtgagc

SEQ ID NO: 8686 - DNA, 885 bp, Artificial Sequence
  Description of Artificial Sequence: Synthetic coding sequence
atggaaacgccggcctggccacgcgtgccgcggcctgaaaccgccgtcgctcggaccctgctgcttggatgggtgttcgcacaagtggcgggggcctccggaactactaatactgtcgcggcgtacaacctcacctggaaatcaaccaactttaagaccatcttggagtgggaacccaaaccagtgaatcaggtgtacactgtccagatcagcaccaaatccggggattggaaaagcaaatgcttttacaccactgataccgaatgtgacttgaccgatgaaattgtgaaggatgtcaagcaaacttatctggcaagagtgttctcgtaccctgcaggaaacgtggagtcgactggaagcgcaggtgagcctctgtacgagaattcgcctgagttcacgccctacctggaaactaatctcgggcagcctactatccaatcctttgaacaagtgggaactaaggtcaacgtgaccgtcgaagatgagaggactcttgtccggagaaataacacgtttctttcccttcgtgatgtgttcggaaaggatctcatatacacgctgtactactggaagagcagctcaagcggaaagaaaactgcaaagaccaataccaacgaattcctgattgatgttgacaaaggagagaactattgcttcagcgtgcaagccgtgatcccgagccgtaccgtgaaccgtaaatcgactgactcgcctgtcgaatgtatgggacaggaaaagggcgagttccgggaaatcttctatatcattggcgcagtggtgttcgtggtaatcattctggtgataattctggctatctcacttcataagtgtaggaaagcaggagtgggtcagagctggaaggaaaactcgcccctcaatgtctcc

SEQ ID NO: 8687 - DNA, 885 bp, Artificial Sequence
  Description of Artificial Sequence: Synthetic coding sequence
atggaaacgccggcctggcctcgcgtgccgcggccggaaaccgcagtcgcacgaacgctgcttctcggctgggtctttgctcaagtggccggcgccagcggaactactaacaccgtggccgcttacaaccttacttggaaatccacgaacttcaaaactatcctggagtgggaaccaaaaccagtcaaccaggtgtacaccgtgcaaatatcaaccaagtcgggcgactggaagtccaagtgcttctacactaccgatacggagtgcgacttgaccgacgagatcgtcaaggatgtcaaacagacctacctggcacgggtcttttcctaccctgcaggaaacgtcgagtccacggggtccgccggagagcctttgtacgaaaactcgccggagtttaccccatacctcgaaaccaatctggggcaaccgactatccagtccttcgaacaggtcggcactaaagtgaatgtgacggttgaagatgaacggaccctcgtgaggcgcaacaataccttcctgagcttgagagatgtgttcggtaaggacctcatctacacgctgtattactggaaatcgagcagcagcggtaaaaagacggcaaagactaacactaatgagtttctcatcgatgtcgacaagggagagaactactgcttcagcgtgcaggcggtgatccccagcagaaccgtgaaccggaagtcgactgactcgcctgtcgaatgtatggggcaagaaaagggggaattccgcgaaatcttctacatcatcggcgccgtcgtctttgtggtgatcatcctggtgattatcttggctatttcactccacaagtgccggaaggcgggggtgggccagagctggaaggagaattcgccgctgaatgtcagc

SEQ ID NO: 8688 - DNA, 885 bp, Artificial Sequence
  Description of Artificial Sequence: Synthetic coding sequence
atggaaactccggcgtggccgcgggtgccacggcccgaaaccgcggtggcacggactcttctgctcggttgggtgttcgcccaagtcgcaggtgcctcgggtacgaccaacacggtggccgcatacaatctcacgtggaaatcaaccaactttaagactatccttgaatgggaaccaaaacccgtcaaccaggtctacactgtgcaaatcagcactaagtcgggggactggaagtccaagtgtttttacaccactgataccgaatgcgatctgactgacgagattgtgaaggatgtgaaacagacctacctggcaagagtgttttcgtaccctgctggaaacgtggagtcgacgggatccgcgggcgaacctctgtacgagaattctcctgagtttactccttaccttgagactaaccttggacagcccacgattcagtcgtttgaacaggtgggcaccaaagtgaatgtgactgtggaagatgaaaggactctggtgcgccgaaataacacttttctgtcccttcgagatgtctttggcaaggatctgatttacaccttgtattactggaaatcgtcgtcatccggaaaaaagaccgcaaaaaccaatactaatgaatttctcatagatgttgataagggtgagaattactgcttttcagttcaagcagtgattcctagccggactgtgaacaggaagtcgaccgattcgccagtcgagtgtatggggcaagaaaagggagagttccgggagatattctacatcattggagcagtggtctttgtggtcatcattctggtcattattctggcaattagcctgcataagtgtagaaaagcaggagtgggacaatcctggaaggaaaattccccactgaacgtgtcc

SEQ ID NO: 8689 - DNA, 885 bp, Artificial Sequence
  Description of Artificial Sequence: Synthetic coding sequence
atggagactcccgcctggccccgggttccccgtcctgaaacagccgtcgccagaacgctcctgctcggttgggttttcgcccaggttgctggggcatcgggcacgactaacaccgttgccgcctacaatctgacttggaagtccacgaacttcaagacaattcttgagtgggagcctaaaccggtgaatcaggtctatactgtccagatttccactaagtccggagattggaagtccaagtgcttctacaccaccgacactgagtgcgacctgaccgacgagattgtgaaggatgtcaagcagacatacctcgcgagagttttctcttaccccgccggaaacgtcgagtccaccggttcggcgggggaacccctttacgagaattctcctgagttcaccccgtacctcgagaccaaccttggtcagcccacgattcagtctttcgagcaggtcggcacgaaagtcaacgttactgtggaggacgaacgtaccctggtacgccgaaataacacgttcctcagcctgcgagacgttttcggaaaggatcttatttacaccctctactactggaagagttcctctagtggcaagaagactgccaagactaacacgaatgaattcctcatcgacgtcgataagggcgagaactactgcttcagcgttcaggccgttataccttcgcgcaccgtaaaccgcaagtccacagacagcccggtagagtgtatgggtcaggagaagggcgagttcagggaaatcttctacatcatcggcgctgtcgtgttcgtcgtgattatcctggtcattatccttgctatctctttgcacaagtgtcgtaaggcaggcgtcggtcagagctggaaggagaactcacccttgaacgtttcg

SEQ ID NO: 8690 - DNA, 885 bp, Artificial Sequence
  Description of Artificial Sequence: Synthetic coding sequence
atggaaacgcccgcgtggccacgggtgccccgcccagaaaccgccgtggcaagaactctcctgcttggatgggtgttcgcacaggtggccggagcttccggaaccactaacactgtcgcagcttacaatctcacctggaaatccactaacttcaaaaccatcctggagtgggagccaaagcctgtgaaccaggtgtatactgtacagatctcgaccaagtcgggggattggaagtcgaaatgcttctacaccactgataccgagtgtgatctgaccgatgagatagtgaaagacgtgaagcagacctacctggcacgggtctttagctaccctgcaggaaacgtggagtcgactggctccgcaggtgaacctctttacgaaaacagccccgaattcaccccataccttgaaactaacctcggccaacctaccatccagtcgtttgaacaagtgggtactaaggtgaacgtgaccgtggaagatgagagaaccctcgtgagacggaacaatacctttctttcccttcgagatgttttcggtaaggaccttatctacaccctttactactggaagtcctcgtcgtcgggaaaaaagaccgcaaaaactaacactaacgaatttctgattgatgtggacaagggagagaactactgcttttcagtgcaagcggtgattccctcacggaccgtgaatcgaaagagcaccgattcgcctgttgaatgcatgggccaagagaaaggtgaatttcgggaaatcttttacattattggagctgtggtgtttgtggtcatcatccttgtgatcatcctggcaattagcctccataagtgtcggaaggcaggtgtggggcagagctggaaggaaaattctccactgaatgtttca

SEQ ID NO: 8691 - DNA, 885 bp, Artificial Sequence
  Description of Artificial Sequence: Synthetic coding sequence
atggaaacccctgcatggccgagggtgccccgcccagaaacagccgtggcaagaactcttctccttggctgggtgtttgcgcaagtagcgggggcctcagggacaacgaacaccgtagccgcttacaacttaacctggaagtcgaccaacttcaagaccattctcgagtgggaacccaagccggtcaaccaagtctatactgtccagatctccactaaatcaggtgactggaagtccaagtgcttctacaccaccgatacagagtgcgatctgaccgacgagatcgtgaaagatgtcaaacaaacatacttggctcgcgtgttcagttaccctgcaggaaacgtcgaatccacagggtcagcaggagagccactttatgaaaactccccagaatttacaccgtacctggagaccaacttaggccaacctacgatccagtctttcgagcaggtgggcactaaggtgaacgtgactgtagaggatgaacgcactcttgtgcgtcggaacaacaccttcctgtctctgagggacgtgttcggcaaggacctgatctatacactctactactggaagtcttcgtctagcggcaaaaagactgctaagacaaacacaaatgagtttttgatcgacgtggacaagggagagaattactgtttctccgtgcaggcggtgatccccagtaggaccgtgaatcgaaaatccacagactcaccggttgagtgtatggggcaggaaaagggcgaattcagggaaatcttttatatcataggtgccgttgtgtttgtcgtgattatcttggtgatcatcctggcaatatcccttcacaaatgtaggaaggcgggcgtaggtcaatcttggaaagaaaactctccgctgaatgtgtcc

SEQ ID NO: 8692 - DNA, 885 bp, Artificial Sequence
  Description of Artificial Sequence: Synthetic coding sequence
atggaaactccagcatggcctagagttccaagaccagaaacagctgtcgccaggactctattacttggatgggttttcgcacaagttgcaggagccagtggtactactaatactgttgcagcttacaatttaacatggaaatctactaatttcaaaactattttagaatgggaaccaaagccagtaaatcaagtttatacagttcaaatttctactaaatctggagattggaaatctaaatgtttttatactactgacacagaatgtgatcttacagatgaaatcgttaaggatgtaaaacaaacatatttagctagagttttttcatatcctgcaggaaatgttgaatcaactggttcagctggagaaccattatatgaaaattcaccagaattcacaccatatttagaaactaatcttggtcaaccaacaattcaatcttttgaacaagtgggaacaaaggttaatgtcacagttgaggacgaaagaacattagttagaaggaataatactttccttagtttaagagatgtttttggaaaggaccttatatatactctttattattggaaatcttcttcatcaggtaaaaagacagctaagacaaatacaaatgaatttttaattgatgttgataaaggagaaaattattgtttctctgtacaagctgttattccatcacgaacagttaatagaaaatcaactgattcaccagttgaatgtatgggacaagaaaaaggggaatttagagagattttttatataattggtgcagttgtttttgttgttattattttagttattattctagctatatcacttcataaatgtagaaaagcaggtgtaggtcaatcatggaaagaaaattcaccattaaacgtttca

SEQ ID NO: 8693 - DNA, 885 bp, Artificial Sequence
  Description of Artificial Sequence: Synthetic coding sequence
atggagactcctgcttggcccagagtgcctcgcccggaaaccgcagtggccagaaccctgctgctgggatgggtgttcgcgcaggtggccggagcctctggcactactaatactgtcgccgcgtacaatttgacttggaagtcgaccaatttcaaaaccatcctggagtgggagcctaagccagtgaaccaagtgtatactgtgcaaatctcaaccaagtccggggattggaagtctaagtgcttttacacgaccgacactgaatgcgacctgactgatgaaatcgtgaaggatgtcaagcaaacctacctggcaagagtgttttcgtacccggccggtaacgtcgaatcaacgggctcggcgggtgaaccgctgtacgaaaactccccggagtttaccccctaccttgaaaccaatctgggacagccgaccatacaatcgtttgagcaagtgggtactaaggtgaatgtcactgtggaggatgaacggacgcttgtccgtaggaacaatacgttcctgtcgctcagggacgtgttcgggaaggacctcatttacaccctgtactattggaaatcttcaagctccggaaaaaagaccgccaaaactaacacgaacgaattcctcatcgacgtggacaagggagaaaactactgtttttctgtccaggcagtgatcccgtcacggactgtgaaccgaaagagcaccgactccccggtcgagtgcatgggacaggaaaagggcgagttccgcgagattttctacatcattggagcggtcgtgttcgtcgtcatcatcttggttatcatccttgcgatcagcctgcacaaatgccggaaagctggtgtgggccagtcgtggaaagagaactccccactgaacgtgtca

SEQ ID NO: 8694 - DNA, 885 bp, Artificial Sequence
  Description of Artificial Sequence: Synthetic coding sequence
atggaaactcctgcttggcctagagttccccgtcctgaaaccgcggtggctagaacacttcttttgggatgggtgttcgctcaagtcgcaggtgcttcaggaactactaacacggttgctgcatacaatttgacatggaagagtaccaatttcaaaactattcttgagtgggaacctaaaccagtcaatcaagtttataccgtacaaatttcaactaaatccggtgattggaagtctaagtgtttctacacaactgacacggagtgtgacttgactgatgagatcgtgaaagacgtcaagcaaacgtatctcgctagagttttttcatatcctgctggtaacgttgagtcaaccggatcggctggtgaaccactttatgagaattctcccgaattcaccccttatctggaaactaatttgggacaaccaaccattcagtcattcgagcaggtggggacgaaagttaacgtcactgttgaagacgaaagaacactcgttagacgaaacaatacgttcttgtcacttcgagatgtatttggtaaagatcttatctacacactttactattggaagtcaagtagcagcggaaagaagactgcgaagacaaataccaatgaatttctgatcgatgtagataaaggtgaaaattactgcttcagtgttcaggctgttataccttcacgtaccgtcaacaggaaatcaactgattcacctgtcgaatgtatgggtcaagaaaagggcgagtttagggagattttctacatcatcggagctgttgtatttgtagttatcatcttggttattattctcgctattagcttgcataagtgccgtaaagctggtgttggtcaatcctggaaggagaatagcccactcaatgtttca

SEQ ID NO: 8695 - DNA, 885 bp, Artificial Sequence
  Description of Artificial Sequence: Synthetic coding sequence
atggaaacccctgcgtggccaagggtgcctagacccgaaacggcggtggccagaactctgctcctgggttgggtctttgcccaggtcgcaggagcctcgggcaccacgaacacggtggctgcttacaacctcacgtggaagagcactaacttcaagactatcttggaatgggaacctaagccggtcaaccaggtgtacaccgtgcagatctcgaccaaatccggggactggaagtctaagtgcttctacaccaccgacactgagtgcgatctgaccgatgagatcgtgaaggacgtgaaacaaacgtacctcgcccgggtgttctcataccctgctggaaatgttgagtccactggatcggcgggggaacctctgtacgaaaactccccagagttcaccccttacctggagactaatctgggacaaccgaccattcagtccttcgagcaggtgggaactaaagtcaacgtcaccgtggaagatgagaggaccctcgtccggaggaacaatacttttctctcgctccgggatgtgttcggtaaggacctgatctacacgctgtactactggaaatcctcctcgtccggcaagaaaaccgccaagaccaatactaatgaattcctgatcgacgtggataagggagaaaactactgcttttccgtccaggctgtgatcccgagcagaaccgtgaaccggaagtcgactgactcaccggtcgaatgtatggggcaagaaaagggtgagttccgggaaatcttctacatcattggagcagtcgtgtttgtggtcatcatcctcgtgatcatcttggccatctcactgcataaatgccgcaaagctggtgttggacagtcgtggaaagaaaactcgccactgaacgtctcg

SEQ ID NO: 8696 - DNA, 885 bp, Artificial Sequence
  Description of Artificial Sequence: Synthetic coding sequence
atggagacaccggcttggccacgcgtccctcgcccggagactgccgtggcgcggactttgctcctgggctgggtctttgcccaggtggctggcgctagcggtaccacgaacactgttgccgcatacaatctgacctggaagtctaccaatttcaaaacaatacttgagtgggagcctaaacctgtgaaccaagtctatacagtccaaatctcgactaagagtggagactggaaatcgaaatgtttctatacaaccgacacagagtgtgacctgaccgacgaaattgttaaagacgtgaaacagacctacctcgcacgagttttctcctatcccgccggtaatgtagaaagtacaggatctgcgggcgaacccctgtacgagaatagcccggaattcaccccatatctggaaacaaacctgggacagcccacgatccaatctttcgagcaagtggggacaaaagtgaatgttacagtggaggatgagcggactctggttcgccgcaataatacattcttgagcttgcgagatgtgtttggaaaagacctgatctataccctgtattactggaagtcgtcctccagtgggaagaagaccgccaagaccaatactaatgaattcctgattgatgtagataaaggtgaaaattactgcttttctgttcaggcagtaatcccaagtcggaccgtcaacaggaaaagtacagatagccccgtcgagtgcatgggacaggagaaaggagaattccgcgagatattttacatcataggtgccgtggtgtttgtcgtgattatcttggtcattattctagcaatctcactccataagtgccgcaaggctggggtgggccagtcctggaaagaaaatagcccattaaacgtatca

SEQ ID NO: 8697 - DNA, 885 bp, Artificial Sequence
  Description of Artificial Sequence: Synthetic coding sequence
atggagaccccggcctggccccgcgtgccgcggcctgagactgccgtggctcggacactgctgctgggttgggtctttgcccaagtggcgggagcttccggcaccactaatactgtggcggcctacaacctgacatggaaaagcacgaatttcaagacgatcctggaatgggagccgaagcctgttaatcaggtctacaccgtgcagatcagcactaaaagcggcgattggaaaagcaagtgtttctataccacggataccgagtgtgaccttaccgatgagattgtgaaagatgtcaagcagacctatttggcgcgcgtcttttcctaccctgcaggtaatgttgaatccaccggaagcgcgggcgagccactgtatgagaactcacctgaattcactccttacctggaaaccaacctgggtcagccgactattcagagcttcgagcaggtgggcactaaggtcaacgtcactgtggaggatgaacggaccctggttcgccgcaataacaccttcctgagcctgcgcgatgttttcggaaaggatctgatttataccttgtattactggaaatcgtctagcagcggtaagaaaaccgctaagaccaacaccaatgagttcctgattgacgtggataagggtgagaattactgcttttccgtacaggccgtcatccctagcaggaccgttaaccgtaaaagcacggattcccctgttgagtgcatgggccaggagaaaggtgaatttcgagagatcttctacattatcggtgccgtggtgttcgtcgtgatcatcctggtgattatcttggccattagcctgcacaagtgtcggaaggcgggcgtcggtcaaagctggaaagagaatagtccgctgaacgtcagc

SEQ ID NO: 8698 - DNA, 885 bp, Artificial Sequence
  Description of Artificial Sequence: Synthetic coding sequence
atggaaactccggcgtggcctagagtcccaagacctgaaactgcagtagcaaggaccctgcttcttggctgggtatttgcacaagtcgccggcgcttctggaactaccaacaccgtggccgcctataacttgacttggaaatcgaccaactttaagactatccttgaatgggaacctaaacccgtcaatcaagtttacactgtgcaaatctccactaagtcgggagactggaagagcaagtgcttctataccactgacaccgagtgtgaccttacggacgaaatcgtgaaggatgtcaagcaaacctacctggctcgagtgttctcgtacccagcaggcaatgtggaaagcaccgggtcggcgggtgaacctctttacgagaattccccagagttcaccccgtacctcgaaactaacttgggtcagcctaccattcagtcgtttgaacaggtcggaaccaaggttaacgtcacggtggaggatgaacgtactctggtgagacgcaataacacctttttgtcactgcgcgacgtgtttggaaaagatctgatttacaccctttactactggaaaagctcctcctcaggaaagaaaaccgcaaagactaacacgaacgaatttctgattgatgttgataagggagagaactactgtttcagcgttcaggccgttataccttccagaacggtgaacagaaagtcaactgattccccagtggaatgcatgggacaagaaaagggagaattcagagagatcttttacatcattggtgccgtggttttcgtagtgattattctcgtgataatacttgcaatttcacttcataagtgtaggaaggcgggagtgggacagtcctggaaagagaatagccctctgaacgtctca

SEQ ID NO: 8699 - DNA, 885 bp, Artificial Sequence
  Description of Artificial Sequence: Synthetic coding sequence
atggaaacgccagcgtggcctagagtcccacggcccgaaactgccgtggcccgcactctgctgcttgggtgggtgtttgctcaggtcgcaggggccagcggaactactaacaccgtggcagcctacaacctgacctggaagtcgacgaactttaagactatcctggaatgggagccgaaaccagtcaatcaggtatatactgtccaaatctcgaccaagtcgggagattggaagagcaagtgcttttacaccaccgatactgagtgtgatctgactgacgagatcgtcaaagatgtgaagcaaacttacctcgcgcgggtcttttcctatccagctgggaatgtggagtcgactggatcagccggcgaaccactgtacgagaattcaccagaattcactccgtacctcgagactaacctcggtcagcccactatccaatccttcgagcaggtgggaacgaaagtgaatgtgaccgtggaggatgagcgaaccctggtccgccgcaataacactttcctgagcttgcgggatgtgttcggaaaggacctcatctacaccctttactactggaagtcatcatcgtcaggcaagaaaaccgcgaaaaccaatactaacgaattcctcatcgacgtggacaagggagaaaactactgtttctcggtgcaggcggtgatcccctcgagaactgtcaatagaaaatcaactgacagccccgtcgaatgtatgggccaggaaaagggagaattccgggaaatcttctacatcataggtgctgtcgtgttcgtggtgatcattctggtcatcatcttggccattagcctccataagtgccgcaaggcgggagtgggtcaaagctggaaagaaaacagcccactgaacgtgtca

SEQ ID NO: 8700 - DNA, 885 bp, Artificial Sequence
  Description of Artificial Sequence: Synthetic coding sequence
atggagactcctgcatggccgcgcgtgccgcgcccggaaactgccgtggctcgtaccctgctcttggggtgggtctttgcccaggtggcaggggccagcgggactacgaacacggtagcagcttacaaccttacctggaaaagcactaatttcaaaactattctggagtgggaacccaaacccgtgaaccaagtgtacaccgtgcagatcagcaccaagagcggcgactggaagtcgaagtgcttctatactaccgatacggaatgcgatctgacggacgagattgtgaaagacgtgaagcaaacctacttggcgcgggtattctcgtacccggcgggaaacgtcgaatctactggctcagctggagagcctctgtacgaaaactcccccgagttcactccatatctcgaaaccaacctgggtcagccaactatccagagctttgaacaagtgggaacgaaggtcaatgtgactgttgaggatgaacgcaccctcgtgagacggaataacaccttcctgtctctgcgcgatgtgtttgggaaagacctcatctacaccttgtactactggaagtccagcagctcaggcaagaaaactgccaagaccaacaccaatgaattcctgatcgacgtggataagggtgaaaactactgcttctccgtgcaggctgtcattccatccaggaccgtcaatcgtaagtcaactgactccccagttgagtgtatgggacaagagaagggagaattcagagagatcttttacatcataggagcggtcgttttcgtcgtgatcatcctggtcatcatcctggccatttcactgcacaagtgccggaaggccggtgtgggacagagttggaaggagaactccccactgaatgtttcc

SEQ ID NO: 8701 - DNA, 885 bp, Artificial Sequence
  Description of Artificial Sequence: Synthetic coding sequence
atggaaaccccagcttggccccgcgtgccacggcccgaaaccgctgttgcgcggacactgctgctggggtgggtgtttgcgcaggtcgctggggcctcagggacaactaatactgttgctgcctataatctgacttggaagagtaccaacttcaagacgattctcgagtgggagcctaaaccggtcaaccaagtgtatacagtgcagataagcaccaaatccggcgactggaaatccaaatgcttttacaccactgacacagaatgtgatctaacggatgaaattgtaaaagacgtcaaacagacgtatctggcgcgggtgttttcctatcctgccggcaacgtcgagagtacagggagcgcaggcgaaccactgtatgagaactcgcctgagtttacaccctacctcgagacaaatctcggccaacctacgatacagtcattcgaacaggtcggtactaaagttaacgttactgtggaagatgagcggacgctggtgcgtcggaataacaccttcctgtcactacgggacgtgtttggcaaggatctcatctacactttgtactattggaagtcttcatcttcaggtaaaaaaactgccaaaacgaacaccaacgagtttctgatagacgtcgacaaaggcgaaaactattgtttctccgttcaggcagtgatcccgtctcggactgttaaccgaaaatccacggactcaccagtcgagtgtatgggccaggagaagggagaattccgcgaaatcttctatattatcggcgctgtggtgtttgttgtcatcatattggtgattattctcgcaatctccctccataaatgtcgtaaggccggcgtcggccagtcttggaaggaaaattcccccttgaatgtgagc

SEQ ID NO: 8702 - DNA, 885 bp, Artificial Sequence
  Description of Artificial Sequence: Synthetic coding sequence
atggagacacctgcatggccccgggtacccaggcccgagacggctgtggctcggacacttttgctcggatgggtgttcgcgcaggtcgccggagcatccggtacgaccaacactgttgctgcgtataacttaacatggaaaagcacaaactttaaaactattcttgaatgggagccgaagcccgtgaatcaggtttacaccgtgcaaatatctactaaatctggcgactggaaaagcaagtgtttctacacgacagatacggagtgtgacctgacggatgaaatcgtcaaggacgtgaagcagacttacctggcccgtgtgttctcctaccccgctggcaacgtggagtcaactggttctgctggtgagcctctgtatgaaaattctccagagttcacgccgtacttggagacaaatctcggacagccaacaatccagtcttttgaacaggtgggcacaaaggttaacgtcacagtggaagatgaacgtactctcgtgcgccgaaacaatacgttcctgtctctgagagacgtctttgggaaagatctcatctacaccctctattattggaagtcctcatcttccggaaaaaaaacagccaaaaccaatacaaatgaatttctcattgacgtggataagggggaaaattattgttttagcgtgcaagccgttattccatcccgtactgttaaccgcaaatctacggattcgccagttgaatgtatgggccaggagaagggagaattccgcgaaattttttacattatcggggctgtggtgtttgtggtaattattttggtgattattctggcaatctccctgcataagtgcaggaaagcaggcgtgggacaaagctggaaagagaactccccactgaatgtaagc

SEQ ID NO: 8703 - DNA, 885 bp, Artificial Sequence
  Description of Artificial Sequence: Synthetic coding sequence
atggagaccccagcgtggcctcgagtgccacgcccagaaaccgctgtagcccgtactctgctcctgggctgggtgtttgcccaagtggccggggcctcaggaaccaccaacaccgtcgccgcgtacaatttgacctggaaatctacgaactttaaaaccattctggagtgggagcctaaacccgtgaaccaagtgtatacagtccagatatcaaccaaatctggtgactggaagagcaagtgcttctacaccaccgacaccgaatgtgacctgaccgacgaaatcgtgaaggacgtgaagcagacttatctggctcgtgttttcagttatcctgccggcaatgtcgagagcaccggaagcgcaggagagcccctgtatgaaaattcacctgaattcaccccatatcttgaaacgaacctgggtcagccgaccatccagtctttcgagcaagtgggaactaaagtaaacgtgaccgtggaggacgagaggaccctcgtgagacgcaacaacacatttctgtccctgcgcgacgtgttcgggaaggacctgatctatactttgtactactggaaaagttcttcttcagggaaaaagactgcgaagacaaatactaacgagtttcttattgatgtcgacaaaggcgaaaactattgcttttcggtgcaggcagtaatcccttcgaggaccgtgaatcggaaatctacagactcccctgttgagtgcatgggtcaggaaaaaggggagtttcgagaaattttctatattataggtgcagttgtcttcgtggttataattctggttattatcctggctatcagcctacacaagtgccgaaaagcaggggtgggccagagctggaaagaaaactcgcccctgaacgtctcc

SEQ ID NO: 8704 - DNA, 885 bp, Artificial Sequence
  Description of Artificial Sequence: Synthetic coding sequence
atggaaactccggcatggccgagagtcccgcgaccggaaactgcggtggcgcgcaccctcttgttgggatgggtgttcgcccaggttgcgggagcgtccggaaccactaatactgtcgccgcttacaatctgacttggaagagcacgaatttcaagaccatcctcgaatgggaacctaaaccagtcaaccaagtgtacaccgtgcagatttccacgaagtccggtgattggaagtctaagtgtttctacaccactgataccgaatgcgacctgacggacgagatcgtgaaggacgtgaagcagacttatctggcgagagtgttctcatacccggccggaaacgtggagtccacgggatcggccggcgaaccgctctacgaaaattcgccggagttcactccgtacctcgaaactaacctcggacaaccgaccatccagagcttcgagcaggtggggaccaaggtcaacgtgaccgtggaggatgaacggactttggtccggcgcaacaataccttcctttccctcagagatgtgtttggaaaggacctgatctacactctgtactactggaagtcctcaagcagcggaaaaaagaccgctaagacgaacaccaacgagttcctgatcgatgtggacaagggagagaactattgcttctccgtgcaggcggtgatcccatcccgaactgtgaacagaaaatccactgactcgcctgtggaatgcatgggccaggagaagggtgagtttcgcgagatcttctacatcatcggggccgtcgtctttgtggtgatcatactggtgatcattttggcaatttccctgcataaatgcagaaaagccggtgtggggcaatcctggaaggaaaattcgccactgaatgtgtcc

SEQ ID NO: 8705 - DNA, 885 bp, Artificial Sequence
  Description of Artificial Sequence: Synthetic coding sequence
atggaaactcctgcttggccaagggtgccgcgaccggaaactgctgtagccagaaccctgctcctaggctgggtgttcgcccaagtagccggggcgtccggaacaaccaataccgttgcggcgtacaatctcacatggaagtctaccaatttcaagaccatcctcgagtgggaacccaaacccgttaaccaagtctataccgtgcagatttccacgaagagcggagattggaagtcaaaatgtttttacactaccgacacagaatgcgacctcactgacgagattgtgaaggatgtgaaacagacctacctggcccgagttttctcataccctgccggcaacgtggaatcaacaggctctgccggagagccactttacgagaatagccccgaatttaccccctacctcgagacaaatttaggtcagccgactatacagagtttcgagcaagtgggcaccaaagtaaacgtgacagtagaagatgagaggacactcgtacgtcgaaacaataccttcctgtctctgagggacgtatttggaaaagacttgatctataccctctactattggaaatcatcctcgtcgggtaagaaaactgctaagaccaataccaacgaatttttaattgatgtcgataagggcgaaaattattgcttcagtgtgcaggccgtgattccatccaggaccgtgaacaggaaatccaccgattcgcccgttgaatgcatgggccaggaaaagggagaattcagagaaattttttacatcatcggagctgtcgtttttgtcgtgatcatcctggtgataatactggccatatccctgcataaatgtcgcaaggccggggtgggtcagagctggaaagaaaactctcctctcaacgtgagt

SEQ ID NO: 8706 - DNA, 885 bp, Artificial Sequence
  Description of Artificial Sequence: Synthetic coding sequence
atggagacccctgcatggcctcgggtgccccgccccgagaccgctgttgcgcgcaccttgctcctcggctgggttttcgcccaggtggccggcgcctcgggtactacgaatacagtggctgcgtacaacctgacttggaagtctacaaatttcaagacaatcttggaatgggaaccaaagccggtcaaccaagtctataccgtccaaatctccaccaagagcggggattggaagtccaaatgtttttacacaaccgacacggagtgcgatctcaccgacgaaatcgtcaaggatgtaaagcaaacttacctagcccgcgtgttttcataccccgcgggcaacgtggaatcgacgggtagtgccggagagcccctctacgagaactcgccggaatttacaccttacctcgagaccaatcttggccagccaaccatccagagtttcgagcaggtgggtacaaaggtgaacgtaaccgttgaagatgagcgaacgctggtccgccgcaacaatacgttcctcagcctgcgtgatgtgttcggaaaagatctgatttataccttgtactactggaaatcgtccagctcgggtaagaaaactgccaagaccaatactaacgaattcttgatagacgtggacaagggtgaaaactactgcttttcggtgcaggctgttatcccctcccgcaccgtgaaccgcaaatcaacggactcccccgtggagtgtatgggccaggagaaaggcgaatttagggagattttctacattataggcgcagtcgtgttcgtcgtgatcatactggtgataatcctggccataagtctccataagtgccgcaaagctggcgtcggacagtcctggaaggagaattcgccccttaacgtgtcg

SEQ ID NO: 8707 - DNA, 885 bp, Artificial Sequence
  Description of Artificial Sequence: Synthetic coding sequence
atggaaacacctgcgtggcctagagttccacgccctgaaaccgccgtggccaggaccctgctgctggggtgggtatttgcccaggtggcaggcgctagtgggacaactaacactgtcgcggcctataatctgacatggaaaagcactaatttcaagacgatactagaatgggagcctaaaccagtcaatcaggtgtatacggttcagatctctacaaagagtggagactggaagtccaagtgtttctatactaccgatacagaatgcgacctcaccgacgagattgtgaaagacgtcaaacagacttatttggcaagggtgtttagttaccctgctgggaacgtggagtctacgggtagcgccggcgagcccctttatgagaattcacccgaatttacaccttatctggaaacaaacttgggccagcctacgatccaatcgttcgagcaggtgggcactaaggtgaatgtcaccgtggaagacgagaggacattggtccggagaaacaacaccttcctctcgctgagggacgtcttcggcaaggacttgatctacaccttgtattactggaagagcagcagctccgggaaaaaaacggcgaagaccaatacaaacgagtttctcatcgatgttgacaagggcgagaactattgtttcagtgttcaagctgtgatacccagtcgcacagtgaaccggaaatccaccgatagtccggtcgagtgtatgggccaagaaaagggcgagttccgggagatattctatatcatcggggctgtagttttcgttgttattattctggtgataatacttgcaatctcgctgcataagtgtaggaaagctggagttggacagtcttggaaagagaatagtcctctgaatgtctcc

SEQ ID NO: 8708 - DNA, 885 bp, Artificial Sequence
  Description of Artificial Sequence: Synthetic coding sequence
atggagacacccgcttggccacgagtcccacggcctgaaactgccgtggcccgaacactcctactcggatgggtctttgcccaggtggccggggcttcaggaacaactaatactgtcgccgcttataacctcacttggaaatcaacaaatttcaaaacaatcttagaatgggaacccaaacccgtaaatcaggtctacacagtacagatcagtactaaatccggggattggaagtcaaagtgcttctacactacagatactgaatgcgatcttacagatgaaatcgtgaaagacgttaagcagacatatttggcgagggtgttcagttaccccgcagggaatgtggaaagtactgggtcagccggagagcccttatatgaaaattctcctgaatttactccatatctagaaacgaatctgggacagcccacaatacagtcttttgaacaggtaggaacaaaagtaaacgtgacagtcgaagatgagcgtacactcgtgaggcgcaataacacattcttgtcactgagagatgtctttggaaaagatctcatatatactttatattattggaaatcaagttcatcagggaaaaaaactgcaaaaactaatacaaatgagttccttattgatgtggacaaaggggaaaactactgtttctccgtgcaggccgtcataccctctagaacggtaaaccggaaaagtacagactctcctgtagagtgtatggggcaggaaaaaggggaatttagagagatattttatatcatcggggccgtggtgtttgttgtgattatccttgtcatcatccttgcaatctctctgcataaatgtagaaaagctggggtggggcagagttggaaagaaaactctcccctcaacgtttcc

SEQ ID NO: 8709 - DNA, 885 bp, Artificial Sequence
  Description of Artificial Sequence: Synthetic coding sequence
atggaaactcccgcttggcccagggtgccaagacctgaaaccgcagtggccaggactctgctccttgggtgggtttttgcacaggtggcaggagcaagtggcactactaataccgtggcagcatacaatctgacttggaagtccaccaacttcaagactattctggaatgggagcctaagcctgtgaatcaggtctacactgtgcaaatttcgacgaaatctggagactggaagtcaaagtgcttttacaccaccgacactgagtgcgatctgactgacgaaattgttaaagatgtgaagcaaacttatctcgcccgcgtctttagctaccctgccggaaacgtggagtccaccggatcggcgggagagccgctctacgaaaattcacctgaatttactccttacttggaaacgaacctgggccaaccaactattcagtcctttgagcaggtgggaaccaaggtgaatgtaaccgtcgaagatgaaaggactcttgtgcgccggaacaacaccttcctttcgctgcgggatgtgtttggcaaagatcttatctacaccctttactactggaaaagctcatcaagcggaaaaaagactgcaaagactaacactaacgaattcctcatagatgtggacaagggggaaaactactgcttttcggtccaggcagtgattccatcccgaactgtgaaccgaaaatcaactgattcccctgtggaatgtatgggacaagaaaagggcgaatttagagaaatcttctacatcatcggagccgtggtgttcgtggtcattattctcgtgattattcttgcaattagcctgcataagtgcaggaaagcaggagtgggtcaatcctggaaggaaaactcccccttgaacgtctct

SEQ ID NO: 8710 - DNA, 885 bp, Artificial Sequence
  Description of Artificial Sequence: Synthetic coding sequence
atggaaaccccagcatggcctcgggtgccacgtcccgaaaccgcggtggcacggaccttgctgctgggatgggtgttcgcccaggtggctggagcgtcgggaaccaccaataccgtggcagcgtacaaccttacctggaagtccaccaactttaagactattctggaatgggagcctaagccagtcaaccaagtctacactgtgcagatttctactaagtcgggcgattggaagagtaaatgtttttacacgacggataccgagtgtgatcttaccgacgaaattgtcaaggatgtgaagcaaacctacctggcaagggtgttctcctacccagcaggaaacgtggaatcgaccggatcggccggcgaaccgctgtacgaaaactcgcccgaatttaccccataccttgaaactaatcttggccaacctactattcaatcatttgagcaggtcggtactaaagtgaatgtcacggtggaagatgaacggaccctggtgagaaggaacaatacctttctgtcccttcgagacgtctttggaaaggacttgatctacactctttactactggaagtcgagctcctcaggtaagaaaactgcaaagaccaacactaacgagtttcttattgatgtggataaaggcgagaattactgtttcagcgtgcaggctgtcataccatccaggaccgtgaatagaaaaagcaccgatagcccagtcgagtgtatgggccaagaaaaaggtgaatttagagaaatcttttacataattggcgccgtggtgttcgtggtcattattctggtgattatacttgcaatttcgctgcataagtgtcggaaagcaggcgtgggacaaagctggaaggaaaactcgcctctgaatgtgtcg

SEQ ID NO: 8711 - DNA, 885 bp, Artificial Sequence
  Description of Artificial Sequence: Synthetic coding sequence
atggaaactcccgcgtggccacgagtgccgcgcccagaaacggctgttgcacgaacactgttgttgggctgggtgttcgcccaggttgccggcgctagtggcactactaacacggtggccgcctacaacctgacatggaaaagtacgaacttcaagaccatcctggagtgggaacctaagcccgtcaatcaagtctacacagtgcagatctctaccaagtcaggggactggaaatcgaagtgcttctacactaccgataccgagtgtgacctcacggatgagatagtcaaagacgtcaagcagacatatcttgcccgcgtgttctcttatcctgcgggtaatgttgaatccacagggagtgctggcgaaccattatacgagaattcccccgagttcacaccttatctggagactaaccttggccaacctactattcaatcatttgaacaggtgggtactaaagtcaatgtcacagtggaggatgagaggactctggttaggcggaacaacacctttttaagtcttcgcgacgtgttcggaaaggatctgatatacacactctactactggaagagctcctcaagcgggaagaagactgcgaagactaacacaaacgagtttcttatagacgtagacaagggagagaattactgcttttctgtgcaggccgtgattcccagcaggacggtgaaccgcaagtccacagattctccggtcgagtgtatgggtcaggagaagggtgagtttcgggagatcttctacatcatcggagccgtggtgttcgtcgtcatcatcttggtgatcatacttgccatcagtctccataaatgtaggaaggccggcgttgggcagtcctggaaagagaatagtccattaaacgtgtca

SEQ ID NO: 8712 - DNA, 885 bp, Artificial Sequence
  Description of Artificial Sequence: Synthetic coding sequence
atggaaactcccgcctggcctcgcgttccaaggcctgagactgctgtggcccgaaccctgctgctggggtgggttttcgcccaagtcgccggcgctagtggaactactaacaccgtggcagcctataacttaacctggaagtccacaaattttaaaaccatactggaatgggagcctaagccagtgaatcaggtctatacagtccaaatctcaactaagagcggcgattggaagtctaagtgtttctacacaaccgacaccgaatgtgacctgacagacgagattgtcaaagacgtgaagcagacttacttggcccgcgtctttagttatccagctggcaacgtggagtctaccgggagcgccggtgaaccactgtacgagaattcaccagagtttactccttatttggaaacaaatctcggccagcccaccatccagagcttcgagcaggtgggcaccaaggtcaatgtcaccgtcgaggacgagagaacactagtcagacgaaataatacctttctgtctttacgggacgtatttggtaaagatctgatctacaccctctactattggaaaagttcttctagcgggaaaaagaccgctaagacaaacaccaacgaatttctgatagacgtggataagggggaaaattattgctttagcgtccaggccgtgatacctagtcgtaccgtaaaccggaaaagcaccgatagcccagtggagtgcatgggccaggaaaaaggcgaattccgcgagatattttatatcatcggagccgtggtcttcgttgttatcatcttagtgatcatcctggctatatcactgcacaaatgtagaaaggcaggcgtgggccaaagctggaaggagaacagtccactgaatgtgagt

SEQ ID NO: 8713 - DNA, 885 bp, Artificial Sequence
  Description of Artificial Sequence: Synthetic coding sequence
atggaaacgccggcgtggccgcgagtaccgcgtccggaaacggcggtagcgcgaacgttactactaggttgggtttttgcgcaagttgcgggtgcgtcgggtacgacgaatacggtagcggcgtataatctaacgtggaaatcgacgaattttaaaacgatattagaatgggaaccgaaaccggtaaatcaagtttatacggtacaaatatcgacgaaatcgggtgattggaaatcgaaatgtttttatacgacggatacggaatgtgatctaacggatgaaatagttaaagatgttaaacaaacgtatttagcgcgagttttttcgtatccggcgggtaatgttgaatcgacgggttcggcgggtgaaccgttatatgaaaattcgccggaatttacgccgtatttagaaacgaatttaggtcaaccgacgatacaatcgtttgaacaagttggtacgaaagtaaatgtaacggttgaagatgaacgtacgttagtacgtcgaaataatacgtttttatcgttacgtgatgtatttggtaaagatttaatatatacgttatattattggaaatcgtcgtcgtcgggtaaaaaaacggcgaaaacgaatacgaatgaatttttaatagatgttgataaaggtgaaaattattgtttttcggttcaagcggttataccgtcgcgaacggtaaatcgtaaatcgacggattcgccggtagaatgtatgggtcaagaaaaaggtgaatttcgtgaaatattttatataataggtgcggtagtatttgtagttataatactagtaataatattagcgatatcgttacataaatgtcgtaaagcgggtgttggtcaatcgtggaaagaaaattcgccgctaaatgtatcg

SEQ ID NO: 8714 - DNA, 885 bp, Artificial Sequence
  Description of Artificial Sequence: Synthetic coding sequence
atggagacgccagcctggccacgcgtcccacgaccggaaacagccgtggcccggactctcttgcttgggtgggtgttcgcacaggtcgcaggcgcttcgggaaccactaacactgttgccgcctacaacctgacatggaaatccactaattttaaaacgatcctggagtgggagcccaaacctgtgaaccaggtttacacagtgcagatctcaaccaagagcggagattggaaatccaagtgcttctatacgacggatacagagtgtgacctcacagatgagattgtgaaggacgtgaagcagacttatctggcgagagtgttctcataccctgcaggcaatgtcgagtctacaggcagcgctggcgaacccctgtacgagaactcccccgagttcacaccttatctggaaactaacttgggccaaccaacgatccaatcgtttgagcaggtagggactaaggtgaacgtgaccgtggaagatgaaaggactcttgtccgtaggaacaacacttttctgtctttacgagacgtgttcgggaaagaccttatttatactctctactactggaagtcttcatcctctggtaaaaaaaccgccaaaaccaacacaaatgagtttttgattgatgtggataaaggcgaaaattactgttttagtgtgcaggccgtgattccctctaggacggtcaaccgaaagtccactgactctcctgtcgaatgtatgggccaggaaaaaggagagtttagggaaattttttacattattggagctgtcgtattcgtcgtgattatcctcgtgatcatcctggcgatctcactgcataaatgcaggaaggctggtgtgggccaatcatggaaggagaatagccccctgaacgtttca

SEQ ID NO: 8715 - DNA, 885 bp, Artificial Sequence
  Description of Artificial Sequence: Synthetic coding sequence
atggaaacccccgcatggccacgtgtgccccgaccggaaaccgccgtggcgcggaccctcctgttgggttgggtatttgcgcaagtcgctggcgcaagcgggactacaaacactgttgccgcctataatctcacatggaaatcgacaaactttaaaacaatcctagagtgggaacctaagccggtgaaccaggtgtacactgtgcagatatcaaccaaatccggcgactggaaaagtaagtgcttttacactactgatactgagtgtgatttgactgacgagattgtcaaagacgtgaaacagacatatctggctagggtgtttagttaccccgccggcaacgtcgagagcacagggtccgccggagagcctctgtatgagaacagtcctgagtttacgccttacctcgagactaatctaggccagccaacgatccaaagctttgaacaagtgggcactaaggtcaacgtgactgtggaggacgagcggactttagttcggcggaataatacatttctatcattacgggacgtgtttggtaaggatctgatttacactctgtattactggaaaagctcttccagcggcaaaaagactgctaagacaaacacaaatgagtttctgatcgacgtagataagggcgagaattactgcttttctgtgcaagccgtcattccaagtcgtacagtgaaccgcaagtccaccgatagccctgtagagtgtatgggtcaggaaaagggcgagtttcgtgagatcttctatattatcggggcggtggtgttcgttgttattattctggtgattatcctcgccattagcttacacaagtgtcgtaaggccggagtgggccagtcgtggaaggaaaactcacctctgaatgtatct

SEQ ID NO: 8716 - DNA, 885 bp, Artificial Sequence
  Description of Artificial Sequence: Synthetic coding sequence
atggagactccagcttggccgcgcgtgccccgcccagaaaccgccgtggcaaggaccttgctgttggggtgggtctttgcccaggtggccggcgcttccggaacaacaaacactgtcgcagcttacaatctgacctggaagtcaaccaatttcaaaacaattctggaatgggaacctaaacctgtgaatcaggtgtatacagtgcagataagcaccaagagcggagactggaaatcgaaatgtttttacacaacagacacagaatgcgacctgacagacgagatcgtgaaagacgtgaagcagacgtatcttgcccgcgtgttctcttaccctgctggcaacgtggagagtactggctcggccggagagcccctgtacgagaactcacctgagtttaccccatacttagagaccaacctgggccagccaacgattcagtcctttgagcaggtgggtacgaaagtcaatgtgacagtggaggatgagagaacactcgtgcgcaggaataatacctttctgtctctcagggatgtgttcggcaaggatctgatttacacactttactattggaaatcgtcaagctccggaaaaaaaaccgcaaaaactaatactaacgagttcctaatcgacgtcgataaaggcgaaaactattgcttcagcgttcaggccgtgatccccagtcggactgtaaacagaaagtcaactgactcacccgtggaatgcatgggccaggaaaagggtgaattcagggaaatattttacattattggggccgtcgtgttcgtggtgatcattcttgtgattatattggcaatttctctgcacaaatgccggaaagccggagtaggacagtcttggaaagagaactctccactgaatgtgtca

SEQ ID NO: 8717 - DNA, 885 bp, Artificial Sequence
  Description of Artificial Sequence: Synthetic coding sequence
atggaaacaccggcctggccacgggtgcctcggcctgagacagctgtcgcccgtaccctgctgttggggtgggtgttcgcccaggtagcgggcgcttctgggacaactaacaccgtggccgcatataatctgacctggaaatctaccaacttcaaaaccattcttgaatgggaaccgaagccggtcaatcaggtgtatactgtgcagatcagtacaaagtcaggcgactggaagagtaaatgcttctacacaaccgacaccgagtgtgacctcacagacgaaattgtgaaggacgtgaagcagacttacttggccagagtgtttagctatcccgcaggcaatgtggagagtaccggcagtgctggcgagccgctgtacgagaactcgcctgaattcacaccttatctggagaccaacctcggccagccaacaattcagtcttttgaacaggtgggcacgaaggttaatgtgacagtcgaggacgagcggacccttgttcggcgaaacaacaccttcttgtctctaagagatgtgttcgggaaggacttaatttataccctttattattggaaatcctctagctctggaaaaaagaccgccaaaactaacacaaacgagtttctcatagacgtggataagggcgaaaattactgcttttccgtgcaagctgtcataccatcccgtaccgtaaaccgcaagtcaaccgatagcccagttgagtgcatgggccaagaaaagggagagtttcgggaaatcttctatattatcggggccgtcgtttttgtggtgattatcctggtcataattcttgccatctcactacataaatgccgcaaggccggtgtggggcagtcctggaaagagaactctcccctaaatgtcagc

SEQ ID NO: 8718 - DNA, 885 bp, Artificial Sequence
  Description of Artificial Sequence: Synthetic coding sequence
atggaaacccctgcgtggccgcgggtgccgcgcccggaaaccgccgtggccaggaccctgctgttgggctgggtgttcgcacaggtggcaggcgcatcgggaaccaccaatactgtcgccgcttacaacctcacttggaagtccaccaacttcaaaacgatcctcgagtgggaacctaagccggttaatcaggtctacacggtccaaatttcgactaagtctggcgattggaagtcaaagtgcttctacaccactgacaccgagtgcgacctcactgatgagatcgtgaaggacgtcaagcaaacttatctggcgcgggtgttctcctacccagccggaaacgtcgagagcactgggtcggcgggagaaccattgtatgaaaactcaccggaatttactccgtacctcgaaactaacttgggacagccgactatccagtctttcgaacaggtgggcactaaagtcaatgttaccgttgaggacgagagaactctcgttagacggaacaacacctttctgtcgcttcgcgacgtttttgggaaagatctgatttacaccctctactactggaagtcctcgagcagcggcaagaaaacggcaaaaactaataccaatgaattcctgattgacgtggacaaaggtgagaactactgcttcagcgtccaagcggtgatcccaagccggaccgtgaatcgcaagtccactgatagcccggtcgagtgtatgggtcaagagaagggagagtttcgcgagatattctacatcatcggagctgtcgtattcgtcgtgatcatcctggtaatcatcctggccatcagcctgcacaaatgcaggaaggccggagtcggtcagagctggaaggaaaattcccccctgaacgtgtcc

SEQ ID NO: 8719 - DNA, 885 bp, Artificial Sequence
  Description of Artificial Sequence: Synthetic coding sequence
atggaaacgcctgcctggccaagagtccctcgtcccgagactgccgtagcgcgaactttattattaggatgggttttcgctcaagtcgccggcgctagcgggacaaccaacaccgtcgccgcctataatttgacctggaagagcacgaatttcaagacaattctggagtgggagccgaaacctgtaaaccaggtgtacacagtgcagatttcaacgaagtcaggtgactggaagagcaagtgcttctataccacggataccgaatgtgatttgacggacgagatcgttaaggatgttaaacaaacctatttggctagggtgtttagctacccagccggcaacgtcgaaagcacaggctcagccggggagcctctgtacgaaaacagccccgagttcactccttatctggaaacgaacctaggtcaaccaacaatccagtcatttgaacaagtgggcacaaaggtaaacgttacagtggaagatgagagaacactggtgaggcgcaacaataccttcctctccctccgagatgtatttggtaaggaccttatttatacactgtattattggaagtccagcagcagcgggaagaagactgctaaaacgaacactaacgagtttttaatcgatgtggataaaggagagaattattgctttagcgtgcaggccgtgatcccaagcaggaccgtgaaccgtaagagtacagattcgccagtggaatgcatgggccaggaaaaaggagaattcagggagatcttctacattatcggagccgtcgtgtttgtggtgattattctggtgataattctggccatctcactacataagtgtagaaaagcgggagtcggccagtcttggaaggagaactctcctctgaacgtgagt

SEQ ID NO: 8720 - DNA, 885 bp, Artificial Sequence
  Description of Artificial Sequence: Synthetic coding sequence
atggagacccctgcatggccgcgcgtacctagacccgagacggccgttgcccgaaccctgctgctcggctgggtcttcgctcaggtggctggtgccagcggaaccaccaacaccgtagccgcctacaaccttacatggaagtccacgaacttcaagacaattctcgagtgggagcctaagcccgtgaatcaagtttacacagtacaaatctccactaagagtggcgattggaagagtaaatgcttttatacgacagataccgagtgtgatctgacagacgagatcgtgaaagatgttaagcaaacatacctggctagggtgttttcataccccgcaggtaatgtcgaatccactggaagcgccggggaaccactgtacgagaactctcctgagttcactccctacctggaaacaaacttgggtcagcctacaatacagagcttcgagcaggtggggacgaaggttaacgttactgttgaggatgagaggacattggtgcgtaggaacaacactttcctgagcctgcgggacgtgttcggaaaagaccttatctacaccctgtattattggaagagtagcagctccgggaagaaaactgctaaaaccaacacaaatgagtttctcatcgatgtcgacaagggtgagaactactgcttttccgttcaggctgttattccgagtaggaccgtgaacagaaagtcgacggactccccggtcgaatgtatgggccaggagaagggggaatttagggagatcttctacatcattggagcagtggtctttgtcgtgatcattctggtcatcattctcgccatcagcctccacaagtgtaggaaagccggtgtagggcagtcttggaaggagaactcacctttaaacgtgtct

SEQ ID NO: 8721 - DNA, 885 bp, Artificial Sequence
  Description of Artificial Sequence: Synthetic coding sequence
atggaaaccccagcctggccgcgggttccacggcccgaaacggccgtggcaaggaccttgttgctcggatgggtgtttgcccaggtcgccggggcatccggtactaccaacaccgtggccgcctacaatcttacttggaagtcaaccaactttaagaccatacttgaatgggaacccaagcctgtgaatcaagtctacaccgtgcaaatcagcaccaaatccggtgactggaaaagcaagtgtttctacactaccgatactgagtgtgatctgaccgatgagattgtgaaggacgtgaaacagacttacttggcacgcgtgttttcctaccctgcaggaaacgtggagagtactggatctgctggagaacctctgtacgaaaacagccctgagtttaccccatatcttgaaactaatctgggacagcccaccattcaatcctttgaacaggtgggcactaaagtcaacgtcaccgtggaggacgagagaactcttgtcagacgcaataacaccttcctttccctcagggatgtgttcgggaaggatcttatctataccctgtactactggaaatcctcctcctcgggtaaaaagaccgcaaaaactaacacgaatgaatttctgatagacgtggataagggtgaaaactactgtttctctgtccaagccgtgataccctcccgcaccgtgaataggaagtcaactgattcccctgtagaatgtatgggacaagaaaagggtgaatttcgggagatcttttacatcattggcgcagtcgtctttgtggtcattattctggtgattatcctggccatttcgctccataaatgtcgcaaggcaggagtcgggcagagctggaaggaaaactcacctcttaacgtctcc

SEQ ID NO: 8722 - DNA, 885 bp, Artificial Sequence
  Description of Artificial Sequence: Synthetic coding sequence
atggaaacgccagcctggcccagagtcccacgcccagagactgcggtcgctagaacactactattgggctgggtattcgcgcaggtggctggcgctagcggcaccactaacactgtcgccgcgtataatctgacttggaaatcaactaactttaaaacaattctggaatgggagccaaagccagtcaatcaagtgtacacggttcaaataagcaccaagtctggagactggaaatcaaagtgtttttatacaacagacaccgaatgtgacctcaccgacgaaatcgtaaaggacgtcaaacaaacgtatctagctcgagtcttcagttatcccgccggtaatgttgaatctactgggtctgcaggagaacccctgtacgagaactctcccgaattcaccccttatctggagaccaaccttggacagcccaccattcagagtttcgagcaggtcggaaccaaagtgaacgtaacagtggaggacgaaagaaccctggtgcgacgaaacaacaccttcttatcgctgagggacgtgtttggcaaagatcttatttacaccctgtattactggaagtctagttcctctggcaagaagacagctaaaacgaatacaaatgagttcctgattgatgtcgataaaggcgaaaactactgtttctccgttcaggcagtgattccatccaggacagtgaaccggaagagcacggacagtccagtagaatgcatgggtcaagagaagggggagtttcgtgagattttttatatcattggtgcagtggtgttcgtggtaataatcctcgtgattatcttggcaatttcactacataagtgccgaaaagccggcgtcggacagtcgtggaaggagaactcgcccttaaacgtcagt

SEQ ID NO: 8723 - DNA, 885 bp, Artificial Sequence
  Description of Artificial Sequence: Synthetic coding sequence
atggagacgcctgcgtggccacgagtgccaagaccagaaaccgcagtggcacggactctcctgctgggttgggtgtttgcccaagtggcaggcgcaagcggcaccaccaacactgtggctgcatataacctcacttggaaatcgaccaactttaagacgatcctggagtgggagccaaagccagtcaatcaagtgtacaccgttcaaatatcaactaaatccggtgactggaagtcaaagtgtttttacactaccgataccgaatgtgacttgaccgacgaaatcgtgaaggacgtgaaacaaacctacctggcccgcgtgttctcctaccccgctgggaatgtggagtcaactggcagcgccggagagccgctgtacgaaaactcgcctgagtttaccccctaccttgaaactaacctcgggcaaccgaccattcagtccttcgaacaggtcgggaccaaggtgaatgtgacggtggaagatgaacgtactctggtcaggagaaacaatactttcctgtcccttcgggatgtgtttggaaaagatctgatctacaccctttactactggaaaagctcaagctcagggaaaaagacggcaaaaactaacactaacgagtttctcatagatgtcgataaaggagaaaactactgtttcagcgtgcaagcagtcattccttctcgtactgtcaataggaaaagcactgattcacccgtcgaatgcatgggacaggagaagggagagtttagagaaatcttttacatcattggcgccgtggtctttgtcgtgattatacttgtgattattctcgcaatctcgttgcacaagtgccgtaaagcaggagtcggacagagctggaaagaaaattcaccccttaacgtgtcc

SEQ ID NO: 8724 - DNA, 885 bp, Artificial Sequence
  Description of Artificial Sequence: Synthetic coding sequence
atggaaactccggcatggccacgggtgcctcgacctgaaaccgcagtggcgagaactctgctcctcggatgggtttttgcgcaggtggcaggcgcctccggaacgacgaacactgtcgcggcgtacaacttgacctggaaatctacgaatttcaaaactatactggaatgggagcctaaaccagtcaatcaggtctacaccgttcaaatttcaacgaagtccggagactggaagagcaagtgtttttacaccaccgataccgagtgtgacctgactgacgaaatagtcaaggatgtgaaacagacttatcttgcaagagtgtttagctacccagccggaaacgtggagtccactggaagcgccggagagccactctacgaaaactcgcccgaatttactccttaccttgaaactaatcttgggcaacccaccatccaatccttcgagcaagtcggtactaaagttaacgtgactgtggaggacgagagaaccctcgtgaggagaaataacactttcctgtcgctgcgagacgtctttggaaaggacttgatatacactctgtactactggaagtcgtcgtcctccgggaaaaagaccgccaaaactaataccaatgaattcctgattgatgtggataaaggtgaaaactactgcttttcggtgcaggcagtgattccctcgagaactgtgaatagaaagtcgactgactcaccggtggaatgcatgggtcaagaaaagggcgagttcagagagatcttctacattatcggagcagttgtgtttgtggtcattattcttgtcatcattcttgctatcagcctgcataagtgcagaaaggccggcgtcggccagtcctggaaagaaaactctccacttaacgtgagc

SEQ ID NO: 8725 - DNA, 885 bp, Artificial Sequence
  Description of Artificial Sequence: Synthetic coding sequence
atggagactccagcctggcccagggtgcctcgtccagagaccgccgtggcccgcaccctgctccttggatgggtctttgcccaagtcgccggggcttctggcaccacaaacacagtggctgcatataacttgacttggaaatcaactaacttcaaaacaatcttagagtgggaacccaagcccgttaaccaggtgtacacagtccagatctccacaaagagtggggattggaagtcaaagtgcttctatacaacagataccgaatgcgatcttacagacgaaattgttaaggacgtcaagcagacctacctggcccgagtgttttcctacccagccggaaacgtggagtctactgggtcggccggggagccgttgtatgaaaactcgcccgagttcaccccgtatctggagaccaacctgggccagcccacaatccagtcgttcgagcaggtaggtaccaaggtcaatgtgaccgtggaggatgagcgaacgctcgtgcgccgcaataataccttcctgtccttacgcgacgtttttggaaaggatctgatctacacgctgtattactggaagtcctcatcgagtggaaagaaaactgccaagaccaatacgaacgagtttctgatcgatgttgataaaggcgaaaactactgcttcagcgtgcaggcggtcatcccaagccgcacagtcaatagaaagtctaccgattcacccgtagaatgcatgggacaggagaaaggggaatttcgcgaaatattctatatcataggagccgtggtatttgtagtgattatcctagtcattatattggccatttcactccacaaatgtcgcaaggccggagtggggcaatcatggaaggagaacagcccactcaacgtgagc

SEQ ID NO: 8726 - DNA, 885 bp, Artificial Sequence
  Description of Artificial Sequence: Synthetic coding sequence
atggagactcccgcctggccacgggtgcctcgcccggaaaccgccgttgcccgtacccttctcttgggctgggtgtttgctcaggtggcaggcgcgtcgggaaccacgaacaccgtggccgcctacaaccttacctggaagtctaccaacttcaagactattctggagtgggagccgaaaccagtgaatcaggtctacactgtgcagatctcgacgaagagcggtgattggaagagcaagtgcttttacactacggatactgaatgtgaccttactgacgagatcgtgaaggacgtgaagcaaacctacttggcacgcgtcttttcttacccagcaggaaacgtcgagagcactggaagcgcgggagagccactctacgagaactcgcctgaattcactccttacctcgaaactaatttgggccagccaactatccaatcattcgagcaggtcgggactaaggtcaacgtgaccgtggaagatgaacgcactctggtgcgccggaacaataccttcttgtcgctcagagacgtctttggaaaagatctgatctacactctttactattggaagtcatcctcctcgggaaagaaaacggctaaaactaacactaacgagttcctgatcgacgtggacaaaggtgagaattactgcttctccgtccaggcggtcatcccgtcgagaactgtgaatcgaaagtccaccgacagccctgtggaatgcatgggccaggaaaagggggaattccgggagatcttctatatcatcggagccgtggtgtttgtcgtcattatcttggttatcatcctcgccatctcgctccataaatgtaggaaggccggggtgggacagagctggaaggagaactcaccgctcaatgtgtcc

SEQ ID NO: 8727 - DNA, 885 bp, Artificial Sequence; identical to SEQ ID NO: 8679
  Description of Artificial Sequence: Synthetic coding sequence

SEQ ID NO: 8728 - DNA, 885 bp, Artificial Sequence
  Description of Artificial Sequence: Synthetic coding sequence
atggaaacgcccgcttggcctcgggtcccaagacccgagacggctgtagcccggactctgctgctcggatgggtgttcgctcaggtagcgggcgcttccggcactaccaacaccgtagccgcctataacttgacatggaagtccacaaactttaagacgatccttgagtgggagcctaaacccgtcaatcaagtatatacagtgcaaatcagcactaagtctggggattggaaatccaagtgtttctataccaccgatacagaatgcgacctgaccgacgaaatcgtgaaggacgtgaagcagacctacttggcgcgggtgttctcataccctgccgggaacgtcgagtccactggtagtgcgggtgagcctctgtacgaaaactcaccagagtttaccccctacctcgagacaaacttaggccagcctactatacagagcttcgaacaggtcggaactaaggtcaacgttaccgtggaggatgagcggactctcgttcggcgaaataatacctttctgtccctgcgtgacgtattcggaaaggatctcatatatacgctttattactggaaatcaagttccagtggcaaaaagaccgcgaagactaataccaacgagtttttaatcgacgtggataagggagaaaactattgcttctccgtccaggcagtcatcccctccaggactgtgaaccggaagtcgactgattcacccgtcgaatgcatgggccaggaaaagggtgagttccgcgagatcttttacattattggcgccgtagtcttcgtggtgataatcctggtaattatcctggctatatccctgcacaagtgtcggaaagcgggagtgggccagtcatggaaagaaaactctcctctgaatgtgtcc

SEQ ID NO: 8729 - DNA, 885 bp, Artificial Sequence
  Description of Artificial Sequence: Synthetic coding sequence
atggaaacccctgcatggcccagggtgcctcgtccagaaactgcagtggcaaggacgcttctgttgggatgggtgttcgcccaagtggccggggcgagcgggacgactaacaccgtggccgcatacaatctgacctggaagtcgacgaatttcaagaccatactcgaatgggaacctaagccggtgaatcaagtgtacaccgtccaaatttcgaccaagagcggagactggaaatctaagtgcttctacaccacggacactgaatgtgacctcaccgatgaaattgtgaaggatgtaaaacagacttatctggctcgggtattctcctacccagccgggaacgtggagtcgactggtagcgcgggagaaccactttacgaaaattcaccagaatttactccctacctggaaactaacctgggtcagcctactatccagtcatttgagcaagtgggcaccaaggtaaacgtcactgtcgaagatgagcggactctggtccgccggaacaataccttcctgtcactccgtgatgtctttggtaaagatttgatttacaccttgtattactggaagtcgtcctcatcggggaaaaagacggcaaagactaataccaacgagtttctgatcgatgtcgacaagggcgaaaactactgcttttccgtgcaggcagttatcccgagtagaaccgttaacagaaagtcaacggattcccccgtcgagtgtatgggtcaggaaaagggcgagtttcgcgagattttctacattattggagctgttgtctttgtggtgataatcctcgtgattattcttgcgatatcacttcataaatgtcgaaaagccggtgtgggtcaatcctggaaggagaattcgccactcaacgtgtcc

SEQ ID NO: 8730 - DNA, 885 bp, Artificial Sequence
  Description of Artificial Sequence: Synthetic coding sequence
atggaaactcccgcatggcctagggtgccacggccagaaacggctgtggcacgtactctgctccttggatgggtgttcgcgcaagttgccggtgcctccggaactaccaacaccgtggccgcatacaatctgacgtggaaatccactaactttaagaccattcttgaatgggaacctaagccagtgaaccaagtgtacaccgtccagatctcgaccaagtcgggtgattggaagtccaagtgtttttacaccaccgataccgaatgcgatctcactgatgagattgtgaaggatgtcaagcaaacctacctggctcgcgtgttcagctacccagcaggcaacgttgagagcactggatcggctggggaacctctgtacgaaaactcgccagaatttacgccatacctcgagactaatcttggccagccgacgatccaatcatttgagcaggtgggtaccaaagtcaatgtcaccgtggaggacgagcggaccctggtcagaagaaacaacacctttctgtcccttagagatgtgtttggaaaagaccttatctacacgctttactactggaaaagcagctcatcaggaaagaaaaccgcaaagactaacaccaacgaattcctgattgacgtggataagggcgagaactattgtttttccgtgcaagctgttattccgagccggactgtgaacagaaaaagcaccgattcgcctgttgaatgcatgggacaagaaaagggagagttccgtgagatattctacataattggcgcagtcgtgtttgtcgtgattattctcgtcattatcctggcgatttccttgcataaatgccgtaaggccggggtgggacagtcgtggaaggaaaattcaccactcaatgtctca

SEQ ID NO: 8731 - DNA, 885 bp, Artificial Sequence
  Description of Artificial Sequence: Synthetic coding sequence
atggagactccggcttggcctagggtgccgcggcctgaaactgctgtggctcgcactctccttctgggctgggtgtttgcccaggtcgcaggagcctccggaacgactaacaccgtggccgcgtacaatctgacctggaagtcgacgaatttcaaaaccatcttggagtgggaacctaaaccggttaatcaggtttacaccgtgcaaatctcgaccaagtcaggtgattggaagtccaagtgcttctacaccactgacacggaatgcgaccttactgatgaaatcgtgaaggacgtgaagcaaacttacttggcccgggtcttttcatacccagcgggcaatgtggagtctactggctccgctggagaaccactctacgaaaattcgccggaattcaccccctatctggaaactaacctcggtcaaccaactatccagtcattcgagcaggtcgggaccaaagtcaacgtaaccgtggaggacgagcggaccctggtccggcgcaacaacactttcctgagccttcgcgacgtgttcgggaaggatttgatatacaccctgtactactggaaatcgagctcgtcaggaaaaaagaccgcaaagacgaacaccaacgaatttctcattgacgtggacaagggcgaaaactactgcttctctgtccaggccgtgatcccaagtcgcactgtgaacagaaagtcgactgatagcccggtcgagtgcatgggacaagagaaaggagaattcagagaaatcttctacattatcggagccgtcgtgtttgtcgtgattatactggtgatcattctggccatctctctgcacaagtgtcgaaaggcgggggtaggacagtcttggaaggagaattccccgctcaacgtgtcg

SEQ ID NO: 8732 - DNA, 885 bp, Artificial Sequence
  Description of Artificial Sequence: Synthetic coding sequence
atggaaactccagcctggccacgggtccctagacccgagaccgcagtggccaggacgctcctcttagggtgggtgttcgctcaggtagctggagcgtccggaaccaccaacactgtggcagcctacaatctgacttggaaaagcaccaactttaagacaattctcgaatgggaaccaaaacccgtcaaccaggtgtatacagttcagatcagtaccaaatctggggactggaagagcaagtgtttctacaccaccgatactgaatgcgatctgaccgacgaaatcgtgaaagacgtgaaacaaacgtacctcgcccgggtgtttagctaccccgccggcaacgtcgaatcaaccggaagcgccggagagccgctctacgaaaacagtcctgagtttacgccctatctggaaacaaatctcggacagcccaccatccaaagtttcgagcaggtggggacaaaagttaacgttacagtggaggacgaaaggactctcgtaagaagaaataacacattcctaagcctgagggatgtatttgggaaggatcttatatacaccctgtattactggaagagcagttccagcggaaaaaagactgctaagactaacaccaatgagtttctgatagacgtggataagggggagaactactgcttttcagtacaggccgttataccttcccgtaccgtcaaccggaagtcaactgatagcccggttgagtgcatggggcaggaaaaaggcgagtttcgcgaaatcttctatatcattggagctgttgtgtttgtggtgattatcttggttataattctggccataagcctgcacaagtgtagaaaagcgggcgtaggtcagagttggaaggagaactcccctcttaatgtgtcg

SEQ ID NO: 8733 - DNA, 885 bp, Artificial Sequence
  Description of Artificial Sequence: Synthetic coding sequence
atggaaacccccgcttggcctagggtgcctcgtcctgagacagcggttgcacgaaccctgctgctgggctgggtcttcgcacaagtcgcaggtgcaagcggtacaacaaataccgtcgccgcctacaacctcacctggaagtctaccaactttaagacaattctggagtgggaaccgaagcccgtgaatcaagtgtacaccgtccaaatctctacaaagagcggagactggaagagtaagtgcttctacaccaccgatactgaatgcgacctcaccgatgaaatagtaaaagacgtgaaacagacctatcttgccagggttttctcttacccagctggcaacgtggagagcactggctcagcaggggagcccctttacgaaaacagccccgaatttactccatatctggaaacaaatcttggacaacccaccatccaatcattcgaacaagtgggaaccaaagtgaacgtgactgtggaggacgagaggaccttggtgaggagaaacaacacctttctgagcttgagggatgtgtttggcaaggacctgatatatactctgtactactggaagtcatccagtagcggcaagaaaacagctaaaacaaataccaatgagtttctcatagacgtggacaaaggtgagaattattgcttcagcgtccaagctgttatcccctctcgaacagtcaaccgcaaaagcaccgactcgcctgtggagtgcatgggacaggagaagggggagtttcgtgaaatattttacatcatcggggctgttgtcttcgtggttatcatattggtaattatcctggcgatcagcctgcataaatgcaggaaagccggagtggggcagtcatggaaggagaacagtcccctcaatgtcagc

SEQ ID NO: 8734 - DNA, 885 bp, Artificial Sequence
  Description of Artificial Sequence: Synthetic coding sequence
atggaaacacctgcgtggccccgtgttccacggccggagaccgcagtggcaagaacactgttgcttggttgggtgttcgcacaggtagccggcgcgtccggcaccacgaatacggtggctgcctacaacctgacttggaagagtaccaattttaaaaccatcctggaatgggagcctaagcccgtgaaccaggtgtatacagtccaaatatcaaccaaatccggcgactggaagtctaaatgcttttataccacggatacagaatgtgatctgacagacgaaatagtgaaagatgtgaagcagacatatcttgcacgtgtgttttcctaccccgccggcaatgtggagagcacgggcagcgccggtgagccactgtatgaaaatagccccgagtttacaccgtatctcgaaaccaacctggggcagccaaccatccagagtttcgaacaggttgggaccaaggtgaatgtgacagtggaagacgaacgaactcttgtcagacgcaacaatacgtttctgtcgctgcgggacgtattcggcaaagatctgatctacaccctctactattggaagagtagtagtagtggaaagaagaccgctaaaactaacacgaatgagtttcttatcgacgtggacaaaggagagaattactgcttttcagtgcaggcagtcatcccatcaaggactgtaaatcggaagtctacagattctcccgtggagtgcatgggtcaggaaaagggagaatttagggaaatattttatatcattggggccgttgtgtttgtcgtcatcattctagtgatcatcttggcgattagtctccacaaatgtcggaaggccggtgtagggcagtcctggaaggagaatagtccattaaacgtctct

SEQ ID NO: 8735 - DNA, 885 bp, Artificial Sequence
  Description of Artificial Sequence: Synthetic coding sequence
atggagaccccagcctggcccagggtgccgcgccctgaaacggccgtggctcggacacttttgcttgggtgggtctttgcccaagtggctggagcctctggtaccaccaacactgtagctgcgtataatctaacctggaagtcgacaaacttcaaaactatactggagtgggagccaaaaccagtgaaccaggtgtacactgtccagatttccactaagagcggggactggaagtctaagtgcttctatacaactgacacggagtgtgatcttacggacgagatcgtgaaggacgtgaagcagacataccttgccagagttttctcataccctgccggtaatgtcgagtcaaccgggagcgcaggagaacccctgtatgaaaactccccagaatttaccccctacctggagaccaacctcggtcaacccaccattcaatctttcgaacaagtgggcaccaaggtaaatgtaaccgtggaggacgaaagaaccctggtgcggagaaacaacaccttcttatccctcagggatgtcttcggtaaagatctgatatatacactctactattggaaatcttctagctctggcaagaagacagccaagactaacaccaacgagttcctcatagacgtggacaaaggtgagaattactgtttttcagtacaggcggtgataccttcccgcacagttaatagaaagagcaccgactctcccgtggagtgcatgggacaggaaaaaggggaatttagggaaattttctacattataggggctgtggtgttcgtggttataatactcgtaatcatactcgccatctctttacataagtgccgtaaggccggcgtcggtcagtcctggaaggagaactcccccctgaatgtttcc

SEQ ID NO: 8736 - DNA, 885 bp, Artificial Sequence
  Description of Artificial Sequence: Synthetic coding sequence
atggaaaccccagcgtggcctcgcgttccccggcccgagacagccgtggctagaacactgctcttgggatgggtgtttgcccaggttgctggcgcctcaggtaccactaacacggtggcggcttacaacctaacttggaagagtacgaatttcaagaccatcctggaatgggaacctaaaccagtgaatcaggtctacaccgtgcagataagtacaaagtcaggggactggaagagcaaatgcttttatacaaccgatacagaatgcgatctcacagacgaaattgtgaaggatgtcaaacagacctaccttgcacgggttttttcctatccagcggggaacgtggagtccaccgggtctgctggtgaacccctgtacgaaaacagccctgagttcactccgtaccttgaaaccaatctaggacagccaaccatacagagttttgaacaagtgggaactaaagtcaacgtgacagtggaggatgagagaactcttgtcaggcgtaacaatacttttctatccctgcgagacgtatttgggaaggatctgatttatactttgtactattggaaatcaagctcatctggcaaaaagacggctaaaacgaacaccaacgagttcctgattgacgtggataagggtgaaaattattgctttagcgttcaggccgtgataccctctcgtaccgtcaaccggaagtcgactgacagtcccgtggaatgtatgggccaagaaaagggagagtttagagaaatcttctacatcattggcgcagtcgtgttcgtggtaataattctggtaattattttagcaatttccttacacaaatgtcgaaaagctggagtagggcagtcctggaaggagaattcacctctcaacgtgagt

SEQ ID NO: 8737 - DNA, 885 bp, Artificial Sequence
  Description of Artificial Sequence: Synthetic coding sequence
atggaaacacctgcatggcccagagtgccccgcccagaaaccgcggtagcgagaacgctgctcttaggttgggtcttcgcacaggttgccggcgcttccggtactaccaatacagtggccgcctataatctaacctggaaatctaccaacttcaaaaccatcttagaatgggagcccaaacccgtcaaccaggtctataccgtccaaatcagtaccaagagcggagactggaagtctaagtgtttctatacaacagatacagagtgtgacctgactgatgagatcgtgaaggacgtcaagcagacgtacctggcacgcgttttcagctatcccgctgggaatgtggagagcaccggctcggccggcgagcccctttatgagaattcccctgaatttacgccgtatctggagacaaacctggggcagcccaccattcagagctttgaacaagtgggtactaaggtgaacgtgaccgtggaagacgagcggacattggttcgccggaacaacaccttcctatcattgcgcgacgtcttcggcaaggatctgatatacaccctatactactggaaaagctcgagctctggaaagaagacagccaaaacaaataccaatgagttcttgatagacgtggataaaggagagaactattgtttctctgtgcaagccgttattccttcacgtactgttaacagaaagtctacagactcaccagtggaatgcatgggccaggaaaagggcgagttccgagagatcttttatatcataggggctgtggtgttcgtagtgatcatcttggttatcattttggccatctccttgcataagtgcagaaaggcaggagtgggtcagtcctggaaggagaactcacccctcaacgtgtct

SEQ ID NO: 8738 - DNA, 885 bp, Artificial Sequence
  Description of Artificial Sequence: Synthetic coding sequence
atggaaaccccagcctggccgcgcgtgccccggcccgaaaccgccgtagcgcgaactctcctgctcggttgggtgttcgcgcaagtggcaggagcatccggcaccaccaacaccgtggctgcttacaacctgacttggaagtcgactaacttcaagaccatccttgaatgggagcctaagccggtgaaccaagtgtataccgtgcagatctctaccaaatccggagattggaagtcgaagtgcttttacacgactgatactgagtgcgacctcactgacgagatcgtgaaggatgtaaagcagacctacctggcccgcgtgtttagctatcccgccggaaacgtggaatccaccggcagtgccggggagccgctctacgaaaactcaccagagttcaccccttacctcgaaactaacttggggcagccgacgatccaatccttcgaacaagtgggaacgaaagtcaacgtaaccgtcgaggatgaaaggactctggtccgcagaaacaataccttcctgagcctgcgggacgtgttcggcaaggatctgatttacacgttgtactactggaaatcgagctcgagcggaaagaaaaccgcgaaaacgaacactaatgagttcctgatcgacgtcgacaaaggggaaaactactgcttttcagtccaggccgtgatcccttcccgaactgtcaatcgcaagtcgactgactcgccggtcgaatgtatgggtcaggaaaagggagaatttcgggagattttctacatcattggagctgtggtgttcgtcgttatcatcctggtgatcatcctcgcaatcagcttgcacaagtgcagaaaagcgggtgtgggtcagagctggaaggagaattccccactgaatgtgtcc

SEQ ID NO: 8739 - DNA, 885 bp, Artificial Sequence
  Description of Artificial Sequence: Synthetic coding sequence
atggagacaccggcctggcctcgcgtcccgcgtcctgagaccgcagtagcgaggacgctactattagggtgggtcttcgcgcaagtcgcgggagcatccgggaccactaacaccgtggccgcctataatcttacatggaagtcgaccaactttaagactatcttggagtgggaacctaagcctgttaaccaggtttacaccgttcagatcagtactaaaagcggggattggaagagcaagtgtttctacaccaccgataccgaatgtgatcttacggacgagattgtcaaggatgtaaagcaaacctaccttgcgcgcgtcttttcgtatccggctggtaacgtcgagtcaaccggttccgccggggagccattgtacgaaaactctccggaattcacaccatatttggagactaacctgggccagcctacaattcaatcttttgagcaagtcggtaccaaggtgaatgtcactgtcgaagatgagcgtactctagtgagacgtaataatacattccttagtctgcgagacgtgttcggtaaagatctcatctataccctttactactggaagagttcctcttccgggaaaaagaccgctaagaccaacactaacgagttccttattgatgtcgataagggagaaaactattgtttctccgtacaagctgtgatcccaagtcggactgtgaaccgcaaatctaccgacagtccggtagagtgtatgggccaagagaagggggaatttcgcgagatcttctacattattggtgctgttgtttttgtcgttatcatcctggttatcattctcgcaatctcgctgcataaatgtcgcaaagctggtgtgggacagtcctggaaggaaaattctcctttgaacgtcagt

SEQ ID NO: 8740 - DNA, 885 bp, Artificial Sequence
  Description of Artificial Sequence: Synthetic coding sequence
atggaaacccctgcgtggccacgagtgcctaggccagagactgccgtggcacgaaccctgctgctgggttgggtgttcgcacaagtcgccggagcatccggtactactaacaccgtcgcagcttacaatctgacttggaagtcaaccaacttcaaaacgatcctggagtgggagccaaagccagttaatcaagtctacacggtgcagatttccaccaaatccggtgactggaagtcgaagtgtttttacaccaccgatactgaatgcgatcttactgacgaaatcgtgaaggatgtgaagcaaacgtaccttgcacgcgtatttagctaccccgcaggaaacgtggaaagcaccggatcggccggtgaaccactgtacgaaaactcgcctgagttcactccatatctcgaaaccaaccttggacagcctaccattcaatcttttgaacaagtgggaaccaaggtgaacgttacggtcgaggatgagagaacccttgtgaggcggaacaatactttcctgtccctgcgagatgtctttggtaaagatctgatttacaccctttactattggaagagctcgtcgtctggaaagaaaactgcaaaaacgaataccaacgaatttcttatcgatgtggacaagggcgagaattactgtttttcggtgcaagcggtcattccttcacgaactgtgaatcgcaaaagcaccgactcgcctgtggagtgtatgggccaggaaaaaggcgaatttagagagatcttctacataatcggggcagtggtctttgtggtgattattcttgtcattatcctcgcgatctcgctccacaagtgcagaaaggctggtgtggggcaatcatggaaggagaattcgcccctgaacgtgtct

SEQ ID NO: 8741 - DNA, 885 bp, Artificial Sequence
  Description of Artificial Sequence: Synthetic coding sequence
atggaaaccccggcttggccgcgcgtcccgaggcccgagacggcggttgcacgcactcttctgctcgggtgggtgttcgcgcaggtggccggtgcgtcaggaactaccaacactgtggcggcatacaatctgacttggaagtcgaccaatttcaagactatactcgaatgggagccgaagcctgtgaaccaggtgtacaccgtgcaaatctccaccaaatctggagactggaagagcaaatgcttctacaccacggacaccgaatgcgatctgacggatgagatcgtcaaggacgtgaagcaaacgtacctggccagagttttctcgtaccccgcgggaaacgtagaaagcaccgggtcggctggtgagccgctgtacgaaaacagcccagaattcactccatacttggagactaatctcggtcagccgactattcagtcgttcgaacaagtggggactaaagtcaacgtcaccgtcgaagatgagcgaaccctggtgagacgtaacaacacgtttttgagtctgcgcgatgtgttcggaaaggatcttatctacactctgtattactggaaatcgtcgagtagcggtaaaaagaccgcaaagaccaataccaacgaatttctcatcgacgtcgacaagggagaaaactattgcttcagcgtgcaggctgtgatcccatcaaggactgtcaatcggaagtccactgactcccctgttgaatgtatgggccaggaaaagggcgaattccgcgagatcttttacatcatcggagccgtggtttttgtggtcattatcctggtcatcattctcgctatctcactccacaagtgccgcaaagccggagtcggccaatcctggaaggagaacagccctttgaatgtgtcg

SEQ ID NO: 8742 - DNA, 885 bp, Artificial Sequence
  Description of Artificial Sequence: Synthetic coding sequence
atggagaccccagcttggccccgagtgccaaggccagaaaccgccgtcgcacggactctcctactgggatgggttttcgctcaggttgctggcgcttccggcacaactaatacagtagccgcctacaatctgacctggaagtcgacaaatttcaagacgatcctagagtgggagccaaagcctgtgaaccaggtgtacacagtacagatcagcaccaaatcgggagactggaaaagcaaatgtttttacactaccgacacggaatgtgacctgacggacgagatcgtaaaagatgtcaaacagacctatctggcacgagttttcagctaccctgccggcaatgtcgagagcaccggcagtgccggcgagccactctatgaaaactcgcccgaattcactccctatctggaaacaaatctcggccagcccaccatacagtcctttgagcaggtcggcaccaaggtgaatgtgactgtggaagatgagaggacactggttagacggaataacacatttctgtccttacgggacgttttcggcaaggatttgatctatactctctattactggaaatcaagctcatccggcaagaagacggcaaaaaccaacacaaacgagttcttgattgatgttgacaagggcgaaaactattgcttcagtgttcaggctgtgattccatccagaacagttaacagaaaaagcaccgattcccccgtggaatgtatgggccaggaaaaaggggagttccgggaaattttctatataatcggagccgtggtgtttgtggtgataatcctagttatcattctggccatctccctgcataaatgccggaaggcgggggtcggacagagttggaaggagaattccccgctgaatgtgagc

SEQ ID NO: 8743 - DNA, 885 bp, Artificial Sequence
  Description of Artificial Sequence: Synthetic coding sequence
atggaaacacccgcctggccgcgcgtacctaggcccgagactgccgttgcaaggaccctgctgctgggctgggtatttgcgcaggtggcaggggcctccggcactacgaatacagtggctgcatacaacctgacctggaagagcacgaactttaagacgattttagaatgggagcccaagcccgtgaatcaggtttacacagtgcaaatttcgacaaagtcgggcgactggaagtctaagtgcttctacactacagacacagaatgcgacctgactgatgaaatagtaaaagatgtcaagcagacgtatctggcacgagtgttttcctaccccgcgggcaacgtggagagcactggctcggcaggagagcctttgtacgagaatagtcccgaattcacaccctatcttgaaaccaacctgggccaaccgacaattcagagtttcgagcaagtgggaactaaagtaaatgtcacagtggaggacgaacgtaccctcgttcgacgcaataacacttttctctctctcagagacgttttcggcaaggacttaatctataccctgtattattggaagagtagcagctcgggcaagaagacggcgaagacaaataccaatgagtttctgatcgacgtggataaaggcgagaattattgtttcagcgtgcaggcggtgataccatccagaactgtaaaccggaagtctacagatagtccggttgagtgcatgggtcaggagaaaggcgagtttcgggagatattctacattattggcgccgttgttttcgtcgtgatcatcctcgtcatcatcctcgctatcagcctccataagtgtcgcaaggccggggttggacaatcttggaaagaaaatagtcccctgaacgtctcc

SEQ ID NO: 8744 - DNA, 885 bp, Artificial Sequence
  Description of Artificial Sequence: Synthetic coding sequence
atggagacgcctgcctggccccgggtgcctcgcccagaaaccgcagtcgcacgcactctgcttctggggtgggtgtttgcacaagtcgcaggggcatcaggtactaccaatactgttgccgcatacaatctgacttggaaatccacgaactttaagaccatactggaatgggaacccaagcctgtcaaccaagtgtacactgtccagatctccactaaatccggtgactggaaaagcaagtgtttttacacgactgatactgaatgtgacctgaccgatgagatagtgaaggacgtcaagcaaacttacctcgcacgagtgttctcgtaccccgccggtaatgtggaatcgactggttcagcgggagagcctctctacgagaactcgcctgaatttactccttaccttgaaactaacttgggacaacccaccattcaatcgtttgaacaggtgggaactaaggtgaatgtcaccgtcgaggacgaaagaactcttgtcagaagaaacaacactttcctttcactccgcgatgtctttggcaaggatctgatttacaccctttactactggaaatcttcgtcatcaggaaaaaagactgcaaagactaatactaacgagttccttattgatgtggacaaaggggagaactactgtttttctgtgcaagccgtgataccatccaggacggtgaaccgcaagtcgactgatagcccagtcgaatgtatgggtcaagagaagggagaatttcgggagatcttctacatcatcggcgcagtggttttcgtcgtgattattctggtgatcattctggcaatttcactccataagtgccggaaggccggtgttggtcagtcatggaaggagaatagccccctgaacgtgtcg

SEQ ID NO: 8745 - DNA, 885 bp, Artificial Sequence
  Description of Artificial Sequence: Synthetic coding sequence
atggaaactccagcgtggccgcgcgtgccccgccccgaaactgcagtggctaggaccctccttctcggttgggtctttgcacaggttgctggtgcttccgggactacgaataccgtggcggcatataatctcacatggaaaagtacgaacttcaagacgattttggagtgggaacccaagcctgttaatcaggtgtacactgtgcagatctcaacaaaatctggggattggaaatccaaatgcttctacacgacggacaccgagtgtgaccttaccgatgagattgtaaaagacgtgaaacagacctacctggcacgagtattctcctacccagccggtaatgttgagagcacgggctccgcaggagagcctctgtatgaaaatagccccgaattcacaccctacttggaaacaaatttgggccagcctaccatacaatcctttgaacaggttggcactaaagtgaatgtaacagtggaggacgaaagaacactggtcagacgaaataatacattcctgtctcttcgggacgtcttcgggaaagatttgatttatacactctactattggaagtcttcttcttctggaaagaagaccgcaaaaaccaataccaatgagttcctgattgatgttgacaaaggcgaaaattactgtttttctgtacaagctgttattccgtcccgcactgtgaaccggaaaagcaccgactcccccgttgagtgcatgggtcaggagaaaggtgagttcagagaaatattctacataattggcgctgtggtctttgtcgtaatcattctcgtgatcattcttgctatcagtttgcacaagtgccgcaaggctggagtcggtcagagctggaaagagaatagcccgttgaacgtatcc

SEQ ID NO: 8746 - DNA, 885 bp, Artificial Sequence
  Description of Artificial Sequence: Synthetic coding sequence
atggagacccccgcctggccacgcgtgccccgacccgagacagctgtggccagaacactgctcctggggtgggtgttcgcccaggtggcgggggcctccgggacaacaaacaccgtagccgcttacaacctgacctggaaaagcaccaacttcaaaaccattcttgagtgggaaccaaaaccagtcaaccaggtctatacagtgcagatctccacaaagagtggagattggaagagcaaatgtttttatacaactgataccgaatgtgacctgacagacgaaatcgtgaaagatgtcaaacagacttacctcgcccgggttttttcttaccccgccgggaacgtagagtctacggggtccgcgggggaaccactgtacgagaattctcccgagtttacaccttatctcgagactaatctgggccagcccacgattcagtccttcgagcaggtgggaacaaaagtaaatgtcaccgttgaggatgagaggacacttgtgagaagaaataacacctttctgtctcttagggacgttttcgggaaggaccttatctacaccctgtactattggaaatcatcctcaagtggcaaaaagacagcaaagaccaatactaacgaattccttatcgacgtggataagggcgagaactattgcttctccgtgcaggccgtaatcccgagccggaccgttaatcggaagtccaccgatagccctgtagagtgtatgggccaggaaaaaggggaattccgggaaatcttttatatcatcggtgcggtagtgtttgttgtcatcatacttgtgatcattctcgccatcagtctgcataaatgtcgcaaggcgggggtcggccagagctggaaggagaactcaccactgaacgtgagc

SEQ ID NO: 8747 - DNA, 885 bp, Artificial Sequence
  Description of Artificial Sequence: Synthetic coding sequence
atggaaactccggcgtggccaagggtgcccaggccagaaacggctgtggctcgcacactgctgttgggctgggtgtttgcccaggtagcaggagcctcaggaacaactaacaccgtcgcggcatataacctgacctggaagagtacaaacttcaaaacaattctggagtgggaacctaagcctgtgaaccaagtgtacacagtgcagatttctactaaatctggcgattggaagagcaagtgtttttatacaacagataccgagtgcgacctgaccgacgagattgtgaaggatgtgaagcagacttacctggctagagtttttagctatcctgcgggaaacgtggaatctactggctccgctggtgaacccctctacgagaactcaccagaatttacgccatacctagagactaaccttggtcagccgaccatccagtctttcgagcaggtgggcaccaaggtgaacgtcaccgtggaagacgagaggactctcgttcgaaggaacaatacttttctgagtttgagagatgtgttcggcaaagatttgatttacaccctttattactggaagtcgtcgagcagtggcaaaaaaacggccaagactaatactaatgaatttctcatcgacgtggataagggcgagaactattgcttctcggtgcaagccgtgattcctagtcggacagtcaaccgaaaaagtaccgacagtccagtcgagtgtatggggcaggaaaaaggagaatttcgagaaatcttctacattattggcgctgtggtgttcgtggttatcatactcgtgataatcctcgctataagtctccataagtgcaggaaagccggcgtcggccagagctggaaagaaaatagccctcttaatgtgtca

SEQ ID NO: 8748 - DNA, 885 bp, Artificial Sequence
  Description of Artificial Sequence: Synthetic coding sequence
atggaaacccctgcatggccacgggtgcctcgccccgagactgctgtcgcacgtactcttctgcttggatgggtctttgcacaagtggctggtgcttccggaacgactaatacggtggcagcgtacaatctgacgtggaagtcgaccaactttaagactatcctcgaatgggagcctaaacccgttaatcaggtgtacaccgtgcagatttcgaccaagtcgggagactggaaatctaaatgtttttacacgaccgatacggaatgtgatctgactgatgaaattgtcaaagatgtcaagcagacctaccttgccagggtgttctcctacccagccgggaatgtggaatcaaccggaagcgccggagaaccgctttacgagaactccccagaatttaccccttatctcgaaaccaacctgggacagccgaccatccagtcattcgaacaagtgggaactaaggtgaatgtgactgtggaggacgaacggaccctcgtgcggcgtaacaatacctttctttcccttcgggacgtctttggaaaagatttgatttacactctgtactactggaaatcctccagctccgggaaaaagactgcgaaaactaacaccaacgagtttcttattgacgtcgataagggagagaattactgcttttcggttcaagccgtgattcctagcagaaccgtgaacagaaagtctactgattcgcctgtggaatgtatggggcaagaaaaaggcgaatttcgggagatcttctacattattggagcagtcgtctttgtggtcattatacttgtgatcatccttgcaattagccttcataaatgtcgaaaggccggagtgggacagtcgtggaaggagaattcgcccctcaacgtgtct

SEQ ID NO: 8749 - DNA, 885 bp, Artificial Sequence
  Description of Artificial Sequence: Synthetic coding sequence
atggagacgcccgcatggccacgcgtgccaaggcccgaaacagctgtagcccggactctgctgctgggttgggtgttcgcccaggttgccggtgcaagcggcacgacaaacacagtggcagcgtacaatctgacgtggaagtcaaccaatttcaagactatcctcgaatgggagccaaaacccgtaaatcaagtttacactgttcagatttcaacaaaatctggcgactggaagagtaaatgtttttatactaccgataccgaatgtgatcttacggacgagatcgtcaaagacgtgaagcaaacgtacctggccagggtgttttcctatccagccggaaatgttgagtctactggcagcgccggagaaccgctttatgagaacagtccagagtttacgccctacctggagaccaacctcgggcagcctacgatccagtctttcgagcaggtggggactaaagtgaatgtgacagtggaagacgagaggaccctggtgagacgcaataacacttttctttcccttagggacgtcttcggcaaggacttgatttacacattgtattactggaagtccagcagctcagggaaaaagacagcaaaaaccaatacgaacgagtttctcatagacgtggacaaaggagagaactattgcttctctgtgcaggctgtaatccctagcaggactgtcaatcggaagagtactgacagcccggttgagtgtatgggccaagagaagggagaatttcgggaaattttctatatcatcggcgctgtcgtgtttgttgtcatcattctcgtgatcatcctggctatttctctgcataagtgtcggaaggctggggtcggccagtcttggaaggagaacagtcccttgaatgtatcc

SEQ ID NO: 8750 - DNA, 885 bp, Artificial Sequence
  Description of Artificial Sequence: Synthetic coding sequence
atggaaaccccggcctggcccagagtgccgcggcccgaaactgcggtcgcgcggaccctcctgctggggtgggtctttgcacaggtggcaggagcatcaggaaccaccaacactgtggcggcttacaacctgacttggaagtccaccaacttcaaaactatcctggagtgggaacctaagccggtgaatcaggtgtacaccgtgcaaatctcgaccaaatcgggcgactggaagtccaagtgcttctacacgactgatactgagtgcgacctgactgatgagatcgtgaaggacgtgaagcaaacctatctggcgcgcgtgttctcatacccggccggcaacgtcgaaagcaccggatcggccggagagcctctctacgagaacagcccagagtttaccccttacctcgagactaacctcggtcagccgaccatccaatcattcgagcaggtcggaacgaaggttaacgtcacggtggaggacgagagaaccctggtgcggcgcaacaatacctttctgtcactgcgggatgtgttcgggaaggatctcatctacactctgtactactggaagtcgtcgtctagcggtaagaaaactgctaagactaataccaatgaattcctgatcgacgtggacaagggagaaaactactgcttcagcgtgcaggccgtgatcccaagtcggactgtgaatagaaagtcgactgacagcccggtcgaatgcatgggccaggaaaaaggcgaattccgcgaaatcttttacatcatcggcgccgtggtgttcgtagtgatcatcctggtcatcatcctcgcgatctcgctgcacaagtgccgcaaagcgggtgtgggacagtcgtggaaggagaattcgccgttgaacgtgtcg

SEQ ID NO: 8751 - DNA, 885 bp, Artificial Sequence
  Description of Artificial Sequence: Synthetic coding sequence
atggagactccagcctggccccgcgtgcctagaccagaaacagccgttgcacgcactttgctcctagggtgggtctttgcccaagttgccggcgcctccggcacaacaaacactgtcgccgcctataatctcacatggaaatctaccaattttaaaaccatactggagtgggaaccgaagcctgtgaaccaagtctatactgtccagatttccaccaagagtggcgattggaagtctaaatgtttctacaccaccgatactgaatgtgacctcaccgacgagatcgtcaaggatgttaagcagacatatctggcacgggtcttctcataccctgcagggaatgttgagtctacaggctcagctggggagcctctctatgagaattcacctgagtttaccccctacctggagacaaacctcggccagcccacgatccaatccttcgaacaggtaggcacgaaggtgaacgtcaccgtggaggatgagcggacactcgtgaggaggaacaacacattcttgagtctgcgggatgtgtttggcaaggacctcatctataccctttactactggaagtcgtcatccagcggcaagaagacagcgaaaaccaatactaatgagttccttatcgacgtagacaagggcgagaactactgcttctctgtgcaggccgttattccaagccgaaccgtcaataggaagtctacagattcgcctgtggagtgtatggggcaggagaagggcgaattccgggaaatcttctatataattggggccgttgtgtttgttgtcataatcctcgtgatcattttggccatctcccttcacaagtgtagaaaggccggtgtgggccagagttggaaagagaattctcccctaaacgttagc

SEQ ID NO: 8752 - DNA, 885 bp, Artificial Sequence
  Description of Artificial Sequence: Synthetic coding sequence
atggaaactcctgcgtggcccagagtcccgcggcctgagactgccgtggcccgcactctgttgctgggttgggtgtttgcacaggtggctggagctagcggaactactaataccgtggccgcgtacaacctgacttggaagtcaactaacttcaaaaccatcctggagtgggagccaaagcctgtcaaccaagtgtataccgtccaaatctccaccaaaagcggcgactggaagtccaagtgcttctacaccaccgatactgaatgtgacctgactgatgaaatcgtgaaggatgtcaagcagacttatctcgcgagagtgttcagctacccagctgggaacgtggaatccactggatccgccggcgaacctctgtacgagaattcgccagagttcactccctacctggagactaacttggggcagcccactatccagagcttcgagcaggtgggtactaaagtcaacgtcaccgtggaggatgagcgcaccctggtccgtcgcaataacactttcctttcacttcgcgacgtttttggaaaggacctcatctacacgctgtattactggaaatcttcatcctccggaaaaaagaccgcgaaaaccaacactaatgagttcctgatcgatgtggacaaaggagagaactactgcttctcagtgcaagcggtgatcccgtcgagaaccgtcaaccgcaagtcgacggactcgccggtggagtgcatgggccaggagaagggtgagtttagagagattttctacatcatcggagcagtggtgttcgtagtgattatcctcgttatcatcttggcaatctcccttcacaagtgtcgcaaagccggggtcggacaatcgtggaaggagaactcacctctcaatgtgtcc

SEQ ID NO: 8753 - DNA, 885 bp, Artificial Sequence
  Description of Artificial Sequence: Synthetic coding sequence
atggagacgccagcatggccacgggtcccaagaccagaaaccgcagtcgcgcgcaccctgctgctcgggtgggtgttcgcccaggtcgccggagctagtggcaccactaataccgtggcggcgtacaacctgacttggaagagcacgaatttcaaaactatcctcgagtgggaacctaagccagtgaatcaggtgtacactgtgcagatctcaaccaagtcgggagattggaagagcaagtgcttctacactaccgacaccgagtgcgatcttactgacgagatcgttaaagacgttaaacagacctacctcgcccgcgtgttctcgtacccagctggtaacgtcgaatcgaccgggtcggcgggagaacctctgtacgagaactccccggaattcactccgtatctcgaaactaacctgggccaacccaccatccaatctttcgaacaggtcggcaccaaagtgaacgtcacggtggaagatgaacggactctcgttcgcagaaacaatacctttctgtcgcttcgcgacgtgtttgggaaggatctgatatacaccctgtactactggaaatcgtcgtcgagcggaaagaaaactgccaagaccaataccaacgagttcctcatcgatgtcgacaagggagagaattactgtttctcggtgcaagcagtcattcccagccggactgtcaaccggaaaagcactgactcaccggtggaatgcatgggtcaggagaaaggagaattccgcgagatcttctatatcatcggagccgttgtctttgtggtgatcattcttgtgattatcctggcgatctcgctgcacaaatgcaggaaggcgggagtcggccagtcctggaaggaaaattctcctctgaacgtgagt

SEQ ID NO: 8754 - DNA, 885 bp, Artificial Sequence
  Description of Artificial Sequence: Synthetic coding sequence
atggagacaccggcgtggccccgagtaccgcgaccagagaccgccgtcgcgagaactcttctgctcggctgggtcttcgcccaggtggccggggcctccgggactactaacactgttgctgcctacaacctcacttggaagagcacaaacttcaagactattctggagtgggagccaaaacctgttaaccaggtgtatacagtgcagatctccactaagtctggggactggaaatcaaaatgcttttataccactgacactgagtgcgacttgaccgacgagatcgtgaaggatgtgaagcaaacatacttggcgcgcgtgtttagctatccagccggcaacgtggagagtactgggtctgccggcgagccactttacgagaattctccggagttcaccccgtacctggagactaacctgggccaacccacgatccaaagctttgaacaagtcggcaccaaagtgaacgtgaccgtggaagacgagagaaccttagtaaggcgcaacaatacctttttgagtctgagagacgtgttcggtaaggacctgatttacacactttattactggaagtccagctcaagcggaaaaaaaaccgccaagactaacacaaacgagtttttgatcgacgttgacaagggggaaaattactgtttcagcgtccaggccgtgatcccctctcgcaccgtgaatcggaaaagcaccgattcacccgtagaatgcatggggcaggaaaaaggcgagtttcgggagatcttttacatcatcggcgccgttgtgttcgttgtcatcatcctagtaatcattcttgcgatctctttacacaagtgccgcaaggccggcgttgggcagtcatggaaggagaatagcccgctcaatgtcagc

SEQ ID NO: 8755 - DNA, 885 bp, Artificial Sequence
  Description of Artificial Sequence: Synthetic coding sequence
atggaaacccccgcctggcctcgcgtgccacgccccgagaccgctgtggcccgcacattgctgctgggatgggtgttcgctcaagtagctggcgcctcaggaactacaaacaccgtggccgcctacaacctgacatggaaatcaaccaacttcaagacaattttggaatgggagcccaagcccgtgaaccaggtgtacacagttcaaatttcaacaaaatccggagactggaagagcaagtgtttctacaccacagatacagaatgtgatctgacagatgagatcgttaaagacgtgaaacagacttatttggcacgcgtattctcttatcccgccggaaacgtggaatcaaccggaagtgcaggcgagcccctctatgaaaattctcctgagtttactccttatctggagactaatctgggccagcccacaatacaaagcttcgagcaggtgggcaccaaagtgaatgttaccgttgaggacgagagaacccttgtgcgtaggaacaacacattcctgagccttagagacgtgttcggtaaggacctcatctacacactgtattattggaagagcagtagcagcggaaaaaagactgcaaaaaccaacactaatgagttcctcatagacgtcgacaagggcgagaactattgcttttctgtgcaggcagtgatcccttctagaactgtgaataggaagtcaaccgactcacccgtggaatgcatgggacaggagaaaggcgagtttcgtgaaatcttttacatcattggtgccgtcgtattcgttgtgataattctcgttatcatactggccattagcctgcacaagtgtaggaaagcaggcgtgggccaaagctggaaggagaactctcctctgaacgtcagt

SEQ ID NO: 8756 - DNA, 714 bp, Artificial Sequence
  Description of Artificial Sequence: Synthetic coding sequence
atggagacgccagcgtggcctagagtgcctaggcccgagaccgccgtggccagaaccctgctgcttggttgggtctttgcccaggtagcaggagcaagtgggacaactaacaccgttgccgcctataaccttacctggaaatctactaactttaaaaccatcttggaatgggagcccaaaccggtgaatcaagtgtatactgtgcagatctcgacaaagagtggcgactggaaatccaagtgcttttacacgaccgataccgaatgtgatctgacggacgaaatagtgaaagacgtcaagcagacatatctcgcgagggtgttctcttatccagctgggaatgtggaaagcacaggaagcgcaggcgaacccctttacgagaatagtcccgagttcacaccctaccttgagaccaacttggggcagcccactatccagtctttcgagcaggttggtactaaggtgaatgtgacggttgaggatgagcgcacactggttcggaggaacaacactttcttgagcttgcgtgatgtgtttggcaaagacctaatttatactttatattattggaaatctagtagtagcgggaagaaatattctacaagcctagaattgtggtacctgtggtcctcgtctctgtctagtagttggctatacctctacacaagcgtggagaggcaggaatggggaagggctggcagacgaaccccacac

SEQ ID NO: 8757 - DNA, 714 bp, Artificial Sequence
  Description of Artificial Sequence: Synthetic coding sequence
atggaaacccccgcctggccacgggtgccaagaccagaaacggccgtggcacgcaccctgctccttggatgggttttcgctcaggtggcaggcgcaagtggaaccaccaataccgtcgcagcgtataacctgacttggaagtcgaccaacttcaagacgatccttgaatgggagcccaagcctgtcaaccaggtatacactgtccagatatccactaagtcgggtgattggaaatcgaaatgcttttacaccaccgataccgagtgtgacctcacggatgagatcgtaaaggatgtgaagcagacttacctcgcgagggtgttttcgtacccggcgggaaatgtggaatctactggttcggcaggagaaccactttacgagaacagccctgagtttaccccttacctggaaacgaacctgggtcaacctaccattcaatcattcgaacaagtgggaaccaaggtgaatgtgactgttgaggacgaaagaactctcgtccgtcgcaacaatacctttctttccctgcgtgacgtgtttggaaaggatctgatttacacgctgtactactggaaatcctcctcttccgggaaaaagtactccacgagcttggaactgtggtacttgtggtccagctcactttcgtcgagctggctgtatctctacacttccgtggaacggcaagagtgggggcgggcaggcagacgaactccccat

SEQ ID NO: 8758 - DNA, 714 bp, Artificial Sequence
  Description of Artificial Sequence: Synthetic coding sequence
atggagacacctgcctggccaagggtccccaggcccgagaccgccgtcgccagaacacttctactggggtgggtctttgcacaggtggcgggagctagcggcaccaccaacacagtggcagcatataatctcacttggaagtctaccaacttcaagacaatccttgagtgggagccaaagcccgtcaatcaggtgtatacggtgcagatctccaccaagagtggggattggaaatcgaaatgtttctacactaccgatactgaatgtgacctgacggacgaaatagttaaggatgtcaagcaaacctacctcgccagagtgttctcttatccggctggaaacgtagagagtacaggcagcgcaggcgagcctctgtatgaaaactcacctgaatttaccccttaccttgagacaaatctaggacagcccacaatccagtcgttcgagcaggtgggaacaaaagtgaacgtcaccgtggaagatgaaagaactctggtcagacggaataacacttttctttctttgcgggatgtgtttggaaaagacctgatttacacactctattattggaaatccagtagttcaggcaagaaatatagcacctcgcttgaactctggtacctgtggagctcaagcctatcctccagctggctatatctgtacactagtgtggagagacaggagtgggggagggcgggcagacgcaccccccat

SEQ ID NO: 8759 - DNA, 714 bp, Artificial Sequence
  Description of Artificial Sequence: Synthetic coding sequence
atggaaacacccgcatggccacgagttccccgacctgagaccgccgtcgctagaactctgttgctgggctgggtgttcgctcaggtggcgggtgcatctgggaccaccaatacggtcgccgcgtataacctaacgtggaagtccactaattttaaaactatcctcgaatgggaaccaaagcctgtcaatcaggtgtacacggtgcagatcagtacaaagtctggagactggaaaagcaagtgcttctatacaacagacactgagtgcgacctgaccgatgaaatagttaaggatgtaaagcagacctatctggctagagttttttcctatcctgccggcaatgtggagtcaacaggttcagctggggaaccactgtacgaaaactccccagagttcaccccgtaccttgagactaacttgggccagccgactattcaatctttcgagcaggttggcaccaaggtgaacgtcacagtagaagacgaaaggaccctggtgcgaagaaacaatactttcctgagcctgcgtgacgtgttcgggaaggacttaatttatacactctattactggaagtcatccagctcaggcaagaaatactccacttcactcgaattatggtacttatggtcctcgagtctgtcttcctcctggctgtatctgtacacatcagtggaaagacaggagtgggggcgtgcaggaagaagaactcctcac

SEQ ID NO: 8760 - DNA, 714 bp, Artificial Sequence
  Description of Artificial Sequence: Synthetic coding sequence
atggaaacccctgcgtggccgagggtgccgcggccagagactgctgtcgcaagaactctcctcctgggatgggtgttcgcacaggtcgcgggcgctagcggtactaccaataccgtcgctgcctataacctgacctggaagtccactaatttcaagacgatcctcgaatgggaaccgaagccagtcaaccaagtgtacaccgtacagatttcgacgaagagcggcgactggaagtcgaagtgtttctacactactgatactgagtgcgatctgacggacgagatcgtgaaggacgtgaagcagacctacctggcaagagtgttctcctaccccgcgggaaatgtggaaagcactggttcagctggggagccgctgtatgaaaactccccggaattcaccccttacctcgaaaccaacctgggacagccgactatccagagcttcgaacaagtgggaaccaaagttaatgttaccgtggaggacgaacgcaccctggtcagacgcaataacacctttctctcgctccgtgatgtctttggaaaagatcttatctacacgctctactactggaaatcatcaagcagcggaaagaagtactcaacctccctggaactgtggtacctttggtccagctccctctcctcgtcctggctttacctctacactagtgtggagaggcaggagtggggtcgagcgggtcgccgcactccccac

SEQ ID NO: 8761 - DNA, 714 bp, Artificial Sequence
  Description of Artificial Sequence: Synthetic coding sequence
atggaaaccccagcctggccaagagtgccgcggccggaaaccgccgtggccaggactctgctgctcggttgggtctttgcacaggtcgcaggcgctagtggaactacgaatactgtggccgcttacaacctgacttggaagtccacgaacttcaaaactatcctggagtgggaacccaagcctgtgaatcaggtgtacaccgtgcaaattagcacgaagtccggggattggaaaagcaagtgcttctacaccacggacacggaatgtgacctgaccgatgaaatcgtgaaagacgtgaagcagacctacctcgcgcgcgttttcagctacccagcaggaaacgtcgaatcaacgggaagcgcgggagaaccgctgtatgagaatagcccggagtttaccccgtatctggagactaacttggggcagccgactatccagtcctttgagcaggtcggcaccaaggtcaacgtgacggtcgaagatgaacgtactcttgttcgacggaacaacactttcctctcattgcgcgacgtgttcggaaaggatctgatatacactctctactactggaagtcgtcaagcagcggcaagaagtactcgacctcgttggaactgtggtacttgtggtcctcgagcctttcgagctcctggctctacctctacacgtcggtggagcgccaagaatggggccgggccggaaggagaaccccgcat

SEQ ID NO: 8762 - DNA, 714 bp, Artificial Sequence
  Description of Artificial Sequence: Synthetic coding sequence
atggagacaccagcttggcctagagttccaagaccagaaacagcagtcgctcgtactttacttctaggttgggtttttgcacaggttgctggagcaagtggaacaacaaataccgttgctgcttataatttaacatggaaatcaacaaattttaaaacaatacttgaatgggaaccaaaacctgttaatcaagtatatacagtacaaatttctactaaaagtggtgactggaagtcaaaatgtttttacactaccgatacagaatgtgatcttacagatgaaattgttaaagacgtcaaacaaacttatttagctcgagtcttttcttacccagctggaaacgtcgaatcaactggatctgcaggagaaccactttatgaaaattcacctgaattcactccatatcttgaaactaatttaggacagcctactattcaatcttttgaacaagttggaacaaaagtaaatgtaacagtcgaagatgaaagaacacttgttaggagaaataatacttttttaagtttaagagacgtttttggaaaagatttgatttatactctttattattggaaatcatcttcttctggtaaaaaatattcaacatctcttgaattatggtatctttggtcatcatcattatcatcctcatggctttatctatatacaagtgttgaaagacaagaatggggaagggctgggagaagaacaccacat

SEQ ID NO: 8763 - DNA, 714 bp, Artificial Sequence
  Description of Artificial Sequence: Synthetic coding sequence
atggaaactccagcgtggcctcgggtgcctcgccctgaaactgcagtggcaagaacgttgcttctcggctgggtctttgcccaagtcgcaggtgcatcaggaactactaatactgtcgcggcatacaacctgacttggaagtccactaactttaagactattctggagtgggagcctaaaccagtgaatcaggtgtacaccgtgcagattagcaccaagagcggagattggaaatccaagtgtttctataccactgatacggagtgtgacctcaccgacgagatcgtgaaggatgtgaagcaaacttacctcgcccgcgtgtttagctacccagctggcaacgtcgaatccaccggttcggcaggcgaaccattgtatgaaaacagccctgagttcaccccgtacctcgaaacgaatctgggtcaaccaaccatacagtccttcgaacaggtgggcactaaggtcaacgtgacggttgaagatgagcgaaccctggttcgtcgcaataacacgttcctttccctccgcgacgtgtttgggaaggatctcatctacaccctttactactggaaaagctcgtcatcaggcaagaagtactcaacttcgcttgaactgtggtacctgtggtccagctcattgtctagctcctggctttacctctacacctctgtcgaacgacaagaatggggaagagcaggacgacgcaccccacat

SEQ ID NO: 8764 - DNA, 714 bp, Artificial Sequence
  Description of Artificial Sequence: Synthetic coding sequence
atggagactcctgcttggccacgcgtgccaaggccagagacggctgtggcaaggactctgctgctgggatgggtgtttgcgcaagtggcgggagcatcgggcaccacgaacactgtggctgcttacaacctgacttggaaatcaacgaacttcaaaactatcctcgaatgggaacccaagccggtcaatcaggtctacactgtgcagatctcaaccaagtcgggcgactggaagtctaagtgtttctacaccaccgatactgagtgcgacctgacggacgaaatcgtgaaggacgtgaagcaaacttatctggccagggtgttcagctaccctgccggaaatgtcgagtcaactggcagcgccggcgagccgctctacgaaaattcacctgaattcactccgtacctggaaaccaacctcggacagccaaccatccagtccttcgagcaggttggcaccaaggtcaatgtaactgtggaggacgaacggacccttgtcagacgcaacaacacgttcttgtctctgcgcgatgtttttggcaaagatctcatctacactctttactattggaagagctcgagttcagggaagaagtactcgacctcgctggaactgtggtacctgtggtcatcctccctgtcctcttcgtggttgtacctttacacctccgtggaaagacaagagtggggccgggcagggcgtcgaaccccccat

SEQ ID NO: 8765 - DNA, 714 bp, Artificial Sequence
  Description of Artificial Sequence: Synthetic coding sequence
atggagacaccggcctggccccgcgtgccacggcccgagaccgccgtggcacgcacactcctactaggctgggtgttcgcacaggtggctggggcctctgggacaacaaatacagtggctgcatataatctcacgtggaaatctacaaacttcaaaacgattcttgagtgggaacccaagccagtgaatcaggtgtacaccgtgcaaatatcaacaaaaagtggcgattggaaaagtaagtgtttctatacgacagatacggagtgcgatctcaccgacgaaattgtaaaagacgtgaagcagacctatctggcacgcgtattctcatacccggccggaaacgttgaaagcacagggtccgccggtgagcctctatacgaaaactcacccgaattcaccccctacctggagacaaacttagggcagcctacaatccagagctttgagcaggtgggcactaaagttaatgtgacagtcgaagacgaaaggactctagttcggaggaataacacctttttatcccttagggacgtgttcggaaaggacctgatttacactctgtactactggaagtcaagcagctccgggaagaagtacagtacttccctcgaactatggtacctttggtcttcgtcattaagctctagttggctctacttatatacctccgtcgagagacaggagtggggacgcgctgggaggcgaaccccgcat

SEQ ID NO: 8766 - DNA, 714 bp, Artificial Sequence
  Description of Artificial Sequence: Synthetic coding sequence
atggaaaccccggcctggccgagggtcccgaggcctgaaaccgctgtcgcacgcacgttgttgcttggatgggtgttcgcccaggtggccggtgctagcggcacgactaacaccgtggcggcctacaatcttacttggaaaagcactaacttcaagactatcctggaatgggagcccaaacctgtgaaccaagtgtacaccgtccagatttctacgaagtcgggcgactggaaatccaaatgcttctataccaccgatactgaatgtgaccttactgatgagatcgtcaaggacgtcaagcaaacctaccttgcgcgcgtgttttcctacccagctggcaatgttgagtcgaccggatccgctggagaacccctctatgagaactccccagaatttactccatacctggaaacgaatctgggacagccgactatccagtcattcgagcaagtggggactaaggttaacgtgactgtggaagatgagcgcaccctcgtacgacgtaataacaccttcctgtcgctgcgggacgtattcggaaaggacctgatctacacgttgtactactggaaatcttcaagttcgggcaagaagtacagcacctccctggagctttggtacctgtggagttcctcgctgtcgtcctcgtggctgtacctgtacactagcgtggaacggcaggaatgggggcgggcgggaagaagaaccccgcac

SEQ ID NO: 8767 - DNA, 714 bp, Artificial Sequence
  Description of Artificial Sequence: Synthetic coding sequence
atggaaaccccggcctggccgagagtccctagaccggagactgcagtggcccgcactctgttgctcggatgggtgttcgcacaggtggcgggagcgtcaggaactaccaacacggtggctgcatataacctgacttggaagtcgacgaatttcaagaccatcctggaatgggaaccaaagccggtgaatcaggtctacaccgtgcaaattagcaccaaatcgggcgactggaaaagcaagtgcttctacactacggatactgagtgcgacttgacggatgagatcgtgaaggacgtgaaacagacctacctcgcccgggttttctcgtaccctgccggaaacgtggaatccactggatcggccggagaaccactctacgaaaactcgcctgaatttactccttatctggagactaatctgggtcagccaaccatccagtccttcgaacaggtggggactaaagttaacgtgactgtggaggacgagaggactctggtgcggagaaacaacacctttctctcattgcgcgatgtgttcggtaaagacctcatctacactctgtactattggaagtcatcatccagcggcaagaagtactccacttccctcgaactgtggtacctttggtcgtcgtcattgtcctcttcctggctgtacctgtacacttcggtggagaggcaggaatggggccgcgccggacggagaaccccgcac

SEQ ID NO: 8768 - DNA, 714 bp, Artificial Sequence
  Description of Artificial Sequence: Synthetic coding sequence
atggaaactccagcctggccccgcgtgccgcgcccggagactgccgttgccagaaccctgctcctgggatgggttttcgcccaagtggctggtgcctccggtaccaccaacactgttgcggcctacaacctcacatggaaatctacaaacttcaagacaatcttggaatgggagcctaaacccgtgaatcaggtctacactgttcagatctcaacgaagtctggtgactggaagtccaagtgcttttacaccacagacacagagtgtgatctgactgacgagatagtcaaggacgtgaagcagacttacttggctcgcgtattttcataccctgccggaaacgtcgagagcaccggatctgctggtgaaccactttacgagaatagtccagagttcaccccataccttgagactaatctgggacagcctaccatccagtctttcgagcaagtgggtacaaaggttaacgtcactgtggaagacgagaggactctcgtcagaaggaacaacacctttctgagtctgagagacgtctttggaaaagatctcatttacaccttgtactattggaaatcatctagctccggtaagaagtactccaccagtctcgaactctggtacctctggtcttcatccttgtcttccagctggttgtacctgtatacgagcgtggaaaggcaggaatggggcagagccggcagaagaacccctcat

SEQ ID NO: 8769 - DNA, 714 bp, Artificial Sequence
  Description of Artificial Sequence: Synthetic coding sequence
atggagaccccggcgtggccgcgggttcctcgccccgagaccgcagtggcaaggactctgctgcttggatgggtcttcgcacaggtggctggtgcctctggtacgacaaatacggttgcagcttacaacctgacatggaaatccacgaatttcaagacgattttggagtgggagcccaaacctgttaaccaagtttacaccgtgcagatctcaacgaaaagcggtgattggaagagtaagtgcttctacacaactgacacagagtgtgacctcaccgacgagatcgtaaaagacgtcaagcagacctaccttgcccgcgtgttctcctacccagccggtaacgtcgaatctacgggatcagcaggcgaacctctctatgagaattctccggagtttaccccatatttggaaactaacctgggacagcctaccatccagtcttttgagcaggtcggaaccaaggttaatgtgactgttgaggacgagagaacactggtcagacggaacaacaccttcctcagccttcgagacgtgtttggcaaggacttgatttacactctgtattattggaaatcctcctcttccggaaagaagtactccacctcacttgagctgtggtacctttggtcaagttccttgagtagttcatggctttacctgtacactagtgtggaaaggcaggagtggggccgagccggacgcaggacacctcac

SEQ ID NO: 8770 - DNA, 714 bp, Artificial Sequence
  Description of Artificial Sequence: Synthetic coding sequence
atggagactcccgcatggccccgcgttcccaggcccgaaacagctgtagctcggaccctgcttcttgggtgggttttcgcccaggtggctggcgcatccggcaccaccaataccgtcgccgcttataacctgacatggaagtccacaaattttaaaacgatccttgagtgggagccaaagcctgttaatcaagtctacaccgtgcaaatttcgacgaaatctggggactggaagagcaaatgtttttataccacagacaccgaatgtgaccttacagatgagatcgtgaaagatgtgaaacagacatacctggctagggttttttcttacccggccggtaacgtggagagcactgggagtgctggggaacccctttatgagaattccccggagttcacgccttacctggaaactaatttaggtcagccaacaatccagagcttcgagcaggtcggcactaaagtgaatgtgacagttgaggacgagagaacattagtccggcggaacaacacgttcctatctttgcgagatgtcttcggaaaggatctgatctataccttgtattattggaagtcatcttcatccggaaaaaagtactccaccagcttggagctgtggtacctttggagtagttccctttcgtcaagctggctttacttgtacacttccgtcgaaagacaggaatggggacgcgcgggacgacggacacctcac

SEQ ID NO: 8771 - DNA, 714 bp, Artificial Sequence
  Description of Artificial Sequence: Synthetic coding sequence
atggaaacgcccgcgtggccccgggtgcctcgtcctgagaccgccgtggctcgcaccctcctgctgggatgggtgttcgctcaggtggcaggcgcatctggcacgactaacacagttgctgcgtataatttaacatggaagtcgacaaattttaagaccatccttgagtgggagcccaagcctgtgaaccaggtgtatacagtgcagatctctacaaaatcaggcgattggaagtctaaatgtttctacacaacagatacagaatgcgatcttaccgatgaaatagttaaagacgtgaagcagacatatctggcaagagtgttctcgtaccccgctggtaacgtcgagtccaccggaagtgcgggagaacccttatacgagaattcccctgagttcaccccctatctggagactaatcttggtcaacctaccatccaatcctttgagcaagtgggcacgaaggtcaacgtgaccgtcgaagatgagagaacactagtgagaagaaataacacttttctctccctgcgagacgtgtttggcaaggacctgatctacaccctgtactactggaaaagcagttcaagcggaaagaagtactctaccagcctcgagctgtggtatttatggtcctcatcactgtcatcgtcttggctctacttgtacacttcggtcgagcggcaggagtggggcagggctggccggaggacgcctcat

SEQ ID NO: 8772 - DNA, 714 bp, Artificial Sequence
  Description of Artificial Sequence: Synthetic coding sequence
atggaaaccccagcctggccccgcgtgccaagacctgagactgcagtcgctagaaccctgctgctggggtgggtgtttgcacaggttgctggagcgtccggcactacgaataccgtggcagcgtacaacctgacttggaagtccactaacttcaaaacgatcctcgagtgggaaccgaagccggttaaccaggtctataccgtccagatttcgactaaatccggcgattggaagagcaagtgcttctacaccaccgatacggaatgcgacctgaccgacgaaatcgtgaaagatgtgaagcaaacctacctcgcgcgggtgttttcctacccggcaggaaacgtggaaagcactggatcggccggagagccgctgtacgaaaactccccggagttcactccgtacctggagactaacctgggtcaaccaactattcagtcttttgaacaggtgggaaccaaagtgaacgtgaccgtggaggacgagcggactcttgtgcgccggaacaatactttcctgtcgctgagggacgtgttcggaaaggacctcatttacaccctgtactactggaagagctcgagcagcggtaagaagtactcaacctcgcttgaactgtggtacttgtggtcatcctccttgagctcgtcttggctctacctctacacttccgtggaacgccaggagtggggccgcgccggaagaagaaccccacac

SEQ ID NO: 8773 - DNA, 714 bp, Artificial Sequence
  Description of Artificial Sequence: Synthetic coding sequence
atggaaacgcccgcctggccccgagttccacggcctgaaaccgccgtagcaaggactcttctactgggctgggtattcgcacaggttgccggagcatctggcaccacgaatacggttgctgcttataatctaacctggaagagcaccaattttaagacaatactggagtgggagcctaaacctgtgaatcaagtttacaccgttcaaataagcacaaagagcggggactggaaaagtaaatgcttttataccaccgacactgagtgcgacctgacagatgaaatcgtcaaggacgtgaaacagacctatctcgcgagggtgttttcttatcccgccggtaacgtggagagcactgggtctgccggagagcctctttatgagaatagtccagaatttaccccctatttggagactaatctcggtcagcccacgatccagtcgttcgagcaggtcgggacaaaggtgaacgtcacagttgaggatgagaggactctcgtccgtaggaacaatacctttctcagcctgagggatgtcttcgggaaagacctaatctacactctgtattattggaaatcctcctccagtggaaagaagtacagcacatctctcgagctttggtacttgtggtcaagcagcttgtccagctcttggctgtacctgtatacatccgtcgaaagacaggagtgggggagagctggcaggaggaccccccat

SEQ ID NO: 8774 - DNA, 714 bp, Artificial Sequence
  Description of Artificial Sequence: Synthetic coding sequence
atggagacccccgcctggccacgtgtacccagacccgaaacggcagtggctagaacgctgcttttgggctgggtctttgctcaggtggctggggccagtggaacaactaatactgtcgccgcatataatttgacttggaaatccacaaacttcaaaacgatcttggaatgggaacccaagcctgttaaccaagtctatacagtgcagattagcacaaaatctggggactggaaaagtaaatgtttctacaccacagataccgagtgtgacctcacagacgaaattgtcaaagatgtgaaacagacatacctagccagagtgttctcttaccctgctggcaacgtagagtcgaccggaagtgccggggagccgctgtatgaaaactctcccgaatttaccccataccttgaaacaaatttgggtcaacccacaatccagtcattcgagcaggtgggcaccaaggttaatgtgaccgtcgaagatgagcggacacttgtacggagaaataataccttcctctcacttcgcgacgtgtttggtaaagacctcatttacacgttgtattattggaagagctcatcatccggaaagaagtatagtaccagtcttgaactgtggtacctgtggtctagctccttatcctcttcctggctgtacctatacacttcagtggagaggcaggagtgggggcgggcgggccgtagaacccctcac

SEQ ID NO: 8775 - DNA, 714 bp, Artificial Sequence
  Description of Artificial Sequence: Synthetic coding sequence
atggaaacccctgcatggccgcgggtcccaagacctgaaaccgctgtcgcgcgaactctgctcctgggttgggtgtttgcacaggtggcgggtgcgtcgggcaccactaacactgtggctgcatacaacctgacttggaagagcaccaatttcaagaccattctggagtgggagccaaagccagtcaaccaggtgtataccgtgcaaatatcgactaagtcaggcgactggaagagcaagtgtttttacactacggatactgagtgcgatcttaccgatgaaattgtgaaggacgtgaaacagacgtacctggcacgtgtgttttcctaccctgcaggtaatgtcgaatcaaccggctcggcgggcgaaccgctttacgaaaacagcccagagttcaccccttacctggaaacgaatcttggacaacctaccatacaatcattcgagcaagtcggtacgaaggtgaacgtgactgtggaggatgaaaggactcttgtgcgccggaacaatacctttctttcacttagagatgtctttggaaaggatttgatttacacgctgtactattggaagagctccagctctggaaaaaagtactccacctccctggagttgtggtacttgtggagtagctcactgtcctcctcctggctttacctgtacacctctgtggaacgccaggaatggggccgcgccgggaggagaaccccacac

SEQ ID NO: 8776 - DNA, 714 bp, Artificial Sequence
  Description of Artificial Sequence: Synthetic coding sequence
atggaaaccccagcttggccgcgcgtcccccgtccggagacagctgtcgctaggacgcttttgttaggatgggtgttcgcccaggtcgccggcgctagcggtacaactaacaccgtagctgcttacaatctcacttggaaaagtaccaactttaaaaccattctggagtgggaacccaagcctgtgaatcaggtttacaccgttcagatttcgacaaaatccggagattggaaaagcaagtgtttctacaccaccgatactgaatgcgatctgacagatgagatcgtgaaggatgtgaagcagacctatctggcccgtgtgttttcatatccagctgggaatgtcgagtccaccggaagcgcaggagaacctctgtatgaaaactcacctgagtttacaccgtatttagaaacgaacctcggccagcctactatccagtcttttgaacaggtgggtaccaaagtcaacgtgacagtcgaggacgagcgtacactcgtgagaagaaacaacacatttctcagtttacgagatgtgttcggaaaggatctgatctatacactgtactattggaagagcagtagctcaggaaagaagtactcgacgagcttggaactgtggtatctgtggtcctcctctctctcgtcctcctggttatatctatacaccagcgtggagagacaggagtggggacgcgcaggccgcaggactccacac

SEQ ID NO: 8777 - DNA, 714 bp, Artificial Sequence
  Description of Artificial Sequence: Synthetic coding sequence
atggagacacctgcctggcccagagtaccaaggcctgagactgccgttgccaggactctgttgctgggctgggtgtttgcccaggtggccggagcaagcggtacgaccaataccgtggcagcttacaacttgacctggaagtcaacaaactttaaaaccattctggaatgggagcccaagccggtcaatcaggtctacaccgttcagatctccaccaagagtggagactggaagtcaaagtgcttttacaccacggacaccgagtgtgatctcaccgatgagatcgtcaaggatgtaaagcagacatacctggcacgcgtattctcctaccctgcaggcaacgtggagtccactgggagcgccggcgagcccctctacgaaaattcccctgagtttactccctacctcgaaactaatctgggccagcccaccattcaatcattcgaacaggtgggaaccaaagttaacgtgaccgtggaagacgagaggacacttgtcaggcggaacaatactttcctgagtcttcgggatgttttcgggaaggatttgatctatactctctattactggaagagttctagctctggaaagaagtacagtacatcgttggagctgtggtatctgtggagctcctcgctgagttccagctggctctatctgtatacaagtgtggagcgccaagagtgggggagagccggccggcggaccccccat

SEQ ID NO: 8778 - DNA, 714 bp, Artificial Sequence
  Description of Artificial Sequence: Synthetic coding sequence
atggagacacccgcctggccaagagtacccagaccagagacagctgtcgctagaacgctgctgctgggctgggtgttcgcccaggtggctggtgcttccggaactacgaatacggtggctgcttataacctcacatggaaatcaacaaatttcaagactattctagagtgggaaccaaaacctgttaaccaggtctacacggtccagatttccacgaagtccggcgactggaagtctaagtgtttttatacgacggatacggagtgtgacctgactgacgagatcgtcaaggatgtgaagcagacctaccttgcccgggtcttcagctacccggccgggaatgttgaatctaccggtagtgccggggagccactctatgagaactcgcctgaatttaccccctatctggagacaaatctgggtcagcctacgattcagtcgttcgagcaggttggcaccaaggtgaatgtgaccgtggaggacgagcgaactctggtgagacgcaataacacctttctgtcgcttcgagatgtctttggtaaggacctgatttacaccctatactactggaaaagctcctcaagcggcaagaaatacagtacaagtttggagctctggtatctgtggagctccagcttgtcctccagctggctgtatttatacacctcggtagagcgccaagaatgggggcgagccggccggcgtactccacac

SEQ ID NO: 8779 - DNA, 714 bp, Artificial Sequence
  Description of Artificial Sequence: Synthetic coding sequence
atggagactccggcttggccgcgggttcccagaccagaaaccgctgtggcgaggaccctgctccttggatgggtgttcgctcaggtggcgggtgcgtccggaacgacgaacaccgtggccgcatacaacctgacttggaaaagcaccaacttcaagactattctggaatgggaacccaagcccgtgaaccaagtgtacacggtccagatttcgactaagtccggagactggaagtccaagtgcttctatactaccgacactgagtgcgacttgactgacgaaatcgtgaaggatgtcaaacagacttacctcgcccgcgtgttctcctacccagcgggtaatgtcgagtcaactgggagcgccggtgagccactgtacgaaaattcgccagagttcaccccatacctcgaaaccaatctgggtcagcccacgatccagagctttgagcaagtcggaaccaaggtcaacgtgaccgtggaggacgaacgcactttggtgcgccgaaataacacctttctgagcctgcgcgacgtgtttggtaaagacctcatttacaccctgtactactggaagtcatccagctccgggaagaaatactcaacttccctcgaactttggtacctgtggagctcatcgctgtcgtcctcctggctgtacctttacacctcggtggagcggcaagaatggggccgcgcagggaggaggaccccgcac

SEQ ID NO: 8780 - DNA, 714 bp, Artificial Sequence
  Description of Artificial Sequence: Synthetic coding sequence
atggaaacccccgcatggccacgcgtgcctaggcccgaaacggcagtggcgagaactctgctcctcggatgggtgttcgcacaagtcgcaggagcatcgggaactactaataccgtggcagcctacaatctcacttggaagagcactaatttcaaaactatcctcgagtgggagcccaagcctgtgaaccaagtgtacaccgtgcagattagcactaagagcggtgattggaagtcgaagtgcttctataccactgacaccgaatgtgatcttactgatgaaattgtgaaagatgtgaagcagacttacctcgcacgcgtgttttcttaccctgctggaaatgtggagtccactggaagcgcgggggaaccactttacgaaaactcccccgaatttaccccatatcttgagactaacctcggacaaccaactatccagagctttgagcaagttggaaccaaggtcaacgtgactgtggaggacgagagaaccctggtgcggagaaataacacttttctttccctgcgggatgtgttcggtaaagatctcatatacactctttactactggaagtccagctcgtcggggaagaaatactcgacctcattggaactgtggtacctgtggagctcatcccttagctcgagctggctgtacctctatactagcgtggaacgacaggaatggggccgcgctggtagacggactccgcat

SEQ ID NO: 8781 - DNA, 714 bp, Artificial Sequence
  Description of Artificial Sequence: Synthetic coding sequence
atggaaacccccgcctggcctagggtccccaggccggaaaccgcagtggcacgaacattgctgttgggctgggtcttcgcccaggtagccggtgcgtcaggtacaactaacacagttgccgcatacaatcttacgtggaagtctaccaattttaaaacaattctcgagtgggaacccaagcctgtgaatcaagtttacaccgtgcagattagtaccaaatctggagattggaagtccaaatgcttttatacaactgacacagagtgcgatctgacagacgagatagtcaaggacgtcaaacagacataccttgcacgtgtgttttcgtaccccgccggcaatgtcgagagtactggatctgccggtgagcctctttacgaaaatagtcctgagttcactccctacttggagacaaatctgggacagccaacaattcagtccttcgagcaggtgggtactaaagtgaatgtgaccgtggaagatgagagaacgttggtgcgtcgaaataacactttcctgtcgctcagagacgtgttcggaaaagatttaatctacaccctgtactattggaagtccagcagctccggtaaaaaatattccactagcctggagctttggtacctctggtcttctagtttgtcctcttcgtggctctacctgtacacttcggtcgaaagacaagagtgggggagggcgggacgtagaactcctcat

SEQ ID NO: 8782 - DNA, 714 bp, Artificial Sequence
  Description of Artificial Sequence: Synthetic coding sequence
atggaaacccctgcctggccgagagtcccacgaccagagaccgcagttgcgcggaccttattgctgggatgggtctttgctcaggtcgccggggccagcggtaccaccaatactgtggctgcctacaaccttacctggaagagcaccaacttcaagaccatactcgagtgggagcccaagcccgtgaatcaagtatataccgtgcagataagcactaaaagcggggattggaaatcaaagtgtttttacacaaccgacacggagtgtgatctgaccgacgagatagttaaagacgtcaaacaaacttacctggctcgagtcttttcgtacccggccggtaatgtggagagtacaggcagtgcgggagagcccctttacgagaatagtcccgagtttacgccctacttggaaacaaatttgggccagcctactattcagtcgttcgaacaggttggtacaaaggtaaacgtgacagtagaggacgagcggacactggtgcgtcgtaataacaccttcctttcgttgcgcgatgtatttggcaaggatctcatctacaccctgtactattggaaatccagttcgtccggtaagaaatatagcacctctctggagctgtggtacctgtggtcatcaagtttgagctcatcttggctgtatctttacacctcggtggaaagacaggagtggggacgggctggtagacgcacgccgcac

SEQ ID NO: 8783 - DNA, 714 bp, Artificial Sequence
  Description of Artificial Sequence: Synthetic coding sequence
atggagacacctgcatggccgcgggtgccacgacccgaaacagccgtcgctcgcacactgctattgggctgggtgtttgcccaagttgcaggcgctagcggcaccaccaacaccgtagctgcttacaaccttacctggaagagcacaaacttcaaaactattctcgaatgggaacccaagccggttaatcaggtctacactgtccagatctctaccaagtcaggcgactggaagtctaagtgcttttatacaaccgatactgagtgtgatcttaccgatgaaatcgtaaaggacgtgaaacagacatacttggcacgcgttttttcttatcctgctggaaatgttgaaagtaccggcagtgctggcgaacctctgtatgaaaatagccccgaatttaccccctacctggagaccaatctcggacaaccgacaatccagtcttttgagcaggttggaactaaagtcaacgtcacggttgaagatgaacgaacactggtcagaagaaacaacacttttctttctctccgcgacgtcttcggcaaggatctgatctacaccctctattactggaagtcatcatccagcgggaagaaatactcaacctcactggagctgtggtatctgtggtcctcatcactttctagctcctggctctacctctacactagcgtggaaaggcaagaatgggggagggctggcagaaggactcctcat

SEQ ID NO: 8784 - DNA, 714 bp, Artificial Sequence
  Description of Artificial Sequence: Synthetic coding sequence
atggaaacgcctgcttggccacgtgtcccgaggcccgaaacagccgttgctcggaccctgctgctgggctgggtgttcgctcaggtggccggcgcctccggtaccaccaacaccgtggctgcctacaatctgacctggaagtccaccaattttaaaacgatcctggaatgggagcccaagcccgtgaatcaggtctacacagtgcagatttctactaagtccggggactggaagtcgaagtgtttttacacgaccgacactgagtgtgatctcaccgacgaaatcgtgaaagatgtaaaacagacatacctggcccgcgtgttcagttacccggccggtaatgttgagagcacaggctcagccggggagcccctgtacgaaaatagtccagagttcaccccctatctggagaccaacttgggccagcctaccatccaaagctttgagcaagttggcaccaaagtgaatgtaacggttgaagacgagcgtacacttgtccggagaaacaatacttttctgagcctgcgggacgtgtttgggaaggatttgatttacaccctgtactattggaaaagctcatcaagcggaaagaagtattctacttctctagaactgtggtatctctggtcttcttctctgtcctcttcgtggctgtacctctatacaagtgtggaacggcaggaatggggtagagctggcaggcgcacaccacat

SEQ ID NO: 8785 - DNA, 714 bp, Artificial Sequence
  Description of Artificial Sequence: Synthetic coding sequence
atggagaccccagcttggccgagggtccccagacctgaaaccgcggtcgctagaactctgttgctgggctgggtgtttgcccaggtcgctggagcatctgggacaaccaatacggtggctgcttacaatttgacttggaaatctaccaatttcaaaactattctggaatgggagccaaagcccgtcaaccaggtatacaccgttcagatttccacaaaatctggcgactggaaatcaaagtgtttctataccactgacacggagtgtgacttgacggacgagatcgtgaaggacgtcaagcagacctacttggcgagagtgttttcttatccagcaggtaatgtggaaagcacaggctccgccggcgaacccctgtatgagaatagccccgagttcaccccatatctggagaccaatctggggcaacccaccatccaatccttcgaacaagtgggaacaaaggtaaatgtgactgtagaggatgagaggacgctggttcggcggaacaacacctttctgtctctccgggatgtgtttggaaaggaccttatatatacactttattattggaagagctcaagctctggtaagaagtatagtacctcactcgagctgtggtatctgtggagctcatctcttagcagtagctggctgtatctgtacactagcgtggaacgacaggaatgggggagagctgggcggagaacgccccac

SEQ ID NO: 8786 - DNA, 714 bp, Artificial Sequence
  Description of Artificial Sequence: Synthetic coding sequence
atggagaccccagcctggcccagagtgcccagacccgaaacagctgtggcccgcacgctactgcttggctgggtgtttgctcaagtggcaggcgccagcggcacgacaaatacagttgccgcctacaatctcacgtggaaaagcaccaattttaagacgattttggagtgggaaccgaagccagtcaatcaggtttacactgtccagatttcaaccaagtccggagattggaagagcaaatgtttctatacaacagacacagaatgtgacctcaccgatgagattgtcaaagacgtcaagcagacatatctagcccgcgtgttctcttatcccgctgggaatgtggagagtactggatccgccggggaacccctctatgaaaatagccctgagtttactccctacttggagacgaacctgggtcagcccacgatacagtcttttgaacaggtggggacgaaggtgaatgtcaccgtggaggacgagagaacactcgtgcggcgcaacaatactttcctgtctctgagggacgtgttcggtaaggacctaatctacacattatactattggaagtctagctcctcagggaagaagtattccacgtccttggaactctggtatctctggtcctcctccctaagctccagctggctatatctgtacactagtgtcgagagacaggaatggggacgcgcaggccggaggaccccgcac

SEQ ID NO: 8787 - DNA, 714 bp, Artificial Sequence
  Description of Artificial Sequence: Synthetic coding sequence
atggaaaccccggcctggccacgcgtgccacgccccgagacggccgtggcgaggaccctccttctgggctgggtctttgcccaagttgccggtgcgtcgggaactactaacaccgtggccgcgtacaatctgacgtggaagtcaacgaatttcaagacgattctggaatgggagccgaagccggtgaatcaggtgtacactgtgcaaatctccaccaagtccggagactggaaatcgaagtgcttctacaccacggatactgagtgcgacctcaccgatgaaatcgtgaaggatgtcaaacaaacctatctggcccgcgtgttctcctacccggcggggaacgtggaatccactggatcggccggagagcctctgtacgagaactcgcccgaattcacgccatacctggagactaacctggggcaaccaaccatccagtccttcgaacaggtgggcactaaggtgaacgttacggtggaggatgaacgaaccctggtccgcagaaataacacctttctctcgctgagagacgtgttcggaaaggatctgatctacactttgtactactggaagtcctcctcgtcgggcaaaaagtactcgacctccttggaactgtggtacctgtggtcaagcagcctgtcatcgtcctggctctacctctacacctccgtggagaggcaggagtggggacgggccggaagaagaacgcctcac

SEQ ID NO: 8788 - DNA, 714 bp, Artificial Sequence
  Description of Artificial Sequence: Synthetic coding sequence
atggaaacccctgcatggccgcgggtccctcgccccgagactgccgtggcacggaccctgctgcttggatgggtctttgcacaggtcgccggcgcctcgggtaccaccaatactgtggctgcatacaacctgacctggaagtcaactaatttcaagaccattcttgaatgggaaccgaagcctgtcaaccaagtgtatactgtccagatcagcactaaatcgggcgactggaaatccaaatgtttttacactacggatactgaatgcgacttgactgatgagatcgtgaaagatgtcaaacagacctaccttgcaagagtgttctcgtaccctgcaggaaacgttgagtcaaccggctcggcgggggaacccctgtacgaaaattcacctgaatttaccccttacctcgaaacgaatcttggtcaaccaaccatacagagctttgaacaggtcggtaccaaagtgaacgttaccgtcgaagatgaaagaaccctggtgagacgcaacaatactttcctttcgctcagggacgtctttggtaaggatcttatctataccctttactactggaagtcgtcgagttcagggaagaagtactccacctcgctggaactgtggtatctctggtcatcctcactttcatcgtcgtggctctacctttacacgtcagtcgagcggcaggagtggggacgagcaggtaggcgcactccacat

SEQ ID NO: 8789 - DNA, 714 bp, Artificial Sequence
  Description of Artificial Sequence: Synthetic coding sequence
atggaaactcctgcgtggccgcgtgtccctcggcccgaaaccgcagtcgctagaacccttctgcttggatgggtatttgcacaggttgctggcgcgtcaggaacgaccaacactgtcgccgcctacaatcttacttggaagtcaaccaactttaagactattcttgaatgggaaccaaaacccgtgaatcaagtgtacactgtacaaatttcgacgaagtcgggtgattggaaatcgaagtgcttctacactactgataccgaatgtgatctgaccgatgagattgtgaaggacgtgaagcagacgtacctggcgcgagtgttttcttaccccgcagggaatgtggaatcaaccggctcagcaggggaaccactttacgaaaactcgcctgaattcaccccttatttggagacgaacctgggtcaaccgaccattcagagctttgagcaggtgggcactaaagtgaacgttactgtggaggacgaaagaaccctggtcagacgaaataacacctttctttccctccgggatgtctttggcaaagacttgatatacactctgtactactggaaatcgtcgtcgtccggtaagaaatactctacgtcactcgagctgtggtacctctggagctcatcgctgtcgagcagctggctgtacttgtatacctccgtcgaacgccaagaatggggtagagcaggtcggagaactccgcat

SEQ ID NO: 8790 - DNA, 714 bp, Artificial Sequence
  Description of Artificial Sequence: Synthetic coding sequence
atggagacaccagcctggcctagagtgcctagaccagaaactgcggtagccagaactctgttacttggctgggtatttgcccaggttgcgggggctagcggcaccacaaatactgtggcagcatataatctgacttggaagtccacaaattttaaaaccatactcgaatgggagcctaaacctgtaaatcaggtatatactgtccagataagcaccaaatctggagactggaaaagcaagtgcttctacaccacggacacagagtgcgacttgactgatgaaatcgtaaaagacgtcaagcaaacctacttagcgagagtgttctcctaccctgctgggaacgtggagagcaccgggtcggccggagagcctctgtacgaaaattcccccgaattcaccccttatttggagaccaacctcggacagccgacaatccagagcttcgaacaggtggggaccaaggttaacgtgacagttgaagatgagaggactctagtgcggcgaaacaataccttcttgtctctccgagacgttttcggcaaagatctgatttataccctgtactactggaagtcctccagcagcgggaagaaatactctacaagcctcgagctgtggtacctctggagcagctccttgtcgtctagttggctgtatctgtacacttccgttgaacggcaggagtgggggcgcgccggacgcaggacaccccac

SEQ ID NO: 8791 - DNA, 714 bp, Artificial Sequence
  Description of Artificial Sequence: Synthetic coding sequence
atggaaactccagcatggccaagggttccaagacccgagaccgccgtggcacgaaccttgctcctaggatgggtttttgcccaagtggcgggtgccagtggcaccaccaacaccgtcgcggcatacaacctgacctggaagtcaacgaatttcaagaccattctggagtgggagcccaaacccgtgaatcaagtttacactgtgcaaatctctactaagtcaggcgattggaagtctaagtgtttttatacaacggacactgaatgtgacttaacggacgaaatagttaaggatgtgaaacagacttatctcgcacgagttttctcgtacccagccggcaacgttgagagtacggggtcagcaggggagcctctttacgagaactcccctgaattcaccccctatttggaaacaaacttggggcaacctactatccagtctttcgaacaggtgggaactaaagtcaacgtgacggtcgaggacgaacgcactttagtgagacgaaataatacttttctgtcacttcgtgatgtgtttggcaaggatctcatatataccctctactactggaaaagttcctcctccggaaaaaagtacagcacctccctggaactttggtatttgtggagctcttcactttctagcagttggctgtatctgtacacttcagtggagaggcaggagtggggaagggctggacgtcgcaccccccac

SEQ ID NO: 8792 - DNA, 714 bp, Artificial Sequence
  Description of Artificial Sequence: Synthetic coding sequence
atggagacacctgcctggcctcgggtgcctcgcccagagacagccgtcgcccggacactgctcctcggttgggtgttcgctcaggtggccggcgcgagcggtacaactaataccgtcgcagcatacaacctaacatggaagtctaccaactttaaaacgatcttagagtgggagccaaaaccagtgaatcaggtttacactgtgcagatctctactaaaagcggggactggaagtccaagtgtttctacacaactgatacagagtgtgacctcacagatgaaatcgtcaaagatgtcaaacagacttatctggctagggtgtttagttaccccgccggcaacgtcgagagcaccggctccgccggcgagcccctatacgagaattccccagaattcacgccttatctagagactaacctggggcagccaacaatccagtctttcgagcaagtgggcacgaaggtaaacgtgactgttgaggacgagcggactctcgtcaggagaaataatacattcctctctctgagagatgtatttggtaaggacctgatctatacgctctactactggaagagttcgagttcaggcaaaaagtattccaccagtctggagttgtggtacctgtggagctcatcactcagcagctcttggctgtacctgtacacctccgtggagcgtcaggagtggggacgggcaggcagaagaactccgcac

SEQ ID NO: 8793 - DNA, 714 bp, Artificial Sequence
  Description of Artificial Sequence: Synthetic coding sequence
atggagacccctgcctggcctagggttccgaggcccgagactgccgtggctaggaccctgctgctgggctgggtttttgctcaggtggccggggcctcagggaccactaacactgtcgcggcttacaacttaacctggaaatctactaacttcaaaactatcctggaatgggagccgaagcccgtcaatcaggtttacactgttcaaatctctacaaagtctggagactggaaatcaaagtgtttttacacaacagacactgagtgcgacttgaccgatgagatcgtgaaagacgttaaacagacctatttagctcgagtgttcagttatccagctggcaatgttgaatctactggcagtgctggagagcctctgtacgaaaatagccctgaattcaccccctatctcgaaacgaatctgggccagccaacaatccagagctttgaacaggtgggcacaaaagtgaacgtgacagtggaagacgagagaaccttggttaggagaaataacaccttcctttctctgagggatgtgttcggcaaagacctgatctacacactgtattactggaaaagctcaagttcaggcaagaagtattctacaagcctggaactgtggtatttatggtcttccagcctatcttctagctggctttacctgtacacatctgtggaaagacaggagtggggacgggccggtcggagaaccccccac

SEQ ID NO: 8794 - DNA, 714 bp, Artificial Sequence
  Description of Artificial Sequence: Synthetic coding sequence
atggaaaccccggcgtggccaagggtgccgcggccagaaaccgcggtcgcccggactctgctccttgggtgggtgtttgctcaggtggcgggagcatcggggactaccaacacggtggcagcctacaatcttacttggaagtcgaccaacttcaaaaccatccttgagtgggagccgaaacctgtgaaccaggtgtacaccgtgcagatctcgacgaagtccggggactggaaatccaagtgcttctatacgaccgacactgaatgcgacctgaccgacgaaatcgtgaaggatgtgaagcagacctacctggccagggttttcagctacccggcgggcaacgtcgagagcacgggttcagccggagaaccactgtacgagaatagccctgagttcacgccctaccttgaaactaacctgggccaaccgactatccaatcgttcgagcaagtgggaaccaaggtcaacgtcaccgtggaggatgaacggacgctcgttagacggaataacacctttctgagcctccgggatgtttttggaaaggacctcatctacaccctgtactattggaagagctcaagctcgggaaagaaatactctacttcacttgaattgtggtacctgtggagctcgtcccttagcagctcgtggctctacctctacacgtccgtcgaacggcaggaatggggtcgcgccggccgccgcacgccgcat

SEQ ID NO: 8795 - DNA, 714 bp, Artificial Sequence
  Description of Artificial Sequence: Synthetic coding sequence
atggaaacccctgcttggccaagagtacctagacccgagaccgcggtcgcccggactcttctgcttggctgggtgtttgctcaggtggccggagcatctggtaccacaaacacagttgccgcctacaaccttacttggaaaagcactaacttcaagactatcctggaatgggaacccaagcctgtcaatcaggtatatactgtgcagattagcacaaaatcgggcgactggaagtccaaatgtttctataccaccgatacagagtgtgatcttaccgatgagatcgtgaaggacgtaaagcaaacatatctggctagagtgttttcctaccccgcaggtaatgtggaaagtacaggctcggcgggggagccgctgtatgagaatagccctgagttcacgccttacctggagacaaatctaggccagccaacgatacaaagtttcgagcaggtgggtacgaaggtcaacgtcacggtggaagatgagagaaccctggtccggcggaataatacattcctatcactccgggacgtgttcggcaaagacttgatttacacgctctattattggaagagctcatcctcaggcaagaaatacagtactagcttggagctgtggtacctatggagtagtagcctttccagcagctggctgtacctctacactagcgtcgagagacaggagtggggcagagctgggagaagaacaccgcac

SEQ ID NO: 8796 - DNA, 714 bp, Artificial Sequence
  Description of Artificial Sequence: Synthetic coding sequence
atggaaaccccagcatggccacgggttcccagacctgagactgcggtggctagaacccttctcttgggttgggtctttgcacaggttgccggagcctcaggcaccaccaacaccgtcgcagcatacaaccttacttggaaatcgacgaactttaagaccattcttgagtgggaaccaaagcccgttaaccaagtctacaccgtgcaaatcagcaccaagtccggcgattggaaatccaaatgtttctacaccaccgataccgagtgcgatctgactgacgaaattgtcaaggatgtgaaacagacttacttggcacgcgtctttagctatccagccggaaacgtcgagtcgacgggaagcgcaggtgaacctctttatgaaaactctcccgaatttacgccatacctcgaaactaacctgggccaaccgactatccaatccttcgaacaggtcggaaccaaggtgaacgtgactgtggaagatgaaagaactctcgttagaaggaataacaccttcctgtcactgagagacgtgtttggtaaggacctcatatacacgctctactactggaagtcgtcctcctccgggaagaagtactcaaccagccttgagctgtggtacctgtggtcatcctcgctgtcgagctcgtggctctacctctacacctcggtggagagacaggaatggggacgcgcgggaaggaggactccgcat

SEQ ID NO: 8797 - DNA, 714 bp, Artificial Sequence
  Description of Artificial Sequence: Synthetic coding sequence
atggagactcctgcctggccgcgcgtgcctcggcccgaaaccgccgtcgcacgcactttgctgctgggctgggtctttgcccaggtggctggagccagcggcactaccaatactgttgcggcatacaacctgacctggaagagcactaacttcaagaccatcctggaatgggaaccgaagccagtgaatcaggtgtacactgtgcagatcagcaccaagagcggagactggaagtccaaatgcttctacaccaccgatactgagtgtgacctgactgacgaaatcgtcaaggacgtcaagcaaacctacttggctagagtgtttagctacccggcaggaaatgtggagtccactggctccgcgggtgagccgctgtacgagaattccccggagttcactccgtacctggagactaacctgggacagccgactatccagtcctttgaacaagtgggcaccaaggtgaacgtgactgtggaagatgagcggaccctcgtgcggaggaataacacgttcctctccctccgcgacgtgttcggaaaagatctcatatacactctctactactggaaatcttccagctcgggaaagaaatactccacgtcgcttgagctgtggtacctctggtcaagctcgttgtcatcgtcctggctgtacctttacacttccgtggaacgccaagaatggggacgcgctggtaggcggaccccgcac

SEQ ID NO: 8798 - DNA, 714 bp, Artificial Sequence
  Description of Artificial Sequence: Synthetic coding sequence
atggaaaccccagcatggccgcgcgtgcctagacccgaaactgcagtggcacggacgctgctgctgggatgggtgttcgcacaagtcgccggggcatcgggaaccactaacaccgtcgctgcatacaacctgacgtggaagtcgactaacttcaagactattctcgagtgggaacctaagcctgtcaaccaagtctatacggtgcaaatttccactaaatccggtgattggaaatcaaagtgtttttacaccacggatactgaatgtgaccttaccgatgaaatagtgaaggatgtgaagcagacgtacctggctcgtgtcttttcctatcctgcaggcaatgtggagtcgaccggctcggcaggcgaacctctttacgaaaactccccagaatttaccccttacttggaaaccaaccttggtcaaccgaccatccaatcattcgaacaagtggggactaaagtcaatgtgactgtggaggatgaaagaaccttggtgcgacgtaacaataccttcctttccctgagggatgtgtttggaaaggatcttatctacactctgtactactggaagtcgtcgtcatccggaaaaaagtacagcacctcccttgaactttggtacctttggtcaagctcgctctcgtccagctggttgtacctctacacctcggtcgaacgccaagaatggggacgggcaggcaggagaaccccgcat

SEQ ID NO: 8799 - DNA, 714 bp, Artificial Sequence
  Description of Artificial Sequence: Synthetic coding sequence
atggaaactcccgcatggcccagagtacctcgcccagagaccgccgtggccagaaccctgcttctcggctgggttttcgctcaagttgctggtgcttcaggcaccactaataccgtggccgcctataatctgacttggaaatctactaactttaaaaccatcctggagtgggagcctaagccagtaaaccaggtctacacagtgcaaatcagtaccaaaagcggcgattggaagagcaagtgcttctacacaaccgatacagagtgcgacttgactgacgaaatcgtgaaagatgtgaagcagacctaccttgccagagttttcagttaccccgctggcaatgttgaaagcaccggttccgccggagaaccactgtacgagaactcacccgagttcactccctacttggagaccaaccttggacaacctacaatccagtctttcgagcaggtcggtactaaagtcaacgtgaccgtggaggacgagcgcaccctcgtccgtagaaacaacacctttctttcattgcgcgatgtgttcggaaaagatctgatttatacactctattattggaagagctcctcttctggcaaaaaatattctacctccttggagctgtggtacctctggagttccagtctcagcagttcctggttgtacctctatacatcagtcgagcgtcaagaatggggaagggctggccgtagaacaccccac

SEQ ID NO: 8800 - DNA, 714 bp, Artificial Sequence
  Description of Artificial Sequence: Synthetic coding sequence
atggaaacccctgcatggccccgagtgccacgccctgagactgccgtggctcgaacgctcctcctgggatgggtgtttgcacaagtggccggtgcttccggtacgaccaacactgtggcggcgtacaacttgacgtggaagtcgaccaacttcaaaacgatcttggagtgggagccgaagccagtgaaccaggtgtatactgtccagatctccaccaaatcaggagactggaagagcaaatgcttttacaccacggatacggagtgcgatctgactgacgaaatcgtgaaagatgtcaagcagacctacctggccagagtgttctcctaccccgccggaaatgtcgaatcaaccggtagcgctggcgaaccgctgtacgaaaactccccagaatttactccgtaccttgagactaatctggggcagcccactatccagtcattcgaacaggtgggaactaaggtgaacgttactgtggaggacgagaggacccttgtccgccggaacaataccttcctttctttgcgggacgtgttcggaaaagacctgatttacaccctctactattggaagtcgtcatctagcggcaagaaatactccacgagcctggaactgtggtacctttggtcatcgtccctgagctcgtcatggctttacctctacacctcggtggaacgccaagagtggggaagagccggacggagaaccccgcat

SEQ ID NO: 8801 - DNA, 714 bp, Artificial Sequence
  Description of Artificial Sequence: Synthetic coding sequence
atggaaactcccgcatggccccgagtacctcggcccgaaactgctgtggcacggacactgctccttggatgggtgtttgcgcaggtagcaggagcttccggaactacaaatacagtggcagcctacaaccttacttggaaatcaactaatttcaaaactatactcgaatgggaaccgaaaccagtaaatcaggtctatacagtccagatttcaacaaaatcaggggattggaaaagtaaatgcttctatactactgatacagaatgtgaccttactgatgaaatcgtgaaagatgttaagcagacatatctggctagggtgttttcttacccagctggaaatgttgaatctacaggaagtgccggagaaccactgtatgaaaattcacccgaatttacaccttatttggaaacaaatttagggcagcctacaatacagtcctttgaacaagtgggaactaaagtgaacgtgacagttgaagatgagcgaacactcgtgagaaggaataacacattcctcagtctccgcgacgtcttcgggaaagatcttatctatactctgtattattggaaatccagttcttctggaaagaaatattctacatcactagaactttggtatctatggtcatcttcacttagttccagttggctatacctgtacacatccgtggaacgccaggaatggggacgagccgggcgacgcacaccccat

SEQ ID NO: 8802 - DNA, 714 bp, Artificial Sequence
  Description of Artificial Sequence: Synthetic coding sequence
atggagacaccggcatggccccgagtcccaagacctgaaaccgcagtggctcgtacccttcttctaggatgggtcttcgcccaagtcgcgggagcttctggaacgaccaatacggtagcagcttataaccttacatggaaatccacaaactttaaaactattctagagtgggaaccaaagccagtaaaccaagtttatacagttcaaattagcaccaagtcaggagactggaaatccaaatgcttttatacaacggatacagagtgcgatctcacagatgaaattgttaaggacgtcaagcaaacttatctggctcgcgtcttctcatacccagcgggaaatgttgagagtactggatctgccggtgaaccgttatatgagaacagtcccgaatttactccatatcttgagaccaacctgggtcaaccgactattcaatctttcgagcaggtcggtacaaaagttaatgtaaccgtggaagatgaacgaacacttgttcgaagaaataataccttcctgagccttagggatgtcttcggaaaggacttaatctacaccttgtattattggaagtcatcatcatcaggtaaaaaatactccacctctttggagctctggtatctttggagttcatctctctcctcttcctggctttatttatacactagtgttgaacgtcaagaatggggaagagcgggaagacgtacaccacat

SEQ ID NO: 8803 - DNA, 714 bp, Artificial Sequence
  Description of Artificial Sequence: Synthetic coding sequence
atggaaactccagcatggcctagggttcctagaccggaaacagcagtggcccgaacactgctccttgggtgggtttttgcccaagtagccggggccagtgggactacgaacacagtagccgcctacaatttgacttggaaatcaactaactttaagacaatcttagaatgggaacccaagcccgttaaccaggtctatactgtgcagatcagtactaagagtggggattggaaatctaagtgcttttatactacagatactgaatgcgatctcacggatgaaatagtgaaagatgttaaacagacatatctcgctcgggtgttctcctaccccgcaggaaatgtcgaatcgacagggtcagcaggggaacccctgtatgaaaactcccccgaatttacaccctatctggaaactaatctcggacagccaactatacagtcttttgagcaagttggaactaaagtgaacgtaactgtagaagacgaaaggactctcgtacgaagaaataacacttttctgagtttacgcgatgtttttgggaaagatctcatatatactctgtactattggaaatcctcttctagtggaaaaaaatatagtacttcactggaactctggtacctgtggtcctcctctttatctagttcttggctttacctgtatacttccgttgagaggcaagagtgggggcgggcggggaggcggacaccccat

SEQ ID NO: 8804 - DNA, 714 bp, Artificial Sequence
  Description of Artificial Sequence: Synthetic coding sequence
atggagacgcctgcctggccgcgcgtcccacggccggaaaccgccgtcgcgcggaccctcctcctgggctgggtgttcgcgcaagtggccggagcctcaggaactaccaatactgtggcggcctacaacctcacttggaaatctacgaatttcaagactatcctcgagtgggagcctaagccagtgaaccaggtgtacaccgtgcaaatctcaaccaaatcaggagactggaaaagcaaatgcttttacaccaccgatactgaatgcgacctcaccgacgagattgtgaaagatgtgaagcaaacctacctggcgagagtgttctcctacccggcaggaaatgtggaatccaccggcagcgccggagagcctctgtacgaaaactcaccagagttcacgccgtacttggaaaccaacctcggtcaacctaccatccaatcctttgaacaggtgggaactaaagtcaatgtcaccgtggaggacgaacgcactcttgtgaggagaaacaatacgttcctctctctgagagatgtgttcggcaaggacttgatctataccctctattactggaagagcagctcatcgggaaagaagtactcaaccagccttgaactgtggtatctgtggtcgtcctcgctctcgtcctcctggctttacttgtatacctccgtcgagaggcaggagtggggacgagccggccggcggactccgcac

SEQ ID NO: 8805 - DNA, 714 bp, Artificial Sequence; identical to SEQ ID NO: 8793
  Description of Artificial Sequence: Synthetic coding sequence

SEQ ID NO: 8806 - DNA, 714 bp, Artificial Sequence
  Description of Artificial Sequence: Synthetic coding sequence
atggagacgccggcctggccccgcgtccccaggccagagacagctgtggctaggactctcttgctcgggtgggtgtttgcccaggtggcaggagcttcagggactacaaacactgtggccgcctacaacctgacttggaagtcaactaactttaaaaccatcttggagtgggagcccaagcctgtgaaccaggtctacacggtgcagatcagtaccaagagcggcgattggaagagtaaatgcttttacacaacagacaccgaatgcgacctgacagacgagatcgtcaaggacgtgaagcagacatacctggcccgcgtgttttcataccctgcaggcaacgtggaatctacggggagcgccggagaacccttgtacgagaattcccccgagtttaccccatatctcgagactaacctgggacagcctacaatccagtctttcgagcaggtgggcaccaaagtcaacgttaccgtggaggacgaaaggaccctggtccgccgcaataataccttcctatccctgcgggatgtgttcgggaaggatctcatatacacactttactattggaaatcatctagctccggcaaaaagtactctacctctttggaactgtggtatttgtggagcagctccctgtcttcatcttggttgtacttatacacaagcgtggaaagacaggagtggggccgggctggccgcaggactccacac

SEQ ID NO: 8807 - DNA, 714 bp, Artificial Sequence
  Description of Artificial Sequence: Synthetic coding sequence
atggagacccccgcctggccacgcgtgcccagaccagaaaccgcagtcgcgcgaacgctgctcctggggtgggtctttgcccaggtagccggagcgtccggaacgaccaatacagtagcagcgtacaacctcacctggaagagcacgaacttcaagactatcctggagtgggaacctaagccggttaatcaggtttatactgtgcagatcagcactaaatctggcgactggaagagcaaatgtttctataccacagatacagagtgtgatttgaccgacgaaatagtcaaggacgtaaaacagacttacctagcccgggtcttcagctatcccgccggcaacgtggagagcaccggcagcgctggcgaaccgctgtacgaaaattcaccagagtttacaccgtacttggagactaacctgggtcaacccacaattcagtctttcgaacaggtaggaacaaaggttaacgtcactgtagaggacgaacgcactctcgtgagaagaaacaacacatttttgagtttacgagacgtgttcggtaaggatctcatatacaccttgtattattggaagtcttcttccagcggcaagaagtatagcacttccctcgaactatggtatctgtggagctcctccctttcaagttcatggttatacctgtacacttctgttgaaaggcaggaatgggggcgggcaggacggaggacaccccat

SEQ ID NO: 8808 - DNA, 714 bp, Artificial Sequence
  Description of Artificial Sequence: Synthetic coding sequence
atggaaactcccgcctggcccagagtgccacgcccagagacagcagtcgccaggactttgctgctggggtgggtgttcgcgcaggtggccggcgcgagtgggactaccaacaccgtagctgcctataacctcacctggaaatctacaaatttcaagacaatactggagtgggaacctaagccagtgaaccaagtgtatacagtgcagataagcactaaatcaggtgactggaagagtaagtgcttttacactacggacaccgagtgcgacctcaccgacgagattgttaaggatgtcaagcaaacctacctggcaagggtattcagctaccccgcaggcaacgtggagtccacgggatccgctggagaaccattgtacgagaattcacccgagtttactccctacctggagaccaatctcggccagccaaccattcaatccttcgaacaggtcggaacaaaggtgaacgtgaccgtcgaagacgaacgcacgctggtccgcaggaacaatacatttctgagcctaagggatgtttttgggaaggacttgatatacacactctattactggaaatcatcctcctctggtaaaaaatacagcactagcctggagctgtggtatctctggtccagttcattgagttcgtcgtggctctatctatatacaagtgttgaaagacaggaatggggcagggcgggaaggcgcactccccat

SEQ ID NO: 8809 - DNA, 714 bp, Artificial Sequence
  Description of Artificial Sequence: Synthetic coding sequence
atggaaaccccggcatggccacgcgtcccccgcccagagacggcagtggcacggactctgctgctcggttgggtatttgcgcaggtggcaggcgcaagcgggactactaatactgtcgcagcctacaacctgacttggaagagcactaactttaagaccatacttgaatgggaacctaaacccgtgaatcaggtctacactgtgcaaatttcgaccaagagcggagattggaagtcaaagtgtttctacactacggataccgaatgtgacctcactgatgaaattgtcaaggatgtgaaacagacctaccttgcacgggtctttagctacccagcaggaaatgtcgagtcgaccggatccgccggagagccgctgtacgaaaactctccagaattcaccccctacctggaaactaacctcggacagcctaccatccaatcgtttgaacaggtcggaaccaaggtgaacgtgaccgtcgaagatgaaaggactctcgtcagaaggaataacacctttctgtcgctgcgggatgtctttggaaaggacctgatatacactctttactactggaagtcctcctcctcggggaaaaagtactccacctcgctggaactttggtatctctggagctcgtcgctgtcatccagctggttgtacttgtacacgtcagtggagcgtcaggagtgggggcgggcaggcaggcgaaccccccat

SEQ ID NO: 8810 - DNA, 714 bp, Artificial Sequence
  Description of Artificial Sequence: Synthetic coding sequence
atggaaactccagcatggccgcgggtgccgcggccggagactgcggttgccaggaccctgttgctgggatgggtgtttgcccaggtggcaggcgcttcgggcaccactaataccgtcgccgcctacaatctcacctggaaatctactaatttcaagactattctggagtgggaaccgaagccagtgaaccaagtgtacaccgtgcaaatcagcaccaaatccggagactggaagagcaagtgcttctacacgactgacaccgagtgcgacctgacggacgagatcgtgaaggacgtcaaacagacttacctcgcccgggtgttctcgtacccagccggcaatgtcgagtccactgggtcagccggcgaacctttgtacgaaaactcacccgagtttactccttacctggagacgaacctggggcaaccgactatccaatccttcgaacaggtgggaactaaggtgaacgtgaccgtcgaagatgaaagaaccctcgtgaggagaaacaacactttcctctccctgcgggacgtattcggaaaggaccttatctacactctgtactactggaagtcctcctcgagcgggaaaaagtactccacgtcactcgaactgtggtacctctggtcctcatcactgtcatcttcctggctgtacctgtacacctcagtggaacgccaggagtggggccgggccggacgccgaactccccac

SEQ ID NO: 8811 - DNA, 714 bp, Artificial Sequence
  Description of Artificial Sequence: Synthetic coding sequence
atggaaaccccggcatggccacgcgtgccgcgtccagagacggccgtggcgcgcaccctgctcctgggatgggtctttgcacaggtcgccggagcttcgggtaccaccaacactgtggccgcttacaatctgacctggaagtccactaatttcaagactatcctggaatgggagccgaagccggtcaatcaggtgtacactgtgcagatctccactaagtccggagattggaagagcaaatgcttctacactactgatactgaatgtgacctcactgacgaaatcgtgaaggatgtcaagcaaacgtacctggctcgcgtgttctcttaccccgcgggaaacgtcgaatcaactggatccgcaggggagcctctgtacgaaaattcaccagagtttacgccataccttgaaaccaatcttggccagcctaccatccagtcattcgagcaggtcgggacgaaggtgaacgtgactgtggaagatgagcgcactctcgtgaggagaaacaacaccttcctgtcgcttcgcgatgtattcggaaaggatctgatctacaccttgtactattggaaaagctcatcctcaggaaagaagtactccacctccctggagctctggtacttgtggtcatcgtcgctctcctcctcctggttgtacctgtacacgtcagttgagcgacaagaatggggacgggcgggccggcggaccccccac

SEQ ID NO: 8812 - DNA, 714 bp, Artificial Sequence
  Description of Artificial Sequence: Synthetic coding sequence
atggagacacctgcatggcctcgggtgcctaggcccgagactgctgtggctaggaccctgcttttaggttgggtcttcgcccaggtggcgggcgcctccgggacgactaacactgtcgctgcctataacctgacttggaaatccactaacttcaaaacaatcctggaatgggagccgaaacccgtaaaccaggtctacacggtgcagatttctaccaagagcggagactggaaaagcaaatgcttctataccactgacaccgaatgcgacctgacggacgaaatcgtgaaggacgtgaagcagacatacctggcacgcgtgttctcttacccggcagggaacgtcgagtccacaggaagcgctggagagcccctgtacgaaaatagccccgagttcactccataccttgagacaaatttgggccagcctacgatccagagttttgagcaggtgggaactaaagtcaacgtgacagtcgaagacgagaggacattggttagaaggaacaacactttcctgtctctccgagacgtgttcgggaaggacctgatctacactctttactactggaaatcctcctcctccggaaaaaaatattccacatccctggagctttggtacctatggagttcgtctctgagttcttcctggctatatttatatacgtcggtggaacggcaggaatgggggagggccgggaggaggacaccccac

SEQ ID NO: 8813 - DNA, 714 bp, Artificial Sequence
  Description of Artificial Sequence: Synthetic coding sequence
atggaaacccctgcttggccgagagttccgcgcccggagactgcggtggctcggacgctgctgctgggatgggtgtttgcccaggtggcgggtgcgtcaggaaccacgaataccgtggcggcctacaacctgacctggaagtcgactaatttcaagacgatcttggaatgggaaccaaagccggtgaaccaagtgtacactgtgcaaatctcgactaagtccggtgactggaaaagcaagtgtttctacactaccgataccgagtgcgacctgactgatgagattgtgaaggacgtgaagcagacctatctggcgagagtgttctcttaccctgcaggaaacgtcgaatccaccggtagtgcaggcgaacctctctacgaaaactcgccggagttcaccccgtatctggagacgaatctgggacagccaaccatccaatccttcgagcaagtcggtactaaggtgaacgtgactgtggaggatgaacgcactctggtgcggcggaataacaccttcctgtcgctgagagacgtctttggaaaggacctgatctacaccctgtactactggaagtcgtcgtcgtccgggaaaaagtacagcacctcactggaactgtggtacctctggtcaagctcgctctcctcaagctggctgtacctgtacaccagcgtggagcggcaggaatggggacgggcgggccgccggactccgcat

SEQ ID NO: 8814 - DNA, 714 bp, Artificial Sequence
  Description of Artificial Sequence: Synthetic coding sequence
atggagacacctgcctggccccgcgttcccaggcccgaaacggctgtcgctagaaccttgttactaggctgggttttcgcacaggtggccggggcgtctggcaccactaacaccgttgcagcatacaacctgacgtggaaatctaccaacttcaagactatcctcgaatgggaacctaagcctgtgaaccaagtttatacggtccaaatctcaacgaagtcgggcgattggaagagtaaatgcttctacaccactgacactgaatgcgatctgactgatgaaatcgtcaaagacgttaagcagacatatctcgcgcgcgtcttctcctatccagcgggaaatgtggaatcaacgggtagtgccggtgagcccctctacgagaactcacccgaattcacgccatatctggaaactaacctgggacaacctacaattcagagctttgaacaagtgggaaccaaagtgaacgtaactgttgaggacgaaaggaccctggtgagacgaaacaatacctttctgagcttaagggatgtcttcggcaaggacctgatatataccctttattattggaaatcgagctcgtccggaaaaaagtatagcacatcactggagctttggtacctatggagtagctctctgagttccagctggctatatttgtatacaagtgtagaaaggcaggaatgggggcgggcaggtagaaggaccccccac

SEQ ID NO: 8815 - DNA, 714 bp, Artificial Sequence
  Description of Artificial Sequence: Synthetic coding sequence
atggaaacgccggcgtggccgcgagttccgcgaccggaaacggcggtagcgcgtacgctattactaggttgggtatttgcgcaagtagcgggtgcgtcgggtacgacgaatacggtagcggcgtataatctaacgtggaaatcgacgaattttaaaacgatattagaatgggaaccgaaaccggtaaatcaagtatatacggtacaaatatcgacgaaatcgggtgattggaaatcgaaatgtttttatacgacggatacggaatgtgatttaacggatgaaatagtaaaagatgttaaacaaacgtatctagcgcgtgtattttcgtatccggcgggtaatgtagaatcgacgggttcggcgggtgaaccgctatatgaaaattcgccggaatttacgccgtatctagaaacgaatttaggtcaaccgacgatacaatcgtttgaacaagttggtacgaaagtaaatgtaacggtagaagatgaacgtacgctagtacgacgtaataatacgtttctatcgttacgagatgtatttggtaaagatctaatatatacgctatattattggaaatcgtcgtcgtcgggtaaaaaatattcgacgtcgctagaattatggtatttatggtcgtcgtcgctatcgtcgtcgtggttatatctatatacgtcggtagaacgacaagaatggggtcgagcgggtcgacgtacgccgcat

SEQ ID NO: 8816 - DNA, 714 bp, Artificial Sequence
  Description of Artificial Sequence: Synthetic coding sequence
atggaaacccctgcctggcctagagtccccagaccagaaactgcagtggctcgtactttgctgttgggatgggtgttcgcgcaagtggcgggcgcatcgggtaccacgaacaccgtcgctgcatacaacctcacctggaagtccacgaacttcaagaccattcttgaatgggagcccaaaccagtgaaccaagtttacactgtccagatctccaccaagtccggagattggaagtcaaagtgtttctacacgaccgacaccgagtgcgatctgactgatgaaattgtgaaagacgtgaagcaaacttatcttgcgcgggtgttttcataccccgccggtaacgtggagtcgaccgggtcggccggagaaccactgtacgagaatagcccagagtttactccatacttggagacgaacctcggacagccaacgatccagtctttcgaacaggtgggtactaaagtcaatgtgaccgtggaggatgaacgaaccctcgtgcgccgcaacaatacttttctgagccttagagacgtttttggtaaggacctcatttacaccctgtactactggaagagcagcagctccggaaaaaagtactctacttcgctcgagctgtggtacttgtggtcgtcctccctgtcgtcatcatggttgtacctttacacctcggtagaacggcaggaatggggcagagcagggcggcgcacccctcac

SEQ ID NO: 8817 - DNA, 714 bp, Artificial Sequence
  Description of Artificial Sequence: Synthetic coding sequence
atggaaactccagcgtggcctcgggtcccaagaccggaaaccgccgtggcacgaactctcctgctgggatgggtgttcgcccaggtggcgggagcctcaggtaccaccaataccgtcgcggcgtacaatctgacctggaagtcaacgaactttaagaccatcctcgaatgggagccgaaaccagtgaaccaggtgtacactgtgcagatctcgaccaagagcggagactggaagtccaaatgcttctacaccaccgacactgagtgtgacctgacggacgagatcgtcaaggatgtgaagcagacctacctggcccgcgtcttttcctacccggctggtaacgttgaaagcaccggttcggccggagaaccactctatgaaaattctccggaattcaccccctacttggaaaccaacctgggacaaccgactatccagtccttcgaacaggtgggcactaaggtgaacgtgacggtggaggacgagcgcactctggtgcgacgcaataacactttcctctccctccgggacgtgttcggcaaggacctcatttacactttgtactactggaaaagcagctccagcggaaagaagtattcgacctcgcttgagttgtggtacctttggtcctcgagcctcagctcatcatggctctacctgtatacctcggtcgagcgacaagagtggggtcgcgctgggcggcgcactcctcat

SEQ ID NO: 8818 - DNA, 714 bp, Artificial Sequence
  Description of Artificial Sequence: Synthetic coding sequence
atggaaacccctgcttggcctagggtgcctcggcctgaaactgctgtcgcacgtactctgcttctgggatgggttttcgcacaggtcgccggagcgagcggcactacgaatactgtcgcagcgtacaatctcacttggaagtccacgaactttaagactatacttgaatgggaacccaagccagtcaaccaagtgtacactgttcaaatcagcactaagtcgggtgattggaaatcaaagtgcttctatactactgatactgagtgtgaccttaccgatgagattgttaaagacgtgaagcagacttatctggcaagagtgttctcgtacccggcagggaacgtggaaagcaccggctcagccggtgaacctctttacgagaattccccagagtttaccccataccttgaaaccaatctgggacaaccgactattcagtcattcgaacaggtggggaccaaggtgaacgtcaccgtggaagatgaacggaccctggtcagaagaaacaacacctttctttcccttagagacgtttttggaaaggatctcatatacaccctgtactactggaagtccagctctagcggaaaaaagtactcaacctccctggagctctggtacctttggagctcatcgctgtcgtcatcgtggctttatctgtacacctcggtggaacgccaagaatgggggcgcgccggtaggcgaaccccgcat

SEQ ID NO: 8819 - DNA, 714 bp, Artificial Sequence
  Description of Artificial Sequence: Synthetic coding sequence
atggaaactcccgcttggccaagagtccccaggccggagacagcagtcgccagaaccctgcttttgggctgggtttttgcccaggtggccggggctagcggcaccacaaataccgtcgccgcctacaacttaacatggaagagcacaaattttaaaacaatcctggagtgggagccaaagcctgtgaaccaggtttatacagtgcagatctccactaagagcggggactggaagtctaagtgcttctataccaccgataccgaatgcgatctgactgatgaaatcgtgaaagacgtcaagcagacctaccttgccagagtgttcagttatcctgctggcaacgtggagagcaccggctccgccggcgaaccactgtacgagaacagccccgaatttaccccttatctggagacaaatctaggccaacccaccattcagagtttcgagcaagtcggaactaaggtgaacgtcaccgtggaggacgaacgtactctggtgcgacggaataacacatttcttagcctcagggacgttttcggcaaggaccttatctacactctctattactggaaatcaagcagttctgggaagaaatattccacctccctggaattatggtatctgtggagtagttctctgtcctctagttggctgtacctttacacatccgttgagcggcaggaatggggccgggccggcaggaggaccccacac

SEQ ID NO: 8820 - DNA, 714 bp, Artificial Sequence
  Description of Artificial Sequence: Synthetic coding sequence
atggagactcctgcctggccgagagtcccaaggcctgagacggctgtggcacggactctgttgctggggtgggtgtttgctcaggtggcaggagcatccggaaccaccaacactgtggcagcatataacctgacttggaaatccacgaatttcaaaaccatactggaatgggaacctaagcctgtgaaccaggtgtacaccgttcaaatctccaccaagagcggggattggaagtcgaagtgtttttacactactgatactgaatgtgaccttaccgatgagattgtgaaggatgtgaagcagacctaccttgcacgagtgttttcgtaccctgcgggtaacgtggaatccactggctccgccggcgagcccctgtacgagaattcgcctgagtttaccccttacctggaaactaatcttgggcaaccaaccatccagtccttcgaacaagtcggcactaaagtcaatgtgaccgtcgaggatgagagaacccttgtgagaagaaacaacaccttcctgtcgctgcgcgatgtttttggcaaagaccttatctacaccctttactactggaaatcctcctcctcgggcaaaaagtactcaacttcgttggaactctggtatctgtggagctcatccctttcctctagctggttgtacctgtacacttcagtcgagaggcaagagtggggacgggccgggcggcgaaccccccac

SEQ ID NO: 8821 - DNA, 714 bp, Artificial Sequence
  Description of Artificial Sequence: Synthetic coding sequence
atggagactcctgcatggcctagagtcccaagaccagagacggctgtcgcgaggaccctgctccttggttgggtgtttgcccaggtcgcgggagcatcgggaaccaccaacactgtggccgcctacaacttgacttggaagtcgaccaatttcaagaccatcctggagtgggaaccaaaacctgtgaatcaagtgtacaccgtccagatctcgacgaagtcgggagactggaaatctaagtgtttttacactactgataccgagtgtgatcttactgatgagattgtgaaagatgtgaagcaaacttacttggcacgcgttttttcgtaccctgcaggaaacgtggagtccacgggatcagctggagaacctctgtatgaaaactcgcctgaatttactccctacctggaaactaacctggggcaacccactatccagtcgtttgagcaagtgggtactaaggtgaatgtgaccgtggaagatgaaagaaccctcgtgcgcagaaataacactttcctctcactgagagatgtctttggaaaggatttgatttacaccctctactactggaagtcatccagctcgggtaagaagtactcgacgtctctggaactgtggtatctgtggtcgtccagcctttcatcgagctggctttacctgtatacgagcgtcgaacggcaagaatggggccgcgcaggacggagaactccacac

SEQ ID NO: 8822 - DNA, 714 bp, Artificial Sequence
  Description of Artificial Sequence: Synthetic coding sequence
atggaaacccctgcttggccaagggtcccccggcctgagactgcagtcgcgcgcacattgttactcggttgggttttcgcccaggtcgctggtgccagcggcaccactaacacagtggccgcttacaacctcacctggaagtccacaaactttaaaacaatcctggagtgggaaccaaagcctgtcaaccaggtgtacacggtgcagatcagcacgaaatccggggattggaagagcaagtgcttttacaccaccgacacagagtgcgatctgaccgacgagatcgtgaaggacgtgaaacagacataccttgccagagttttctcttacccggccggtaacgtggaatcgaccggctccgcaggagaaccactgtacgagaactctccagaattcactccgtaccttgagactaacttgggtcagccaaccattcagagtttcgagcaagttggaaccaaggtgaacgtgacagtggaggatgagaggaccttggtgcgacgcaacaacacatttctctctctcagagacgtgtttggcaaggacctgatttacacactgtactattggaagtccagctcatctggaaagaaatattctaccagcttggaactgtggtatctttggtcaagttccctgagtagcagctggctttacttatatacttcagtggaaaggcaggagtggggcagggctggaaggcgaactccccat

SEQ ID NO: 8823 - DNA, 714 bp, Artificial Sequence
  Description of Artificial Sequence: Synthetic coding sequence
atggaaacacctgcatggcctcgcgttccacgcccagaaacagcggttgccagaactctgcttctcggctgggtttttgcgcaagttgcgggcgcaagcggcacgacaaatacggtcgccgcatataatctgacgtggaaaagtactaacttcaaaactatccttgaatgggaaccgaaacctgtgaatcaggtttacactgtgcaaatctcgaccaaaagtggagattggaaatcaaaatgcttctataccacggatacggaatgtgatttgacagatgagatcgtcaaggacgtgaaacaaacgtatttagcgcgagtgttttcttatccggcaggcaacgtcgaaagcacaggaagcgccggagaaccgctgtatgaaaactctccggagtttacaccgtacttagagacgaaccttggtcagcctacgattcagtcctttgaacaagttggcacaaaagttaatgtgaccgtggaagatgaacgaacacttgtacgcagaaacaataccttcctgtctctgcgagatgtattcggcaaagatctgatttacacattatattactggaaatctagctcatcagggaaaaaatattccacctctttagaactctggtatctgtggagtagttccctgtcgtcttcttggttgtacttatacacatctgtggaaagacaagaatggggccgcgcgggccggcggacgccgcat

SEQ ID NO: 8824 - DNA, 714 bp, Artificial Sequence
  Description of Artificial Sequence: Synthetic coding sequence
atggaaaccccagcatggccacgtgtgccccgccccgaaaccgctgtggccagaactctcctgcttgggtgggtctttgcgcaggtagcaggtgcctccggcaccactaataccgtggctgcctacaacctcacttggaaatcaaccaacttcaagactattcttgagtgggaacctaagcccgttaatcaagtctacaccgtgcagatttcgaccaagtccggcgactggaaatcgaaatgtttttacaccacggatactgagtgtgaccttactgatgaaattgtgaaggatgtgaaacaaacctacctggcacgtgtcttttcctaccctgcaggtaatgttgagagcactggatcggcaggtgaacctctctacgaaaacagcccagaattcaccccctaccttgaaactaacctgggtcagcctacgatccaatcttttgagcaagtgggaaccaaggtgaacgtcactgttgaggatgaacgaactctggtgcgaagaaataacacttttttgagtctgagggatgttttcggtaaggacctgatatacaccctctactattggaaatcatcttcgtccgggaagaagtactccacttcacttgaactgtggtatttgtggtcatcatcgcttagctcgagttggctctacctttacacgtcggtcgaacggcaggagtggggacgggcagggaggagaactccccac

SEQ ID NO: 8825 - DNA, 714 bp, Artificial Sequence
  Description of Artificial Sequence: Synthetic coding sequence
atggaaacacccgcatggccgcgagttcctcgccccgagaccgctgtggcacgcacgcttctgctcggttgggtctttgcccaagttgcaggtgcatctggcaccaccaataccgtggccgcatataatctaacgtggaagagcaccaacttcaagaccatcctggaatgggagcccaaacccgtgaaccaagtctataccgtgcagatctccaccaaaagtggtgattggaagagtaagtgtttctacacgaccgacacggagtgcgatctcaccgacgagatcgtcaaggatgtaaaacagacctacctcgcccgcgtctttagctaccctgctggcaacgtcgagtccaccggcagcgccggtgagccgttgtacgaaaacagtcccgaattcactccttacctggagaccaacctgggccagccgacgatccaaagtttcgagcaggtcggaacgaaggtcaacgtaaccgtagaggatgaacgaacattagtacgacgtaacaacactttcctctccttgcgtgatgtgttcggcaaagatctgatctacaccctttactactggaagtctagctcctccggtaagaagtactccacctccctcgagctctggtatctgtggtcctcatcactctcgtcctcgtggctttacctttataccagcgtcgagcgtcaagagtggggacgggccggtcggagaaccccgcat

SEQ ID NO: 8826 - DNA, 714 bp, Artificial Sequence
  Description of Artificial Sequence: Synthetic coding sequence
atggagacgcctgcctggccgcgagtgcctcggccggagaccgcggtagcacgcactctcctgctgggctgggtctttgctcaggttgcaggagcctctggtactacaaataccgtggctgcttataatctgacctggaagtctaccaattttaagaccatacttgaatgggagcccaagccggtaaaccaggtgtacaccgtccagatctccactaaatcaggtgactggaaatctaagtgcttctatacaacagatacggaatgcgacctgaccgatgaaatcgttaaagatgtaaaacagacatacctggcaagggtgttctcctatccagccgggaatgtggagtccaccggatccgctggtgagccactgtacgagaacagtccagaatttaccccttacctcgagaccaatcttgggcaacctacaattcagagcttcgaacaggttgggactaaagttaatgtgactgttgaggatgagagaactttagtgcgccggaacaacacatttctgtccctgcgcgatgtcttcggtaaagacttgatttacactctgtactactggaagtcatcatcttcaggcaaaaagtattccacatcacttgagctgtggtatctgtggtcgagctctttgtctagcagttggctgtacctgtacacatctgttgagcgacaggagtggggccgggccggcaggcggacgccccac

SEQ ID NO: 8827 - DNA, 714 bp, Artificial Sequence
  Description of Artificial Sequence: Synthetic coding sequence
atggagacacccgcctggcctagggtcccacggcctgagacagcggtagccaggacgctgttactcggctgggttttcgcacaggtggcgggcgcatcaggaaccaccaatacggtggccgcgtataatttaacttggaaatccactaattttaaaacgatcctcgagtgggagcccaaacccgtgaatcaggtctacactgtgcaaattagtaccaagagcggcgactggaaatcgaagtgcttctacactacggataccgagtgcgacttgactgacgagattgttaaggacgtgaaacagacgtatttggcccgagtcttttcttatccagccggcaacgtagagagcacaggatcagctggcgaacccttgtatgaaaactcacccgagttcacgccctacttggagacgaacctgggccagccaacaattcaatccttcgagcaggtgggtacgaaggttaacgtcaccgtggaggatgaaagaacccttgtgcgccgaaacaatacgttcctgagcctgagggacgtttttggcaaggatctaatttacacgctgtattactggaagtctagcagtagcggcaagaagtattcgacgtcgctggagctgtggtacctgtggtcatccagcctgtcgagctcgtggctatatctgtatacgagcgttgagcgccaagagtggggcagggccggacgcagaacaccacac

SEQ ID NO: 8828 - DNA, 714 bp, Artificial Sequence
  Description of Artificial Sequence: Synthetic coding sequence
atggagactccagcttggcctcgcgtcccacggcctgagaccgcggtcgcgcgaaccctcctgctcggctgggttttcgcccaggtcgcaggcgcctccggtacaacgaacaccgtagctgcctataatctcacctggaaatccactaatttcaagaccatattagagtgggaaccaaaacctgtcaaccaggtctacaccgtgcaaatctcaaccaaaagcggcgactggaaatcgaagtgtttctatactaccgacacggaatgcgatctgaccgatgaaatagtgaaggatgtgaaacagacgtatctagcccgcgtattttcttatcccgctgggaatgtagaaagtactgggagtgcaggggagccactctacgagaactctcccgaattcaccccgtaccttgagaccaacttggggcagccgactatccagtctttcgagcaggtaggcacgaaagtgaatgtgacggtggaagatgagcgcacgctggtgcggcggaacaacaccttcctgtcactgagggacgtcttcggcaaagatctaatttatactctgtattactggaaatccagctctagcggcaaaaagtattcaactagccttgagttgtggtacttgtggagtagcagcctcagttcttcttggttatatctgtatacatctgtcgagaggcaggaatgggggagagctgggaggagaacccctcat

SEQ ID NO: 8829 - DNA, 714 bp, Artificial Sequence
  Description of Artificial Sequence: Synthetic coding sequence
atggagacccctgcttggccaagagtgccacggcccgagaccgctgtcgccagaacactcctgctcggttgggtctttgcccaggttgcaggcgcatccgggaccacaaatactgtagctgcctataatcttacctggaagtccaccaattttaagacaatcctggaatgggagcccaaacccgtaaatcaagtgtataccgtccaaattagcaccaagtccggagattggaagagtaagtgcttctacaccacagatactgagtgtgacctgacggacgagatcgttaaggatgtaaagcagacctatcttgcacgagtcttctcgtatcctgcagggaacgtggaatctaccggctctgcgggggaaccactgtacgaaaactcaccggaattcacaccttacctggagacaaacctcggccaacccacaatccagtcttttgagcaagttggtactaaggtcaatgtgacggtcgaggatgaacgaacgctggtgagaaggaacaacacttttttgagcttgagggatgtgttcggcaaggaccttatttatacactctactattggaagtcttcctcgagtgggaagaagtactcgacttcactggagctgtggtacctttggagttctagtttgtctagcagttggctgtacttgtacacctctgtcgaacggcaggagtgggggcgagctggcaggagaaccccccac

SEQ ID NO: 8830 - DNA, 714 bp, Artificial Sequence
  Description of Artificial Sequence: Synthetic coding sequence
atggaaaccccagcctggcctagggtccctcgtcctgaaacagcagtagcgcggacactattgcttgggtgggtgtttgcccaagtcgcaggagcgagtgggactacaaatactgtcgccgcatacaatctcacctggaagtctacaaacttcaaaacaatactcgagtgggagccaaagcctgtgaatcaggtatacacagtccagatctctacgaaatcaggagactggaaatcgaagtgtttctatacgactgacactgaatgcgacctcaccgatgagatcgtgaaggatgttaaacagacctatctggcccgggtgttcagctatcccgccggaaatgtggagtctactggtagcgcaggagaaccactttacgaaaacagtcccgaattcacaccgtatttagagacaaatctcggtcaacctacaattcagagcttcgaacaagttgggactaaggttaatgtgacggtggaagatgaacggaccctcgtgagaaggaataacacgttcctcagcctgcgggatgtgttcggtaaggatctcatctacaccctgtactattggaagtcctccagctcggggaagaaatacagcacctctctggagctctggtacctttggtcatcctcattatcatcctcctggctctacctgtatactagcgtggagagacaagaatggggaagggctgggcggcgaactcctcat

SEQ ID NO: 8831 - DNA, 714 bp, Artificial Sequence
  Description of Artificial Sequence: Synthetic coding sequence
atggagacccccgcttggcctcgggtgcccaggccagaaacagctgttgccagaactctacttctcggatgggtttttgctcaagtcgctggcgccagcggtactaccaacaccgttgccgcatataacttgacatggaagagcacaaattttaagaccatacttgagtgggaaccgaaacctgtcaatcaagtttatacggtgcaaattagtactaagagcggggactggaaatccaaatgtttttatactacagatactgaatgcgatctcactgatgagattgtgaaagacgtgaagcaaacatatctagccagggtgttttcttacccagcgggtaatgttgaaagtacaggctcggccggcgaaccattgtatgagaactcacctgagttcacaccttatctcgaaactaatctggggcagccaacaattcaatcatttgagcaagttggaacaaaggttaatgtgaccgttgaagatgaaagaacgctcgttcgccggaataacacattcctttcactcagggatgtttttggaaaggatttaatttacaccttgtattactggaagtcctcatcgagcgggaagaagtattcaacctcactcgaactctggtatttgtggagcagcagcttgtccagctcatggctttatttgtacacatcggtggaacgacaagagtgggggagggcgggcaggaggactccccat

SEQ ID NO: 8832 - DNA, 714 bp, Artificial Sequence
  Description of Artificial Sequence: Synthetic coding sequence
atggaaacgcccgcctggccgcgcgtgcccagaccagaaactgcagtcgcaagaactttgctgctgggatgggttttcgcccaagtggctggggcaagcggaaccaccaatactgtggcagcgtacaatcttacctggaaatcgaccaactttaagactattcttgaatgggaaccaaagcctgtgaaccaggtgtacactgtccagataagcaccaagtccggagactggaagtctaagtgtttttacaccacggataccgaatgtgatcttaccgacgaaatcgtgaaagatgtcaagcaaacttacttggctcgggtgttcagttaccctgcaggcaatgtggagtccaccggatcggccggagaacccctctacgaaaattcacccgaatttactccatacctcgaaaccaacctggggcagcccaccatccagagctttgaacaggtgggtactaaggtgaatgtcaccgtggaagatgaaagaacgcttgtgcgaagaaataacacgttcctctccctcagagacgtctttggcaaggatctcatttacactctgtactactggaagagctcgtcctccggtaaaaagtactctactagcttggaactgtggtacctgtggtcctcctcactgtcaagctcctggctctacctctatacctcagtggagagacaggaatggggaagggcgggtcgccgtactccgcat

SEQ ID NO: 8833 - DNA, 714 bp, Artificial Sequence
  Description of Artificial Sequence: Synthetic coding sequence
atggaaacaccagcgtggccacgtgttcctcgacccgaaaccgccgtcgcacgtacactgctgcttggatgggtgttcgctcaggttgcaggtgcctctggcacgaccaatacggtggcagcgtacaatttgacctggaagagcaccaactttaagaccattttagagtgggagccaaaacctgtcaaccaagtctacacagtccaaatttcaaccaaaagtggcgactggaaatccaagtgtttttatacgacggacactgagtgcgacctcaccgacgaaatagtgaaggatgtcaagcagacatatcttgctcgtgtattctcctatccagccggcaatgtggaatctactggctcagcaggcgagccgttgtacgaaaacagtcctgagttcaccccttatcttgagacgaacctcgggcaacctacaattcagtccttcgagcaggtcggaactaaggtgaatgtgacggttgaggacgaaagaacactcgtccgtagaaataacacatttttgtccctgagagatgtgttcggcaaggatctcatttatacactatactactggaagtcaagctcctcaggtaagaagtatagcacttccctcgagctgtggtatctgtggtcctcatccctgtcgagttcctggttgtatctctacacgtcagtcgagcgccaagagtggggccgggcaggacgccggacgcctcac

SEQ ID NO: 8834 - DNA, 714 bp, Artificial Sequence
  Description of Artificial Sequence: Synthetic coding sequence
atggagacgcccgcctggccgcgggtcccccgcccggaaactgctgttgcgcgcaccctgctgctgggatgggtgtttgcacaagttgccggcgccagcggtaccaccaacaccgtggccgcctacaacctcacttggaagtcaaccaacttcaagacgatcctcgaatgggagccaaagccggtgaatcaggtgtacacggtgcagatcagtaccaagtccggtgactggaaatctaaatgtttctacactactgatactgagtgcgacctgactgatgagatagtgaaggacgtgaaacaaacctacctggctcgtgtgttctcgtacccggctggaaatgtggaatcgaccggatcggcgggagagccattgtacgaaaacagccctgaattcactccctacctggaaactaacttgggacagcctactatccagagtttcgagcaggtcgggaccaaggtgaatgtgacggttgaagatgaaagaaccctggtgcggcgcaacaacaccttcctgtcattgagagacgtgtttggcaaggacttgatctacaccctgtattactggaagtcctcttcgtcaggaaagaaatactcaacctcgctcgaactctggtatctttggagctcctccctttcgtcgtcttggctctacctgtacactagcgtcgagcgccaagaatggggacgggcagggcgccgcactccgcac

SEQ ID NO: 8835 - DNA, 714 bp, Artificial Sequence
  Description of Artificial Sequence: Synthetic coding sequence
atggagactcccgcctggccacgagtcccaagaccagagaccgcagtggcgcgaaccttgctcctcggctgggtgtttgcacaggtggcaggtgcatcaggcaccacgaataccgttgctgcatacaacctcacctggaagtctacaaacttcaagacaatattagagtgggagcccaagcccgtgaaccaagtgtatacagtgcagatctccaccaagtcaggggattggaaatccaagtgcttctacaccaccgatacagaatgcgacttaactgatgagatcgtgaaggatgttaaacagacctatctggcacgagtctttagctatcctgccggaaacgtcgaaagtaccgggtcagccggagagcctctgtacgagaattcacctgagttcaccccctacctcgaaaccaacctcggccagcccacaatccagtccttcgagcaggtgggcaccaaagtaaatgtgaccgtcgaggacgaacggacgctggtgcgaagaaacaacacattcctgtcactgcgggatgtttttgggaaagatctgatctataccctgtactactggaagtcttcttcttctggcaaaaaatattccacaagtctcgagctctggtacttgtggtcctcatctttaagcagttcctggctttatctttatacaagcgttgagcgacaggagtggggaagggctggccgcaggacacctcat

SEQ ID NO: 8836 - DNA, 714 bp, Artificial Sequence
  Description of Artificial Sequence: Synthetic coding sequence
atggagactccagcatggcccagagttcccaggccggagacagccgtggcacgtacgttgctactgggttgggtttttgcacaggttgccggcgcaagcggaactacaaacacagtcgccgcatacaatctcacttggaagagtactaattttaagaccatacttgaatgggagccgaagccagtaaatcaggtgtatacagttcagatttcgactaaatctggcgattggaaatctaagtgtttttacactacagatactgaatgcgatctgactgacgagatagtcaaggatgtgaaacaaacatatttagcgcgcgtgttctcctatccagccggcaatgttgaaagtaccggtagcgccggagaaccgttgtacgaaaattctcctgagtttacaccctacctggaaactaacctcggccaacccacgatacagagctttgagcaggtaggaacaaaagtgaatgtgaccgtggaggacgagagaactctcgtgagacgcaacaataccttcttatcactgcgcgatgtgttcgggaaagacctaatctatactctctactactggaagtccagctcttcagggaagaagtattctacttccctggaactctggtacttgtggtcgtcttcattgagtagctcatggttatatctgtatacatccgtcgagcggcaggaatgggggcgagctggacggcgaaccccacac

SEQ ID NO: 8837 - DNA, 714 bp, Artificial Sequence
  Description of Artificial Sequence: Synthetic coding sequence
atggagacccctgcctggcctcgggttccgcgaccggagacggcagttgcacggaccttgctgctaggttgggtcttcgcccaggtggcaggcgcatccggtacgactaacaccgtcgccgcctacaacctgacctggaagagcactaacttcaagacgatcctggaatgggagccgaagccagtcaatcaggtttacacggttcagatcagtacaaagagcggcgactggaaatccaaatgcttctacactaccgacacagaatgtgatttgaccgatgagatcgtcaaagatgtcaaacagacctatctggcgcgcgtatttagctaccccgcgggtaacgttgaaagcaccggttctgctggtgaacctctgtacgagaactccccggaatttactccatacctcgagactaacctgggccagccaaccatccagtcctttgaacaggtgggaaccaaagtgaatgtcactgtggaggatgagcgaaccctggtgcgccgcaataataccttcctgtctctgagggatgtttttggtaaagatctaatctacacgctgtactattggaagtccagctcaagcggcaaaaagtatagtacctctctggaactgtggtacctgtggtccagcagcctttcgtccagctggctctacctgtacaccagcgtggaacggcaggaatggggcagggccggacgccgaaccccgcac

SEQ ID NO: 8838 - DNA, 714 bp, Artificial Sequence
  Description of Artificial Sequence: Synthetic coding sequence
atggagactcccgcctggccaagggtgccccgcccggaaaccgcggtcgctcgcactctgctgctcgggtgggtgttcgcacaagttgcgggggctagtgggaccacgaacactgtggcagcctacaacttgacgtggaagtcgactaatttcaaaaccatcttggaatgggaaccgaagccagtgaatcaggtctacaccgtgcagatctcgactaagtcaggcgactggaagagcaaatgcttctacactaccgatactgagtgcgatctgaccgacgagatcgtgaaggacgtgaagcagacttacctcgcaagggtcttttcatacccagcggggaatgtcgagtccactggctccgccggagaaccactgtacgagaattcgccggaatttaccccatacctggaaaccaatttgggccaaccaactatccagtcctttgaacaagtgggaaccaaggtgaacgtgaccgtggaggacgaacgcacgctggtcaggcgcaataacaccttcctgtccctgcgggacgttttcggaaaagacctcatctacaccctctactattggaagtcctcgtcatcaggaaaaaagtacagcacttcactggagctgtggtacctgtggtcctcctccctgtcgagcagctggctgtacctctacacgagcgtggagagacaggaatggggaagagctggcagacgaaccccccac

SEQ ID NO: 8839 - DNA, 714 bp, Artificial Sequence
  Description of Artificial Sequence: Synthetic coding sequence
atggagactccggcctggccgagagtcccccggccggaaaccgcggtggcacggaccctcctgctgggttgggtgttcgcccaagtggccggcgcgtccgggaccactaatactgtggccgcttacaaccttacttggaaatcgaccaacttcaaaaccattctggaatgggagcccaaaccggttaaccaggtctacactgtgcagatctccaccaagagcggagactggaagtccaagtgtttctacaccactgataccgaatgcgatctcaccgatgagatcgtgaaggacgtgaagcagacctacctggctcgcgtgttctcctacccggcgggcaatgtcgagtcgactggatcggccggtgaacctctctacgagaactcgccagaattcacgccatacctggaaaccaatctgggacaacctactatccagagcttcgaacaggtgggaaccaaggtcaacgtgacggtcgaggacgaacgcaccctggtgaggcgaaacaatacttttctgtcgctgcgggacgtctttgggaaggacctgatctacactttgtactattggaaatcaagctcatcaggaaagaagtacagcacctcactcgaactgtggtacctctggtccagttctctcagctcgtcgtggctttatttgtacacttccgtggagcgccaagagtggggcagagcaggacgcaggacgccacat

SEQ ID NO: 8840 - DNA, 714 bp, Artificial Sequence
  Description of Artificial Sequence: Synthetic coding sequence
atggagactcctgcatggccacgcgttccacggcccgaaacggccgtggcacgcaccctgttgcttgggtgggtctttgcacaagtcgctggagcctcgggaacgactaacaccgtggcagcgtacaacctcacgtggaaatccaccaacttcaagaccattctcgagtgggaaccgaagcctgtgaaccaggtgtacaccgtgcagatttcgacgaagtccggtgactggaagtccaaatgcttttacacgacggataccgaatgtgacctcactgacgagatcgtgaaggacgtgaaacagacctaccttgcacgcgtgttctcttacccagcaggcaatgtggaatccaccggtagcgctggggagcctctttatgaaaattccccagaattcactccataccttgaaactaaccttgggcaaccgaccattcagtcatttgagcaggtggggactaaggtcaacgtgactgtcgaagatgagcgcaccctggtcagaaggaacaacacctttctttcccttcgggatgtgttcggtaaagatctgatttacactctttactactggaagtcatcgtccagcgggaaaaagtactctacctcacttgagctgtggtatctgtggtccagctcgctcagcagcagctggctttacctgtacacctcagtcgagcgccaagaatggggaagagcgggacggcgcacccctcat

SEQ ID NO: 8841 - DNA, 714 bp, Artificial Sequence
  Description of Artificial Sequence: Synthetic coding sequence
atggagacccctgcttggcccagagtccctaggccagaaaccgccgtcgccaggaccctgctcttgggctgggtttttgctcaggtagctggcgccagcggcacaaccaacactgttgctgcctataacctcacatggaaatccactaacttcaagaccattttggagtgggagcccaaaccagtcaaccaggtctatacagttcagatctctacaaaatctggcgactggaaatctaaatgcttctacaccaccgatacggagtgtgacttgaccgacgagatcgtaaaggatgtgaaacagacataccttgcccgagtgtttagttatccggcaggcaacgttgagagcacagggagcgctggcgagccgctgtatgaaaattctccagagtttaccccatacctggaaaccaacttggggcagccaactatccagagcttcgagcaggtgggaacgaaagtcaacgtcacagtggaggacgagagaactctcgtccggcggaacaacacatttctctccctccgggatgtatttggcaaggatctgatctacaccctctattactggaaatcttcctcttctgggaaaaaatacagcacgtcactggagctctggtacctctggagctccagcctgtccagctcatggctgtatctgtacacctctgttgagcggcaagaatggggaagagctgggcggcggacaccacac

SEQ ID NO: 8842 - DNA, 714 bp, Artificial Sequence
  Description of Artificial Sequence: Synthetic coding sequence
atggaaactccagcatggccaagggtgccacggccagagactgcagtcgcgcgcacgcttctgctgggatgggtgttcgctcaagtggccggagcctcgggaaccaccaatactgtggcagcgtacaacctcacgtggaaaagcaccaactttaagaccattctcgagtgggaacctaagcctgtgaaccaggtgtacaccgtgcaaatctcgaccaaatccggcgattggaagtctaagtgtttttacactacggacaccgaatgcgatttgactgatgagattgtcaaagacgtgaagcaaacctacctcgcccgggtgttttcgtaccctgcagggaacgtggagagcaccggctccgcgggagagccactttacgaaaattccccagagtttactccatacttggaaactaatttggggcaacctaccatccagtcctttgaacaagtgggtactaaagtgaacgtcaccgtcgaagatgaacgaactctggtgagaaggaacaatacctttctctcccttcgcgacgtgttcggtaaggacctcatctacactctgtactactggaagtcgtcgagctcgggtaagaaatactcgacgtcccttgagctctggtacctgtggtcctcgagcctgtcgtcatcatggctctatctttacaccagcgtcgagaggcaagaatggggcagagcgggacgtcgcactcctcac

SEQ ID NO: 8843 - DNA, 1383 bp, Artificial Sequence
  Description of Artificial Sequence: Synthetic coding sequence
atgcagagagtgaacatgatcatggccgagtcacccggcctgattaccatatgtctactagggtacctcttgagtgcggagtgcaccgtattcctggatcatgagaatgccaataagatccttaatagaccaaaaaggtacaattcgggcaagctggaggagttcgttcaggggaacctggagagggagtgtatggaagaaaagtgtagtttcgaagaggcccgggaagttttcgagaataccgaaaggactactgaattttggaaacagtacgtggatggcgaccaatgcgagtctaacccttgcctgaatgggggtagctgtaaggacgacataaattcatatgagtgttggtgtccctttggcttcgaaggcaagaactgcgagctggatgtgacatgcaacattaagaacggcaggtgtgagcagttttgtaagaattccgcagataacaaagtggtatgcagctgcacggaaggataccgactcgctgagaatcaaaaatcttgtgaacctgcagttcctttcccgtgcggacgggtgagcgtctcccagacctctaaacttactcgagctgaaacagtgttcccggacgtggattatgtcaacagtacagaggctgagacaatactcgacaacatcacacagagcacccagagctttaacgattttacaagagttgttggcggagaagatgccaaacctgggcaattcccgtggcaggtggtgctgaacggtaaagtggatgctttctgcggcggctcgattgtcaatgagaagtggatcgtgacagccgctcattgcgtggaaactggcgtgaagattactgtggtggcgggtgagcacaacattgaggaaacagagcacacagagcaaaagcgcaatgtgattcgcataattccacatcataattacaacgctgccatcaataaatataatcacgacattgcactgctcgagctggacgagccccttgtgttgaattcatatgtcactccaatctgtatagccgacaaggaatatacaaacatctttctcaagtttggctcgggttacgtatcaggttgggggcgggtcttccataagggaaggagcgcacttgtgctacagtacttacgtgttcccctggttgaccgcgccacctgcctccgatccaccaaatttactatatacaacaatatgttttgcgctggtttccatgagggtgggcgcgactcctgccagggtgattccgggggtccccatgtcacagaagtggaggggacctcctttttgacggggatcatatcctggggagaggaatgcgcaatgaagggcaaatacggtatatatactaaggtgtcccggtacgtgaattggatcaaagaaaaaaccaaactgaca

SEQ ID NO: 8844 - DNA, 1383 bp, Artificial Sequence
  Description of Artificial Sequence: Synthetic coding sequence
atgcaacgcgtgaacatgattatggcagaaagcccgggcctcattacgatttgcctgctgggatacctgttgtcggcagaatgtactgtgttcctggatcacgaaaatgccaacaagatcttgaaccgccccaaacggtacaactcaggtaagctcgaagagtttgtccagggcaacctggaaagggagtgcatggaggaaaaatgttcgtttgaggaagcacgggaagtgttcgagaacaccgaacgcaccactgaattttggaagcaatatgtggacggggatcagtgcgagtcaaatccttgcctgaacgggggctcctgcaaggacgacattaactcctatgaatgctggtgtccgtttggattcgaaggaaagaactgcgaactcgacgtgacttgcaatatcaaaaatggacgctgcgaacagttttgtaagaattcagccgacaacaaggtggtgtgctcgtgcactgagggctaccggctcgccgagaatcagaaatcgtgtgagcccgctgtgccgttcccatgcggccgcgtgagcgtgagccagacgagcaaactgacccgcgctgaaaccgttttcccggatgtggactacgtgaacagcacggaagcagaaaccattctggacaacatcacgcaatcaactcaatccttcaatgatttcactcgcgttgtcggaggggaagatgcaaagccgggtcaattcccatggcaggtcgtcttgaacggaaaagtcgatgccttctgcggaggatccatcgtcaacgagaagtggatcgtgaccgcagcgcattgcgtggaaaccggagtgaagatcaccgtggtcgcaggagaacacaacatcgaggaaactgagcatactgagcaaaagcggaatgtgattagaattatcccacaccacaactacaacgcagcgatcaataagtacaatcatgatatcgctctgttggaactcgacgagccgctggtgctcaatagctatgtcactcccatctgcatcgcggacaaagagtacactaacatcttcctgaagttcggatccggatacgtctccggatggggaagagtctttcataaaggaagatcggcacttgtcttgcaatacctccgggtgccgttggtcgaccgcgctacttgcctgcggtcgactaagttcactatctacaacaatatgttctgcgcgggattccatgagggcggacgcgattcgtgccagggtgactccggaggcccccatgtgaccgaagtggagggcaccagctttctcaccggtatcatctcgtggggggaagagtgtgcgatgaagggaaagtacggaatctacacgaaagtctcccggtacgtgaattggatcaaggaaaagactaagctcacc

SEQ ID NO: 8845 - DNA, 1383 bp, Artificial Sequence
  Description of Artificial Sequence: Synthetic coding sequence
atgcaaagagtgaacatgatcatggccgagtcccctgggttgatcactatctgtttattagggtacctgctgtccgcggaatgtacggtatttcttgatcacgagaacgcgaacaagattctgaatcgacctaagcggtacaactccggaaaattagaggagtttgtgcagggaaaccttgagagagaatgcatggaagagaaatgctcattcgaggaagcccgggaggtgtttgagaataccgagcgtaccaccgagttctggaaacagtacgttgacggtgaccagtgcgagtctaatccttgtctgaatggaggttcatgcaaggacgacatcaattcttacgaatgctggtgcccattcggatttgagggcaaaaactgcgaactcgatgttacatgtaatattaaaaacggtcgctgcgagcagttctgtaagaacagcgccgataataaggtggtatgtagctgcaccgaagggtatcgtctggctgaaaatcaaaagtcttgcgagccggctgtgccattcccctgcggacgcgtgtctgtttctcagacctccaagctaaccagggccgaaacggtttttccggatgtggactatgtgaactccaccgaagccgagacaatcctggacaacatcactcaatcaacacagtcattcaacgacttcaccagagtcgtaggcggcgaagatgccaagcccggccagtttccttggcaggtggtcctcaatggtaaggtcgacgcattctgcggggggagcatcgtcaacgagaagtggatagtcacggctgctcactgcgtcgagacaggagttaaaataaccgttgttgctggtgaacacaacatcgaagagaccgaacacacagagcagaaacgcaatgttataaggattatcccccatcacaattacaatgcagcaattaacaaatacaaccacgatatcgccctgttggaactcgacgagcccctagttctcaattcttacgtgactcctatttgcattgcagataaggaatacactaacatttttctgaagtttggcagcggatacgtttccggatgggggcgggtcttccataagggacggtctgccttagtgctccaatacctgcgggtacccctggtggatcgtgctacttgcctccggagcacaaagttcaccatctataacaatatgttttgtgcgggctttcacgagggcggacgagatagctgccagggggacagtggcggccctcatgtgacagaggtcgagggtacatctttcctaactggaatcatatcatggggagaagagtgcgccatgaagggtaagtacggtatatatacaaaggtctcccggtatgtcaactggattaaggaaaaaaccaagctcaca

SEQ ID NO: 8846 - DNA, 1383 bp, Artificial Sequence
  Description of Artificial Sequence: Synthetic coding sequence
atgcagagagtgaatatgattatggcagagagcccaggacttatcactatctgcctcctgggttacctcctgtccgcagagtgtactgtgtttctggaccacgaaaacgctaataagattcttaatcgccctaagcgatacaatagcggcaaactggaagagtttgtccagggaaatcttgaacgtgaatgtatggaggaaaagtgctcgttcgaggaagcacgagaggtgtttgaaaatactgaaagaactactgaattctggaagcagtacgtcgatggtgatcaatgtgaatcgaacccatgtctgaacggtgggtcatgtaaggacgacatcaattcttacgaatgttggtgtccatttggatttgaaggaaagaactgtgaactcgatgtgacttgtaacattaagaacggacggtgtgaacagttttgtaagaactcggcggataacaaggtcgtgtgtagctgcaccgaaggttaccgcctggcagagaaccagaagtcgtgtgaacctgcggtcccttttccctgtggcagggtttctgtctcgcagacctcaaagctgactcgggcagagactgtgttccctgatgtggattacgtgaatagcactgaagccgaaaccattcttgataacattacccaatcgacgcagtcgtttaacgattttacccgcgtggtggggggcgaagatgccaaaccgggccaatttccttggcaagtggtgctgaatgggaaggtggatgcattctgcggcgggagcattgtgaacgaaaagtggattgtgacggcggcacactgtgtggagactggcgtgaaaatcaccgtggtcgcaggggagcataacattgaagagacggaacataccgagcagaagcggaacgtcataaggataattcctcatcacaactacaacgcagcaattaacaagtacaaccacgacatagcgctgctggaactcgatgaacctctggtgcttaattcgtatgtgactcctatatgcatcgccgataaggaatacaccaacatattcctgaagtttggctcaggctacgtgtcgggctggggaagagtgttccataaaggaaggtccgcactcgtgcttcagtacctcagagtgccactggtggatcgggcaacgtgcctcagatcaactaagtttactatttacaacaacatgttttgcgccggcttccacgaaggaggaagggatagctgtcagggagactccggtgggcctcatgtcactgaagtcgaaggaacctcattccttaccggaatcattagctggggagaagaatgtgcaatgaagggcaagtacggtatttacaccaaagtgtcaaggtacgtgaattggattaaggaaaaaactaaacttacc

SEQ ID NO: 8847 - DNA, 1383 bp, Artificial Sequence
  Description of Artificial Sequence: Synthetic coding sequence
atgcagagagtgaacatgatcatggctgaatcgccgggactgatcaccatctgtctgcttggatacctcctgtccgcggaatgtactgtgttcctggaccacgagaatgcaaacaagatcctcaataggcccaaacggtacaatagcggaaaacttgaggaattcgtgcagggaaatctggaaagggagtgcatggaagagaagtgctcatttgaagaggcgcgagaagtgtttgagaacacggagagaactacggagttttggaagcagtacgtggatggcgatcagtgcgagtcaaacccgtgtttgaatgggggaagctgcaaggacgacattaactcatacgagtgctggtgtcccttcggattcgagggaaaaaactgcgaactggatgtcacgtgcaatatcaaaaacgggagatgtgaacaattctgcaagaactcagctgataacaaggtggtgtgctcatgcaccgagggctaccgcctggcagaaaaccaaaagtcgtgtgagccagccgtgccttttccgtgtggacgtgtgtcggtgtcccagacctcgaaactcacccgcgctgagactgtctttccggacgtggattacgtgaattccactgaggcagagactatcctggacaacataactcagtcgactcagtccttcaacgacttcaccagagtcgtgggaggggaagatgcaaaaccgggtcaattcccgtggcaggtggtgctcaatggaaaggttgacgccttctgtggaggaagcatcgtcaacgaaaaatggattgtgaccgcggcgcactgcgtggagactggagtgaaaatcactgtggtggccggagagcacaacattgaagaaactgagcataccgaacaaaagaggaacgtgatccggattatccctcatcacaactacaatgcggccattaacaagtacaatcacgacatcgccctgttggaactcgacgaaccgcttgtgctgaactcatacgtgaccccaatctgtattgcagataaggaatacaccaacatattcctgaagttcggctccggatatgtctccggatggggtcgtgtgttccacaagggaagatcagccctggttctccagtacctgagagtgccactcgtggaccgggcgacttgcctccgctcgacgaagtttactatctacaacaacatgttttgcgccggattccacgagggcgggcgggattcctgccagggagactcgggagggccgcatgtgaccgaggtcgaaggaacctccttcctgactggaatcatctcctggggggaagaatgtgccatgaagggaaagtacggcatctacaccaaggtgtcccgctacgtcaactggattaaggaaaagactaagctgact

SEQ ID NO: 8848 - DNA, 1383 bp, Artificial Sequence
  Description of Artificial Sequence: Synthetic coding sequence
atgcagcgtgtgaatatgatcatggcagagtcgccaggtctgataaccatctgcctcctcggataccttttgtcggcagaatgtaccgtatttctggaccatgaaaacgccaacaagattcttaatagacctaagcgctataactcgggaaagctggaagaattcgtccaaggaaacttggaaagagaatgcatggaggagaagtgttcctttgaagaggcacgtgaagtgttcgaaaacactgaacgcactactgaattttggaagcaatacgtggatggtgatcaatgcgagtcgaacccttgcctgaacggaggaagctgtaaggatgacataaactcatacgaatgctggtgcccattcgggtttgagggcaaaaactgtgaactggatgtgacttgcaacatcaaaaacggtagatgtgaacaattttgtaaaaactcagcggacaataaagtcgtgtgtagctgtactgaggggtacagacttgccgaaaatcaaaagagctgtgagccggcagtgccgtttccctgtggccgggtttcggtgagccagacctcgaaacttactcgcgccgagacggtgtttcccgatgtcgattacgtgaactcaaccgaggccgaaaccattctcgataacatcacgcagtccactcaaagtttcaatgatttcacccgtgtcgtgggcggggaagatgctaagccagggcagtttccatggcaagttgtgctgaatgggaaagtggacgcgttttgtggaggttcgattgtgaatgagaagtggattgtgaccgcggcgcactgcgtggaaacgggagtgaagatcacggtcgtcgctggagaacacaatatagaagaaacggagcatactgaacagaagcggaatgtgatccgtattatcccacaccacaattacaacgccgccatcaacaaatacaatcacgacattgccttgctggagctcgacgaaccactcgttctcaacagctacgtgacgcctatctgcatagccgacaaggagtacaccaatatcttcctcaagttcgggagcggttacgtctcaggttggggccgagtctttcacaagggtcgatctgcattggtcctgcagtacctgcgagtccccctggtggatagggcgacctgtctgcgtagcaccaagtttactatatacaacaacatgttttgtgcaggatttcatgagggtggtagggactcctgtcaaggtgatagcggaggaccccatgtcactgaagtggagggtacttcctttcttactggcatcatctcatggggtgaagagtgtgcaatgaagggcaagtatggtatctacaccaaggtttcgagatacgtgaattggatcaaggaaaaaaccaagctgact

SEQ ID NO: 8849 - DNA, 1383 bp, Artificial Sequence
  Description of Artificial Sequence: Synthetic coding sequence
atgcaaagagtgaatatgattatggcggagtcccctggtcttattactatttgtttgcttggttaccttctttccgcagaatgtaccgtgtttctcgaccatgaaaacgcgaataagattctgaacagaccaaagcggtacaattcaggaaagctcgaagagtttgtccagggcaatctggagcgcgaatgtatggaggaaaaatgctcgtttgaggaagcaagagaagtgttcgagaacacggaaagaaccactgaattctggaaacaatacgtggatggggatcaatgtgaatccaacccttgccttaatggaggatcatgtaaggatgacattaactcttacgaatgctggtgtcccttcggctttgaagggaagaactgtgagctcgatgttacctgtaacatcaaaaatggcagatgcgaacagttctgcaagaactcagcagacaataaggtcgtctgtagctgtactgaaggataccgccttgcagaaaaccaaaagagctgcgagcctgccgtgccctttccctgtggtagggttagcgtgagccaaacttccaaactcactcgtgcagaaaccgtgtttccggacgttgattacgtgaactcgaccgaggcagaaactattctggacaacattacccaaagcacccaatccttcaacgacttcacccgggtcgtcggaggagaagatgcaaagccgggacaatttccttggcaggtggtgctcaacggtaaggtcgacgccttttgcggaggatcgattgtgaatgagaaatggattgtgaccgctgcccattgtgtggaaacgggtgtcaagatcaccgtcgtggccggggagcataacatagaagaaaccgaacacactgagcaaaaaagaaacgtcatccgcatcatcccccaccacaattacaatgccgcaattaacaagtacaaccatgacattgcgctgctggaacttgatgaaccacttgtgcttaactcctacgtgaccccaatatgcattgctgacaaggaatacaccaacattttcctcaaatttggttcgggatacgtctctggttggggccgcgtgttccataagggacgcagcgcacttgtcctgcaatatctgcgggtgcctctggttgatcgggcaacttgtctgaggagcaccaagtttaccatctataacaacatgttctgcgcaggatttcatgaaggtggacgcgattcctgccaaggtgattcgggtggtccccatgtcaccgaggtggagggcacgtccttccttacggggatcatttcctggggtgaagagtgtgctatgaagggaaagtacggtatatacacgaaggtgtcacggtatgtgaactggatcaaggaaaagaccaagctgact

SEQ ID NO: 8850 - DNA, 1383 bp, Artificial Sequence
  Description of Artificial Sequence: Synthetic coding sequence
atgcagcgggtgaacatgattatggctgagagcccaggcttaatcaccatttgcttgctaggatatctcctgtccgccgagtgtacagtgttccttgatcacgaaaacgccaataagatcctgaaccgtcctaaaagatacaacagtggcaagctcgaggagtttgtccaaggtaacctagagcgtgaatgtatggaagaaaagtgcagctttgaagaggctcgtgaggtcttcgaaaacacagagcgtaccaccgaattctggaaacagtacgttgacggtgaccaatgtgaatccaacccgtgcctcaacggtggctcatgtaaggacgatattaatagttatgagtgctggtgccccttcggtttcgagggcaagaattgcgagctcgacgtcacttgcaatatcaagaacggacgatgtgaacagttctgcaagaattctgcagacaacaaggtcgtgtgttcgtgtaccgagggttaccggttggccgagaaccaaaagtcatgcgaaccggctgtccccttcccctgtggacgtgtaagcgtaagccagaccagtaagctcacgcgagcagaaacggtgttcccagatgtcgactacgttaactcaactgaggccgagaccattctggacaatatcacacagtcgacgcagtctttcaacgattttacgagagtagtgggtggtgaagatgccaagcccggacagtttccttggcaggtggttctgaacggtaaggtcgacgccttctgtggcgggtcgatagttaatgaaaagtggatcgtcaccgcagcgcactgcgttgagactggtgtgaagatcacagtggttgcaggtgagcataatatagaagaaaccgaacatacagagcagaagaggaatgtcatccggattatacctcatcataattataacgcagcgattaacaagtataatcatgatattgctttgctcgagctggatgagcccttagtacttaattcatacgtgactccgatctgtatcgccgataaggaatataccaacatctttttgaagttcggttctggctacgtgagcggctggggacgtgtgttccacaagggccgcagcgcccttgttcttcaatacttgagagttcccctagtggatcgagcaacgtgtctacgctctactaagtttacgatttacaataacatgttctgtgcaggatttcatgaaggtggtagagactcgtgtcaaggtgactccgggggccctcatgtcactgaagttgaaggtacgagcttcttgaccggcatcatttcttggggcgaagagtgtgcaatgaagggtaaatacggaatctataccaaggtgagccgatacgtgaattggatcaaggaaaaaacaaagctcaca

SEQ ID NO: 8851 - DNA, 1383 bp, Artificial Sequence
  Description of Artificial Sequence: Synthetic coding sequence
atgcagcgagttaacatgattatggccgagtcgccaggactgattacaatctgtctgctaggctacttgctatcggcggaatgtacagtgttccttgatcacgaaaatgccaacaagattctgaatagaccgaaacgctataattcgggaaaactcgaagagttcgtacagggaaatttggaacgcgagtgcatggaagaaaagtgctcctttgaagaggcaagagaggtcttcgaaaatacagaaaggactacggagttctggaagcaatatgtagatggagaccaatgcgagtcaaatccctgcctcaatggcggttcatgtaaagatgacattaattcatatgagtgttggtgcccatttggcttcgaaggaaagaattgtgaactcgatgtcacttgtaacatcaaaaatggtcgatgtgaacagttctgcaaaaactctgctgacaataaggttgtttgttcgtgtaccgagggatacagacttgctgagaatcaaaagtcctgcgagccagccgtaccgttcccatgcgggcgagtttcagttagtcaaacatcgaagttaactcgagcagaaaccgtgtttccggatgtcgattatgtaaattctacggaggcagaaactattcttgataatataacgcaatctacacagagctttaatgacttcacccgagtcgttggaggagaagatgcgaaaccaggacaattcccttggcaagttgtgcttaatggaaaggttgatgctttttgtgggggaagtatcgtcaatgagaagtggatagtgacagctgctcattgtgttgaaacgggggtcaaaattactgttgttgctggagaacataacattgaagaaactgaacatacggaacagaaaagaaacgttattcgaatcattccacatcacaattataacgccgcaattaataaatacaatcatgatattgcattattagaactggacgagccactcgtgctcaattcatacgtcacaccaatttgtatcgccgataaggagtatacgaatatctttctaaagtttggatcaggatatgttagcggttggggacgggtttttcataagggcagatctgcattagtattgcaatatctaagagtaccactggtggatcgagctacttgcctacgttcgactaaatttaccatttataataatatgttctgcgccggattccatgagggtggaagagatagttgtcaaggagactcgggcggaccacatgtgaccgaagttgaaggaacaagttttttgactggaattatttcttggggagaagagtgcgcaatgaagggaaaatacggcatttacacaaaagtttcaagatatgtgaattggattaaggagaaaaccaagttaacg

SEQ ID NO: 8852 - DNA, 1383 bp, Artificial Sequence
  Description of Artificial Sequence: Synthetic coding sequence
atgcaacgggtcaatatgatcatggccgagtcgcctggactcatcaccatttgcctccttggatacctcctctcggcagaatgtactgtctttctggaccatgagaacgcaaacaaaatccttaacagaccgaaacggtacaattccgggaagctggaagaatttgtgcaaggaaatctggagagggaatgcatggaggaaaagtgctcattcgaagaggctcgtgaggtgtttgagaacaccgaaaggactaccgagttctggaaacagtacgtcgacggggaccagtgtgaatcgaacccttgcctcaacggaggatcgtgcaaggatgacattaacagctacgaatgctggtgtccgttcggcttcgagggcaagaattgtgaactggacgtcacctgcaacattaagaacggacgctgcgagcagttctgcaagaacagcgccgataacaaagtggtgtgcagctgtactgaaggttacagactggccgaaaatcaaaagtcatgtgaaccagccgtcccgtttccgtgtggaagggtatctgtgtctcagaccagcaaactcactcgcgccgagactgtctttcccgatgtggattacgtgaattcaactgaggctgaaaccatcctggataacatcacgcagagtacgcaatccttcaatgatttcactcgggtggtcgggggagaggacgcgaagccaggacagttcccgtggcaagtggtcctgaacggtaaggtggatgcattttgcggtggttccatcgtgaatgaaaaatggatcgtgaccgccgcacactgtgtggaaaccggagtgaagatcaccgttgtggcaggagaacataacattgaggaaaccgagcatactgaacagaagcgaaacgtcattcggataatccctcaccataactacaacgctgcgatcaataagtacaatcacgacattgctttgctggagctcgacgaaccactggtgcttaactcctacgtcaccccaatctgcatcgccgacaaggagtacactaacatctttctgaaatttggatctggatacgtgtcgggctggggacgagttttccataaggggcggtccgcactggtgctgcagtacttgcgcgtcccgttggtggaccgagccacctgccttaggtccacgaagttcaccatatacaataacatgttctgcgcgggcttccacgaaggcggaagagacagctgccagggcgatagcggcggacctcacgtgactgaagtggaaggaacttcgttcttgactgggatcatctcttggggcgaggagtgcgctatgaagggaaagtacggaatctatactaaggtgagcagatatgtgaattggatcaaggaaaagactaaactgacc

SEQ ID NO: 8853 - DNA, 1383 bp, Artificial Sequence
  Description of Artificial Sequence: Synthetic coding sequence
atgcagagagttaatatgattatggccgaatctcctgggctgataacaatatgtttgttagggtaccttctgtccgccgaatgtactgtgttcctagatcatgaaaatgccaacaaaattctgaatcgccctaaacggtacaattcaggaaagctggaagaattcgtacagggaaacctcgagagggaatgtatggaagagaaatgctccttcgaagaagctagggaagtatttgaaaacacagaaagaacaactgaattctggaaacagtatgtggatggagatcagtgtgagagtaacccttgcttgaatggggggtcttgcaaagatgatatcaattcctatgagtgttggtgcccttttggatttgaagggaagaattgtgaattagatgtaacatgtaacatcaaaaacggacggtgtgagcagttttgtaaaaattcagctgataacaaagttgtgtgttcctgtacagaagggtatagattagctgaaaaccagaagtcatgcgaacctgccgtaccgttcccttgtgggcgcgtttctgtctcacagacatcaaaactaactagagcagaaacagtgtttccagacgtagattatgtaaactctactgaagccgaaacaatactggataacataacacaatccacacagtccttcaacgactttacaagagtggtggggggagaggacgctaaacccgggcagtttccttggcaggttgtactaaatggaaaggtggatgccttttgtggaggatctatcgtgaatgaaaaatggatcgttacagctgctcattgtgtggagactggggtgaaaattacagtcgtagccggagaacacaacatcgaagagacagaacacacagaacagaagaggaacgtcataaggattatcccccaccataattataacgctgccataaacaaatataatcatgatattgccctccttgagctagatgaaccactcgtgcttaactcttatgtgactcccatctgtatagcggacaaagaatatacaaatattttcttgaaatttggatcgggatatgtttcaggatgggggagagtttttcataaagggagatctgctctcgtattgcagtatctgagggttccccttgtggacagagctacatgtctccggtctacaaaattcacaatttataacaacatgttctgcgccggatttcatgaaggggggagagactcttgtcagggggattcagggggacctcatgtgactgaggtggagggaacttccttccttacagggataatatcctggggagaggaatgcgcgatgaaaggaaaatacgggatatatactaaagtatctcgatatgtgaactggattaaagaaaaaactaaacttaca

SEQ ID NO: 8854 - DNA, 1383 bp, Artificial Sequence
  Description of Artificial Sequence: Synthetic coding sequence
atgcagcgggttaatatgatcatggccgaatccccagggctgatcactatctgcttactgggctacctcctgtcagctgaatgcacagttttccttgatcatgaaaatgcaaacaaaatcctcaacagacccaaacgctataatagcgggaagcttgaagaatttgtacagggcaacttggagcgagagtgtatggaagagaaatgttcttttgaggaggcacgagaagtgttcgagaataccgaaagaacgactgaattttggaagcagtatgttgatggagaccagtgcgaatctaacccttgtctgaatggaggcagctgcaaggacgatatcaattcctacgagtgttggtgccctttcggatttgagggaaagaactgtgagctcgacgtgacgtgcaatattaagaatgggcgatgcgagcaattctgtaagaacagcgccgacaataaagtggtatgttcctgcactgaggggtataggctggcagagaaccagaagtcttgcgagccggccgtgcccttcccctgcgggcgtgtatccgttagtcagacttccaaacttacccgtgcggagacagtgtttccagacgtggactatgttaacagcacggaggccgagaccattctggacaatatcacgcagtcgacccagtcttttaacgatttcactagggtggtcggcggagaagacgccaaacctggccaatttccatggcaagtggttctgaacgggaaggtcgacgccttttgtggtggaagcatcgtaaacgaaaaatggattgtcactgccgctcattgcgtcgagacgggagtcaagatcactgtggtggctggagagcacaacatcgaggaaaccgaacatacagaacagaagagaaacgtgatcaggatcattccacaccacaattacaacgcagcaatcaacaaatacaatcacgacattgcactgctggagctcgacgaacccctggtcttgaattcttacgtcacccccatctgcatcgccgataaggaatacacaaatattttccttaagttcgggagcggttatgtgtctggatggggacgtgtgtttcataagggaaggagtgccctcgttttgcagtatctcagggtacctcttgtagaccgagcaacatgcctgaggagcacaaaattcactatctataacaacatgttctgcgctgggtttcatgagggcggacgagactcctgccagggggactctggcggtccccacgtgacagaagtcgagggcacctccttcctgacagggatcattagctggggagaagaatgcgccatgaaggggaagtacggaatttataccaaggtatctaggtacgtcaattggatcaaagagaaaacgaagttgacc

SEQ ID NO: 8855 - DNA, 1383 bp, Artificial Sequence
  Description of Artificial Sequence: Synthetic coding sequence
atgcagcgcgtcaacatgatcatggcagaatccccaggactgatcacaatctgtctcttaggctatctgctatctgctgagtgtacagtttttctcgatcatgagaacgcgaataaaatcctgaacagacctaagagatacaattccggcaaactggaggagtttgtgcagggaaacctggaaagggagtgtatggaggaaaagtgcagctttgaggaagctagagaggtttttgaaaataccgaaagaactaccgaattttggaagcagtacgtggacggcgatcagtgtgaatctaacccctgcttaaatggtggttcctgtaaagacgatatcaactcctacgagtgttggtgtccattcggttttgaggggaaaaactgcgaactcgacgtgacgtgcaatattaaaaacggacgatgtgagcaattttgcaaaaattcagccgataacaaagtcgtctgcagctgcacagagggttatagactggctgaaaaccagaaatcctgtgaacccgcagttccctttccatgcggacgtgtttctgtgagtcagacctctaaactgacaagggccgaaaccgtttttcctgacgttgattatgtgaattcaacggaagccgagaccattctcgacaacataacacagtctacacagtcattcaacgactttaccagagtggtcggcggtgaggacgccaaacctggccagttcccatggcaggtggtcctgaatgggaaggtcgatgcattctgtggtggaagcattgtgaatgagaagtggatcgtaactgcagctcactgtgtggaaacgggcgtgaagatcacagtcgtcgcgggcgaacataatattgaggagacggagcatacagagcagaagagaaatgttatccgcataatcccacaccacaactacaatgcagcgatcaacaaatataatcatgacatcgctctgctggagcttgatgaaccccttgtgttgaactcatacgtcactccaatatgcatcgctgacaaggagtatactaatatttttctcaagtttggctctggttacgtgagcggctggggccgtgtgtttcataaaggccgcagcgccttggtgttacagtatcttagggtacccctggtcgaccgggctacctgtctgcgatcaacaaaatttacaatatacaacaatatgttttgcgcgggcttccacgaaggcggtcgagattcctgccagggcgacagcggtggcccgcatgttaccgaggtagagggtacaagttttctcacaggtattatcagctggggagaagagtgcgctatgaagggcaagtacggtatatatactaaagtgagcagatacgtaaactggattaaggagaagacaaagctgaca

SEQ ID NO: 8856 - DNA, 1383 bp, Artificial Sequence
  Description of Artificial Sequence: Synthetic coding sequence
atgcaaagggtgaatatgattatggctgagagtcccggccttataacgatatgcctcctcgggtatctcctgagcgctgaatgcaccgtgttcctcgaccatgagaacgctaataagatcctgaatcggcccaagaggtacaacagcggaaaactcgaggaatttgttcagggcaatttggagcgcgagtgtatggaggaaaaatgttcttttgaagaggcccgggaggtcttcgagaacaccgagagaaccactgagttctggaagcagtatgtggatggcgaccagtgtgaaagcaatccttgtctgaacggcggaagttgtaaggacgacatcaatagttacgaatgttggtgccctttcgggtttgaaggcaaaaactgcgaactggacgttacatgcaatataaaaaacggccggtgcgaacaattctgcaaaaattcagccgacaacaaggtcgtctgttcctgcaccgaagggtatagactggcagagaatcagaagtcctgcgaaccggccgtgcctttcccttgtggccgagtttctgtcagtcagacatcaaaactgacacgggctgagacagtgttccccgatgtggattatgtgaatagcacagaggctgaaaccatactggacaatattactcagtccacccaatccttcaacgattttactagagtagtgggaggggaggatgctaaaccaggtcagttcccgtggcaggtggtactgaacggcaaagtcgacgctttttgtggcgggtcaatcgtcaatgagaaatggattgtcacagcagctcattgcgtcgagaccggcgtgaagattacagtggttgcaggggaacataatatcgaggaaaccgagcacacagaacagaaacggaatgttattagaattataccccatcacaattataatgccgcaatcaacaaatataatcacgacatcgcattgctcgaacttgacgagcccttggtcctgaatagttacgtgactcctatctgcattgccgacaaagagtatactaatatcttcctcaagttcggcagtggatatgtatcaggatggggcagagtgttccacaaaggaagaagtgctctggtccttcaatacttgagggttccactggtggacagagctacttgtctcaggtcaaccaagttcacgatttataataatatgttttgtgccgggttccacgaaggggggagggactcttgtcagggcgacagcggtggtccacacgtgacagaagtggagggtacatccttcctgacaggtattatcagttggggagaggaatgcgcgatgaagggcaaatatggcatatatacgaaggtgtcccgctacgtgaattggattaaggagaaaaccaaacttaca

SEQ ID NO: 8857 - DNA, 1383 bp, Artificial Sequence
  Description of Artificial Sequence: Synthetic coding sequence
atgcagagggttaatatgattatggcagaaagtcctggtttgattaccatctgtctgctgggctacctgctgtctgcagagtgtacggtctttctagaccacgagaacgcgaacaaaatcctgaatagacccaagaggtacaattccggtaagctcgaggaattcgtgcagggcaacctcgagcgcgagtgcatggaggaaaaatgttctttcgaggaggcacgcgaggttttcgaaaataccgagcgaacgaccgagttctggaaacagtatgtagacggggaccagtgcgagtcgaatccctgcctgaatggagggtcatgtaaggatgacattaactcctatgagtgctggtgtccattcggattcgagggcaagaattgcgagctcgatgttacctgcaacataaaaaacggacgctgcgagcaattttgcaagaatagcgccgacaataaggtggtttgctcctgtaccgagggctaccgactcgccgaaaatcagaagtcctgcgagcccgccgtgcccttcccctgtggccgggtgagcgtcagtcaaacctctaaattgacaagagcagagactgtttttcccgacgtggactacgtgaactctaccgaggccgaaacgatcctcgacaacattactcagagtacacagtcatttaacgatttcactagagtcgttggaggggaggacgccaagccgggacagtttccctggcaggtggttctgaatggcaaggtggatgccttctgcgggggctccatagtgaatgagaaatggatagtcaccgctgctcactgcgtggagactggggtgaagatcaccgtggtcgcaggcgaacacaacattgaggagaccgaacatacggagcagaaacgcaacgtgataagaataatcccacaccataactataacgcagctattaataagtataatcatgacatcgcgctgttagaactggatgaaccgctggtgctcaattcctacgtgacccccatctgcatcgctgataaggagtacacaaatatcttcctgaagttcggttcaggttacgtgagcggctggggtcgggtattccataaggggcgcagtgctctggtgctgcagtacttgagggtcccacttgtcgaccgggcaacctgtttgaggtctacgaaatttactatctacaataatatgttttgtgctgggttccatgagggggggagagattcctgccagggggactctggagggccgcacgttaccgaggtggaggggacttccttcctgactggcataatctcctggggggaggagtgcgccatgaaaggaaaatatggcatctacacaaaggtaagtaggtacgtaaattggataaaggagaagacaaagctaacc

SEQ ID NO: 8858 - DNA, 1383 bp, Artificial Sequence
  Description of Artificial Sequence: Synthetic coding sequence
atgcagcgcgtcaatatgatcatggccgaatcgccggggctcatcaccatttgccttctggggtatctgctctccgcggaatgtacggtgttcctggaccacgaaaacgctaataagatcttgaacaggccgaagcgatacaactcagggaagctcgaggaattcgtgcaggggaatctggagagggagtgcatggaagagaagtgtagcttcgaagaggcccgggaggtgttcgaaaatactgaacggactacggagttctggaagcaatacgtcgacggagatcagtgcgagtctaatccctgcctgaacggaggatcctgcaaggacgacatcaattcgtacgagtgttggtgtccatttggtttcgaaggaaagaactgcgagttggatgtgacctgcaacataaagaatggtcgctgcgaacagttttgcaaaaacagcgccgataacaaggtcgtctgctcctgtactgagggataccgtctggctgaaaaccagaagtcgtgcgagcctgctgtgcctttcccatgcggtagagtctcagtgtcacaaacctctaagctgactcgcgctgagactgttttcccagacgtggattacgtgaactcgaccgaagcagaaaccatcctcgataacatcactcagagcacccagagcttcaacgattttacccgcgtggtgggaggagaggatgcaaagccaggccagttcccttggcaagtagtgctcaatggaaaagtggacgccttctgcgggggttctatcgtgaacgagaagtggatcgtcaccgccgcacactgcgtggagactggagtgaaaatcaccgtcgtcgccggtgaacataacatcgaggaaactgagcacactgaacagaaacggaatgtgattcggatcattccacaccataactacaatgccgctattaacaagtacaaccacgacatcgctctcctggaattggacgagccgctggtgctgaattcctacgtcactccgatctgtatcgcagataaggaatacaccaatatcttcctcaaattcggatcgggctacgtctcgggatggggaagggtctttcataaagggcggtcagcccttgtccttcaatacctcagggtgccacttgtggacagagctacctgtctgcggagcactaagttcaccatctacaacaacatgttctgcgccgggtttcatgagggaggccgtgactcgtgccaaggcgactcgggcggaccgcacgtgactgaggtggaaggcaccagtttcctgaccggaatcatttcctggggggaagaatgtgctatgaagggcaagtacggcatctacaccaaagtctctcgctacgtgaactggatcaaagaaaagaccaagctcact

SEQ ID NO: 8859 - DNA, 1383 bp, Artificial Sequence
  Description of Artificial Sequence: Synthetic coding sequence
atgcagagagtaaatatgatcatggccgagagcccgggcctgattaccatttgcctgcttggatacctcctaagcgctgagtgcaccgtgtttctcgatcacgagaacgctaacaaaattcttaacagacccaagagatataacagcggaaaactggaagagtttgtgcaggggaacctggagagggagtgcatggaggagaaatgcagcttcgaagaagcccgggaagtttttgaaaacaccgaaaggaccactgagttttggaagcaatacgttgatggcgaccaatgtgagagtaacccgtgtcttaatggaggaagctgcaaggatgacatcaactcatacgaatgttggtgcccattcggattcgaagggaagaactgcgagctggatgtaacctgcaatatcaaaaacggccgctgtgaacagttctgcaaaaacagcgctgataacaaagttgtgtgcagttgcacagaggggtatcgcctggccgaaaaccaaaaatcctgcgaaccagctgttcccttcccatgtggaagagtgtctgtgtctcagacttccaaactcacacgcgccgagaccgtgtttccagatgtggactatgtgaatagtactgaagcagaaaccattttggataatatcactcaatccacacagtcctttaacgatttcactcgcgtggtcggcggagaggacgccaagcctggacagttcccttggcaagtagtcttgaacggaaaggttgatgccttttgcggaggaagtattgtcaatgaaaagtggattgtgaccgccgcacattgcgtggagaccggtgtgaagatcactgtcgtggctggagagcacaatatcgaagaaacagagcacacagaacaaaagagaaacgtgattagaattattccccatcataactacaacgcggctattaacaaatataaccatgacattgctttgcttgagctcgatgagcctttagtccttaacagctatgtaactcctatctgcatcgctgataaggaatacaccaacatttttctgaaattcgggtctggatatgtttctggatgggggcgagtatttcataaagggcgtagcgctttggtgttacagtacttgcgagttcccctcgttgatcgcgccacctgcttgcgcagtacaaagtttaccatttataacaatatgttttgtgcaggatttcatgagggaggaagagattcttgccagggtgacagtgggggaccccacgtgaccgaagtcgagggtacatcttttttgaccggcatcatctcttggggtgaggagtgtgccatgaagggaaagtacggaatctacaccaaggtctcaaggtacgtcaactggatcaaggagaagaccaaactaacc

SEQ ID NO: 8860 - DNA, 1383 bp, Artificial Sequence
  Description of Artificial Sequence: Synthetic coding sequence
atgcagcgcgttaatatgatcatggccgagtccccagggctgatcaccatctgcctacttgggtacctgctcagcgccgagtgtactgtgttcttggatcacgagaacgccaataaaatccttaacaggcctaagcgatataattctggaaaattagaagagttcgttcaaggcaacctggagagggaatgtatggaagaaaagtgctcgttcgaagaagctagagaggtcttcgaaaatacagagcgaacaacagaattctggaaacagtacgttgatggcgatcagtgcgagtctaatccttgtcttaacgggggctcttgtaaggatgacatcaattcatatgagtgttggtgcccttttggctttgaaggcaagaattgcgagctcgacgtcacctgcaacatcaaaaatggtcggtgcgagcaattttgtaagaactccgcggataataaggtggtctgctcatgcactgagggctaccggctcgccgagaaccaaaagtcatgcgagccagcagtgccctttccatgtgggcgcgtctccgtgtctcaaaccagcaaactgacaagagccgagactgtcttccccgacgtggactacgtcaattccacggaggcagaaacaatcctggacaacattacccagtctacccagagctttaatgatttcactcgggtggttgggggcgaggatgcgaagcctggacagttcccttggcaagtggtgcttaacggcaaggtggacgccttttgtggcggtagtatagtcaacgagaagtggatagtgacggctgcccattgtgtggagactggcgtcaagatcactgttgtcgcgggagaacacaatatagaggaaacggaacacaccgagcagaagagaaatgtcatcagaattatacctcaccacaactataatgctgccattaacaagtacaaccatgatatcgccttgctggaattggatgagcctttagtactgaatagctacgtcacccctatttgtatcgcggacaaggagtacaccaacatctttttaaagtttggatctggttacgtaagtggatgggggcgggtgttccacaaaggtcgatcagcactggttttacagtatctgcgagtccctctagtcgacagagccacctgcttacgctccaccaaatttactatttacaacaacatgttctgcgcaggattccatgaaggtggccgcgactcctgtcagggcgattctggtggcccgcacgtgactgaagtggaaggcactagcttccttacaggcattatttcgtggggcgaagaatgcgctatgaaaggtaaatacggaatttacaccaaagtgagccggtatgtcaattggattaaagagaagaccaagctgact

SEQ ID NO: 8861 - DNA, 1383 bp, Artificial Sequence
  Description of Artificial Sequence: Synthetic coding sequence
atgcagagagtgaacatgatcatggcggagagtcctgggctcattactatttgcctgctcggttatcttctgtccgctgagtgtaccgtctttctggaccacgagaacgctaacaagatacttaaccgacccaagagatataactcaggcaaattggaagagtttgtccaggggaaccttgaaagagaatgcatggaggagaaatgctcattcgaagaggcccgggaagttttcgagaacacagagcgcaccactgagttttggaagcagtatgtcgatggggaccagtgcgagtcaaacccctgcctcaacggcgggagctgcaaagacgacatcaacagctacgagtgctggtgtcctttcggcttcgagggaaagaattgcgagctggatgttacatgcaatatcaaaaacggaagatgtgaacagttctgcaagaattccgccgacaataaagtagtgtgtagctgcaccgagggttatcgcctggccgaaaatcagaaaagttgcgaaccggcggtgccatttccctgcgggagagtcagcgtgtcacagacttctaaactcactcgggctgagactgttttcccagatgtggattatgttaactcaacagaggcggaaactattttggataatataacccagtccacacagtcttttaatgacttcacccgggtggtaggaggtgaggatgccaagccagggcaatttccttggcaagtggtccttaatgggaaagtagatgccttctgcgggggtagcatcgttaacgagaaatggattgttactgccgcccactgtgtggagaccggcgttaaaattacagttgtggccggtgagcataacattgaagaaactgagcatacggagcaaaagcggaacgttatcaggatcattccacatcacaattataatgccgctatcaacaaatataaccatgatattgccttgctggagttagacgaaccactggtccttaactcatatgttaccccaatttgtattgcagacaaagagtatacaaacattttcttgaagttcggatcaggctatgtttccggctggggccgtgtttttcacaagggaagatcggctctggtcctccaatacctccgggtgcccctagtggatagggccacctgcctcagatccactaagttcacaatttacaataatatgttctgcgctggctttcacgaagggggcagagacagttgtcagggcgacagtggaggccctcatgttaccgaggtcgagggaaccagctttctcactgggataatctcatggggcgaggagtgtgctatgaaggggaaatacggcatctacacaaaagtgagtagatatgtcaattggatcaaggagaagacgaagcttaca

SEQ ID NO: 8862 - DNA, 1383 bp, Artificial Sequence
  Description of Artificial Sequence: Synthetic coding sequence
atgcagagggtaaacatgataatggccgaatcacccgggttgattaccatctgtttgcttggctaccttctctcagccgaatgcacagtgtttcttgaccatgaaaatgcaaacaagattctgaaccgaccaaaaaggtataatagtgggaaactagaggaattcgtacagggtaatctcgagcgagaatgcatggaagagaaatgtagctttgaggaagcccgtgaggtgttcgagaacacagagcgaacaaccgaattctggaagcaatatgttgatggtgaccagtgcgagagtaacccctgtctgaatgggggaagttgcaaggatgacataaatagctacgaatgctggtgcccttttgggttcgagggcaagaactgcgagctggacgtcacgtgcaacattaagaatgggcgctgcgagcagttttgtaaaaattcagctgacaataaggtcgtttgtagctgcacagaggggtaccggctggcagagaatcagaagtcctgtgaacctgcggtgccctttccctgtggccgcgtgagtgtgtcgcagacctctaagctcacgcgggccgagactgtatttcctgatgtggattatgtgaattctactgaggcagaaaccatacttgacaatataactcagagtacccagagcttcaatgatttcactcgcgtggtggggggcgaggacgccaaacccggacagtttccttggcaggtggtcctcaatgggaaagttgacgctttttgcggcgggagcattgtcaacgagaagtggatcgtgaccgctgctcattgcgtggagacaggcgtgaaaatcacagtagtggccggtgaacacaatatagaggaaaccgagcacactgaacagaaaaggaatgtgattagaattatcccccatcataactacaatgctgctataaataagtataatcacgacattgcattgcttgaactggacgaacctctggtccttaactcctacgttactccaatttgcattgccgacaaagagtacaccaatatttttcttaaattcgggtcgggttacgtgtcggggtggggccgagtgttccataagggccgatccgcactggtgctgcagtatctgcgggttccccttgtcgatcgggctacatgcctgagatccacaaagtttaccatttacaacaacatgttctgtgcaggtttccacgaggggggtcgggattcctgccagggggacagcggaggccctcatgtgacggaagtggaggggactagctttctgacgggtatcatcagctggggggaagaatgcgctatgaagggcaagtatgggatctacactaaggttagcagatatgtgaactggattaaggaaaagactaaactcact

SEQ ID NO: 8863 - DNA, 1383 bp, Artificial Sequence
  Description of Artificial Sequence: Synthetic coding sequence
atgcagcgggtgaacatgatcatggccgaaagccctggactcatcacgatctgcctgctggggtatctgctgtctgccgaatgcaccgtgttcctggaccatgagaacgcaaataagatcctgaaccggcctaagaggtacaatagcggcaaactcgaggaattcgtgcaaggaaacctggaaagggaatgcatggaggagaagtgttccttcgaagaagcccgggaagtgttcgaaaacactgaacgcactaccgaattctggaaacagtacgtggacggggaccaatgcgaatcaaacccctgtcttaatggcggaagctgcaaggatgacattaactcgtatgaatgttggtgcccgtttggattcgaaggaaagaactgtgagctcgacgtgacctgtaacattaagaatggacggtgcgaacagttctgcaagaactcggcagataacaaggtggtgtgttcatgtacggaagggtaccggcttgcagaaaatcagaagtcctgtgagccagccgtgccttttccatgtggtcgggtgtcggtgtcccaaactagtaagctgacccgtgctgagactgtctttccagacgtggattacgtgaactcgactgaagctgaaaccatcctggacaatatcactcaatcaacccaatccttcaatgacttcactcgcgtggtgggaggagaagatgccaagcccggccagtttccgtggcaggtggtgctcaacggcaaagtcgatgcgttctgcggaggttcgatcgtcaatgagaagtggatcgtgactgctgctcattgtgtggaaaccggcgtcaagatcacggttgtggccggagaacacaatatcgaggaaaccgaacataccgaacagaaaagaaatgtcatccgcataatacctcatcataactacaatgccgcgatcaacaagtataaccatgacatcgcgttgttggagctggatgagccgctggttcttaattcctacgtcacccctatctgcatcgccgataaggagtacactaatatcttcctgaaatttggctcaggttacgtctcgggatggggacgggtgttccacaagggacggagcgcgctcgtgttgcagtacttgcgcgtgccgctcgttgatagagccacgtgcctgaggtcgaccaagttcaccatctacaataacatgttttgcgctggcttccatgaaggaggacgcgactcgtgccagggagatagcggagggccacatgtgaccgaggtcgaaggcacctcattcctgaccggcattatctcctggggagaggaatgtgcgatgaaaggaaaatacggaatctacaccaaagtgtcgcggtacgttaactggatcaaggagaaaaccaagctgacc

SEQ ID NO: 8864 - DNA, 1383 bp, Artificial Sequence
  Description of Artificial Sequence: Synthetic coding sequence
atgcagcgagtgaacatgatcatggcagagtcacctggcctgatcacaatttgcctgctgggctatctgttgtccgcagagtgcactgtgttcctggatcatgaaaatgcgaacaagatcctgaaccggccgaaacgatataattctgggaagctggaagagtttgtgcaaggtaatctagaaagagaatgtatggaagagaagtgctccttcgaagaggccagggaggtattcgagaacaccgagcgcacaactgaattttggaagcagtatgttgatggagatcagtgcgagagcaacccctgcttgaacggtgggagctgcaaggacgacattaatagctatgaatgctggtgcccgttcggattcgagggcaagaattgtgagcttgatgttacttgtaacatcaagaacgggagatgtgaacaattttgtaagaacagcgcagacaacaaggtggtgtgttcatgtacagaaggatatcgtctggcggagaatcagaagagctgtgagcccgccgttccattcccctgtggcagagtgtctgtctcacagacctcgaagcttactcgcgctgagactgtgttcccagatgtcgactatgttaactctacagaggctgaaactattttggataacattacccagtcaacgcaatcgttcaacgacttcacccgtgtggtgggcggggaggatgccaagccgggccagttcccgtggcaggttgtgctgaacggtaaggttgacgcattctgtggtggctctattgtcaacgaaaagtggatagtgacagccgcccattgcgtggagaccggagtgaagatcaccgtggtcgccggtgagcacaacatagaagagactgagcacacagagcagaaacgcaatgtgatacgtatcattcctcatcacaattataatgccgctatcaataaatataatcacgatatagcgttacttgaattggatgaaccactggtgctcaacagttacgttactcccatatgtatagcagacaaggaatacacaaacatattcctaaaatttggttccggctacgtgtcaggatggggaagggtgttccataaaggacgcagtgccctggttcttcaatacctgcgggtgcctctggttgaccgagccacgtgcctaagatccacaaaatttactatttacaacaatatgttctgcgctggattccacgagggcggacgggactcatgccaaggagactcaggcggtccgcatgtaactgaggtggagggcacgtccttccttaccgggattatctcctggggggaggagtgtgctatgaagggtaagtacggaatttatactaaagtgtctagatatgtcaactggataaaagaaaagaccaagctcact

SEQ ID NO: 8865 - DNA, 1383 bp, Artificial Sequence
  Description of Artificial Sequence: Synthetic coding sequence
atgcagcgggtgaacatgatcatggctgagtcgccgggcctcatcactatttgcctgttgggatacctgttgagcgctgaatgcactgtgttcctcgaccatgagaacgccaacaagatcctgaacagaccaaaacgctacaactctggcaagctggaggaattcgtgcaaggcaacctggaacgcgagtgcatggaagaaaagtgcagcttcgaggaggctagggaggtattcgaaaataccgagagaactactgagttttggaaacaatacgtcgacggagatcaatgtgagtcgaatccatgccttaatggcggatcctgcaaggacgatatcaacagctatgaatgctggtgccctttcggtttcgaaggcaaaaactgcgagctggatgtaacctgcaacatcaaaaacggtcgctgcgaacagttttgcaagaactccgcggacaacaaagtggtatgtagctgtaccgaaggatacaggttggcggaaaaccagaaaagctgtgagccagcggtcccgtttccctgcggacgggtgtcggtgagccagacctccaagctcaccagggctgaaaccgtgttccctgacgtggactacgtgaattccaccgaggcagagactattctggataacatcacccagtcaactcagtcgtttaatgatttcactagagtcgtgggaggcgaggacgccaagccgggacaattcccgtggcaggttgtcctcaacgggaaagtggacgcgttttgcgggggatccatcgtgaacgaaaagtggatcgtcactgcggcacactgcgtggagactggtgtgaagatcactgtggtcgcgggagagcacaatatcgaggaaaccgaacacaccgagcagaagcgcaatgttatcaggattataccgcaccacaattacaacgcagccatcaacaaatacaaccatgacatcgctctgcttgaactggatgagccgctcgtgctcaacagctacgtgactccaatctgcattgccgataaagaatacacgaatatcttccttaagtttgggtcgggatatgtgtcggggtggggacgggtgttccacaagggccggtctgcactcgtgctgcagtacttgcgggtgcctctggtggacagagcgacctgcctccgttcaaccaagttcacgatctacaataacatgttctgtgccggatttcatgaaggtggacgcgactcatgtcaaggggactcgggcggaccgcatgtcaccgaggtcgaaggcacgtccttcctcaccgggatcatctcttggggcgaagaatgtgcgatgaagggcaagtacggcatctacacgaaggtgtcaagatacgttaactggatcaaggaaaagactaagctgacc

SEQ ID NO: 8866 - DNA, 1383 bp, Artificial Sequence
  Description of Artificial Sequence: Synthetic coding sequence
atgcagagggtgaatatgatcatggcggagtcacctggcctgattaccatctgcttgctgggctacctcctgagcgctgaatgcaccgtgtttctggatcatgagaacgccaataaaatccttaacagaccgaaacggtacaacagcggaaagctcgaagagttcgtccaaggaaacctcgagcgcgaatgcatggaggagaaatgctccttcgaggaagcgagagaggtgttcgaaaacaccgagagaaccacggagttctggaagcagtacgtggatggagatcagtgtgagagcaatccctgtctgaacggagggtcgtgtaaggatgacataaactcgtatgaatgctggtgcccgttcggattcgaaggcaagaactgtgaactggatgttacgtgcaacatcaagaacggccgctgtgaacagttctgcaagaacagcgctgacaataaggtggtatgttcctgcaccgaaggctaccgcttggccgagaatcaaaagtcgtgcgaacctgctgtcccatttccatgcggccgcgtgtcagtctcccaaacttcaaaactcacccgggccgagactgtttttccggacgttgattatgtgaactccactgaagccgaaaccatcctggacaacatcactcagtcgacccagtcgttcaacgacttcactcgggtggtgggcggagaggacgcaaagccgggtcaattcccgtggcaggtcgtgctgaacggtaaggtggacgccttctgcggaggatccatcgtcaacgaaaagtggatcgtgactgccgcacattgtgtggaaactggtgtcaagatcaccgtcgtggccggtgaacacaatatcgaggaaaccgaacacaccgaacaaaaaaggaatgtgattcggatcatcccacaccacaattacaacgcggcgatcaacaaatacaatcacgacattgccctgttggagctcgacgagcccctggtccttaattcgtacgtgaccccaatctgcatcgctgacaaggagtacactaatatttttctcaaattcgggtccgggtacgtgtcgggatgggggcgcgtgtttcataaaggaagatcagcactcgtcctgcagtaccttagggtgccgctggtggatcgagcgacttgcctccggagcacgaagtttactatctacaataacatgttctgcgcaggattccatgaaggaggacgcgactcctgccagggtgattctggaggacctcacgtcaccgaagtggagggaacttcgttcctgaccggcatcatctcatggggggaagaatgcgccatgaagggcaagtacggaatttacaccaaggtgagccgttacgtcaactggatcaaagaaaagacgaagctgact

SEQ ID NO: 8867 - DNA, 1383 bp, Artificial Sequence
  Description of Artificial Sequence: Synthetic coding sequence
atgcagcgtgtcaacatgattatggctgaatctccaggtcttattacaatttgcttgcttggatacctgctctctgcagagtgcacagtgttcctggatcatgagaacgctaacaaaattttgaataggcccaaacgttacaattctggcaagctggaagagttcgtacagggcaatctggagagggagtgcatggaggagaagtgttcattcgaggaggcaagggaggtctttgagaacactgagcgcactactgaattttggaaacagtatgtcgacggagaccaatgcgaatccaacccctgcttgaacggtggttcttgcaaagacgacattaattcttacgagtgttggtgtcctttcggtttcgagggcaagaattgcgaattggatgtcacctgtaacattaagaacggtaggtgtgagcaattctgtaagaactctgctgacaacaaggtcgtctgttcatgcacagaaggatacaggctcgccgagaatcaaaagtcttgcgaacctgccgtaccatttccctgtggcagagtcagcgtttctcagacctctaaactcactcgtgccgaaactgtgttccctgatgtcgactatgtgaattcaacagaggccgaaacaatcctggataacatcactcagtctacccaatcctttaacgactttacacgtgtcgtcggtggagaagacgccaagcccggtcagttcccttggcaggttgtgctgaacggcaaagtcgatgcattctgtggtggatccatcgtcaacgagaagtggattgtgaccgctgctcattgtgtggaaaccggcgtgaaaatcactgttgtcgctggcgagcataacatcgaggagaccgaacacaccgagcagaaaaggaacgtgatccgcatcatccctcaccataactacaacgctgcaataaataagtacaatcatgacattgcacttctcgagctggacgaaccattggtgttgaatagctacgtgactcccatttgtatcgccgataaggagtacaccaacatctttctcaagttcggcagcggatatgtctccggatggggccgtgtttttcacaaaggccgctctgccctcgtcctccagtacctgcgtgtgcccctcgttgatcgcgctacctgccttcgctctactaagttcactatctacaacaatatgttctgcgctggatttcatgaaggcggtagagactcttgtcagggcgattccggtggtcctcatgtgaccgaggtggaaggcacatccttcttgacaggtatcattagctggggagaggaatgtgccatgaaaggcaagtatggcatctacactaaagtcagtcgctacgtcaattggatcaaggagaagaccaagcttacc

SEQ ID NO: 8868 - DNA, 1383 bp, Artificial Sequence
  Description of Artificial Sequence: Synthetic coding sequence
atgcagcgggtgaatatgatcatggctgaatccccgggtctgatcaccatttgcctgctggggtaccttctcagcgccgagtgcactgtgttcctggaccacgaaaacgccaacaaaatcctcaaccggccaaaaagatacaattcgggcaagctcgaggaattcgtgcagggtaacctggaaagagaatgcatggaggagaagtgctcgttcgaagaagctcgcgaagtgttcgagaatactgaacggactaccgaattttggaaacagtacgtcgatggagatcagtgcgaatcgaacccatgcctcaacgggggcagctgcaaggatgatatcaattcctatgagtgttggtgtccgttcggctttgaaggaaagaattgcgagctcgatgtgacttgcaacattaagaacggccgctgcgagcaattctgcaagaacagcgccgacaataaagtcgtgtgctcatgtaccgagggatacaggctggctgaaaaccaaaagtcctgtgagccggccgtgccgttcccgtgcgggcgggtgtcggtttctcagacttcgaaactgactagggccgaaaccgtgttcccggatgtggactacgtgaattcgactgaggcagaaaccatcctggacaatatcactcagtcaacccaatcgttcaacgacttcactcgcgtggtgggaggtgaagatgcgaagcccggtcagttcccgtggcaagtggtgctgaacggcaaggtcgatgcattctgcggcggctccattgtgaatgagaagtggatcgtcaccgcggctcactgcgtcgaaactggtgtcaagatcaccgtcgtggccggagaacacaatatcgaagagactgaacacactgaacagaaacggaatgtgattcgcattatcccacatcacaattacaacgccgcgatcaacaagtacaatcacgacatcgccctgctggaactggacgagccgttggtcctcaacagctacgtcacccccatttgcatcgcagataaggaatataccaatatctttctcaagttcggcagtggatacgtctcgggttggggaagagtgttccataagggccggtcagcactcgtgctccaatacctgcgcgtcccgttggtggatcgcgctacttgcttgaggtcaactaagttcaccatctacaataacatgttctgcgcgggattccatgaaggaggacgcgactcgtgtcaaggggattccggcggaccgcacgtcaccgaggtggaaggaacctccttcctgaccggtatcattagctggggagaggagtgcgcaatgaagggtaagtacggtatctacactaaagtctcgcgctacgtgaactggatcaaggaaaagacgaagctgacc

SEQ ID NO: 8869 - DNA, 1383 bp, Artificial Sequence
  Description of Artificial Sequence: Synthetic coding sequence
atgcagcgcgtcaacatgatcatggccgaaagtccaggacttattactatctgtttgctcggctatctgctctccgcagagtgcaccgtctttctggatcatgagaacgcgaacaaaattctgaatcgccctaaacgctacaactcaggtaagctggaggaatttgttcagggtaacctggagcgagaatgtatggaggaaaaatgtagctttgaagaagctagagaagtgttcgaaaacaccgagcgcaccaccgagttttggaaacaatacgtggatggtgatcagtgtgagtcaaatccgtgtctcaatggcgggtcgtgtaaggatgacatcaattcctacgaatgttggtgtccatttggttttgaggggaagaactgcgagctggacgtgacctgtaacattaagaacggccgttgtgagcagttctgtaagaatagcgcagataacaaagtggtctgttcgtgcactgaaggatacagactcgcagaaaaccaaaagagctgtgagcccgcagtgccatttccttgcgggcgggtgtcggtgtctcagacctccaagctcacccgcgccgaaacggtctttcctgacgtcgactacgttaactccaccgaagcagaaactatacttgataacattactcaatctactcagagctttaatgacttcactcgcgtggtcggcggagaagatgcaaaaccaggtcagttcccatggcaggtggtccttaatggaaaagtggacgcattctgtggcgggtccattgtgaatgagaagtggatagtgactgctgcacattgcgtggaaaccggagttaagatcacggtggtggcaggggaacataacattgaagagactgaacataccgaacaaaagcgaaatgtgattagaataatccctcaccacaactacaatgcagcaatcaacaagtacaatcacgatattgctctgttggaactggacgaaccattggtgctgaattcgtacgtcaccccaatctgtatcgcggacaaggaatacaccaacatctttcttaagtttggaagcggttacgttagcggttggggccgcgtgttccataaaggcagatccgcgcttgtcctccaatacttgcgcgtcccactggtggatcgcgctacgtgtcttaggtcaaccaagtttaccatttacaacaatatgttttgtgccggatttcatgagggcggaagagacagctgccaaggggactcgggcgggccccacgtaactgaagtcgaaggtactagcttccttacggggattatcagctggggcgaagaatgcgctatgaagggaaagtacggaatctacactaaagtgtcaagatacgtgaattggataaaagaaaagactaagctgacc

SEQ ID NO: 8870 - DNA, 1383 bp, Artificial Sequence
  Description of Artificial Sequence: Synthetic coding sequence
atgcagagagtgaatatgatcatggctgaatcccccgggttgatcactatttgtctgcttggatatctcctttccgcagaatgcactgtctttctcgatcatgaaaatgccaacaaaatcttgaacaggcctaagaggtataactcaggaaaactcgaagaattcgtccaggggaatctggagagagaatgcatggaagaaaaatgttcattcgaagaagctagggaagtgtttgaaaacacagaacggacaactgagttttggaaacagtacgttgatggagatcagtgtgaatcaaacccctgcctgaatggaggatcttgcaaggacgatataaattcctacgaatgttggtgtcccttcggatttgaagggaagaactgcgaattagatgttacttgtaacatcaagaatgggaggtgtgagcagttttgtaaaaattcagctgataacaaagtcgtctgttcttgtactgaaggatatcggctcgccgaaaatcagaaatcttgcgaacctgctgtgccatttccatgtggaagagtctcagtatcccagacaagtaaattaactagggccgagacagtgttcccagatgtggattacgtcaattcgactgaagccgaaactatacttgataatatcactcagtcaactcagtctttcaatgattttacacgcgtggtgggaggggaggatgccaaacccgggcagttcccttggcaggtagtgttaaatggaaaagtcgatgctttctgtggagggtccatcgtcaacgaaaaatggatcgtcacagctgcacattgcgtggaaactggggtgaaaataacggtagtggctggagagcataatatcgaagaaacagagcacactgagcagaaacggaacgttatacgaatcatcccacatcacaactacaacgccgcaattaacaaatataatcacgacatagcccttctagaactcgatgaaccactggtgcttaattcctatgtgactcctatctgcatagccgataaggaatatacaaatattttcctcaagttcggatccgggtatgtctctgggtgggggcgagtgttccataaagggagatctgctcttgtgctccagtacctacgggtgcctctcgtagatagagccacttgtctcaggagtactaaattcactatatataacaatatgttctgtgctggatttcatgaagggggaagggattcatgtcaaggagattccgggggacctcacgtgactgaagttgaaggaacttcgttcctcacagggattatatcttggggagaggaatgcgcaatgaaagggaaatatggaatttatacaaaagtctcccggtatgtcaattggataaaagagaagactaaactcaca

SEQ ID NO: 8871 - DNA, 1383 bp, Artificial Sequence
  Description of Artificial Sequence: Synthetic coding sequence
atgcagcgcgtcaatatgatcatggctgaaagcccgggcctcattaccatctgcctgctgggatacttgctttccgcagagtgtaccgtctttcttgaccatgagaatgccaacaagatactcaatcggccgaagcggtacaactcgggaaagctcgaggaattcgtgcagggaaatctggaacgcgagtgcatggaagagaagtgttcattcgaagaggcacgggaagtgttcgaaaacaccgaacggacgactgagttttggaagcagtacgtggacggcgatcaatgcgagtcgaacccttgcctgaacggcggcagctgcaaagatgatatcaacagctacgaatgttggtgccctttcggttttgaaggtaagaactgcgaacttgacgtgacctgcaatatcaagaacggaaggtgcgagcagttctgcaaaaactccgctgacaacaaggtggtgtgttcctgcactgaaggttatcgcctggccgaaaaccagaagtcctgcgagccagccgtgccgttcccttgtggacgtgtgtcggtgtcccagacctcgaagctcacccgtgctgaaactgtgtttccggacgtggattacgtgaactcaactgaggccgaaactattctggacaacatcacccagtccacccagtcgtttaatgacttcactcgggtcgtcggtggggaggatgcgaagcctgggcaattcccgtggcaagtggtgctcaatggcaaggtggatgccttctgcggaggttcgatcgtgaacgagaaatggattgtgactgccgcgcattgtgtcgagactggagtcaaaatcacggtggtggcgggcgaacacaatatcgaggagactgaacataccgaacagaagcgcaatgtcattcggatcatccctcaccacaactacaatgccgcgatcaataagtacaaccacgatatcgcgctgcttgagctggacgaaccattggtcctgaactcgtacgtgacgccaatctgcatcgcggacaaggagtacacgaacatcttcctgaagttcgggtccggatacgtgtcgggctggggccgcgtgtttcacaagggccgcagcgcactggtgctccaatacctcagggtcccgctcgtggaccgggcaacttgccttcggtccaccaagttcaccatctataacaacatgttctgcgccggattccacgaaggggggcgcgattcctgccagggcgactcaggtggcccgcacgtgaccgaagtcgaaggaacgtccttcctcaccggaatcatttcatggggcgaggagtgcgctatgaagggaaagtacgggatttacacgaaagtgtcacggtacgtcaattggatcaaggaaaagaccaagctcacc

SEQ ID NO: 8872 - DNA, 1383 bp, Artificial Sequence
  Description of Artificial Sequence: Synthetic coding sequence
atgcaacgggtgaacatgattatggctgagagccccggcctgatcacaatatgtctccttgggtacctgctgagcgctgaatgtaccgtattcctagaccacgaaaatgccaataagattttaaaccggccgaaaagatacaactctgggaaactggaagagttcgttcaaggcaatcttgaacgcgaatgtatggaggagaagtgctctttcgaggaggcaagggaggtatttgagaacaccgagcgcaccaccgagttctggaagcagtatgtggatggggatcaatgtgagtcaaatccgtgtctgaacggtggatcttgcaaagacgacattaacagctacgaatgttggtgccctttcggctttgagggaaagaattgcgagttagatgtgacatgtaacataaaaaatggacggtgcgaacagttttgtaaaaactcggccgataataaagtggtatgttcctgcaccgaggggtacaggcttgctgagaaccagaagagctgtgaacccgcagtgcctttcccctgcgggagagtcagtgtgtctcagacctccaaactgaccagagcagagacagttttcccggacgtggactacgtcaacagcactgaggcagagaccatcctggacaacataactcagagcactcagagtttcaatgactttaccagagtggtaggcggagaggatgctaagccgggccagtttccatggcaggtggtcctgaacggtaaagtggatgccttttgtgggggctccatcgtgaacgaaaagtggatcgtaaccgcggcccactgtgtagagaccggcgtaaaaataacagtggtcgccggggagcataacatcgaagagaccgagcacacagagcaaaaacggaacgtgatcagaattatacctcaccacaactataatgcggccatcaataagtataaccatgacatcgcactgctggaactggacgaaccactggtgctcaatagttacgtgactcctatttgtatcgccgacaaggaatacacaaatatttttctgaagttcggcagtggttacgtgtccggatggggacgtgtcttccataaaggaaggagcgcccttgttctccaatacctgagagtgccacttgtagaccgcgcgacttgcctacgaagtaccaagttcacaatctacaacaacatgttttgcgctggatttcatgagggcgggcgggactcctgccagggagatagcggaggcccgcacgtcacagaggtcgagggtacttcattccttactggcatcataagctggggagaggaatgcgccatgaagggcaagtacggcatttatacaaaggtaagtagatacgtcaactggatcaaagaaaaaacgaaattaaca

SEQ ID NO: 8873 - DNA, 1383 bp, Artificial Sequence
  Description of Artificial Sequence: Synthetic coding sequence
atgcaacgtgttaacatgattatggcagaaagtccaggacttataacaatatgccttcttggatatcttttatcagcagaatgtactgtgtttcttgatcatgaaaatgctaacaagattttgaatagacctaaacgttataactctggaaaattagaagaatttgttcaaggaaatcttgaaagagaatgtatggaagaaaaatgttcatttgaagaagctcgtgaagtttttgaaaatacagaaagaacaactgaattctggaaacaatatgttgatggagatcaatgtgaaagtaatccatgtttgaatggaggatcatgtaaggatgacatcaattcatatgaatgttggtgtccatttggttttgaaggaaaaaattgtgaattagatgttacctgtaatataaaaaatggacgttgtgagcaattttgtaaaaactcagcagataataaggttgtttgttcatgcacagaaggatatagattagcagaaaatcaaaaaagttgtgaaccagcagttccatttccttgtggaagagtatcagtatcacaaactagtaagttaacaagagcagaaactgttttcccagacgttgattacgttaattccacagaagctgaaactattttagataatattacacaaagtacacaaagttttaatgattttactcgtgttgtaggaggggaagatgcaaaacctggacaatttccatggcaagttgttcttaatggaaaagttgatgcattttgtggtggaagtattgttaatgaaaaatggattgttacagctgcacattgcgttgaaacaggtgttaaaataactgttgttgctggagaacataatattgaagaaacagaacatacagaacaaaaaagaaatgtaatacgaattattccacaccataattataatgctgctattaataaatataatcatgatatagcattgttagaactagatgaacctttagttttgaattcttacgttactcctatttgcattgctgataaagaatatactaatatctttcttaaattcggaagtgggtatgtttcaggttggggtagagtatttcataaggggcgttcagctttagtattacaatatttaagagttcctttagttgatagagctacatgccttagaagtacaaagttcacaatttataataatatgttttgtgcaggtttccatgaaggaggtagagattcatgtcaaggagatagtgggggaccacatgtcactgaagtagaaggaactagttttttaactggtataatttcatggggagaagaatgtgctatgaaaggaaagtatggaatatacactaaggtgtcacgttatgttaattggattaaggaaaaaacaaaactaaca

SEQ ID NO: 8874 - DNA, 1383 bp, Artificial Sequence
  Description of Artificial Sequence: Synthetic coding sequence
atgcagagagtgaatatgattatggcggaatcgcctggcctgataactatttgccttcttgggtacctcttgtccgccgagtgcaccgttttccttgaccatgaaaatgcaaacaagattctgaataggccgaaaagatacaactcaggcaaattggaggagtttgtgcagggaaatcttgagagagaatgcatggaggagaagtgttcgttcgaagaggcccgcgaggtctttgaaaatactgagaggactactgagttctggaagcagtatgtcgacggggaccaatgtgagtccaacccttgtctgaatgggggcagctgtaaggacgatatcaattcatacgaatgttggtgcccctttggttttgaagggaagaattgtgaacttgacgttacgtgtaacattaagaatggacgttgcgagcaattctgcaagaactccgcagataacaaggtcgtgtgctcctgtactgaaggttaccggctggctgagaaccagaagagctgtgagcccgctgtgcctttcccatgtggccgcgtgagtgtttcgcaaaccagtaagttgactagagcagaaaccgtgtttcccgatgtggattacgtgaactctactgaagccgagacgatccttgataacataactcagtcgacccagagcttcaatgattttacgcgggtcgtgggtggagaggacgcaaaaccaggacaatttccttggcaggtcgtgctgaacgggaaagtggatgccttttgcggtggatcgatcgtgaacgaaaaatggatcgtaaccgcggcgcattgtgtcgaaacgggcgtgaagataaccgtggtcgcaggggaacataacatagaggaaacggaacacaccgaacaaaagcggaatgttattcgcattatcccacaccacaactacaacgcggctattaacaagtacaaccatgatatcgcccttctcgagctggacgaacccctggttcttaacagctacgtgacgccaatctgtatcgcagacaaggaatacactaacatatttctcaagtttggtagcggatatgtctcgggatggggtagggtgtttcataaggggagaagcgccctcgtgctccagtacctgcgcgtgcctctcgtggatcgcgcaacctgtctgaggtcgaccaagtttactatctacaataacatgttttgcgcaggcttccacgaaggcggtcgggattcgtgtcagggtgattcaggtggccctcatgtgactgaagtggaagggacctcttttctgactggtatcatttcatggggagaggaatgcgcaatgaagggcaagtacggaatttacactaaagtctcgcgatacgtgaactggattaaggaaaaaaccaaactgacc

SEQ ID NO: 8875 - DNA, 1383 bp, Artificial Sequence
  Description of Artificial Sequence: Synthetic coding sequence
atgcagagggtaaatatgataatggccgagtcccccggtttgataacgatttgtttgctcgggtaccttctgtctgcggagtgcacagttttcctggatcatgaaaacgcgaacaagattctaaaccgacccaaacgatacaactctggcaagctggaggagttcgttcagggaaaccttgaaagggagtgtatggaagaaaaatgctccttcgaggaagcgagagaggttttcgaaaacacagaacgtactactgagttttggaagcagtacgtggacggcgaccagtgcgagagtaacccctgcttaaacggaggctcctgcaaagatgatattaactcatacgaatgttggtgcccatttggattcgagggcaagaattgcgaattggatgtgacctgcaacataaaaaacgggaggtgcgaacagttctgtaagaattcagccgataacaaggtggtctgttcatgtaccgaaggctaccgactggcagagaatcagaagagttgtgagcctgccgtcccattcccctgcggcagagtgagcgtctcccagacgagcaaacttacacgggctgagacagtcttccccgatgtggattatgtcaactccaccgaggcagaaacaattttagacaacattacacagtctacccagtcgtttaatgacttcactcgagtcgtcggaggggaagacgctaaaccaggccagtttccctggcaagtggtgttgaatggcaaagtagatgcattttgtggtggatcaattgtaaatgagaagtggatcgttaccgccgcccactgcgttgaaactggagtcaagatcactgtggttgctggggaacataacatagaagaaacggaacacaccgagcagaaaaggaatgttattcgaataattcctcatcacaactataatgcagcaattaacaagtataatcacgacatcgcactactggagctcgatgagccactcgttctaaactcgtacgttacgcctatatgcatagctgataaagaatatacaaacattttccttaaattcggaagtggctatgtgtccgggtggggcagggtgttccacaagggacgtagcgcgctggtcctgcagtacttgagggtgccattggtcgacagagccacctgcctgaggtcgaccaaatttaccatttataacaatatgttttgcgccgggtttcatgagggcggcagagatagctgccagggagacagcggcggtcctcacgtaaccgaagtcgagggcacttcattcctgacaggtattatttcttggggggaggaatgtgctatgaaggggaaatatggcatctacacaaaagtcagtaggtacgtgaattggatcaaagaaaaaacaaagctcact

SEQ ID NO: 8876 - DNA, 1383 bp, Artificial Sequence
  Description of Artificial Sequence: Synthetic coding sequence
atgcagagagtcaatatgatcatggccgagtcacccgggctgataaccatctgccttctgggatacttgctgtccgccgagtgcaccgtgttcttggaccacgagaatgcaaacaagattctgaatcgccccaaaaggtacaatagcggaaagctggaagagttcgtgcagggaaacctggaacgtgaatgcatggaggaaaagtgctcgttcgaagaggcgagagaggtattcgagaataccgaacggaccactgaattctggaagcagtacgtggatggggaccagtgcgagtcgaacccttgtctgaacggcggatcctgcaaggacgacatcaacagctacgaatgttggtgtccgttcggatttgaaggaaaaaactgtgagctcgatgtcacttgcaacatcaagaacggacgctgcgagcagttttgcaagaattcggcggacaacaaggtggtgtgctcttgtacggaaggatatcgcctggctgagaaccagaagtcatgcgagcctgccgtgccgtttccgtgcggcagggtgtcggtgagccagacctcgaagttgacccgcgcagagactgtgttccccgacgtggactacgtgaactcaacggaggcagaaactatcttggataacatcactcagtcgactcaatcattcaacgacttcacccgggtggtcggaggcgaagatgccaagccaggacagttcccgtggcaagtcgtgcttaacggcaaggtcgatgccttttgcggcggaagcatcgtgaacgaaaagtggatcgtgaccgccgcgcactgtgtggaaaccggagtcaaaatcaccgtggtggcaggcgaacacaatatcgaggaaaccgaacacaccgaacagaagcgcaatgtgattcgcatcatcccacatcacaactacaacgccgccatcaacaagtacaaccatgacattgccctcctcgagctcgatgaacccctggtgctgaactcctacgtgaccccaatctgtatcgctgacaaggaatacaccaacatcttcctgaagtttgggtccggctacgtgtctggttggggtcgggtgttccataagggtaggagcgcgctggtgctgcagtacctgcgcgtgccactggtggatcgagccacttgcctgcgctcgaccaagttcaccatctacaacaatatgttctgcgcgggcttccatgaaggcggacgggattcatgtcaaggggactccggaggacctcatgtgaccgaggtggagggcaccagcttcctcaccgggatcatttcctggggagaggagtgcgcgatgaaaggcaaatacggaatctacactaaggtgtccaggtacgtgaactggatcaaggaaaagacgaaacttacc

SEQ ID NO: 8877 - DNA, 1383 bp, Artificial Sequence
  Description of Artificial Sequence: Synthetic coding sequence
atgcagagagttaacatgatcatggcagagagtcccgggctgatcactatctgcctgctgggctacctcctgagcgcggaatgcacagttttcttggatcatgagaacgccaataagatcctgaaccggccaaaacgctacaatagcggcaaactagaggagttcgtccagggtaatctggagcgtgagtgcatggaggagaagtgcagttttgaagaggcacgagaggtattcgagaacaccgagcggacaacggaattctggaagcagtatgtagacggcgatcagtgcgagtcaaatccctgcctaaacggcggatcctgcaaggatgatatcaacagctatgaatgctggtgcccgttcggttttgagggcaaaaattgcgaattggatgtgacgtgcaacataaaaaatggccgctgcgagcagttttgcaagaatagcgccgataataaggtggtgtgttcttgtacagagggttaccgtcttgcggaaaatcagaagagttgcgagccggctgtaccatttccgtgcggacgcgtgtcagtgtcacagaccagcaagctgactagagctgagaccgtattcccagatgtcgattacgtgaattcaacagaggccgaaactatcctggacaatattactcagtccactcagagcttcaatgactttacgcgcgtggtggggggcgaggatgcaaagccgggccagtttccctggcaggtcgtcctgaatggaaaagtggacgccttctgtggcggaagcatcgttaatgagaagtggattgtgaccgccgctcactgcgtggaaacaggggtgaaaattaccgtggtggccggcgagcacaatatcgaagaaaccgagcacaccgagcaaaagcgaaatgtgatacgcattattccacaccataactacaacgcagcaattaataagtacaaccatgacatcgccctgctcgagctggatgagcccttggtcctgaattcgtacgttacgcctatttgcatagcggacaaggagtacaccaatattttcctaaagtttggttcgggttacgtgtcgggctggggacgagtttttcacaagggacgctccgccctggtcctgcagtacctgcgcgttcccctcgtggacagagccacctgcctccgaagtaccaagtttaccatttacaataacatgttctgcgctggctttcacgagggcggacgtgatagctgccagggtgattccgggggaccccatgtaacagaagtggaaggcacgtccttcctaactggcattatatcgtggggagaagagtgcgcgatgaagggaaagtatggaatatacaccaaagtctcgcgctacgtgaattggattaaggaaaagactaagctgacc

SEQ ID NO: 8878 - DNA, 1383 bp, Artificial Sequence
  Description of Artificial Sequence: Synthetic coding sequence
atgcagagagttaacatgatcatggctgagtcccctggactcatcaccatttgcctattggggtacctcctgagtgcagagtgcaccgtgttcctggaccatgagaatgccaataaaattttgaaccgtcccaaaaggtacaactccggcaaactagaagaattcgtgcaaggtaacctggagagagaatgcatggaggagaagtgcagtttcgaagaggctcgagaggttttcgagaacaccgaaaggacaactgaattctggaagcagtatgttgacggagatcagtgtgagagcaatccttgcctcaacggcgggtcttgtaaagacgatattaatagctacgaatgctggtgcccctttggcttcgaaggcaagaattgtgaactcgacgtgacgtgcaacatcaagaatggccgatgcgagcagttttgcaaaaattcagctgataacaaggtcgtttgctcatgcacggagggttaccgactggcagagaaccagaagagctgcgaaccggcagttccgtttccgtgcggacgtgtgagcgtctcccagaccagcaagttaaccagggcagagacagttttccccgacgtggattacgtcaacagtactgaggcagaaaccatactggacaacatcacacaatccacccagtcattcaacgacttcacccgtgtagtgggcggagaagacgcaaagcctggccaattcccctggcaagtcgtcctgaacggaaaggtggacgcgttctgcggaggttcaatcgtgaacgagaagtggatcgtcacggccgctcattgcgttgagactggcgtgaaaataaccgtggtggcaggggaacacaatatagaagagacagaacatacggaacagaagagaaatgtcatccggatcattccccaccacaattataacgctgccattaacaagtacaaccacgatattgcactcttagagctggacgagcctctcgttctaaatagctacgttacaccaatttgcattgctgataaagagtacacgaacatcttcttgaaattcggctcaggttacgtgtccggctggggcagagtttttcacaaaggaagatcagctctggtgctgcagtaccttcgtgtgcctttggttgatcgtgccacttgcctaagatccactaagttcaccatctataataacatgttctgcgcaggctttcacgagggcgggcgggattcctgccagggagactctggaggtcctcacgtgacagaggtggaaggtacttcgttcctcacaggcataataagctggggagaagaatgcgcaatgaagggtaagtatgggatttacaccaaagtgtctcgctacgttaactggattaaggaaaaaacaaaactgact

SEQ ID NO: 8879 - DNA, 1383 bp, Artificial Sequence
  Description of Artificial Sequence: Synthetic coding sequence
atgcaacgcgtgaatatgatcatggccgagtcgcctgggttgataacgatttgtctgctgggatacctgctctccgcggagtgtactgtgtttctggatcatgagaatgcgaacaaaattctgaacagacctaaacggtacaatagcggtaaattggaggaattcgtgcaaggaaatctcgaacgagaatgcatggaagagaagtgctcattcgaagaagcaagggaggtgttcgaaaataccgagcgcacgactgaattctggaagcaatacgtcgacggagatcaatgtgagtccaatccatgcctcaacggagggtcctgcaaggatgacatcaattcatacgaatgttggtgtccatttggattcgaaggaaaaaactgcgagctcgatgtgacctgcaacatcaagaacggacgctgcgagcagttttgtaaaaactccgcagacaacaaggttgtgtgtagctgtactgaagggtacagactggcagagaaccagaagtcctgtgaaccagcagtacctttcccctgtggcagagtgtccgtatcgcagacttcgaagctgactcgggctgagactgtctttcctgatgtggactacgtgaactcgaccgaagcagagactattcttgataacataacgcagtccactcaatcattcaacgattttaccagggtggtgggaggtgaagatgctaagccgggacaatttccctggcaggtcgtgctgaacgggaaggtggatgctttttgtgggggatctattgtcaacgaaaagtggatagtgaccgcagcccactgcgtggagactggtgtgaagattactgtggtggccggtgaacataacattgaagaaactgagcataccgaacaaaaaaggaatgtaattcgtatcatcccacatcataactacaacgcagcgattaacaagtacaatcacgacatagcccttcttgaacttgatgagcctctggtgcttaactcgtatgtgacccccatttgcatcgcagacaaggaatacaccaatatctttctcaagtttggcagcggatacgtgtcggggtggggacgggtctttcataagggccgttcggccctggtgctccaataccttagagtgccacttgttgatagagcaacctgtcttagatctacgaaattcaccatttacaataacatgttctgtgctgggtttcacgaagggggccgggacagctgtcagggggattcaggtggtcctcacgttaccgaagtcgaaggcacgtcgtttcttaccggaattatcagctggggcgaagagtgtgcaatgaaaggaaagtacggtatctacactaaagtttcacgatatgtcaattggataaaggaaaagacgaagctcacc

SEQ ID NO: 8880 - DNA, 1383 bp, Artificial Sequence
  Description of Artificial Sequence: Synthetic coding sequence
atgcaaagagtgaatatgataatggctgaaagccccggattaatcacaatttgccttcttggctacctgctaagcgccgaatgtaccgtcttcctggatcacgagaacgctaataagatactgaaccgacccaagcgctacaatagtggtaagctggaagagttcgttcagggtaacttggaacgagagtgtatggaagaaaagtgcagttttgaggaggctagggaggtatttgagaatacagagcgaacaacagagttctggaaacaatatgtggatggggaccaatgtgaaagcaatccctgcttaaacggcggctcatgtaaagacgatataaacagctatgaatgttggtgtccctttggattcgagggaaaaaattgcgaactcgacgtgacatgcaatatcaagaacgggcggtgcgaacagttttgtaaaaacagcgcggacaacaaagtggtgtgttcgtgtacagaggggtacagactggcagagaaccaaaagtcttgtgagccagccgtgccctttccttgcggacgggtgagcgtgtcacagacatcgaaactgacgcgggcggaaacagtgttcccggatgtggattacgttaattctaccgaagctgaaaccatactggataacattacacagtccacacagagcttcaacgactttactcgggtggtgggaggagaagacgccaaacctggacagttcccctggcaggtggtgctcaatggaaaagtcgacgccttctgtggaggttctatcgtgaatgagaagtggattgtcaccgcagcccactgtgttgaaacaggggtgaaaattacagtcgtagccggcgagcataacatagaggagactgaacacacagagcagaagcgaaacgtaataagaatcattccacaccacaactacaacgctgcaattaataagtacaaccacgatatcgccctgcttgaactagacgaacccctcgtgcttaactcctacgttacgcccatctgtattgccgataaagagtataccaatatcttccttaagtttggctctgggtacgtgtcggggtggggcagagttttccacaaggggcgttcagccctggtgttgcagtacctccgcgtgcctctggtcgatcgggcaacatgcctaagaagcactaagttcaccatttacaataatatgttctgcgcggggttccacgaagggggacgcgatagctgccaaggggattccgggggaccacatgtgaccgaggtggaaggaacctccttcctcaccgggattataagttggggggaagagtgtgccatgaagggaaagtatggcatatacacgaaggtctcgagatacgtgaactggatcaaggaaaaaaccaagctaact

SEQ ID NO: 8881 - DNA, 1383 bp, Artificial Sequence
  Description of Artificial Sequence: Synthetic coding sequence
atgcagcgcgtcaatatgatcatggctgagtctccaggtctgataaccatctgcctccttggatatttattatccgctgagtgtaccgttttcctggaccatgagaatgccaataagattttaaaccgacctaagaggtataacagtggcaaactcgaagaatttgtgcaaggaaacttggaaagagagtgcatggaggaaaaatgttcgttcgaagaagcccgggaggtgtttgaaaatactgagcgaactactgaattctggaaacagtatgtggacggcgatcaatgcgaaagcaacccttgcctgaacggcggctcttgtaaagacgacataaactcttatgagtgttggtgcccctttggcttcgagggcaaaaactgtgagctcgacgtgacttgtaatatcaaaaacggaaggtgcgaacagttttgcaagaatagtgcagacaataaggtggtgtgctcctgcaccgagggttaccggttagccgaaaatcagaagagttgcgaacccgcggtgccctttccttgtggacgcgtcagtgtcagccagaccagcaaactcacccgcgccgagacagtgtttcctgatgtggattatgtgaatagtacggaggctgagacaatacttgacaatatcacacagtcaacccagagcttcaatgactttaccagagtcgtaggcggagaggacgcaaaacccgggcaatttccttggcaggtggtgctcaatggtaaggtcgacgctttctgcggtggctctatagtcaacgaaaagtggatcgtcacagcggcacactgtgtcgaaacaggagtgaaaattacggtggtggccggtgagcacaatattgaagaaacagaacatacagagcaaaagcggaacgtcatacgaatcatcccacatcacaattataacgccgccattaataagtacaatcatgatatagcgctgctcgaacttgacgaacccctcgtcctcaactcatacgtaacacctatctgtattgccgacaaagagtacactaatattttcctgaaattcggaagcggctacgtctctggttgggggagagtctttcataaggggcgatcagccttggtgctccaatacctccgggtccctctcgttgatagagccacctgcttgcgctccaccaagttcacaatctacaataatatgttctgcgcaggattccatgagggaggcagagatagctgccaaggggattctggcgggccccacgtgactgaagtcgaaggaacttcctttttgactggcataattagttggggagaagagtgcgctatgaagggcaaatatggcatctatacgaaggtgagccgctatgtaaattggataaaggagaaaacaaagcttact

SEQ ID NO: 8882 - DNA, 1383 bp, Artificial Sequence
  Description of Artificial Sequence: Synthetic coding sequence
atgcagcgggtcaatatgattatggccgaatctcctgggctgattaccatctgcctgctgggctatctcctcagtgccgaatgcacggttttcctggatcatgaaaacgcgaataagatactgaataggcccaaaagatataatagtggcaagctggaggagttcgttcagggaaacctggagcgcgagtgcatggaggagaaatgctcatttgaagaagccagggaagtttttgagaatacggagaggacgactgaattctggaagcagtacgtggatggagatcaatgtgagagcaacccctgcttgaacggtggatcctgtaaggacgacataaatagctacgagtgctggtgtccctttggattcgagggaaaaaactgtgagcttgacgtcacctgcaacattaagaatgggcgctgtgaacagttttgcaaaaactccgccgacaataaggtggtctgttcatgcacagaaggctacagactcgctgagaatcagaagtcatgtgaaccagccgtcccatttccctgcgggcgcgtgtccgtgtcccagacttccaagctcacccgagcagagaccgtgtttccagacgtggattatgtaaattccactgaggcggagaccatacttgacaatattacccagagcacccagagctttaacgatttcactcgggtagtgggcggtgaggatgctaaaccgggacagttcccgtggcaggttgtcctgaacggcaaagtggatgctttctgtggtggaagtatagtgaatgaaaaatggatcgtcacagccgcgcattgtgtcgaaactggagtcaagataacagttgtcgccggcgagcacaatatcgaagaaaccgaacatacggagcagaagcgaaacgttataagaattataccacaccataattacaacgccgccattaataagtacaatcacgacatcgcccttctggaactcgacgaacctctggtcttgaacagctacgtcactcccatctgcattgcagacaaggagtatacgaacatattcctgaagttcgggtccggatatgtgagcggttgggggcgggtgtttcacaagggaagatctgctctcgtactgcagtacctccgggtgcctctggtggatagagctacttgcctgcgatccacgaagtttacgatttataacaatatgttttgcgcaggattccacgaagggggccgcgactcctgccagggggatagcggtgggccgcatgtgaccgaggtagaagggacctcatttctgactgggattataagttggggggaggaatgtgccatgaagggtaagtacggtatttatacaaaagtcagtcgatatgtgaactggataaaggaaaaaactaaactgaca

SEQ ID NO: 8883 - DNA, 1383 bp, Artificial Sequence
  Description of Artificial Sequence: Synthetic coding sequence
atgcagcgggtgaatatgatcatggctgagtctcccggcctgataacaatctgcctcctgggctatctgctgagcgctgagtgcacagtctttctcgatcacgaaaacgctaataaaatcctgaaccgtcccaagaggtacaacagcgggaagctggaagagttcgtgcaaggaaaccttgagcgagaatgtatggaagaaaagtgttcattcgaggaggctcgtgaggtattcgagaatactgaacggaccaccgaattctggaaacagtacgtggacggcgatcaatgtgaatctaacccatgcctcaatggtggaagttgcaaggatgacattaacagttatgaatgctggtgtccttttggttttgagggaaagaattgcgaacttgatgtgacctgtaatattaagaacgggcggtgtgagcagttctgcaagaattctgcagacaataaagtcgtgtgctcgtgcacagaagggtatagactggctgagaaccagaagtcttgtgagcctgccgttccgttcccatgtggccgcgtgtctgtttcccaaacatcaaaacttacaagagcagaaacggtattccctgatgtagactatgtgaactctaccgaggccgagaccatactggataacattacacagagcacccagagtttcaatgactttacaagggtcgtaggaggagaggatgccaaacctggccagttcccatggcaagtggtactgaacggaaaggtggacgctttctgtggaggaagtatagtgaatgagaaatggatcgtgaccgccgctcactgtgttgagacgggagtcaagataaccgtggtggccggggagcacaatatcgaggagaccgagcacactgaacagaaacgcaatgtgataaggattattcctcaccataactacaacgccgctatcaacaaatacaaccatgacatcgccctgcttgaacttgatgagccattggtactgaactcgtacgttactcctatctgtatcgccgacaaagaatacacaaatatcttcctgaagtttggctccgggtacgtcagcgggtggggaagggtgttccacaaaggacgcagcgcgcttgtgctacagtatctgagagtacccctcgtggaccgggcaacttgcctcaggtctacgaagttcacgatctacaataacatgttctgcgccggttttcatgaggggggtcgggattcctgtcaaggcgatagtgggggacctcacgttactgaggttgagggcacttcctttttgaccgggattatcagttggggcgaggagtgcgccatgaagggtaagtacggcatctacacaaaagtctctcgatatgtcaactggattaaagaaaagacaaagctgacg

SEQ ID NO: 8884 - DNA, 1383 bp, Artificial Sequence
  Description of Artificial Sequence: Synthetic coding sequence
atgcaaagggtgaacatgatcatggctgaatcaccagggctgatcactatctgtctcctgggataccttttaagcgcagaatgtaccgttttccttgaccatgaaaatgctaacaagatactgaatagacctaaaagatataactctggaaaactcgaggaattcgtgcagggcaatctggagcgcgaatgtatggaagagaaatgttcatttgaggaggcacgggaggtattcgagaatacagaaagaaccacggagttctggaagcagtatgtagacggggatcaatgtgagagtaatccatgtctgaacgggggttcctgtaaggatgacattaattcatacgaatgttggtgcccattcggtttcgagggaaagaactgtgaactcgacgtcacctgcaacatcaaaaacggacgctgcgaacaattttgtaaaaacagcgccgataataaagtggtgtgttcttgtaccgaagggtaccggctcgcggagaaccagaaatcttgcgaacccgccgttccgttcccttgcggccgagtgtcagtgagtcagacatccaaactgaccagggctgagacagtattcccggacgtggattacgtaaattccacggaggctgaaacaattcttgacaatatcactcagtctacacagtcttttaacgacttcacacgggtcgtagggggagaggatgccaagcccggacagtttccctggcaggtggtactgaacggaaaggtggacgctttctgcgggggatctatagtgaatgagaaatggatcgtgacagctgcccattgcgtggaaacgggcgtcaagataactgttgtggctggggagcataatatcgaggagacggagcacaccgagcagaagaggaacgtaatacgcatcatccctcaccacaactacaatgctgcgatcaacaaatacaaccatgatattgccctcctggaactggatgaaccgttggtgctgaactcgtacgtgacccctatttgcattgccgacaaggaatacactaatatctttctaaagttcggatccgggtacgtgtccgggtggggtagggtgtttcataaaggtaggagcgccctggtgctccaatacttgagagtgcctctggtagaccgagccacctgcctgcgcagtacaaagtttacaatctataacaatatgttctgcgccggctttcacgaaggcggaagggactcctgccagggagactcaggcgggccgcatgtgacggaagtggaaggcactagcttccttaccgggattatctcatggggagaagagtgcgccatgaaaggcaagtatgggatttataccaaggtttcccgatatgtaaactggattaaagagaagacaaaactcacc

SEQ ID NO: 8885 - DNA, 1383 bp, Artificial Sequence
  Description of Artificial Sequence: Synthetic coding sequence
atgcagcgggtaaatatgataatggccgaaagtccgggcctcatcaccatctgtctcctcggctatcttctaagcgctgagtgcaccgtgttcttggaccatgaaaatgcgaacaaaatccttaaccgtcctaaaaggtataactccggcaagttggaggagttcgtgcagggaaacctggagcgagaatgtatggaggagaagtgctcctttgaggaagctcgggaggtattcgagaatacagaacggacaacggagttttggaaacagtacgtagatggggaccagtgcgaatcgaacccttgcctcaacggggggtcctgcaaggacgacatcaactcgtatgagtgttggtgccctttcggtttcgaaggcaagaactgtgaattggatgtgacatgtaacataaaaaacggcaggtgtgagcaattctgcaagaactccgcagataataaggttgtctgcagctgcactgagggttaccggctcgctgaaaatcagaagagttgcgaacccgctgtccctttcccttgtggccgtgtgtcggtttctcagacaagtaaactgactcgcgctgaaacagtattcccggatgtagactacgttaatagtacggaggccgagacaattttagataacatcacccagtccactcagtctttcaatgacttcaccagggtggttggtggcgaggatgccaagcctgggcagtttccctggcaggtggtcctcaatggtaaggtcgacgcattttgcggcgggtctatcgtgaacgaaaagtggattgtgaccgctgcccactgcgtggagacaggtgtgaagataacagtagtggcaggcgagcacaatattgaggaaacagaacacacagaacaaaagcgcaatgtgatacggattatcccacaccacaactacaatgctgcaatcaataagtataatcatgatattgccctgctggagttggacgagcctctggtccttaattcctacgttacgcccatctgtatagcagacaaagaatatacgaatatattcctcaagttcggctctggctacgtgagcggctggggacgggtttttcacaaaggtcgaagcgctctggtgctacagtatctgcgcgtccctctggtcgatagggccacatgtctacgatctacaaaattcaccatttacaataatatgttctgcgctgggttccacgaaggcggaagagattcctgccagggcgattcggggggacctcatgtgactgaggtagaagggacctcctttctcaccgggatcatctcttggggggaagaatgcgccatgaaaggcaagtatggaatttacacgaaagtctctcgctatgttaactggataaaagagaagaccaagctaacc

SEQ ID NO: 8886 - DNA, 1383 bp, Artificial Sequence
  Description of Artificial Sequence: Synthetic coding sequence
atgcagcgggtaaacatgataatggccgaatcccccgggctaatcactatctgtctcctgggatatttgctgtcagccgagtgcacagttttccttgaccacgagaatgcaaacaagatcctgaaccgccctaaaaggtataactctggtaagctcgaagagttcgttcagggaaatctcgagcgtgaatgcatggaagaaaagtgctcttttgaagaggccagggaagtctttgaaaacacggaaagaaccaccgaattttggaaacagtacgtcgacggagatcagtgcgagtccaatccctgtctcaatggaggaagttgcaaagatgatatcaactcctacgaatgctggtgccctttcggatttgaggggaagaactgtgagctggacgtcacctgtaacatcaaaaatggtcgctgcgagcagttctgcaagaattccgctgacaataaggtcgtctgttcctgcacagaggggtacagactggctgaaaatcagaaaagttgcgagcctgcagtgcctttcccttgtggcagagtgagtgttagccagaccagcaaattgacgcgggccgaaactgtgtttccggacgtcgattacgtgaactcaacggaggctgagacaattctcgacaacatcacacagagcactcaatcatttaacgatttcacgcgagtggtcggcggcgaagacgcaaagcccggccagtttccctggcaggtcgtcctgaacggcaaggtggatgccttctgcggggggtctattgtgaacgagaaatggatcgtgacagccgctcactgtgtagagaccggggtcaagataactgtcgtggcgggagagcacaacatagaggaaaccgagcacactgaacagaaacggaatgtgatacgaatcataccccatcacaattacaacgccgcaattaataaatacaaccacgatattgctttgctggagctggacgaacctttggtactgaactcctacgtgaccccaatctgtatcgcagataaagaatacaccaatatatttttgaagtttggctctggatacgttagcggctgggggcgtgtatttcataaaggtcgtagtgcgttagtactgcagtacctgagggttccactggttgatcgcgcaacctgcttgcgctcgaccaagtttaccatctacaataacatgttttgcgcgggattccatgaaggtggtagggattcttgccagggtgattcaggcggtccgcacgtcaccgaagtagaggggacatcctttcttaccggtatcatcagctggggcgaggagtgtgctatgaaggggaagtacggaatttacaccaaggtgtcaaggtatgttaattggataaaagagaaaacaaagctgacc

SEQ ID NO: 8887 - DNA, 1383 bp, Artificial Sequence; identical to SEQ ID NO: 8883
  Description of Artificial Sequence: Synthetic coding sequence

SEQ ID NO: 8888 - DNA, 1383 bp, Artificial Sequence
  Description of Artificial Sequence: Synthetic coding sequence
atgcagcgggtgaacatgatcatggccgagtccccgggtctgatcactatttgtctgctggggtacctgcttagcgcggaatgtacggtgtttctcgatcatgagaacgctaacaaaatcctgaacaggccgaagagatacaattcggggaagctggaggagtttgtccaaggaaacctggagcgggaatgcatggaagaaaaatgctcgttcgaagaggcccgcgaagtgttcgaaaataccgaacgtacgaccgaattttggaagcagtacgtggacggagatcagtgcgaatctaacccgtgtctgaacggagggtcatgcaaggatgacatcaactcgtacgaatgctggtgcccgttcggatttgaggggaagaactgcgaactggatgtaacttgtaatatcaaaaacggaaggtgtgagcagttctgcaaaaactccgctgacaataaggtggtctgctcatgcaccgaaggataccgcctcgccgaaaaccagaagtcgtgcgagcctgcggtccctttcccatgcggaagagtctcggtcagccagacctccaagctcactagagcagagactgtgttcccagatgtggactacgtgaactccaccgaagccgaaaccatcttggataacatcacgcagagcacgcagtcctttaatgacttcactcgcgtggtgggaggagaggatgccaaacccggccagttcccgtggcaagtggtgctgaacggaaaagtcgacgcgttctgtggaggatccatcgtcaatgaaaagtggatcgtgactgcagcccactgcgtcgaaaccggagtcaaaatcaccgtggtggccggagaacacaatatcgaggaaaccgagcataccgagcagaaaagaaacgtcatcaggatcatcccgcaccataactacaacgcagcaatcaacaagtacaatcacgatatcgctctgctcgagctggacgagcccctcgtgttgaattcatacgtgaccccgatttgcattgccgataaagaatatacgaatatcttccttaagttcggctctggctacgtgtcggggtggggaagggtctttcataagggacggtccgcactggtgctgcagtaccttcgcgtccccttggtcgaccgcgccacgtgtctcaggagcacgaagtttactatttacaacaacatgttctgtgcgggattccacgaaggagggagagacagctgccagggtgactccggcggaccgcatgtcaccgaagtcgaaggtacctcgtttcttactggaattatcagctggggagaggagtgcgcaatgaagggaaagtacggaatctacaccaaagtgagccgctacgtgaactggatcaaagaaaagactaaactcacc

SEQ ID NO: 8889 - DNA, 1383 bp, Artificial Sequence
  Description of Artificial Sequence: Synthetic coding sequence
atgcagagggtcaatatgatcatggcggagagtcctggtctgatcacaatctgcctcctcggttacctcttgtctgccgagtgcacagtttttctggaccacgagaatgctaacaagattctcaacagaccgaagcgctacaattctggcaaactcgaggagttcgtgcagggcaatctggagagagagtgcatggaagagaaatgctcatttgaggaggcaagggaagtcttcgaaaacactgaaagaaccacggagttttggaagcagtacgtcgatggtgaccagtgcgagtctaacccatgtcttaacggaggatcttgcaaagacgatatcaactcttacgagtgctggtgtccttttggattcgaaggaaagaactgcgagctggacgttacctgcaacatcaaaaacggtagatgcgagcagttttgcaagaacagcgcagataacaaggtggtgtgctcatgcacggagggctacagactcgctgagaaccagaagagctgcgagcctgctgtcccattcccctgcggaagggtcagcgtcagccagaccagtaagcttacccgcgctgagacagtgtttccggacgttgattacgtcaactctactgaagctgagaccatactggataacatcacccaatctactcagagctttaacgattttacaagagtcgtaggcggagaagatgctaagcccggtcaattcccctggcaagtcgttttgaacggaaaagtcgacgccttctgcggtggctctattgtcaatgaaaagtggattgttaccgctgcccactgcgtagagacaggcgtcaagataaccgttgttgccggtgagcacaacattgaagagacggagcacacggaacagaagaggaacgtaatccgcatcatccctcaccacaactacaacgccgcgatcaataagtacaaccacgacatcgcccttctggagctggatgaacccctcgtgctgaactcatacgtgacccctatatgtatcgccgataaggagtacacaaacatctttcttaagtttggaagcggatacgtgtcaggctggggccgcgtgtttcacaaaggcaggagcgctctggttttgcaatacttgagggtgcctctcgttgaccgcgctacctgtctgcgctcaactaagttcacaatctacaacaacatgttctgtgcgggttttcacgagggcggcagggattcctgtcaaggcgattccggcggcccccacgtgacggaggttgaaggaaccagcttcctcacaggaatcatctcttggggtgaggagtgcgcgatgaagggaaaatacggcatttacaccaaggtgtctcgctacgtgaactggatcaaggaaaaaaccaagttgacg

SEQ ID NO: 8890 - DNA, 1383 bp, Artificial Sequence
  Description of Artificial Sequence: Synthetic coding sequence
atgcaaagagtgaacatgataatggcggaatccccgggtctgattactatctgcctgcttggctacctcctttcggcagaatgtaccgtgtttctggatcatgaaaacgctaacaagatcctcaaccgcccgaaacgctacaacagcggaaagctcgaagaatttgtgcaaggaaatctggagcgggagtgcatggaagaaaagtgttcctttgaggaagcaagagaagtgtttgaaaacaccgaacgaactactgaattttggaagcagtatgtggatggtgatcagtgtgaatccaacccgtgtctgaatggagggagctgtaaggatgacattaactcctatgaatgttggtgtcctttcggtttcgaaggaaagaattgcgaactcgacgtgacctgtaatatcaaaaacggaagatgtgaacaattctgcaagaatagcgccgataacaaggtggtctgtagctgcaccgaaggatatagactggcagaaaatcagaaatcgtgcgagcccgccgtgccatttccttgcggtcgcgtctcagtttcacagacttcgaaacttacgagagcggaaactgtctttccagacgtcgactacgtcaacagcacggaagcagaaactattctggacaatatcacgcaatccactcaatcctttaatgatttcaccagagttgtgggtggcgaagatgccaaacctgggcagtttccttggcaagtcgtgctgaatggaaaagtggacgcattttgtggagggagcattgtgaatgaaaagtggattgtcaccgcggcacattgtgtggaaaccggcgtgaagatcaccgtcgtggctggggaacacaatatcgaagaaaccgagcacacggaacaaaagcgtaacgttatccggatcattccccatcacaactacaacgcagcaatcaataagtacaatcatgatattgctttgctcgagctggatgagcccctggttctgaattcgtacgtgactcctatatgtatcgccgacaaggaatacactaacatttttctgaaatttgggagcggttacgtgagcggttggggtcgtgtctttcacaagggcagatccgcacttgtcctccagtacttgcgcgtccctcttgtcgacagagcaacctgcctgcggtccaccaagtttactatctacaacaacatgttttgtgcagggtttcatgagggaggcagggatagctgtcaaggagatagcgggggcccacatgtgaccgaggtcgagggaactagcttcctgaccggaattatctcctggggagaagaatgcgcaatgaagggaaaatacgggatttacaccaaggtatcccggtacgtcaactggattaaagagaaaactaagctgacc

SEQ ID NO: 8891 - DNA, 1383 bp, Artificial Sequence
  Description of Artificial Sequence: Synthetic coding sequence
atgcagcgtgtgaatatgataatggctgaaagtcctggtctgattaccatctgcttactggggtacctgttatccgccgaatgtaccgtctttctcgaccatgagaacgctaataagatcctgaatcggccaaagaggtacaacagcggaaaactggaagagttcgtacagggtaatctggagagggaatgtatggaagagaaatgtagttttgaggaagctagggaagtgttcgagaataccgagcgcaccactgaattttggaaacagtacgtcgacggagaccaatgcgaatctaacccgtgcctgaatggtgggtcctgtaaagacgatattaactcctacgagtgctggtgccccttcggctttgaagggaaaaattgtgaactggacgtgacttgcaatattaagaacgggaggtgtgagcagttttgcaaaaattccgcagacaacaaagtggtctgcagctgcaccgaggggtatcgattggcagagaaccagaagtcatgcgagccagcggtgccatttccttgtggtagggtgagcgtgtcacaaaccagcaaacttacaagggcggagacggtgttcccagacgtggactacgtcaatagcaccgaagctgagacaatccttgataacattacccagtccacacagtcctttaatgattttactagggttgtaggcggagaagatgccaaaccgggccagttcccctggcaagtcgtgctgaacggaaaagtcgatgctttctgcggcggcagcatcgtaaacgagaagtggattgtcaccgcagcccattgtgtggagactggagtaaagattacggtggttgctggtgagcataatatcgaggagacagagcatacagaacaaaagcggaacgtaattcgaatcataccccaccataactataacgcggctattaacaagtacaatcatgatattgcgctgctcgaactggacgagcctctggttctgaacagttacgttacaccaatttgcatcgccgataaggagtataccaacatcttcctgaagtttggctcaggatatgtatctgggtgggggagagtcttccataagggtcgatcagcattagtgctccaatatctgcgagtgccattagtcgaccgagcaacctgcctgcgatctacaaagttcacaatatataacaatatgttctgtgctgggttccacgaaggcggcagggactcctgccagggggacagtggcgggcctcacgttactgaagtagaagggacgtctttcctgaccggaattataagctggggggaggagtgcgcaatgaagggtaagtatggcatttatactaaagtatctaggtacgttaattggataaaggagaagactaagttgacg

SEQ ID NO: 8892 - DNA, 1383 bp, Artificial Sequence
  Description of Artificial Sequence: Synthetic coding sequence
atgcaacgggtgaacatgatcatggcggagagccccggtcttattaccatttgtctgctcggatacctgctttccgcagaatgtaccgtctttctggatcatgagaacgcgaacaaaatcctcaacagaccaaagagatacaactcgggtaagctggaagaatttgtgcaaggcaatctcgagcgggaatgtatggaggagaagtgttcattcgaggaagcaagagaggtgtttgaaaacaccgaacgtacgactgaattttggaaacaatacgtggatggagatcaatgcgaaagcaacccttgcctgaatggcggctcgtgtaaggatgatatcaattcctacgaatgctggtgtccctttggatttgagggcaagaattgtgaactggatgtcacgtgtaacataaagaacggacgctgcgaacaattttgtaagaattcggcagacaataaggtggtgtgttcgtgcaccgaaggatacagattggcagaaaatcaaaagagctgtgagcccgcagtccccttcccctgtggtagggtttccgtgtcgcagactagcaagctcacgcgtgcagaaactgtgttccccgatgtggattacgtgaactccactgaggcggagacgattcttgataacattacccagtcaacccagtcgtttaacgatttcactagggttgtgggaggagaagatgccaaacctggtcagtttccttggcaagtggtcctgaatgggaaggtggatgccttttgcggtggctcaattgttaacgagaaatggattgtgaccgccgcgcattgtgtggaaactggagtcaagattacggtcgtggcaggagaacataacattgaggagactgagcacaccgagcaaaagagaaacgtgatccgcatcattcctcatcataactacaacgcagccatcaacaagtacaatcatgacattgcacttcttgaacttgacgaacccctggtgctgaactcctatgttacgccaatttgtattgccgataaggagtacaccaacatcttcctcaagtttggctcaggatatgtgtctggatggggcagagtgtttcataaggggaggtccgcactggtgcttcaatacctcagagtgccacttgtggaccgggctacttgtctccgttcgaccaagtttaccatctataacaacatgttttgtgcaggatttcatgagggtggtcgggacagctgccagggcgactccgggggacctcacgtgaccgaagtggagggaacttcctttctgaccggaattatctcctggggagaagaatgtgcaatgaaagggaaatacggaatttacactaaggtcagtagatacgtgaactggatcaaagaaaagactaagctgacg

SEQ ID NO: 8893 - DNA, 1383 bp, Artificial Sequence
  Description of Artificial Sequence: Synthetic coding sequence
atgcaacgtgtgaacatgattatggcagaatcgccgggacttataacgatttgcctccttggatacctcttgtccgcagaatgtaccgtctttcttgatcatgagaacgcaaacaagatacttaaccgccctaagagatacaacagcggtaagttggaagaattcgtccaaggtaatctggaacgcgaatgcatggaggagaagtgcagtttcgaagaagcaagggaagtgtttgaaaataccgagagaacgactgaattctggaagcaatatgtggatggtgaccaatgtgaaagcaatccatgtctgaatggtggttcgtgcaaggatgacataaacagttacgaatgttggtgtccattcggattcgaagggaagaattgcgagctcgacgtgacctgtaacattaagaacggtagatgcgagcaattttgtaagaacagcgcagacaataaggtcgtgtgctcgtgcaccgagggataccgtcttgcagaaaaccaaaagtcgtgtgagcccgcagtgcctttcccgtgtggaagagtgtcagtcagccagacgtccaaacttaccagggcagaaaccgtctttcctgacgtcgattacgtgaatagcaccgaagccgaaactatcctggacaatatcacccaatccactcaatcatttaacgattttactcgagtggtgggaggggaagatgccaaacctggtcagtttccatggcaagtggtgctgaacggtaaggtcgacgcattctgcggaggctcgattgtgaatgagaagtggatcgtgaccgcggcacattgcgtcgaaacgggagtgaagattacggtggtggccggtgaacataacattgaggaaactgaacatactgaacagaaaaggaacgtcattcgaattatccctcatcacaactacaacgcagcaataaacaagtacaatcacgatatagccctgcttgaactcgacgaacctcttgtgctcaactcctacgtgaccccaatctgtattgccgacaaggaatacaccaatatctttctgaagttcggttcaggatatgtcagcggctggggtagggtgtttcataagggaagatcggcactcgtcctgcaataccttcgggtccccctggtggacagggccacttgtctgcgtagcaccaagtttactatctacaacaatatgttttgtgctggattccatgaaggtggacgggattcctgccagggagactcgggagggccccacgtcactgaggtggaaggaacttcctttctcaccggaattatctcctggggtgaagagtgtgcgatgaaaggaaagtacgggatttacactaaagtgagcagatatgtgaattggatcaaggaaaagaccaaactcact

SEQ ID NO: 8894 - DNA, 1383 bp, Artificial Sequence
  Description of Artificial Sequence: Synthetic coding sequence
atgcagagggttaatatgatcatggcagagagcccaggactaataaccatctgtctcttgggctatctgctgagcgctgaatgtactgtcttcttagatcatgagaatgccaacaagatcctgaatcggcctaagcgatacaactccgggaagctagaggagttcgtgcaaggtaacctggaaagggaatgtatggaagagaaatgcagctttgaggaagcacgggaagtgtttgagaataccgagaggaccactgaattctggaagcagtacgtggacggtgatcagtgtgagtcgaatccttgcctgaacggcggtagctgtaaagacgatatcaattcctatgagtgttggtgcccctttggctttgaaggcaaaaactgtgaactggatgtcacctgcaacatcaagaacggtaggtgtgagcaattttgtaaaaacagcgcagacaataaagtcgtgtgtagttgcaccgagggctacaggttggccgagaaccagaagtcctgcgagcctgcggttccattcccatgcggtcgcgtctctgtatctcagacttccaaactgacccgagcagaaacagtgtttccagatgtcgactatgttaatagcactgaagctgagactatcctggacaatatcactcagtccacacagtcttttaacgacttcacgcgtgttgtgggcggggaggacgcgaagcctggtcagttcccttggcaagtcgttctcaatggaaaggtggacgctttctgcgggggttccatcgtgaatgaaaagtggattgtgacagcggcccactgcgttgagactggggtcaagattacagtggtggccggggaacataatatagaggagaccgaacataccgagcagaaacgcaatgtgatcaggattatcccccaccacaattataacgccgctatcaataagtacaaccatgacatcgccctattggaactggacgagccgcttgtcctgaacagctatgttactccaatctgtatcgctgataaggaatacaccaacatattcctaaaatttgggtccggttatgtctcaggttggggcagagtcttccacaagggtaggagtgcactggtgctgcaatacctgcgtgtgccactggtagacagggccacctgcctgaggtccactaaattcacgatctacaacaacatgttctgcgccgggttccacgaaggcggaagagatagctgtcagggtgattctggagggccacatgtgaccgaggtcgaagggacaagtttcctcactggcatcatctcttggggcgaagaatgcgcaatgaagggcaagtatgggatatatactaaagtgagccggtatgtgaactggatcaaggagaaaacaaagctgacc

SEQ ID NO: 8895 - DNA, 1383 bp, Artificial Sequence
  Description of Artificial Sequence: Synthetic coding sequence
atgcagcgcgtgaacatgattatggccgaaagcccgggactgatcactatatgtctgctgggctacctgttgagcgcagagtgcaccgtgttcttggaccatgaaaacgctaacaagatcctcaatagacctaagagatacaacagcgggaagctcgaggaatttgtccagggaaatctggaacgcgaatgcatggaggaaaagtgttctttcgaggaggctcgggaggtgttcgaaaacactgaacggaccacggagttttggaagcagtacgtcgatggtgaccagtgcgaatcaaatccatgcctcaacggaggtagctgtaaagacgatatcaacagctacgagtgctggtgtccgttcgggttcgaaggaaagaattgcgaactcgatgtgacttgcaacatcaaaaatgggagatgcgagcagttttgtaagaactctgcagataacaaagtggtgtgctcgtgcactgaaggctacagactcgccgaaaatcaaaagtcgtgcgaaccagcggtgcccttcccttgtggcagagtgtcagtctcccagacttcaaagctcactcgcgctgagactgttttcccggatgtggactacgtcaattcgacggaggcggaaactatccttgacaacatcacgcagtctacccagtcgttcaacgacttcactcgcgtggtgggaggtgaagatgccaagccaggacagttcccttggcaagtcgtgttgaacggtaaggtcgacgccttttgcggcggttccatcgtgaacgagaagtggattgtgaccgccgctcactgcgtggaaaccggagtgaagatcaccgtggtggccggagagcacaatattgaggagactgagcacactgagcaaaaacgaaacgtcatccggattatcccgcaccacaactacaacgcagccatcaacaaatacaatcatgacatcgcccttctcgaactggatgagccactggttctgaattcatatgtcactccgatctgcatcgccgacaaagaatacacgaacatctttctgaagttcggatcgggatacgtgtccggatggggtcgggtgttccacaaaggtcgctccgcgcttgtgctgcagtaccttcgggtcccactggtggaccgggcgacttgcctcagatccacgaagtttacgatctataacaatatgttctgcgctggatttcatgaaggaggcagggactcctgtcaaggagattcgggaggcccgcatgtgaccgaggtggaggggaccagcttcctgactggaatcatctcctggggtgaagagtgtgcgatgaagggcaaatacggcatctacactaaagtctcccgatacgtgaactggatcaaggaaaaaaccaagctgact

SEQ ID NO: 8896 - DNA, 1383 bp, Artificial Sequence
  Description of Artificial Sequence: Synthetic coding sequence
atgcaacgggtgaatatgattatggccgaatcacctgggctgatcactatctgcttgcttggataccttctctcagccgagtgcactgtgtttcttgatcatgaaaacgcgaacaagattcttaaccgccctaagagatacaattccggaaagctggaggagtttgtccaaggcaaccttgagcgagaatgtatggaagaaaagtgtagttttgaggaagcgagagaagtgttcgaaaacaccgaacgcaccactgagttctggaagcaatacgtggacggagatcagtgtgagagtaatccatgtttgaatgggggatcctgcaaggatgacataaactcctacgaatgctggtgtccctttgggttcgaaggtaagaactgtgaactggatgtgacctgtaatatcaaaaatggacgatgcgaacagttctgtaagaatagcgcagacaacaaggtggtgtgctcctgtactgagggatacagactggctgagaatcaaaaatcatgtgaacccgcagtcccatttccctgtggacgggtgtcggtgtcacagacctccaagctgaccagagcagaaaccgtgtttccagacgtggattacgtgaatagcaccgaagcagagactattctggataacatcactcaatctactcaatccttcaatgactttacccgagtcgtgggaggcgaggatgcaaaaccaggtcagttcccatggcaggttgtgctgaatggtaaagtggatgccttctgtggtggaagcattgtcaacgaaaagtggattgtgactgccgcccactgcgtggaaaccggcgtcaagattacggtcgtggcgggcgaacataacattgaagagactgaacataccgaacagaagagaaatgtgatcagaatcattcctcatcataactacaacgcagcaatcaacaagtataaccatgacatagcgctcctcgagctggatgaacccctcgtgctgaattcctacgtgacccctatctgcatagcagataaagaatacactaacattttcctgaagttcggctccggctatgtgtcgggatggggcagggtgtttcataagggaagatcagccctcgtgctccaatacctccgcgtgcctctggtggatcgcgccacttgtctccgttcgaccaaattcactatctacaataacatgttttgtgcaggtttccatgaaggtggacgcgattcatgtcagggcgacagcggtggaccccatgtgactgaagtggaaggtacttcgttcttgacgggaatcataagctggggtgaagaatgcgcaatgaagggaaagtacggtatctacacgaaagtctcaagatacgtgaattggatcaaagaaaagaccaaacttact

SEQ ID NO: 8897 - DNA, 1383 bp, Artificial Sequence
  Description of Artificial Sequence: Synthetic coding sequence
atgcagcgcgtaaacatgatcatggccgagtctccagggctgattacaatctgcctgttgggatatcttctgtccgccgagtgcactgtgttcctcgaccacgagaacgccaataaaatcctgaatcgccccaagagatacaattcaggcaagctagaagagtttgtgcagggcaatttagaacgggagtgtatggaagagaagtgctcttttgaagaagcacgggaagtgtttgagaatacggagaggaccaccgagttttggaagcagtatgttgatggtgaccagtgtgagagcaacccctgccttaacggaggaagttgtaaggacgacatcaacagctacgaatgctggtgcccctttggatttgagggcaagaactgtgaattagacgtcacatgcaacattaagaacggccgctgcgaacaattttgtaagaattcagcagacaacaaggtggtgtgtagctgcacagaaggctaccgtctcgctgagaaccagaagagttgcgagcccgccgttccattcccatgtggtagagtcagcgtatcccagacctctaagctgaccagggctgagaccgtatttcccgacgtggactacgttaactcgactgaagccgagactattcttgataatatcactcagagtacacaaagctttaatgattttaccagagtcgttggcggagaggacgccaagccaggacagttcccctggcaagtcgtgctgaacggtaaagtggacgcattctgcgggggatccatcgtcaatgaaaaatggatcgtgacagctgcccactgtgttgaaacgggcgtgaagatcacggtggtggcgggcgagcacaacatcgaggagacagaacacacagaacaaaaacgaaacgtcatccgcattatcccacatcacaactataacgcagcaatcaataaatataatcatgacatcgcactgctggagcttgacgagcccctggtactgaactcgtacgtcactcccatttgtatcgcagacaaagaatacaccaatatcttcctgaagttcggatccggctatgtgtccgggtggggacgggtgtttcataagggcagatcagcacttgtgctacagtacctgagggtgcctcttgtagatcgggccacctgtctgcggagtaccaagttcactatatacaataatatgttttgtgccggcttccacgagggcgggcgtgattcatgccagggagatagcggcggcccccacgtaacagaggtggaaggaacgtccttcctgaccggtatcattagctggggcgaagaatgtgccatgaaagggaagtatgggatttacacaaaagtgtcccgttatgtcaattggatcaaagaaaaaactaagctcacg

SEQ ID NO: 8898 - DNA, 1383 bp, Artificial Sequence
  Description of Artificial Sequence: Synthetic coding sequence
atgcagcgcgtgaacatgattatggcagaatcgccaggcctcattaccatctgtctcctgggttatctgcttagcgccgaatgtactgtctttttggatcatgagaacgcaaataagattcttaacaggcctaagaggtacaactccggcaagctggaagaatttgtccaggggaatctggagcgggaatgtatggaagaaaagtgctcctttgaggaagctcgcgaagtgtttgaaaacacggagagaactaccgaattctggaaacaatacgtggatggtgaccaatgtgagtcaaacccttgcttgaacggtggatcatgtaaagatgacatcaatagctacgagtgctggtgtccttttggatttgagggtaagaactgtgaactcgacgtgacttgtaacatcaaaaatgggagatgcgaacagttctgtaaaaactccgcagacaataaagtggtctgctcgtgtactgaggggtaccgccttgcagaaaaccagaagtcctgtgaaccagcagtgcctttcccttgcggacgggtatccgtgtcgcagaccagcaagctgacgagggctgaaacggtgtttcccgatgtcgattacgtgaatagcactgaagcagaaaccatcctggataacattactcagtcgacccagtcgtttaatgacttcaccagagtggtgggtggagaggacgctaaaccaggccaatttccctggcaagtggtgcttaatgggaaggtggatgcattttgtgggggcagtattgttaatgaaaagtggatcgtgacggcagcccattgcgtggaaactggcgtgaagatcacggtcgtggctggcgagcacaatatcgaagaaacggagcatactgaacaaaagcggaacgtgatacgcatcattccgcatcataactacaatgccgcgatcaataagtacaaccatgacattgcgctcctggaacttgatgagccactggtgctcaacagctacgtgactcccatatgcatcgccgataaagaatacactaacattttcctgaaattcggaagcggatacgtctccggttggggccgagtctttcacaagggacggtcagcactcgtgctccaatacctgagggtcccactcgtggatcgggccacctgtcttaggagcacgaagtttactatatacaataacatgttttgtgccggattccatgaaggaggacgggactcatgtcaaggagattccggtggaccacacgtgaccgaggtggaaggcacttcatttctcactgggatcatttcctggggagaggaatgcgcaatgaaaggaaaatacggaatctacaccaaggtatctaggtacgttaactggattaaagaaaaaactaaacttact

SEQ ID NO: 8899 - DNA, 1383 bp, Artificial Sequence
  Description of Artificial Sequence: Synthetic coding sequence
atgcagcgtgtcaatatgattatggctgaaagccctggattaataacaatctgtttgttaggataccttttatcggcagagtgtacggtttttcttgaccatgagaacgcaaacaaaatcttaaacagacctaaacgctacaatagtggaaaactcgaagaattcgtccagggcaatttagagcgcgaatgtatggaggagaagtgtagctttgaagaggctcgagaagtttttgaaaacacagagagaaccacagaattttggaaacaatatgtggatggagatcagtgtgagtctaatccttgtctgaacggaggcagttgcaaagacgatattaactcttatgaatgctggtgcccttttggcttcgaaggtaagaactgtgaactagatgtgacgtgcaacatcaaaaatggccgttgtgaacagttttgcaagaactcagcggataacaaagtagtctgttcatgcactgaaggctatcgacttgcggagaaccaaaaatcatgtgaacctgcggtaccgtttccgtgcggtcgagtcagcgtgtctcaaacgtcgaaacttacacgagctgaaacagtctttcctgatgttgattatgtgaatagtactgaggcggaaactattcttgataatatcacgcagagcactcaaagctttaacgattttactcgggtagttggtggtgaagatgccaaacctggccagtttccttggcaagtagttctgaacggcaaggtagatgcgttctgcggcggatcgattgttaacgaaaagtggatagtcacggcagcgcattgtgtagaaacaggggtgaaaatcacggttgtggcaggggaacataatatcgaggagacagaacatacggaacagaaaagaaatgttattcgcatcatcccccatcataattataatgctgccattaacaagtataatcatgatattgctctgctagagttggatgaaccgcttgtcctcaactcatatgtgactccgatctgtattgcagacaaggaatacacaaacatttttcttaaatttggttcaggatatgtgagcggctggggcagagttttccataaaggccgttctgctctggtactgcaataccttagggtcccgttagttgatcgtgcaacgtgcctgcgctcgactaaatttacaatatataataatatgttctgcgcgggtttccatgagggaggtagagatagttgccagggtgattctggtggcccccacgtaacagaagtggaaggaacaagcttcttgacaggaataatcagctggggagaagaatgcgcaatgaaaggaaaatacggaatatatacgaaggtctcgcggtatgtaaattggatcaaagaaaagactaagcttacc

SEQ ID NO: 8900 - DNA, 1383 bp, Artificial Sequence
  Description of Artificial Sequence: Synthetic coding sequence
atgcagcgcgtgaatatgattatggcagaatccccaggattgattacaatttgtctgctgggctatctgctttctgccgagtgtactgtatttctggatcatgagaatgcaaacaagatactgaatcgtcccaaacgctataatagcggtaaactagaggagttcgtccaaggcaatctggaaagagaatgcatggaggagaagtgcagcttcgaagaagcgagggaggtctttgaaaacacagagcgtactaccgagttttggaagcaatacgtggacggggatcagtgcgaatccaacccctgtcttaacggaggttcttgcaaggacgacattaactcttacgagtgttggtgtccgttcgggttcgagggtaaaaactgtgaacttgacgtgacctgcaatatcaagaatgggagatgtgaacagttttgcaagaactcagcagacaacaaagttgtctgttcatgcactgagggttacagactggctgagaatcagaaaagctgcgagccagccgtcccattcccttgtggccgcgtttcagtgtcccaaacaagtaagctcactcgcgcagaaaccgtgttccctgatgtcgactatgtgaattctacagaggcagagacaattctagataacatcacgcagtctacccagtcgtttaacgacttcactagagtcgtgggcggcgaggacgcaaagcctggccagtttccgtggcaggtggtgctgaacggcaaagtcgacgccttctgcgggggcagcattgttaatgaaaagtggattgtaacggctgcgcactgtgtcgagactggcgtgaagatcacagtggtggcaggagagcacaacattgaggagaccgaacacactgaacagaagaggaatgttatacggattattcctcatcataattacaatgctgccatcaacaaatataatcacgatatcgcgctactcgagctggacgagcctttggtgctgaacagctatgtcacccccatttgcattgcagacaaggaatataccaatattttccttaagttcgggtcgggctacgttagcggttggggtcgcgtcttccacaagggaaggagcgcgctggttctgcagtaccttagagtgccactggtggatcgggcaacttgtctcaggagcacgaaattcactatttacaataacatgttttgtgccggctttcacgagggcggtcgtgatagctgccagggcgatagcggcggtccacacgtcaccgaggtcgagggcacaagttttctaaccgggattatttcctggggagaggagtgcgccatgaaaggaaagtacggaatctatacaaaagtatctcggtatgtcaattggattaaggagaagaccaaacttaca

SEQ ID NO: 8901 - DNA, 1383 bp, Artificial Sequence
  Description of Artificial Sequence: Synthetic coding sequence
atgcagcgtgtaaatatgattatggctgagtctcctggccttattaccatttgcttacttggatatctgctgtccgctgaatgtaccgtctttctggaccacgagaatgcaaataaaattcttaataggcctaaaagatataattctggcaaattagaggaattcgtgcaagggaatctggaacgagagtgtatggaggaaaaatgcagtttcgaagaggctcgagaagtattcgagaacacagaacgtacaacggaattctggaagcagtacgttgatggagaccagtgcgagtccaatccgtgtctcaacggagggtcctgtaaagatgatatcaactcgtatgaatgttggtgcccctttgggtttgagggcaaaaactgtgaattggatgtaacatgtaacatcaaaaatggcagatgcgagcagttttgcaaaaacagcgccgacaataaagttgtgtgctcgtgtactgaggggtataggcttgctgagaaccaaaaatcatgcgagcccgccgtgcctttcccttgtgggcgggtgagtgtctcccagaccagcaagctgactagggcggagactgtgttccccgatgtggactatgttaactccaccgaggctgagacgatactggataatatcactcagtctactcagagtttcaatgactttactcgcgttgtgggcggggaggacgccaagcctggccagttcccatggcaggtggtcctcaacggcaaagttgacgcattctgcggagggtctatcgtgaacgagaagtggatcgtcaccgcagcccactgtgtggagaccggggttaagattacggttgtggccggggagcataacatagaggaaaccgaacacaccgaacagaaaaggaacgtcattcgcataattcctcatcacaactacaatgccgctataaacaaatacaatcatgacatcgccctgcttgaactggatgagcccctcgttctcaattcatacgttactcctatatgtattgcagacaaggagtacaccaacatattcctgaaattcggttctgggtatgtaagcggttggggccgggtgtttcataagggtagaagcgcattagtgcttcaataccttagggttccactggtggatcgcgcgacgtgcttgcgctcaactaaatttaccatttataacaatatgttctgcgcaggcttccacgagggaggccgggattcctgccagggcgacagcggggggcctcacgtaaccgaggtggagggcacatcattccttactggaattattagctggggggaggagtgtgccatgaaagggaagtacggaatatatactaaagtctcccgttatgtgaactggattaaagagaaaaccaaactcacc

SEQ ID NO: 8902 - DNA, 1383 bp, Artificial Sequence
  Description of Artificial Sequence: Synthetic coding sequence
atgcagagagtcaatatgatcatggctgagtcgccgggcttgatcactatctgtctgcttggctatctactttctgccgaatgtaccgtgttcctggaccacgagaatgccaataagatattgaatagacccaaacggtataattccgggaagctcgaggaattcgtgcagggcaatctggaacgcgagtgcatggaggagaagtgttcattcgaggaggctcgagaggtcttcgagaacacagagcgcaccacagagttctggaaacaatatgtggatggggatcagtgtgagagtaatccttgcctcaacgggggatcctgcaaagatgacatcaattcctacgagtgttggtgcccattcggctttgagggaaagaactgtgaacttgacgtgacctgtaacataaagaacggtcgctgcgaacagttttgtaaaaacagcgccgacaacaaagtggtttgctcatgtactgaagggtatcgactggcagaaaatcagaagagctgtgagcctgcagtgccgtttccatgtggtcgggtcagcgtgtcacagaccagcaaattgacaagagcagagactgtatttccagacgtggactacgttaactcaacagaagctgagacgatcctggacaatataactcagtcaactcagtcatttaacgatttcactagggtagtgggaggggaggatgctaagccggggcaattcccctggcaggtagtcctgaacggtaaagtggatgccttctgcggtgggagtatagtgaacgagaaatggatcgttacagccgctcactgtgtagaaacgggggtgaaaataacagtcgttgcgggggagcacaacattgaggaaactgaacatacagagcagaaacgaaatgttatccgaatcatccctcatcataactataacgctgcaattaataaatacaaccacgatatcgcgctgcttgagttagatgagcctctcgtgctcaactcctacgttacccccatctgtatcgccgataaagagtataccaatattttccttaagttcgggtcaggctacgtctccggatggggacgagtgttccacaagggccgcagcgcacttgtcctgcagtacctgagagtgccattagtcgacagggcaacctgcctgcggtccactaaattcacgatctacaataacatgttctgcgccggttttcatgagggcggacgagatagctgtcaaggcgatagtggtggccctcatgtaaccgaagtggagggaacatccttcctgacaggcattattagctggggggaggagtgtgctatgaaggggaagtacggcatctacacaaaggttagtaggtacgtaaattggatcaaggagaagactaaactcact

SEQ ID NO: 8903 - DNA, 1383 bp, Artificial Sequence
  Description of Artificial Sequence: Synthetic coding sequence
atgcagagagtgaatatgatcatggccgagtccccgggcctgattaccatctgtctgcttggttacctgctgtcggcggagtgtactgtctttcttgatcacgaaaacgcaaacaagattcttaaccgaccaaagagatacaactccggcaaacttgaagaatttgtccaaggaaatctcgagcgagagtgtatggaagagaagtgctccttcgaagaggcaagagaagtctttgaaaacaccgagaggactaccgaattctggaagcaatacgtggatggagatcaatgcgagtcaaatccttgccttaacggaggttcgtgcaaggatgacatcaactcgtatgaatgttggtgcccttttggctttgagggcaagaattgcgagcttgacgtgacttgtaacattaagaacggacgttgtgagcaattttgtaaaaactcggcagacaataaagtggtgtgttcgtgtacggagggttacaggcttgcagagaatcaaaagtcctgtgaacccgcagtgccatttccctgtggccgcgtgtcagtctcgcaaacgtccaaacttactcgcgcagaaactgtgtttcctgacgtggattatgtgaatagtaccgaagcggaaaccattcttgataacatcacccagtccacccaatcctttaatgattttaccagggttgtcggaggtgaggatgcaaaaccaggacagtttccgtggcaggtggtgttgaatggaaaggtggatgccttctgcggggggtcaatcgtgaacgaaaagtggatagtgactgcagcacattgtgtggaaaccggagtcaagataaccgtggtggccggagaacacaacatcgaggagactgagcacaccgagcagaaaagaaacgtcatacgaatcatacctcatcataactacaacgcagccataaacaagtacaaccatgatatagccttgctggaactggatgaaccgttggtgctcaactcatacgtgactcctatctgcatcgcagacaaggaatacaccaacatattcctgaaattcggatccgggtacgtgtccggctggggtagagtgttccataagggccggtctgcactggtgcttcaatacctgagagtgcctcttgtggatagggcaacttgtctgagatccaccaagtttaccatttacaacaatatgttctgcgcgggattccacgagggtgggcgggatagctgtcagggagattcaggcggaccccatgtgacggaagtggaaggaacttcctttctcactggcatcatttcatggggcgaggagtgtgcgatgaagggaaaatacggtatttacaccaaggtgtcgcggtacgtcaactggattaaggaaaagaccaaacttacc

SEQ ID NO: 8904 - DNA, 1383 bp, Artificial Sequence
  Description of Artificial Sequence: Synthetic coding sequence
atgcagagagtcaatatgataatggcggaatcacctgggctcattaccatctgcctgctgggttacctgctttcggcagagtgtactgtctttctggatcatgaaaacgccaacaagatcttgaaccgccctaaaagatacaatagcggtaagctggaggaattcgtgcaaggaaatttggaacgcgaatgcatggaagaaaaatgttcatttgaagaagcgcgtgaggtgtttgaaaacactgagagaacgacggagttctggaagcagtacgtggatggtgaccaatgcgaaagcaatccttgtctcaatggaggctcatgtaaagatgatatcaactcgtacgaatgctggtgtccttttggattcgaaggtaagaactgtgaacttgacgtcacctgcaacatcaaaaacggtcgttgtgagcagttttgtaagaattccgcagataacaaggtcgtgtgttcatgtactgaaggataccggctcgcagagaaccaaaagtcttgcgagcctgcagtcccttttccctgtggacgagttagcgtgtcccaaaccagcaagctgacccgtgccgaaactgtgtttccggacgtggactacgtgaactccactgaagcggaaaccatcttggataacatcactcaatccacccaatcgttcaacgattttactagggtggtcggtggtgaagatgcaaaacctggccagtttccctggcaagtggtgttgaacggcaaggtggacgcgttttgtggcggttccatagtgaatgagaagtggatcgtgacggctgcacattgtgtcgaaaccggcgttaagataacggtcgtggcaggcgagcacaacattgaagagactgaacataccgaacagaagcgaaacgtgataaggattattcctcaccataactacaacgcagcaataaacaagtacaatcacgacatcgcccttctcgaattggatgagccgcttgtgcttaatagctacgtcactcctatctgtatagcagacaaagagtacactaacattttcctgaagtttggctccggatacgtgagcggctgggggcgggttttccataaggggagatctgcactggtcctgcagtaccttagggtgccgcttgtcgatcgggccacctgtctccgctccaccaaattcaccatatacaacaacatgttttgtgctgggtttcatgagggcggaagagattcctgtcagggcgattccggaggacctcacgtgactgaggtagaaggtacttcgttcctgaccgggattatctcctggggagaagaatgcgcgatgaagggaaagtacggaatctacacgaaggtgtcaaggtacgtgaattggataaaggaaaagaccaagctgacc

SEQ ID NO: 8905 - DNA, 1383 bp, Artificial Sequence
  Description of Artificial Sequence: Synthetic coding sequence
atgcaacgcgtgaacatgatcatggcggagtccccgggactgatcaccatctgcctgctcggatacctcctgagcgcggagtgtactgtgttcttggaccacgaaaatgccaacaaaatcctcaaccgcccgaaaagatacaactctggaaagctggaggaattcgtgcaaggaaacttggaacgagagtgcatggaagagaagtgctcattcgaagaggcccgggaggtttttgagaataccgagaggacgaccgagttttggaagcaatacgtggacggtgaccaatgcgagtcgaacccgtgcctcaacggaggatcatgcaaagatgacatcaattcgtatgagtgctggtgcccgtttggatttgaggggaagaattgcgaactggacgtcacttgcaacatcaaaaatggtcgatgcgagcagttctgcaagaattccgccgacaacaaagtggtgtgttcgtgtactgagggatacagactggccgaaaaccaaaagtcatgtgagccagcagtcccttttccgtgcgggcgcgtgtccgtgagccaaacctcaaagctgacgagggcggagactgtgttccctgatgtggactacgtcaattccaccgaggctgaaactattctcgacaacattacccagtcgactcagtcgttcaacgatttcactcgggtggtgggcggagaggacgccaagccaggacagttcccctggcaggtcgtgttgaacggaaaagtggacgcattctgcggcggctcgatcgtgaacgagaaatggattgtgactgccgcccactgcgtggaaacgggtgttaagatcaccgtcgtggcgggcgaacacaacatcgaagaaaccgagcacactgaacaaaagaggaatgtgatccgcatcatcccccatcataactacaatgctgccatcaacaaatacaatcacgatatcgcactcctggaactcgatgaaccgctcgtgctgaactcgtatgtcactccgatctgtattgcagacaaggaatacactaatatctttctgaagttcggatcgggctacgtctcgggatggggacgggtgtttcataagggaagaagcgccctggtgctgcaatacctccgggtgccgttggtggatcgtgcgacttgcctcaggtcaaccaagtttaccatttacaacaacatgttctgcgcgggtttccatgagggagggcgcgactcatgccagggcgattcgggtggaccccacgtcaccgaagtcgaggggactagcttcctgaccggaatcatctcttggggagaagaatgcgccatgaagggaaagtacggcatttacactaaggtgtccagatatgtgaactggatcaaggagaaaacgaaacttact

SEQ ID NO: 8906 - DNA, 1383 bp, Artificial Sequence
  Description of Artificial Sequence: Synthetic coding sequence
atgcagcgcgtcaatatgatcatggctgaatcccccggcctgatcactatctgcctgctcggatacctgctgtctgccgagtgcactgtgttcctggaccacgagaacgcgaacaaaatcctgaatcggccaaagagatacaactcaggaaagttggaggagtttgtgcaggggaacttggaaagagaatgcatggaagagaagtgcagcttcgaggaggcacgcgaggtattcgagaacaccgaacgcactacggagttttggaagcaatacgtggacggcgaccagtgcgaatcaaacccgtgcctgaacggaggatcgtgcaaggacgacataaacagctacgaatgttggtgcccattcgggttcgaaggaaagaactgcgaactggatgtgacctgcaacattaagaacggtcgctgtgaacagttctgcaaaaacagcgcagataacaaggtcgtctgcagttgcactgaaggataccgcctggccgagaatcaaaagtcttgtgaaccggcggtgccttttccgtgcggccgggtgtcggtgtcccagacctcgaaacttacgcgggctgagactgtattccctgacgtggactacgtcaactcgacggaggcggaaactatcctcgacaatatcacccagtccacccaatcctttaatgatttcaccagggtggtgggaggagaggatgccaagccaggacagttcccatggcaagtcgtcctgaacggaaaagtggacgccttctgtggtggatcgatcgtgaacgaaaaatggatcgtgaccgcggcgcattgtgtggagacgggagtgaagatcactgtcgtggctggcgagcataacatcgaagaaaccgagcacactgaacaaaagcgcaatgtgatccgcatcatcccgcaccacaactacaatgccgcaataaacaagtataaccatgatatcgccctgcttgagctggacgagccactggtcctcaactcctacgtgactccgatctgcatcgcagacaaggagtacacgaatatctttctgaagttcggctcgggttacgtctcgggatggggtagagtctttcacaagggcagatcggccctggtgctccagtatctgcgcgtcccgcttgttgatcgggcgacctgcctcagatccaccaaattcaccatttacaacaacatgttctgcgctggatttcatgaaggaggaagggactcctgccaaggagactccggtggtccgcacgtgaccgaggtggagggcacttccttcctgaccggaatcatctcgtggggagaagagtgcgccatgaagggaaaatacggtatctacaccaaggtttccagatacgtgaactggattaaggaaaaaaccaaactgact

SEQ ID NO: 8907 - DNA, 1383 bp, Artificial Sequence
  Description of Artificial Sequence: Synthetic coding sequence
atgcaacgagttaatatgataatggcggaatcgccgggtttaataacgatatgtctattaggttatttactatcggcggaatgtacggtatttctagatcatgaaaatgcgaataaaatattaaatcgaccgaaacgttataattcgggtaaactagaagaatttgtacaaggtaatttagaacgtgaatgtatggaagaaaaatgttcgtttgaagaagcgcgtgaagtatttgaaaatacggaacgaacgacggaattttggaaacaatatgtagatggtgatcaatgtgaatcgaatccgtgtttaaatggtggttcgtgtaaagatgatataaattcgtatgaatgttggtgtccgtttggttttgaaggtaaaaattgtgaactagatgttacgtgtaatataaaaaatggtcgttgtgaacaattttgtaaaaattcggcggataataaagtagtttgttcgtgtacggaaggttatcgtctagcggaaaatcaaaaatcgtgtgaaccggcggttccgtttccgtgtggtcgtgtatcggtatcgcaaacgtcgaaattaacgcgtgcggaaacggtttttccggatgtagattatgttaattcgacggaagcggaaacgatactagataatataacgcaatcgacgcaatcgtttaatgattttacgcgtgttgtaggtggtgaagatgcgaaaccgggtcaatttccgtggcaagttgtactaaatggtaaagtagatgcgttttgtggtggttcgatagtaaatgaaaaatggatagttacggcggcgcattgtgttgaaacgggtgtaaaaataacggtagtagcgggtgaacataatatagaagaaacggaacatacggaacaaaaacgaaatgtaatacgaataataccgcatcataattataatgcggcgataaataaatataatcatgatatagcgttattagaattagatgaaccgttagttttaaattcgtatgtaacgccgatatgtatagcggataaagaatatacgaatatatttttaaaatttggttcgggttatgtatcgggttggggtcgagtttttcataaaggtcgttcggcgctagtattacaatatttacgagtaccgttagtagatcgtgcgacgtgtttacgttcgacgaaatttacgatatataataatatgttttgtgcgggttttcatgaaggtggtcgagattcgtgtcaaggtgattcgggtggtccgcatgtaacggaagtagaaggtacgtcgtttctaacgggtataatatcgtggggtgaagaatgtgcgatgaaaggtaaatatggtatatatacgaaagtatcgcgttatgtaaattggataaaagaaaaaacgaaattaacg

SEQ ID NO: 8908 - DNA, 1383 bp, Artificial Sequence
  Description of Artificial Sequence: Synthetic coding sequence
atgcagagggtgaatatgatcatggccgagtcccccggcttgatcactatctgtctgttgggatatctgctgtcagccgagtgtactgtgttccttgaccacgaaaacgccaacaagattctgaaccggcctaagcggtacaacagcggaaaactggaggaatttgtgcagggaaatctggaacgggagtgcatggaagaaaagtgctccttcgaggaggcccgggaagtgttcgaaaacactgagcggactacggaattctggaagcaatacgtggatggagatcaatgtgagtcaaatccgtgccttaatggcgggtcctgcaaggacgatatcaacagctatgagtgctggtgtcccttcggttttgagggcaaaaactgcgagcttgacgtgacctgcaacatcaaaaatggccgctgtgaacagttctgcaagaattcggccgacaacaaggtggtgtgctcatgcaccgagggatacagactcgcggagaatcaaaaatcttgcgaaccggccgtgccgttcccttgcggacgcgtgtcagtctcacagacctcgaagctcacgagagcagaaactgtgttcccggacgtcgattatgtgaattccactgaggcggaaaccattctggacaacattacccagtcgactcagagctttaatgatttcacccgggttgtgggaggagaagatgccaagccgggacaattcccatggcaggtcgtactgaacggcaaggtcgacgctttttgtggcggatcaatcgtgaacgaaaagtggatagtgaccgccgctcattgtgtggaaaccggcgtgaagatcactgtggtggcaggagagcacaatatcgaagaaacggagcataccgaacagaaacgcaatgtcatcagaatcatcccgcaccataactacaatgcagccatcaataagtacaatcacgatatcgccctgctcgaactggacgaaccgctcgtcctgaattcatacgtgactccaatctgcatcgccgacaaagaatacaccaatatcttcctgaaatttgggagcgggtacgtgtcgggatggggaagagtattccacaaggggaggtctgccctggtgctgcagtatctccgcgtcccccttgtggacagagctacctgccttcggtccacgaaattcaccatctacaacaacatgttttgcgcaggattccacgagggaggtagagactcgtgtcaaggagactccgggggtccccatgtgaccgaagtggaaggcacctccttcctcactggaatcatttcctggggcgaagaatgcgctatgaaggggaagtacgggatctacactaaggtgtcgcggtacgttaactggatcaaggagaaaacgaaactcact

SEQ ID NO: 8909 - DNA, 1383 bp, Artificial Sequence
  Description of Artificial Sequence: Synthetic coding sequence
atgcagcgcgtgaacatgatcatggcagagtcgccaggtttgatcactatctgcttgctcggatacttgctttcggccgaatgtactgtctttttggaccatgaaaacgcgaataagatcctgaaccgtccgaagcgctacaacagcggaaagctcgaggaattcgtccaaggcaatctggaacgggagtgcatggaggagaagtgtagcttcgaggaagcaagagaagtgtttgaaaacaccgaaagaaccactgaattttggaagcagtacgtggatggtgaccaatgcgaatcgaacccatgcctcaacggcggatcctgcaaagatgacattaactcctacgagtgttggtgccccttcggatttgaaggcaagaattgcgaactcgatgttacttgcaacattaagaatggacgctgcgagcagttctgtaagaattccgcggataacaaggtagtgtgtagctgcactgagggataccggctggccgaaaatcaaaaatcctgcgaacctgctgtgccgttcccctgcggtcgggtttctgtgtcccaaacttccaaactgaccagggccgagactgtgtttccggacgtggactatgtgaactcgactgaagccgaaaccatcctggacaatatcactcagtcgactcagtcgttcaatgacttcacgagggtcgtgggtggagaagacgctaagccaggacagttcccgtggcaggtggtgctgaacggtaaagtcgatgcattttgcggtggatcaatcgtgaacgaaaaatggatcgtcaccgcagcccactgcgtggagactggcgtgaaaatcacggtggttgccggagagcacaacatcgaagagactgaacacaccgagcagaaacggaacgtgatcagaatcatcccacaccataactataacgccgccatcaacaaatacaaccacgacattgccctgctcgagctggacgaaccgctggtgctgaatagttacgttactccgatctgcatcgcggacaaagagtacaccaatatctttctcaagttcggatcaggatacgtctccgggtgggggcgtgtgtttcataagggccggtccgcacttgtgctccagtaccttagggtcccgctggttgatcgggcaacgtgtttgagaagcactaagttcactatatacaataacatgttctgcgctggcttccatgaaggcggacgcgacagctgccagggagattcaggaggaccacacgtcaccgaggtcgaaggcacttccttcctcactggaattatctcctggggagaggagtgcgccatgaaaggaaaatacggaatctataccaaggtttccagatacgtgaactggattaaggagaagacgaagctgact

SEQ ID NO: 8910 - DNA, 1383 bp, Artificial Sequence
  Description of Artificial Sequence: Synthetic coding sequence
atgcagcgcgtgaacatgatcatggcggagtcccctggactgatcactatctgcctgctgggatacctgctgtccgcggagtgcaccgtgttccttgaccacgagaacgcgaacaagatcctgaaccgcccaaagagatacaactcgggtaaactggaagaattcgtccaggggaacctcgagagagagtgcatggaagaaaaatgctccttcgaggaggcccgggaagtgttcgaaaatactgaacggaccactgagttctggaaacaatacgtggacggggatcagtgcgagtccaacccttgcctgaacgggggatcgtgcaaggatgacatcaattcatacgaatgctggtgtccattcggtttcgaaggaaagaactgcgaattggatgtgacttgcaatatcaagaatgggcggtgcgaacagttctgcaagaactccgccgacaacaaggtcgtgtgctcctgcacggaaggctacaggctggccgaaaaccagaagagctgtgagccagcagtgccgttcccgtgcggtcgcgtctccgtgtcacagaccagcaaattgacgagagcggagactgtgttcccggacgtggattacgtgaattccactgaagccgaaaccatcctggacaacatcacccagtcaacgcaatcgttcaatgatttcaccagagtcgtcggtggggaagatgcaaagccgggacaattcccgtggcaagtggttctgaatggcaaggtggacgccttctgtggagggtctatcgtgaacgagaagtggatcgtcactgctgcacattgtgtggaaactggcgtgaagatcactgtcgtggcaggggaacacaacatcgaggaaactgagcacactgaacagaagcgaaatgtgattcgcattatcccgcatcacaactacaatgcagccatcaataagtacaatcacgacatcgcgctccttgaactcgacgagccactcgtgctcaactcctacgtcactcctatttgtatcgccgacaaagagtacacgaacatctttcttaagttcggatccggatacgtgtcaggctggggtcgggtgtttcacaagggacgaagcgctctggtgctgcaataccttagggtgcccctggtcgacagagcgacgtgccttcgaagcaccaagtttactatctacaacaatatgttctgtgcgggatttcatgagggcggacgggacagctgccagggagactcaggcggcccgcacgtgactgaggtggagggcacctcattcctgactggaattatctcttggggggaggagtgcgctatgaagggaaagtacggaatctacaccaaagtctcccgatacgtcaactggatcaaggaaaaaactaagctgacc

SEQ ID NO: 8911 - DNA, 1383 bp, Artificial Sequence
  Description of Artificial Sequence: Synthetic coding sequence
atgcaacgagtgaacatgataatggctgagagcccaggtctgattacgatttgcctgttgggctacctgctgtcagccgaatgtaccgtatttctcgatcacgagaacgcgaacaagatccttaatcggcccaagaggtataattctgggaagctggaggaatttgtccaggggaacctggagcgggagtgtatggaagagaagtgctcctttgaggaggcacgcgaggttttcgagaacaccgaaaggaccaccgaattctggaaacaatatgtagacggagatcagtgtgagtcaaacccatgcctgaatggagggagctgtaaggatgacatcaatagttacgaatgctggtgcccatttggatttgaggggaagaattgcgaattggacgtgacatgcaatattaagaatgggcgatgcgaacaattctgtaagaattcagctgataacaaagtggtctgttcctgcactgaaggctaccgcttggccgagaatcaaaagtcctgtgagcctgccgtgcctttcccctgtggacgggtgtctgtctcccagacttccaagctgactagagcggagaccgtgttccccgacgtggattacgtgaattctaccgaagcggaaaccattttggataacattacgcagtccactcaatcttttaacgactttactagagttgtggggggagaagatgcaaaacccggccaattcccttggcaagtggtcctgaacggcaaggtggacgccttctgcggcggatccatcgtgaatgagaaatggatagtgaccgctgcccattgcgtagaaaccggggtcaagatcaccgtggtggccggcgagcataacattgaagaaaccgagcacaccgagcagaagcggaatgtcatacggatcatcccacatcacaactacaatgcagccatcaacaagtataaccatgacatcgccctccttgagctggacgagccacttgtgctgaatagttatgtgacccctatctgtatcgccgataaggaatacacgaacattttcctcaagttcggttcaggatacgtgagcggttgggggcgcgtgtttcacaaaggaagaagcgcactggtgctgcagtatctgcgggtgccactggtggatagagctacttgccttagaagtaccaaattcaccatttacaacaacatgttctgtgctggcttccacgagggagggcgcgattcatgccagggggacagcggaggccctcatgtcacagaagttgaagggactagtttcttgaccggtatcattagctggggggaagaatgtgccatgaaaggcaagtacggtatctatactaaggtgagtcgctacgttaattggataaaggagaagactaagctgaca

SEQ ID NO: 8912 - DNA, 1383 bp, Artificial Sequence
  Description of Artificial Sequence: Synthetic coding sequence
atgcagcgtgtcaacatgatcatggcggagtctcccggactcatcacaatttgcctgctgggatacctgctgtctgccgagtgtactgtgttcttagaccatgaaaacgctaataagattctgaataggcctaagcgctacaattctgggaagttggaggaatttgtgcaaggaaaccttgagcgtgaatgcatggaagaaaaatgcagctttgaagaggcgagggaggtattcgagaacaccgagaggaccactgagttctggaagcaatacgttgatggagatcagtgtgagagtaatccttgtttgaacggcggtagttgcaaggatgacatcaatagttacgagtgttggtgtccttttggtttcgagggcaaaaactgcgagcttgatgtgacttgtaatattaaaaacggccgatgtgagcagttctgtaaaaactctgctgataataaagtggtgtgctcttgcaccgagggatatcgcttggctgagaaccagaaaagctgcgaaccagccgtcccctttccctgcggcagagtcagcgtctctcagaccagcaaactgacaagggctgagacagtgtttcccgatgtggattacgtcaactctaccgaggctgaaacgatactcgacaacataacccaatccacccagagcttcaacgatttcacccgagtggtgggaggagaagacgcaaagccaggacagtttccctggcaggtcgtcctcaatggaaaggttgacgcattttgcggcggatcaatcgtgaatgagaaatggatcgtcaccgctgcccactgtgtggagacgggagtgaagatcaccgttgtcgctggagagcacaacatcgaagagactgagcacactgaacagaagagaaacgttataaggataattccacaccataactacaacgcagccatcaataaatacaaccacgatatagcactcctggagctggatgaaccccttgtgcttaactcttacgtcaccccaatctgcatcgcagataaagagtacacaaatatctttctcaaatttggatcaggctacgtctctggctggggcagagtgttccacaaagggaggtctgctctggttctccagtatttaagggtgccccttgtggacagggccacttgcctccggtctacaaagttcacaatctataacaacatgttttgcgcaggattccatgaggggggcagagactcctgtcagggagattccggcggccctcatgtgaccgaagttgagggcactagttttctgactggcatcattagctggggagaggaatgcgctatgaaaggaaaatatgggatctacacaaaagtcagccgctacgtgaactggattaaggagaaaaccaaactgaca

SEQ ID NO: 8913 - DNA, 1383 bp, Artificial Sequence
  Description of Artificial Sequence: Synthetic coding sequence
atgcagcgcgttaatatgatcatggccgaatcaccaggactgatcactatatgcttactggggtacctgttgtcagctgagtgtactgtgttcctcgaccacgaaaatgcaaacaagatcctgaaccgccccaaaaggtataacagtggcaagctggaagaatttgtccaaggcaatctggaaagggagtgtatggaagagaagtgcagcttcgaagaggcccgggaggtctttgaaaataccgagagaaccacagaattttggaagcagtacgtggacggcgaccagtgcgagtccaatccctgtctcaacgggggttcctgtaaagatgacatcaatagctatgagtgttggtgtcctttcgggtttgaaggcaagaactgtgaactggacgtaacatgcaatatcaaaaatgggaggtgcgagcagttctgtaagaatagcgcagacaataaggtcgtgtgttcatgcaccgaaggttataggctcgccgagaatcagaagtcatgcgaacccgctgtgccatttccttgtgggagagtgtctgtttcacagacctccaaactgacccgtgcagagaccgtctttccggatgttgattatgtaaatagcacggaagcagagactatcctggataacattactcagagcactcagtccttcaatgatttcacccgggtggttggcggcgaggacgccaagccagggcaattcccttggcaggttgtcctcaatggaaaggtagatgccttctgtggcgggagcatcgtcaatgagaagtggatcgttactgctgcacactgcgtggaaacaggtgttaagatcacggtagtagctggggaacacaacattgaggaaaccgaacacacagagcagaaacgcaacgtgatccgaattattcctcaccacaattacaacgccgcaatcaacaaatataatcacgacatcgctctgctcgaactggacgaaccactggttcttaactcttatgtgacacctatctgcatcgccgacaaggagtatacgaacatatttttgaaattcggaagcggctatgtcagcggatggggacgcgtgttccataagggccggagtgcacttgtcctgcaatacctgagagtgccgttggtcgacagagccacttgtctgcggtccaccaagttcactatttataataacatgttttgtgcaggattccacgaaggtggacgggattcttgtcagggggacagcggtgggccccacgtcacagaggttgaaggcacttctttcctaactgggatcatcagttggggcgaagagtgtgctatgaaaggtaagtatgggatatatacgaaagtttcccggtacgtgaattggataaaggaaaagacaaagcttact

SEQ ID NO: 8914 - DNA, 1383 bp, Artificial Sequence
  Description of Artificial Sequence: Synthetic coding sequence
atgcagagagtcaacatgataatggcggaatcacctggcctcatcactatctgtctgctgggataccttctgtcggcggaatgcaccgtctttctcgatcatgagaatgcaaacaagatactgaataggccaaagcgctacaactccggaaaacttgaggagttcgtccaaggcaaccttgaaagggaatgtatggaagagaagtgcagctttgaagaggcgagagaggtgtttgaaaataccgagcgtactaccgaattctggaagcagtacgttgatggggaccagtgtgaatcgaacccttgtcttaatggaggatcatgcaaggatgacattaacagttatgagtgttggtgtcccttcggctttgaaggcaagaactgtgagcttgacgtgacttgcaacatcaagaatggtagatgtgaacagttctgtaagaattcggcagataacaaagtagtgtgtagctgtacggagggctatagactcgccgaaaaccaaaagtcatgtgaaccagccgtcccgttcccgtgtggtcgcgtgtccgtttcgcaaacctcgaagttgactagggcggagactgtctttcccgacgtggattacgtgaatagtaccgaagcagaaactattctcgacaacataacccaatcgactcagagcttcaacgattttacgcgtgtagtgggcggagaggatgctaagcctggacagtttccgtggcaggtcgtgttgaatggaaaagtggatgcattctgtggaggatcgatcgtgaacgaaaaatggatcgtgaccgcagcccattgtgtggaaaccggtgtcaagattacggtggtggccggggaacataacattgaagaaactgaacacacggagcaaaagcgcaacgtgattcggattatcccacaccataactacaatgcagccatcaataagtacaatcatgacattgcacttctggaacttgatgagccactggtgttgaattcttacgtgacgcctatttgcattgcagacaaggagtacactaacatctttctgaaatttggctcagggtatgtgtccggctggggccgagtctttcacaaaggaaggtcagcacttgtgttgcaatacctgcgggtaccactggtcgaccgtgccacttgcttgcggtccactaaattcaccatctacaacaacatgttttgcgctggattccacgaaggggggagagattcctgccaaggagattcaggtggacctcatgtgaccgaagtcgagggtaccagctttcttaccggtatcatttcctggggtgaagaatgcgcaatgaaaggaaaatacggtatatacaccaaggtgagcaggtacgtgaattggattaaggaaaaaactaaactcacc

SEQ ID NO: 8915 - DNA, 1383 bp, Artificial Sequence
  Description of Artificial Sequence: Synthetic coding sequence
atgcagcgggtcaatatgattatggccgagtcgccaggtctgatcactatctgcctgctgggatacctgctctccgcggaatgtaccgtctttctggatcacgaaaacgcaaataagatcctgaatcgccccaagagatataacagcgggaagctggaggagttcgtgcaaggcaatctggaaagggagtgcatggaagaaaagtgttcctttgaggaggcccgcgaagtgtttgaaaacactgaacgcaccaccgaattttggaagcagtacgtggacggtgatcagtgcgaatcgaatccgtgcctcaacgggggctcttgcaaggacgatatcaactcctacgagtgctggtgtccgttcggcttcgaggggaaaaactgcgaactcgatgtgacttgtaacatcaagaacggtagatgcgaacaattttgcaagaactcagcagataacaaggtggtctgcagctgcactgagggctacaggctggcggagaaccagaagtcatgtgaacctgcggtgcctttcccatgcggtcgggtgtccgtgtcccagacgtcaaagctgacccgagccgaaaccgtctttccggacgtggactacgtgaactcgacggaagccgaaaccatcctcgacaacatcactcaatcgactcagtcgtttaacgacttcacccgggtggttggaggagaagatgccaagccgggtcagtttccatggcaggtggtcttgaacgggaaggtagacgccttctgtggaggatccattgtcaatgaaaagtggatcgtcactgccgcccattgcgtggaaaccggagtgaaaatcaccgtcgtggccggagaacataacatcgaggaaactgaacacactgagcaaaaacgcaacgtgatccgcatcatcccccatcacaactacaacgcggcaatcaacaagtacaaccatgacatcgcattgctggaactggacgagccactggtcttgaactcctacgtcacgccgatctgcatcgcggacaaggaatatactaacatcttcctgaaattcggttccggatacgtgagcgggtggggaagagttttccataagggacggtcagccttggtgttgcagtacctgcgggtgcccctcgttgacagggccacctgtctgcgctccactaagtttaccatctacaacaacatgttttgcgccggttttcacgagggaggccgcgatagctgccagggcgacagcggcggaccgcacgtgactgaggttgaaggaacttcgttcctcactgggattatctcgtggggagaagagtgcgcgatgaaaggcaagtatggaatttacacgaaagtcagcagatacgttaactggatcaaggagaaaaccaagctgact

SEQ ID NO: 8916 - DNA, 1383 bp, Artificial Sequence
  Description of Artificial Sequence: Synthetic coding sequence
atgcagcgtgtcaatatgattatggcggagagtcctggtctcataacaatctgcctgctcggatatttgcttagcgccgagtgcacggtattcctggaccacgagaatgccaacaagattcttaataggccaaaacgttataatagtggaaagctcgaggagtttgttcaaggtaatctggaacgagaatgcatggaagagaaatgttctttcgaagaagcgagggaggtgtttgagaatacggagagaacaacggagttctggaagcaatacgtcgacggggatcaatgcgagtctaacccctgcttgaacggcgggtcttgcaaagatgatattaacagctatgaatgttggtgcccgttcggatttgaagggaagaattgtgaactcgacgtgacttgcaacataaagaacgggcggtgcgaacaattctgcaaaaattcagccgataacaaggtcgtttgttcctgtaccgagggctaccggcttgcagaaaaccagaaatcatgtgagccggccgtgccatttccgtgtgggcgtgtttccgtgtcgcagacttccaaactgactagggctgagaccgtattccccgacgtggactatgtgaacagtacagaagccgagacaatcctagataatatcactcaaagcacccagtcgttcaacgacttcactcgggttgtcggtggggaagacgctaagccagggcagtttccgtggcaggtggtcctcaacggcaaggtcgacgccttttgtggggggtccatcgtcaacgagaagtggatcgtaaccgccgcacattgtgtcgagacgggcgttaaaatcacggtcgtcgccggagagcataacattgaggagacagagcatacagagcaaaaacgaaatgtcatccgcatcatcccccatcacaattacaacgctgcaattaataagtacaaccacgatattgcactgcttgaattggacgaacctctggttctcaatagctatgttactcctatctgcatagcggacaaagaatacactaatatcttcctgaagttcggctccgggtatgtctccggttggggcagggtctttcataaggggcgatctgccttagttctgcagtatctgagggtcccactcgtggatagggcgacttgcttgagaagtacgaaattcactatttacaataatatgttttgtgcaggatttcatgagggcggacgtgatagctgccagggcgacagtggaggccctcacgtgaccgaagtcgagggcacaagcttccttactggcatcatctcctggggcgaagaatgtgctatgaaaggcaagtatggcatttataccaaggtctctcgatatgtgaactggataaaagaaaaaaccaagcttacc

SEQ ID NO: 8917 - DNA, 1383 bp, Artificial Sequence
  Description of Artificial Sequence: Synthetic coding sequence
atgcagcgcgtgaacatgattatggccgagtcccctggacttattaccatctgtctcctcgggtacctgctgtcggccgaatgcaccgtgttcctggatcatgaaaacgcaaacaaaattcttaaccgaccgaaaagatacaattcgggaaagttggaagaatttgtgcagggtaatcttgaacgggagtgcatggaggaaaaatgtagctttgaagaagcccgtgaagtgttcgagaatacggagcgcactaccgaattctggaaacaatacgtcgatggtgaccagtgcgaatccaacccatgtttgaatggagggtcgtgtaaggatgatatcaattcgtatgagtgttggtgccctttcggtttcgagggtaagaactgtgaacttgacgtgacctgcaacataaagaacggaagatgtgaacaattttgcaagaactccgcagataacaaagttgtgtgttcctgtaccgaaggatacagacttgctgagaatcaaaaaagctgcgagccggcagtcccttttccctgtggacgggtatccgtgtcgcagacgtctaaacttaccagggcggagactgtgtttcccgacgtggattacgtcaacagcactgaagcggaaaccatccttgacaacatcactcagtcgacgcaatcctttaacgactttaccagggtggtcggcggagaagatgccaagccgggacagttcccatggcaagtggttctcaacggaaaggtcgatgccttttgtggaggaagcattgttaacgagaagtggatagtgaccgcagcacattgtgtggagacgggtgtcaaaatcactgtcgtggcgggagaacataacattgaagaaaccgaacataccgaacaaaagagaaatgttattcgcattatcccacatcacaattacaacgcagcgatcaacaagtataatcatgatatcgcccttctggaacttgatgaacctctcgtgctgaactcctacgtcacgcccatctgcatcgcagataaagagtacactaacattttcttgaagttcggttcagggtacgtgtcaggctggggtcgcgtgtttcacaagggtcggtctgcacttgtgctgcagtatctccgcgtgcctctcgtggacagagcgacttgtcttaggtcgactaagttcactatttacaacaacatgttctgtgcagggtttcatgaaggaggtcgcgattcctgtcagggagattccggaggacctcacgtcactgaggtggaagggacctcgtttctgactgggatcattagctggggtgaagaatgtgcaatgaaaggaaagtacgggatttacactaaggtgtcgcgatacgtcaattggattaaagaaaagactaagctcact

SEQ ID NO: 8918 - DNA, 1383 bp, Artificial Sequence
  Description of Artificial Sequence: Synthetic coding sequence
atgcagagagtgaacatgattatggccgagtctccagggctaatcacaatttgtctcctggggtatctcctctcagccgagtgcactgtgtttcttgaccatgaaaacgccaataaaatcctgaacaggcccaaaaggtacaactcggggaaacttgaggaattcgtgcaggggaatctggaacgcgagtgtatggaggagaaatgctcttttgaggaggctagggaggtgttcgagaataccgagagaactactgagttttggaaacagtacgtggacggagatcaatgtgagtctaacccgtgcctgaatggaggcagctgcaaagatgacattaacagctatgaatgctggtgccccttcggattcgaaggcaagaactgtgagcttgatgtaacgtgtaatataaagaatggacggtgtgaacagttttgcaaaaacagtgcagacaataaagtcgtttgtagttgtactgaagggtatcgtttggccgagaaccagaagtcatgtgaacccgccgtccctttcccatgcggacgagtatcggtttcccagactagtaagttaacccgtgccgagactgtgtttccagacgttgactacgttaattcgacagaggcagaaaccattctcgataacattacccaatctacccagtcctttaatgactttacacgcgtggtgggcggtgaggacgccaaaccaggacaatttccctggcaggttgtgctcaacggaaaagtcgatgctttttgtgggggatctatcgtcaatgagaaatggattgttaccgcagcccattgtgtagaaaccggtgttaaaattaccgtggtggctggggagcataacattgaggagactgaacacacggagcagaagcggaatgtaatcaggatcataccccaccacaattacaatgcagcgattaataaatacaatcacgatattgcattactggagttagatgaaccactggtgcttaattcctatgtgactcctatttgcatagctgacaaggagtacaccaatatcttcctgaagttcgggtctggatacgtgagtgggtggggacgtgtgttccataagggacgttctgctctggtcctgcaatacctaagggtccccctggtggatagagccacttgcctgcgaagcaccaagtttacaatctataataatatgttctgcgcaggatttcacgaggggggcagggactcatgccagggcgattccggcgggccccatgtgaccgaggtcgagggcacttcctttctgaccggtatcatttcttggggggaagaatgcgcaatgaaaggaaagtacgggatctacactaaagtgagcaggtacgtcaattggataaaagaaaagacaaagcttaca

SEQ ID NO: 8919 - DNA, 1383 bp, Artificial Sequence
  Description of Artificial Sequence: Synthetic coding sequence
atgcagcgtgttaacatgataatggcggagtctcccggtttgattacaatctgcctgctcggctacctgctgtccgccgaatgtactgtgttcctggaccacgagaacgccaataagatcctaaaccggcccaagaggtacaacagtgggaagctggaagagttcgtgcagggcaatttggaacgcgagtgtatggaggagaagtgttctttcgaagaggctagagaggtgttcgagaacactgaaagaacaacagaattctggaagcagtatgttgatggtgatcagtgtgaatccaatccctgcttgaacggtgggtcttgtaaggacgacataaattcctacgagtgctggtgccccttcggttttgagggtaagaactgcgagttggacgttacgtgcaacatcaaaaacggccggtgcgagcagttctgcaagaatagcgccgataacaaagtggtgtgctcctgcaccgaggggtatcgactggcagaaaatcagaagtcttgcgagccggctgtgcccttcccctgcggtagggtgagtgtcagccagactagtaagctgaccagagccgagacggttttccctgacgtcgactatgtgaactccactgaagctgagaccattctggacaacataactcagtctacgcaatctttcaatgatttcaccagagtggttggaggcgaagacgccaaacccggacaattcccctggcaggtcgttcttaacggaaaggtggatgcgttttgcgggggctctatagtgaacgaaaaatggattgttaccgccgctcactgtgtggagactggagtcaagattacagtcgtggctggggaacacaatatcgaggagactgaacataccgagcaaaagcgaaacgtcatccggatcatccctcaccataattacaatgctgctattaataagtacaaccatgatattgccttgttggagcttgatgaacccttggtcttgaattcttacgtgacaccaatctgcattgccgacaaagagtataccaacattttcctgaagttcggtagcggctacgtgagcggctgggggagggtgttccacaaaggaagatcagctctggtgctccagtacctaagggtccctctggtagatagagcaacgtgcctccgaagcactaaatttaccatctacaataacatgttttgcgctggattccatgaggggggtcgggattcatgtcagggcgattcgggcggcccccacgtgacggaagtagaggggacgagcttcctgacaggaataatcagttggggagaagagtgcgccatgaaaggtaaatatggcatctacactaaggtcagtaggtatgtgaactggatcaaggagaaaaccaaactgacg

SEQ ID NO: 8920 - DNA, 1383 bp, Artificial Sequence
  Description of Artificial Sequence: Synthetic coding sequence
atgcaacgggtaaacatgatcatggctgaaagcccgggactcatcaccatctgcctccttggatacctcctgagcgctgaatgtaccgtgtttctcgatcatgaaaacgccaacaagatcttgaatcgccctaaaagatataacagtggaaagctcgaggaattcgtccagggaaacctcgaaagagaatgcatggaggaaaagtgcagcttcgaagaggcacgggaggtgtttgagaataccgagcgcactaccgagttctggaagcagtacgtggacggagatcaatgcgagtcgaatccgtgtctcaacggaggatcttgtaaggacgatatcaactcctacgaatgttggtgcccgttcggcttcgaggggaagaattgcgagctggacgtgacttgcaacataaagaatggccgctgcgagcagttctgcaagaattcggcggacaacaaggtcgtgtgttcttgcactgaaggctatcgcctggccgaaaatcaaaaatcatgcgagccggccgtgcctttcccatgtgggagggtgtcagtgtcgcagaccagcaagctcactcgggcggaaaccgtttttcctgacgtggattacgttaattcaaccgaggctgaaactatcctggataacataacccaatccactcaatcattcaacgatttcactcgcgtcgtggggggagaagatgcaaagcctggccaatttccgtggcaggttgtgcttaatgggaaggttgacgccttctgtggcggaagcattgtgaatgagaagtggatcgtgaccgcggcccactgcgtggaaactggtgtcaaaatcacggtggtggcgggagaacacaacatcgaggaaactgagcacactgaacagaagaggaacgtcattagaattatcccacatcacaattacaacgcggcaatcaataagtacaaccacgatatcgcactgctggagctcgacgagcccttggtgctgaacagctacgtgacccctatctgcattgccgacaaggagtacaccaacatcttccttaagttcggatccggatacgtgtctggatggggtcgggtctttcataaaggtcgctcagcattggtcctccagtacctgcgcgtcccgctggtggaccgggcaacttgcctgagatcaaccaagttcactatctacaataacatgttctgcgccggatttcacgagggagggagggactcgtgccagggagattcgggaggaccgcacgtgacggaagtagaggggacttccttcctgaccggtatcatcagctggggggaagagtgcgcaatgaagggaaaatacggtatctacacgaaagtctccagatacgtgaactggatcaaagaaaaaacgaaactgacc

SEQ ID NO: 8921 - DNA, 1383 bp, Artificial Sequence
  Description of Artificial Sequence: Synthetic coding sequence
atgcagcgcgtgaacatgattatggctgaaagcccggggctgatcaccatttgtctgctgggttatcttctctccgctgagtgtaccgtgttcctggaccatgaaaatgcgaataagatcttaaaccggcctaaacgctacaactcgggcaaactggaggagttcgtccaaggcaacctggagcgcgagtgtatggaggagaagtgttcctttgaggaagcccgcgaagtgtttgaaaacacggaacgcactacggagttttggaagcagtacgttgacggagaccagtgcgaatctaatccgtgtctgaacggtggtagctgtaaggatgacattaatagctatgagtgctggtgtccatttggtttcgaaggcaaaaattgcgagctggacgtcacctgcaatatcaagaacggccgatgcgaacaattttgtaaaaactcagcagacaacaaagtggtctgttcctgtactgaaggctaccgcttggccgaaaaccagaaatcttgcgagccggcggtgcccttcccatgcggcagggtcagcgtctctcagaccagcaagctaactagagccgaaacggtttttccggatgttgattacgtcaatagtacggaggccgaaacgattctggacaatattacgcagtcgacgcaaagctttaatgatttcacgcgcgttgtcggcggagaggatgctaagccaggccaatttccgtggcaggtcgttttgaacggtaaggtcgatgcattttgcggcggctccatcgtgaatgaaaagtggatagtgacggcggcacactgcgtggagactggtgtgaaaatcacagtcgtcgctggagaacacaatattgaagagacggaacacaccgaacagaagcggaatgtgattcgcattattccacaccacaattataatgcagccattaataaatataaccacgacattgctttgctggagctcgatgagcctctggtcttgaactcttacgtgacgccaatttgtatcgccgataaagagtacacaaacatcttcctcaagttcggctcgggctacgtcagcggctggggccgggttttccacaaaggccgcagcgccctggtcctacagtatctgcgtgttccgctcgtggatcgcgccacttgtttgcggagcacgaaatttaccatttataataacatgttttgcgcgggtttccatgagggcgggagggatagctgccagggcgactccgggggtccacacgttactgaggtggaaggcacaagcttcctcacgggtattatcagctggggtgaggaatgcgcgatgaaaggcaagtacggcatttatacgaaagttagccgctacgtaaattggattaaggagaagacgaaactcaca

SEQ ID NO: 8922 - DNA, 1383 bp, Artificial Sequence
  Description of Artificial Sequence: Synthetic coding sequence
atgcaacgggttaacatgatcatggcagaatcaccaggtttaatcaccatctgccttcttggttatttattgtctgccgaatgcactgtgttcctagatcatgaaaatgcaaataagatccttaataggcccaagcgttataactccgggaagctcgaggagttcgtccagggtaatttggaaagggaatgtatggaagaaaagtgctcattcgaagaggctcgtgaagttttcgaaaatacagagcgaacaactgaattctggaaacagtacgtggacggtgatcaatgcgaatcaaacccttgccttaacggtgggagctgtaaagacgatatcaattcctacgaatgttggtgcccttttggttttgagggaaaaaattgcgaactcgacgtgacttgtaatatcaaaaacggtagatgcgaacagttttgtaaaaactcagctgataataaggttgtctgtagttgtactgaaggatataggttggcggagaaccagaaaagttgcgaaccagccgttcccttcccatgcggtagagtttctgtgtcccaaactagtaagcttacaagggctgagaccgtctttccagatgtcgattacgtgaattccacagaggctgaaactattctcgacaatattactcaatcaacccagagtttcaatgatttcacgcgggtggttggaggcgaagatgctaaacctgggcagttcccttggcaagttgtactaaatggaaaggtcgacgctttttgcggaggatcaattgtgaatgagaagtggattgttactgctgctcactgcgtggagaccggtgttaaaatcaccgttgtcgctggcgaacataacattgaagagaccgagcacactgaacaaaagcgaaatgtgattcgaataattccacaccataactacaatgctgctattaataagtacaaccatgacatcgctcttttagagctagatgaacccttggtgttgaactcatatgttacgccaatctgcattgctgacaaagaatataccaacatctttttgaaatttggaagtggctatgtttcaggttggggtagggtgtttcataagggccgatccgctcttgttttacaataccttagggttcctcttgtcgatagagctacttgcctaaggagtacgaaattcaccatatacaataacatgttttgcgctggttttcatgaaggtggacgggacagctgtcaaggcgattcgggaggtccacatgttaccgaggttgaaggcacgtccttcttgacaggcatcatcagctggggagaagagtgcgccatgaagggaaaatatggtatctatactaaagtctctcgatacgtaaattggattaaggaaaagaccaaactgact

SEQ ID NO: 8923 - DNA, 1383 bp, Artificial Sequence
  Description of Artificial Sequence: Synthetic coding sequence
atgcagcgcgttaacatgatcatggctgaaagcccaggattaatcaccatttgcctgttaggctacctcctgagtgctgagtgcacagtcttcctggaccatgaaaacgccaacaagatattgaacagacctaagcgatacaattcggggaaactggaagagttcgtgcaaggcaatctggaacgtgagtgcatggaagagaagtgtagcttcgaagaggccagggaggtattcgaaaataccgaacggactactgagttctggaaacagtacgttgacggtgatcagtgtgaatccaatccatgcctgaatggtggcagttgcaaagacgatattaattcttacgaatgctggtgcccattcggtttcgaaggaaagaattgcgagctggatgtgacttgcaacatcaaaaacggccggtgtgaacaattttgtaaaaatagcgctgataacaaagtggtttgttcttgcacagaggggtaccgtctggccgagaaccaaaagagctgcgagccagccgtcccattcccatgtggcagggtttctgtgagccaaacatctaaactaacacgcgcggagacggtcttcccagatgtggactacgtcaatagtacagaggccgagaccatcctggacaatatcactcaatctacacaaagttttaacgatttcactagggtggtcgggggagaggacgccaaaccaggtcagttcccgtggcaagtggtcctgaatggaaaagtagatgctttttgcgggggaagcattgtgaacgaaaaatggatcgtgactgccgctcactgcgtagaaacgggcgtcaagataacagtggtggcaggagagcacaacatcgaggagaccgagcacaccgaacagaagcgtaacgtgatcaggatcattccacaccacaactataacgccgcaataaataaatataaccatgatatcgctctgctggagcttgatgagcccctcgtgcttaacagctacgtgacccctatttgcatcgctgacaaagagtacaccaatatcttcttgaagttcggatctggctatgtgtccggctggggccgcgtcttccataagggtcgcagcgctctggtcctgcagtacctccgagtgcctcttgtggaccgagccacatgcctccgttcaactaagtttactatctataacaatatgttctgtgcggggttccatgagggaggcagggattcatgtcaaggtgactcaggtggcccgcatgtgaccgaggtggaaggcacaagctttctgaccggaattatttcctggggcgaggagtgcgctatgaagggtaaatacggcatctataccaaagtctctaggtacgtgaattggatcaaggagaagacaaaactgacc

SEQ ID NO: 8924 - DNA, 1383 bp, Artificial Sequence
  Description of Artificial Sequence: Synthetic coding sequence
atgcagagggtgaacatgataatggcagaatcccctggtctgatcactatctgtctgctggggtatctgctgtccgctgagtgcaccgtgttcctagaccacgagaatgcaaataagatcttgaaccgcccaaaaaggtacaactctggcaagttggaggagttcgttcagggaaatttggaaagagaatgtatggaagagaagtgttccttcgaagaagctagggaggttttcgaaaataccgagcgcaccaccgagttttggaagcagtacgtagacggcgaccagtgtgaatccaacccctgcctgaacggcgggtcgtgtaaggacgatattaattcttacgagtgttggtgtcctttcgggttcgaaggaaagaattgtgagcttgacgttacctgcaatataaagaatgggcgttgtgagcagttttgcaagaatagcgcggacaacaaggtagtgtgtagttgtacagagggatacaggttagcagaaaaccagaagagctgcgagccagccgtgccatttccttgcgggcgggtatctgtcagtcagacttccaaactcacacgcgcagagactgtgtttcccgatgtcgactacgttaattccaccgaagccgaaacaatccttgacaacatcacccagtctactcaatctttcaatgactttaccagagtcgtaggtggcgaggatgcaaaacccgggcaattcccgtggcaagtggttctgaatggaaaggttgacgcattttgtggagggtcgattgtgaatgagaagtggattgtgacagctgcgcactgcgtagagactggtgtgaaaatcactgtcgtcgccggggagcacaacatcgaagagaccgagcacaccgaacaaaaacggaacgttatccggattattccccaccacaattataatgctgccatcaataagtacaaccatgacatcgcactgctggaactcgatgagcccctggtactgaatagctatgtcacaccaatttgcatcgcggacaaggagtacacgaatatcttccttaagttcggatcaggctatgtgtcgggctggggcagggtgttccataagggacgcagtgcattggtcctgcagtatctgcgtgtgccactcgtagatagggccacctgcttgaggagcactaaatttaccatatacaataacatgttttgcgcgggtttccacgaggggggaagagacagttgccagggagactcaggcggcccacacgtgacggaggttgaagggacaagttttcttacaggcataatttcatggggcgaagagtgcgctatgaaaggaaagtatgggatctacaccaaagtgtcgaggtacgtgaactggattaaggagaaaacaaaactcacc

SEQ ID NO: 8925 - DNA, 1383 bp, Artificial Sequence
  Description of Artificial Sequence: Synthetic coding sequence
atgcaacgagtgaacatgattatggcagagagccctgggctgatcactatctgtctcctgggttatctcctttccgcagagtgtaccgttttcttggaccacgaaaacgcgaacaagattcttaacaggcctaagcgatacaatagcggtaagctcgaggaatttgtccaaggcaacctggaacgcgagtgcatggaggagaaatgttcctttgaggaagcccgcgaagtgttcgaaaatactgaaaggactacggaattctggaaacaatacgtggacggcgatcagtgtgagtcgaatccctgccttaacggaggaagctgtaaagatgacataaactcgtatgaatgctggtgtcccttcggctttgaaggtaagaactgtgaacttgacgtcacctgtaacatcaagaacggtcgatgcgaacaattttgcaagaattcagcagacaataaggtcgtctgttcgtgtactgagggctaccggctggcagagaaccagaaatcatgcgaaccagcagtcccttttccgtgtggcagagtctccgtgtcccaaacctctaagttgacgcgggcagaaaccgtctttcctgacgtggattacgtcaattccaccgaagccgagactatccttgataacattacccagtcgactcaatcatttaacgatttcaccagagtggttggtggggaagatgcgaaaccaggacagtttccttggcaggtggttctgaacggtaaagtggatgccttctgcggaggctcgatcgtgaacgaaaagtggattgtgaccgcagcacactgtgtggaaactggggtcaaaatcaccgtcgtggctggagaacacaatattgaagaaactgagcacaccgagcagaagcgcaacgttattaggatcataccacatcacaattacaacgcggccattaacaagtacaaccacgatattgcacttctcgagcttgacgaaccgctggtgctgaattcctacgtgacgccaatatgcattgccgataaggaatacaccaacatatttctcaaatttggcagcggatatgtgtcgggctggggaagagtgttccataagggtcgaagcgctttggtgctgcaatatctgcgggtgccgcttgtggaccgcgcgacctgtttgcgctccaccaaattcacgatttacaataacatgttctgtgcaggatttcacgaaggtggacgcgattcgtgtcagggggactccggtggaccccatgtgacggaggtggaaggtactagcttcctgacggggatcatctcgtggggagaagaatgtgctatgaagggaaaatacggaatttacactaaggtgagcagatacgtgaattggataaaggaaaagaccaaacttact

SEQ ID NO: 8926 - DNA, 1383 bp, Artificial Sequence
  Description of Artificial Sequence: Synthetic coding sequence
atgcaaagggtgaacatgatcatggcagaaagcccaggtttgattactatttgtcttttgggctaccttctttctgcagaatgtactgtgttccttgatcatgaaaatgcaaacaagattcttaatagacctaaaaggtacaatagcgggaagttggaagaattcgtgcaaggtaatctggaaagggaatgtatggaagagaagtgctcgtttgaggaggcacgcgaagtctttgagaacactgaaagaactactgagttctggaagcagtacgtcgacggcgatcagtgtgaatccaacccttgtttgaatggaggttcctgcaaagacgacataaactcctatgagtgttggtgcccttttggatttgaagggaagaactgcgaacttgatgtgacttgcaacataaagaacggacgatgcgagcagttctgcaaaaacagcgctgacaacaaagtcgtctgctcatgcaccgaggggtaccgcctcgcagagaaccagaaatcgtgtgagcccgccgtgccattcccatgtgggcgggtgtcggtgtcgcaaacgtcgaaacttactcgcgcagaaaccgtgttccctgatgtcgattacgtgaactccactgaagcagaaaccattcttgacaacatcactcaaagcactcagtccttcaacgacttcacgagagtcgtgggcggcgaggatgccaagccgggacagtttccttggcaagtcgtgttgaacggtaaggtggacgcgttttgtggaggaagcatagtgaacgaaaaatggattgtgactgctgcacactgtgtggagactggcgtcaagattacggtggtggcaggagaacataacattgaggaaaccgaacatactgaacagaaacgtaatgtcatacgcataattccacaccataactacaacgcggcaattaacaagtacaaccatgatattgccctcctcgaacttgatgaaccccttgtcctgaactcgtacgttaccccaatttgtatcgcggataaagaatacaccaacatatttctgaagtttggatccggttatgtctccgggtggggacgggtctttcacaaaggtcgctcggcccttgtgctccaataccttagagtcccacttgtggatcgggcaacttgtctgaggagcactaaattcaccatttacaacaatatgttttgtgcaggatttcacgaagggggtcgcgattcctgccaaggtgattcaggaggaccccacgtgaccgaggtcgaaggaacttcctttctcactggtatcatttcctggggtgaagaatgcgccatgaagggtaagtacggtatctacaccaaggtcagccggtacgtgaattggattaaagaaaagaccaagctcacc

SEQ ID NO: 8927 - DNA, 1383 bp, Artificial Sequence
  Description of Artificial Sequence: Synthetic coding sequence
atgcagcgcgttaatatgattatggccgagtctcctggattgatcactatctgcctgctgggctacctgctctctgctgagtgcactgtttttctggatcacgaaaacgctaataagatcctgaatcgccctaagcgctacaatagcggcaaactggaggagttcgtccaaggcaacctcgaacgcgaatgcatggaagagaaatgctcctttgaagaagcgcgggaagttttcgagaacacggagaggaccaccgagttttggaaacagtacgttgatggcgaccagtgtgagtccaacccttgcttaaatggcggcagctgcaaggatgatatcaactcgtacgaatgctggtgtccgttcggcttcgaggggaagaactgtgagctcgacgtcacttgcaacatcaaaaacggccgatgcgagcagttctgtaaaaacagtgccgataacaaggtcgtgtgttcctgcaccgaaggttaccgtctcgcagagaaccagaagtcctgcgagcccgcagtcccgtttccctgtggtcgcgtcagtgtctctcagacctctaaactgacccgagcggagaccgtcttcccggacgtcgactatgttaactccaccgaggccgagacgatcctcgataacatcacccagagtacccagtcatttaacgacttcaccagagtcgtcggaggcgaggatgccaagcccggtcaattcccctggcaggtcgtgctgaacggtaaggttgatgcattctgtggtggtagtatcgtgaacgaaaagtggatcgtcacggcggctcattgtgtcgagacaggcgtcaagatcaccgtggttgccggcgagcacaatatagaggaaacggaacacacggagcagaagaggaatgtcattcgcattatcccacaccacaactacaacgccgccatcaataagtacaatcatgacatcgccctgctcgagctggacgaaccgcttgtgctgaactcatatgtcacccccatttgtatcgctgataaggagtatacaaatattttccttaagtttggctcaggttacgtctccggctggggtcgtgtcttccacaagggccgcagcgcactggtccttcagtacctacgcgtgcccctcgtcgatcgagcgacatgcctgaggagcacgaagtttacgatctacaacaacatgttttgtgctggattccacgaggggggacgcgatagttgtcagggagacagcggcggacctcacgtcactgaggtggagggtactagcttccttaccggaattatctcgtggggtgaggaatgcgccatgaagggtaagtacggaatttataccaaggtaagccggtacgtcaactggatcaaggaaaaaacaaagctaact

SEQ ID NO: 8928 - DNA, 1383 bp, Artificial Sequence
  Description of Artificial Sequence: Synthetic coding sequence
atgcagagggtgaacatgatcatggccgagagtccaggcctgattacaatctgcttactgggctatctcctctccgctgaatgtacagtgttcctggaccacgagaacgccaataaaatactgaaccgacccaaacgctacaactccggcaagcttgaggaattcgtgcagggcaatctggagcgagagtgtatggaagagaagtgctccttcgaagaggctcgtgaggtttttgaaaacactgagagaacaactgaattctggaaacaatacgtggacggggaccagtgcgagtctaacccctgtctgaacggcgggtcttgtaaggacgacattaattcctatgagtgctggtgtcctttcggctttgaaggcaaaaactgcgagctggacgtgacctgtaatataaagaacggcaggtgtgaacagttttgtaaaaatagtgctgataacaaggtggtctgttcttgcacagaggggtataggctggcagagaatcagaaaagctgcgagcctgcagtgcctttcccatgcggtcgagttagcgtctcccagacctccaaactgactcgggctgaaactgtgtttcctgatgtcgactatgtgaactccaccgaggccgagactattctcgacaatattacacaatccacacagagtttcaacgattttactcgagtggtgggcggcgaggatgccaagcccggccaattcccctggcaggtggttttaaatgggaaagttgacgcattttgtggtgggtcaattgtgaacgaaaagtggatagtcaccgcagcccattgcgtggagacaggcgtgaaaatcactgttgtcgcaggggaacataatattgaagagactgagcatactgagcaaaagcggaatgtgatacggatcattccccatcataactacaacgctgccataaacaagtacaaccatgacatcgcattactagagttagatgagcccctggttctgaacagttacgtgacccccatatgcatcgctgataaggaatatacaaacatctttctcaagtttggctctggctatgtttccggctggggcagagttttccataagggccgctccgcccttgtgcttcaatacctgcgcgtgcctctagtggatagggctacctgcctgcgctccactaagtttactatttacaacaatatgttctgtgctggattccacgagggcggccgggactcatgtcagggagactctggcgggccacatgtcacagaagtagaggggacctcttttctgaccggcatcatatcctggggcgaagaatgtgcaatgaaagggaagtatggcatctacactaaagtttcccggtatgtgaattggatcaaggagaaaactaagctcacc

SEQ ID NO: 8929 - DNA, 1383 bp, Artificial Sequence
  Description of Artificial Sequence: Synthetic coding sequence
atgcagagggttaatatgattatggcagagtcccctggccttataactatttgcctcttgggataccttctttcagcagagtgcactgtgtttctggaccatgagaacgcaaataagatcttaaataggcccaagcgttataactcgggaaaattggaagagttcgtacaaggcaacctggagcgagagtgcatggaggagaagtgctccttcgaggaagctagggaggtttttgaaaatactgaaagaacgactgagttctggaaacagtacgtggatggagatcaatgcgagtctaacccatgtttgaatggtggcagttgtaaggatgatataaatagctacgaatgctggtgtcccttcggcttcgaagggaagaactgtgagctggatgtcacgtgcaatattaagaatggccggtgcgagcagttctgtaaaaactccgccgataacaaagtggtgtgttcctgtaccgagggatacagactggccgagaaccagaagtcctgtgagcctgccgtcccctttccttgcgggagggtgtccgtttcccaaacaagtaaactcaccagggccgaaacagtcttccccgatgtggactacgttaactccacggaagcagaaaccatattagataatataacccaatcaacccaaagctttaacgactttacacgcgtggtcggaggcgaggatgcgaagccgggacaattcccttggcaggtggtgctgaatggaaaagtggatgcattctgcgggggatccattgttaacgaaaagtggattgtgacagccgcccactgtgtggagacaggcgtgaagatcactgtcgtggctggggagcacaacatagaagagacagaacacaccgagcaaaaacggaacgtcattcgcataattccacaccataactacaatgccgccattaataagtataatcacgacatagccctgttggaactagatgagccccttgtgctgaatagttatgttacacctatttgtatcgccgataaagaatataccaacatatttcttaaattcggcagcgggtacgtttccggatggggcagggtcttccacaagggacgcagtgccttggttctgcaatacctgcgagtacctctggtggaccgagcaacatgcctcagaagcactaagttcaccatttacaacaacatgttttgtgctgggttccacgaggggggccgagactcttgccagggggacagtggggggccacatgtgaccgaggttgagggcacatcattcctgacagggattattagctggggggaagagtgcgccatgaagggtaagtatgggatttatactaaggttagtcgttatgtgaattggataaaggagaaaaccaaacttacc

SEQ ID NO: 8930 - DNA, 1383 bp, Artificial Sequence
  Description of Artificial Sequence: Synthetic coding sequence
atgcaaagggtgaatatgattatggctgaatcacctggactgatcaccatttgtctcctcggttacctcctctccgcggaatgcaccgtctttctggatcacgagaatgccaataagatcctgaatcggccgaagagatacaattcagggaagctggaagaattcgtgcagggaaaccttgagcgggagtgtatggaggagaaatgctccttcgaggaggcgcgggaggtgttcgaaaataccgaacggaccactgagttctggaagcaatacgtcgacggggatcagtgcgaatcaaatccgtgcttgaatggcgggagctgtaaggatgatatcaatagctacgaatgctggtgcccgtttggattcgaaggaaagaactgtgagctggacgtgacttgtaacattaagaatggacgctgcgagcaattctgtaagaattccgccgacaacaaagtggtctgctcatgcaccgagggctaccggctcgcggaaaaccagaagtcatgcgagccagcagtgcctttcccttgtggccgcgtgtcggtgtcgcaaactagcaagttgactcgggcggaaaccgtgttcccagacgtggactacgtgaactcaaccgaagcagaaacgatcctggacaacatcactcagtcgacccagagctttaacgatttcacccgggtggtgggaggtgaggacgctaaaccgggacagtttccatggcaagtggtcctgaatggcaaggtggacgcgttctgcggaggatcgatcgtgaatgaaaagtggatcgtcaccgcggctcattgtgtggagactggagtgaaaatcaccgtggtggcgggcgaacacaacatcgaggaaaccgaacacactgaacagaaaagaaacgtgattcggatcatcccacaccacaactacaatgcagcaatcaataagtacaaccatgatatcgccctgctggagctggatgagcccctggttctgaactcgtacgtgacccctatttgcatcgccgataaggagtataccaatatctttctgaagttcggctcaggctacgtgtcgggatggggacgggtgttccataaaggccggtccgcacttgtcctgcagtacctccgcgtgccgttggtggaccgcgccacttgcctgctgagcaccaaattcactatctataacaacatgttctgcgcaggctttcacgaaggaggccgggacagctgccaaggagactccggtgggccgcacgtgacggaagtggagggcactagcttcctgactggcatcatctcgtggggggaggaatgcgcaatgaaaggcaagtacggaatctacaccaaggtgtccaggtacgtgaattggatcaaggaaaagaccaaactcact

SEQ ID NO: 8931 - DNA, 1383 bp, Artificial Sequence
  Description of Artificial Sequence: Synthetic coding sequence
atgcagcgggtgaacatgattatggccgagtctcctggtctaattacgatatgtctgctcggatatctgctctcggctgaatgcactgtgttcctcgaccacgagaacgctaacaagatcttaaatcgcccaaaacgttacaactccgggaagctagaggagttcgtgcaggggaacctggaaagagaatgtatggaggagaagtgctcctttgaagaggcacgcgaggtgttcgaaaatacagaaagaacgaccgaattctggaagcaatacgtcgacggagaccaatgtgaaagcaatccctgtctaaacggcggtagctgtaaggacgacattaactcttatgagtgttggtgcccttttgggtttgagggcaaaaattgcgagcttgacgtcacatgtaacatcaagaacgggcgctgtgaacagttctgcaaaaacagtgccgacaacaaagtagtttgttcctgtaccgaggggtaccgactcgctgagaatcagaagtcctgcgagcctgcggttcctttcccatgtggcagagtgtccgtttcccagactagtaagttgaccagggccgagacggtcttcccagacgtggactacgtcaacagcactgaggccgagaccatcttggacaatattacacagagcactcagtcgttcaacgactttactagggttgttggtggtgaggatgcaaaaccggggcaatttccatggcaggtggtccttaacggcaaagtggatgccttttgcggcgggagcattgtgaatgaaaagtggatagtcacggcagcccactgcgtggagactggagtgaagattactgtagtcgccggcgagcataatatcgaggagactgaacatacggaacagaaaaggaacgtgatcagaattattcctcatcataattacaacgccgccattaataagtataaccatgacattgcactgcttgaactcgatgagcccctagtgctcaacagctacgtgaccccgatttgcatcgccgataaggaatacacaaatatttttctcaagtttggtagtggctacgtctctggctgggggcgcgtgttccacaagggtcggtctgcgctcgtgctgcagtatttgcgcgtgccccttgtggaccgtgccacttgcttgctctctacaaagttcaccatttacaataatatgttctgtgccgggtttcatgaaggagggcgggattcttgccagggcgacagcggcggccctcacgtcaccgaagtagaaggcacaagctttctcaccggtataatttcgtggggcgaggagtgcgctatgaaggggaagtacgggatctacaccaaagtcagccgctatgtcaactggatcaaggagaagaccaagctcact

SEQ ID NO: 8932 - DNA, 1383 bp, Artificial Sequence
  Description of Artificial Sequence: Synthetic coding sequence
atgcaaagggtcaacatgatcatggccgaatccccaggactgattactatttgcctgctgggatacctcctgagcgccgagtgcaccgtgttcctggaccacgaaaacgccaacaagatcctcaaccgcccgaagcggtacaactcgggaaagctggaggaattcgtgcaaggaaatctggaaagagagtgcatggaagagaagtgctcgttcgaagaggcacgggaagtgttcgaaaacaccgaaagaaccaccgagttctggaaacaatacgtggatggcgatcagtgtgaatcaaacccctgcctgaatggtggctcgtgcaaagatgatatcaatagctacgaatgttggtgcccattcggatttgagggaaagaactgcgagttggatgtgacttgcaacatcaagaatggacgctgtgaacagttctgtaagaatagcgcagacaataaggtcgtctgctcctgtactgaaggctacagactggcagaaaatcagaagtcctgcgagccagccgtgccctttccgtgcggacgcgtgtccgtctcccagacttcaaagctgaccagggcggaaactgtgttcccagatgtggactacgtgaactctactgaagcggagactattctcgataacattactcagtcgactcagtccttcaacgactttactagggtcgtgggcggagaggacgctaagccaggacaattcccttggcaggtggtcctgaacggaaaagtggacgccttctgtggtggatcaatcgtcaacgagaaatggatcgtgaccgccgcccattgcgtcgaaaccggcgtgaagatcaccgtggtcgcaggcgaacataacatcgaagagactgaacacaccgaacagaagcgcaatgtcatccgcatcatcccgcatcataactataatgcagcgatcaataagtacaatcatgacattgcactcctcgagctggatgagcccttggtcctcaattcatacgtgaccccgatctgcatcgcggacaaagagtacaccaatatcttcctgaaatttgggtccggatacgtgagcggctggggtcgcgtgtttcataaaggcaggagcgccctcgtgctgcagtacctgcgggtgcctctggtggaccgagcaacgtgtcttttgtcaactaagtttactatctacaacaacatgttctgcgcgggcttccacgaaggcggacgggactcgtgtcagggagactcgggagggccgcatgtcaccgaggtggaaggtacctccttcctgactggtatcatcagctggggagaggaatgtgcgatgaagggaaagtacggaatctacaccaaggtttcgcgatacgtgaactggatcaaagagaaaactaagctgact

SEQ ID NO: 8933 - DNA, 1383 bp, Artificial Sequence
  Description of Artificial Sequence: Synthetic coding sequence
atgcagcgggtgaatatgatcatggccgaatcgccaggactgatcactatctgtctgctgggctacctcctgtcagctgagtgcaccgtgttccttgatcatgaaaatgcgaacaagatcctcaacaggcccaagcgatacaactctggcaagctggaagagttcgtccagggaaatttggaacgcgaatgcatggaggaaaaatgctcattcgaggaggcccgcgaggtgttcgagaatactgaaagaaccactgagttctggaaacaatacgtggatggggaccaatgtgaatccaatccgtgcctgaacggaggctcgtgtaaggacgacatcaattcttatgagtgctggtgcccattcggttttgaaggaaagaactgtgagctcgatgtcacctgtaacatcaagaatggaaggtgcgagcagttctgtaaaaactcggccgataacaaggtcgtctgttcatgcactgagggctaccgcctggccgagaaccagaagagctgcgaaccggccgtgccattcccgtgcggtcgcgtctcggtgtcgcagacttcgaagctcacccgggctgagactgtgttccccgacgtcgattacgttaattcaaccgaggcagaaaccatcctcgacaacatcactcagagcacccaatccttcaacgattttactcgggtcgtcggcggggaagatgctaaaccaggccagttcccttggcaggtcgtcctgaatgggaaggtggacgcgttctgcggaggatccatcgtgaacgaaaagtggattgtgaccgcggcgcactgtgtggaaacgggagtgaagatcactgtggtggctggggagcacaatatcgaagaaaccgaacacaccgagcaaaagagaaatgtcatcagaatcatcccgcaccacaattacaatgcagctatcaacaaatacaatcacgatatcgcattgctggagctcgatgagccgctggtgcttaacagctacgtgactccgatctgtatcgctgacaaggaatacaccaacattttcctgaagttcggttccggctacgtgtccggttggggccgcgtctttcacaagggacgctcagcactcgtgctgcagtatctgagagtccctctcgtggaccgagcgacctgccttctcagcaccaagttcactatctacaacaatatgttttgtgcaggattccatgaaggcgggcgggactcctgccaaggcgacagcggaggaccacacgtcaccgaggtcgaaggaaccagctttctgactggaatcatttcctggggcgaagagtgcgccatgaaaggaaaatacggaatttacactaaagtctcccgctacgtgaactggatcaaagaaaagacgaagctgacc

SEQ ID NO: 8934 - DNA, 1383 bp, Artificial Sequence
  Description of Artificial Sequence: Synthetic coding sequence
atgcagcgtgtgaacatgattatggccgagtcccccgggctgattacaatctgccttctggggtatctcctgtccgctgaatgcactgtttttctcgatcacgagaacgctaacaagattcttaaccgtcccaaacgttataatagcggcaagctcgaggagttcgtacagggtaacctcgaacgggagtgtatggaggagaagtgtagctttgaagaggcccgagaggtctttgagaacacagaacgcaccaccgagttctggaagcagtacgtggatggggaccagtgcgagtccaatccctgtctcaatggaggcagttgcaaggacgatataaactcatacgagtgctggtgccctttcggttttgagggcaagaattgtgaactggacgtcacctgtaacatcaagaatgggcgttgtgagcagttctgtaagaatagcgcagataacaaagtggtgtgtagttgcacagaagggtacagactagctgaaaatcagaaatcgtgtgaacctgcagtgccttttccttgcggccgggtatccgtttcccagaccagtaagttgactcgggcagaaactgtcttcccggacgtggattacgtgaacagtacagaggccgagactatccttgacaatatcacccagtcgacccagtcttttaacgatttcacgcgcgtggtcggcggcgaagatgccaagccaggccagttcccttggcaggtcgtgctgaacgggaaggtggacgccttttgtggagggtcgattgtcaacgaaaagtggattgtgactgcagctcattgtgtggagacaggtgtgaaaattacagtggtcgcaggcgaacacaatatcgaggagaccgagcacactgagcagaaacgaaacgttattcggattattccacatcataattataacgcggctatcaataaatacaaccatgacattgctcttctcgaacttgacgaacctctggtgctgaactcttacgtgactcccatttgcatcgcagacaaggaatatacaaacatattcctcaagttcggaagcgggtacgtctccggttggggcagggtatttcacaaggggaggtctgccctggtgttacaatacctccgagttccactggtcgatcgagccacatgcctactcagcaccaagtttacaatttacaataatatgttttgcgctggatttcacgagggtgggcgggattcttgtcaaggtgactcaggcggaccacacgtcacagaagtggaaggtacttctttcctgactggcatcatttcgtggggcgaggaatgcgccatgaaaggaaagtacggaatttatacaaaagtgagccgatacgttaactggataaaggaaaaaaccaagctcact

SEQ ID NO: 8935 - DNA, 1383 bp, Artificial Sequence
  Description of Artificial Sequence: Synthetic coding sequence
atgcagagggttaacatgattatggccgaatctcctggtctcataacaatttgcctcctcggatacctcctctcagcagagtgcaccgtctttctggaccacgaaaatgccaacaagatcctgaacagaccaaaaaggtacaacagcggtaaattggaagagtttgtgcagggaaatctggagagggagtgcatggaagaaaagtgttctttcgaggaggcacgggaggtctttgaaaacaccgagcgcacaactgagttctggaagcaatatgttgacggcgaccagtgtgaaagcaatccttgtctgaatggagggtcctgcaaggatgacattaactcttatgagtgctggtgtccatttgggtttgaggggaaaaattgcgagctcgatgtcacctgtaatatcaaaaacggcaggtgcgagcagttctgcaagaattctgcagataataaagtggtgtgctcctgcacggagggttaccggctcgcggaaaatcagaagagctgtgaaccggccgtgccattcccctgcggtagagttagcgtatcacaaaccagcaagctgaccagggccgagacagtcttcccagacgtggactacgtgaacagtactgaagctgagacgattctggataatattacccagagtacacagtccttcaatgacttcaccagagtggtaggcggcgaagatgcaaaaccaggacaattcccgtggcaggtcgtgctgaatggaaaagttgacgctttttgcgggggaagtatcgtcaatgagaagtggatcgtgacagctgcgcactgcgtggagactggggtaaagatcacagtggtcgctggcgagcataacattgaggaaaccgagcatactgagcagaagaggaacgttattcgaataatcccgcaccataactataacgccgccattaacaagtacaatcacgacatagcactgctggagctcgatgagcccctggttctgaatagttatgtgacacctatttgtatcgctgacaaagagtacacaaacatcttcttgaagtttggatctggttacgttagtgggtgggggcgagtgtttcataagggtagatctgcccttgtgctccaatatctgagggttccactggtggaccgggccacgtgcctgctgagcacaaaattcacgatctacaacaatatgttctgcgccgggttccacgagggtggccgggacagttgccagggtgatagcggagggccccatgtgacagaagtcgagggcaccagcttcctgacaggtattatctcttggggagaagaatgcgcgatgaagggcaagtacggtatatacactaaggtctccaggtatgttaattggattaaggagaaaactaagctgacg

SEQ ID NO: 8936 - DNA, 1383 bp, Artificial Sequence
  Description of Artificial Sequence: Synthetic coding sequence
atgcagagagtgaatatgatcatggccgaatcgccgggcctgattactatttgccttctgggatatctcctctcggcagagtgcactgtattcctggaccacgaaaacgccaacaagatcctcaatcgcccgaagcggtacaactcgggtaagctcgaagaatttgttcaaggtaatttggagagagaatgcatggaagagaagtgctcgtttgaagaggcgcgcgaggtgttcgagaatacggaacgtacgacggaattttggaaacagtacgtggatggagatcagtgcgagtcaaatccgtgccttaacggaggatcatgtaaagacgacatcaactcctacgagtgttggtgcccattcggatttgaaggcaagaactgcgagctcgacgtgacctgtaacatcaagaatggcagatgcgagcagttctgcaagaactcagccgataacaaggtggtgtgctcctgcactgagggatacaggctcgcggagaaccagaaaagctgtgagccagcagtccccttcccatgcggaagggtgtccgtctcacagacttcgaagctgacccgggccgaaaccgtgttccctgacgtggactacgtcaactctaccgaagctgaaactatcctggacaacatcactcagagtacgcagtctttcaacgactttaccagggtcgttggaggcgaggatgcgaagccgggccagttcccgtggcaggtcgtcctcaatggcaaagtggatgccttctgcggtggttcgatagtgaatgaaaaatggatcgtgaccgcggcgcattgcgtggaaaccggagtgaagatcactgtggtggcgggggaacacaacatcgaagagacggagcataccgagcagaagcgaaacgtgatccgcatcatcccacaccacaactacaacgctgcgatcaacaagtacaatcatgatatcgcactccttgaactggacgagccactggtcctcaactcgtacgtaactccgatctgtatcgcagacaaagaatacactaatatcttcctgaagtttggctcggggtacgttagcggctggggtcgtgtgttccacaagggccggtcagccctggtgctccagtacttgcgggtcccgctggtcgatcgggcaacctgtctgctgtccaccaaattcaccatttacaataacatgttctgcgccggctttcatgaagggggaagagactcgtgccagggtgactcaggtggccctcacgtcactgaagtcgaaggaactagctttttgaccggaatcatttcgtggggagaggagtgcgcaatgaaaggaaagtacgggatctacactaaggtgagccggtatgtgaattggattaaggagaaaactaaattgacc

SEQ ID NO: 8937 - DNA, 1383 bp, Artificial Sequence
  Description of Artificial Sequence: Synthetic coding sequence
atgcagcgggtgaacatgattatggccgaatccccggggctcatcactatttgcctcctgggatacctgttgtcagcagaatgcaccgtgtttctggatcatgaaaacgcaaataagattctgaacaggccaaaacggtacaactctggtaagctggaggaattcgttcaagggaacctggaacgggagtgtatggaagagaaatgctcgtttgaagaggcccgtgaggtgttcgagaacaccgaacgcaccaccgagttctggaaacaatatgtcgatggagatcagtgcgagtcgaatccgtgtctcaacggcggcagctgtaaggacgatatcaatagctacgagtgctggtgtccgttcggcttcgaggggaagaattgtgaactcgacgtcacctgcaatatcaagaacggacggtgcgaacagttctgcaagaactcggccgacaacaaggttgtgtgctcatgtactgagggatacaggttggcggaaaaccaaaagtcgtgtgaaccagctgtgccgttcccgtgcggacgcgtctcagtgagccagacctcgaagctcacgcgcgcggaaaccgtgttccctgacgtcgattatgtcaattccacggaagcagagactatcctggacaacatcacccagtcaactcagtcgtttaacgattttacgagggtggtgggaggcgaagatgctaagccaggtcaatttccctggcaagtcgtcttgaacggaaaagtagacgcattctgcggaggcagcatcgtgaatgaaaaatggatcgtgaccgccgcgcactgcgtggagactggagtgaaaatcactgtagttgcgggagaacataacatcgaagaaactgaacataccgaacaaaagcgtaacgtgattagaattatcccacaccacaattacaacgccgcgatcaacaagtataatcacgacatcgctctcctggagctcgacgaacccctggtgctcaactcgtacgtgaccccgatctgcatcgcagacaaggagtacacgaatatcttcttgaagttcggaagcggatacgtgtccgggtggggtcgcgtctttcacaagggacggtctgctctcgtgttgcagtacctgcgcgtgcctctggtggatagagccacttgtctcctgtccaccaaattcactatttacaacaatatgttctgcgcgggcttccacgaaggcggcagggactcctgtcagggagacagcggcggaccgcacgtgaccgaagtggaaggaacgtcctttctgactggcatcatctcatggggagaagaatgtgcgatgaagggaaagtacggaatctacacgaaggtgtcacggtatgtcaactggataaaggaaaagaccaagctcacg

SEQ ID NO: 8938 - DNA, 1383 bp, Artificial Sequence
  Description of Artificial Sequence: Synthetic coding sequence
atgcagcgagtgaacatgatcatggctgaatcaccgggccttatcactatatgtctcctgggataccttctgtcggcggaatgcactgtctttctggaccatgaaaatgccaacaaaattctgaatcgccctaagaggtacaactcaggaaaacttgaggaatttgtgcaaggaaatttggaacgggaatgtatggaggaaaagtgttcgttcgaggaagcaagagaggtgtttgagaataccgaaaggaccaccgaattttggaagcaatacgtcgatggagatcaatgtgaatcgaacccatgtcttaacggtggcagctgtaaagacgacataaactcctacgaatgttggtgcccattcggatttgaaggaaagaactgtgagcttgatgtcacctgcaacatcaaaaacggacgttgtgaacagttctgtaagaacagcgcagataacaaagtggtgtgttcctgtactgaaggttatcgtttggcagaaaaccaaaagtcatgtgaaccggcagtcccttttccttgtggccgcgtctcagtgagtcaaacgagcaagctgacccgcgccgaaaccgtgtttccggacgtcgattacgtcaattcgacggaagcagagacgattctggataacatcacccagagcacccagtcatttaacgattttacgcgcgtggtgggcggagaggatgctaagcctggacagttcccttggcaggtcgtcctgaatggcaaggtggacgcattttgtggcggatcgattgtcaacgaaaaatggatcgtgacggcagctcattgcgtcgaaaccggagtcaagatcactgttgtcgccggtgaacataacattgaagagactgagcacaccgaacagaagagaaatgtgattagaatcattcctcaccataactacaacgcagccattaacaaatacaatcacgacattgcacttcttgagctggatgagcccctcgtgctcaactcgtacgtgactccaatttgcatagcagataaggaatacaccaacatcttcctgaaatttggttccggatacgtgtcgggttggggacgggtgttccataaaggacgctccgccctggtcctgcagtaccttcgtgttccactggttgatagagcaacttgcctgctttcgacgaagttcactatatacaacaatatgttttgtgcagggtttcatgaaggaggcagagactcctgccaaggcgattcaggaggacctcatgttaccgaggtggagggtacttcattcctgaccggaatcatttcgtggggtgaggaatgcgcaatgaaaggaaagtacggaatttacactaaagtgtcccgctacgtgaattggattaaagagaaaaccaaacttact

SEQ ID NO: 8939 - DNA, 1383 bp, Artificial Sequence
  Description of Artificial Sequence: Synthetic coding sequence
atgcagcgagtgaatatgatcatggcggagtccccaggactgatcactatctgtctgttgggatacctgttatccgccgagtgtaccgtcttcctggaccacgagaacgccaataaaatactcaaccggccaaagcggtataattcggggaagctggaggagtttgtccagggcaatcttgagagagaatgtatggaggagaaatgctcgtttgaggaagctcgagaggttttcgagaatactgagcgtactactgaattttggaaacagtatgtcgatggcgatcagtgtgagtctaatccttgcttaaatggcggaagttgtaaagatgatatcaacagttatgaatgctggtgccccttcggctttgagggcaagaattgtgagctggacgtgacatgtaatataaaaaacgggcgatgcgaacagttttgcaaaaactctgctgacaacaaggttgtgtgttcctgtacagaggggtacagactggccgagaaccaaaagtcatgtgaacctgcggtgccatttccgtgcggacgggtctcggtttcacaaacaagtaagctgacaagagccgagaccgtgttcccagacgtcgattatgttaactccactgaagccgaaactatactggacaatatcactcagagcacacaaagcttcaatgactttactagggttgtgggaggagaggatgcaaaacctgggcagtttccctggcaggttgtgcttaatggtaaagtggacgctttctgcggtggaagtatcgtgaatgaaaaatggatcgtgacggctgcacactgtgtggagacgggtgtcaaaattaccgtggtggcgggagagcacaacatcgaggagacagagcataccgaacagaagaggaatgtcatccgtatcataccccaccacaactacaacgctgcgattaataaatacaaccatgacatcgctcttctcgagttggatgaacccctcgtgcttaatagctatgtcaccccaatatgcatcgccgacaaagagtacacgaacatcttcctaaagttcggttcagggtacgtctccggctgggggcgggtgttccataaaggtcggagtgccctagtgctgcagtatcttcgagttcctctggtcgatagagccacttgtttgctgtccacgaagtttactatttacaataacatgttttgcgctggtttccacgaggggggtagggactcctgccagggggacagcggcggacctcatgtgacagaggtggaaggcacgtcctttctgactggtataatatcttggggagaagaatgcgccatgaaggggaagtatggcatttacacgaaagtgtcccgctatgtgaactggattaaggaaaagactaagctgacc

SEQ ID NO: 8940 - DNA, 1383 bp, Artificial Sequence
  Description of Artificial Sequence: Synthetic coding sequence
atgcagcgggtcaacatgatcatggcagaaagtcctggacttatcacaatctgcctgctaggatacctactgtctgcagagtgcactgtgttcctggaccatgagaatgccaataaaatcttaaaccgcccaaaacggtacaattccggtaagcttgaggagttcgtccagggcaatctagaacgagaatgtatggaggagaagtgcagctttgaagaagctagagaggtatttgagaacaccgaacgtactacagagttctggaagcagtacgttgatggcgaccagtgtgaaagcaacccatgtctgaatggtggctcttgtaaagacgacattaactcctacgagtgttggtgtcctttcggtttcgagggcaaaaattgtgagctggacgtcacgtgcaatattaagaatggcagatgcgagcagttttgcaaaaacagtgccgacaacaaagtagtgtgtagctgcacagaagggtataggctggccgaaaaccagaaatcatgcgagccagctgtgccattcccatgcggtagagtttcggtgagtcagacctctaagttgacccgggctgagaccgtgttcccagatgtagactacgtgaactccacagaggcggaaaccatactcgataacattacccagagcacccagagcttcaacgacttcaccagagtagttggcggggaggacgcaaaacccggccagttcccctggcaggtcgtgctgaacgggaaggttgatgcattttgcgggggaagcattgtgaacgagaaatggatcgtcaccgccgcccactgcgtagaaacaggggtgaagattacggttgtggctggagagcataatattgaagagaccgagcacactgaacagaagaggaacgtgatcagaattatcccccaccataattacaacgctgcaataaacaagtataatcacgatattgcattgctcgagctggacgagcccttagtgttgaattcctatgtcactcctatttgtatagccgacaaggagtacacgaacatctttctgaaatttggctctggttacgtcagcggctggggccgggtgtttcacaaaggtcgaagcgcactagtattgcagtatctcagggtcccgctagtcgatcgggcaacatgcctcctcagcacgaagttcaccatctacaataatatgttttgtgcaggttttcatgaagggggcagggatagttgccaaggggactctggaggacctcatgtgaccgaggtggagggcacatcatttttaactggaatcatatcttggggcgaagaatgcgcaatgaaaggcaaatatggtatatataccaaagtctcgaggtacgtgaactggatcaaggagaagacaaagctcact

SEQ ID NO: 8941 - DNA, 1383 bp, Artificial Sequence
  Description of Artificial Sequence: Synthetic coding sequence
atgcagcgagtcaatatgatcatggccgagagccccggattgataaccatctgcctgctcggttacctgttgtcggctgagtgcacggtctttctggaccatgagaacgccaacaaaatcctgaatagacccaaacgttataactcgggaaagctcgaagaattcgtccaggggaacctcgaacgggagtgcatggaggagaagtgctcattcgaggaagcgagagaagtctttgaaaacaccgagcgcaccactgaattctggaagcagtacgtggatggggatcagtgcgaatcgaacccatgtttgaacggcgggagctgtaaagacgatatcaattcgtacgagtgctggtgtccgtttggatttgagggaaagaattgcgaactggatgtgacctgtaacatcaagaacggacgatgcgaacaattctgcaagaactctgcagacaataaggtcgtctgctcctgcactgagggatacagactggctgaaaatcaaaaaagctgtgaaccggctgtgccatttccgtgtgggcgcgtgtcagtgtcccaaacgtcaaaactgactagggccgaaaccgtctttccagacgtcgactacgtgaactccaccgaagctgaaaccattctggacaacatcactcagagcacgcagtcgttcaacgattttacccgggttgtgggcggggaggatgcaaagccaggacaattcccctggcaagtggtgctgaacggcaaggtggacgcattctgcggaggatccatcgtgaatgagaaatggatcgtgaccgccgctcactgtgtggaaaccggagtgaagattaccgtggtggccggggagcacaacatcgaggaaactgaacacaccgaacagaagagaaacgtgatccgtatcatccctcaccataactacaacgccgcaattaacaagtacaaccatgatatcgcgcttcttgagctggacgagcccctggtgctgaattcctatgttaccccgatctgcatcgccgataaagaatacactaatatcttcctgaaatttggctccggctacgtcagcggatgggggagagtttttcacaaaggaaggtcggcgcttgtgctgcagtacctgcgcgtcccgcttgtggaccgcgctacctgcctgctcagcacgaaattcaccatctacaacaatatgttttgcgccggatttcatgagggcggacgcgattcgtgtcagggagactccggcggtccgcacgtcactgaagtggagggaacctcattcctgaccggtatcatctcctggggggaagagtgtgctatgaagggcaagtacggcatctacactaaggtgtctcggtatgtgaattggatcaaggaaaagaccaagttgacg

SEQ ID NO: 8942 - DNA, 1383 bp, Artificial Sequence
  Description of Artificial Sequence: Synthetic coding sequence
atgcagcgagtgaacatgatcatggcagagagtccgggactgataactatttgcctgctcggttatctgctgtccgcggaatgtacggtgtttctggatcatgaaaacgccaacaaaattctcaacaggcctaagcgttataactcaggcaaattggaggagtttgtccaaggtaacctcgagagggagtgcatggaagagaaatgcagttttgaggaagctcgtgaggtttttgagaacaccgagaggaccactgaattttggaaacagtatgtcgatggggaccaatgtgagtcaaatccctgtctgaacggagggtcatgcaaagatgatatcaactcttacgagtgctggtgccccttcggatttgagggcaagaattgtgagctggacgtcacatgtaacattaaaaatggaaggtgtgagcagttctgtaagaacagtgccgacaacaaagtcgtgtgctcttgtactgaagggtaccgtctggctgaaaaccagaaatcttgcgaaccagccgtaccattcccctgcggtcgggtctcagttagccagacatcaaaattgacccgcgcagagactgtctttcccgatgtggattatgtgaacagcacggaggccgaaaccattctggacaacatcacgcagagcacccaaagttttaacgactttaccagggtcgtcggaggagaagacgcgaagccaggccagtttccatggcaggtagtgttaaacggaaaggtagacgccttttgcggcggctcgatcgtgaatgaaaaatggattgttactgcagctcactgtgttgagacaggcgtgaagattacagtcgttgccggcgagcacaatatcgaggaaaccgagcatacagagcaaaaacggaacgtgatccggatcatcccacatcacaactataacgccgcgataaacaagtacaatcatgacatcgctctgctggagctggacgaacctctggttctgaattcctatgtaaccccaatttgcatagccgataaggaatacactaacatctttctcaaatttggatctgggtacgtgtccggctggggcagggtctttcacaaaggaaggtccgctctggtgctgcagtatctcagggttccgctggtggaccgagctacgtgccttctgagtacgaaattcacaatatacaataatatgttttgtgctggctttcacgaagggggccgtgactcctgtcagggagattcaggtggacctcacgttacggaggtggaaggtacatctttcctcaccgggattatttcctggggcgaggagtgcgcaatgaagggcaagtatggtatttataccaaagtatccagatatgtgaattggatcaaggagaagactaagcttacc

SEQ ID NO: 8943 - DNA, 1383 bp, Artificial Sequence
  Description of Artificial Sequence: Synthetic coding sequence
atgcagagagtgaatatgataatggccgaaagccctggtctcatcacaatctgtcttctaggctatctcttatctgccgagtgcacagtctttctagatcatgagaatgcaaacaagatcctaaatcgacccaagaggtacaactcagggaagcttgaggagtttgtgcagggcaatctggagcgggagtgcatggaagagaaatgtagcttcgaggaagctagggaagtcttcgagaacacagagcgaacaaccgagttctggaagcaatacgtggatggcgatcagtgcgagtcaaatccatgtttgaatggggggtcctgtaaggacgacatcaattcctacgaatgctggtgtccatttggctttgaaggaaaaaattgcgaactggacgtcacttgtaacataaagaacggcaggtgtgaacaattttgcaagaattctgccgacaacaaagtcgtatgctcctgcactgaaggctataggctcgctgagaaccaaaagagctgcgagcccgcagtgccgttcccctgcggcagagtatccgtgagccagacttcgaaattgacacgggcagagaccgtctttccagatgtagattatgtaaactcaacagaagcagagaccatcttagataacataacacagagtacacagtcttttaatgacttcactcgcgttgttggaggcgaagacgctaagccaggacagtttccgtggcaagtagtactcaatggaaaggtggatgcattttgtggaggcagtatagtcaatgagaagtggatcgtcacagccgcccactgtgtcgaaactggcgtcaaaattactgttgtggccggcgaacacaatatcgaagagaccgaacatactgaacagaaacgcaatgtgatcagaatcattccacatcataattacaatgccgctatcaacaagtacaatcatgatatcgcgctcctggaactagacgaacccctggtgctcaacagttacgttacacctatctgcatcgccgacaaagagtatacaaatatctttctgaaatttggttcgggttacgtgtcggggtggggccgcgtgttccacaaaggtcgaagcgcgttggtcctacaatacttaagggtacccctggtcgaccgcgcaacttgtttgctctcaacaaagtttactatatataacaacatgttctgcgccggcttccatgaaggaggcagggattcttgccagggcgacagtggaggccctcacgtcacagaagtagaggggacgtcttttttgacaggtataatctcttggggagaggagtgcgcaatgaaaggaaagtatgggatttatactaaagtaagtcgctatgtcaattggatcaaggaaaaaaccaaactgacc

SEQ ID NO: 8944 - DNA, 1383 bp, Artificial Sequence
  Description of Artificial Sequence: Synthetic coding sequence
atgcaacgtgtcaacatgataatggcggaatctcctggccttatcacgatttgcctactcggatacctgctgagtgccgagtgcaccgtgtttctggatcacgaaaacgccaacaagatactgaatagaccaaagcggtacaactctggcaagcttgaggagttcgtacagggaaacctggagagggagtgcatggaagagaaatgtagtttcgaagaagcaagagaagtgtttgaaaacacagaaagaaccaccgagttctggaagcagtacgtcgatggcgatcagtgtgaatcgaacccttgtctcaacggtggatcttgtaaagacgacattaattcttacgaatgttggtgccccttcgggtttgaagggaaaaactgtgaactggatgttacatgcaacatcaagaacggccggtgcgagcagttctgcaagaactctgccgacaacaaggtggtctgcagctgcaccgagggctatagactggcagaaaaccagaaatcttgcgaaccggctgtgccatttccgtgtggaagggtgagcgtgagccagacctctaaactgacacgcgcggagaccgtgtttcctgatgttgactacgttaacagcaccgaagccgagacgattcttgataacattacacaatcaacacagtcattcaatgacttcacgagggtggtgggaggcgaggacgcgaaacccgggcagtttccgtggcaagtggtgctaaatggtaaagtggatgctttctgcggcggatctatcgtgaacgagaagtggatcgttacagcagctcattgcgtagaaacaggggtaaaaatcacagttgtcgcaggagaacacaacattgaggaaactgaacacacagagcagaaaaggaacgtaattaggattatcccacaccacaactacaacgcagcgatcaacaagtacaatcacgatatcgcccttctggagctggatgaacctttggtgctgaacagttacgtcaccccaatttgtatcgccgacaaagaatatacaaacatcttcctcaaattcggaagcggatatgtgagtggctggggaagggtgttccataaaggcaggagtgctctcgtgctgcagtatctgagggtccccctggtggatcgggctacatgcttgctcagcactaaattcaccatttacaacaatatgttctgcgcggggttccatgaaggcggacgagactcgtgtcaaggcgactccggtggaccacacgttaccgaggtggaggggacatcttttctgactgggattatttcctggggtgaagagtgtgctatgaaaggaaaatacggcatctacacgaaggtttcccgatatgtgaattggatcaaagagaaaaccaaattaaca

SEQ ID NO: 8945 - DNA, 1383 bp, Artificial Sequence
  Description of Artificial Sequence: Synthetic coding sequence
atgcaacgagttaacatgattatggccgaatccccgggattgatcaccatctgtctcctggggtacctgctgtcggcagaatgtaccgtgtttctggatcacgagaacgcaaacaagatcctgaaccgtccaaagaggtataacagcgggaagctggaagaattcgtgcaaggaaatctggagcgcgaatgcatggaagagaaatgttcattcgaagaggcaagggaggtgtttgagaatactgaacgtaccacggaattttggaagcaatacgttgacggtgaccaatgcgaatcgaacccatgtcttaatggtggaagctgcaaggatgacattaactcctacgaatgctggtgcccctttggttttgaaggaaaaaactgtgaactcgatgtgacctgcaacataaagaacggtaggtgcgagcagttttgtaagaattcagcggataacaaggtggtctgctcgtgtacggaaggatatcgcttggccgagaatcagaagtcctgtgaaccagcagtccctttcccatgtggtcgcgtgagcgtaagccagaccagcaagttgaccagggccgaaactgtctttccggatgtcgattacgtgaactcgactgaggctgaaactattctggataacatcacccagtccacgcaatcgtttaatgactttaccagagttgtgggaggagaagatgctaagccgggtcagttcccgtggcaggtggtccttaacgggaaggtcgatgcgttctgcggaggatccattgtcaatgaaaagtggatcgtcaccgctgcccattgcgtggaaaccggcgtgaagattactgtggtggcaggagagcataacatagaggaaaccgaacacactgagcagaagcgtaatgtgatcaggatcatacctcatcacaactacaatgccgcaattaacaagtacaaccatgacatcgccctcctcgagctggacgaacctcttgtcctcaattcttatgtgactcccatctgcatcgcagacaaagaatacactaacatattccttaagtttggctcggggtacgtgtcgggatggggacgcgtgtttcataagggacggtctgcactggtgctgcaatacctgagagtccctcttgtggaccgagctacttgtcttttgtcaactaagtttactatctacaacaatatgttttgcgcaggtttccacgaaggcgggcgtgatagctgtcaaggggattctggaggacctcatgtgactgaagtcgagggaacttctttccttactggcatcatttcgtggggcgaggagtgtgccatgaagggtaagtacggtatttacactaaagtgtcccgatacgtcaattggattaaagaaaaaacgaaacttacc

SEQ ID NO: 8946 - DNA, 1383 bp, Artificial Sequence
  Description of Artificial Sequence: Synthetic coding sequence
atgcagagggtcaatatgataatggcggagtcacccggattgattacaatctgtttactgggctacttgctgtcggccgaatgtactgtgtttttggaccacgagaacgcaaacaaaatcctgaacaggcctaaacggtacaattccggtaagctggaagaatttgtccaggggaacttagagagggagtgtatggaggagaagtgctcattcgaggaggcacgcgaggtcttcgaaaacaccgagaggaccacagagttttggaaacagtatgtggacggggaccagtgtgaatccaacccttgccttaacggcggtagttgtaaggatgatattaacagctacgagtgttggtgccctttcggtttcgagggcaaaaattgtgagctagatgtcacttgcaacatcaaaaacggtcgatgcgaacagttctgcaaaaattctgccgataacaaggtggtgtgttcttgcacagaagggtacagactcgcggagaaccaaaaaagttgtgaaccagccgttccttttccctgcgggcgcgtgtccgtttcacagaccagtaaattaacccgcgcagaaacggtgttccccgacgtggattatgtaaactctacagaagccgaaacgatcctggacaatataactcagtcaacccaaagctttaacgattttacacgggtggtgggcggagaagacgctaaaccaggtcagtttccctggcaggtggtcttgaatgggaaagtggacgccttctgtgggggatccatcgtgaatgagaagtggattgtcacggccgctcattgtgtggagacaggcgtgaagatcactgtcgtcgctggtgagcataacatcgaggaaacggaacacacggagcagaagagaaatgtaatccgcataatcccacatcataattacaacgccgctatcaacaaatataaccatgacattgccctgctggagctggatgagcccctcgtgctgaacagctacgtcacccctatctgcattgcggataaagagtataccaacatatttctcaaatttgggagcggttatgtctccggatgggggagagtgtttcataagggacgttccgccctagtactgcaatacttgcgcgttcccctggtggatcgagctacctgtttactgagtaccaagttcacgatttacaataatatgttctgcgccggattccacgaggggggaagagacagttgtcagggtgactctggtgggccccatgttacagaggttgaggggacaagcttcttgactggaatcatctcctggggcgaggaatgcgccatgaaaggcaaatacggtatctataccaaggtaagcaggtatgtaaattggattaaggagaagaccaaactgaca

SEQ ID NO: 8947 - DNA, 1383 bp, Artificial Sequence
  Description of Artificial Sequence: Synthetic coding sequence
atgcagagagtgaacatgatcatggcagaatcaccaggactcataacgatatgtttgcttggatacctgctctcggcggaatgcactgtctttcttgatcacgagaacgcaaataagatccttaaccgccctaaacggtacaactcaggcaagctggaagaattcgttcaaggcaacttggaacgtgagtgtatggaagagaagtgctcgttcgaagaggcacgcgaggtgtttgaaaacaccgagagaactacggaattctggaagcaatacgtcgacggtgatcaatgtgaaagtaacccctgcttgaacgggggatcatgcaaggatgacattaactcttacgaatgctggtgtccattcggctttgaaggaaagaactgtgagctggatgtgacttgtaatatcaagaacggtcggtgcgagcagttttgcaagaattctgcagacaacaaagtcgtctgttcatgtaccgaaggctaccggctggcagagaatcagaagtcgtgtgaacctgcagtgcccttcccatgcggccgcgtcagcgtgtcccagacttcgaaacttacccgggccgagacggtgtttcctgatgtggactatgtgaacagcaccgaagcagaaactattctcgacaatatcacgcaatccacccaatccttcaacgatttcactagagtggtgggtggtgaagatgccaaaccaggccagtttccttggcaagtggtgctgaacggaaaggtcgacgcattttgcggtggaagtattgtgaacgaaaagtggattgttaccgctgctcattgtgtggaaactggggtcaagattaccgtggtcgccggtgagcacaacattgaagaaaccgaacacactgagcaaaagaggaatgtgattcggatcattccacatcacaattacaacgccgccattaacaaatacaaccacgacatcgcgctgcttgaattggatgagcccctcgtccttaactcctacgtgactcctatctgtatcgcagacaaggaatacaccaatatcttcctcaagtttggttcaggatatgtcagcggatggggccgagtgtttcataagggtagatccgcactggtgctgcagtacctgagggtgccgcttgtggatagggcaacttgtctgctctcgactaagttcaccatttacaacaatatgttttgtgcgggtttccatgagggcggaagagattcgtgtcagggggattctggtggacctcatgtgaccgaggtggaaggaacctcctttttgactggtataatctcttggggagaagagtgtgccatgaagggaaaatacggaatctacacgaaggtcagtcggtacgtcaattggattaaagagaaaaccaaactcacg

SEQ ID NO: 8948 - DNA, 1383 bp, Artificial Sequence
  Description of Artificial Sequence: Synthetic coding sequence
atgcagagggttaacatgataatggccgagagtccaggcttgattaccatctgtcttctcggttatctcctgtccgcggagtgtactgtctttctcgatcatgagaatgccaataagatcctgaatagacctaagagatataactccggaaagttggaagagttcgtgcagggcaacctggagagagaatgcatggaggagaaatgctcctttgaagaggctagagaggtcttcgaaaataccgagagaaccacagaattctggaagcagtatgtcgatggcgaccagtgtgagtcaaacccgtgtcttaacggcgggtcatgcaaagatgatatcaattcctacgaatgttggtgtcctttcggcttcgaggggaaaaattgcgagctggacgtgacatgcaacattaaaaacgggagatgtgagcagttctgcaaaaactccgcagataataaagtggtgtgtagctgtactgagggatacagactagcagaaaatcaaaagagctgcgagcctgccgtgccctttccgtgcggaagagtgagcgtctctcagacctctaagctgaccagagccgaaaccgtgtttccggacgtagactacgtgaacagcacggaggccgagaccatccttgacaatatcacacagtccactcaatcattcaatgactttacgcgggtggttggcggagaggatgcaaagccagggcagttcccttggcaggtggttctaaatggcaaggtggatgctttttgtggaggtagcatagtgaatgagaagtggattgtgaccgcagcacactgtgtggagactggcgtgaagataaccgtggtggcgggggaacataatattgaggaaacggagcacactgaacagaagaggaatgtgattaggataattccacaccataactacaatgccgccattaacaagtataatcatgatatcgcccttctcgagctggatgagcctctggtgctaaattcatacgtcacacccatctgtattgcggacaaggagtacaccaacatctttctcaagtttggctcgggctatgttagtggatggggccgcgtgtttcacaagggtagaagtgctctggttctccagtatctacgggtcccgttggtggaccgggccacgtgcctgcttagtacaaagttcactatctacaataacatgttctgcgctggtttccacgagggaggaagggactcatgtcagggggacagcggtggccctcacgtcactgaggttgagggcaccagtttccttaccggcatcattagctggggtgaggagtgcgctatgaagggaaagtacggcatatacacaaaggtatcccggtacgttaactggatcaaagaaaaaacaaaattaaca

SEQ ID NO: 8949 - DNA, 1383 bp, Artificial Sequence
  Description of Artificial Sequence: Synthetic coding sequence
atgcagagggtgaacatgataatggccgaaagccctggactgatcactatctgcctgctcggatacctgttgtctgcagaatgcactgtgtttctggaccacgagaacgcgaacaagatcctgaaccggccaaaacgctacaattcaggcaagctggaagagttcgtgcaaggtaaccttgagcgggaatgcatggaagaaaaatgctcgttcgaagaagcgagggaggtgtttgagaatactgaacgcactaccgagttttggaaacagtatgtcgacggggaccagtgcgaatccaacccgtgcctgaatggcggatcgtgtaaagacgacattaactcctatgagtgttggtgcccatttggatttgaagggaaaaactgtgaattggatgtcacctgtaacatcaagaatggaagatgtgagcagttctgcaagaactcggcagacaacaaagtggtgtgctcctgcactgagggatatagactcgccgagaatcaaaaatcctgtgagcccgcggtcccgttcccctgcgggcgcgtgtccgtctcccagacttcaaagctgaccagagccgaaacggttttcccagacgtcgactacgtgaactccactgaggctgaaactatcttggataacatcacccaaagcacccagtccttcaacgacttcacgagagtggtcggtggagaggacgcgaagccgggccagtttccatggcaagtggtcctgaatggtaaggtcgacgccttctgcgggggatctatcgtgaatgaaaagtggattgtcaccgctgctcactgcgtcgagacgggagtcaaaatcacggtggttgcgggagagcacaatattgaagagactgagcacaccgaacaaaagcgcaacgtcattcggattattccgcaccataactacaacgctgccatcaataagtacaaccacgacattgccctgctggagctcgacgagccactggtgctgaattcgtatgtaaccccgatctgcatcgccgataaggaatacaccaatatcttcctcaagtttggaagcggctacgtgagcgggtggggaagggttttccacaagggacgctcagccctggtgttgcagtacctgagagtgccactggtggacagggctacctgcctgctgtcgactaagttcactatctacaacaacatgttctgcgccgggttccatgaaggaggaagagattcgtgccaaggtgacagcggaggaccacatgtgaccgaggtggaaggcacctcgttcctgacggggatcatctcttggggagaagaatgtgcgatgaaggggaaatacggcatttacaccaaagtgtcccgctacgtgaattggatcaaggaaaagactaagctgact

SEQ ID NO: 8950 - DNA, 1383 bp, Artificial Sequence
  Description of Artificial Sequence: Synthetic coding sequence
atgcagcgggtgaacatgatcatggctgagtccccaggactgattacaatttgtcttctggggtacctcttgtccgctgaatgcacagtgtttctagaccacgaaaatgctaacaaaatcttgaatcgcccgaaacgctacaacagtggaaagctcgaagagttcgttcaagggaatctggagagggagtgcatggaggagaagtgtagtttcgaggaggctcgggaagttttcgagaacacagagagaacgaccgagttctggaagcagtacgtcgatggcgaccagtgtgagagcaacccctgtctcaacggaggctcttgcaaggatgacattaatagttacgaatgctggtgtcctttcggtttcgagggaaagaactgcgagcttgacgttacttgtaatatcaagaacgggcggtgcgaacagttctgcaagaatagtgccgataacaaggtggtgtgcagttgtaccgaaggctacaggctggcagaaaatcaaaagagctgtgagcctgctgtaccttttccatgtggccgcgtgagtgtttcccagacaagtaaactgacacgggctgaaacagtcttccctgacgttgactacgtgaactccacagaagcggaaaccattctggataacataacacagtcgactcagagcttcaatgattttacacgtgtggtgggtggcgaggatgccaaacctggacagttcccttggcaggttgtgctgaatggtaaggtggacgccttctgcggcgggagtatagtgaacgagaagtggatcgttaccgccgctcactgtgtggaaacgggagtaaaaatcacggtggtggccggggaacataatatcgaggagactgagcacaccgaacagaagcggaacgttatccggattattccacaccacaattacaacgctgctattaataagtacaatcacgatatcgctttactcgaattagacgaacccttagttctgaacagttacgtgactcccatatgcatcgctgacaaggagtacaccaatatcttcctaaagttcggatctggctacgtgagtggttggggacgggtgttccataaaggaaggtctgccctggtgctgcagtacctgagggttcctctggtcgatcgggccacgtgcttgctgtccacgaagtttactatctacaataatatgttctgtgcaggctttcacgaaggaggccgagactcctgtcaaggtgactccggcggccctcacgtcacagaagtagaaggcaccagtttcttaaccggtatcatcagctggggggaggaatgtgccatgaaaggaaagtacggtatctacacaaaggtatcccgttacgtgaattggatcaaggagaagactaagcttact

SEQ ID NO: 8951 - DNA, 1383 bp, Artificial Sequence
  Description of Artificial Sequence: Synthetic coding sequence
atgcagcgagtgaacatgattatggctgaatctcccggcttaattacgatctgtttgctggggtatctactctcagcagagtgtacagtgtttctcgaccatgagaatgctaataaaatccttaataggcctaagaggtacaacagcggtaaactagaggagtttgttcagggtaacctcgagagggagtgtatggaagaaaagtgttctttcgaggaggcgagggaagttttcgaaaataccgaacgaacgaccgagttctggaaacaatacgttgacggagatcagtgtgaaagtaatccctgtcttaacggaggctcatgcaaagacgatataaattcatatgagtgctggtgtccatttggcttcgagggtaagaactgtgaattggacgtgacatgtaatatcaagaacggcagatgcgagcagttttgcaagaacagcgcagacaataaagttgtatgttcctgtaccgaggggtataggttggcagagaatcagaagtcctgtgagccagccgttcctttcccttgtggcagagtatccgtgtcacaaacttcaaagcttactagggcagagactgtattcccagacgtcgattacgttaattccacggaagcagaaacaatactggacaatatcacccaaagcacacagtcttttaacgactttactcgagttgttggcggtgaagacgctaaacccggccaatttccttggcaggtggtcttgaacgggaaggtcgacgccttttgtggcggatctattgttaatgagaagtggattgtgactgccgcccactgtgtggaaactggagtaaaaatcacagttgttgcgggagagcataacatagaggaaactgagcatacagagcaaaagcggaacgttatcaggataatacctcaccacaattacaatgcagcgatcaacaagtataatcatgatattgctctccttgagctggacgagcctttggtgcttaattcttatgtcacaccaatttgcatagccgataaggagtacacaaacatttttctcaagtttgggagcgggtatgtgagtggttgggggagagttttccacaaaggtagatctgctctggtccttcaatatttgagggtaccactcgttgacagagctacctgcctcctttcaaccaagttcactatctataacaacatgttttgtgctgggttccatgagggaggacgagatagttgccagggagatagcggaggtccacatgtgactgaggtggaggggacatcttttctgacaggtatcatctcttggggtgaagaatgcgcaatgaagggaaagtacggtatttatacgaaggttagccgatatgtcaattggataaaggagaaaacgaagcttacc

SEQ ID NO: 8952 - DNA, 1383 bp, Artificial Sequence; identical to SEQ ID NO: 8931
  Description of Artificial Sequence: Synthetic coding sequence

SEQ ID NO: 8953 - DNA, 1383 bp, Artificial Sequence
  Description of Artificial Sequence: Synthetic coding sequence
atgcagcgcgttaacatgattatggcggaatcgccaggcctgattaccatttgtctcctgggttaccttctttccgcagagtgtactgtgttcctggatcacgagaacgctaacaaaatcctgaaccggcctaaaagatacaactcggggaaacttgaagaatttgtgcagggcaaccttgagcgagaatgtatggaggaaaagtgcagcttcgaagaggcaagagaagtgttcgagaataccgaaagaactactgaattttggaaacaatacgtggatggtgatcaatgcgagtcgaacccctgtctcaacggagggtcgtgtaaggatgatatcaattcctacgaatgctggtgtccttttggctttgaaggaaaaaactgcgaactggacgtcacttgcaacattaagaatggacgttgtgaacagttctgtaagaatagcgcggacaataaagtggtttgttcctgtactgaaggataccgccttgcggagaatcaaaagagctgtgagccagcagtcccatttccttgcgggcgggtgtcagtctctcaaacgagcaagctgactcgcgccgaaaccgtctttccagatgtggattacgtgaactccaccgaggcggaaaccattttggataacataactcaatcaactcaatcctttaatgactttactcgcgtggtgggaggggaggatgcaaagcccggacaattcccttggcaggtcgtgcttaatggaaaagtggatgctttttgtggtgggtctattgtcaacgaaaagtggatcgtgaccgcagcacactgtgtcgagactggcgtgaagattaccgtcgtggcaggtgaacacaatattgaagaaaccgaacataccgaacagaagaggaacgtgatcagaatcatcccccaccataactacaatgcagcgattaacaagtacaatcatgacattgcacttctggaacttgatgagcccctcgtccttaacagctacgtgactccaatctgcatagctgacaaggagtacaccaacatttttcttaagttcgggtcaggatacgtcagcgggtggggaagagtgttccataaggggcggtcagcacttgtcctgcaatacttgcgggtgccactggtggatcgcgctacgtgtctcctttcgaccaaattcacgatttacaacaacatgttttgtgcgggctttcatgaaggaggtagagactcgtgtcagggtgacagcggagggccacacgtgactgaagtggaagggacctcgtttctgaccggaattatctcatggggtgaggaatgtgccatgaagggaaagtacggtatttacaccaaggtgtcaaggtacgtgaactggatcaaagagaaaactaagctgacc

SEQ ID NO: 8954 - DNA, 1383 bp, Artificial Sequence
  Description of Artificial Sequence: Synthetic coding sequence
atgcagcgggtcaacatgatcatggctgaatcacccggcttaattacaatctgcctcttaggctatctcctctccgctgaatgcaccgtcttcctggatcacgagaatgcaaacaagatcttgaaccgcccgaagagatataactcaggaaaactggaggagtttgtgcaagggaacctggagcgagagtgcatggaggaaaagtgcagctttgaggaagccagagaggtgtttgagaataccgaacgtaccaccgagttttggaagcaatatgtggatggcgaccaatgcgagtccaacccctgcttgaatggcggttcctgcaaggacgatattaattcttacgagtgttggtgtcccttcgggttcgaggggaagaattgtgaattggatgtcacttgtaatatcaagaacggtcggtgtgaacagttctgcaaaaatagcgccgacaataaggtggtgtgctcctgtacagaaggatatcggctggccgaaaaccagaaaagctgcgaaccagcggtgccgttcccatgcggcagagtgagcgttagtcagacgagcaagctgaccagggccgagacggtattcccagacgttgattatgtgaactccactgaggccgagacaatactcgacaatattacccagtctacgcagtccttcaacgattttacgagagtcgtggggggtgaagatgcgaagccagggcagtttccatggcaggttgtcttgaacggaaaagtggacgccttctgcggtggcagcattgtcaacgaaaagtggatagtgaccgcagcacactgcgtagagacgggagtgaaaatcaccgtcgtggcgggtgagcacaatatagaagaaaccgaacatacagaacagaagcgcaatgtgatcaggattattccgcaccataattataatgccgccatcaacaaatacaaccatgacattgccctcttggagctggacgagccactggttctgaacagttatgtgacccccatatgcattgccgataaggaatatacaaacatttttctgaagtttgggtccggctacgtttccggctgggggcgcgtgtttcacaaggggcgatctgctctggttctgcagtatctgcgagtaccactcgtggacagagccacatgtcttctgagtaccaagtttacaatctataacaacatgttctgtgctgggttccatgaaggcggtcgggactcatgtcaaggtgacagtggcggtccacacgtgacagaggtggaaggtacctctttcctgactgggattatttcctggggtgaagagtgtgccatgaagggtaaatacgggatatacacaaaggtctcccggtatgtgaattggattaaagagaagaccaaactcacc

SEQ ID NO: 8955 - DNA, 1383 bp, Artificial Sequence
  Description of Artificial Sequence: Synthetic coding sequence
atgcagcgtgtgaatatgattatggcggagagtcccggtctgatcaccatctgtctgctgggctatttgctgagcgcagagtgtactgtcttccttgaccacgaaaacgctaacaaaattttaaaccggccaaaaaggtacaatagcggtaaactggaggagtttgttcaaggcaatctggagcgagagtgtatggaagaaaaatgctccttcgaggaagcaagggaagtgttcgaaaatactgagcgcaccacggagttttggaaacagtatgtagacggagatcaatgtgagagcaacccgtgtctgaacggtggcagctgcaaggacgacatcaatagctacgagtgctggtgcccgttcggtttcgaaggtaagaattgtgagttggacgtcacctgtaacattaaaaacggtaggtgtgaacagttctgtaaaaactctgcggataacaaagtggtgtgttcctgcactgagggttaccgcctggcagagaatcagaaaagctgcgaacctgctgttccgttcccgtgcggccgtgtaagcgtgtcgcaaaccagcaaacttactcgggccgagacagtgtttcctgatgtggactacgtgaacagcaccgaagccgagaccattttggacaacatcacgcaatctacccagagcttcaacgactttaccagggttgttggaggagaagacgctaaaccgggccaattcccgtggcaggtcgttctgaacggcaaggtggatgccttctgcggcggcagcatcgtgaacgagaaatggatcgttaccgcagctcactgcgtggaaaccggtgtgaagatcactgtagttgctggtgaacataacattgaggagacagagcacactgaacagaaacgcaacgtcatacgcattatcccgcaccacaactacaacgcagccattaacaagtataaccacgacatcgctctgctggaactcgatgaacccctggtgcttaactcttacgtaacccccatctgtatcgctgataaggaatatacaaatatattcttgaagttcggttccgggtatgtgtcgggttggggccgcgtgttccacaaggggcgttctgcactggttctgcagtatctgagggtgccactcgttgaccgcgctacctgtctgctgtctaccaaattcactatttacaataatatgttctgtgcaggtttccacgaaggcggacgagattcgtgtcagggtgacagcggcggccctcacgtgaccgaggtggaaggcaccagcttcctgacgggtattatttcatggggtgaggaatgtgctatgaagggtaaatacggaatttataccaaagtgagcaggtacgttaactggatcaaagaaaagactaaattaacc

SEQ ID NO: 8956 - DNA, 1383 bp, Artificial Sequence
  Description of Artificial Sequence: Synthetic coding sequence
atgcaacgcgttaacatgatcatggctgagtcgcccggtttgatcactatttgtcttttgggatacctgctgtccgccgaatgcactgtgttcctggatcacgagaacgcaaacaagatcctgaataggccaaagaggtacaattccggaaaactcgaggagtttgtgcaaggaaatttggagcgcgaatgcatggaggaaaaatgctcattcgaagaagcgagagaggtgttcgagaacactgagaggaccacggaattctggaagcagtacgtggacggcgatcagtgcgagagcaacccgtgccttaacggaggatcgtgcaaggatgatatcaacagctatgaatgttggtgcccgttcggattcgagggaaagaactgcgaactggacgtgacctgcaacataaagaacgggcggtgtgaacaattctgcaagaattccgctgacaacaaggtggtgtgctcctgcaccgaaggataccggctggcggaaaatcaaaagtcgtgcgagccggcagttcctttcccatgcggccgcgtgtcagtctcgcaaacctcaaaactgactcgcgccgaaaccgtgtttccggacgtggactacgtgaatagcaccgaagccgaaactatcctggacaatatcacccagtccactcagtcctttaacgactttactcgcgtggtgggaggtgaggacgccaaacccgggcagttcccttggcaggtggtgttgaatggaaaagttgacgcattctgtggcggaagcatcgtcaacgaaaagtggatcgtgaccgcagcgcattgcgtagagacgggagtgaagatcaccgtggtcgccggggaacacaacatcgaagagactgagcacacggagcagaaaagaaacgtgattcgcattatccctcatcacaactacaacgccgccattaacaagtacaatcacgacatagccctcctcgaacttgacgaacctctggtcctgaacagctacgtgactccaatttgcattgccgacaaggagtacactaacattttcctgaagtttggtagtggctacgtgtcgggctggggtcgggtgtttcataagggcaggagcgccctggtgctgcagtaccttcgcgtgccccttgtggatagagcaacctgtctcctctcgaccaagtttaccatctacaataacatgttctgcgctggatttcacgaaggaggacgcgactcttgtcagggagactcgggaggcccacatgttactgaagtggaaggcacctcctttctgaccgggatcatcagctggggtgaagagtgtgcgatgaaggggaagtatggcatatacaccaaagtgtcccggtacgtcaactggatcaaagaaaagaccaagctgacc

SEQ ID NO: 8957 - DNA, 1383 bp, Artificial Sequence
  Description of Artificial Sequence: Synthetic coding sequence
atgcagagagtcaacatgattatggcagagtcgcctggcctgatcaccatttgtctgctgggttacttgctgtccgcggaatgtacggttttcctggatcatgaaaacgccaacaagatcctgaaccgccctaaacgatacaactccggaaaactggaagaattcgttcagggcaacctggagagagaatgtatggaagaaaagtgtagcttcgaggaagcgagagaagtgtttgaaaatactgaaagaactactgagttttggaagcaatacgtcgatggcgaccagtgtgaatcgaatccatgtcttaatggcggaagctgtaaggacgacataaactcttacgagtgttggtgtccatttgggtttgaaggtaagaactgtgagctggacgtgacctgtaacattaagaacggtaggtgtgaacaattttgcaagaattccgcagataacaaagtcgtgtgttcgtgcaccgagggatacagacttgctgaaaaccagaagtcgtgtgagccggctgtgccttttccgtgtgggagagtctcggtgagccaaacctcaaagctgactcgtgccgaaacggtgtttcccgacgtggactacgtgaactcgactgaagcggagactattcttgataacatcacccaatcgactcaatcattcaacgactttacccgcgtggtggggggagaggacgcaaagccaggacaatttccttggcaggtggtccttaacggcaaggtggatgcgttttgtggaggatcgattgtgaacgagaagtggattgtcaccgcggcgcactgcgttgaaaccggcgtgaagattactgtagtggcaggtgagcataacatcgaagaaaccgaacatactgaacaaaaaagaaacgtgatccgaattatcccacatcacaattacaatgccgcaatcaataagtataatcacgatattgcacttcttgaactggatgaaccccttgtgctgaattcctacgtgaccccgatctgtatagccgataaagaatataccaacatttttctcaagtttggttctggatacgtctccggctggggtcgtgtgtttcataaaggtcggtcagcactggtcctgcagtacctccgggtccccctggtggacagagctacttgtctcctgtcgacgaagtttactatatacaacaatatgttctgcgcaggctttcatgagggaggacgcgattcatgtcagggcgatagcggagggccacatgtcactgaggtcgagggtacgtcgtttcttaccgggattatctcttggggagaggaatgtgctatgaagggcaagtatgggatctacaccaaggtgagcagatacgttaattggattaaggaaaaaactaagctgacc

SEQ ID NO: 8958 - DNA, 1383 bp, Artificial Sequence
  Description of Artificial Sequence: Synthetic coding sequence
atgcaacgcgtcaacatgatcatggcagaatccccaggacttattactatttgcctcctggggtacctgctctccgcagaatgtaccgtgtttctggatcatgaaaatgcaaacaaaattcttaacagaccaaagagatacaactcgggaaaactcgaggagtttgtgcaaggcaaccttgagagggagtgtatggaggaaaagtgttcgtttgaggaggcccgcgaagtattcgaaaatacggaacgcactactgaattctggaaacagtacgtcgatggagatcagtgtgagtcgaacccttgccttaacggaggttcatgtaaggatgatatcaacagctacgaatgttggtgtccatttggcttcgagggcaagaattgcgaactggatgtgacttgcaacatcaagaacggaagatgtgaacaattctgtaagaactccgcggacaataaagtggtgtgctcgtgtaccgaaggttaccggctggcagaaaaccaaaagtcctgcgagccggcagtgccatttccgtgtggtagagtctcggtgagccagacctcaaagctcactcgcgcagagactgtgtttccggacgtcgattacgtgaactccaccgaagcagaaactattctggataacatcacccagtcgacccagagctttaacgatttcactcgcgtcgtgggaggggaagatgcgaagcccgggcagtttccttggcaggtggtgctgaatggtaaggtcgatgcattctgtggaggctccattgtgaacgaaaagtggatagtgactgcggcacactgtgtggaaactggagtgaagatcactgtggtggccggcgagcacaacattgaagagacggaacacaccgaacagaaacggaacgtgattaggatcattcctcaccataactacaacgctgcaattaacaaatacaatcatgatattgcactgcttgaactcgatgaacctttggtgctgaattcgtatgtgactcccatttgcattgccgacaaggagtacactaacatatttctgaagttcggatcaggatacgtctccgggtgggggagagtgttccataagggtcgatcagcactggtgcttcagtacctgagggtccctttggtggatagagccacctgtctgctttcaaccaaattcactatttacaacaatatgttttgtgctggctttcatgaaggaggtcgggattcgtgtcagggggattcagggggaccccacgtcaccgaagtcgagggtacttccttcttgaccggcataatctcctggggagaagagtgtgccatgaagggcaagtacggtatttacaccaaggtgtccagatacgtgaactggattaaggagaaaactaagttgacc

SEQ ID NO: 8959 - DNA, 1383 bp, Artificial Sequence
  Description of Artificial Sequence: Synthetic coding sequence
atgcagcgggtaaacatgatcatggctgaaagtcccggactgataacaatatgcctgcttggatatttactaagtgctgagtgtactgtgttcctggatcacgaaaacgcaaacaaaatcctaaaccgacccaaacggtataattctggaaaactagaagaatttgttcagggaaatctcgagagggaatgtatggaagaaaagtgctccttcgaagaagcacgagaggtgttcgaaaatactgagcgaacgacagaattctggaaacaatatgtggatggagaccaatgcgagtccaacccctgtctcaacgggggaagttgtaaagatgacataaattcatatgaatgctggtgtccatttggattcgaagggaaaaattgtgaattagatgtgacatgtaacatcaagaatggaagatgcgaacagttttgtaaaaacagtgccgacaacaaagttgtttgctcatgtactgaagggtatcgactggccgagaatcagaaaagttgcgaaccagcagtgccctttccttgtgggagggtgagtgtatctcagacaagtaaacttactagggcagaaactgtcttccccgacgtcgactatgttaactcaacagaagccgagacgatcctagataacattacacagtctacacaatccttcaacgatttcactcgggtcgtggggggagaagatgccaaacccgggcagttcccctggcaggtagtgcttaatgggaaagtggatgcgttctgcggaggatcaatcgtgaacgagaagtggatagtgactgctgctcactgtgttgaaacaggagttaagatcacagtggtggcaggagaacacaacatcgaagaaactgaacatacagaacagaaacgaaatgtcatcagaataatcccacaccataattacaacgcggccataaacaaatacaaccacgacatcgcactcctagaattggacgaacccttggtgctgaattcatacgtcacacctatctgcatagcggataaagaatatacaaatatcttcctcaagttcggatctgggtatgttagtgggtgggggagggttttccacaaagggagatctgccctggtgcttcagtacctcagggtgccactggtggatagggccacatgtctcttatctacaaaatttacaatctataataatatgttctgtgccggattccacgaaggaggaagagacagttgtcagggagattctggagggccacatgtgacagaggtggaagggacatccttccttacggggataatatcttggggggaagaatgtgctatgaagggaaagtatgggatatatactaaagtctctcggtatgtgaattggatcaaagaaaaaacaaaactcaca

SEQ ID NO: 8960 - DNA, 1383 bp, Artificial Sequence
  Description of Artificial Sequence: Synthetic coding sequence
atgcagcgagtgaacatgatcatggccgagtccccgggcttaattactatctgcctcctgggatatctgctctctgccgaatgtacagtctttctggatcacgagaatgctaacaagatcctgaatagaccaaaaagatataatagtgggaagctcgaagagtttgtgcagggcaacctggagcgggagtgtatggaggaaaaatgcagctttgaagaagcacgggaagtttttgaaaatacagagcggactactgagttctggaagcagtatgtggacggcgaccaatgtgagtccaacccctgtcttaatggagggtcctgtaaagatgacataaactcatatgaatgctggtgtccattcggtttcgagggtaaaaactgcgaattggacgtgacctgtaacattaagaacggtaggtgtgagcagttttgcaagaatagcgccgacaataaggtggtgtgcagttgcactgaaggctatcggctcgccgagaaccagaaaagttgtgaacccgctgtaccctttccctgcggccgcgtgtccgtctcgcagacatccaagctcacaagggccgaaactgtgttccccgacgtggactatgtgaattctaccgaagccgaaacaatcctggataacattactcaatctacccaatcctttaacgatttcaccagggtggtcgggggcgaggacgccaaaccgggtcagtttccatggcaggtggttctgaatggtaaagtcgacgccttctgcggcggcagtattgtgaatgagaaatggattgtaaccgccgcccactgtgtcgagacgggggtgaagataacagtggtcgcaggcgaacacaatattgaggaaacagaacataccgagcagaaacgtaatgtaatccgcatcattcctcaccataactataacgcagccattaataagtataatcatgacatagctttactagaactagatgaacctctggtgttgaatagctacgtgactcccatctgcatcgcagataaagaatacactaacatcttcctcaagttcgggtctggttacgtcagcggctgggggcgggtgttccacaagggcagatcagccctggtgctccaataccttagagtgccactggtggaccgtgctacctgtttactcagtaccaaattcactatttataataatatgttttgtgccgggttccatgaaggtggccgggattcgtgtcagggcgactccggtggaccccacgtgacagaggtcgaaggtaccagttttctgaccggcattatctcctggggcgaagaatgtgccatgaaaggcaagtatggaatatatacaaaggtcagccgctacgtgaactggatcaaggagaagaccaaattgacc

SEQ ID NO: 8961 - DNA, 1383 bp, Artificial Sequence
  Description of Artificial Sequence: Synthetic coding sequence
atgcagcgcgtaaatatgatcatggctgagagcccaggtttgattactatctgtctgttgggttatctgttgtccgcggagtgtaccgtctttctggatcacgaaaacgccaataaaattttgaaccgcccgaagaggtacaacagtggaaagctcgaggaattcgtgcagggaaacctggagagggagtgcatggaggagaaatgctctttcgaggaagctagagaggtgttcgagaacacggagagaacaactgagttctggaagcagtacgtcgacggtgaccagtgtgaaagtaacccgtgtctgaacggtggaagctgtaaggatgatatcaacagttacgagtgctggtgccccttcggttttgaaggaaaaaattgcgagttggacgtgacctgtaacataaagaacggcaggtgtgagcaattctgcaaaaacagtgcggataacaaggtcgtctgctcctgcaccgagggttatcgcctcgctgagaatcagaaatcttgcgaaccggcagtccctttcccatgcggaagagtgtcagtctcacagacctcaaaactgacgagagcggaaacggtctttccagacgtggactatgtgaattccaccgaggccgaaaccattctcgacaacatcacacagtctacccagtcatttaacgacttcaccagggtggtaggtggagaggacgctaagccaggacaattcccgtggcaggtggttctcaacggtaaggttgatgcattttgcggtggttccatcgtcaacgagaaatggattgttacggcagcccattgtgtggagaccggagtgaagatcactgttgtggcgggagagcacaatatcgaggagacagagcatactgaacagaaacgcaacgttatcaggataatccctcaccataactataacgctgcgattaataaatacaaccacgatatagctctgctcgagctcgacgaaccacttgtcttgaattcctacgtgaccccgatatgcatcgcggacaaggagtacaccaatatattcctcaagttcggatctggctacgtatctggatggggacgcgtgttccataagggaagaagcgctcttgtgcttcagtacctgcgcgtgcccttggtggacagagctacttgtctcctttccaccaagtttactatatacaacaatatgttttgcgcgggatttcatgagggcggcagggactcctgtcaaggtgactcaggaggacctcacgtgacggaagtcgaaggtacgtctttcctgaccggcatcatttcttggggagaagagtgtgccatgaagggtaaatacggaatctatacaaaagtatccaggtatgttaactggatcaaggagaaaaccaagctgact

SEQ ID NO: 8962 - DNA, 1383 bp, Artificial Sequence
  Description of Artificial Sequence: Synthetic coding sequence
atgcaacgcgtgaacatgatcatggcggaatccccagggctgataactatctgcctgctgggatacctgctgtcagcggagtgcacggtgtttcttgaccacgaaaacgccaataagattctgaatagaccaaagcgctacaactccggaaagctcgaagagttcgtgcaaggaaacctggagagggagtgcatggaagaaaagtgctcgtttgaagaagccagagaagtctttgagaacactgaacggaccacggaattctggaagcagtacgtggatggggaccagtgcgaatcgaatccatgtctgaatggaggatcgtgcaaggacgacatcaactcctatgagtgctggtgcccgtttggcttcgaaggaaaaaactgtgaactcgacgtgacgtgcaacatcaagaacggacggtgcgaacaattctgcaaaaattcggctgacaacaaggttgtgtgctcctgtactgaaggataccgcctggcagaaaaccagaagtcgtgtgaaccggccgttccattcccgtgtggacgcgtgtccgtgtcgcagaccagcaagctcactcgcgcagagactgtgttcccggatgtcgactatgtgaattcaaccgaggccgaaactatcctggacaacatcactcaatcaactcaatcattcaacgacttcactagagtcgtgggcggcgaagacgccaagccgggccaattcccatggcaggtggtgctgaatgggaaggtggatgcgttctgcgggggtagcattgtcaacgaaaagtggatcgtgacggcggctcactgcgtcgaaaccggagtgaagattacggtcgtcgcgggtgagcacaatatcgaagaaactgagcatacggagcaaaagcggaacgttattcggattattccgcaccacaactacaacgcagccatcaacaaatacaatcatgatatcgccttgctggaactcgatgagccgctggtgctcaattcctacgtgacgccgatctgcatcgccgataaggaatacaccaatatctttttgaagtttgggtccggatacgtcagcgggtggggccgggtgttccataaaggcagatcggcactggtcctgcagtacctgcgggtccctctggtcgaccgggccacctgtcttctgtcaaccaagttcaccatctacaacaatatgttttgtgcgggcttccacgaaggaggaagggactcctgccagggagactccggaggccctcatgtgaccgaggtcgaaggaactagcttcctgaccggaatcatctcatggggagaggaatgcgctatgaaaggcaaatacggaatctacactaaggtgtcacggtacgtgaactggatcaaggaaaaaaccaagctgacc

SEQ ID NO: 8963 - DNA, 1383 bp, Artificial Sequence
  Description of Artificial Sequence: Synthetic coding sequence
atgcagcgagtcaacatgatcatggcagagtcacccgggctaataacaatatgcttactcggatatcttctctctgctgaatgtactgtatttttagatcacgaaaatgccaacaaaatactgaacagaccaaaacggtataactccgggaagttagaagaatttgtgcaggggaatctggaaagggaatgtatggaagagaaatgctcattcgaagaagctagagaagtgtttgaaaatacagaacggactacagaattctggaagcagtacgtggatggagatcagtgcgaatctaatccatgcctcaatgggggaagttgcaaagatgatataaactcatatgaatgctggtgtcccttcggattcgaaggaaaaaactgcgagctcgatgtgacatgcaacatcaaaaacggacgatgcgaacagttctgtaaaaactcggcggataataaggtagtttgttcttgcacagaaggatataggctcgctgaaaaccaaaaatcctgcgaacccgccgtaccttttccctgtgggagggtgtccgtgtctcagacttccaaactgactagggccgaaactgtcttccccgatgtagattatgtgaattccacagaagcggaaacaattctggacaacattactcagtcaacacagtcctttaacgatttcactagagttgttgggggggaggatgctaaaccagggcagtttccttggcaggttgtgctgaatgggaaagttgacgctttttgtgggggatcaatcgtgaatgaaaaatggatcgttacagctgcccattgtgtggaaactggagtcaagatcacagttgttgctggggaacacaacatcgaagaaactgaacatactgaacagaaacggaacgtgattagaatcataccacatcataactataacgcagccatcaataaatacaatcatgacatagctctcttggaactcgatgaacccttagtcctcaactcctatgtgactccaatttgcatagcagacaaggaatatacaaacatatttctaaaatttgggtctggatatgtatccggatggggacgcgtctttcataagggacgaagtgctctcgtgcttcagtatctacgggtgcccctcgtggatagagctacttgccttctttcaactaaattcacaatttataacaatatgttctgtgccgggttccatgaaggagggcgcgactcctgtcagggggactcggggggaccgcatgtaacagaagtcgaggggacgtcttttctaactggaatcatctcctggggagaagagtgtgccatgaagggaaaatatggaatctacactaaagtgagtagatatgtgaattggattaaagaaaaaacaaaactcaca

SEQ ID NO: 8964 - DNA, 1383 bp, Artificial Sequence
  Description of Artificial Sequence: Synthetic coding sequence
atgcagagggtgaatatgataatggccgagtctccaggcttaatcaccatttgtttattgggatacctgttgagcgctgaatgtactgtgtttcttgatcacgaaaatgcgaataagattctgaatcggcctaaaagatataactctggaaagcttgaagagtttgttcagggtaatttggaacgtgaatgtatggaggagaaatgttcttttgaggaggctcgtgaagtcttcgaaaatacagagaggacgactgaattctggaagcagtatgttgatggagatcagtgtgaaagcaatccatgtttaaatggaggctcatgcaaggatgatattaacagttacgaatgttggtgcccattcggttttgaaggtaagaattgtgagctggacgttacatgtaatattaaaaatggacgttgcgaacaattttgtaagaactccgctgataacaaggttgtttgtagctgcacggagggatatagactagccgagaatcaaaaatcgtgtgagccagctgttccgttcccgtgcggacgcgtatcagtgagtcaaacgagcaaacttacacgcgcagagacagtcttcccagacgtggactacgttaatagcacagaagcggagactatactcgataatataactcaaagtacacaatcattcaacgactttacacgagtcgtaggtggtgaagacgcaaagccaggacaatttccgtggcaagttgtgttgaatggtaaggttgatgcattttgcggcggatcaattgttaacgaaaaatggattgtgacagcagcacattgcgtagaaactggtgtgaagattacagttgttgctggcgaacacaacattgaggaaacagaacatactgaacagaaaagaaatgtcatacgtattatcccacatcataattataacgccgcaattaataaatacaatcatgatattgctcttcttgagttggatgaaccactggtcctcaattcttatgtcaccccaatttgcattgccgataaagagtatacaaatatcttccttaaatttggttccggatacgtctctggatgggggagagtgttccacaagggacgtagtgcccttgtcctacaataccttcgagttccactcgttgatagagcgacttgtttgttgtcaacaaaatttaccatttacaataacatgttctgcgcgggttttcatgaaggaggacgggatagttgccagggagattctggaggtccgcacgttaccgaagttgaaggaacttcatttcttacaggtataatctcatggggtgaagaatgtgctatgaaaggcaaatatggtatttataccaaggtctcacgctatgtgaactggatcaaggagaaaactaagctaaca

SEQ ID NO: 8965 - DNA, 1383 bp, Artificial Sequence
  Description of Artificial Sequence: Synthetic coding sequence
atgcagcgtgtgaacatgattatggccgaatctcccggcttaattaccatctgcctgctgggatacctgctctcagcagaatgtacggtcttcctcgatcatgagaacgctaacaaaatactgaataggccgaaacggtataactctggtaagcttgaggagtttgtgcagggaaatctggagcgagaatgtatggaggaaaaatgctcattcgaagaggcccgggaggtctttgagaacaccgagcggactaccgaattttggaagcaatacgtggacggcgatcagtgtgagagtaacccttgtttaaatggaggatcttgtaaggatgacatcaattcctatgaatgttggtgccccttcggttttgagggcaaaaactgtgaattggatgtcacttgtaatatcaagaacggccgttgtgagcagttttgcaaaaattcagcagacaacaaagtagtgtgctcttgtacagaaggatatcgactggcggagaatcaaaagagttgtgagcctgcagtacccttcccatgtggccgcgtctctgtctcacagacaagcaaacttaccagagccgaaactgtcttcccagacgttgactacgtcaattcaaccgaagcagagaccattttggataacataacacagtctacccagtcatttaacgacttcacacgggtggtcggcggagaagacgccaagccaggacagtttccctggcaggtggtgttgaatggaaaagtggatgcgttttgcggagggagcattgtcaacgagaaatggatcgtgactgctgctcactgtgtggagaccggggtgaagattacagttgttgccggagagcataatatagaggagacggagcacacagaacagaaacgtaatgtcatccggattatcccacatcataactacaacgcagctatcaacaaatataaccacgatatcgctttactggagctagacgagccgcttgtcttgaactcatatgtgacaccgatttgcattgcggacaaggaatacactaatatttttctcaagttcggctctggttacgtgtctggctggggccgagtgttccataaagggagaagcgcccttgtgctgcaatatctgcgggtacctctggttgaccgggccacttgcctgttgtccacaaagtttaccatctataataatatgttctgcgcgggcttccatgagggcggccgtgattcatgtcaaggcgattctggaggcccccacgttacggaggtcgaagggacctcctttcttacgggcatcatttcctggggagaagaatgtgccatgaagggcaagtatggcatatacacgaaggtcagcagatacgtgaactggatcaaagaaaagacaaaactaact

SEQ ID NO: 8966 - DNA, 1383 bp, Artificial Sequence
  Description of Artificial Sequence: Synthetic coding sequence
atgcagcgtgtgaacatgataatggccgagtctccggggctaattaccatttgtttgcttgggtatctactatccgctgagtgtacagtgtttctggatcatgagaatgctaacaaaatcctgaaccgcccgaagagatacaatagtggaaaactggaggagtttgtgcagggcaatcttgaacgcgagtgcatggaagaaaagtgcagttttgaagaggccagagaagtcttcgagaacactgaacggacgaccgagttttggaagcaatatgtagatggagaccagtgcgagtctaatccgtgcctgaacggtggctcctgtaaagatgacatcaacagctatgaatgctggtgcccgttcgggttcgaaggcaagaattgcgaactagacgtgacctgtaatatcaagaatgggaggtgtgaacagttttgtaaaaattctgccgataacaaagtggtctgcagctgcactgagggttatcgactcgctgaaaatcagaaaagctgtgagccagcagttcccttcccctgcggcagggtgtctgtgtctcaaacatctaagctgaccagagcggaaacagtcttccctgacgtggactacgtgaactccacggaagccgagacaatccttgacaacatcacccagtcgacacagagcttcaatgatttcacacgagtggtcggaggggaggacgcaaaaccaggacagttcccttggcaggttgtgctcaacgggaaagtggacgctttctgtggtggttccattgtgaatgagaaatggatcgtaacggccgcccattgcgtggaaacaggcgtaaagatcacagtcgtcgctggtgaacacaacattgaggagactgagcacaccgagcaaaagcggaacgtcattaggatcatacctcaccataactataacgcagcaattaacaaatacaaccatgacattgcgttattggagctcgacgagcccctggtgctgaattcatacgtgacccccatttgcattgctgacaaggagtacaccaacatcttcctgaagttcggctctggttacgtgtctggatgggggcgggtatttcacaaaggccgctcagctctcgtgctgcagtatctcagggtgcccctcgttgatagggccacttgcttgctttcgaccaaatttaccatttacaataacatgttctgtgctggattccacgaaggtggacgggactcatgtcagggcgattccggggggccacacgttaccgaagtggagggaactagctttctgaccgggatcatctcgtggggggaggagtgcgccatgaagggcaaatatggcatttataccaaagtgtcgcggtatgtgaattggatcaaggaaaagacgaaactgaca

SEQ ID NO: 8967 - DNA, 1383 bp, Artificial Sequence
  Description of Artificial Sequence: Synthetic coding sequence
atgcagcgcgtcaacatgataatggcagagagtccgggactgattactatctgccttttgggatatctgctctccgcagagtgcaccgtgttcttggaccacgagaacgccaacaagattctgaatcgcccaaagagatataactccggaaaattggaggaattcgttcaaggtaatcttgagcgcgagtgcatggaggaaaagtgctcatttgaagaagcccgggaagtgtttgagaatacagagcgtaccactgagttttggaaacaatacgtggacggagaccagtgcgaaagcaacccctgcctgaacggaggctcttgcaaggatgatatcaatagctacgagtgctggtgccctttcggatttgagggtaaaaattgcgaactcgacgtgacgtgtaacatcaagaacggccgatgcgagcaattctgcaaaaacagtgccgacaacaaggtggtgtgctcctgcacagagggctaccgtctggccgagaatcagaagagctgcgagcccgcggtaccgttcccctgcggccgcgtctccgtgtcacagacatcaaagttgactagggcagagaccgtgttcccagacgtagattatgtcaactctactgaggccgaaaccattctggacaacatcacacaatcgacccagagcttcaatgatttcactcgagtcgttggcggagaggacgccaagcccggtcaattcccctggcaggtggtgctgaacggaaaggtggacgcattttgcggaggctctatcgtgaatgagaagtggattgtgacggctgcgcactgcgtcgagacaggcgtgaagattactgtcgtggccggggagcacaatattgaggagaccgaacacactgagcagaaacgcaatgtaatccgcatcattccccatcacaactataatgcggccatcaataagtacaatcacgacatagcgttgctcgaactcgatgaacctctagtgttgaactcatacgtcaccccgatctgcattgccgacaaagagtatacaaacatctttctgaagttcggtagtggctacgtgtcaggatggggccgtgtatttcacaaagggcgatccgctttggtgctgcagtaccttcgggtcccgctcgtggatcgcgcgacgtgcttgctgagtactaagttcactatctataacaatatgttctgcgcaggattccacgagggaggccgcgattcctgccagggcgattccggcggtccacacgtgaccgaggtcgagggaacatcgtttctcaccggcatcattagctggggagaggagtgcgccatgaagggtaaatatggtatctacaccaaagtcagccgctatgtaaactggattaaggagaagactaagctcacc

SEQ ID NO: 8968 - DNA, 1383 bp, Artificial Sequence
  Description of Artificial Sequence: Synthetic coding sequence
atgcaacgcgtgaacatgattatggcagaaagcccaggtctgattactatttgcctgcttggctacttgctgagcgcagagtgcaccgtgtttcttgatcatgaaaacgctaacaagatcctcaatcgcccgaagaggtacaacagcggaaagctggaagagtttgtgcaaggcaacctggaacgcgaatgtatggaagaaaagtgttccttcgaggaagcacgcgaagtgtttgaaaacacggaaagaaccaccgagttttggaagcaatacgtggatggagatcaatgtgaatcgaacccttgtctgaatggaggttcgtgtaaggacgacataaacagctacgagtgttggtgtccttttggatttgaaggtaagaactgtgaactggatgtcacctgcaacatcaaaaacggaaggtgcgagcagttctgcaaaaacagcgcagacaacaaggtggtctgctcgtgcactgaaggttatcgtcttgccgagaaccagaagagctgtgagcctgcagtgccatttccgtgtggtcgcgtgtccgtctcgcaaacctcaaaacttacccgcgcagagactgtgtttcctgatgtggactatgttaactccacggaggctgagacgattcttgacaacatcacccaatcaactcagtccttcaatgattttactagggtggtcggaggagaggacgccaaaccaggacaatttccatggcaagtcgttttgaatggaaaagtagatgcgttctgtggcggttcgattgtgaatgagaaatggattgtgactgcagcacattgcgtcgagacgggcgtcaagattactgtcgtcgcgggagaacataacatcgaggagactgaacacaccgagcaaaagagaaatgtgatccgaatcattccacaccataactataatgcagcgataaacaaatacaatcatgatattgcactgcttgagcttgacgaacctctggtcctcaatagttacgtgacgcctatctgtattgcagataaagaatacactaatatctttctgaagttcgggtctggttacgtctccggttggggaagggtgtttcataaaggccgatcggcactggtgcttcaatacttgcgggtgcctctggtggatagggcgacctgtctgctgtctactaagttcactatttacaataacatgttttgtgcaggattccacgagggtggtagagactcatgtcaaggcgattccggtggtccacatgtgaccgaggtggaaggaacctcgtttctgaccgggatcatatcgtggggagaggaatgtgcgatgaagggtaagtacggcatttacaccaaggtgtcgagatacgtgaattggatcaaggaaaaaaccaaacttacc

SEQ ID NO: 8969 - DNA, 1383 bp, Artificial Sequence
  Description of Artificial Sequence: Synthetic coding sequence
atgcagcgcgtcaacatgattatggcagagtccccagggctcatcaccatatgtctcctaggctatcttctctccgctgagtgcacagtgttcctcgaccatgagaacgccaacaagattctcaatcggcccaaaaggtacaatagtggtaagcttgaagagttcgtgcaagggaacctggaaagggagtgtatggaagagaaatgctcattcgaggaagcccgcgaggtgtttgaaaataccgaaagaacgacagagttctggaagcaatatgtggatggcgaccagtgcgaatcgaacccatgcctcaatggcggttcctgcaaggatgacatcaatagctacgagtgttggtgtcctttcggctttgagggtaagaactgcgagctcgacgtcacctgtaatattaaaaacgggaggtgcgaacaattctgtaaaaattctgcagacaacaaggtggtttgttcttgtacggagggctaccgtttggcagagaaccaaaaatcttgtgaaccggctgtcccgtttccatgtggacgagtttcggtcagtcaaacttctaagctgacaagggcagaaactgtgtttccagacgtggattacgttaatagcaccgaagcggagactattctcgacaacatcactcagtcaacacagtcttttaatgattttaccagagttgttggcggtgaagatgcaaaaccaggtcagtttccatggcaagtcgtactgaatgggaaagtcgatgctttctgtggcgggagcatcgttaatgagaagtggatcgtcacggccgcccactgcgtggagacaggtgtgaagatcacagtggtcgccggtgagcacaacatcgaagagaccgagcacaccgaacagaagaggaacgtgatacgcatcattccccaccacaattacaacgccgccatcaacaaatacaatcacgatatcgccctgcttgagctcgatgagcccctggtgctaaacagctacgtgacacccatctgtatcgccgataaggagtatactaacatttttctgaagttcggaagcggttatgttagcggctggggccgagtctttcacaagggcagaagcgccttggtcctccagtaccttcgggtgccactcgtggaccgagccacctgccttttgtcgaccaagttcaccatttacaacaatatgttttgtgcaggtttccatgagggcggtagggactcctgtcagggagactccggcgggcctcatgttactgaggtcgagggaacaagttttcttacaggcattatcagctggggtgaggagtgcgctatgaagggcaagtacggcatttataccaaagtctcccggtacgtgaactggataaaggaaaagacaaagctcacc

SEQ ID NO: 8970 - DNA, 1383 bp, Artificial Sequence
  Description of Artificial Sequence: Synthetic coding sequence
atgcagagagtaaatatgattatggccgagtcaccaggtctcatcaccatctgtctacttggttatcttctttctgctgagtgcactgtgtttcttgatcacgagaacgcaaacaagattctgaatcgacctaagcgatataactctggaaaactggaggagtttgtgcaggggaatctggagcgggagtgcatggaggaaaaatgcagtttcgaggaggcacgagaagtgtttgaaaacaccgagcgcactactgaattttggaaacaatatgtggatggagaccagtgcgagtccaacccttgtctcaatggcgggtcatgcaaggacgatatcaattcatacgagtgttggtgcccgtttggctttgaggggaaaaactgtgagctggatgtcacatgtaacataaaaaatggccgctgcgaacagttttgtaagaactcagctgacaacaaagtggtctgttcctgcaccgagggatacaggttggcagaaaatcagaaatcttgtgaacccgccgtccccttcccttgtggaagagtgagcgtgagccagacatcaaaattgacgagagctgagacagtgttccccgatgtggactatgtgaactctacagaggctgagacaatactcgataatatcacacagtctacccaatcattcaatgactttacgagggtcgtaggcggggaggacgccaagcctggccaatttccctggcaagttgtgctgaacggaaaggtcgatgccttctgtggtgggagtattgtgaatgagaaatggatagtgaccgccgctcattgtgtggagacaggagtgaaaattactgtcgtggccggcgagcacaacatagaggaaaccgagcatacagaacagaagagaaacgtcatcagaattatcccccaccacaactataacgcagccattaacaaatacaatcatgatattgctttgttggaactggacgaacctcttgtgctgaatagctacgtcacgccgatctgtatcgcggataaagaatatactaacatattcctcaagttcggttccggttacgtgtcaggctggggcagggtctttcataaggggaggtctgcactggttttgcaatacttgcgggtgccgctggttgacagagcaacctgccttctgtcaactaaattcaccatttacaacaacatgttctgcgctgggttccacgaggggggtcgtgattcgtgccagggcgactcaggcggaccacacgtcaccgaggtggaggggacctcttttcttacaggcatcatctcttggggagaggaatgtgcaatgaaggggaaatacggaatatataccaaggtgtcaaggtatgtgaattggatcaaggagaagaccaaactgacg

SEQ ID NO: 8971 - DNA, 1383 bp, Artificial Sequence
  Description of Artificial Sequence: Synthetic coding sequence
atgcagagggtcaacatgattatggccgagagtcctggcttgataacaatctgtctgctgggctatttacttagcgcagagtgcacggtgtttctggatcacgaaaacgcaaacaagatcctgaaccgaccaaaaaggtacaatagtgggaagctcgaagagttcgtgcagggaaaccttgagcgggaatgcatggaagaaaagtgtagcttcgaggaagcccgcgaggtcttcgaaaatacagagcgcacgaccgaattttggaaacagtacgtagatggggaccagtgtgagtccaacccatgcctgaacggcggctcatgcaaagacgatatcaattcgtacgagtgttggtgtccattcggtttcgagggaaaaaactgcgaattagacgtcacttgcaacattaagaatgggcgttgtgaacagttctgcaagaactccgccgataataaagtggtgtgttcatgtaccgagggctaccggctggcagagaaccagaaaagctgcgagccggcagttccattcccgtgcggtcgagtctctgtgtcccaaacttcaaagttgacacgcgccgaaaccgttttcccagatgtggactatgtgaacagcacagaagcagaaactattctcgataatatcacacagagcacccaatcctttaatgattttacacgggtcgtagggggtgaggatgccaagcccggccagttcccctggcaagtcgtgctgaacggaaaagtagacgcgttctgtggaggcagcattgttaacgagaaatggatagttacagccgcccactgtgtggagacaggagtgaagattacagtcgtggctggggagcataatatagaggaaaccgagcataccgagcagaagcggaacgtgatccgaattattcctcaccataactataacgctgcaattaataagtacaaccacgatatagcactgctggaattggacgagcccttggtgttgaacagctacgtgactccaatctgtatcgcagacaaggaatatacaaatatctttcttaaattcggctcgggctatgtcagtggttggggacgagtattccacaagggacggtcggctctcgtgcttcagtacctccgtgttcctcttgttgaccgcgccacctgtttgttgtcaacaaagttcacaatctataataatatgttttgcgccggctttcatgaggggggaagagactcttgccagggtgactcggggggcccacacgtgacggaggttgaaggaacgtcttttctgaccgggattatcagctggggtgaggagtgtgctatgaagggtaagtatggtatctacactaaagtttctagatacgtcaactggatcaaagaaaagacaaagctgaca

SEQ ID NO: 8972 - DNA, 1383 bp, Artificial Sequence
  Description of Artificial Sequence: Synthetic coding sequence
atgcaacgtgtcaacatgataatggccgaatctccaggtctgatcaccatttgtctcctgggctacctgttgtctgccgaatgtactgtgttccttgaccacgaaaatgcaaacaagatcctcaaccgccccaaacgttataatagcggcaaactggaggaatttgtccagggaaacttggagagagaatgcatggaagaaaagtgctccttcgaggaggcccgtgaggtgtttgaaaataccgaaaggactaccgaattctggaagcagtacgtcgatggtgatcagtgcgagagtaacccttgcctgaatggcggatcttgcaaagatgacattaactcttatgagtgctggtgccctttcggatttgagggcaagaactgtgagcttgatgtgacatgcaatatcaaaaatggaagatgtgaacagttctgtaagaactccgctgataacaaagtggtttgctcctgtaccgagggttatcgtcttgctgagaaccaaaaatcttgcgagcccgctgtgccttttccttgtggacgcgtaagcgtctctcagacatcaaagctgacaagggcagagactgtatttcccgatgtggactatgtgaacagtactgaggccgagactatcctggacaacatcacccagagtacccagagtttcaatgatttcactcgcgtggtcggaggagaagacgcaaagcccggtcagttcccttggcaggttgtcctcaacggtaaagtcgacgcattctgcggcggctctatcgtaaatgagaagtggatcgtgactgctgcccactgcgtagaaaccggcgttaaaataactgtagtagcaggagagcacaacatcgaggagacagaacatacagagcagaagaggaacgtgatccgtatcatccctcatcacaactacaatgcagctatcaataagtacaaccatgatattgctctcctcgagctggacgagcccctggtcctcaatagctatgtcacacccatttgcatagcagacaaggagtacaccaacattttcctgaaattcggttccggatacgtgtctggttggggtcgcgtgtttcacaagggtagatccgcactcgtgttgcagtacctgcgcgtgccactggtagacagggccacttgcttgcttagtacaaagtttactatttacaacaatatgttctgcgccggattccacgagggaggtcgcgacagttgccagggtgattccggtggccctcacgtgaccgaggtggagggaacaagcttccttaccggtattatcagctggggtgaggagtgcgctatgaagggcaagtatggtatctacactaaggtctctcgttatgtgaattggatcaaagagaaaacaaaactgacc

SEQ ID NO: 8973 - DNA, 1383 bp, Artificial Sequence
  Description of Artificial Sequence: Synthetic coding sequence
atgcagagagtgaatatgatcatggccgagtcgcctggtttgattactatctgcctcttggggtacctcctttccgccgaatgtacggtttttttagaccacgagaacgctaataagatcttgaaccggcctaaaaggtacaacagcgggaagcttgaagaattcgtgcaaggaaacctggagagggagtgcatggaggagaaatgttcatttgaggaggcacgggaggtttttgagaatacggaacgcacaaccgagttctggaaacagtatgttgacggtgatcagtgcgagtctaacccctgtctgaatgggggctcttgcaaagatgatatcaacagctatgaatgttggtgcccattcggcttcgaagggaagaactgtgagttagatgtgacatgtaatattaagaatggcagatgcgagcagttttgtaaaaacagcgccgataacaaggtggtctgctcttgtaccgaggggtaccggctggcggagaaccagaaaagctgtgagcctgccgtgcccttcccttgcggaagggtgagcgtatcacagacatctaaattaacaagagccgagaccgtctttccggacgtggattacgtcaactccacagaggcagaaacaattctggacaacatcactcagtcgacacagtcattcaatgactttactagggtggttggcggggaagatgccaaacctggtcagttcccatggcaagtggtgttgaatggtaaggtagacgcattttgtgggggtagcatagtaaatgagaagtggatagtaacggctgcgcactgcgtggagaccggagtgaaaatcactgtagttgcaggcgaacacaacatcgaggagacagagcatactgaacaaaagagaaatgtgattaggataattccacaccacaattacaatgccgctataaacaaatataatcatgatatcgctctgctggagctggatgagcctctggttctcaattcatatgttacacctatctgtattgccgataaggagtacacaaatatattcctgaaatttggaagcggctatgtgagcgggtgggggagggtgtttcacaaggggaggtctgctctcgttctgcagtacctgcgggtccccttggtcgatcgagccacgtgcctgctgtctaccaaattcaccatctataacaacatgttctgtgccggcttccatgaaggcggccgcgattcctgtcagggcgattccgggggaccgcacgtaacagaagtggaaggcacatcatttttgaccggaataatttcttggggtgaagaatgcgccatgaagggaaagtatgggatatatacaaaggtaagcagatacgttaactggattaaagaaaagacaaaactcaca

SEQ ID NO: 8974 - DNA, 1383 bp, Artificial Sequence
  Description of Artificial Sequence: Synthetic coding sequence
atgcagagagtaaatatgatcatggctgaatcccccggcctgatcacaatctgtctactgggttatctgctgtcagccgaatgcacggtttttttggaccacgagaatgcgaacaaaatattaaacaggcccaagaggtacaactctggaaagctggaagagttcgttcagggcaacttagaaagggagtgtatggaggagaagtgtagctttgaggaagcccgggaggtgttcgagaacaccgagcgaactactgaattctggaagcagtacgttgacggcgatcagtgtgagtcgaacccctgcctgaatgggggctcctgcaaagatgacattaacagttatgagtgctggtgtccttttggcttcgagggaaagaactgcgaactcgatgtgacttgcaacatcaaaaacggcaggtgcgagcagttttgcaaaaatagcgccgataacaaagtggtgtgctcatgcaccgaagggtataggctggccgagaatcagaagtcatgtgagcctgctgtgcctttcccttgcggcagagtctctgtttctcagacatccaagctgacaagggcagagactgtgtttcctgatgtggattacgttaactcaaccgaagctgagaccatacttgacaacattacccagtccacccagagcttcaacgactttacacgggtggttggcggcgaggatgctaagcccgggcagtttccttggcaggtcgtcttgaacggtaaagtcgatgctttctgcggagggtccattgtcaacgaaaagtggatcgtgactgccgcacactgcgtggagaccggagtcaaaatcactgtcgtggcaggagaacacaacatcgaagagaccgagcatactgaacagaagagaaatgtcatccgaattattccacatcacaattataatgctgccattaacaaatacaaccacgatatagccctgctggagttagacgagccccttgttctgaacagttacgtgaccccgatctgtatcgctgacaaagagtacaccaatattttcttgaaattcggctctggatacgtttcaggatggggtcgtgtattccataagggcaggtccgcactcgtactccagtacttgcgtgtgcctcttgtggatagggctacctgccttttatccacaaaattcaccatctacaataacatgttctgcgcgggcttccacgaaggggggcgcgatagctgccagggcgattctggtgggccccatgttaccgaggtggaagggacttctttccttacgggcatcatctcttggggggaagagtgtgcgatgaaggggaagtacggcatatacacgaaagtcagccgatacgttaattggataaaggaaaagaccaaactgact

SEQ ID NO: 8975 - DNA, 1383 bp, Artificial Sequence
  Description of Artificial Sequence: Synthetic coding sequence
atgcaaagagtgaacatgataatggccgagtcaccgggccttatcacgatctgccttctgggatatctgctttccgcagaatgcaccgtgttcctggatcacgagaatgcaaacaagattctgaatcgccctaagaggtacaactctgggaagctcgaggaatttgttcaagggaatctggaacgagaatgcatggaggaaaagtgctcgtttgaggaagcgagggaagttttcgaaaatacggaacggaccactgaattttggaagcagtacgtggatggggatcagtgcgaaagcaatccgtgtctcaatggaggatcatgcaaggacgacataaactcctacgagtgttggtgtcctttcgggtttgaagggaagaactgtgagcttgacgtcacctgtaacattaagaacggtagatgtgagcagttttgtaagaattcagcagacaacaaagtcgtgtgttcctgcactgaaggctatcgtctcgcagagaaccagaagtcgtgtgaaccagctgtcccttttccatgtggcagggtgtctgtgtcgcaaacttcaaagctgactagggcggaaactgttttccccgatgtggactacgtcaactccaccgaggcagagactatcctggataacatcacccaatccactcagtcgtttaacgactttacccgggtggtcgggggtgaggacgcaaagcctggtcagtttccttggcaggtggtcctgaatggtaaggtggatgcattttgtggaggatcaattgtgaatgagaaatggatcgttacggcagcccattgcgtcgaaacgggcgtcaaaatcaccgtggtcgccggcgaacacaatattgaagagactgaacacaccgaacagaagcgaaacgtcatcaggattattcctcatcataactacaacgcagcaattaacaagtacaaccatgatattgcccttcttgagctggacgaaccgctggtgcttaacagctacgtgaccccaatatgtattgcggataaggagtataccaatatctttcttaagttcggaagcggttacgtgtcaggctggggtagagtgttccataaaggacgctccgcgctcgtgctgcagtaccttcgcgtgccccttgtggatagagccacttgtctgctgtcgactaagtttaccatttacaataacatgttttgtgcagggttccacgagggaggacgagatagctgtcagggggattctggaggccctcatgtgaccgaagtcgagggaactagctttttgaccggcatcatttcgtggggagaagagtgtgctatgaaaggaaagtacggcatatacactaaggtgtcgagatacgtgaattggattaaggaaaaaaccaagctgacc

SEQ ID NO: 8976 - DNA, 1383 bp, Artificial Sequence
  Description of Artificial Sequence: Synthetic coding sequence
atgcaaagggtgaatatgattatggccgagtcccctggtctgatcactatatgcctgctgggttaccttctttcggcagaatgcaccgtctttctggatcatgagaacgcaaataagatactcaaccgcccaaagagatacaattccggaaaactcgaggaatttgttcaaggaaatctcgaaagggagtgtatggaagaaaagtgctcctttgaagaagcccgggaagtctttgagaacaccgagaggaccactgagttctggaaacaatatgtggacggagatcaatgtgaatcgaatccttgtctgaatggtggtagctgtaaggacgatatcaactcctacgaatgctggtgcccatttgggtttgagggaaaaaactgtgaactggatgtgacgtgcaacatcaagaatggtagatgcgagcagttttgtaaaaacagcgccgacaacaaggtggtgtgcagctgtaccgaagggtaccgccttgctgaaaaccagaagtcatgtgaaccagccgtgcctttcccatgcgggagggtgtcagtgtcgcaaacgtcaaagctgactagagcagaaactgtgttcccagatgtggactacgtgaacagcaccgaagcagagacgattcttgacaatatcacccagtctacccagagcttcaacgattttaccagggtcgtcgggggtgaagatgcaaagcctggacagtttccctggcaggtcgtcctgaacggtaaggtcgacgcattctgcgggggctcgattgtcaacgagaagtggatcgtgacggcagcacactgtgttgaaactggagtcaagatcactgtggtggcaggggaacacaacatcgaggagactgagcacacggagcaaaagagaaatgtcatacggataattccacatcacaattacaacgcagcgattaacaaatacaaccatgatattgcgcttctggaacttgatgaacctttggtcctgaactcgtatgtgactcccatttgcattgcagataaggaatacactaatatcttccttaagtttggatcgggatacgtgagcggttggggacgagtgtttcacaagggacgctcggcactggtcctgcaatacctccgggtgccactggtcgaccgggctacctgtcttttgtccactaagtttactatttacaataacatgttttgtgcaggattccatgaaggcggaagagattcgtgtcaaggcgattcaggaggacctcatgtcaccgaggtcgaagggacctcctttcttaccggtatcatatcgtggggcgaggaatgcgctatgaaggggaaatacgggatctacactaaagtgtcccgttacgtcaattggataaaagaaaaaactaagctgacg

SEQ ID NO: 8977 - DNA, 1383 bp, Artificial Sequence
  Description of Artificial Sequence: Synthetic coding sequence
atgcaaagagtcaacatgattatggctgaatcacctggacttattactatatgtttacttggttatttacttagtgctgaatgtacagtttttcttgatcatgaaaatgcaaataaaatcttaaatagaccaaaaagatataactctggaaaattagaagagtttgtccaaggaaatttagaacgtgaatgtatggaagaaaaatgttcttttgaagaagcaagagaagttttcgagaatactgaaagaactactgaattttggaaacaatatgttgatggagatcaatgtgaatcaaatccatgtttgaatggaggatcatgtaaagatgacattaattcatatgaatgttggtgtccttttggatttgaaggaaagaattgtgagttggatgttacctgcaatattaaaaatggaagatgtgaacaattttgtaaaaactccgctgataataaagtggtatgttcatgtaccgaaggatatagattagctgaaaatcaaaaatcatgtgaaccagcagtgccttttccttgtggaagagtttctgtctctcaaacatcaaagcttactagagcagaaactgtctttccagatgttgattatgttaatagtactgaagctgaaactattttagataatattacacaatcaactcaatcatttaatgattttactcgtgttgttggaggagaagatgcaaagcctggacaattcccatggcaagttgttttaaatggtaaagttgatgcattctgcggaggatctattgtcaatgaaaaatggattgttacagcagctcattgtgtggaaacaggtgttaaaataacagttgttgctggtgaacataatatagaagaaactgaacatacagaacaaaagagaaatgttattaggattattccacatcacaattataatgcagcaattaataaatataatcatgatattgctttattagaattagatgaaccacttgttttaaactcgtatgtaaccccaatatgtattgctgataaagaatatacaaatatatttttgaagttcggatctggatatgtttctggttggggtagagttttccataagggaagatcagcccttgttttacaatatttaagagtgccacttgttgatcgtgcaacatgtttactctcaactaaatttactatttataataatatgttctgtgctggattccatgaaggaggtagagattcctgccaaggagattctggtggacctcatgttacagaagtcgaggggacttcattccttactgggataatttcatggggtgaagaatgtgcaatgaaaggaaaatatggaatttatactaaagtttcaagatatgttaattggattaaagaaaagacaaaacttact

SEQ ID NO: 8978 - DNA, 1383 bp, Artificial Sequence
  Description of Artificial Sequence: Synthetic coding sequence
atgcaaagagtgaatatgatcatggctgaatcacccggtcttattactatttgtctgcttggttaccttctttccgcggaatgcaccgtgtttctggaccacgagaatgcaaacaagatattgaaccggcccaagcgatacaattcaggtaaacttgaagagtttgtccaaggtaacctggaaagagaatgtatggaagagaagtgttcgttcgaagaggcacgggaggtgtttgagaacaccgaacggaccactgaattctggaaacagtacgtcgatggggaccagtgtgaatccaacccttgcctgaatggcggatcgtgcaaggatgacattaactcttatgaatgctggtgcccttttggttttgaaggaaaaaactgcgagctcgatgtgacttgcaatatcaaaaatggacggtgcgaacagttttgcaaaaactcggcagataacaaggtcgtgtgctcatgtaccgaaggatacaggctcgcagaaaaccagaaaagctgcgaaccagccgtgccgtttccttgtggtcgggtgtcggtcagccaaacttccaaactgacccgggcagaaaccgtgttccctgacgtggattacgttaattcaaccgaagcagagactattctcgacaacatcactcagtccactcaatccttcaatgattttaccagagtcgtgggtggtgaggatgccaagccgggacaatttccctggcaagtggtgcttaacggaaaggtggacgcattttgtggtggttcaatcgtgaacgaaaagtggattgtgactgcggcgcattgcgtggagactggcgtgaaaatcactgtcgtcgccggtgagcataacattgaggaaaccgaacataccgaacagaagcggaacgtcattcgcataattcctcatcacaactacaacgcggcaatcaataagtacaaccatgatattgcacttctggagcttgatgaaccgctcgtgcttaactcctacgtgacccctatatgtattgcagataaggagtacactaacatatttctcaagtttggtagcgggtacgtttcaggatggggacgtgtgtttcacaagggaagatccgcgcttgtgcttcaatacctgcgagtcccccttgtggacagagcaacttgcctcttgtccacgaaattcaccatctataacaacatgttttgtgccggttttcatgagggtggtagggactcctgtcagggagactccggcggccctcacgtcaccgaagtggagggcacctcttttctgacgggcatcatttcatggggagaggagtgtgcaatgaaagggaagtacggcatttacacgaaagtgagtcgctacgtgaattggatcaaggagaaaacgaagctgacc

SEQ ID NO: 8979 - DNA, 1383 bp, Artificial Sequence
  Description of Artificial Sequence: Synthetic coding sequence
atgcagcgagtgaacatgatcatggctgagagtcctggactgatcacaatatgcctgctcggctatctcctcagtgccgagtgtacagtgtttctggaccatgagaacgccaacaagattcttaacaggcccaagcgttataattcaggcaaattagaggaattcgtccagggaaacctagagcgggagtgcatggaggagaagtgctcctttgaagaggctagggaggtgttcgagaacaccgagaggacaacggagttctggaaacaatacgtggacggcgatcaatgcgaaagcaacccatgtctcaatggtggcagctgtaaggacgatataaactcctacgaatgctggtgtccattcggatttgaaggtaagaattgcgaactggatgtcacatgcaacatcaaaaacggacgatgcgagcaattttgtaagaactcagcagacaataaagtcgtatgttcttgcacagaggggtaccggctggctgagaaccaaaaaagctgtgagcctgccgtcccgtttccttgtggcagggtgtcggtctcacagacttccaagcttaccagagctgagaccgttttcccagatgtagactatgtgaattctaccgaagccgagactatactggataatatcacccagagtactcagagctttaatgactttacccgggtcgttggaggcgaggacgcaaagcctggacagtttccgtggcaggttgtcttaaatggcaaagtggatgccttttgcgggggatccatcgtgaacgagaaatggattgtgaccgccgctcattgtgtggaaaccggggtaaaaattacagtggtggccggcgagcataacatcgaagagacagagcatacagagcagaaaagaaacgtgatccggatcataccacatcacaattacaacgcggctatcaacaaatacaatcacgacatagctctgctggaattggacgagccactggttctcaacagctacgtcacaccaatctgcatcgctgacaaagagtacaccaatatttttttgaaatttggcagtggttacgtgagcggatggggacgcgtatttcacaagggacgcagcgcgctcgtgctgcaatatcttcgcgtgcctttggtggatcgcgctacctgccttctgtcgacaaagtttaccatttataacaatatgttctgtgctggattccatgaaggaggcagagatagttgtcaaggcgacagcggggggccacacgtgacagaggttgagggcacatccttccttacaggaattataagttggggagaggaatgcgcgatgaaaggaaagtacggtatctacactaaggtgagccggtacgttaactggattaaggagaagacaaaactgaca

SEQ ID NO: 8980 - DNA, 1383 bp, Artificial Sequence
  Description of Artificial Sequence: Synthetic coding sequence
atgcagagagtgaatatgataatggcggagagcccaggcctgatcactatttgcctgctgggctacctacttagcgccgaatgcaccgtgttccttgaccatgagaacgccaataagattctcaataggcccaagcgatacaacagcggaaagctggaagaattcgttcagggtaatctagaaagggagtgcatggaggagaagtgcagtttcgaagaggcaagagaagtgtttgaaaataccgagcggacgaccgaattctggaagcagtacgtcgatggggatcagtgcgaatccaatccctgtctcaatggaggctcctgtaaggatgatattaactcctacgaatgctggtgtccattcggatttgaaggaaagaactgtgaactagacgtgacatgcaacatcaaaaacggaagatgtgagcagttctgtaaaaattctgccgataacaaagtggtgtgcagctgtaccgagggctatcggctggctgagaaccagaagtcatgtgagccggccgttccatttccctgcggacgagtgtccgttagccagacatctaaattaacccgagctgaaactgtgtttcccgacgtcgactatgtgaattctaccgaggccgaaacgatcctggataatatcacccagtccacccaatcttttaatgattttactcgggtcgtcggtggtgaggacgctaagcccggccagttcccatggcaagtggtgctcaacgggaaggtagatgctttttgtggtgggagtatcgtgaatgagaagtggatcgttacagccgctcattgtgtggagactggtgtgaaaataactgtggtggccggcgaacacaacattgaagaaaccgagcatacagaacagaagcgcaacgtcatccgcatcatcccgcaccacaactacaatgccgccatcaacaagtataatcacgacatcgctttgctggagctggatgagcccttagtactgaatagctacgtgactcctatctgcatcgctgacaaggaatacacgaatatctttcttaagtttggaagtgggtacgtttccgggtgggggcgggtgttccacaagggtcgcagcgccctggtgctgcaatacctaagagttccactcgttgaccgggcaacgtgcctgctgtcgacgaaatttaccatctacaacaatatgttctgtgctggatttcacgagggtgggagggattcctgccagggagattccggaggcccacatgtcaccgaggttgaaggaaccagtttcctcacgggtattatttcttggggggaagagtgcgccatgaaaggaaagtacggaatatacacaaaagtgagtagatatgtgaactggataaaagaaaagactaagctgacg

SEQ ID NO: 8981 - DNA, 1383 bp, Artificial Sequence
  Description of Artificial Sequence: Synthetic coding sequence
atgcaaagagtaaatatgatcatggcagaaagccccggtctgattaccatttgcctcctaggctacttacttagcgctgagtgtaccgtgtttctagatcacgaaaacgccaataagatcctgaatcgcccaaagcggtataatagcgggaaactcgaagaattcgtgcagggcaatctagaacgtgaatgcatggaggagaaatgctcattcgaagaggctcgggaggtgtttgaaaataccgagagaactaccgaattttggaagcaatacgtcgacggcgatcagtgtgaatctaacccttgcctgaatggaggaagttgcaaggacgacatcaacagctatgagtgctggtgccccttcggcttcgaaggaaaaaactgcgaacttgatgtaacctgtaacatcaagaatggcaggtgcgagcagttctgcaagaatagcgctgataacaaggtggtgtgcagctgcactgaaggctaccggctggcagagaatcagaagagctgtgaacccgcggtcccctttccatgtggcagggtgtccgtatcccagacctctaagcttactcgagctgaaacagtgtttcccgatgtggactacgtgaattccactgaggccgaaaccatcctggataacatcacccagagcacacaaagcttcaacgatttcaccagggtcgtaggaggagaagatgctaagcccggacagttcccctggcaggtcgtactaaacggaaaagtcgacgccttctgtggaggtagcatagtaaacgagaagtggatagtcactgctgcccattgcgtggaaacgggagtgaagattactgtcgtggccggtgagcataatatcgaggagaccgaacacacagagcagaagcgaaacgttatcagaatcatcccacaccacaactataacgctgccattaacaaatacaatcacgacattgccctgctagagttagatgaaccattggttctcaattcatacgtgacccccatttgcatagcagataaggaatatactaatatcttcttgaagttcggcagcggatatgtttccggatggggacgcgtgttccacaagggccggtccgcccttgtcctccagtatctgcgcgtgccactcgtcgacagggcaacatgcctcctatccaccaagtttactatctataataatatgttctgcgccggattccatgagggaggccgggattcctgtcagggagattccggcggacctcacgtcaccgaggtggaaggaacaagcttcttgacagggatcatctcatggggggaagaatgtgcaatgaaaggaaagtacggtatctacacaaaagtctctcggtatgttaactggataaaagagaagaccaaactgact

SEQ ID NO: 8982 - DNA, 1383 bp, Artificial Sequence
  Description of Artificial Sequence: Synthetic coding sequence
atgcaacgagtgaacatgattatggcagaaagcccaggactcatcactatatgcctgctggggtatctcctgagcgcagagtgtacagtcttcctcgaccacgaaaacgccaataagattctgaaccgacctaagagatacaactctggcaaactggaagagtttgtacaggggaacctcgagcgagaatgcatggaagagaaatgtagttttgaagaagcacgcgaggtgtttgagaataccgagcgaacaacagagttttggaaacaatacgtggatggagatcaatgcgagtcaaatccttgcctgaacggtggatcctgtaaggacgatattaatagctacgaatgctggtgtcccttcgggttcgagggcaagaattgtgagctagacgttacttgcaatataaagaacgggagatgtgaacagttttgcaagaactctgctgataacaaggtcgtgtgttcctgtacagaggggtatcggctggcggaaaaccagaagtcatgtgaacccgccgttccgtttccctgtgggcgcgtttcggtctcacagacatccaagctaacgcgggccgaaacagtgttccctgacgtggattacgtcaactcaacagaagctgaaacaatactggacaatataacccaatccactcaatccttcaacgactttacccgagtggtgggtggcgaagatgccaaacccggtcagttcccatggcaggtcgtcctaaatgggaaggtcgacgccttttgcggaggatctatcgttaacgaaaagtggatcgtgacagccgcgcactgtgtggaaaccggagtgaagattacggtagtggctggcgaacacaatattgaagagactgaacataccgaacagaaaaggaatgttataaggatcattccccatcacaattacaacgccgccattaacaaatacaaccacgatatagctctgctagaactggacgaacccctcgtgctgaattcctatgtcaccccgatttgtatagctgacaaggaatacacaaacatcttcctaaaattcggctctggatacgttagcggttggggcagagtattccacaaagggagatcggcactggtccttcagtatctgcgggtgccccttgtagacagagctacttgtttgctttctactaaatttaccatctacaataacatgttttgtgcaggattccacgaggggggtcgtgatagctgtcaaggggactcgggcggacctcacgtgacggaagtcgaggggacctcgtttttaaccggtatcattagctggggtgaagagtgtgctatgaaagggaagtatggcatatacacgaaggtgtctcgctacgtcaactggataaaggagaagaccaagctgacc

SEQ ID NO: 8983 - DNA, 1383 bp, Artificial Sequence
  Description of Artificial Sequence: Synthetic coding sequence
atgcagagagtgaatatgatcatggccgagtcccctggcctcatcactatttgtctgctgggttacttgctcagcgcagaatgcacggtgttcttggatcacgagaatgccaacaagatcctcaaccggccgaagagatacaactccggaaaactcgaagaattcgtgcaagggaaccttgagcgcgagtgcatggaagagaagtgctcgttcgaagaggcccgcgaagtctttgaaaatactgaacggactactgagttctggaaacagtacgtcgacggtgaccagtgcgaatcaaatccgtgcctcaacggagggtcgtgcaaggacgacattaactcgtacgaatgttggtgcccgttcggttttgaagggaagaattgcgaactggacgtgacttgcaacatcaagaacggacggtgcgagcagttttgtaagaactcggctgacaataaggtggtgtgctcctgcaccgaggggtacagattggcggagaatcaaaagtcatgcgaacccgccgtcccgtttccgtgcggacgtgtttcggtttcgcagacctcaaagctcacgcgtgccgaaactgtgttcccagatgttgattacgtgaactccaccgaggcggaaaccatcctcgacaacattactcaaagcactcagtccttcaacgactttaccagggtggtgggtggggaagatgcgaaaccaggacaattcccttggcaagtcgtgctgaatggaaaggtcgatgccttctgcggcggctcaatcgtgaacgagaaatggatcgtcaccgctgcacactgtgtggagactggagtgaaaatcactgtggtggcaggggagcacaacatagaagaaacggagcataccgaacaaaagaggaacgtcatccggattatcccccaccacaactacaacgcagctattaacaagtacaatcatgacattgcgctcttggaattggatgagccgctggtgctgaatagctacgtcactccaatttgtatcgcagataaggagtatacgaatatctttctgaagttcggctcaggatacgtctctggatggggacgcgtgttccataaaggcaggagcgcactggtcctgcagtacctgcgcgtgcctctcgtggacagggcgacttgcctcctctcaaccaagttcacgatctataacaacatgttctgcgcgggatttcacgaaggcggacgcgattcctgtcagggagatagcggagggccgcatgtcactgaagtcgaaggtacttcgttcttgaccggaatcatctcctggggcgaggagtgtgccatgaagggaaagtacggcatctacaccaaggtgagcaggtatgtcaactggatcaaagaaaaaaccaaactgacc

SEQ ID NO: 8984 - DNA, 1383 bp, Artificial Sequence
  Description of Artificial Sequence: Synthetic coding sequence
atgcaacgggtgaatatgatcatggccgagagccccgggctaattacaatttgtctgctgggttacctgttgagtgctgaatgtaccgtgttcttggatcacgagaacgcaaataagatattgaatcggcctaaacggtacaacagtggaaagttggaagagttcgttcagggaaacctggagcgtgagtgcatggaagagaaatgtagttttgaagaagcccgtgaggtcttcgagaatacagagaggactactgagttctggaagcagtacgtcgacggagaccagtgtgagtctaacccatgtttgaatggaggctcatgtaaagatgacattaactcctacgagtgttggtgtcctttcggcttcgaaggaaagaactgcgagctggatgttacctgcaacattaaaaacggccgttgcgaacagttctgcaaaaattcagcagataataaggtagtgtgctcctgcaccgaaggataccgactcgctgaaaatcagaagagctgtgaacctgcagtccctttcccctgcggaagggtctccgtgagccagaccagcaagctcaccagggccgagactgtctttccggatgtggactatgtcaattcaaccgaggctgagaccattctcgacaacattactcagagtacacagtctttcaatgatttcacacgcgtagtaggtggggaggatgctaaacctggccagtttccctggcaggtagtcctcaacggcaaagttgatgctttttgtggcggatctatagttaacgagaagtggattgtaaccgcagctcactgtgtagagacgggcgtcaaaattacggttgtggccggcgagcacaatattgaggaaactgagcacacagaacaaaaacgaaacgttatccggataatcccacaccacaattataacgctgccattaacaagtataatcatgatatcgctcttctggagcttgatgaacccctggttctaaattcttacgtgacccccatatgcatcgctgataaggaatatacaaacatcttccttaagtttggttcaggatatgtttccggatggggtcgggtgtttcacaagggccgctctgcactcgtcctccagtacctgagggtgccactggtggaccgggccacctgcctgttgtccaccaagttcaccatttacaataatatgttttgcgccgggttccacgagggcgggcgcgacagctgccagggcgattcagggggaccccacgtgaccgaagtcgaaggaacgtcgttcctcaccgggattattagctggggcgaggagtgcgccatgaaggggaaatacggaatttatacaaaggtgtctcggtacgttaactggatcaaagagaagactaagcttaca

SEQ ID NO: 8985 - DNA, 1383 bp, Artificial Sequence
  Description of Artificial Sequence: Synthetic coding sequence
atgcaacgcgtgaatatgatcatggcagagagccccggtctgatcaccatatgcctgctgggatacctgctatccgcagaatgcacagtgtttttagatcacgaaaatgccaacaaaatcctcaacaggcccaaacgatacaattctgggaagctagaagaattcgtgcaaggaaatctggagcgcgaatgcatggaagaaaagtgtagcttcgaggaggcccgcgaggtctttgaaaataccgagcgtacgaccgagttctggaaacagtatgtggacggagaccagtgcgaatctaacccttgcctgaacgggggaagctgcaaagacgatatcaactcttacgagtgttggtgccccttcgggttcgaaggcaaaaattgtgagctcgacgtgacatgtaatattaaaaacgggagatgcgagcagttctgtaaaaactctgcagacaacaaggtcgtgtgctcttgcaccgaagggtatcgtctcgctgagaatcagaagtcatgcgagcctgccgtgccctttccctgtggtcgagtgagtgtcagccaaacctccaaactcacaagagcggagaccgtatttcctgatgtggattacgttaacagcactgaagcagagaccatcctggacaacatcacacagagcacgcagtcatttaatgatttcactagggtcgttgggggggaagacgcaaagcctggccagtttccatggcaagtcgtgcttaacggaaaagtggatgctttttgtgggggctcaatagtcaatgagaagtggattgtgactgccgcccactgtgttgagacaggcgttaagattacggtggtcgccggggagcataatattgaagagacagagcacacggaacaaaaacggaacgtgattcggatcatccctcaccacaactacaacgcggccattaataagtacaaccacgacatagctttgctcgaactggatgaacccctggttctcaactcctatgtgacccccatatgcatagccgacaaagaatataccaacatatttctcaaatttggctccggttacgtctcagggtgggggagagtgtttcacaagggtcggtccgccctggtgctccagtacttgagagtgcctttagtcgacagagcaacatgcctcctctctacaaagttcaccatttacaataacatgttttgtgccggtttccatgagggtgggagagattcctgccagggcgattcaggagggccccacgtcaccgaagtggagggtacctccttcctgactggtatcataagctggggcgaggaatgtgccatgaagggaaaatacggcatctacaccaaagtatctaggtacgtaaattggatcaaggaaaagactaagctaacg

SEQ ID NO: 8986 - DNA, 1383 bp, Artificial Sequence
  Description of Artificial Sequence: Synthetic coding sequence
atgcagcgagtgaacatgattatggccgaatcacctggactcattaccatatgtttgcttggttatctcctgtcagctgagtgcaccgtctttctggatcatgagaacgcgaacaaaatactcaatagacccaagcgatacaactcgggcaagctcgaagagtttgtgcaagggaatctggaaagagaatgcatggaagaaaagtgcagctttgaggaggcacgggaagtctttgagaacacggagcgcacgaccgaattttggaagcaatacgtggatggtgatcagtgtgaatccaacccttgtttgaatggaggctcatgcaaagatgacattaacagctacgaatgctggtgtccatttggctttgaaggtaagaactgtgaacttgatgtaacctgcaacattaagaatggtcgttgtgaacagttctgtaagaactcggcagataacaaggtcgtctgttcatgtactgagggttaccgtctggcagagaatcaaaagagctgtgagccggcagtgccgtttccttgtgggagagtgtcagtgtcccagacctccaagctcacgagagccgaaactgtctttccggatgtggactacgtgaactcgaccgaagctgaaaccatacttgacaatatcacccaaagcactcaatctttcaacgatttcaccagggttgtgggcggagaagatgcaaagccaggccagttcccgtggcaagtcgttctgaatggaaaggtggacgcattctgtggagggtcgatcgtgaatgagaagtggattgtcaccgcggctcattgtgtggagactggggtgaagattactgtggtcgccggagagcacaatatcgaggagactgaacacactgaacagaaacgcaatgtcataaggattatcccacaccataactacaatgcagccatcaacaaatacaaccacgacattgcactgctggagcttgatgagccgctcgtcctgaactcatacgtcactccaatctgtattgcagacaaagaatatactaacattttccttaagtttggatccggttacgtgagcgggtggggacgggtctttcacaagggtcgctcggcccttgtcttgcagtacctgagagtgcctttggtcgatcgggctacttgcctcctcagcaccaagtttactatctacaataacatgttttgtgcaggttttcatgaggggggacgggacagctgtcaaggggattcgggtggaccacatgtcaccgaagtggaaggtacgtccttcctcactgggatcatttcatggggggaagagtgtgccatgaagggaaaatacggtatatacactaaggtatcccgctatgtgaactggatcaaggaaaaaaccaaacttact

SEQ ID NO: 8987 - DNA, 1383 bp, Artificial Sequence
  Description of Artificial Sequence: Synthetic coding sequence
atgcaacgtgtaaatatgataatggcggaatcgccgggtttaataacgatatgtttactaggttatctattatcggcggaatgtacggtatttttagatcatgaaaatgcgaataaaatactaaatcgtccgaaacgatataattcgggtaaattagaagaatttgttcaaggtaatctagaacgagaatgtatggaagaaaaatgttcgtttgaagaagcgcgagaagtatttgaaaatacggaacgtacgacggaattttggaaacaatatgtagatggtgatcaatgtgaatcgaatccgtgtttaaatggtggttcgtgtaaagatgatataaattcgtatgaatgttggtgtccgtttggttttgaaggtaaaaattgtgaattagatgtaacgtgtaatataaaaaatggtcgatgtgaacaattttgtaaaaattcggcggataataaagtagtatgttcgtgtacggaaggttatcgtctagcggaaaatcaaaaatcgtgtgaaccggcggtaccgtttccgtgtggtcgagtatcggtttcgcaaacgtcgaaattaacgcgtgcggaaacggtttttccggatgttgattatgtaaattcgacggaagcggaaacgatattagataatataacgcaatcgacgcaatcgtttaatgattttacgcgagtagttggtggtgaagatgcgaaaccgggtcaatttccgtggcaagttgttttaaatggtaaagttgatgcgttttgtggtggttcgatagtaaatgaaaaatggatagtaacggcggcgcattgtgtagaaacgggtgtaaaaataacggtagttgcgggtgaacataatatagaagaaacggaacatacggaacaaaaacgtaatgtaatacgtataataccgcatcataattataatgcggcgataaataaatataatcatgatatagcgctattagaattagatgaaccgttagtattaaattcgtatgtaacgccgatatgtatagcggataaagaatatacgaatatatttttaaaatttggttcgggttatgtttcgggttggggtcgtgtatttcataaaggtcgttcggcgctagttctacaatatttacgtgtaccgctagttgatcgagcgacgtgtttattatcgacgaaatttacgatatataataatatgttttgtgcgggttttcatgaaggtggtcgtgattcgtgtcaaggtgattcgggtggtccgcatgttacggaagtagaaggtacgtcgtttctaacgggtataatatcgtggggtgaagaatgtgcgatgaaaggtaaatatggtatatatacgaaagtatcgcgttatgtaaattggataaaagaaaaaacgaaactaacg

SEQ ID NO: 8988 - DNA, 1383 bp, Artificial Sequence
  Description of Artificial Sequence: Synthetic coding sequence
atgcagagagtcaatatgataatggccgaatcgcctggccttatcacgatctgccttctgggatacctcctgagtgccgaatgtaccgtgttcttggatcatgagaatgcgaataagatcctgaaccggccaaagaggtacaactcgggaaagctcgaggagtttgtgcaggggaacctggagagagagtgcatggaggaaaagtgctcgtttgaggaagcccgcgaagtgttcgagaacaccgaacgcactaccgagttctggaaacagtacgtcgacggcgatcagtgtgaatccaacccatgcttgaatggtggatcatgtaaggatgatatcaactcatacgaatgctggtgccctttcggcttcgaaggaaagaattgcgaactggacgtaacctgcaacattaagaacgggagatgtgaacagttctgcaaaaattcggcagataacaaagtggtctgttcctgcactgaaggttaccggctggcagaaaatcaaaagagctgcgagccagcggtgcctttcccatgtggacgcgttagcgtcagccaaacttctaagctgactcgagccgaaaccgtgttccccgacgtggactacgtgaactccactgaagctgaaacgatcctcgataatatcactcaatccacccagtccttcaacgatttcacccgcgtggtgggaggagaggacgcaaagccgggtcaatttccgtggcaggtggtgctgaatggaaaagtcgacgcgttttgcggaggatcgatcgtcaacgaaaagtggatcgtgaccgcagcgcactgcgtggagactggcgtgaaaatcaccgtggtggcgggagaacataacatcgaggaaaccgaacatactgaacagaagaggaatgtcattaggattatcccgcaccacaactacaacgccgctatcaacaagtacaaccacgatatcgccctgctggagctcgacgaaccgctcgtcctcaacagctacgtgaccccgatctgcatcgccgacaaggaatacaccaatattttccttaaattcggatccggatacgtgtcgggatggggacgcgtctttcacaaggggcggtcagctctcgtgctccaatacctgcgcgtccccctggtggaccgggccacttgtctgctgagcacgaagttcaccatctataacaacatgttttgcgccggcttccatgagggaggcagagacagctgccagggtgactccgggggtccgcacgtcaccgaggttgagggcacttcgttcttgaccggcattatctcatggggagaagagtgcgctatgaaaggcaagtatgggatctacactaaggtgtcacggtacgtgaattggatcaaagagaaaacgaagctgact

SEQ ID NO: 8989 - DNA, 1383 bp, Artificial Sequence
  Description of Artificial Sequence: Synthetic coding sequence
atgcaacgggtgaacatgataatggccgaatcgccaggacttattactatctgtctgttgggctacctcctgagcgcagaatgtaccgtgttcttggatcatgaaaacgcaaacaagatcctcaatagacctaagaggtacaattccggtaagctggaagagttcgtccagggtaatcttgaaagagaatgtatggaagaaaaatgttctttcgaggaggcacgcgaagtattcgagaacaccgaaagaactaccgaattctggaagcaatacgtggatggcgatcaatgtgagtccaatccatgcctgaatggcggatcgtgtaaagacgatatcaacagctacgaatgttggtgtccatttggatttgagggaaagaactgtgaactcgatgtcacttgcaatatcaagaatggaagatgcgagcaattttgtaagaactccgcagacaataaagttgtgtgttcctgtactgaggggtaccggcttgcagagaatcagaagtcgtgcgagccagctgtgccttttccgtgtggtcgagtgtctgtctcccagaccagcaagttgaccagggccgaaaccgtctttcccgatgtggattacgtgaactcgactgaagccgaaaccattctggataacatcacccagtccacccagtcatttaacgatttcactcgggttgtcggaggagaggacgccaagcctgggcagtttccttggcaggtggtgctcaacggaaaagtggacgccttctgcggaggttccatcgtcaacgaaaagtggatcgtgactgcggcgcactgtgtcgaaactggtgtgaagatcactgtcgtggccggtgaacataacattgaggaaaccgagcataccgaacaaaagcggaacgtcattcggattattccacatcataactacaatgccgctatcaacaagtacaaccatgatatagctctgctcgagcttgatgaacctctcgtcctcaattcctacgtgactcctatttgcattgcagataaggagtacaccaacatatttcttaagtttggttcgggatacgtgtccggatggggacgggtctttcataaagggaggtccgcactcgtgctgcaataccttcgcgtgcccctggtggatcgcgcaacttgtctgctcagcaccaagtttaccatctacaacaacatgttctgtgccggatttcatgaaggggggcgggactcctgccagggtgattcaggtgggccacacgtgactgaggtggaaggcacttcttttttgacggggatcatttcatggggagaagagtgcgcaatgaaggggaagtacggtatatacactaaggtgagccgatatgtgaattggatcaaggaaaaaactaagctgacc

SEQ ID NO: 8990 - DNA, 1383 bp, Artificial Sequence
  Description of Artificial Sequence: Synthetic coding sequence
atgcaaagagtgaatatgatcatggcggagtcgccgggtttgatcactatttgtctgctcggatacctgctttcagcggagtgcaccgtctttctggatcacgaaaacgcaaacaaaatcctcaatcggccgaaacgctacaattccggaaagctggaggaattcgtgcaagggaaccttgagcgggaatgtatggaggaaaagtgctcgttcgaggaagcacgggaagtctttgagaacactgaacggactaccgaattctggaagcaatacgtcgacggtgatcagtgcgaatccaacccgtgcctcaacggtggttcgtgtaaggacgatatcaactcatacgagtgctggtgcccattcggattcgaaggaaagaattgcgaactggacgtgacctgtaacatcaagaatggacggtgcgagcagttctgcaaaaactccgcagacaacaaggtggtgtgctcctgtactgaaggctaccgcctcgcagaaaaccagaagagctgcgagcccgctgtgccctttccgtgtggacgcgtgagcgtgagccagacctccaagctgacgcgcgcggagactgtgtttccggatgttgattacgtcaactcgaccgaagcagaaaccattctggataacattacccagtcgacccagtccttcaatgatttcacccgcgtggtgggaggagaggacgcgaaaccaggacaattcccctggcaggtggtcctcaatggaaaggtggacgccttctgtggcggatcgatcgtgaacgagaaatggattgtgactgctgctcactgcgtcgaaaccggcgtcaaaatcaccgttgtggcgggagagcacaacatcgaagaaactgaacacaccgagcagaagcgaaacgtgatcagaatcattccgcatcataactataatgcggcgatcaacaagtataatcatgatattgcccttttggaactcgatgaaccgctggtgctgaattcatatgtgactccgatatgcatcgccgacaaggaatacactaacatcttcctgaagttcgggtcaggatacgtgtcaggctgggggcgggtctttcataagggccggtcagcgttggttctgcaatacctccgcgtgccactggtggaccgggctacctgcctgctgtcaactaagttcactatctacaacaacatgttttgcgcagggttccatgaaggagggcgggactcgtgccaaggtgactcgggaggaccgcatgtgaccgaagtggaggggacctcatttctcaccggaattatctcctggggcgaagagtgtgccatgaaaggcaaatatggaatctacactaaggtatcacggtacgtgaattggatcaaggaaaagaccaagctcacg

SEQ ID NO: 8991 - DNA, 1383 bp, Artificial Sequence
  Description of Artificial Sequence: Synthetic coding sequence
atgcagcgggtgaacatgataatggccgagtcgccaggccttatcactatctgcctcctgggatacctgctttcagccgaatgtaccgttttcctcgatcatgaaaacgcaaacaagattctgaaccgacctaagcgatacaattcggggaagctcgaagaattcgtgcagggaaatctggagcgggagtgtatggaagagaaatgctcattcgaggaagcacgcgaagtctttgaaaataccgaaagaactactgagttttggaagcaatacgtcgatggcgatcagtgcgagtccaacccgtgtctcaatggaggctcctgtaaggacgatatcaacagttatgaatgttggtgtccctttggttttgaaggtaagaactgtgaactggacgtgacctgcaatatcaagaacggtagatgtgaacaattctgtaagaactccgcggataacaaagtagtgtgcagctgtactgagggttataggctggccgaaaatcaaaagtcctgtgaacccgcagtgccttttccatgcggacgcgtgtcagtgagccaaactagcaagctgactcgcgcagaaacggtctttcccgatgtggattacgtcaactcgaccgaagcagaaaccatactggataacatcactcaatcaacccaaagtttcaacgactttaccagggtggtgggaggtgaagatgcaaagccaggccagtttccctggcaagtggtgcttaacgggaaagtagatgcattttgtgggggttctatagtcaatgagaaatggattgtgaccgctgcgcactgcgtcgaaacgggggtcaagatcactgtggtcgcaggagaacataacattgaagaaaccgaacataccgagcaaaaacgcaacgttattcgtattatccctcaccacaactacaatgcagcaatcaacaagtacaatcacgacattgcccttcttgaacttgacgagcctctggtgctcaattcgtacgtgactccaatttgtatagcggacaaggagtacacgaacatttttcttaagtttggaagtggatacgtctccgggtggggacgcgtctttcataaaggtcggagcgccctcgtgttgcagtacctgagagtgcctctggtcgacagagctacctgtctgctgagcaccaagtttactatttacaataacatgttctgcgcgggattccatgagggtggtcgcgatagctgtcagggagattcaggaggtccacatgtcaccgaagtggaggggacttccttcctgacgggtatcatctcatggggagaagagtgcgccatgaaggggaaatacggcatttacactaaggtgtcccgatacgttaattggattaaagaaaagactaaacttacc

SEQ ID NO: 8992 - DNA, 1383 bp, Artificial Sequence
  Description of Artificial Sequence: Synthetic coding sequence
atgcaaagggtgaatatgattatggctgaaagccctggactcataaccatctgcttgctggggtaccttctcagcgccgagtgtactgtgtttctagatcacgagaacgccaataaaatattgaatagacctaagagatataacagcggtaaactggaagagtttgtacagggaaaccttgagcgcgaatgtatggaggaaaaatgcagtttcgaagaagcccgagaagttttcgagaacaccgagcgaacaacggaattctggaagcagtatgtggatggagaccagtgcgagagcaacccctgtctgaacggaggtagctgtaaggacgacatcaattcctacgaatgttggtgtccatttggcttcgaaggaaagaattgcgaattagacgtgacatgtaacataaagaatggcagatgcgaacaattctgtaaaaactcagctgacaacaaggtggtgtgcagctgtaccgagggctaccggctggcggaaaaccagaagagttgtgaaccagccgtaccgttcccctgcggacgggtatcggtgtcccagacatccaaacttacacgtgctgagacagtgttccccgatgtcgattatgtaaactctaccgaggccgagactatcctggataacataacgcagtcaactcagtccttcaatgactttactcgcgtggtgggaggagaggacgccaaaccagggcagttcccctggcaggttgtgctgaacggcaaggttgacgctttctgcggagggagtatagtcaatgaaaaatggatcgtgacagcagctcattgtgtggaaactggcgtgaaaattacggttgttgcgggagagcataatattgaggaaaccgagcacacagaacaaaagcggaacgtgattcgaatcattccccatcacaattacaatgcagccattaacaaatataaccacgacatcgcgctcctcgagctagatgagccattggtgttaaactcttacgtgacacccatctgcatagctgataaagagtacactaacatattcctgaagttcgggtctgggtacgtgagcgggtggggcagggtattccacaaagggaggtccgccctggtgctgcagtatctccgagtgccactcgtggatcgagctacgtgcctccttagcaccaagttcactatttacaacaacatgttttgtgcgggctttcacgagggaggaagagactcgtgccagggcgactctggaggtcctcatgtgacagaggttgaaggcacgtctttcctgacagggattattagctggggggaggagtgtgcaatgaagggaaagtatgggatctacacgaaagtgtctcggtacgtgaactggataaaggagaagaccaagttaacc

SEQ ID NO: 8993 - DNA, 1383 bp, Artificial Sequence
  Description of Artificial Sequence: Synthetic coding sequence
atgcagcgcgtaaatatgattatggctgagtctccggggctgattacaatttgcttgctcggttatttgttatccgcagaatgcacggtgtttcttgatcatgagaacgcaaataagattctgaatcggccgaagagatacaattcaggcaagttagaagaatttgttcaaggtaatcttgaaagagaatgtatggaagaaaaatgttcatttgaagaagctcgggaagtatttgagaacacagagcgaactaccgaattctggaaacaatatgtcgacggcgaccaatgtgagtctaatccatgcctgaatggtggttcgtgtaaagacgacattaacagctatgagtgttggtgtccgttcggtttcgaagggaaaaactgtgaactggacgtcacctgtaatattaaaaatggcagatgcgaacagttttgtaaaaatagcgcagataataaagttgtttgctcttgtacagaagggtaccgattggcagagaaccaaaaatcctgtgagccggcggtgccgttcccttgtggccgcgtgagcgtctctcagacttctaaactcacaagagcagagacagtgttcccggatgtcgattatgtaaatagtacagaagctgaaacaatcctggataatattacccagtcaacacagagctttaatgattttacgcgcgtcgtggggggcgaggacgctaaaccaggccaattcccgtggcaggttgtacttaacggaaaagttgacgcattttgcggcgggagcattgtcaacgaaaaatggatagtcacggctgctcactgcgtagagaccggagtgaaaattacagtggtagcgggcgagcacaatattgaagaaacagagcataccgaacaaaaaagaaacgtgattcgtatcatcccgcatcataactataatgccgccattaataagtacaatcatgatatcgccttactcgagcttgatgaaccgcttgttctgaactcctatgtaacgcctatatgcatcgctgacaaagagtacacaaatatcttccttaaatttggaagcggatatgtcagcggctggggacgggtttttcataaaggccgttcagctcttgtcctccagtacctgagggtaccacttgtcgacagagcaacatgtcttctttcaaccaaatttacgatctacaataacatgttttgcgcgggattccacgaaggcgggagagactcatgccaaggagattctggagggcctcacgtgacagaagtggaaggcacaagctttctgacaggaataatttcctggggtgaagaatgtgcgatgaaaggaaaatatggtatatacacaaaagtgtctcggtatgtgaattggatcaaagaaaaaacaaaacttacc

SEQ ID NO: 8994 - DNA, 1383 bp, Artificial Sequence
  Description of Artificial Sequence: Synthetic coding sequence
atgcagcgggtcaatatgatcatggcggaaagcccgggtcttatcacgatctgtctgttgggctacctgctcagcgctgaatgtaccgtgttcctggaccacgaaaatgccaacaagattctgaaccggccaaaaagatataactcggggaagttggaagaattcgtgcaagggaatcttgaaagagaatgcatggaggagaaatgttcgttcgaggaggccagggaagtgttcgaaaacactgaacggaccactgaattttggaaacaatacgtcgacggcgatcagtgcgaaagcaacccctgcttgaacgggggctcttgcaaggacgacattaactcgtacgaatgctggtgtcccttcgggtttgaaggaaagaattgcgagctggacgtcacgtgcaatatcaaaaatggaagatgcgagcaattttgcaagaacagcgctgacaataaggtcgtgtgctcctgcacggagggataccgactcgcagagaatcaaaaatcgtgtgaaccggcggtgccatttccatgcggccgggtgtccgtgtcacagacctcgaagctcactcgggctgaaactgtgttcccggatgtggactacgttaatagcactgaagccgaaactatcttggataacattacccagagcactcagagcttcaacgatttcactcgggtggtgggaggggaggatgcaaagcctggacagttcccgtggcaggtggtgcttaacggcaaggtggatgctttctgcggcggatccatcgtcaacgagaaatggattgtcacggcagcacattgcgtcgagactggcgtcaagatcactgtcgtggcaggagaacacaacatcgaggagacggagcacaccgaacagaagcgaaatgtgatcagaatcattcctcatcacaattacaacgcggccatcaataagtacaaccacgacattgcgcttctggagctcgacgaaccactggtgctgaacagctacgtgacgccgatctgcatcgccgacaaagagtacaccaacatcttcctcaagtttggttccggatacgtttcgggatgggggcgggtgttccataagggccgctccgcactcgtcttgcaatacctgcgagtgccgctggtggatcgtgctacctgcctgctttcgaccaagtttacgatatacaataacatgttctgcgccggctttcatgagggagggagggattcctgtcagggagactcaggaggaccccatgtgacggaggtggaggggacttcatttttgaccggaatcatctcttggggcgaggaatgcgccatgaaaggaaagtatggcatttacaccaaggtgtcacggtacgttaactggatcaaggaaaagactaagctgact

SEQ ID NO: 8995 - DNA, 1383 bp, Artificial Sequence
  Description of Artificial Sequence: Synthetic coding sequence
atgcagagggtgaacatgataatggcagaatcccctggtctgatcaccatatgtttgctgggatacctcctgagcgcagaatgtaccgtttttctggatcacgaaaacgcaaataagattctcaaccgccctaagaggtacaatagcggaaaacttgaggagtttgtgcagggcaatctggaacgtgaatgtatggaagagaagtgttcatttgaagaagcgagggaggtgtttgaaaacacggaaagaactactgaattttggaaacaatacgtggatggagatcaatgcgaatcgaacccgtgtctcaacggtggaagctgcaaagatgacattaactcgtacgaatgttggtgtccatttggattcgaggggaagaactgtgaacttgacgtcacgtgtaatatcaagaatggccgctgtgagcaattttgtaaaaactcggctgataacaaagtcgtgtgctcgtgtaccgaaggttacaggctcgcagagaatcagaagagctgtgaacccgctgtgccattcccatgcggaagagtgtccgtctcgcaaacttcgaaacttactcgggcagaaactgtattccctgatgtcgactacgtcaactctactgaagcagaaaccatccttgacaacataactcagtcgacccagtcgttcaacgactttactagggtggtgggaggggaagatgcaaagcctgggcaattcccatggcaagtagttctgaacggaaaagtggacgcattttgcggtggaagcattgtgaacgagaagtggatcgtcaccgcagctcattgcgtggaaacgggagtgaagattaccgtcgtggccggcgagcataacatcgaggagactgagcacactgaacagaagcggaacgtgattcgcatcattccccaccataactacaatgcggctatcaataagtataatcatgatatcgcgctcctcgaacttgacgaacccttggtgctgaactcctacgtcacccctatttgcatcgcagacaaagaatacaccaacatattcctgaagtttggttcgggctacgttagcggttggggccgtgtctttcataagggaaggtccgccctcgtgcttcaataccttcgggtgccactcgtggaccgggcaacttgccttctgtccaccaagttcactatttacaacaacatgttttgcgcaggatttcatgaaggcggtagagactcttgtcaaggggatagcggaggacctcacgtgactgaagtggaagggaccagtttcctcactggcatcataagctggggggaagagtgtgcaatgaaaggcaaatatggaatttacaccaaggtgtcgcgctacgtcaattggattaaagagaaaaccaagctcacc

SEQ ID NO: 8996 - DNA, 1383 bp, Artificial Sequence
  Description of Artificial Sequence: Synthetic coding sequence
atgcaacgcgtgaacatgatcatggcggaatccccggggctgattacgatctgccttctcggttacctgctttcggcagagtgtaccgtgtttttggatcacgaaaatgcgaacaaaatccttaaccgcccaaagaggtataacagcgggaagctggaagaatttgtgcaaggcaaccttgagcgggagtgtatggaagaaaaatgttcgttcgaagaagcaagagaggtctttgaaaatacggaaagaactaccgaattctggaagcagtacgtggacggcgaccaatgtgagtcgaacccttgcttgaacggggggtcgtgcaaggatgatatcaattcttacgagtgttggtgtccctttggtttcgaaggtaaaaactgcgaactcgatgtgacttgcaacatcaaaaacggacggtgtgaacagttctgcaagaactccgcggacaacaaggtggtctgttcatgtactgagggctaccggcttgcagagaatcagaagtcgtgtgagcctgcggttccgtttccgtgcggtagagtgtcagtgtcacaaacctcaaagctcactagagctgaaaccgtgtttcctgatgtggattacgttaattccactgaggcagagactatactggataacattactcagagtacgcaatcctttaacgacttcactcgcgttgtgggtggtgaagatgcgaagcccggacaatttccatggcaggtggtgcttaatggtaaagtcgatgcgttctgtgggggatccattgtcaacgaaaagtggatcgtcaccgccgcgcattgtgttgaaactggagtgaagattaccgtggtggcaggagaacacaatattgaagagactgaacataccgagcagaaacggaatgttatcagaatcatcccccatcataactacaacgcagcaatcaataagtacaatcacgatattgccttgctcgagctggacgaacctcttgttctgaactcctacgtcacccccatttgcattgctgacaaggaatataccaacattttcctcaaatttggttcaggctacgtgtcgggttggggtcgagtctttcacaaaggccgttcagccctggtgctccagtacctgagggtgccactggttgacagggccacgtgcctgctgtccactaagttcaccatttacaataacatgttttgcgcaggttttcatgaggggggaagagattcctgtcaaggagactcaggtggtccacatgtgactgaggtggaaggaacttcgtttcttaccgggatcatttcatggggagaagaatgtgctatgaaaggtaaatacggaatttacaccaaggtgagcaggtacgtgaactggattaaggagaaaaccaagctgacc

SEQ ID NO: 8997 - DNA, 1383 bp, Artificial Sequence
  Description of Artificial Sequence: Synthetic coding sequence
atgcagcgcgttaacatgattatggctgagtctccaggcctcataactatctgcttgctgggctacctgctctcagcagagtgcacagtgtttctggatcacgaaaatgctaataagattctcaaccgcccaaaaagatataactccggaaagctcgaggagttcgttcaggggaacctggagcgcgaatgcatggaagagaaatgcagtttcgaggaggctcgcgaggtattcgaaaacaccgagaggaccaccgagttctggaagcagtatgttgatggagatcagtgcgaatccaacccttgcctgaacggcggatcctgcaaagacgacatcaactcttatgagtgctggtgcccttttggtttcgaaggaaagaattgcgaactggatgtgacctgcaacatcaaaaacggtcgctgcgaacagttctgtaagaactccgccgataacaaagtggtctgctcctgcacagagggatatcggctcgcagaaaaccaaaaatcctgtgagcctgctgttccatttccatgtggccgagtctccgtgagccagacatccaagcttacaagagccgaaaccgtctttccagatgtcgattacgtcaactcaaccgaggccgagaccatcttggataacataactcagtccacacaatcttttaatgacttcacacgggtagtgggcggcgaggacgctaagcccggacagtttccctggcaggtggtcttgaatgggaaggtggacgccttttgtggaggcagtatcgtcaacgagaaatggatcgtgaccgcagcgcactgcgtcgaaaccggggtgaaaataacagttgtcgccggagaacacaacatagaggagaccgagcacaccgaacagaaaaggaacgtcatacgcatcattccacaccacaattacaacgcagccattaacaagtacaatcacgacatcgcattgctcgagctggatgagcctctcgtgctgaattcatatgtgactccaatttgtatcgcggataaggagtacacgaacatctttctcaagtttggaagcgggtacgtaagtggatggggtagagtgttccacaagggaagaagcgcactcgtgttgcagtacctgcgcgtaccacttgtcgacagagccacgtgccttctgtctacaaaattcactatctacaacaatatgttttgtgccggattccacgagggcgggagggattcttgccagggtgattcaggtggaccacatgtgacagaggtggagggcacctcctttctgaccggaattatctcatggggggaagagtgtgcaatgaaaggcaaatatggaatctacacaaaggtgtccaggtacgttaattggataaaggagaagactaagctgact

SEQ ID NO: 8998 - DNA, 1383 bp, Artificial Sequence
  Description of Artificial Sequence: Synthetic coding sequence
atgcaacgggtgaacatgatcatggctgagtcgcccgggctgatcacgatctgcctgctggggtacctcctttcagccgaatgtactgtgtttctggatcatgagaatgctaacaaaatcttgaaccgccctaagcgctacaactcagggaagctggaagaattcgtgcaaggaaacctcgagagagaatgcatggaagagaagtgctcttttgaagaggcgcgcgaagtgttcgaaaacaccgagagaaccaccgaattctggaaacagtacgtggacggtgaccaatgcgagtccaacccgtgcctgaacggaggctcgtgcaaagatgacatcaacagttacgaatgttggtgcccattcggattcgaaggtaagaactgtgaactggacgtgacttgcaacatcaaaaacggtcggtgcgaacagttttgcaagaattcagccgacaataaggttgtctgttcgtgtactgagggatatcggctggctgagaaccagaaatcctgtgagccagccgtgccgttcccgtgcggccgcgtgtctgtgtcccagacgagcaaacttactcgcgccgaaaccgtgttcccggacgtggactacgtgaacagcaccgaggctgaaactatcctcgacaacattactcaatcaacccagtcgttcaacgactttacccgagtggtgggaggagaagatgcgaaacctggacagttcccttggcaagtggtcctcaacggcaaggtcgacgcattctgcggggggtcgatcgtgaacgaaaagtggatcgtgaccgcggctcattgcgtggaaactggagtgaagatcactgtcgtagcgggagaacacaacatcgaagagacggaacatactgaacagaaacgcaatgtcatccggatcatcccgcaccacaactacaatgccgccatcaacaagtacaaccatgacatcgcattgctcgaactggacgagcccctggtgctgaactcgtatgtcacccctatctgtatcgcggataaggagtacactaacatttttctgaagttcgggtcaggatacgtttcgggatggggccgcgtctttcacaaggggcggtccgccctcgtgctgcaatacttgcgcgtaccattggtggatagggccacttgccttcttagcaccaagttcaccatctacaataacatgttctgcgccggattccacgaaggtgggagagactcttgccagggagactcaggaggcccccatgtgactgaggtcgagggaacttcgtttctcaccggcatcatctcatggggcgaagaatgcgcaatgaagggcaagtatgggatctatactaaggtttcgaggtacgtgaattggattaaggaaaagaccaaacttacc

SEQ ID NO: 8999 - DNA, 1383 bp, Artificial Sequence
  Description of Artificial Sequence: Synthetic coding sequence
atgcagagggtcaacatgatcatggccgaatcgcccggcctcatcactatctgcctgttgggctacttgctgtcggcagagtgcaccgtctttctggaccacgagaacgccaataagatcctgaaccggccgaaacggtataactcaggcaaactggaggaattcgtccaagggaacctcgaaagggaatgcatggaagagaaatgtagcttcgaagaagcccgagaagtgttcgagaacacggaacgcaccactgagttctggaaacagtacgttgacggagatcagtgcgagtcgaacccgtgcctgaatggtgggtcatgtaaagatgacatcaacagctatgaatgttggtgtccgtttggattcgaaggaaagaattgcgaacttgatgtgacctgcaacatcaaaaacgggagatgtgagcagttctgtaagaatagcgcagacaataaagtcgtttgctcgtgcactgagggataccggctcgccgaaaaccaaaagtcgtgcgaaccggccgtgccgtttccttgcggaagagtgtccgtgagccaaactagcaagttgacccgggcagaaactgtgttcccggatgtcgactatgtgaattcgacggaagcggaaaccatccttgacaatatcacgcaaagcacgcagtccttcaacgacttcactcgcgtggtcggaggcgaagatgcaaaacctggacaatttccatggcaggtggtcctcaacggaaaggtggacgcgttttgtggaggttcaatcgtgaacgaaaagtggatcgtgactgcggcccactgtgtggaaactggcgtcaaaatcactgtcgtggcgggcgagcacaacatcgaggaaaccgagcatactgagcagaagcgcaacgtcattcggatcatccctcaccataactacaacgcggcgatcaataagtacaaccacgatatcgccctcctggaattggacgagccccttgtcttgaactcctacgtcacccctatctgcatcgccgacaaggaatacaccaatatcttcctgaagttcggctcgggatacgtgagcggctggggccgcgttttccataaagggagatcggcgctcgttctccaatacctgagggttcctttggtggaccgcgctacctgcctcctgtcaactaagttcaccatctacaacaacatgttctgcgcgggcttccacgaaggaggacgcgatagctgtcagggagattccgggggtccacacgtgactgaggtcgagggcacctccttcctgaccggaatcatctcatggggcgaggagtgtgccatgaaaggcaagtacggcatctacactaaggtgagccgctacgtcaactggattaaggaaaagactaaacttact

SEQ ID NO: 9000 - DNA, 1383 bp, Artificial Sequence
  Description of Artificial Sequence: Synthetic coding sequence
atgcagcgcgtgaatatgatcatggctgagtctccgggtcttatcacgatctgtctcctgggatacctgctgtccgcggagtgtacggtgtttctggaccacgagaacgccaataagatcctcaatagaccgaagagatacaactcaggaaagctcgaggagtttgtccagggaaatttggagcgggaatgtatggaagagaagtgcagcttcgaagaagcaagagaagtgttcgagaacaccgagcggactactgaattctggaaacagtatgtggacggtgaccagtgcgaatctaacccgtgtctcaacggcggatcatgcaaggacgacattaactcctacgaatgctggtgcccgtttggattcgaggggaaaaactgtgaactggacgtgacttgcaacatcaagaacggcaggtgtgagcagttctgcaaaaactcagcagataacaaagtggtctgctcatgcaccgagggataccgccttgccgaaaatcaaaagtcgtgcgaaccggccgtccctttcccgtgcgggagggtgagcgtgtcgcagacgagcaagctcacccgcgccgaaaccgtgttccctgatgtggattacgtgaattcgaccgaagcggaaaccattctcgataacatcacgcaaagcacccagtcattcaatgacttcacccgggtggtgggcggggaggacgcaaaacctgggcagttcccttggcaagtggtgttgaacggaaaggtcgacgcgttctgcgggggatcaatcgtcaacgagaaatggatcgtgacggcagcccattgtgtggaaactggagtgaagatcaccgtggtggctggagagcacaatatagaagaaaccgagcatactgagcaaaagcgcaacgtcattcgcataattccccatcacaactacaacgcggcaatcaacaagtacaatcacgacatcgcgttgctggaactggatgaaccactggtgttgaattcgtacgttactcccatctgcatcgctgataaggaatataccaatatctttttgaaattcggcagcggttacgtcagcggatggggacgcgtgttccataaaggcagatcggccctggtcctgcagtacctgcgggtgccactggtcgacagggccacctgtttgttgagcaccaagttcactatctacaataacatgttctgcgcggggttccatgaaggaggtagagactcctgccagggagactcgggcggaccgcatgtgactgaggtggaagggacgagctttctcaccggaatcatttcgtggggagaagagtgcgcgatgaagggcaaatatggaatctacactaaagtctcacgctacgtgaactggatcaaggaaaagactaagctgacc

SEQ ID NO: 9001 - DNA, 1383 bp, Artificial Sequence
  Description of Artificial Sequence: Synthetic coding sequence
atgcaaagagtgaacatgatcatggcggaatcaccaggattgatcaccatctgcctcctcggctacctgctttcggcagagtgcactgtctttctcgaccatgagaacgcaaacaaaatcctcaatagaccaaagcggtacaactctggtaaattggaagaattcgtgcagggtaatctggagcgcgagtgcatggaggaaaagtgctcattcgaggaggcccgcgaagtgtttgaaaacactgaacggactaccgagttctggaagcagtacgtggatggcgaccagtgcgagtcaaatccttgcctcaacgggggctcctgcaaggacgatatcaattcctacgagtgctggtgcccgttcggattcgaaggcaagaactgcgagctcgacgtcacttgtaacatcaaaaacggaaggtgtgaacagttctgtaagaacagcgccgacaacaaagtagtgtgcagctgtaccgaaggatacagactggcggaaaaccaaaagtcatgcgagccagccgtgccatttccgtgtggtcgcgtgtcggtgagccagacgtctaaactgacccgggccgagactgtgttccccgacgtcgattatgtgaacagcaccgaggcagagactatcttggacaacatcactcaatccactcagagcttcaacgactttactagggtcgtgggaggcgaggacgcaaagccgggacagttcccgtggcaagttgttctcaacggaaaggtggatgcgttctgcggaggatcaatagtgaatgaaaagtggatcgtgaccgccgcacactgtgtggaaaccggcgtcaagataaccgtcgtcgccggagagcataacattgaagaaactgaacacactgaacagaagcgcaacgtcattcgcatcatcccgcaccacaattacaacgcggccatcaataagtacaaccatgatattgctctgctggaactcgacgagccgctcgtgctgaactcctacgtcaccccgatctgcatcgctgataaggaatacacgaacatcttcctgaaatttggctcagggtacgtgtctggctggggccgggtctttcacaaagggcgcagcgcgttggtcctgcaatacctgcgcgtgcccctggtggatcgcgccacctgtctgttgagcactaagttcactatttacaataacatgttctgcgcgggtttccatgaaggaggacgggactcctgccagggggattcaggaggtccccacgtcaccgaagtggaaggaacctcgtttctgacgggcatcatttcttggggagaggagtgtgccatgaaagggaagtatggaatctacactaaagtgtctcgctatgtgaattggatcaaggagaaaaccaaactgacc

SEQ ID NO: 9002 - DNA, 1383 bp, Artificial Sequence
  Description of Artificial Sequence: Synthetic coding sequence
atgcagagggtcaacatgataatggcagagagcccaggactcatcaccatctgccttttgggctacttgctgtctgcagagtgtactgtgttcctggaccacgagaatgcaaataagatcctcaaccgccctaagaggtataattctgggaagctagaagagttcgtgcagggcaatcttgaaagagaatgcatggaggagaaatgtagtttcgaggaagcccgcgaggttttcgagaacacggaacgcactactgagttctggaaacagtatgtggacggagatcagtgtgagtctaacccctgtttgaacggcggctcttgcaaggatgacattaattcgtatgaatgttggtgcccgtttggcttcgaagggaaaaattgtgagttggatgtgacctgtaacattaagaacgggaggtgtgagcagttttgtaaaaattctgccgacaataaagtcgtctgcagttgcaccgaaggttacagactggccgaaaatcagaagtcctgcgaacctgctgtcccttttccttgtggcagagtaagcgtgtcacaaacctccaaacttactcgcgccgaaaccgtcttcccagatgttgattatgtgaattccacagaggccgaaacgattcttgacaacattacacagtcaactcagtccttcaacgatttcactcgtgtagtgggaggggaggatgcaaagccggggcagttcccttggcaggtcgtccttaatggtaaggttgacgcattctgcgggggaagcatcgtcaatgagaagtggatcgtgacagcagcccactgtgtcgaaactggcgttaaaatcacagtggtagccggtgaacacaatattgaagagactgagcatactgagcagaagcggaatgtgatccgaattataccgcaccataactataacgcggcaatcaataagtacaatcatgatatagcactactggaactggatgagccattggttttaaactcttacgtcacccccatttgcatagctgataaggagtataccaacatcttcctaaaattcggcagcgggtatgtgagtggctggggccgggtcttccataagggccgatctgctctggtgcttcagtaccttcgcgtccccctggtcgacagggccacttgcttgcttagcactaagtttacaatttacaataacatgttctgtgctggatttcatgagggcgggcgcgactcctgtcagggagatagcgggggccctcacgtgaccgaggtagaaggcaccagctttttgaccggtatcatcagttggggcgaagagtgtgctatgaaaggaaaatacgggatctacacaaaagtatctaggtatgtgaattggatcaaggagaagacgaagctcact

SEQ ID NO: 9003 - DNA, 1383 bp, Artificial Sequence
  Description of Artificial Sequence: Synthetic coding sequence
atgcagcgtgttaacatgatcatggccgaatctcccggtctaattacaatttgcttgctcggctacctcctgtccgccgagtgcaccgtcttcctcgatcatgagaacgctaacaagatcctgaaccgtcccaaacgttacaactcaggcaagcttgaggagttcgtccagggtaacctggaacgtgaatgtatggaggagaagtgcagttttgaggaggcccgtgaagtcttcgagaacaccgaacgcacgacagagttctggaagcagtatgtggacggtgatcagtgcgagtccaacccctgtctgaatggtgggtcatgtaaagacgacatcaactcttacgaatgctggtgcccgtttggtttcgaagggaagaactgtgagctcgacgtcacttgcaacatcaagaacggtcgttgtgaacagttctgcaagaacagtgccgacaacaaagttgtctgctcctgtacggaggggtatcgcctggccgaaaatcagaagtcctgcgaacctgcggtcccctttccctgtggtcgggtcagcgttagccagacaagcaagcttacccgtgccgaaaccgtctttcctgacgtcgactatgttaactccaccgaagcagaaaccatcttggacaatatcactcaaagcacccagtcattcaacgactttacgcgtgtagtcggcggcgaggacgctaagcccggacagtttccgtggcaggttgttttgaatggtaaggtcgatgcattttgtgggggatcgattgttaacgagaagtggatcgtgactgcggctcactgcgtagagaccggcgtcaagatcactgtcgttgccggcgagcacaacattgaggagactgagcataccgaacagaagcgcaacgtcatccgtatcatccctcaccacaattataacgctgctatcaacaagtataaccacgatatcgctttgctggagctggacgagcctctggttctaaacagctacgtcacccctatctgcatcgcggacaaggagtacacaaacatcttcctcaagttcgggtcgggttacgtcagcggttggggtcgtgtctttcataaggggcgtagcgcccttgtgcttcaataccttcgtgtccctctcgtggatcgcgccacgtgccttctctcgactaagttcactatttacaacaatatgttctgtgcgggattccacgagggcggccgagacagttgccagggcgactcaggtggtcctcacgtcaccgaggtcgaggggacctctttcctgaccggcataatctcatggggcgaagaatgcgcaatgaagggcaagtacggcatttatactaaggtgagtagatatgtcaattggattaaggagaagaccaagttgacc

SEQ ID NO: 9004 - DNA, 1383 bp, Artificial Sequence
  Description of Artificial Sequence: Synthetic coding sequence
atgcagcgcgtgaacatgattatggccgagtctcccgggctgattactatttgtttgcttggctatctactctcagccgagtgcaccgtcttcctcgatcacgagaatgcaaataagatccttaatcggcccaagaggtacaattcaggcaagctcgaagaattcgtgcagggtaacctcgagagagaatgtatggaggaaaagtgttcctttgaagaggcacgggaggtgtttgagaacactgagaggacaacggaattctggaagcagtacgtggacggggatcagtgtgagtctaatccttgcctcaatgggggctcgtgcaaggatgatatcaattcatacgaatgttggtgtccatttggatttgaaggcaaaaactgtgaacttgacgtaacatgcaacataaaaaacggacgatgcgaacagttttgcaagaatagtgccgacaacaaagtagtttgctcctgtacggagggttacagattagcggaaaatcagaaaagttgtgagcctgctgttcctttcccttgtggacgcgtcagcgtgtcccagacctctaagctcactagggccgagacggttttccctgacgtggattatgtgaattccactgaggccgagaccatactggacaacatcacacagagtacccagtctttcaacgactttactagggtcgtgggtggggaagacgccaagcctggccagttcccatggcaggtggtcctaaatgggaaggtcgatgctttctgtgggggctccatagtgaatgagaagtggatcgtgactgcagcacattgtgtcgaaactggcgtgaagatcaccgtggtcgctggagagcacaacatcgaggagacagaacacaccgaacaaaaacggaacgtgatcaggattataccccatcataactataacgcagctatcaacaagtacaaccatgacatagcactcctcgagttagacgagccacttgttctgaactcctatgtgaccccaatctgtatagccgacaaagaatacactaacatcttcctgaaattcggaagtggctatgtatctggatggggtagggtattccataaggggcgatcagcattggtactgcagtacctgagggtacctctggtggatcgagccacatgtcttctgtccaccaagttcactatctacaacaacatgttttgtgctggttttcacgagggaggaagagactcctgccagggggacagtggcgggcctcacgtgaccgaggtcgagggaacctcattcttaactgggattatctcttggggtgaggaatgcgctatgaagggaaaatatggcatttacacaaaagtcagtcgctatgtaaactggatcaaagaaaaaacaaagctgaca

SEQ ID NO: 9005 - DNA, 1383 bp, Artificial Sequence
  Description of Artificial Sequence: Synthetic coding sequence
atgcaacgcgttaatatgatcatggccgaatctcccggcctcatcactatctgtctcttggggtatctgctctccgcggaatgcaccgtttttctcgaccatgaaaacgccaacaaaatcctcaaccggccaaagcggtataactcagggaaactcgaggagttcgttcagggtaacttggagagagagtgcatggaagagaagtgctctttcgaagaggctcgcgaggtatttgaaaataccgaacgcaccaccgaattttggaagcagtacgttgacggggaccagtgtgagagcaatccttgcctcaacgggggtagctgcaaagatgatatcaatagctatgagtgttggtgccctttcggattcgaggggaaaaactgtgagttggacgtcacctgtaacatcaagaatggccgctgtgaacagttctgcaagaatagcgccgataacaaggtcgtttgcagttgcacggaaggatatagactagccgaaaatcagaagagttgtgagcccgccgtgcctttcccctgcggacgggtgtccgtctctcaaacctcgaagttaaccagggccgagaccgtcttccccgacgtcgactatgtcaactccacagaggccgagactatcctggacaacattacacagtccacgcaaagcttcaatgacttcacgcgggtggtgggtggagaagatgccaagcctggtcagttcccatggcaggtagttctgaacgggaaagtggacgctttttgcgggggatctattgtaaatgagaaatggatagtaactgctgcgcattgcgtcgaaacaggagtgaaaattacagtggtggcgggggaacataacatcgaagaaactgagcacacggagcaaaaaagaaacgtgatcaggatcataccgcaccataactataatgctgccattaataagtataaccatgatatcgcactgttagagctggatgaacccctggtgcttaactcgtacgtgacgccaatctgcattgcggacaaggagtacactaacatcttccttaagtttgggtcagggtacgtttcggggtggggccgagtgttccataagggccggtcagccctcgtgctccagtatctgcgggtcccgcttgtggacagggccacctgcctgctctcaactaaatttacgatctataacaatatgttttgcgctggcttccatgaaggcggtcgtgactcttgccagggcgactccgggggacctcatgtgactgaggtcgaggggacgtccttcttaacaggcatcatttcttggggcgaagagtgtgcaatgaaaggtaaatacggcatctacaccaaagtgtcccgctacgtgaactggatcaaggagaagaccaagctgaca

SEQ ID NO: 9006 - DNA, 1383 bp, Artificial Sequence
  Description of Artificial Sequence: Synthetic coding sequence
atgcaacgggtcaatatgatcatggcggaatcaccgggcctcatcactatctgcctgctgggataccttctgtccgcggaatgcactgtgttcttggaccatgagaacgcaaacaaaattctgaacaggcctaaacgctacaacagcggaaagctcgaggaattcgtgcagggaaaccttgagcgcgaatgcatggaggaaaagtgcagcttcgaagaggcgcgcgaggtttttgaaaacacggagagaaccaccgagttctggaagcaatacgtggacggggaccagtgtgaaagcaacccgtgcttgaacggaggatcatgcaaggacgacatcaactcttacgaatgttggtgcccgttcggatttgagggcaagaactgcgagctggatgtgacctgcaacatcaagaacggccgctgtgagcaattctgtaagaacagcgcggataacaaggtggtgtgtagctgcaccgagggttaccggctcgcagaaaatcaaaagtcgtgtgagccggccgtgccttttccatgtggaagggtgtcggtgtctcagacctcgaaacttactagagcggaaaccgtgttcccggatgtcgattacgtgaattccacggaggcagaaactatccttgacaacatcacccaatcgacccagagcttcaatgactttactcgagtggtcggaggagaggacgccaaaccgggtcagtttccgtggcaggtggtgctgaatggaaaggtggatgctttctgcggagggtcaatcgtcaacgagaagtggatcgtgaccgccgcccactgcgtggaaacgggagtgaagatcaccgtggtagcgggtgagcacaatatcgaggaaaccgaacatactgaacaaaagcgcaacgtgatccgcatcatcccgcaccacaactacaatgcggctatcaacaagtacaatcatgacatagccctgctcgagctcgacgagccgctcgtgctcaactcctacgtcacgcctatctgcatcgcggacaaagaatacaccaacatcttcctcaagtttggaagcggatacgtgtccggatgggggcgcgtgttccacaaaggaaggagcgccctggtcctgcagtacctgcgcgtgccgctggtggatcgggctacgtgcttgttgagcactaagttcaccatttacaacaatatgttttgcgctggttttcacgaaggtggacgcgactcgtgtcaaggagatagcggaggaccacacgtcaccgaggtggaaggcacgtcattcctgactggcatcatctcgtggggggaggaatgcgccatgaagggtaagtacggcatctataccaaggtgagcagatacgtcaattggatcaaagaaaagaccaagctgact

SEQ ID NO: 9007 - DNA, 1383 bp, Artificial Sequence
  Description of Artificial Sequence: Synthetic coding sequence
atgcagagagtgaacatgattatggctgaatcccccggacttattaccatctgcctgcttggctatttgctgtcagcggagtgcacagtcttcctggatcacgagaacgctaataaaattttgaaccgcccaaaacgctacaacagcggaaagctggaggagtttgtacagggcaaccttgagcgggaatgtatggaggagaagtgcagttttgaagaggcccgggaggtgttcgaaaacactgagaggactacagagttctggaagcagtatgtggacggagaccagtgcgaatcaaacccctgcttgaatggaggttcctgtaaagatgacatcaattcttacgagtgctggtgcccatttggctttgagggaaagaactgtgagcttgatgtcacctgcaatatcaagaacggaaggtgcgagcagttctgcaagaatagcgcagacaataaggttgtgtgtagttgtacagagggatacaggctggccgaaaatcaaaagagctgtgagccggctgtcccatttccatgcggacgcgttagcgtgagccagacctctaagctcacacgagccgaaaccgtattcccggacgtggactacgtcaattccacagaggctgagactatcttggataatattacacagtctacccagagtttcaacgattttacccgcgtcgtcggaggagaggatgctaagcctggtcagtttccctggcaagtcgtgctcaatggaaaagtggacgcgttctgcggtggctcaatcgtgaacgagaaatggatagtgaccgccgcccactgcgtggagactggagtgaagatcactgttgtcgcaggcgaacataacatcgaggagacagagcataccgaacagaaacgcaatgtaattcgaattattccgcatcacaattacaatgccgcgatcaataagtacaaccatgacattgcccttctcgagcttgatgaaccgttggtgctgaactcttacgtgacgccaatttgtattgccgacaaggagtataccaatatctttctaaagtttgggtccggttatgtctctggttggggccgggttttccataaggggcgttctgccttggttctgcagtacttgagagtgcctttggtggaccgggccacatgcttgttgagcacaaaattcaccatctacaacaatatgttttgcgctggattccacgaaggaggtcgtgacagttgccaaggtgactctggagggccacatgtcacagaagtggagggcacgtcttttctcaccggaatcattagctggggggaggaatgcgcaatgaaaggcaaatacggcatttatactaaggtttctcgttacgtaaactggattaaggaaaaaaccaaactgaca

SEQ ID NO: 9008 - DNA, 1383 bp, Artificial Sequence
  Description of Artificial Sequence: Synthetic coding sequence
atgcaaagggttaacatgattatggctgagtcacccggcctcatcaccatatgcctactgggctatttactgtctgctgagtgtacagtttttctcgatcacgagaatgccaacaagatcctgaatcgacccaagcgctacaatagtggcaagctagaggaattcgtccagggtaacctggaacgcgagtgtatggaagagaaatgctccttcgaggaggccagagaggtcttcgaaaatacagaaaggaccacagagttttggaagcagtatgtggatggcgaccagtgcgaatctaacccatgcctgaatgggggctcttgtaaagacgatatcaacagttacgaatgctggtgcccttttggattcgaaggtaagaattgcgaattggacgtgacatgtaacattaagaatggtaggtgcgaacagttctgtaagaattccgccgacaataaggtggtgtgttcatgcaccgagggttacagattggccgaaaatcagaagtcttgcgaaccagcagtcccctttccctgcggccgcgtatctgtcagccaaacctccaagctcacccgcgctgaaaccgtgtttccagatgtcgattatgtgaactccactgaggccgagacaatactggacaacatcacacaatctacacagtcatttaacgactttaccagagttgtggggggcgaagatgctaaacctgggcagtttccctggcaggttgtactgaatgggaaagttgacgccttttgtggaggaagtattgttaacgaaaagtggattgtgaccgccgcccattgcgttgagaccggggtcaagattactgtcgtagctggcgaacataatatcgaagaaacagagcataccgagcagaagcgcaatgtgattcggataataccccaccataactataacgccgccatcaataaatacaatcacgacattgccctgttagagctggatgaaccattagttctgaactcttacgtgacccccatatgcattgcagataaagaatacacaaatatcttcctgaagtttggctcaggatatgtcagcggctggggccgggtgtttcataagggccgctctgcattagtactgcagtacctgcgagttccactggttgacagagccacatgcttgctatccactaagtttaccatttacaacaacatgttttgcgccggctttcatgaggggggcagggattcctgccagggcgattctggagggcctcacgttactgaggtcgaggggacttcctttctcactggcattatttcttggggggaggaatgcgccatgaagggaaagtacgggatttacaccaaggtgtccaggtatgtgaattggatcaaggagaaaaccaaattgaca

SEQ ID NO: 9009 - DNA, 1383 bp, Artificial Sequence
  Description of Artificial Sequence: Synthetic coding sequence
atgcaacgcgtgaacatgattatggcagaatcaccgggactcatcaccatttgccttctgggatacctgttgtcagccgagtgtaccgtgttcctggatcatgaaaatgcgaacaagattctcaaccggcctaagagatacaactcgggtaaactggaggagttcgtgcaaggaaacctcgaaagggaatgtatggaagaaaagtgcagctttgaagaggccagagaggtctttgaaaacactgaaagaacgactgagttttggaagcagtacgtcgacggagatcaatgtgagagcaatccttgtcttaatggcggaagctgcaaggacgacattaactcatacgaatgttggtgtccatttgggtttgaaggcaagaactgtgagcttgatgtgacttgcaacataaagaacggtaggtgtgaacagttctgtaagaactccgcagacaacaaagtggtgtgttcctgcactgaaggttaccggcttgccgaaaatcaaaaaagctgtgagccagctgttcctttcccttgcggaagagtgtcggtgtcacagacctccaagctgaccagagcagaaacggtgttccctgatgtggactacgtgaattcaactgaagcagagacgattcttgataacattactcaatcgacccaatcgttcaatgactttactagagtggtgggcggagaggacgccaagccagggcaattcccctggcaagtggtcctgaatggtaaggttgatgcgttctgtgggggatcaattgtgaacgagaagtggattgtcaccgcggcacactgtgtggaaaccggggtgaagataaccgtggtggcaggggaacacaatatcgaggaaactgaacatactgagcaaaagagaaatgtcattcgtatcattccccatcacaactacaacgccgccatcaacaagtacaaccacgacatagcgttgcttgagttggatgagcccctcgtgttgaacagctacgttactcctatctgtattgcagataaagaatacaccaacatttttctgaaattcggttctggatatgtgtcaggatggggacgggtgttccacaagggacgcagcgcactggtgctccagtaccttcgggtcccattggtggaccgggcaacgtgcttgctgtccactaagtttaccatatacaataacatgttttgtgcaggtttccacgagggagggcgcgattcgtgtcagggggactcgggaggtcctcatgttacggaagtggaaggtactagcttccttaccggtattatctcgtggggggaagagtgcgcgatgaagggcaagtacggaatctacaccaaggtatcccgatacgttaactggatcaaggaaaagaccaagctcacg

SEQ ID NO: 9010 - DNA, 1383 bp, Artificial Sequence
  Description of Artificial Sequence: Synthetic coding sequence
atgcagagggtcaatatgatcatggcagagtctcctggcctgataacaatctgtttgcttggttacctgttgagtgctgagtgcactgtattcctggaccatgaaaacgctaacaagatccttaaccggcccaaacggtataacagcggcaagttagaggagtttgtccaaggaaaccttgagcgggagtgcatggaggaaaaatgctcgttcgaggaagccagggaagtatttgaaaacacggagcgtacgaccgagttctggaaacagtacgtcgatggcgaccagtgcgagtcaaacccctgcctcaacggggggagttgcaaggacgatattaacagctacgagtgttggtgcccatttggcttcgagggcaagaattgtgagctagacgttacgtgcaacatcaagaacggccgatgtgagcagttctgtaaaaactcggcggataataaagtggtgtgctcctgcacagagggatacagactcgcagaaaaccagaagtcgtgcgagcctgcagtgcctttcccatgcgggcgtgtctctgtctcgcagacgtcgaaacttacgcgggccgaaactgtctttcctgatgtcgattatgtcaacagcactgaggccgagactatcttggataatattacccagtctactcaatcatttaatgattttacccgcgtcgtcgggggcgaggacgcgaagccaggtcagtttccgtggcaggtggtgttgaacggcaaggtcgacgcgttctgtggtggctctatcgtcaatgaaaagtggatcgttacagcggcccattgtgtggaaaccggtgtcaagataacagttgtcgctggagaacataatatagaggaaactgagcatacagagcaaaagagaaatgttattcgaattatcccgcaccacaattacaacgccgctatcaacaagtacaaccatgatattgctctccttgaactagacgagccactggtgttgaactcctacgttactccaatttgcatagccgacaaggaatataccaacatctttctgaaattcgggtccgggtacgttagcggctggggcagagtcttccacaagggtagatcggctcttgttcttcaatacctccgtgtacctctggtcgaccgcgcgacatgcctcttatcgaccaaattcaccatctataacaacatgttctgcgcaggttttcatgaaggcggaagggactcctgccagggggacagcgggggaccccatgtcacggaggttgagggcacttcctttctaaccggtatcatttcgtggggcgaagaatgcgccatgaaaggcaaatacggtatctacacaaaggtatctagatacgtaaattggatcaaggagaagactaagctcact

SEQ ID NO: 9011 - DNA, 1383 bp, Artificial Sequence
  Description of Artificial Sequence: Synthetic coding sequence
atgcagcgcgtgaatatgatcatggccgaatcccccgggcttatcaccatctgcctgctcggctacctcctcagcgcggaatgcactgtgttcctcgatcacgaaaacgcaaataagatccttaatcggccgaaaagatacaactccggcaagctcgaagaattcgttcaaggcaacctcgagcgggaatgtatggaggagaagtgttcgttcgaggaggcaagggaggttttcgagaatactgagcggaccactgaattctggaaacagtacgtcgatggtgaccagtgcgaatcgaacccttgcctgaacggaggctcctgcaaagacgacatcaactcatacgaatgttggtgcccgtttggattcgaagggaagaactgtgagctggacgtgacgtgcaacatcaaaaatggaagatgcgagcaattctgcaagaactcggcagataacaaagtcgtctgcagctgcaccgaaggttaccgcctggccgaaaaccagaaatcatgcgagccggcagtgcccttcccatgcggccgcgtgtccgtctcccagacgtcaaagctgacccgcgccgaaaccgtgtttccagacgtggactacgtgaactcaaccgaggcggaaactattctcgacaacatcactcagtcgacgcagtcattcaacgacttcacccgggtcgtgggaggcgaggatgccaagcctggccagtttccatggcaagtggtgcttaatggcaaggtggacgccttctgtggagggagcatcgtgaatgagaagtggattgtgactgccgcacattgtgtggaaaccggcgtgaagatcaccgtggtggccggtgaacacaacatcgaggagactgaacacacggaacaaaagcgcaacgtgatcagaatcatcccacatcacaattacaatgcggcgatcaacaagtacaatcatgatatcgccctgctggaactggacgaaccgttggtgctgaactcctacgtgactcctatctgcatcgccgacaaggaatacaccaatatcttcctgaagttcggaagcggatacgtgtcgggatgggggcgggtgtttcacaagggacgcagcgcgctcgtcctgcagtacctgcgggtgcctctggtcgatcgcgcgacgtgccttctctctaccaaattcaccatctacaacaatatgttctgcgcagggttccacgagggcggaagggactcctgccagggggactcaggaggaccgcatgtgactgaggtggaaggaacctcgttcttgactggaatcatctcgtggggcgaggaatgcgccatgaaagggaagtacggaatctacaccaaggtgtccagatacgtgaactggattaaggaaaagactaaactgacc

SEQ ID NO: 9012 - DNA, 1383 bp, Artificial Sequence
  Description of Artificial Sequence: Synthetic coding sequence
atgcagagagtgaacatgattatggcggaatctcctggactcatcacaatatgcctcctggggtatctcctgagcgctgaatgcaccgttttcctggatcacgaaaacgcgaataagattcttaaccgccccaaacgctacaattctggtaagctcgaggagttcgtccaaggcaacctcgagcgcgagtgtatggaagagaagtgttctttcgaagaggctcgtgaggtgtttgaaaataccgaaaggactacggaattttggaaacaatacgtcgatggagaccagtgcgagtccaacccctgcctgaatggaggcagctgtaaggatgacattaatagttacgagtgctggtgccccttcggctttgaaggaaagaattgcgagttggacgttacctgcaatatcaagaacggaaggtgcgagcagttctgtaaaaattctgccgataacaaggttgtgtgctcttgtaccgaggggtataggttagccgagaatcagaagagctgtgagcctgccgtgccgtttccttgcgggcgggtttcagtgtcacagacaagcaagctcacgcgagctgagacggtattcccagatgtggactatgtgaactctactgaagccgagacgattctcgacaacattacccaaagcacacaatcttttaatgattttacaagagtagtgggcggtgaagacgctaaacccggacaatttccgtggcaggtagttcttaacggtaaggttgatgccttctgtggcggttccatagtgaacgaaaaatggatcgtgaccgccgctcactgcgtggagaccggggtaaagataaccgtggtggccggggagcacaatattgaggagaccgagcatactgagcagaagaggaacgttattagaataattcctcaccataattacaatgctgcaattaataagtacaaccacgatatcgccctgctggagttggacgagcccttggtgcttaattcttatgtcacccccatctgcatcgcagataaagaatatactaacattttcttgaagtttggttcagggtacgtatctggctggggccgagtctttcataagggaaggtccgccctggtgttgcagtacctgagggtccctctggtggatagagcaacctgtctcctgtccacaaaatttacgatctataacaatatgttctgtgctgggttccatgaagggggcagagatagttgccaaggagattctggcggtccacatgtgacagaagtcgaaggtacgagctttcttaccggcattatcagttggggagaggaatgtgccatgaaagggaaatacggcatttacacaaaagtgtctcgctacgtcaattggatcaaagaaaaaaccaaactgacc

SEQ ID NO: 9013 - DNA, 1383 bp, Artificial Sequence
  Description of Artificial Sequence: Synthetic coding sequence
atgcagcgtgtgaacatgataatggcggagagcccaggcttgataacaatttgtctattagggtatcttctgtctgccgagtgcactgttttcctcgatcatgagaacgcgaataaaatcttaaatcggcccaagcgctacaacagtgggaagctggaggagttcgttcagggcaacctggagagagaatgtatggaagagaagtgttcgttcgaggaagcaagagaggtcttcgaaaatacagagagaaccactgagttttggaagcagtatgtggatggcgaccagtgtgagtcaaatccatgtctgaatgggggtagctgcaaggatgatattaattcctatgaatgttggtgccctttcgggttcgagggcaagaattgcgagcttgatgtcacgtgtaatattaagaatggccggtgcgagcagttttgtaaaaacagtgctgacaacaaggtggtctgttcatgcactgagggctaccgcctggccgagaatcagaagtcttgtgaacctgcagtgccgtttccctgtggaagggtctcagtgtcccagaccagcaagctgactcgggccgagactgttttccctgatgtcgattacgtgaacagtacggaggctgaaaccattcttgataacattacgcaatcaacacaatcatttaatgattttaccagagtcgtcgggggagaggacgccaagcccggacagttcccttggcaagtagttctcaacggaaaagtcgatgctttctgcgggggatctatcgtaaatgagaagtggatcgtgaccgccgcgcattgcgttgagacgggggttaaaattacggtggtagccggcgagcacaacatcgaggaaaccgagcacaccgagcagaaaaggaacgtgatccgaatcataccccaccacaactacaatgccgccattaacaaatacaatcatgatattgcactccttgaactggatgaaccgttggtgctcaattcctacgtgactcctatatgcatagcagacaaagaatatactaatatcttcctcaagttcgggagcgggtatgtttccggatgggggcgggtttttcataaggggcgctccgccctcgtgctccaatacctccgcgtgccattagttgatcgagccacttgcctcctcagcactaagttcacaatctataataacatgttttgtgcaggtttccacgagggtggacgagattcatgtcaaggcgacagcggcggtccccatgttaccgaggttgaaggaacgtcattcctcacagggattatttcctggggtgaggagtgtgctatgaaaggtaagtacgggatatacactaaagtgagtagatatgtgaattggatcaaagagaaaactaaacttacc

SEQ ID NO: 9014 - DNA, 1383 bp, Artificial Sequence
  Description of Artificial Sequence: Synthetic coding sequence
atgcagagagtgaatatgatcatggctgagtcccctgggctgattactatttgcctgttgggttacctactatctgccgaatgtaccgtattcctagatcatgagaacgccaacaagatcttaaatcgacctaaacgatataattcgggtaagttagaggagttcgtccagggaaatctcgaacgagagtgtatggaggagaaatgctcattcgaggaagctagggaggtattcgagaacactgagcggaccaccgaattctggaagcagtacgtagacggagaccaatgtgaatcgaacccctgccttaatggcggatcctgcaaggatgacatcaatagctacgaatgttggtgccctttcggtttcgagggcaaaaactgtgaattagacgttacctgtaatatcaagaacggccggtgtgagcaattctgcaagaattccgcggataataaggtagtgtgcagttgtaccgagggctaccgcttggccgagaatcaaaagtcctgcgagcctgccgtgcccttcccttgtggccgcgtgtcagtaagtcagacttctaagctgacacgagcagagaccgttttcccggatgtcgactacgtgaattcaaccgaagcggagactattctagataatattacccagagcactcagagcttcaacgacttcacccgcgtcgtgggcggcgaagatgccaagcccgggcaatttccatggcaggtggttcttaatggcaaagtggacgccttctgcgggggatcaattgtgaacgagaaatggatcgtgacagccgctcactgcgtggagactggcgtaaagatcactgtggtcgccggggagcacaacatcgaggagacagagcacacggaacagaagaggaacgtgattcgaattatccctcatcacaactataacgccgcaatcaacaaatacaaccacgatattgcgctcctcgaactcgacgagcccctcgtcttgaattcttatgtgaccccgatttgtatcgctgacaaggaatacacaaatatctttctcaaatttggctctggctatgtgtcagggtggggccgggtgttccataaaggccgttcagcactggtcctgcagtatttgcgcgttcccctggtagaccgcgcaacttgcctgttgtccactaagttcaccatatacaataatatgttttgtgctggatttcacgaaggcgggagggattcttgccagggtgattcaggggggccccatgtcaccgaggtggaaggtacatcttttctgacagggataatctcttggggtgaggaatgtgctatgaagggtaaatatggcatctacacgaaagtgtccaggtacgtgaactggatcaaggagaaaactaagcttaca

SEQ ID NO: 9015 - DNA, 1383 bp, Artificial Sequence
  Description of Artificial Sequence: Synthetic coding sequence
atgcagcgcgtcaacatgattatggcagaatcgcccgggctgataaccatatgtcttttggggtacttgttgtccgcagaatgtactgtctttctggatcacgaaaacgctaacaaaatccttaatcgtcctaaacggtacaactccggaaaactcgaagaattcgttcagggaaaccttgagcgcgagtgtatggaagaaaaatgttcgttcgaagaagccagagaggtgttcgaaaacacggagcggactacggaattttggaagcagtatgttgacggggaccagtgtgaatcgaacccatgcctgaatggtggttcttgcaaggatgacattaacagctatgaatgctggtgccccttcggattcgagggcaagaactgtgagttggatgtgacttgtaacattaagaacgggagatgtgaacagttctgtaagaattccgctgataacaaggtggtgtgtagctgcaccgaaggttacaggctcgccgaaaaccagaagtcctgtgagcctgcagtcccttttccatgtggtcgagtctccgtgtctcaaacttccaaacttactcgcgcagagactgtgttccccgacgtcgactacgtgaattcaactgaggcggaaactattctcgacaacataacccaatccacgcagtcgtttaacgactttacccgggtggtgggaggtgaggacgccaaacccggacagtttccatggcaggtggtgctgaatggaaaagtggatgcgttttgtggggggtcaatcgtgaacgagaagtggattgtgaccgcagcacattgtgttgaaacgggtgtgaagatcaccgttgtggcgggtgaacacaacattgaagaaactgagcataccgaacagaaacgcaacgtgatccgcatcatccctcaccacaactataacgcagcgatcaataagtacaatcatgatatagccctgctggaattggacgagccacttgtgcttaatagctacgtcacccctatttgcatcgcagataaggagtacaccaacattttcttgaagtttggatcaggttacgtttcaggatggggaagagtctttcataagggacgttccgcactggtgctccaataccttagagtgcctctggtggatagagcaacctgtctgctgtccacgaagtttaccatttacaacaatatgttctgcgcaggttttcacgagggaggccgcgattcgtgtcagggcgattcggggggtcctcatgtgaccgaagtcgagggaaccagctttcttactgggatcatttcatggggtgaggaatgcgccatgaagggtaagtacggaatatacaccaaggtgtcgcgctacgtgaattggatcaaggaaaagaccaaactgacc

SEQ ID NO: 9016 - DNA, 1383 bp, Artificial Sequence
  Description of Artificial Sequence: Synthetic coding sequence
atgcaacgggtcaatatgataatggctgaaagtcccgggctgatcaccatctgtttgctcggttatctcctgtctgcagagtgtacggtcttcttggatcatgagaacgccaacaagatcctgaacaggcctaaacgctacaactccggtaaattggaggagttcgtgcagggcaacctggaacgggagtgcatggaagagaaatgtagcttcgaggaggccagggaggttttcgagaacaccgaacggactacggagttctggaagcagtacgtggatggagatcagtgtgagtctaatccctgtctcaacgggggtagttgcaaagacgatattaacagctacgagtgctggtgtcctttcggatttgaaggaaagaattgcgagttggatgtgacttgcaatattaagaatggtcggtgcgaacagttttgcaagaacagcgcagacaataaagttgtttgctcatgcacagagggatatcgccttgcagagaatcagaagtcttgtgagccggccgtgccgtttccctgcggccgggtatctgtatcccagaccagcaaactgacccgggccgagaccgtgtttcccgatgtggactatgttaactccactgaggccgagacaattctggacaacatcactcagagtacccagtcctttaacgattttactagagttgtgggcggtgaggacgcgaagcccggtcaattcccatggcaagtggtcctgaacgggaaggtggacgccttttgtggcggatctatcgtgaacgaaaagtggattgtcacagccgcacactgtgttgaaacaggggttaaaattaccgtcgtggccggggagcataacatcgaggaaacagaacacacagagcagaaaagaaacgtgattcgcataatccctcaccataactacaacgctgcaatcaataaatataatcacgacattgctctgctggagctcgatgaaccgttggtgctgaatagctatgtaaccccaatctgcatcgccgacaaagagtataccaatatcttcctgaagttcggcagcggctacgtctccggatggggaagggtattccacaaaggtcggagtgcccttgtgcttcagtacctccgggtcccgctggtggatagggcaacttgcctgctcagtactaaatttaccatttacaacaacatgttctgtgcaggatttcacgagggcgggagggacagctgtcaaggcgactctggtggcccccacgtcacggaggtggaaggaacctcctttcttacaggtatcatctcctggggggaggagtgtgcaatgaagggaaaatatgggatatatacgaaagtctcccgctatgtgaattggatcaaggaaaaaaccaagctgact

SEQ ID NO: 9017 - DNA, 6672 bp, Artificial Sequence
  Description of Artificial Sequence: Synthetic coding sequence
atgttccctggatgccccaggctttgggtcctcgttgtgctgggtacatcatgggtggggtgggggtcacagggaaccgaagccgcccagcttcgccaattttacgtcgctgctcagggtatcagctggagctataggcctgaacctacaaattcgtcattaaatttatctgtgacaagctttaagaagattgtgtacagagaatacgagccgtactttaagaaagaaaagccccagtccacaataagcggcctgctaggcccgacgctgtatgccgaggtgggcgatatcatcaaagttcactttaaaaacaaagctgataaacccctttctatccatcctcagggaatccgatattctaaactgagcgagggcgcctcctaccttgaccacacattccccgccgaaaagatggacgatgcagtggcaccaggcagagaatacacctatgagtggtcaatctcggaagactctggcccaacacatgacgaccctccttgcctcacacatatctactactcacacgagaatctgattgaagattttaattctggtctgatcggcccactcctaatatgtaagaaggggaccttgaccgaaggcggaacacagaaaacttttgacaaacaaatcgttctgcttttcgctgtgttcgatgaatctaagtcctggtctcagagctcttcattgatgtacacggtaaacgggtacgtgaatggcacgatgcccgacatcaccgtctgtgcacatgatcacatctcttggcacctcctcggtatgagctccggccccgaactgttttctatccactttaatggacaagtgctcgaacagaatcaccataaggtgtccgccataactctagtgtctgctacttctaccaccgcgaacatgacagtcggcccagaaggtaagtggatcatctcttccttgacgcctaaacatctgcaggctgggatgcaggcctacatagacatcaaaaattgtcctaagaaaacaaggaacctgaagaagattacgagagagcagcggcgtcacatgaaaagatgggagtattttatagccgcagaagaagtaatctgggattatgcccctgtgattcccgccaatatggacaaaaaataccgaagccagcacctggataacttttctaatcaaattgggaaacactataagaaagtgatgtatacacagtatgaagacgaaagtttcactaagcataccgtaaatccaaatatgaaagaggatggaattctggggccaattatcagggcgcaagtgagggacacactcaaaatcgtgtttaagaatatggcttctaggccctacagtatatacccacacggggtgactttcagtccttatgaagatgaggtcaacagcagtttcacctccggtagaaacaacaccatgatcagagcggttcaaccaggagagacatatacctacaagtggaatatcttggagttcgacgagcccaccgagaatgacgcgcagtgtttgacgcggccatattacagcgatgtggatattatgagggacatcgcctccgggctgatcgggctgctgctgatctgtaagagccgatccctggataggcggggcatacagagagcagccgacattgagcagcaggcagtgtttgctgtctttgatgagaataagagctggtacttggaggataacattaataaattttgtgagaatccagacgaggtgaagcgtgacgatcccaagttttatgagagtaacattatgtcaaccatcaatggctatgtacccgagtccatcaccaccctagggttttgcttcgatgacactgtccagtggcacttttgcagcgttgggacacagaacgagattcttaccatccacttcacaggccactcctttatttatggaaagcgccacgaagatacccttacactgttcccaatgaggggggaaagcgtaactgtcaccatggataacgtcggtacctggatgctgaccagcatgaattctagcccacgcagcaagaaactacgtctcaagttccgtgacgtgaaatgcatccctgatgatgacgaagactcttacgaaatttttgagccacccgaaagcacagtgatggccactcggaaaatgcacgatcgactggagccggaggatgaagaaagcgatgccgactacgattatcagaatcggctggccgccgccctgggaatccggagcttccggaacagcagccttaatcaagaagaggaagaattcaacctcaccgccctggcactcgagaacggcactgagttcgtcagcagcaacacggacatcattgtaggttctaattactcgtcccctagcaacatatctaagtttactgtgaataacctcgcggagccccagaaggcaccctcgcatcaacaggcaaccactgccggaagcccattgaggcatcttatcgggaagaacagcgtcctcaactcttccaccgcagagcactcctctccctatagtgaagatccaatcgaggatcccctccaaccggatgtgacggggatcagattattgtccctgggagcgggggaattcaaatctcaggagcatgccaaacacaagggcccaaaggtggagagagatcaagccgctaagcacagattcagttggatgaagcttctcgctcacaaggtgggtaggcatttgtcgcaggataccgggtccccaagcggcatgagaccctgggaggacctgccctctcaggacaccggatctccaagcagaatgagaccttggaaggacccacctagcgatctcctgctgttgaaacagagcaactcttccaagattcttgtcgggaggtggcacttggcctctgagaagggctcctacgagatcatccaggatacagacgaagacacagcggtcaacaattggctcatctcgcctcagaacgcctccagggcttggggagagtccacgcctttagccaacaagccaggcaaacagagcgggcatcctaagttccctagggtgcgtcataagtccctgcaagtgcgccaagacggggggaagtccagacttaagaaaagccagtttctcatcaaaacacggaagaaaaagaaggagaagcacacgcaccacgcacctttgtcacctaggacatttcatcctcttcgatccgaggcctataataccttttctgaacggaggctaaagcatagtctggtgctgcacaagtctaatgagacctctttgcctaccgatctaaaccagaccctaccctctatggattttggatggattgcgtcgcttccagatcacaaccagaattcttctaatgataccgggcaggcaagttgtcctcccggcctctatcagactgtcccgccggaggagcattatcagacattccctatccaggacccagatcagatgcactccaccagcgacccttctcatcggagttctagtccagagctgagcgagatgctggagtacgatagatcacacaaatccttcccaactgacatcagccagatgtctccctcatccgagcatgaagtctggcagaccgtgatttcaccggacctgagccaggtgacactgtctcccgagctctcacagacaaacctcagcccagatctgtcccatactacacttagcccggaactgattcaaaggaacttgtctccagcccttggccagatgccaatttctcccgacttgagtcatacaaccctcagtccagatctgtctcataccactctatccctcgacctgagtcagacaaatctctcgcctgaactcagccagactaatctctctccggctctggggcaaatgcctctgtctccagatctgtcgcataccactttgtctctggacttctcccaaactaacctctcacctgaactgagccacatgacgctgtcgcccgaattgagccaaacgaacctgagccccgcattagggcaaatgcctattagcccagacctgtcccatacaacattgtccttggacttctctcagacaaatctgtcgcccgaactgtcccagaccaatttgagtcctgcgttgggccagatgcccctgtctccagatcctagtcatacaaccttgtccttggatctgagccagacaaatctgtcacccgaactttctcagacaaacttaagtccagacctgtctgagatgccgctgtttgcagacctttcacagattcccctgacccctgatttggaccagatgaccctgtcgcctgatctgggtgaaacggacctgagtcctaatttcggacaaatgagcctctcgccggacctctcccaagtgacactgtccccagatatttctgacactaccctactccccgacctgtcgcagatctccccacctccagaccttgaccaaatcttctacccctctgagtcctcacagtccctgttgctacaggagtttaacgagagtttcccttatcccgatctggggcagatgccatcaccaagctcaccaacactaaacgatacatttctttctaaggaattcaaccccctagtcatcgtgggtctaagtaaagatggcactgattatatcgaaataatccctaaagaagaggtacaatcctccgaggacgactacgctgagatagattacgtgccctacgacgacccatacaaaaccgatgttcgcacgaatattaatagtagtcgtgacccagacaatattgctgcctggtacctgcgtagtaacaatggcaatcgacgtaattattatattgcggcggaggaaatttcttgggactatagtgagtttgtccaaagggagacagatatagaagattctgacgacattcccgaggatacaacttacaaaaaagtggtgttcaggaagtacctagatagcactttcacgaagagagacccccggggggagtatgaggaacatctcgggatcttaggacctattatcagagcggaggtcgatgatgtgatacaggttcgatttaagaatctagcgtcccggccatactcgctgcacgcccacggtctgtcctatgagaaatcctccgagggtaagacttatgaggatgatagcccggaatggtttaaggaggacaacgcagtccaacctaatagctcgtacacttatgtgtggcacgcgactgagaggagtggccccgagagccctgggtctgcgtgtcgagcttgggcctactacagcgccgttaaccccgaaaaagatattcatagtgggctgatcggaccgctgcttatttgccagaagggcatcctgcacaaagattctaacatgccaatggacatgcgtgaattcgtgcttttgtttatgacatttgatgaaaaaaagagttggtattacgagaaaaagagtagatcatcgtggcgcctgacctcgtctgagatgaagaagtcccacgaattccacgcgatcaatggaatgatctatagcttaccaggcctcaagatgtacgaacaagagtgggtccgactccacctgctaaacatcgggggatcccaggacatccatgtggttcattttcatggccaaacgttgttagagaacggaaacaaacaacatcagttgggagtgtggcctctcctcccaggcagttttaaaacccttgaaatgaaggccagcaagcccggctggtggttgctcaataccgaggtgggcgaaaaccaacgcgcggggatgcaaaccccttttttaattatggaccgcgattgcaggatgcctatgggattatctaccggaatcatttcagattcgcaaattaaagcgagcgaatttctgggctactgggagccccgactggctaggctgaacaacggcggatcatacaatgcgtggtccgttgagaaactggcagctgagttcgcctccaaaccctggattcaggtcgatatgcagaaggaggttattattacaggcatacagacccagggagcaaagcactacctcaagagttgctataccactgagttctacgtggcatactcctccaaccagatcaactggcagattttcaagggaaactctacacggaacgtgatgtatttcaatgggaactccgatgccagtaccattaaagagaaccaatttgatcctcctatagtcgctcggtacattcgcatatctccaacccgcgcgtataaccgtcccaccttgagactcgagctgcagggctgcgaggttaacggctgtagcacacccctggggatggagaacggcaagattgagaacaaacaaattactgcatcttcatttaagaagagctggtggggcgattattgggagccttttagggccaggctgaacgcacagggccgtgttaatgcatggcaggccaaagctaataataacaagcagtggctggagattgacctgttgaagatcaagaaaattactgccataatcacgcagggatgcaagagcctgtcctccgaaatgtacgtgaagtcctatactatccattactcggagcagggagtcgaatggaaaccctatcgcctcaagtcctctatggtcgacaaaatcttcgagggcaacaccaacaccaagggtcatgtcaagaatttctttaatcctccaatcatatcccgctttatccgagtgatccctaaaacatggaatcagtccatagccctccgcctggaactatttggctgtgatatatac

SEQ ID NO: 9018 - DNA, 6672 bp, Artificial Sequence
  Description of Artificial Sequence: Synthetic coding sequence
atgttccctggttgccctcgcctgtgggtcctggtggtcctgggcacatcctgggtgggatgggggagccaagggactgaggctgcccagctcaggcaattttatgtggcagcccaagggatcagttggtcttatcggcccgaacccactaattcaagccttaatctctcagttacgagcttcaagaagatagtgtatagggaatacgaaccgtacttcaagaaagagaaacctcagagcactattagtgggcttttgggacctacgctatacgccgaagtaggggatataataaaggtgcactttaagaacaaggcagacaaacctttgtccatccacccacagggtatacgatacagcaagctctccgaaggggccagctatctcgatcatacttttccagcggaaaagatggacgatgccgtcgcccctggcagagaatacacctacgagtggtctatctctgaagattccggccccacccacgatgaccctccgtgcctgacccacatttattatagtcatgaaaatttgatcgaggattttaattccggtttgatcggaccacttttaatctgcaagaaaggcacactcactgaaggaggaacccagaaaactttcgacaagcagattgtcctcttattcgccgtcttcgacgaaagcaaaagctggtcacagtcaagttcactgatgtacacggtgaatggatacgtgaacggcacgatgccggacataacagtatgcgctcacgatcacatctcatggcacttgttgggtatgtcaagcggcccggaactctttagcatccactttaatggccaggtgttagagcagaatcaccataaggttagtgccattacactagttagcgcaaccagcacaacggccaatatgactgtgggtcccgagggaaagtggattatctcctcactgacacctaagcacctccaggcaggcatgcaggcctacatagacattaagaattgtcccaaaaagacccggaatctgaaaaagattacaagagaacagagaagacacatgaagagatgggagtactttattgctgccgaggaagtgatctgggactacgcaccagtgatccctgcaaacatggacaagaaatatagaagtcagcacctggacaacttttccaatcaaatcggcaagcactataagaaggtgatgtacactcagtatgaagatgaatcttttaccaaacacaccgtcaaccctaacatgaaggaggacggaatcttgggcccaatcatcagggcgcaggttagagatacattgaaaatcgtctttaaaaacatggcatcgaggccatattctatctaccctcacggggtgactttctcaccatatgaggacgaggtgaattcctcttttacctcaggacgaaacaatacaatgatcagagcggtgcagcccggagagacctatacctacaagtggaatatcctggaattcgatgaaccaaccgagaacgacgcccagtgtctgactcgaccatattatagtgacgtagatatcatgcgggatattgcctctggcctgatcgggctgctgctgatctgcaaatcacgctctctcgatcgtagaggcatacagcgtgctgctgatatcgaacaacaggccgtcttcgctgtgtttgacgaaaacaagagttggtacctagaggataatatcaacaaattttgtgaaaatcccgatgaggtgaagcgagacgatccaaaattttacgagtccaacataatgtccacaattaacggttatgtaccggagtccattacgactctagggttttgcttcgacgacaccgtgcagtggcacttctgcagtgtcggaacacagaacgaaatactgacgatccattttaccggacattcctttatttatggaaagcgccacgaagatacgctcacactcttccccatgcgaggcgagtcggttactgtgacaatggataatgtggggacctggatgctgacttccatgaattcaagccctaggtcgaagaaacttaggctgaagtttagggatgtcaagtgtatccctgatgatgacgaggacagctacgagatctttgagcctcctgaatcgaccgttatggccacccggaagatgcacgatcggcttgagcccgaggatgaggagtcggatgccgactacgattaccaaaataggttggcggccgccttaggaatccgatccttcaggaattcgtccctcaaccaagaagaagaggaatttaacctaactgctctggcccttgagaacgggactgagtttgtttcaagcaacaccgacatcattgttggcagtaattatagcagcccatccaacatctcaaaattcactgtcaataatctcgccgaaccccaaaaagccccttcacatcaacaggctactacagccggaagccccctaagacacctgatcggcaagaacagcgtgctcaattcatccactgccgagcactcatcaccatattcggaggatcctatagaggaccctttgcagccggacgtgactggaatcagactgctttctctgggcgcgggagaattcaaaagtcaggagcatgctaagcataagggaccaaaggttgagcgtgatcaagctgcgaaacacaggttttcatggatgaagctactggcccacaaggtgggacgccacctgtcccaggacaccggctcccccagtggaatgcggccatgggaggacttgccctcccaggataccggcagcccatctcgaatgcgcccttggaaagatccacccagtgatctgctgttgctcaaacaatctaactccagcaaaattctggtgggccgctggcatctggctagtgaaaagggcagctatgagataattcaggacacagatgaagacaccgccgtgaacaactggttaattagtcctcaaaatgcgagcagggcctggggagagtctacccctctcgctaataaaccgggcaagcaaagcggccaccccaagttcccgcgggtgcggcataaatccttgcaggttcgtcaggacggaggaaaaagtaggttaaaaaaaagtcagtttcttattaagactaggaagaagaagaaagagaaacacacacatcatgcgccattgagccctaggaccttccatccactacgctccgaggcatataatacgttttctgaaagacgcttaaaacactctctcgtgctccacaagtctaacgagacgagtttgcccacagatctcaaccagacgttgccatcaatggacttcggttggatcgcctcgttacccgaccacaatcagaattcttccaacgacactggacaagcaagctgtccccccggcctataccagacagtgccccccgaggaacactatcaaaccttccctatccaggacccagatcagatgcattcaacgagcgatccaagccatcgctcttcctccccggagctaagtgagatgctggagtatgaccgaagccataagtcatttccaacggatattagccagatgtctcccagctccgaacacgaagtgtggcagaccgtcatctcgccagatttgagccaggttactctgagcccggagctgtcacaaaccaacctctcccccgacctatcacatactactctgtcaccagagctgattcaacgcaacctgtctcccgcattgggccaaatgcccattagcccggacctgtcccatacgacactttcccccgatctatcccacaccacgctctcactagacctgagtcagacgaatctttcccccgaactgagccagactaacctgagtccagcactcgggcagatgcctttgtcacccgacctgtcgcacactaccttgtctctggacttttcacagacaaatctgtctcctgagttgagccatatgaccctttcccctgagttgtcacagacgaatttgagccccgcgctgggtcagatgcccatcagtcccgatctcagccacaccaccctgagcctggacttttcccagaccaacctgagccctgagttatctcaaaccaacctgtcccccgcattaggtcagatgcccttgtctcccgatcctagccataccacgctgagtctggatttatcccagaccaaccttagcccggaactgtcccagaccaacctgagcccagatctcagcgagatgccgctgtttgccgaccttagtcagatccctctgacccctgacctggaccagatgactctgtctccggacctcggagagaccgatttgtcacccaatttcgggcagatgagccttagcccggatttatcccaggtgaccctgagccctgatatcagtgatactacacttcttcccgatctttctcagatatcccccccgccagacctcgatcaaatcttttatccgagcgaatcgtcacaatctctgctgctgcaggagttcaacgagagctttccctatccagatctcggacagatgcctagcccttcgtcaccaaccctcaatgacactttcttgagtaaagaattcaaccctctcgtcatcgtggggctaagtaaagacgggacagattacatcgagattatcccgaaagaggaagtccagagcagtgaggatgattatgcggaaatagactacgtgccgtacgacgacccctataagaccgacgtcagaaccaacattaacagtagtcgcgacccagataatatcgctgcatggtacttacgcagtaacaatggaaatcgccgcaactactatatcgctgccgaagagatatcctgggattatagcgagtttgtgcagcgcgaaactgatatcgaggatagcgacgacatccctgaagacaccacctacaagaaggtggtgttccgtaagtacctggacagcacattcaccaaaagagatccaaggggagaatatgaggagcatttaggaatcttgggtccgatcattagagctgaggtggatgatgtaattcaagtacggttcaaaaacctggcttcaaggccatattcactccacgcacatgggttgtcttatgagaaatcaagcgaggggaagacctatgaggacgacagccccgagtggtttaaagaggataacgctgttcagcctaatagcagctatacttacgtttggcacgccacagagaggtccggacccgagtctccaggatcggcatgtcgagcctgggcgtactacagtgctgtgaacccagaaaaggatatccatagcgggttgatcggcccgctcttgatctgtcagaaaggaattctacacaaggattccaatatgccaatggacatgcgggaattcgtgctgctgtttatgactttcgacgagaagaaatcatggtattatgagaaaaaaagcaggtcgtcctggcgcctgacatctagtgaaatgaaaaaatcccacgaattccatgccatcaacggcatgatctattctctgcctgggcttaagatgtacgaacaagaatgggtgagactccatctgcttaacattggcggatcccaagacatccacgtcgtgcactttcatggacagactctcctcgagaacggcaataagcagcaccagcttggagtgtggccattgcttcctggtagttttaagacattggagatgaaggccagcaagcctgggtggtggctcctgaacacagaagtgggggaaaaccagcgggccggaatgcagacccccttcctcataatggacagggactgcaggatgcccatggggctctcaactgggatcattagcgactcccaaataaaggcttcagaatttctgggttactgggaaccacgactcgctagattgaacaacggcggatcatataacgcctggtcagtggaaaagctggctgccgagttcgcatccaagccatggatccaggtggatatgcagaaagaggttattatcacagggatccaaacccagggggctaaacactacttgaaaagctgctatactaccgaattttatgtagcttattcctctaaccagatcaattggcagatctttaagggcaattcgacccgcaatgtcatgtattttaacgggaactcggatgccagtacgatcaaagagaatcagtttgaccctcctatcgtggccagatatatccgaatcagcccaacacgggcgtataatagaccaactctcaggctagagttgcagggttgcgaggttaacggttgctccactcccctagggatggagaacgggaaaatcgagaacaagcaaattaccgcgagcagcttcaaaaaatcctggtggggtgattactgggaacctttccgagcacgtctcaacgctcaagggagggtgaatgcgtggcaagccaaggctaacaacaataagcagtggcttgaaatcgatctgcttaagataaaaaaaatcaccgccatcataactcagggctgtaagagccttagcagcgagatgtacgtgaagagctataccatccactactctgaacagggcgtggaatggaaaccttacagactcaagagttctatggtggataagatctttgagggcaatactaacaccaagggccatgttaaaaacttcttcaaccccccaatcatcagccgcttcattcgcgtgatccccaagacctggaaccagtctattgctctgcgcctcgagctgtttgggtgtgatatttac

SEQ ID NO: 9019 - DNA, 6672 bp, Artificial Sequence
  Description of Artificial Sequence: Synthetic coding sequence
atgttccctggatgcccgcggctgtgggtgcttgtggtgctgggcacctcctgggtgggatggggctcacaaggaactgaagcggctcagctgcgccaattctacgttgcagcccagggaatcagctggagctaccggccagaacctaccaattcatcccttaatctctcggtcaccagcttcaagaagatcgtgtaccgggaatacgaaccgtacttcaagaaggagaagccgcaatccactatctccggcctgctgggaccgactctttacgcagaagtcggcgacataatcaaagtacactttaagaacaaggccgacaagcctctgtcgattcatccgcaaggcatccgctattcgaagctcagcgagggtgcgtcgtatttggatcatactttccctgccgaaaagatggacgatgccgttgcgccgggccgcgaatacacctacgagtggtccatttcagaggacagcggtccaacgcacgacgacccgccttgccttactcatatctactactcccacgaaaacctgatcgaagatttcaatagcggtcttatcgggccacttttgatctgcaagaaaggaactctgactgagggcggaacgcagaaaactttcgacaagcaaatcgtcttgctgttcgcggtgtttgacgagtcaaaatcctggtcgcaatcatcgtcactgatgtacaccgtgaacggatacgtgaatggaaccatgcccgacatcacggtgtgcgcccacgaccatatctcctggcatctcctcgggatgtcaagcgggcctgagctgttctcaatccacttcaacggacaagtcttggagcagaatcatcacaaagtgtcggccattaccctggtgtccgcaacctcgaccactgcaaacatgacggtgggacccgagggaaagtggattatcagttcactcaccccaaagcacctgcaggctggcatgcaggcgtacatcgacatcaagaactgtccgaaaaagactcgaaacctgaagaaaatcacccgggaacagcgcagacacatgaaaaggtgggaatactttatcgcagctgaggaggtgatctgggactacgcaccggtaatcccggcgaacatggacaagaagtaccggagccaacacttggacaacttctccaatcagatcggaaagcactacaagaaagtcatgtatacccagtacgaggacgagtcctttaccaaacatactgtgaatcccaatatgaaggaggacggcatcctcggacccatcatcagagcccaggtgagggacacccttaagatcgtgttcaagaacatggcatcaagaccttattccatctatccacacggagtgaccttcagcccttacgaagatgaggtgaacagcagctttacttccggtcggaataacactatgatccgcgctgtccagccgggagaaacgtacacgtacaaatggaatattctggaattcgacgagcctaccgaaaatgatgctcaatgcctcacgcgcccctactacagcgatgtcgacataatgcgggatatcgcgagcggactgatcggattgctgctcatttgcaagtcgcgctcgctggatcggcgcgggatccagagagccgcagacatcgaacagcaagcagtctttgccgtgttcgatgagaacaagtcatggtatttggaggacaacatcaataagttttgcgaaaacccagacgaagtgaaacgcgacgatccgaagttctacgaatccaacatcatgtctaccatcaacgggtacgtgccggagtcgatcaccaccctggggttctgctttgacgataccgtgcagtggcatttttgctctgtcggaacccagaacgagatcctcaccatccacttcaccggccatagcttcatctacggcaagcgacacgaggacaccctgactctgtttccaatgcgcggggaatccgttaccgtgactatggacaatgtcggaacttggatgctgactagcatgaactcatctccgcgtagtaaaaagctgcgtttgaaattccgggatgtgaaatgcatcccagatgacgacgaagattcgtacgagatcttcgaaccgcccgagagcactgtgatggccactcggaagatgcacgatagactggaaccagaggatgaagagtcggacgcggactacgactaccagaacagattggcggccgctttgggaatccgaagtttccgaaacagcagcctgaaccaggaagaggaggaattcaacctcactgcgctcgctctggaaaatggcaccgaattcgtgtcgagcaacaccgatatcattgtgggctccaactacagctcgccttcgaacatctcgaaattcactgtcaataacctcgccgaaccccagaaagccccctcgcatcagcaggccaccaccgccgggtccccattgcggcacctgatcgggaaaaactccgtgctcaatagctcaactgctgaacactccagtccctactccgaagatccgattgaagatccgctgcagcctgatgtcactggcatccggctcctttcgctgggagcaggagagttcaaatcccaggaacatgcgaaacataagggacctaaggtggaacgcgaccaggccgcgaagcataggttttcctggatgaagctgctggcccacaaggtcggacgacatctgtcgcaagacacgggctccccgagtgggatgcggccatgggaagatttgccatcgcaggatactggatcaccgtcgagaatgcggccgtggaaggacccaccttctgacctgctcctcctcaagcagtctaactcgagcaagattctggtgggacggtggcatctggcgtcggaaaagggttcatacgaaatcatccaagacactgacgaggacaccgccgtgaacaattggctcatctcgccgcagaacgcgtcccgcgcgtggggcgaatcgaccccgcttgccaacaagccgggtaagcaatcaggccaccccaaattcccgcgcgtgcgccataagtcacttcaggttcgccaagatgggggtaagtcgaggctgaaaaagtcacagttcctcattaagacccgcaagaagaaaaaggagaagcacacccaccacgctccacttagtccgcggaccttccatcccctgcgctcagaagcctacaatactttcagcgagcggcgattgaaacactccctggtgctgcacaagtccaacgagacttcgctccctaccgacctgaaccaaaccctgccttcgatggattttggatggatcgcctccctccctgaccataaccagaattcctcaaatgatactggacaggcttcctgcccacctggactgtaccaaaccgtgccacctgaggagcattaccagacgttccctatccaagatcccgaccagatgcattctacctccgaccctagccaccgctcgtcgtcgcctgaactttcggagatgctggagtacgatagatcgcacaagagcttcccgacggacatctcacagatgtccccatcctcagagcacgaagtgtggcaaaccgttatctcgccggatctgtcccaggtgactctcagcccggagctctcccagaccaatctgagtccggacctgtcacacactactctgtctccagaactcattcagaggaacctctctccagcactcggacagatgcccatctcaccggacctgagccataccacgctctccccagatctctctcacaccaccctctctctcgacctctcgcagaccaacctgagtccggaactttcacaaaccaatctgtcgcctgctctgggccaaatgccactgtctccggatctctcgcacactaccctctcgctggacttttcccaaaccaatctttcaccggaactgagccatatgaccctttcaccggagttgtcccagactaacctgtctccagccctcgggcaaatgccaatcagcccggacctgtcccacaccaccctgtcgctggacttcagtcagactaacctttcacctgaactgtcacaaactaacctgtcaccggcgttgggacagatgccgcttagcccggacccctcgcataccaccctgtccctggacttgtcgcagacgaatctctcacccgagctgagccagactaatctgtcacctgacttgagcgagatgcctttgttcgccgatctgagccagatcccattgaccccagacctcgaccagatgacgctgagccccgaccttggtgaaaccgacctctccccgaacttcggacagatgagcctgtcgccggatttgtctcaagtgaccctctcgccagacatctccgacactaccctgttgccagatctctcgcaaatctcaccaccccccgacttggaccagatcttctaccccagcgagtcgtcacaaagcctgctgttgcaagagtttaacgagtcattcccctacccagacctgggccagatgccatcgccgtcatcgccgacgctgaacgatacttttctgtcgaaggagttcaatccgctggtgatcgtgggattgtccaaagacggaactgactacatcgagatcatccctaaggaagaggtgcaaagcagtgaagatgattacgccgaaatcgactacgtgccctacgatgacccgtacaaaactgacgtccgcactaacatcaactcgtcacgcgacccagataacatcgccgcatggtacttgcgcagcaataatggaaatcgcaggaactattacatcgcggccgaagaaatcagctgggattactcggaattcgtgcagcgggaaaccgacatcgaggactcggatgacataccggaggataccacttacaaaaaggtcgtattcaggaagtacctggattcgacgttcactaagcgggatccgaggggagaatacgaagagcacctgggaatcctgggcccgatcatcagagcagaagtggacgacgtgattcaggtgcggtttaagaacctcgcctcaagaccatactcccttcacgcacatgggctcagctacgaaaagagcagcgaaggaaagacctacgaggatgactcgccggagtggttcaaggaagataacgccgtccagccgaactcgagctacacttacgtctggcacgctactgaacggtcgggaccagaatcaccgggaagcgcttgtagagcgtgggcatactactccgctgtgaatccggaaaaggacattcactcgggactgatcggtccgctccttatctgccagaaaggaatcctccataaggattcgaatatgccaatggacatgagagaattcgtccttctcttcatgactttcgatgaaaagaaatcatggtactacgagaagaagtcgcgcagcagctggcgcctgacctcctccgaaatgaagaagtcacacgagttccacgcaattaacggtatgatctactcactgccaggtctgaagatgtacgaacaagagtgggtcaggttgcatctgctgaatatcggcggttcacaagatattcacgtcgtgcacttccatggacagactctcttggaaaacgggaataaacaacaccaactcggagtctggccgctcctgccgggtagcttcaagactcttgaaatgaaggcgagcaagcccggctggtggctcctcaacactgaggtgggagaaaatcagcgggccggaatgcagacgcctttcttgattatggatcgcgactgtcggatgccaatgggcttgtcaactggaattatctctgacagtcagatcaaggcttcggaatttctgggttactgggaaccgcgcctggcccgcctcaacaatgggggctcgtataacgcctggagcgtggagaaactggccgcggaattcgcctccaaaccgtggatccaagtggatatgcaaaaggaggtgatcatcaccggcatccagactcagggagccaagcactatctgaagtcgtgttacaccactgaattctatgtcgcatacagctccaaccaaatcaattggcagattttcaaagggaactccactagaaacgtgatgtacttcaatggaaactcggatgcgtcgacgatcaaagaaaatcaatttgatccaccgatcgttgctagatacatcagaatctcgccgacccgggcctataaccgtccgaccctgaggttggagctccagggctgtgaagtgaatggctgttcgaccccactgggaatggagaatgggaagatagaaaacaaacaaattactgcatcctcgtttaagaagagctggtggggggactactgggagcctttcagggcaagactgaatgcgcaaggacgcgtgaacgcttggcaggccaaagccaacaataacaagcagtggctggagatcgacctgctgaagatcaagaagattactgctatcattactcagggttgcaagtctctgtcatccgagatgtacgtgaagagttacactattcattactccgagcagggagtcgaatggaaaccttaccggctgaaaagctccatggtcgataagatcttcgagggcaacaccaacacgaaaggccacgtgaagaactttttcaacccgcctatcatttccagattcatacgcgtcatccctaagacctggaaccagtccatcgcgctgcgcctggaactgtttggttgcgacatctac

SEQ ID NO: 9020 - DNA, 6672 bp, Artificial Sequence
  Description of Artificial Sequence: Synthetic coding sequence
atgtttcctggttgcccgcgcctctgggtcttggtcgtgctcggaacttcctgggtgggatggggatcccagggaaccgaggcagctcaactgagacaattctacgtggcggctcaaggcatctcatggagctaccggcctgagccgactaattcttcgctgaacctctccgtgacctcattcaagaagatcgtctaccgtgaatacgagccatacttcaagaaagaaaaaccacaatcgaccatctcgggcctcctgggcccaaccttgtacgccgaggtgggagacatcatcaaagttcactttaagaataaggcagacaagcctctctccatccatccacagggaatcaggtactctaagctgtcagaaggagcttcatacctggaccataccttcccagccgagaagatggacgatgcggtcgcccctggcagggagtacacttatgaatggtcgatctcggaagattcagggcctactcacgatgacccgccttgtctgactcacatctattactcacacgagaatctgatcgaagatttcaacagcggactgatcggtccactcctgatttgtaagaagggaactctgaccgaagggggaacccaaaagactttcgataagcagattgtcttgctgtttgctgttttcgatgaatcaaagagctggagccaatcgagctcgctcatgtacaccgtgaacggctacgtcaacggcacgatgccggacatcactgtctgcgcccatgatcacatctcatggcacctgctgggaatgtcgtcgggaccggaactcttctccatccacttcaatgggcaggtgctggagcaaaatcaccacaaagtgagcgctatcaccctcgtgtcggctacttccaccactgcgaacatgaccgtcggaccagaaggcaaatggatcatctcctccctgaccccgaaacacttgcaggcaggtatgcaggcctacattgatatcaagaactgccccaaaaagaccagaaatctgaagaagattaccagggaacaacgccggcacatgaaacgctgggaatacttcatagctgcagaggaggtcatctgggattacgctccggtgatcccagcaaacatggacaaaaagtaccggtcgcagcacctggacaatttctctaaccaaatcggtaagcactataagaaagttatgtacacccagtacgaggacgaatcctttactaaacataccgtgaatcctaacatgaaggaagatggaattctggggcccattattcgagcccaggtccgggacactttgaaaattgttttcaaaaacatggcctccaggccgtactcaatctacccgcacggggtgaccttcagcccatacgaagatgaggtcaacagctctttcacctccgggaggaacaacactatgatccgcgccgtgcagccgggcgagacttacacttacaagtggaatatcctggaattcgacgaaccgaccgaaaacgacgcgcagtgccttacgcgtccttactactcggatgtggacattatgcgcgatatcgcctcaggcctcatcggtctgctcctgatatgcaagagccggtccctcgaccgccggggaatccagagagcagctgacattgaacaacaagctgtctttgcagtgttcgacgaaaacaagagctggtacctcgaggacaacatcaacaagttctgcgaaaacccggatgaggtgaaaagggacgaccccaagttctacgagtccaatatcatgtcgacgatcaatggatacgtgcccgagtccatcaccaccctgggtttttgcttcgacgacactgtgcagtggcatttctgctccgtcggaactcagaacgaaatcctgaccatccattttaccggacattcctttatctacggcaagagacacgaagataccctcactctgttcccgatgcgcggagaatcagtcaccgtgaccatggacaatgttggaacttggatgctgacttccatgaactcgtccccccggtccaaaaagctccggctcaaattccgggacgtgaagtgcataccagacgatgacgaagattcgtatgagatcttcgaaccccctgagtcaaccgtgatggccacgcgcaagatgcacgacagactcgagccggaggatgaggagtcagatgctgactacgactaccagaatagactcgctgcagcactgggaatccggtcttttaggaacagctccttgaatcaggaggaagaggaattcaatctgactgcgctggccctggagaatggtaccgagttcgtgtcgtcaaacaccgacatcatcgtcggcagcaactacagctcccccagcaacatttcgaaattcactgtgaacaatctggcagagcctcagaaggccccatcccatcaacaagccaccacggccggctcaccactgcggcacctgatcggaaagaattcggtcctgaattcgtcgactgccgagcactcctccccatattccgaggatccgatcgaagatcctctccagcccgacgtgacggggatcagactgctgtcgcttggcgccggcgagttcaagtcgcaggaacacgccaaacacaagggcccaaaggtggagcgcgaccaggctgccaagcatagattcagctggatgaaactgcttgcccacaaggtgggacgacatctctctcaagacactggatccccgtcaggaatgcgcccgtgggaagatctgcccagccaggacactggaagcccttccagaatgcggccgtggaaggaccccccgagcgacttgttgctccttaagcagagcaattccagcaagatcctggtgggtcggtggcatctggcttcagaaaagggttcatacgaaatcatccaggacactgacgaagataccgcagtgaacaattggcttatctcaccgcagaacgcctccagagcctggggagagtcgacccctctggcgaacaaaccggggaaacagtccggccaccctaagtttcccagagtgcggcacaagtcgctgcaagtccgccaagatggaggcaagtccaggctcaaaaagtcgcagttcctgatcaaaactcggaagaagaaaaaggaaaagcacacccatcacgcgcccctgtccccacgtacctttcatccactcagatcggaggcttataacaccttttccgagcgccgcttgaagcactccctggtcctgcacaagagcaacgagacttcgctccctacggacctgaaccaaacgttgccgagcatggacttcggatggatcgcttcgctgcccgaccacaaccaaaacagcagcaacgacaccggccaggcatcctgtcccccagggctgtaccagacggtcccgccagaggaacattaccaaaccttcccgatccaggatccggatcaaatgcactcgacttccgacccatcacataggagctctagcccagaactcagtgaaatgctcgagtacgacagatcccataaatccttcccgaccgatatctcacaaatgtcaccatcatccgaacacgaggtctggcagaccgtaatctcgccagatctgtcgcaggtgaccctctcccctgaactcagccagacgaatctgtcaccagacctctcacacaccactctctccccggaactgatccaacgcaacttgtcccctgccctgggacagatgcctatttcgccggatttgtcgcacactactctctcgcccgatttgtcccacacgactctttcgctggaccttagtcaaactaatctgtcgccggagctgtcccagactaacctgtctcctgccctggggcagatgccgctttcaccagatctgtcccatactaccctttcgttggacttctcgcagactaatctcagcccagaactttcgcacatgactctctcaccggaactgtcgcagaccaaccttagtcccgccctgggccagatgccgatcagccctgatctgagccatactactttgtcgctggacttttcgcaaacgaatctgtcccctgagctgtcgcagacgaacctgtccccggcactcgggcagatgcccctgagccccgatccgtcccacactacgctctccttggacctgtcacagaccaatctgtcgcctgaactctcgcagaccaatttgtcaccggacctgtcagaaatgccgctgttcgccgatctctcccagatcccactcacgccggatctggatcaaatgaccctgtcccccgatctgggtgaaacggacctgagcccgaattttggacagatgagcctgtcgccagacctcagccaggtgaccctgtcaccggatatcagcgacacgactctcctgccggacctctctcagatctcaccgccgcccgatctggatcagatcttctacccttcagagagctcgcagtcactgctcctgcaagagttcaatgaatcgttcccataccctgaccttggacagatgccctccccgtcaagcccgaccctcaacgacacctttctttcaaaggagtttaatccgctggtcatcgtggggctctccaaggatggcactgactatatcgagataatccctaaggaagaagtgcaaagctccgaggatgattatgctgagatcgactacgtgccctatgacgacccctacaagactgatgtgcgcaccaatatcaattcatcgagggaccctgataacattgccgcatggtacctgcgctcgaacaacggaaaccgcagaaattactacatcgccgcagaagaaatctcatgggattactcggaattcgtgcagagggaaactgatatcgaggactcggatgatatccctgaggacacgacctacaaaaaagtggtgtttcgcaaatacttggacagcaccttcacgaagcgcgatccacggggagaatatgaagagcatctcggtatcttgggaccgatcattagagcagaagtggacgatgtcattcaagtccgcttcaagaacctcgcttccagaccgtacagccttcatgctcacggactgagctacgaaaaatcatccgagggaaagacttacgaggatgactccccagaatggtttaaggaggacaacgcggtgcagccaaatagctcgtacacctacgtatggcacgccactgagcggtctggcccagagtcacctggaagcgcgtgtagggcttgggcgtactactccgcggtgaacccagaaaaggacatccatagcgggctcattggaccactcctcatttgtcaaaagggaatcctgcacaaagacagcaatatgcctatggacatgcgggaattcgtgctcctcttcatgacttttgatgagaagaaatcgtggtactacgaaaagaagagccgcagctcgtggcgcctcactagctcagaaatgaaaaagtcacatgaattccacgccattaacggaatgatctactcgttgccaggactcaagatgtacgaacaagagtgggtgcgactgcatctgctgaacattggcggttcacaggatattcatgtcgtgcacttccacggacaaaccttgctcgagaacggtaacaagcagcatcagctcggagtgtggcctctgttgccgggatccttcaaaaccctcgagatgaaggcgtctaagcctggatggtggttgcttaataccgaggttggagaaaatcaaagggccggcatgcagactccgtttctcattatggacagggactgcagaatgcccatgggattgtcgaccgggataatctcggactcccagatcaaggcgtccgagttcctcgggtactgggaaccacgtcttgcccgcctgaacaacggtggctcatacaatgcctggtcagtggagaagctcgccgccgagttcgcgtctaaaccatggatccaagtggacatgcaaaaggaggtgatcatcaccggaatccaaactcaaggcgcaaaacactatctcaaaagctgttacactactgagttctacgtggcctacagctcaaatcagataaactggcaaatcttcaagggaaattcgaccaggaacgtgatgtacttcaatggaaatagcgacgcgtccacgatcaaggaaaaccagttcgatcctccgatcgtcgccaggtacatccggatctcccccacccgggcttacaaccgtcctaccctcagactggaactgcaagggtgcgaggtgaatgggtgcagcactccattgggtatggaaaacggcaagatcgagaacaagcagatcactgcctcatcgttcaaaaagtcatggtggggagactactgggaaccgtttagagcccggctcaacgcccaggggcgcgtcaacgcatggcaggccaaagccaacaacaataagcagtggctggaaatcgacctgctcaagatcaaaaagataaccgccatcattactcagggatgcaagtcgctgtcatcagagatgtacgttaagtcctacactattcattacagtgaacagggcgtggaatggaaaccgtacaggcttaaatcatcaatggtcgataagatctttgaaggaaataccaacaccaagggccacgtgaagaatttctttaacccgccaatcatctcgcggtttatcagggtgattccaaaaacctggaaccagtccatcgctctccgcctggaactgttcgggtgcgatatctac

SEQ ID NO: 9021 - DNA, 6672 bp, Artificial Sequence
  Description of Artificial Sequence: Synthetic coding sequence
atgttcccgggctgccctaggctgtgggtgctcgtggtcctgggtacgtcctgggttggctggggttcacaggggaccgaagcagcacagcttagacagttttacgtagccgcacagggaatttcatggtcataccgcccggagcctacgaacagctcccttaacctcagcgtcacttcctttaagaagattgtgtacagagaatacgaaccttacttcaagaaagaaaagccacagtcgaccatctcggggttgctcgggcctaccctttatgctgaagtgggcgacatcattaaggtgcactttaagaataaggctgacaaacctctttcgattcatcctcaaggaatcaggtactcaaaactttcggaaggagcatcctaccttgaccatacctttcctgcagagaagatggatgacgccgtggccccgggtcgagaatacacctacgaatggtccatctccgaagatagcggccccacccatgacgaccctccatgtctgactcatatctactactcccatgagaacctcatagaagatttcaactcaggtcttatcggccctctcctgatttgtaagaaaggtaccttgaccgaaggtggaactcaaaagacgtttgacaagcagatcgtcctgcttttcgccgtgttcgacgaatcgaagtcgtggagccaatcctcgtcacttatgtacaccgtgaatggctacgtgaatggaactatgccagatatcactgtgtgtgctcatgatcatatttcgtggcatctgcttgggatgtcgtcgggaccagagcttttttccattcatttcaatggacaagtgctggaacagaaccatcacaaagtgtcagctattacgcttgtttcagctactagcaccactgccaacatgactgtgggacccgaagggaaatggatcattagtagcctgaccccaaaacacttgcaagccggtatgcaagcatacattgacattaagaattgtcccaaaaagactagaaatctcaagaaaatcactagagaacaacggcgccacatgaagaggtgggaatactttattgcagccgaagaggttatttgggactacgcaccagtgattcctgccaatatggataagaagtaccggagtcaacatttggacaacttttcaaaccaaattggaaagcattacaaaaaggtgatgtacacgcaatacgaggacgaatcgtttactaagcacaccgtgaatccgaacatgaaggaagatggtatactgggtccgataatcagagcacaagtgagggacaccctgaagattgtctttaagaatatggcaagcagaccctacagcatttacccgcatggagtcaccttctccccatacgaggatgaagtcaactcgtcgtttacctcgggacgaaataacacgatgattcgggcggtgcaacccggtgaaacgtacacttacaaatggaatatactggagtttgacgaaccaaccgagaatgatgcacaatgtctcaccaggccctattactcggatgtcgatatcatgcgggacattgcgtccggtctgataggacttcttcttatttgcaagtcccgctcacttgatcgacgtggtattcagagagcagcagacattgagcaacaggcagtgtttgccgtgtttgacgagaacaagtcgtggtacttggaggataacatcaataagttttgtgaaaacccagatgaggtcaagcgggatgatcccaagttttacgaatccaacataatgtccactatcaatggttacgtgcctgaatccataacgaccttgggtttttgttttgatgatactgtgcaatggcatttttgcagcgtgggaacccagaatgagatactgaccattcattttactggtcactccttcatttatggaaagagacatgaggacactctgactctctttcccatgcgtggagaaagcgtgaccgtgactatggataatgtcggaacctggatgcttacttcgatgaactcatcgccgcgcagcaaaaagctgcgattgaagttcagggacgtgaagtgcatcccggacgacgacgaggattcctacgagatctttgagccccccgaatcgaccgtcatggcgactcgcaagatgcacgaccgtcttgaacctgaggatgaagaatcagatgctgactacgattatcaaaacagactggctgcagcgttgggaatccgctcgtttagaaactcgtccctgaaccaagaagaggaagagtttaaccttacggctcttgcactggaaaacggaacggaatttgtcagttccaacaccgacataatagtcggaagcaactactcatcgccatccaacatcagcaaattcactgtgaacaacctggccgagccgcagaaagcaccttcgcatcaacaggccaccaccgccggatcacccctgagacaccttatcgggaagaattctgtgcttaactcttcgaccgcagaacattcgagcccctactcggaggatcccatcgaagatcctctgcaaccggatgtgactgggatccggctgctgtcgcttggagcaggcgaattcaagagccaagaacatgccaagcataaggggcctaaggtggagagagatcaagcagcaaaacacagattttcgtggatgaagctgctggcccataaggtcggtagacatctttcgcaggacactggttcaccatcgggcatgcgaccttgggaggatctcccttcccaggacaccggcagcccctcgagaatgcgcccttggaaggatcctcctagcgatcttctgctgttgaagcagagtaattcctcgaagatccttgtgggtcggtggcatcttgcaagcgaaaagggttcctacgaaatcattcaagatactgatgaagataccgcagtcaataactggctgatctcacctcaaaacgcaagccgcgcctggggagaatccactcccctggcgaataaacctggaaaacaatccggacatccgaagttcccaagagtgaggcataagtccctccaagtcaggcaggacggaggtaagtcacgactgaaaaagtctcagtttctgataaagaccagaaagaaaaagaaagaaaaacatacgcatcacgcgccattgtcccccagaacttttcatcccctgcgctccgaggcatacaatacttttagcgaacgtaggttgaagcacagcctggtgctccataagtcgaacgagacttccctccctaccgacctgaaccagaccctgccatcaatggactttggttggattgcctccctgccagatcataaccagaactcctccaacgatactgggcaagcatcatgtccacccgggctgtaccagaccgtgcctcccgaagagcattaccaaaccttcccaattcaggatccggaccaaatgcattccacctcggacccatctcatcgctcatcctccccagaacttagtgaaatgctggaatacgatcgctcgcataagtcttttccaaccgatatttcacaaatgtcgccttcgtccgagcatgaagtttggcaaaccgtgatatcgccggatctctcccaggtcacgctgagccctgagctctcccagactaatcttagcccggacctctctcacaccaccttgtcgcctgagctcatccaaaggaacctgagcccagcgctcggtcaaatgccaatctcacccgatctgtcgcacacgactttgagcccggacctttcccacacgaccctcagtctggacttgtcgcagaccaatctgtcaccggaactgtcgcagactaacctgtcgccagcactgggacagatgcctctttctcccgatctgtcacacaccactttgtcgcttgatttctcgcaaaccaatctctccccagagctttcacatatgacgctttcacctgagctttcgcaaacgaacctttcacccgccctcggccaaatgcctatatcgccagacttgtcgcacactaccctgtccctggatttctcccaaactaatctcagtcccgagctttcacagacgaacctcagccctgcactgggtcaaatgccgctttcgccagatccgagccatactactttgtccctggacctgtcacagaccaatctttcaccagaactgtcccaaaccaacctttcgccggacctttcggagatgccacttttcgcggacctgagccaaattcctctgacgcctgatctcgatcagatgaccctctccccagatcttggtgaaactgacttgtcgcctaatttcggacaaatgtcccttagccctgacctttcccaagtgactctctcacctgatatttcagataccaccctcctgccagacctctcgcagatttcgccgcctccggatctggaccaaatcttttacccaagcgagtcatcacagtcgctgctgctccaagagtttaatgagagcttcccctaccctgaccttggacagatgccctcgcccagctcgcctacgctgaacgatacctttctctcgaaagaattcaatcctctggtgatcgtcggtctgtccaaggacggaacggattacatagagattattcctaaggaagaagtgcagtcgtccgaagatgattacgcggaaattgattacgtgccatacgacgatccttacaagacggatgtgagaactaacatcaactcctccagagatcccgacaatatcgcagcgtggtatcttaggtccaacaacggaaataggagaaactactacatagccgccgaggaaatcagctgggattactctgaattcgtgcagagagagactgatatcgaagattcggatgacatcccggaagatacgacttataagaaggtggtctttcgtaaatacctggattccacgtttactaagagagatcctagaggggaatacgaagaacacctcggcattcttggcccaattatcagggcagaagtggacgacgtgattcaagtgagatttaagaacctggcatcccggccttactctcttcatgcccatggccttagctatgaaaaaagctcagaagggaaaacctacgaagatgatagcccagagtggttcaaggaagataacgctgtgcaacctaatagctcctacacctatgtgtggcatgcgactgaacgatcggggccagagtcaccgggttcggcatgtagggcatgggcatactactcagcagtcaacccagaaaaggatattcattcagggttgattggaccactgcttatttgtcaaaagggaatattgcataaggatagcaacatgccaatggacatgagggaattcgtgttgctgttcatgactttcgacgaaaagaagtcatggtactacgaaaagaaaagccgatcttcctggcgcctgacttcatccgaaatgaagaagtcacatgaattccatgccattaacgggatgatctactcactccctggactgaagatgtacgagcaggaatgggtccggcttcatcttcttaacattggcggtagccaagatattcatgtcgttcattttcacggacagaccctgcttgagaatggcaacaagcagcatcaactcggagtctggcccctgctgcctggtagttttaagaccctcgaaatgaaggcatccaaacctggatggtggttgctcaacaccgaggtaggagagaaccaacgtgcaggtatgcagacgccattcctgattatggatcgagattgtcggatgccaatgggcctgtcgaccggaatcatatccgatagccagattaaggcatccgagtttcttgggtactgggagcctcgactcgcacgccttaacaacggtgggagctacaacgcatggtccgtggagaagttggcagcggaatttgcatcgaaaccatggatccaggtggatatgcagaaggaggtgattatcactgggattcagactcaaggagctaaacattacctcaagtcctgttacactactgaattctacgttgcatactcatccaaccagatcaattggcagattttcaagggcaactccactcgcaatgtcatgtactttaacggcaatagcgatgcctcgaccattaaggaaaatcaatttgatccacctattgtcgcccggtacattcgtatttcgcctaccagggcttacaaccgtcctactttgaggcttgaactgcaggggtgcgaagtcaacggatgctcgaccccccttgggatggaaaacggcaagattgaaaacaagcaaattactgcctcgtcgttcaagaaaagctggtggggggattattgggaacccttcagggcaagactgaacgcacaaggcagagtgaatgcctggcaggcgaaggctaacaataacaagcaatggcttgagattgatctgctgaagattaagaagatcaccgcaattatcacccagggttgcaagtcactgtcctcggagatgtatgtgaagtcttacactattcattattcggaacaaggagttgaatggaaaccttacagactcaagtcatcaatggtcgataagattttcgaaggcaacaccaacaccaagggacacgtcaagaactttttcaatccacccatcatttcaagattcatcagggtgattcctaagacttggaatcagtcgattgcactgcgcctcgagctgtttggatgcgacatctac

SEQ ID NO: 9022 - DNA, 6672 bp, Artificial Sequence
  Description of Artificial Sequence: Synthetic coding sequence
atgttccccggatgtccgcgcctctgggtgctcgtggtgctggggactagctgggtgggctggggaagccagggcaccgaggccgcgcagcttagacagttttacgtcgcggcacaagggatctcatggtcgtatagaccggaacctaccaactctagcttgaacctgtcagtgacgtcgttcaagaagatcgtgtaccgcgaatacgaaccgtacttcaagaaagagaagcctcagtccaccatctcgggcctgctggggcctaccctctacgccgaagtcggagacatcatcaaggtgcatttcaagaacaaagcagataagccgctgtccatccacccacagggcatccggtacagcaaactttcggaaggggcctcgtacctcgatcatactttcccggcggaaaaaatggacgacgcagtggcgccgggacgggaatatacgtacgagtggtcaatctcggaggactcaggcccgactcacgacgaccccccatgcctcactcatatctactactcccatgagaatctgattgaggatttcaactccggcctcatcggcccgcttctcatctgcaaaaagggaacccttactgaaggaggcactcaaaagacctttgataagcaaatcgtcctgctcttcgctgtgttcgacgagtcgaaatcctggagccagtcgtcctccctcatgtacaccgtcaatggatacgtgaatggaaccatgccggatattacggtgtgcgcccacgaccacatttcatggcacctgttgggtatgtcgagcggaccggagctgttctccatccacttcaacgggcaagtgctggagcagaaccatcacaaggtgtccgcaatcactctcgtctcagcgactagcaccactgcgaatatgactgtcggaccagaaggaaagtggattatctcgtccctgaccccgaagcatctgcaagccggcatgcaagcctacatcgacatcaagaactgcccgaagaaaactcgcaacctgaagaagatcacccgggagcagcgccgacacatgaagcggtgggaatacttcattgccgccgaagaagtgatttgggattacgcgccagtgatccccgctaatatggacaaaaagtacagaagccagcatctggacaacttcagcaatcagatcgggaaacactacaagaaggttatgtacactcagtatgaagatgagtcgttcactaagcacactgtcaatccaaatatgaaagaggatggcattctgggcccgattattcgcgcgcaggtgcgcgataccctcaagattgtgttcaaaaacatggcgtcacgcccgtactcgatctatccacatggagtgactttctcaccgtacgaggacgaagtcaacagttccttcaccagcgggcgcaataacactatgatcagagctgtgcaaccgggtgaaacttatacctacaagtggaatatcctggaattcgatgaaccaaccgagaatgatgcgcagtgcctgactcgcccttactactcagatgtggacatcatgcgggacatcgcctcaggactcatcggactgctgctgatctgcaaatcgcgcagtctggaccggcgcggaatccaacgcgcagccgatatcgaacagcaggcagtgtttgctgtctttgatgagaacaagtcgtggtacttggaagataacattaacaagttctgtgaaaacccagatgaggtaaaaagggatgaccccaagttctacgaatcaaacatcatgtctactatcaacggttacgtcccggagtccatcaccaccctgggtttttgtttcgatgatacggtgcagtggcatttctgctcggtgggaacccagaatgaaatcctgactatccactttaccggtcactcgttcatctacggcaagagacatgaagatactctgacccttttcccgatgcggggcgagtccgtcaccgtgactatggacaacgtgggtacctggatgctcactagcatgaatagctccccaaggtccaagaagctcagactgaagtttcgcgacgtgaagtgcatcccggatgacgatgaagatagctacgaaatttttgaaccgccggagtcgaccgtcatggccactagaaaaatgcacgaccgccttgagcctgaggatgaagaatcagacgcggactacgactaccaaaacaggctggcagccgctttgggtatccgtagcttccggaattcctccctgaatcaggaagaggaagagttcaatctcaccgccctcgctttggaaaatgggaccgagttcgtgagctcgaatactgacatcatcgtgggatcgaattactcatcaccaagcaatatctcgaagtttaccgtcaacaacttggccgaaccgcagaaagccccgtcgcaccaacaagcaactaccgcaggctccccgctgagacatcttatcggaaagaactcggtgctgaacagcagcaccgcggagcattcctctccgtattcggaggacccaatcgaagatcctctgcagccggacgtgactggcattcggctcctgagcttgggggctggcgagtttaagagccaggaacacgctaagcacaagggccctaaggtcgaacgggaccaggcagccaagcatagattcagctggatgaagctgttggcgcacaaagtgggacggcatctctcacaggacaccggatccccgagcggaatgcgtccgtgggaggacctgccatcccaggacactggttcgccgagcaggatgcggccgtggaaggacccgccttccgacctcctcctgctgaagcagtcaaattccagcaagatcctggtcggacgctggcacctggcttcggagaagggatcgtacgagatcattcaagatacggacgaagatactgcagtcaacaattggctgatctccccgcagaacgcctcaagagcctggggagaatcgactccattggctaacaagcctggaaagcaaagcgggcaccctaaatttccgagggtgaggcacaagtccctgcaggttcgccaggacggcggaaagtcgcggctgaaaaagagtcaatttcttattaagacccgcaagaagaagaaggaaaaacacacccatcacgccccactgtcgccgcgcacttttcacccgctgcggtcggaagcctacaacaccttcagcgaacgccggctgaagcactctctggtgctccataaatcaaacgaaacttccctgccaactgatttgaaccagactctcccctcgatggacttcggatggatcgcatccctgccagaccacaaccagaactcatcaaatgacactggccaagccagctgtccacccggactgtaccaaaccgttccaccagaagagcattatcagaccttccctatccaggaccctgaccagatgcactcgacctccgatccgagtcacaggtcgtcatcccctgaactgtccgaaatgctggagtacgaccggagccacaaatcgttcccgaccgacatcagccaaatgtcgccctcgtcggagcacgaggtttggcagaccgtgatctcgccagacctgagccaggtgacgctgtcgccagagctgtcccagaccaaccttagcccggacttgagccacaccaccctttcacccgagctcatccagcgaaatctgtcacctgccctggggcaaatgcctatcagccctgatctcagccacacgaccctgtcgcccgacctgtcccacactacgctttcgctcgatctgtcacagacgaacttgtcaccggaactgtctcagactaatctcagcccggctctgggccaaatgccgctgtctcctgatctgtcgcataccactctttcactggacttctcccagactaacttgagcccggagttgtcgcatatgacgctttcccctgagctctcacagactaacctctcgcctgcccttggtcagatgcctatatctccagacctgtcacataccaccctgtcattggactttagtcaaaccaacctgtctccagaactgagccagaccaatctcagtccggcactgggacaaatgcctctgtccccagatcctagccatactaccctctcgttggatctctctcaaacgaacctctccccagaattgagccaaacgaatctctcacccgatctctcggagatgcccctgttcgcggacctttcacagatccccctgactccggacctcgaccaaatgacgcttagccctgacctgggggaaacggatctttcgcctaacttcggccagatgagcctgtccccggacctctcccaggtgaccctttccccagacatcagcgataccacgctcctcccagacctctcacaaatcagcccgccgcccgatctggatcagatcttctacccgagcgaatccagccaaagcctgctgctccaagaattcaacgaatctttcccataccctgaccttggccagatgccttccccctcatcaccgacgctgaatgataccttcctctcgaaagagtttaacccgctcgtgatcgtgggcctgtccaaagacggaactgactacattgagatcatcccaaaagaggaagtccaaagctccgaagatgattatgctgaaatcgactacgtcccttatgatgatccatacaagaccgacgtgcgaaccaatatcaacagctcccgggacccggacaatatcgcagcctggtacctccgctccaacaatggaaacaggcgcaactactacatcgcagccgaggaaatctcctgggactactcggagtttgtgcaacgcgagactgacatcgaggactccgatgacatcccagaggataccacttataaaaaggtggtgtttcggaagtacctggactccacgttcaccaaaagagatccgcgcggtgagtacgaagaacacctggggatcctcggccctatcatccgggcggaagtggacgacgtgatccaagttaggtttaagaacctggcctcgcgcccatactcactgcacgctcatggactgtcgtacgaaaagtcctcggagggtaaaacttacgaagatgactccccagagtggtttaaggaggataacgccgtgcagccgaattctagctacacttacgtctggcacgcgaccgaaagatcaggccccgaatcgccgggatcggcctgtagggcgtgggcctactactctgcggtgaacccggagaaggatatccattccggacttattgggcccctgttgatctgccagaagggaatcctgcacaaggattcgaacatgccaatggatatgagagaattcgtgttgctgttcatgaccttcgatgaaaagaaatcatggtactacgagaagaaaagtcggtcgtcatggcggctgacctccagcgagatgaagaaatcgcacgagttccatgccatcaatggaatgatctactcacttcccggcctgaagatgtacgagcaggagtgggtgagacttcacctgttgaacatcggaggatcacaagacatccatgtggtccatttccacgggcagaccctcctcgaaaacggaaacaaacagcaccagctcggagtctggcccttgctccccggatccttcaaaactctggaaatgaaggcgtccaagccaggctggtggctgctgaacactgaagtgggagaaaaccagagagccggaatgcagaccccgttcctcattatggacagggactgccgcatgccgatgggtctgtctactggaatcatctcggactcgcagatcaaggcttcagaatttctcgggtactgggaacctcgcctggctcggctgaacaacggagggtcctacaacgcgtggtcagtggaaaagctggcggcagagttcgcgtcgaagccctggatccaagtcgacatgcaaaaggaagtgattatcactggaatccaaacccaaggagcaaagcactacctcaaaagttgctacaccactgaattctacgtcgcttactcctcaaatcaaattaattggcagatcttcaagggaaactccaccaggaacgtgatgtactttaacggaaactccgacgcatcgactataaaggaaaatcagttcgacccgccgatcgtcgcacgctacatccggatcagccctactcgggcgtacaacagaccgactctccggctcgagctgcaaggatgcgaagtgaacggatgcagcactccactcggtatggagaatggaaaaattgaaaacaagcagatcaccgcctcgtcctttaagaagtcatggtggggggattactgggagccgttccgggcccgcctcaacgcccagggacgcgtcaatgcctggcaggccaaggccaacaacaacaagcagtggctggaaatagacttgctgaagatcaagaaaattaccgccatcatcacccagggttgcaagtcactgtcgagcgagatgtacgtgaaatcctacaccatccactactccgagcaaggtgtggaatggaaaccataccgcctgaaatccagcatggtcgacaagatcttcgagggcaacaccaataccaagggccatgttaaaaatttcttcaatccaccgatcatctcgcgattcattagagtaattccgaaaacttggaaccagtcgatcgctctcagactggagctcttcggatgtgacatttac

SEQ ID NO: 9023 - DNA, 6672 bp, Artificial Sequence
  Description of Artificial Sequence: Synthetic coding sequence
atgtttcctggctgtccgaggctgtgggtcctggtcgtcctgggcactagctgggtgggatgggggtcccagggtactgaggcggcacagctgcggcaattctacgttgctgcgcagggaatttcctggtcgtatcgacctgaaccgactaactcttccctgaatctgtccgtgacctcgttcaaaaagatcgtgtatcgggagtacgagccgtacttcaaaaaggaaaagcctcaatcgaccatctccggtctgcttggcccgaccctgtacgccgaagtgggagacatcatcaaggttcacttcaaaaacaaggcagacaagccgctgtcgatccatccgcaaggaatcagatactccaaactgtccgaaggagcgtcatacctggatcataccttcccggcggagaagatggatgacgcagtggccccggggagagaatacacctacgaatggtcaatctcagaggactcaggcccaacccacgatgatccaccgtgtctcacccacatctactattcgcatgaaaatctgatcgaggactttaacagcgggctgatcggaccgcttttgatctgtaagaagggaacccttactgaaggcggaacccaaaagactttcgacaagcagatcgttctgctgttcgctgtgtttgatgagtcgaagtcgtggtcacagtcgagcagcctgatgtacactgtgaacggttacgtgaacggtaccatgccagatatcactgtgtgcgcgcatgaccatatttcatggcatctgttgggaatgtcgtcgggaccggaactcttttccatacactttaacggacaggtgctggaacaaaatcaccacaaagtctcggcgattacccttgtgagcgcgacctccactactgcgaacatgaccgtgggaccggaaggaaagtggatcatctcctccttgacgccaaaacatctgcaagcaggcatgcaagcctatatcgacattaagaactgtccgaaaaagactcgcaacctcaaaaagatcactcgggaacagaggcgccacatgaaaaggtgggaatactttatcgccgcggaggaagtgatctgggactatgcacccgtgatcccggccaacatggataagaagtaccggtcccagcatctggacaacttctcaaaccagattggtaagcactacaaaaaagtcatgtacactcagtacgaggatgagtcttttaccaagcataccgtcaacccgaatatgaaggaggacggaatcctcggcccgatcattagagcccaggtgcgcgacaccctcaagatcgtgttcaagaacatggcttcgcgcccatactcgatctacccgcatggcgtgactttcagcccgtatgaagatgaagtcaactccagctttacgagcggacggaacaatacgatgatccgggccgtccaaccgggcgagacttacacctacaaatggaatatcttggagttcgacgagccaaccgaaaatgacgcccaatgcctgactcgcccatactattccgacgttgacatcatgcgggatatcgcttcgggattgataggcctgctgctcatctgcaagtcgaggtcgctcgatcggcgggggatacaacgcgctgccgacatcgagcagcaagctgtctttgctgtctttgatgagaataagtcgtggtacttggaggataacatcaataagttttgcgaaaatccggacgaagtcaagcgggacgacccgaagttctacgaatcaaatatcatgtcgaccatcaacggatacgtgccggaatcgattaccactctgggcttctgcttcgacgacaccgtccagtggcacttctgctcggtcggaacgcagaacgaaattctgactatccactttactggccacagctttatctatggaaagcggcacgaagatactcttactctcttcccaatgcggggagagtcggtgaccgtgactatggacaatgtcggcacgtggatgttgacttccatgaactcgtcgccacgcagcaagaagctgcggctcaaatttcgggacgtcaagtgcatcccagacgatgatgaggattcttatgagatcttcgagccaccggaatcgactgtgatggctactcggaaaatgcatgatcggctggagccagaggacgaggagagcgatgccgactacgactatcaaaataggctcgcggcagcgctgggcatccgctccttccgcaactcctccctcaaccaagaggaagaagaattcaacctcaccgcactggcgctggaaaatggaactgaattcgtgtcaagcaataccgatatcatcgtgggatcgaactactcctccccgagcaatatcagcaagttcacggtgaacaatctggccgaaccccaaaaagccccatcgcaccaacaggccacgaccgcaggatccccactgagacacctgatcggcaagaactcggtgctgaactcaagcactgctgagcattcatcaccgtactctgaggaccctatcgaggacccgctgcagccagacgtgacgggcatcagactgctgtcgcttggagctggagagtttaagtcccaggaacatgccaaacacaagggaccaaaagtggagcgggaccaggcagccaaacatcgcttctcgtggatgaaactgttggcgcacaaggtgggacgccacctgtcacaggacactggctccccgagcgggatgaggccgtgggaggacctcccatcgcaggataccggatcaccctctcggatgcgcccgtggaaggatcctccgagcgacttgctgcttctgaaacagtcgaattcgtcaaagatccttgtgggtcgctggcacctggcttccgaaaagggatcttacgaaatcattcaggatactgacgaggatactgccgtcaacaattggcttatttccccacagaacgcatcaagagcctggggtgagagcactccgttggcgaacaagccggggaagcaatccggacacccgaaattcccccgcgtcaggcataagtcactccaagttcgccaggacgggggcaagtccagactgaaaaagagccaattcctcattaagactcggaaaaagaagaaagaaaagcacacccaccatgcaccgctctcgccgcgcaccttccacccactgcggtcggaagcctacaacactttcagcgaaagacggctcaagcactcattggtcctccataaatccaatgagacttctctgccgaccgatctgaatcagactctcccgtcaatggacttcggctggatcgccagcctgccggaccacaaccagaacagcagcaacgacaccggacaagcgtcgtgcccacccggactgtaccaaaccgtgccgcccgaggaacattaccagacttttccaatccaggacccagaccagatgcattcaacctccgatccgtcacatcgctcctcgtccccagaactgtcagagatgctggaatacgatcggagccacaagtcgttcccaacggacatcagccaaatgtccccatcttcggaacacgaagtgtggcagaccgtcatctcaccggacctgtcccaggtgaccctgtctcctgagctgtcgcaaactaacctttcaccagatttgtcgcacaccaccctcagcccggagctgatccaacgaaatctcagccccgccctggggcagatgccaatcagcccagatctgtcacacaccaccctttctcccgacctgtcccataccactctgagcttggatctttctcagaccaacctctccccggaactgtcgcagaccaacctgtcgccggcgctcggccaaatgcctctctcccccgacttgtcgcatactaccctttccctcgacttttcacagactaatctctccccggagttgtcccacatgactctgtcaccagagctctcacaaacgaatctgtcaccagcgctgggacagatgccgatttccccggatctctcccataccacgctctcccttgatttctcgcaaacgaacttgtcccctgagctctcccaaaccaacctgtcacctgctctcgggcagatgccgctcagcccggacccttcgcacaccactctgtcgctggacctctcccagacgaaccttagccctgaactgtcccaaacgaacctgtcgccagatctctccgagatgccactcttcgcggacttgtcacagattcctctgactcccgacttggatcaaatgactcttagccccgacctcggggaaaccgacctgtcaccgaacttcggacagatgtccctgtcgccggatctgagccaagtgaccctgtcgcctgacatcagcgacaccaccctgctgcctgacctctcgcagatcagcccgccacctgatctggaccagatcttttacccttcggagtcgtcacagagcctccttctgcaagagttcaacgaatcgtttccgtacccggacctgggccagatgccatcgccatcatcgccgaccctgaacgataccttcctctcaaaggaattcaaccccctggtcattgtgggcctgtccaaggatggaactgactacatcgaaatcatcccgaaggaagaagtccaaagcagcgaggacgactacgccgagatcgactatgtgccgtacgacgatccctacaagaccgatgtgcgcactaacatcaactcttcccgcgacccggacaacatcgccgcatggtacttgcgctctaacaatggcaacaggcgcaactactacatagcggcggaggaaatcagctgggattactccgaattcgtccaacgggaaaccgatatcgaggactcagacgacatcccagaggacacgacttacaagaaggtggtgtttcggaagtaccttgactcgactttcacgaagcgcgaccctagaggagaatacgaggaacatctgggcatccttgggccgatcatccgcgcagaggtggatgatgtcatccaagtgcgcttcaaaaatctggcaagcaggccatattcacttcatgcgcatggattgtcgtacgaaaagagctctgagggaaaaacctacgaagatgattctccggagtggttcaaagaagataatgcggtccagcctaactcgtcgtacacgtatgtctggcacgccactgagaggagcgggcctgaatcgccgggctccgcctgccgcgcatgggcctactactcggccgtgaatccggagaaggacattcactcaggattgattggacctctgttgatctgccaaaaaggcatccttcacaaagattcgaatatgcctatggatatgagggaattcgtgctcctgttcatgaccttcgacgagaaaaagtcctggtactatgaaaagaagagccgctcgagctggagattgacgtcaagcgagatgaagaaatctcacgagttccacgccatcaacggaatgatctactccctgcccggactgaagatgtacgaacaggaatgggtgaggctgcacctcctcaacatcggaggcagccaggatattcacgttgtgcactttcacggacagactcttctggaaaacgggaataagcagcaccaattgggagtgtggcccctcctgcctggatcgttcaaaactctcgagatgaaggcctcgaagcctggttggtggctgctgaacaccgaggtgggtgaaaatcagcgcgcaggtatgcagacccctttccttatcatggaccgggactgcagaatgccgatggggctgtccactggtattatctccgactcgcaaatcaaggcctccgaattcttgggatactgggaaccgcggctggcaagacttaacaatgggggtagctacaatgcctggtccgtggaaaagttggccgccgaattcgcctccaagccctggatccaagtggacatgcagaaagaagtgataatcactggaatccagacccagggcgccaagcactaccttaaaagctgctacaccactgaattctacgtggcgtacagctcgaaccagattaactggcaaatcttcaaggggaactcaacgaggaatgtcatgtacttcaacgggaactccgacgcatccaccatcaaggagaaccagtttgatcctccaatcgtcgccagatacatcagaatttctcccactcgggcctacaatcgaccaactctgagactcgaactgcagggttgtgaggtgaatggctgctccaccccactcggaatggaaaatggcaaaatcgagaataagcagatcaccgcctcctcattcaagaaatcctggtggggcgattattgggagcccttcagagccagactgaatgctcaaggccgggtgaacgcctggcaggcgaaggcgaacaacaacaagcaatggctcgaaattgacctgctcaagatcaagaagattaccgccatcattacccagggatgtaagtccctgtcgtcggaaatgtacgtgaagtcatacactatacattactccgaacagggcgtggagtggaagccttaccgcctgaagtcctcgatggtggacaagatcttcgagggaaacactaacactaaaggacacgtgaagaactttttcaacccgccgattatctcccgcttcatccgggtgatcccaaagacctggaatcaatctatcgcactgagactggaactgttcggatgcgatatctac

SEQ ID NO: 9024 - DNA, 6672 bp, Artificial Sequence
  Description of Artificial Sequence: Synthetic coding sequence
atgttcccgggatgtccccgcctgtgggtcctggtggtgctcggcacttcgtgggtcgggtggggaagccaaggaactgaagccgcacagctgcggcagttttatgtcgctgctcaaggaatcagctggagctatcgcccggagcccaccaacagctccctgaacctttccgtgacctcgttcaagaaaatcgtgtacagagaatatgagccttacttcaaaaaggaaaagccacagtcaaccatctctggcctcctgggaccgaccctgtacgcggaagtgggagacatcatcaaggtccactttaagaataaggccgacaagcctctctccatccatccgcagggaatacgctactcaaaactgtcggaaggtgcctcataccttgatcatacctttccggccgagaaaatggacgatgcggtggccccgggacgggaatacacttacgaatggagcatctccgaggactccggtccgacgcatgatgaccctccgtgcctgactcacatctattacagccacgaaaatctcatcgaggatttcaatagcggactcatcgggccattgttgatttgcaagaagggaactctgaccgagggagggactcaaaagacgtttgacaagcagatagtgctcctgtttgccgtgtttgatgaatcaaaatcatggagccagtcgtcctcgttgatgtacactgtcaacggatacgtgaacgggactatgccggacatcacggtgtgtgcgcacgaccacatttcctggcatcttcttggaatgtcatcgggaccagagctcttctcgatccatttcaatggacaggtgctggagcaaaaccatcacaaggtgtcagcgattactctggtttccgcgacctcaaccaccgcgaatatgaccgtgggcccagagggtaagtggattatcagctcgctgacccctaagcaccttcaggcgggaatgcaggcgtacattgacatcaaaaactgtccaaaaaagactagaaacctgaagaagatcactagagagcagcgtcgtcacatgaaaagatgggagtacttcatcgctgccgaagaagtgatctgggattacgccccagtgatcccggcaaacatggacaagaagtacaggtcgcagcatcttgataacttttcaaatcaaatcggcaaacactacaaaaaggtgatgtacacgcagtacgaggatgagtcttttaccaaacacactgtgaatcctaacatgaaggaagatggaattctgggccctatcatccgcgcccaagtgcgcgacacgttgaaaatcgtgtttaagaacatggcttctcggccatactcgatttaccctcacggagttaccttctcaccgtacgaggacgaagtgaattccagctttacgtccggtaggaataacaccatgatccgcgcagtccagccaggtgaaacttacacctacaagtggaatatcctggaattcgacgaacctaccgaaaacgacgctcagtgtcttaccagaccttactattcagacgtcgacatcatgagagacatcgcaagcggcctcatcgggctgctgctgatctgcaagtctcggtcactcgacaggcgtggaatccaaagggccgccgacatcgagcagcaagccgtgttcgccgtgttcgatgagaacaaatcttggtacctggaagataacatcaacaagttctgcgagaatcctgacgaggttaagcgcgatgatccaaagttctacgaaagcaatatcatgtcgactattaacggttacgtgccggaatcgatcaccactctgggattttgcttcgacgacaccgtgcaatggcacttctgctccgtggggacgcaaaacgagatcctgactatccatttcaccggacactcgttcatttacggcaagcgacacgaggacactctcacgctctttccaatgagaggagagtccgtgactgtcactatggacaacgtgggaacctggatgttgacctcaatgaacagctcaccgcggtcaaagaagctgcggctgaagtttcgcgatgtgaagtgcatcccagacgacgacgaggattcgtacgaaatcttcgaaccgccagagtcgaccgtgatggcgactcggaagatgcacgaccggctggagcccgaagatgaagaatcagatgccgactacgactaccaaaatcggcttgcggcagccctcggtatccggagctttcggaactccagcctgaatcaagaagaagaagaattcaatctgaccgcgctcgcattggaaaatggaacggaatttgtctcctcgaacactgacatcattgtgggaagcaactacagctctccctcgaacatcagtaaattcactgttaacaacctggcagaacctcaaaaggcgccgtcgcaccagcaagctactactgctggatcccctctgcgccacttgatcggaaaaaacagcgtgctgaactcctcaactgcggagcatagctcgccctattccgaggacccgatcgaagatccactgcagccagacgtgacgggtatcaggctgctctctctcggagcgggtgaattcaagtctcaagagcacgccaagcataagggaccaaaagtggaacgcgaccaggccgctaagcaccgctttagctggatgaagctcctcgcccacaaagtcggccgccacctcagccaggataccggatccccgtcgggaatgcggccatgggaggacctcccatcacaagacactggctccccatcgcggatgcgcccatggaaggacccgccgtcggatctgctcctgctgaagcaatcgaacagctccaaaattcttgtgggacggtggcatctcgcttccgaaaagggatcctacgaaatcatccaagacactgacgaggacactgcagtcaataactggcttatttccccgcaaaacgccagcagggcgtggggggagagcactccgctcgctaacaagccaggtaaacagtccggacaccccaaattcccgcgcgtgcgccataagtcactgcaggtgcggcaggacggaggcaaatcgcggctcaagaagtcccagttcctcatcaagacccgcaagaaaaagaaggaaaagcacactcaccatgcgccgttgtcaccccggaccttccacccactgcggtcggaagcgtacaataccttctctgaacgcagattgaaacacagcctcgtgctccacaagtccaacgaaacctcattgccaaccgaccttaaccagactctgccgtcaatggacttcggatggatcgcttcactgcctgatcataaccagaactcctcaaatgacaccggacaagcgtcctgtccgccgggactgtaccagaccgtgccgccagaagaacactaccaaacctttccgatccaagatccggaccagatgcactccacttctgacccatcgcaccggtccagctcaccagaactttcggaaatgctggaatacgatcgcagccacaagtcctttccgaccgacatttcacagatgtcgccttcctcggagcatgaggtgtggcaaaccgtcatctcaccggatctctcgcaggtgacgctctccccggaactgtcgcaaactaacctgtcgcccgacctgtcccacacgaccctgagcccggaactcatccaacgcaacctctcgccagcactcggtcaaatgccaatttcacctgatctttcacataccaccctgagcccagacctgtcacacaccactctgtccttggacctgtcccaaactaacctctctccggaactctcccagaccaatttgtcccctgccctgggtcaaatgcctctctcaccggatttgtcgcatactacgctctcgctggacttctcacaaaccaacttgtcgccagagctgtcccacatgactctgagcccagaactgtcgcagactaatctgtcacccgctctgggacaaatgcccatcagcccggatctttcgcatactactctgtctctggatttctcgcagacgaatctctcgcctgagctgagtcagaccaacctgtcaccagctctgggccagatgcctctttcgccagatccgtcgcacactactctgtcgctcgatctgtcccagactaacctgagccctgaactttcacaaacgaaccttagcccggacctgtccgagatgcccctgtttgccgacctctcccaaattccgctgaccccagacctcgaccagatgacccttagccccgacttgggggagactgatctttccccaaatttcgggcagatgtccctgtcgccggatctctctcaggtgaccctgtcgccagacatctcggatactactctcctccctgacctgagccagatctcacctcccccggatctggaccagatcttctacccttccgagagctcgcagtccctcctgctgcaagagttcaatgaatcttttccgtaccctgatcttggacagatgccatccccctccagcccgacgctgaacgatactttcctgtccaaggaattcaatccactcgtgatcgtgggcctgtcaaaagatggaactgactacattgagatcatccctaaagaagaggtgcagtcaagcgaggacgattacgcggagatcgactacgtgccctacgacgacccgtacaagaccgacgtccggactaatatcaatagctccagggatccagataacattgccgcctggtacctccgctcaaacaatggaaatcggagaaactactatattgcggccgaggaaatctcctgggattactcggagtttgtgcagagggagactgatatcgaagattcggacgacattccggaagataccacttacaagaaagtcgtgttcagaaaatacctggactcaaccttcaccaagcgggatccgcggggcgagtacgaagaacacttgggaatccttggacctatcattcgcgcagaggtcgatgacgtgatccaggttcggttcaagaacctggcctccagaccctacagcctgcacgcgcatggattgtcatacgagaagtctagcgaaggcaagacctacgaagatgattcgccagaatggttcaaggaggacaacgccgtacagccaaactcatcctacacgtatgtgtggcatgctaccgagcgcagcggacctgagtcgcccggatctgcgtgtcgcgcgtgggcctactatagcgcggtgaacccagagaaggatatccattcgggtctgatcggaccgttgctcatctgccaaaaaggaatcctgcataaggattcgaatatgccgatggacatgagagaattcgtgctgctgttcatgacgttcgacgagaagaaatcatggtattacgaaaagaagtcccggtcatcctggcgcctgacctcaagcgaaatgaagaagtcgcatgaattccacgccattaacggtatgatctactccctcccgggcctcaagatgtacgagcaggaatgggtgcgccttcacctgctcaacattggcgggagccaagacatccacgtggtgcatttccatggtcaaactctgctcgaaaatggtaacaaacaacatcagctgggagtgtggccgctcctgcctgggtcgttcaaaaccttggagatgaaagcatcgaagccggggtggtggctgctgaacactgaggtgggcgaaaatcagcgggcaggaatgcagaccccgtttctgatcatggatagagactgccgcatgcctatggggctctcaaccggaattatctccgactcgcaaatcaaggcatcggaatttctgggatactgggaaccgaggctggccagactgaataatggcggctcttacaacgcgtggtcagtcgagaagctggccgccgaattcgcgtcgaaaccgtggatacaagttgatatgcagaaggaggtgatcatcactggaatacaaactcagggagccaagcactacttgaaaagctgctacactaccgagttctacgtggcctactcctccaaccaaatcaactggcaaatcttcaaaggcaattccacccgcaatgtcatgtacttcaacggaaattccgacgcatcaaccatcaaggaaaaccagttcgacccccctatcgtggccagatacattcgcatcagccctactagagcatacaaccggcctactctgaggttggaactccagggttgcgaggtcaatggatgcagcacgcctttgggaatggagaacggtaagatcgagaacaaacaaatcactgccagcagcttcaaaaagtcctggtggggagactactgggagccctttcgggcccgcctgaacgcccaggggcgcgtcaatgcctggcaggcgaaagcgaacaacaataagcagtggctggagattgacctgcttaagattaagaagatcaccgccatcatcactcagggatgcaaatcactgtcctcagagatgtacgtgaagtcatacaccatccactactcggaacaaggcgtggagtggaagccataccggctgaagtccagtatggtggataagatcttcgaaggaaacactaataccaaggggcatgtgaagaacttcttcaacccaccaatcatctcgcgctttatcagggtcattccaaagacctggaatcagtccatcgccctgaggcttgagctcttcggatgtgatatctac

SEQ ID NO: 9025 - DNA, 6672 bp, Artificial Sequence
  Description of Artificial Sequence: Synthetic coding sequence
atgtttcctggatgtcctcgcctgtgggtacttgtggtgctgggaacttcatgggtcggctggggctcacagggaaccgaggcagcacagctgcgccaattctacgtggccgctcaaggaattagctggtcctacaggccagagccaactaactcgtcgttgaacctttcggttacgagctttaagaagatcgtgtacagagaatacgaaccttacttcaaaaaagaaaagccacaatcgacgatttcaggcctcctcggtcccactctttacgcagaggtcggagacataatcaaagtccacttcaaaaacaaggcagacaaaccactgtccatccacccccagggtattagatacagcaaacttagcgaaggtgcaagctaccttgatcacacgttccctgcagaaaagatggatgacgcagtggcacctggtcgggaatacacttacgaatggagcatttcggaggacagcggaccgactcatgatgaccccccttgtctgacccacatctactactctcacgagaacttgatcgaagatttcaactcaggcctgatcggtccacttctgatatgtaagaagggaaccctgaccgagggcggaacccaaaaaacttttgataagcagatcgtgcttctgttcgcagtgttcgacgaatccaagtcctggagccagtcgtcatcccttatgtacactgtgaatggatacgttaatggaactatgcccgatataaccgtgtgtgcacatgatcatatttcctggcatcttttgggaatgtcgtcgggacccgaacttttttcgattcatttcaacggacaggtgttggagcaaaaccatcacaaagtgtcggccatcaccctggtcagcgcgacctcaactaccgcgaatatgaccgtcggacctgagggtaagtggataatcagctcattgaccccaaaacaccttcaagcgggaatgcaagcatacatagacataaagaattgtccaaaaaagacccgaaacctgaagaagattactcgagaacaacgccggcatatgaagagatgggagtactttattgccgctgaagaggtgatttgggattacgcacctgtgattcctgcaaatatggacaagaaatacagatcgcaacatcttgataacttttccaatcagataggaaagcattacaagaaggttatgtacacccagtatgaggatgaatcttttactaaacacaccgtgaatcctaacatgaaggaggacggaattcttggacctatcatccgtgcacaggtccgcgacaccttgaagattgttttcaagaatatggcatcccggccgtactccatttatcctcacggtgtgaccttttccccctacgaggacgaagtcaacagctcgtttacgtcgggtaggaacaacaccatgattcgggctgtgcaacctggtgagacttacacctataagtggaacattctcgaattcgacgaaccgactgaaaacgatgcacaatgcctgaccagaccatactactcagatgtggacataatgcgggatatcgcctccggcctcattggattgctcctgatttgtaaatcgcgttcgctcgaccgacgtggtatccagagggcagcggacattgaacaacaagctgtctttgcagtgttcgatgagaataagtcttggtacctggaagataacattaacaaattctgcgaaaaccccgacgaagtgaaaagagatgaccctaagttctacgaatccaacattatgtcaacgattaacggatacgtgcctgaatcgatcaccacgctgggcttctgttttgatgataccgtgcaatggcatttctgttccgtcggcactcaaaatgaaattctgacgatccattttaccggacattcctttatctacggaaagcgccatgaggacactctgactcttttccctatgagaggtgaatcagtgactgtcaccatggataatgtggggacctggatgctcacgtccatgaattcaagcccgagaagcaaaaagctgcgattgaagtttcgggatgtgaagtgcatacccgacgacgatgaggacagctatgagatttttgaaccccctgaatcaacggtcatggccacgcgcaagatgcatgacagattggaacccgaggacgaggagtccgacgcggattacgattaccaaaaccgtttggccgccgcactgggcatccggtcctttagaaactcatccctgaatcaggaggaagaggaattcaatctgacggcactggctctcgagaatggaactgaatttgtgtcgtcaaataccgacataattgtcggaagtaactactcgtcaccatcaaacatatcgaaattcactgtcaataacctggccgaaccccaaaaggcaccctcgcatcaacaagcaaccactgcaggcagtccactgagacatctcatcggcaagaattcagtgctgaattcatcaactgcggaacattcgtccccctacagcgaagatcctattgaagatcctctgcagcctgatgtcaccggaatcaggctccttagcctcggtgcgggggagtttaagtcccaggaacacgcaaagcataagggtcccaaggttgagcgcgaccaagcagcaaaacataggttctcttggatgaagctgcttgcccacaaggtcggacggcacttgagccaagacactggatccccgtcgggaatgcgcccatgggaagatctgccatcgcaggataccggatcaccaagccgcatgaggccgtggaaggatcctccttcagaccttctcctgctgaagcaatcaaattcgtccaaaatcctcgttgggagatggcatctggcctcagaaaaggggtcatacgaaatcatacaggatacggacgaggacactgccgtgaacaattggcttatttcacctcaaaacgcatcccgagcttggggggagtcaactcctctggccaacaagccaggtaagcaatccggacacccaaaattccctagagtgagacataagtcgctgcaagtgcgccaggacggaggaaagtcacgtttgaagaagtctcagtttctcattaagactcgcaagaagaaaaaggaaaaacatacccaccatgcacctctttcgcctagaactttccaccctcttcgtagtgaggcctacaatacgttttccgaacgcagacttaagcattcgctggtgctccataaatccaatgagacttcattgcctactgatcttaaccagactcttccctcaatggacttcgggtggatcgcttcgcttccggatcacaaccagaactcctcaaacgatactggccaagcatcctgtcctcctggattgtatcagacggtccctccggaggagcactatcagacgtttcctatacaagaccctgatcagatgcattccacttcagatccgtctcataggtcgtcgagcccggaactttctgagatgctcgagtacgatcgctcgcacaaatcctttcccacggatatttcacagatgagcccttcatccgagcatgaggtgtggcaaactgtgatttcgcctgatttgtcgcaagtgactcttagcccagaactctcccagacgaatctgagccctgacttgtcccataccaccttgtcccctgaactcatccaacggaacctgtccccagcacttggacagatgccaatttcacccgacctttcacacaccaccctttcccctgatctgtcccacaccactctgtctttggatctgtcacaaaccaatctctccccagagctttcccagactaacctctcgccggcgcttggtcaaatgcctctgtctccagacctttcgcataccaccctctctctcgacttttcgcaaacgaacctgtctcctgaacttagccatatgaccctgtcgcccgaactgagccaaacgaatctgtcgcctgcactcggtcaaatgcccatcagtcccgacctctcccacacgactcttagcttggatttttcccagaccaacctgtcgccagaactctcgcagaccaatcttagcccagcactgggtcagatgccgctttccccggatccctcccatactaccctttcactggacctctctcaaaccaacctcagccctgaactgagccagactaatctctcgcccgacctcagcgaaatgccacttttcgccgacctttcgcagatcccactgactccagatctcgaccaaatgaccctgtctcccgatttgggtgaaaccgacctgtccccaaactttggtcagatgagcttgtcgccagacctttcccaagtgaccctctcgcctgatattagcgataccaccctcctgcctgacctttcacaaatctcgccccctcctgaccttgatcaaatcttttacccatcagaatcgagccagtccctgctgcttcaggaattcaacgagtcgtttccatacccggatcttgggcaaatgccctcgccttcatcgcctactctgaacgacacctttttgtccaaggagtttaatccactcgtgatagtcgggctcagtaaggatggcactgactacattgaaatcattcctaaggaggaagtgcaatcctcggaagatgattacgcggagatcgactacgtcccatacgatgatccctacaagaccgacgtgcggactaacatcaattcatcccgggatcctgacaatattgcagcgtggtacctccgctccaacaatggaaacaggcggaattactacattgcagcagaggagatcagctgggattacagcgaattcgtgcaaagagaaaccgatattgaggattcagatgatattccagaagatactacctacaaaaaggttgtctttagaaaataccttgatagcacttttaccaaacgagatcctagaggtgaatacgaagaacacctggggatcctcggcccaataatcagggccgaagtggacgatgtgattcaggtcagattcaaaaacctcgcatcgaggccatattcgcttcatgcacacggcctgtcctacgaaaagtcctctgagggaaagacttacgaggacgattcgcctgaatggtttaaggaggataacgcagtgcaacctaacagctcctacacctacgtgtggcatgcaactgaaagatcaggccctgaatcgccaggtagcgcatgcagggcgtgggcgtactacagtgcagtgaatcctgaaaaggacatacattcgggtcttatcggcccacttctcatctgtcagaaggggattctgcacaaggattccaacatgccaatggatatgcgtgaatttgtgctgctctttatgacctttgatgagaagaaatcgtggtattatgaaaagaagtcccgaagctcctggagactcacgagcagcgaaatgaagaagtcccatgaatttcacgcaattaacggtatgatctacagcctgcctggactgaagatgtacgagcaggaatgggtgcggcttcatcttttgaatataggaggatcacaagatatccatgtcgtccacttccatggacagactcttcttgagaacgggaacaagcagcaccagcttggggtgtggccgctgctcccaggttcgtttaagaccctggaaatgaaggcatcaaaaccgggatggtggctgctgaataccgaagtgggggaaaaccagcgggctggaatgcaaacccctttcctcataatggatagagattgtaggatgccaatgggtctgtccactgggatcatatcggacagccaaatcaaggctagcgaattcctcgggtattgggagcctcgccttgccagactcaacaacggagggagctacaatgcatggtcagtagagaaacttgcagcagagttcgcttcaaaaccgtggatccaggtcgatatgcagaaagaggtgattatcacgggtattcaaactcaaggagctaaacactacctcaagagctgttacaccactgagttttatgtggcctactcgtcgaaccaaatcaactggcagattttcaaaggtaacagtaccagaaacgtgatgtactttaacggtaactctgatgcttccaccattaaggaaaatcaatttgatcctccaattgtggcgcggtacatccgaatttcgcctacgcgagcatacaaccggccgacccttagacttgagctgcagggctgcgaggtgaacggctgttcgacgcccctgggaatggaaaacgggaaaatcgaaaacaagcaaattacggcctcgtcgttcaagaagtcatggtggggagactactgggaaccgttcagagctcggcttaacgcacagggaagagtgaacgcatggcaagcaaaggcaaacaacaacaagcaatggcttgagattgatcttctgaaaatcaagaagatcactgcgatcattacccagggttgcaagtcactgtcgagcgagatgtacgtgaagagctacaccattcattacagcgaacaaggggtcgagtggaagccctaccgcctcaagtcgagtatggtggacaagatctttgaaggcaacactaataccaaaggacatgtaaagaacttctttaaccccccaatcattagccggttcattagggttattcctaagacctggaatcagtcgatcgcactccggcttgaactcttcggctgtgacatttat

SEQ ID NO: 9026 - DNA, 6672 bp, Artificial Sequence
  Description of Artificial Sequence: Synthetic coding sequence
atgtttccggggtgtccacggctgtgggttctcgtagtgttgggcactagctgggttgggtggggtagtcaaggaaccgaggcagctcaactgaggcagttttatgtcgcagcacagggcatctcatggtcataccgccccgagcccaccaatagctccctcaatctgtccgtgacctcctttaagaagattgtgtatcgggaatatgagccttacttcaagaaagagaaacctcaatcaacaatttcggggctgctcgggccgactctgtatgcagaggtgggcgacatcattaaagtccatttcaaaaataaggcagacaaacccctgagcatacacccccaggggattcggtactctaaattaagtgagggggcaagctatctcgatcatacctttccggccgaaaaaatggacgatgccgtcgccccaggtagggagtacacttacgaatggagtatttctgaggactccggccctacccacgacgacccaccatgcttgacacacatttactactctcacgaaaacttaatcgaagatttcaattccggactcattggtcccctgctcatttgtaagaaaggaacactgaccgaggggggaacccagaagacttttgataagcaaattgttttgctgttcgctgtctttgatgaaagcaaatcttggtcacagtctagtagcctgatgtataccgtcaacgggtacgtcaatgggacgatgccggacatcacagtgtgtgcccacgatcatatctcgtggcacctgctgggcatgagttccggccccgagctgttctctatccattttaacggccaggtgttggagcagaaccatcacaaagtgagtgccattaccttggtaagtgccactagcacgacagctaacatgacggtcgggcctgagggtaagtggattattagctcgctaacccccaagcacttacaggctggtatgcaggcatacatcgatataaagaattgtccaaagaaaacgcgaaatcttaagaaaatcaccagagagcaacgacgccacatgaagaggtgggagtatttcattgccgcagaggaggtgatttgggattatgctcctgtcatccctgctaacatggataaaaagtaccggagtcagcatttggacaattttagcaatcagattggaaagcactacaagaaagtgatgtatactcagtacgaggacgagtcatttacaaaacacaccgtgaatccaaatatgaaagaggatggcatactgggtccaatcattcgcgctcaggtgcgtgacaccttgaaaatagtttttaagaacatggcctctagaccttattccatttacccacatggtgtgacctttagcccgtacgaagatgaagttaacagttcctttacgtcgggaaggaacaatactatgatccgggccgtccagcctggcgagacctatacctacaaatggaacattcttgagtttgatgagcccaccgaaaacgatgctcaatgcctaactcggccttattattcagatgtcgacattatgagagacattgcatcgggcctgataggcctactactgatttgtaagagcaggtcattggatcggcgtggcatccagcgggctgccgacattgagcagcaagctgtgttcgctgtgttcgatgaaaataagtcctggtaccttgaagataacataaacaagttttgcgagaaccctgacgaagttaagcgggatgaccctaagttctacgagtctaacattatgagtactatcaacgggtatgtgccggagagcattacaacccttggattctgcttcgatgacaccgtccagtggcatttctgttccgtcggcacgcagaatgaaattcttacaatccacttcacagggcattctttcatctatggcaagaggcacgaagacaccctcactctctttccaatgcggggcgaaagcgtgacagtgactatggacaacgtcggaacttggatgctgaccagtatgaactctagcccgcggtcaaaaaagctacgcctgaagtttagggacgtcaaatgcatacctgacgacgacgaggattcctacgaaatttttgagcctccagaatctacggtaatggctaccaggaaaatgcatgaccgcctggaacccgaggatgaagagagcgacgcagactacgattaccagaaccggttagcagcggcacttggcatcagatctttcaggaactcttccctgaaccaggaggaagaggagtttaatttgaccgcactggctcttgaaaatggaacagaattcgtcagtagtaatacagacatcatcgtaggctctaattacagttccccctcaaacatcagcaagttcaccgtaaacaatctagccgaacctcagaaggctccctcgcatcagcaggcaaccaccgccggttcaccccttcggcatctgatcgggaaaaactctgtgcttaactcctcaaccgcagagcactcctcaccatacagtgaggatccaatagaggatcccctgcagcccgacgtgaccggtattaggttactaagccttggagcgggagagtttaaaagtcaggaacacgccaagcacaaaggccctaaagtcgaacgggatcaagccgcaaagcatcggtttagctggatgaagctgttagcccataaagtgggcagacacttaagtcaggacacgggctcgccctcaggcatgaggccttgggaggacctgccttcgcaggatacaggttcacccagtcggatgcggccatggaaggatccgccatctgacctactcctgctgaaacagagtaattcctccaaaatcctcgttggcaggtggcacctcgcatcggagaaaggtagttatgagatcattcaggatacagatgaagacacagcagtcaacaactggctgattagtccacaaaatgccagcagagcttggggagaatcaacccctctggctaacaagcccggtaagcaatccggccatcctaagttccccagagtgcgacataaatccttgcaggtgagacaagacggaggtaagtcacggcttaagaaatcacagtttctcatcaaaaccaggaaaaagaaaaaggagaaacacacacaccatgcaccattgagtccccgaacttttcacccccttcggtctgaagcgtacaatacattttcggaacgacggctgaagcattctctagtcctccacaagtcgaatgagacctccctccccacagatctcaaccaaactctgccctcaatggattttggctggatcgcgtctttgccagatcataaccagaacagctccaatgacaccggccaggcttcctgcccccccggcctctatcaaaccgttccccccgaagaacactaccagacgttcccaatccaggaccctgaccagatgcacagcacatccgacccgagccatcgctcttcatctcctgaactctccgaaatgctggagtacgaccgctcccacaaatcttttcccaccgatataagccagatgtctccctcttccgaacacgaggtctggcaaactgttatatcacctgacctgagccaggtgacgctgtcccccgaattatcccaaacgaatctgtcccctgacctgtcgcacaccaccctgtctcctgaactgattcagcggaatctttcccctgcgttgggccaaatgcctatctcccccgacctttcccacaccacactctcccccgatctttcccacactactttgtcactagacttgtcccagacgaacctgtcgccggagctctctcagacgaacctgtccccagcactgggccagatgccactaagtcctgacttatcacacaccactctatcgctggatttttctcagactaacctctcacctgagttatcccacatgacactatccccagaactctcccagacaaatttgtcccccgcccttggacaaatgccaatctcccccgacctgtcacatactaccctgagtttggactttagtcagacgaacctgtcccctgaactgtcacagactaatttatccccagcactgggacagatgccactctcccctgatccaagccataccacactctcactggatctgtcccagactaacctttcacccgagctgtcccagactaacctcagtccagacctgtccgagatgccacttttcgcggacctgagccaaatccccctcacaccggatttggatcagatgactctttctccagaccttggcgagactgacctgtccccgaactttggacagatgagcttgagtcctgatctctctcaggtcactctgtctcccgatatctccgacacaacgctgctgccggacctcagccagatttctcccccccctgacctagaccaaatcttttacccaagcgagtcatcacagtccctactgctgcaggagttcaatgagagtttcccataccccgacttggggcagatgccctcgccaagctccccaaccttgaatgatactttcttgtccaaggaatttaatcccctggtgatcgtgggcttgtctaaagatggcactgattatatcgagatcattcctaaagaagaagttcagtctagtgaggacgattatgccgagattgactacgtcccctacgacgatccttacaaaaccgacgtgcgtaccaatatcaactcctcccgggacccagacaatatcgcagcctggtacctcagaagcaacaacggcaacaggcgcaattactatatcgcagccgaagaaatttcgtgggattacagcgagttcgtacaaagggaaacagatattgaagacagtgatgacattccagaagacactacttataagaaggtggtttttagaaagtatctcgatagcactttcaccaagcgggatccgcgtggggaatacgaagagcatcttggaatcctaggacctataatacgggctgaggtcgatgatgtcattcaggtccggtttaagaacttggcttctcgaccttattcactgcacgcacacgggttgtcatatgagaaaagttcagagggtaaaacctatgaagacgatagcccagagtggtttaaggaagataatgcagtgcaaccaaactccagttacacctatgtctggcacgcgaccgagagatctggcccggaatctccgggctccgcttgtagggcatgggcttactacagcgccgtgaatcctgagaaggatattcactcgggcctcatcggccctctcctgatatgtcagaagggcatcctgcacaaagattccaacatgcccatggacatgcgcgagttcgtattattgttcatgacattcgatgagaaaaagagctggtactacgaaaaaaagagtcgcagctcttggcggttgacctcgtctgagatgaagaaaagtcacgaattccacgctattaacggaatgatctacagtttaccagggttgaagatgtacgagcaggaatgggtccggctacatttactgaatatcgggggttcacaggacatacacgtggttcacttccacggtcaaacacttctggagaacggaaataaacagcatcagctcggtgtatggcctcttcttcccggctcatttaaaacactggagatgaaggccagcaaaccaggatggtggctgctgaacacggaagttggagaaaaccagagggccgggatgcagacaccattcctgatcatggatcgggattgtcggatgccaatgggcctgagcacaggcattatatccgactcccagatcaaggcctcggagtttctgggttactgggagccccgtctcgctcgcttaaataacggtggttcttataatgcgtggtctgtagaaaagctggcagcggaatttgcatccaaaccttggattcaggtggatatgcagaaagaggttataattaccggaattcagacacagggggctaaacattacctcaagtcttgctacactacggaattctatgtggcctactccagtaatcagatcaactggcaaatatttaagggcaattccacgcgaaatgtcatgtacttcaatggaaacagtgacgcctctacgattaaggaaaatcagtttgatcccccgattgttgccaggtatattagaatttctccaactcgggcctataaccgtccaacactgcggctggaattacaggggtgtgaggtgaatgggtgctccactccgctgggaatggagaatgggaaaatcgagaataagcagattactgccagctctttcaagaaatcttggtggggggattattgggaaccttttagggcacgactgaatgcgcagggtcgtgtcaacgcttggcaagccaaagctaataacaataagcagtggttggaaatcgatttactgaagatcaaaaaaatcacagctatcatcacacaaggctgtaagtctctgagttccgagatgtatgtcaaatcctatacaatccactattcagagcagggcgttgaatggaaaccttatcggctcaagtcttctatggtcgataagatcttcgaaggcaatactaacaccaagggtcatgtcaaaaatttctttaatcctcctattatttccaggtttattagagtgatacccaagacctggaaccagtcaatcgccctgcgactggagcttttcggctgcgatatatat

SEQ ID NO: 9027 - DNA, 6672 bp, Artificial Sequence
  Description of Artificial Sequence: Synthetic coding sequence
atgtttcctgggtgccctagactgtgggtgctggtcgtactgggtacatcctgggtcggatgggggtctcagggcaccgaggcggctcaactgaggcagttctatgtggctgctcagggaattagctggtcgtaccgcccagagccgaccaactcatctttgaatctgtccgtgacatcttttaaaaaaattgtataccgagagtatgaaccttacttcaagaaagaaaagccccaaagtacgatttctggcttactgggacccaccctctatgctgaggtgggagatattataaaggtacatttcaagaataaggccgacaagcccctttctatccacccacaaggtatcagatactcgaaactctctgaaggtgcctcctaccttgaccacacgttccccgccgaaaaaatggacgatgcagttgcgcctggacgagagtacacgtacgagtggagcatatcagaggacagtggtcctacccatgacgacccaccgtgtctaacgcatatatactacagccacgagaacctcatagaagacttcaacagcggcctgatcggacccctgctgatctgtaaaaaggggacactgaccgagggcggcacacagaagacttttgataaacaaatcgtgctgctgtttgccgtttttgatgagtctaaatcctggagccagagctcctccctgatgtacaccgtcaatgggtatgtcaacggaacgatgcccgacatcactgtgtgcgctcacgaccacatttcgtggcacttgctaggaatgagtagcggacctgagttgttttctattcatttcaatgggcaggtgctggaacagaaccaccacaaggtttctgccatcacactcgttagcgcaacatcaacaaccgcaaacatgactgtcggcccagaagggaagtggattataagtagcttgacaccaaaacacctgcaggcagggatgcaagcatacattgatatcaagaactgccctaagaaaacccggaacctaaagaaaatcactcgggagcagcgaaggcacatgaagaggtgggagtacttcatcgcagctgaggaggtgatctgggactacgccccggtcatcccggccaacatggacaagaagtaccgctcccagcatcttgacaacttcagcaaccagattggaaagcactacaaaaaggttatgtacacccagtacgaagacgagagttttaccaaacatacggtgaacccaaatatgaaagaggacggcatcctgggaccgattattagggcccaggtgagggacaccctaaagatcgtattcaagaacatggccagcagaccctacagcatttatccccacggagtcacatttagtccatatgaggacgaggtcaattctagttttacgtctggacggaacaacactatgatacgggctgtgcaaccaggggagacttatacctataagtggaacatcctggaatttgatgaacccaccgaaaacgacgcccagtgcctgacacgcccctattatagcgacgtggacatcatgcgcgatatcgcctctggcctcatagggctgcttcttatctgtaagtccaggtctcttgaccgtcggggtatccagagggctgccgatatcgagcagcaggctgtctttgcagtctttgacgagaataagagctggtacctggaggataacataaacaaattctgcgaaaaccccgatgaagtgaaaagggatgatccgaaattctatgagtctaatataatgtcaaccatcaacggatacgtccctgagagcatcactaccctggggttctgttttgatgacacagtacagtggcatttttgctcggtgggcacacagaatgagatactgacaattcatttcacaggtcatagttttatctacggtaagaggcacgaagatacgctcacactcttccctatgcgtggagaatctgtcactgtgacgatggacaacgtgggaacctggatgcttacttccatgaactcctcccctcggtcgaaaaagcttcgactgaagtttagggatgttaagtgtatccccgacgatgatgaagatagctatgagatttttgagcctcctgagtcaactgtgatggccactagaaagatgcacgataggctcgagccagaggacgaggaatctgacgctgattacgactatcaaaaccgcttggcagctgctctgggcatacgatccttccggaactcctctctgaaccaggaggaggaagaattcaatctgactgcattagctctcgaaaacggcacagaatttgtaagtagcaatacggacatcatcgttggaagcaactattctagcccaagcaatatttcaaaatttactgtaaataatcttgccgaaccccagaaggcaccttctcaccagcaagctacaactgccggtagtccgctgcgtcacctcattggtaagaactccgtccttaatagtagtaccgccgagcattcatcaccatactctgaggaccccatcgaggatcccctccagccagatgtgaccggaatacggctactgtccctgggagcaggcgaattcaagtctcaggaacacgccaaacacaagggtcccaaggtggagcgcgatcaggcggcaaagcaccggttttcctggatgaaattgctggcacataaggtcggacgtcatctctcgcaggatactggttccccgtcaggaatgaggccctgggaggaccttccatcccaggatactgggagtccaagccgcatgcgcccatggaaggatcctcctagtgacttgctgttgctgaagcagtccaatagcagcaagatactggtagggcggtggcaccttgcctccgagaagggctcctatgagatcatccaggatacagatgaggataccgccgttaacaactggttgatcagccctcagaatgcctcacgcgcatggggcgaatccacacccctggcgaataagcctggaaaacaatctggacacccgaagtttccgcgagtgcgtcataagtcactccaggtgagacaggatggtggcaaaagtagactaaagaagagccagtttctcatcaagacacggaaaaagaagaaggagaaacatacccaccatgccccattgtccccaagaactttccacccactgaggtctgaggcatataacacttttagtgagcgccgattgaagcattctctggttctacacaagagcaatgagacttcacttcccacagatctcaatcagaccctgccatctatggactttgggtggatcgcttctctgcccgatcataatcagaattcgtctaacgacacgggtcaggcctcttgcccaccagggctgtaccaaactgttccgcctgaggagcactatcagacctttccaattcaggaccccgaccagatgcacagcacttctgatcctagtcataggagcagctccccagagctctctgagatgctcgaatacgatagaagtcacaaatcttttcctaccgatatcagccaaatgtcacctagtagcgagcatgaggtatggcagacggtgatttccccggacctctcccaggtgaccctttctcccgagctttctcagaccaacctgagcccggacctcagtcacacgaccttaagtcctgagctgatccagcgaaaccttagccccgccttggggcagatgcctatctcaccggacctctctcatacgaccctctcacctgacctgtcacacactaccctatcccttgacctgagccagactaatctgagcccagagctatcacagacaaacctatctcccgctctcggccagatgcccttgagtcccgatctttctcacaccacactttctctggacttcagccaaacgaatctttctcctgagctgtctcacatgaccctgagtcctgaactttcccaaaccaacctatctcctgcccttgggcaaatgcccatcagtccagacctatctcataccacactctccctggacttctcccagacaaatctttcacctgaattgtcacaaacaaatctgtcccctgccctgggacagatgcccctgtctcctgacccctcccatactacattgagcctggatctcagtcagacaaacctcagcccagaattgagccaaacaaacttatctccggacctcagcgaaatgcccttattcgccgacctgagccagatcccactgacacccgatctggaccagatgacactgtccccagacctgggtgagaccgacctcagcccaaattttggacagatgtctttgtctcccgacctttcccaggtcacgctatctcccgacatcagtgacacgacattgctccctgacctcagtcagatctctcctccaccggacctggatcagattttttacccgtccgaatcttcccagtctctgctgctgcaggaattcaacgagtcatttccataccctgacttgggccagatgccttccccttcctcccccaccctcaatgacaccttccttagcaaggagttcaatccgctcgtaatcgtgggactgtcgaaagacggaacagattacatagagatcatacccaaagaagaggtgcaatctagtgaggatgactacgccgaaatcgattatgtcccctacgatgacccttacaagaccgatgttcggactaacatcaatagctcgcgtgaccctgataacatcgctgcctggtatctgcggtctaacaacgggaaccggagaaactactatatcgcagcggaagaaatatcctgggactacagtgagttcgtgcagcgtgagactgatattgaggactctgatgacatcccagaggacacaacttacaaaaaagttgtgttccgcaaatacctggactcgacattcactaagagggacccgcggggcgagtatgaagagcacctcgggattctcggccctataattcgcgctgaggtggatgacgtgatacaggtgcgttttaaaaaccttgcctctagaccttattcccttcacgcacatggactcagttacgagaaatcaagcgagggtaagacttacgaagatgattcgcctgaatggtttaaggaagataatgccgtgcagcctaactcttcttacacatacgtgtggcacgcaacagaacgttccgggccagagtctccgggctccgcttgtagggcatgggcatactactcagctgtcaaccctgaaaaagacatccacagcggtctgataggccccctattgatttgtcagaagggaattctgcacaaggatagcaacatgccaatggatatgcgggaattcgttctcctgttcatgaccttcgacgaaaagaagtcttggtattacgaaaagaagtccagaagctcctggcgccttacatcttcagagatgaaaaaatctcatgagttccacgccattaatgggatgatctactctttgccaggcttgaagatgtacgagcaggagtgggtgcggttgcaccttcttaacataggaggctcccaggatattcacgtggtacatttccatggacagaccctattggaaaacggcaacaagcagcaccagctcggggtctggcctttgctgcccgggtcatttaaaaccttagaaatgaaagcttccaaaccagggtggtggctcctgaacactgaagtgggggagaatcagcgagcaggcatgcaaaccccatttcttattatggatagagattgccgcatgcccatggggttgtccaccgggataatttcagacagtcagattaaagcatcggagtttttgggctattgggagcctcgcctggccagattgaataacggaggttcatacaacgcctggagcgtagagaagttggccgcagagtttgcttctaaaccctggatacaggtcgatatgcagaaagaggtcatcatcaccgggatccagacacagggagctaagcactatttaaaaagctgttatactactgaattctacgtggcatacagcagcaaccagatcaattggcagatcttcaaagggaactcaactcgtaacgtaatgtactttaatggcaattctgacgcatctaccattaaagaaaaccagttcgatcccccaatcgtggcacgctacatacgaattagtcctacccgagcttacaacagaccgactctgcggctggaattacagggttgcgaagttaacgggtgttccacgccgctcggaatggaaaacggtaaaatcgaaaataagcagatcacagcctcttcgttcaagaaaagctggtggggagactactgggagccatttcgtgctcggctgaacgcacaaggcagggttaatgcctggcaggcgaaggccaacaacaacaagcagtggttagaaatcgatttgcttaagatcaagaaaataaccgcaatcattactcagggctgtaagtccctgagcagtgagatgtatgtgaaaagttacaccatccactactcggaacagggggttgagtggaagccttatcgtctgaagtccagcatggtagacaagatattcgaggggaacacaaataccaaaggacacgtaaagaatttcttcaaccctccaatcatttccagatttattagggtgattccgaagacctggaaccagtctatcgctctccgcctggaactcttcggatgtgatatttac

SEQ ID NO: 9028 - DNA, 6672 bp, Artificial Sequence
  Description of Artificial Sequence: Synthetic coding sequence
atgtttcccgggtgccctcggctgtgggtgctcgtagttctgggaacttcatgggtcgggtgggggtctcagggtacggaagccgcccaactgcgacagttctacgttgccgctcagggaatatcttggagttacaggcctgaaccaaccaactctagtctgaatctgagtgtgacgtcattcaagaaaatagtgtatcgcgagtacgaaccctattttaagaaggagaaacctcagagtactatctccggtttgctgggccccactttgtacgcagaggtgggcgacatcatcaaggtgcattttaagaataaagcagacaagcccctgagcatccacccccagggaataaggtactcaaaacttagcgagggtgcctcgtacttggaccatacttttcccgcagaaaaaatggatgatgctgttgctcccgggcgggaatatacttatgagtggtccattagcgaagactcgggccccacacatgatgaccctccgtgcctgactcatatctactactctcatgaaaatctcatcgaggattttaacagcggactcatcggtccgttgttgatttgcaaaaagggtacgctcactgaaggcggaacccagaagactttcgacaaacagattgtgctcctgttcgccgtgttcgacgagtccaagagttggtcccagtctagtagcctcatgtacaccgtcaacggctatgttaacggcactatgcccgatataacagtttgtgcgcacgaccacatcagttggcatctcctgggaatgagttctggtccagaacttttttctatacatttcaatgggcaggtcctcgagcagaatcatcacaaagtttcggctattacactcgtgagtgccacctctacaacagcaaacatgaccgtagggccagagggtaagtggatcatctcctctctgacacccaaacatctccaggcaggcatgcaagcatatattgatattaagaactgccctaaaaagacaagaaacctgaaaaaaatcacaagggaacaaaggcgccacatgaaacggtgggaatactttatcgctgcggaagaagtcatatgggactacgcacctgtcatcccggccaacatggacaagaaatacaggtcacaacaccttgacaacttcagcaaccagattggtaagcattacaagaaggtgatgtatacgcagtacgaagatgagtcttttactaagcatacagtcaatcctaacatgaaagaggacggcattctgggacccattatcagagcacaggtccgggacacactgaagatcgtatttaagaacatggcgtcccggccttacagcatttatccccatggcgtaacctttagcccatatgaggatgaagtaaactcaagttttacaagtggacggaacaataccatgattagagcggtacaacctggagaaacgtatacttacaaatggaacattctagaattcgacgagccaacggagaatgatgcacagtgcctgactcggccttattattctgatgtggatatcatgcgggacatcgcctctggcctcataggtttgctgctcatatgtaaatcaagaagtttagatcggcgcggcatccagagagccgctgatattgagcagcaggctgttttcgccgtttttgatgaaaataaatcttggtacttggaggacaacatcaacaagttttgtgaaaatcccgatgaagtcaagcgggatgatccgaagttctatgagtcaaatattatgagcacaatcaacggctatgttccagagtccatcactaccctgggcttttgtttcgatgatactgtccaatggcatttttgttccgtcggcacgcagaacgaaatccttacaattcactttactggccactcctttatttatgggaagagacacgaggatacgctcacactttttcctatgcggggtgagtccgttaccgtcacaatggacaacgtgggtacatggatgctgaccagcatgaactcttccccccgcagcaagaaactccggttgaagttccgtgacgtcaagtgcatcccagacgatgatgaggactcctatgagatctttgagccaccagagtccactgttatggccaccagaaagatgcacgataggctcgagccggaggacgaggagtctgatgctgattacgattaccaaaacagactggctgccgcactcgggatacggtcctttagaaatagttcgctaaatcaggaagaggaagagtttaatctaactgcccttgccttggagaatgggacggagttcgtttcaagtaacactgatataatcgtgggttccaactattcctctccatcaaacatctccaagtttaccgtaaataacctggctgagccacagaaggcccccagtcaccagcaggctactacagcaggttctccgctgcgacacctaatcggcaagaatagtgtgcttaacagctcgactgccgagcactctagtccatactcagaagacccaattgaagatcccctgcagccggatgtgacaggcattagactcttaagtctgggcgctggagagttcaagtcacaggagcatgccaaacacaagggtcccaaggtagagcgcgatcaggccgcaaaacatcgattctcctggatgaagctgttagcccacaaggtggggagacacctgtcacaagatactgggagccctagcggaatgaggccttgggaggatctgccatcccaggatactgggagtccatcccgaatgcgtccttggaaggatcccccatccgacctgttgctgttgaagcagtctaacagtagcaaaattctggtagggagatggcatctggcctcggagaaaggctcatatgagattattcaggataccgacgaggatacagcagtcaataactggctgatttctccccagaatgcctcccgtgcctggggcgagtctactcctctggctaacaagcctgggaagcagtcaggacaccctaaattcccccgcgtgcggcacaagagcctgcaagtgcgacaggatggtggcaaaagtcgcctaaagaagtcacagttcttaattaaaacacgcaaaaaaaagaaggagaaacatacccaccacgcccctctttcacctaggactttccacccgctaaggtcggaggcttataatacgttttcagaaaggcgtctcaagcacagcttagtcctccataaaagcaacgagacttccctcccaaccgacctgaatcaaaccctcccttccatggatttcgggtggatagcctcactccctgatcacaatcaaaacagctccaatgatacaggtcaggctagttgccctcccgggctgtatcagactgtgccaccagaggagcattaccagacattcccaatccaggaccctgatcagatgcacagtacttcagatcccagtcataggtccagctcacctgagctgtcagagatgctcgagtacgacagaagccacaagtcattccctactgatatcagtcagatgagtccatccagcgaacacgaggtctggcaaacagtgatctcacccgacctgtcccaggtcaccctgtcacctgagctttcccagactaacctgtctccagatctgtcacacacaacactgtcccccgaattaatccagaggaacctgtctccggcattaggccagatgccgatcagccccgatctgagccacacaacactgtctccggatctttcccatacgaccctttcgttagacctctctcagaccaatttaagtcccgagctgagccaaaccaatctttcgcctgccctgggccagatgccattgtcccccgatctctctcacactacgctgagtttagactttagtcaaaccaacctcagtcctgagcttagccacatgactctatctcctgaactgagccagacaaacctgtccccagcactgggccagatgcccatctcccctgatctgagccacacgacactcagccttgacttctctcagacaaacctttcccccgagctgagccagaccaatttgagcccagccttgggccaaatgccactttctcccgatccgtcgcacaccacactgagtctggacttgtcacagactaacttatcccctgagctgtcccaaacaaatttgtcgccggacctgtccgaaatgcccctattcgccgacttatctcagattccacttacccctgacctggaccaaatgacgttaagcccagaccttggggaaacagatctttcacctaatttcgggcaaatgtccctatcccccgatctgagccaggtgacactgtctcccgatatttcagacaccaccctgctacctgacctctctcaaataagcccgccaccggacctggaccaaatcttctacccctctgaaagctcgcagagtcttctgctgcaggaatttaatgagagttttccttaccctgacctggggcagatgccaagcccatcatcgcccaccttgaacgacacattccttagcaaggaattcaatccgctggttatcgtcgggctgtcaaaggatggcaccgactatatcgagatcatccccaaggaggaggtccaatcttcggaggacgattacgcggaaatcgattacgtcccttatgacgatccatacaagactgatgtaaggacaaatatcaattctagtcgggaccctgataacatcgctgcctggtatctcagatctaataatggtaacaggcggaattactacattgctgctgaggagatctcgtgggattattcggagttcgtacagcgggaaactgacatcgaagactctgatgatattccagaagatacaacctacaaaaaagtggtcttccgcaaatatcttgattccacgtttactaaacgtgaccctcgcggggagtatgaggaacatttaggaattctgggccctatcatccgagccgaggtcgacgatgtcatccaggtacgatttaagaacctcgcgtctagaccctacagtttacacgcgcatgggttgtcatacgagaagtcttccgagggaaagacatatgaagatgacagtcccgagtggtttaaggaggataatgcggtccagcctaattccagttatacttacgtgtggcatgccacggagaggtcgggcccagaatctcccggatccgcttgcagagcatgggcctattacagtgctgtgaacccagagaaagatatacactccggattaataggccctcttctcatctgtcagaagggcatactacacaaggattctaacatgccaatggacatgagggagtttgttctgctatttatgactttcgacgagaaaaagagctggtactacgaaaagaaaagtcgatccagctggagactgacttcctcagagatgaaaaaaagccacgaattccatgctatcaacgggatgatctacagcctcccaggattaaaaatgtacgaacaagaatgggtgcgcctgcacttgctaaacattgggggttcacaggacatccatgtggtccatttccacggccagacactcttagaaaatggcaataagcagcatcagctgggggtttggcccttactgcctggatcctttaaaacgctggagatgaaggcgagtaaacccggctggtggctgctgaacacggaggtcggagagaatcaacgggccggtatgcagacaccatttctgatcatggacagggactgtaggatgcccatggggctgtcgacggggattatctcggattcacaaattaaagcaagcgagttcctgggttactgggagccccgattagcccggttaaacaacgggggcagttataacgcttggtccgtggagaagcttgctgctgagttcgcctcaaaaccctggatacaagttgacatgcagaaggaagtgattatcaccgggatccagacacagggggcaaaacattatctgaagagctgctacactactgaattctatgtggcatactcgtccaaccagattaattggcaaatctttaagggcaattctacccgcaacgtgatgtacttcaacgggaactccgacgcttcgaccataaaggagaaccagttcgatcctccaatcgtagctaggtacatcagaatatccccaacgcgggcctacaacagacctacactcagattggagttgcagggctgcgaagtgaacggatgttctacccccctcggtatggaaaacggaaagatagagaataaacagattacggcgagcagctttaaaaaatcctggtggggggattattgggagcctttccgggcaagactgaacgcacaggggagagtgaacgcttggcaagccaaagctaacaataacaaacaatggctcgagatagatcttctaaagatcaaaaagattacagcaatcatcacgcaagggtgcaagagcctgtctagcgagatgtacgtcaaaagctatacgatccattactctgaacagggagttgaatggaaaccctaccgtctcaaatcatctatggtagacaagatttttgagggcaacaccaataccaagggacacgttaagaactttttcaatccaccaatcatttctagatttatacgggtaatccctaagacctggaaccagagcatagcactccgactggagcttttcggatgtgatatttat

SEQ ID NO: 9029 - DNA, 6672 bp, Artificial Sequence
  Description of Artificial Sequence: Synthetic coding sequence
atgtttcctggatgtccccgactctgggtgctggtcgtcctgggaacttcctgggtggggtggggatcgcaaggaactgaagctgcgcaactgcgccaattctacgtagcggctcagggaatctcatggtcgtaccggccggaaccaactaattcgtccctcaacctgtctgtcacctcgttcaagaagatcgtgtaccgcgaatatgagccatacttcaagaaggaaaaaccgcaaagcactatctcgggactgctggggcccacgctttacgcagaagtcggagacattatcaaggtgcatttcaagaataaggcggataagccgctgtccatccaccctcaaggcatccggtactccaaactgagcgagggggcctcctacttggaccacacctttccggccgagaagatggacgacgctgtggcgcccggacgggagtacacgtacgagtggtccatctcggaagatagcgggcctacccacgatgacccgccctgccttacccacatctactactcccacgagaacctgatcgaggatttcaattcgggcctcatcgggccacttctgatctgcaaaaaaggaactctgactgagggaggaactcagaaaacttttgacaagcaaatcgtgcttttgttcgctgtgttcgatgaaagcaagtcttggtcccaatcgtcgtcgctgatgtataccgtgaacgggtacgtgaacggaaccatgcccgacatcaccgtatgtgcccacgaccatattagctggcatctgctgggcatgtcctccggaccggaactgttttcgatccatttcaatggacaggtgctggaacaaaaccaccacaaagtttcagcgattaccctggtgtccgccacctccacgactgcgaacatgaccgtcggaccggaggggaagtggataatctcgtccctgaccccaaaacacttgcaggcagggatgcaagcctacatcgatatcaaaaactgccctaagaaaacccggaacctgaagaagataactagggaacagcgtcggcatatgaagagatgggaatacttcatcgctgcggaagaagtgatctgggattacgcaccggtgatcccggcgaacatggacaagaaataccgctcgcagcatctcgacaatttctccaatcagatcggcaaacactataagaaggtgatgtacacccagtacgaggacgaatcgttcaccaagcacacggtgaatcctaatatgaaggaggacggaatcctcggcccaatcatccgagcgcaggtccgcgacaccctgaagatcgttttcaagaatatggcctcacggccttactcgatctaccctcacggagtcaccttttcgccttacgaagatgaggtgaacagcagctttacttcgggacggaataacaccatgatccgggcagtgcagcccggcgaaacttacacctacaagtggaacattctggagttcgatgagcctaccgagaacgacgcccagtgcctcaccaggccctactattctgatgtggacattatgcgggacatcgcctcaggacttatcggcttgctgcttatctgcaaaagtagatctctcgacagacgcggcatccagagagccgctgatatcgaacaacaggcggtctttgccgtgttcgacgaaaacaaatcgtggtacctggaggacaacattaacaaattctgtgagaacccggacgaagtgaaacgcgatgacccgaaattctacgagtccaacatcatgtcgaccatcaacggttatgtgccagaatccatcaccaccctgggcttttgcttcgacgataccgtccagtggcatttctgttcggttggcacccaaaacgagatcctcaccatccattttactggacactccttcatctacggcaagcgccacgaagatacccttacgctgttcccaatgaggggcgagtctgtgaccgtgaccatggataacgtgggtacctggatgctcacgtcgatgaacagttcgccgcgctcgaagaaacttcggctgaaatttcgcgatgttaaatgcatcccggacgatgatgaggactcatacgaaatctttgagccgccggaatcaaccgtcatggccacccgcaaaatgcacgaccgcctggaaccggaggatgaggaatccgacgccgattacgactaccaaaaccggctggcggcagccctgggaatccgctcgttcagaaattcgtccttgaatcaggaagaagaagaattcaacctgactgccctcgctctcgaaaatggaacggaatttgtctccagcaataccgacatcatcgtgggatccaactactcatccccgtcgaacataagtaaattcactgtgaacaatctcgccgagccacagaaggccccgtcgcaccaacaggctaccaccgctggttcaccactgcgccacctgattggcaagaactcggtgcttaattcatccacggcggaacattcatccccatacagcgaagatcctatcgaagatccgctgcagccggacgtgactggtattcggcttctgtcgctgggagccggagagtttaagtcacaagagcacgcaaagcacaagggacctaaggtcgaaagagatcaggctgctaagcatagattcagctggatgaaattgctggcgcataaagtggggaggcacctgtcccaggacactggaagcccgtcggggatgcgcccatgggaggacttgccttcccaggacaccggatcgccttcccgcatgcgcccttggaaggacccgccgtccgacctgcttctgttgaagcaaagcaattcatctaagattctcgtcggacgctggcatctggcgtcagaaaaggggtcgtatgaaatcattcaggatactgacgaggataccgcagtcaacaattggttgatctcgccacagaacgcgtcgagggcatggggggaatccactccgctggccaacaaaccgggaaagcagagcggtcatccaaagttcccgcgggttagacacaagtccctgcaggtgcgccaagacgggggaaagtcccgcctcaagaagtcgcaattcctgatcaagaccagaaagaagaagaaggaaaagcacactcatcatgccccgctgtcgccaagaactttccatccgctccgctcagaggcgtacaacactttctccgaacggcgcttgaagcacagccttgtgcttcataagtccaatgaaactagcctgccgaccgaccttaaccagactctgccatccatggacttcgggtggatcgccagcctgcctgatcacaatcaaaatagctcgaacgacaccggtcaagctagttgtccgccgggactgtatcagactgtcccgccggaagaacattaccagactttcccgatccaggacccagatcagatgcactcgacctcggacccgtcgcaccgctcgtccagcccagaactcagcgagatgctcgagtacgacaggtcgcacaagtcgttcccgactgacatctcccagatgtcgccaagcagcgagcacgaggtgtggcagaccgtgatttccccggatttgagtcaggtcacgctgtcaccggaactttcccagacgaacttgtccccagacctcagccacaccaccctgagccccgaactcatccagagaaatctgtcaccggcccttgggcaaatgcctattagtcccgacctctcccacactacgctctcaccagatctgtcacacaccactctgagtttggacctgtcccagactaatctctcgccggagctgagccagacgaacctgtcaccagcccttggccaaatgccgctgtcaccagacctttcccacaccactttgtctctggatttttctcagactaacctttccccagagctctcacacatgaccctctcaccagaacttagccaaacgaacctttctcccgccctgggtcagatgccgatatcacccgacctgtcacacacgacgctgtccctcgacttctcgcagacgaacctcagccctgaactctctcagacgaatctttcacccgcactggggcaaatgccgctctcccccgacccctcgcatactaccctctcgctggatttgtcgcaaactaacctctcgcccgagctgtcacagactaatctgtcgccggacctgagtgagatgccactttttgccgatctcagccagatccctctgaccccggatctggaccaaatgaccttgtcgccagatttgggtgaaactgacctcagccctaactttggacagatgagcctctctcctgacctgagccaggtcactcttagcccggacatatctgataccaccctgctgccagatctctcgcaaatcagccctccgcctgacctggatcagatcttctacccctctgaatcaagccagtcgttgctgctgcaggaattcaatgaatcattcccgtaccccgacttgggacagatgccttcaccgagttcaccaactctgaacgatactttcctctccaaagagttcaatcctctcgtgatcgtgggcctgtccaaggacggaaccgactacattgagattatcccaaaggaagaagtccagagttccgaagatgattacgctgaaatcgattacgtgccgtacgacgatccatacaagactgacgtgcgcaccaacatcaactcgagccgggacccggataacatcgccgcctggtacctgaggagtaataacggcaatcggcgcaattactacatcgcagcagaggagatttcatgggattactccgaattcgtgcagcgagagactgacattgaagatagcgacgacatccctgaggatactacctacaagaaggtggtgttccgcaagtacctcgattcaactttcaccaaacgcgacccaaggggtgagtacgaagagcatctgggcatcctgggaccgatcatcagagccgaagtcgacgacgtgatccaagtcagattcaagaacctggcctcaagaccgtacagcttgcacgctcacggcctgtcatacgagaagtcgtccgaaggcaagacctacgaagatgactcgcctgagtggttcaaggaagataacgcggtgcagcctaactcctcctacacttacgtgtggcatgcaactgaaagaagcggtccggagtcaccgggttccgcctgccgtgcctgggcctactacagcgcggtgaacccagagaaagatatccactccggtctgatcggacctctgctcatctgccagaaaggaatcctgcataaagactcgaacatgccgatggacatgcgggaattcgtcctgctctttatgactttcgatgagaagaaatcctggtactatgaaaagaagtctcggtcctcgtggcggctcaccagcagcgaaatgaaaaagtcccacgaatttcatgccattaatgggatgatttactcgctccctggactcaagatgtacgaacaagaatgggtgcgcctgcacctgctgaatatcggaggatcacaggacatccacgtcgtgcatttccatggtcaaacgctgctcgaaaacggaaacaagcagcatcagctgggagtgtggccgctgctcccgggatcgttcaagactctggagatgaaggcatcaaagccaggatggtggctgctgaatactgaggtgggcgagaatcagcgcgctggaatgcaaaccccattcctcatcatggatagagattgccggatgccaatgggtctgagcactggaatcatttccgattcgcagattaaagcatccgagttccttggctactgggagccgcggttggcaagactcaataatggcggctcatataacgcttggtccgtcgagaagctcgcggccgaatttgcatcgaagccgtggatccaggtggacatgcagaaggaggtgatcattactggaattcagacccaaggcgcgaagcattacctcaaatcttgctacaccactgagttttacgtggcttacagctcaaaccaaatcaactggcaaatctttaagggaaactctacccgaaacgtgatgtactttaacggcaattcagacgcctcgaccatcaaagaaaaccaattcgacccgcccatcgttgcaaggtacatccggatcagcccaactcgggcgtacaaccgcccaaccctcagactggaactgcagggctgcgaggtgaatggatgttcgactcctttgggaatggaaaacggaaagatcgagaacaagcagatcactgcctcatcgttcaaaaagagttggtggggcgactactgggaaccgtttcgggccaggctcaatgctcagggacgggtgaacgcctggcaagccaaggcgaacaacaacaaacaatggctggagatcgacttgctcaaaatcaaaaagataaccgcaatcatcactcagggttgcaagagcctgtccagcgagatgtacgtcaagtcgtacaccatccactactcagaacaaggcgtggaatggaaaccctatcgcctcaagagcagtatggtggacaaaatcttcgagggaaacaccaacaccaagggacacgtcaagaatttcttcaatccgccaatcatcagccggttcatccgcgtcatccctaagacttggaatcaatcaattgcactgcggctcgaactcttcggctgcgacatctac

SEQ ID NO: 9030 - DNA, 6672 bp, Artificial Sequence
  Description of Artificial Sequence: Synthetic coding sequence
atgtttccggggtgccccagattgtgggtgcttgttgtcctgggaacaagctgggtgggctggggatcccaggggacagaagcagcccaacttcgccaattttacgttgccgcgcagggcataagctggtcttaccgccccgaacccacaaactccagtctgaatctgtctgtgacttcatttaaaaagatcgtttaccgggagtacgagccatatttcaaaaaggagaaaccacagagtaccatttcaggactgttgggacctaccttgtacgccgaggtcggcgatatcataaaagtgcactttaaaaacaaggccgacaagcccctgtccattcatccacagggcatccgatatagtaagctgtctgagggtgcaagttacctggaccacactttccccgccgaaaaaatggatgatgcagtggcacctgggcgggaatatacctatgagtggtccatctcagaagacagtggtcccacacacgatgacccaccctgtctgacacacatctattattcccacgagaatttgatcgaagattttaacagtgggcttatcggccctctcctcatctgcaagaaaggaactctgactgaaggcggcacacagaagaccttcgacaaacagatagttttactatttgccgtctttgatgaatctaagtcctggagccagagcagctcactgatgtatactgtgaatggctatgtaaacgggacaatgcctgatatcaccgtgtgcgcccacgatcatatcagttggcatctgctggggatgagcagcggtccagagctcttttccattcatttcaatggacaagttctggaacagaatcatcacaaggtttcagctatcacactggtctcagccacgagcacaacagccaacatgaccgtcggaccagagggtaagtggattatttcgagtctcactcctaaacacctgcaagcggggatgcaggcatatatcgatataaaaaattgtcccaagaaaacgcgcaatctcaaaaagatcacgcgggagcaacggaggcacatgaaaaggtgggaatacttcattgccgccgaggaagtcatctgggactatgcacctgtgatccccgccaatatggacaagaaatatcgatcccagcatctagataatttcagcaatcagattggaaagcattacaaaaaggtgatgtatacacagtacgaggacgagtcgttcacgaagcataccgttaatcctaatatgaaggaagatggtatcctgggacctatcatccgagcgcaagtgagggacaccctgaaaattgtcttcaaaaacatggccagtagaccatattcaatttatcctcatggggttacctttagcccatacgaggatgaagtgaacagctcctttaccagcggtcggaacaatacaatgatcagagctgtccagcctggagagacctacacctataagtggaacatactcgaattcgacgaacccacagagaacgacgcccaatgtctgacccggccttactattcagacgttgatatcatgcgagatattgcctcgggattaatcggcctcctgctcatttgtaagtctcgaagcttggacagacgtgggattcaacgcgctgctgatattgaacagcaggctgtatttgccgtcttcgacgaaaacaagtcatggtacctcgaggacaacatcaataaattttgcgaaaaccctgatgaagtgaagagggacgatcccaagttctacgagtctaacatcatgagcaccatcaacggatacgttcccgaaagtataacaacactgggcttttgctttgacgatacggtgcagtggcatttttgttcggtgggaacccaaaacgaaatcctcacaattcactttacaggtcacagtttcatctacggtaaacgacacgaagataccctgaccctgttccccatgagaggtgagtctgtgactgtcaccatggataatgtggggacatggatgctcacttcaatgaactcttctcccaggtcgaagaagctgcgccttaagttcagggatgtcaagtgtatcccggacgatgacgaggactcttacgagatcttcgaacctccagaatcaactgttatggccacacggaaaatgcacgaccgcctggaaccagaagatgaggagtccgacgcagattatgattatcagaaccgcctcgccgccgctctcggcataaggagcttccgcaattcctctctcaatcaggaggaggaggagttcaatctgaccgcgttagccctagaaaacggcacagagtttgtatcttccaataccgatatcatcgtgggctcgaactacagtagcccaagtaacatctccaagttcactgtgaataatcttgccgagcctcagaaggcaccaagccaccagcaggctaccaccgccggtagcccattgcgtcatcttataggaaagaattccgtcctgaatagcagcactgccgaacattcgagcccatacagcgaggacccaattgaggatcctctccaacccgacgtgaccggcatcaggctcctgtctctcggagccggggagtttaagtctcaggagcatgcaaaacataagggacctaaagtggaacgtgatcaggccgccaaacatcggttcagctggatgaagctcctagcacacaaggtggggcggcatctgagccaggacactgggtctccatctggcatgagaccatgggaggacctgccctctcaggacaccggtagccctagccggatgcgcccgtggaaagatccaccgtctgacctcctgctgttgaagcagagcaattcctcaaagattctggttggacgctggcaccttgcttcagagaaagggtcgtacgaaattatccaggacacagatgaagacactgccgtcaataattggctgatttcgccccaaaatgcgtctcgagcgtggggcgagagtacccctttggccaataagccgggaaaacaaagcggacatccaaaattcccacgcgtcaggcacaagtctctccaggtaaggcaagacggcggtaaatcaagactcaagaagagtcagtttttgataaaaacacgcaaaaagaagaaggagaagcacacccatcatgcccccctctctccaagaacattccacccgctgcggtccgaggcctataacacgttttccgaacggagactgaagcactccttagttctgcataagtcaaatgaaacatccttgccaaccgatcttaatcaaacgctgccgagcatggactttggttggatcgcaagcctcccggaccacaaccagaatagctcaaacgacacaggtcaggcctcatgccccccaggcctgtatcagactgtcccaccagaagagcactaccagacttttcctattcaggaccccgaccaaatgcactccacatctgacccgtcccaccggtcatcctcacctgagctgagcgagatgttggagtatgatagaagccataaaagctttccaaccgacatctctcagatgtccccatccagtgaacacgaggtctggcagaccgtaattagcccagatctaagtcaggtcacactgagcccagaactgtcccagactaatttaagtcctgatttgagtcacacaaccctgtcacccgagttgattcagagaaatctgtccccagctctggggcaaatgccaatctcaccagatctaagtcacaccacgctctcgccggatttatcgcataccacattgagtcttgacctgtcccagacaaacctttctcctgagctgtcccagaccaatctcagccccgctttagggcagatgccgttgtctccagatctaagccacaccactctgtcccttgatttctcccagacgaatctttcgcctgagcttagtcacatgacgctcagtcctgaactttcccagacaaatctgagcccggcgttgggtcagatgcccatcagcccggatctaagtcatacaacgctatctctggatttctcccagaccaacctctccccagagctgtcccagacaaatctcagtcccgccctgggtcagatgccactgtcccccgacccgtcccatacaaccctctcgcttgatctgtcccaaaccaacttatcccctgaattgtcacagacaaacctgagtccggatttgtccgaaatgccactctttgcggatctcagccagatcccattgacgccagatcttgatcagatgacactcagtccggatctcggcgagacagatttgtcccccaacttcggccaaatgtccctctcgcccgatctctcacaggtgaccctgagtcctgacatttcggatactacgctgctgccagatctcagtcagatcagtccaccccccgacctggaccaaatattttacccctcagagagcagtcagagcctcctgctgcaggaattcaatgagtcctttccttacccggacctcggacagatgccctccccatcatctcccacattaaatgacacatttctgtccaaagagtttaatcctctggtcatcgtaggtctgagtaaggatggaactgattacattgaaataattcctaaagaagaggtccaatctagcgaagacgattatgcggaaatcgattatgtgccttatgacgatccttacaaaacagacgtcaggacaaatattaactccagcagagacccagataacatcgccgcctggtacttacgatccaataacggtaacagacgtaactactatatagcagctgaagaaatatcatgggactatagcgaattcgtgcaacgggagacagatattgaggactcagatgatatcccagaggacaccacttacaagaaggtggttttccgaaaatacctggactcaaccttcactaagagggatccccggggcgagtacgaagagcaccttgggattctggggcctattatacgggcggaggtggatgatgtaatccaggtccgttttaaaaacctcgcgagccgaccctacagcctgcacgcccacggcctcagctacgagaaaagttcggagggcaaaacgtatgaagatgatagtcctgaatggtttaaagaagacaacgctgtacagcccaactcatcttatacctatgtgtggcacgccacggaaaggtccggacccgagagcccaggctcagcttgtagggcctgggcatactactccgcagtcaaccctgagaaggacatccactcagggctgatcgggccactgctgatctgtcagaagggaatcctacacaaagactctaacatgcctatggatatgcgcgaatttgtgctgctgtttatgacatttgacgaaaaaaagtcgtggtactacgaaaaaaagtcccgatcaagttggcgtctgacgtcctcagaaatgaagaaaagccatgaattccatgctatcaacgggatgatctactccttgcccgggctgaagatgtacgagcaggagtgggtgaggctgcacctacttaacatcggcggcagccaagacatccacgtagtgcactttcacgggcagacgctgttggagaacggaaataagcagcaccaactcggagtgtggccattacttcccggttcatttaagaccttggagatgaaggctagtaagcctgggtggtggctgctcaatacagaagtcggggaaaaccagcgggctgggatgcagaccccattcttaattatggatagagactgtagaatgccaatgggcctgtcgacggggattatctctgattcacagatcaaagcgtccgagttcctcggttactgggaaccacggttggctcggctgaacaacggaggcagctataatgcgtggtccgttgaaaagctggctgccgagttcgcgtccaagccttggatccaagttgatatgcagaaagaggttatcatcacagggatccagactcaaggcgcaaaacactatttgaagtcttgttataccaccgagttttacgtggcttactcttctaatcagatcaattggcaaatatttaaagggaattctactcgcaacgtcatgtacttcaacggtaactctgacgcgagtactataaaggagaatcaatttgacccccccatagtggctcgctacatcaggatcagcccaactcgcgcttataaccgcccgacactgaggttggagctgcagggttgcgaggtgaacggatgctcgactcccttgggaatggagaacgggaaaatcgaaaacaaacaaattactgcttcttcctttaaaaagtcctggtggggcgactattgggaacctttcagggctcgcctgaatgcacaggggagggtcaatgcctggcaggcgaaggcgaataataataaacagtggcttgagatcgacttactgaagatcaagaagatcaccgctattatcacccagggctgcaagtcactcagctcagagatgtatgtaaaaagttatactatccactattctgagcaaggggtcgagtggaaaccatacagactaaaaagttcgatggttgacaaaatcttcgagggaaacacgaacaccaaaggacatgtgaaaaatttcttcaacccccccattatttctcggtttattcgagtgattccgaaaacatggaaccaatccattgcacttcgtctagaattgtttgggtgtgacatctat

SEQ ID NO: 9031 - DNA, 6672 bp, Artificial Sequence
  Description of Artificial Sequence: Synthetic coding sequence
atgtttcctggatgccctaggctgtgggttctcgtggtacttggtacaagctgggtgggatggggatctcaaggaactgaagctgctcagctacgacaattctacgttgcagcccagggaattagttggtcttatagaccagaaccaacaaactcaagtctaaacctgtcagtgacaagcttcaaaaagatagtgtaccgggaatatgaaccttacttcaagaaagagaaacctcagtctacaatcagtggactcctcggccccaccctgtatgctgaagttggggacatcatcaaggtccatttcaagaacaaggctgataagcccttaagtatccaccctcagggaatccggtatagtaagttaagcgagggggcctcttacctggatcataccttcccagctgaaaaaatggacgatgctgtggcccccgggagggagtacacgtatgagtggagcatatctgaagactccggtcctacccacgacgaccccccttgtctcacacacatttattacagccatgagaacctgatagaagactttaactctggattgatcgggcccctgctgatttgcaaaaagggcaccttaaccgagggaggtactcagaagacatttgataagcagatcgtcctacttttcgccgtcttcgacgaaagcaagtcctggagccaatcaagtagtttgatgtatacagtcaatggatatgtgaatggaactatgcccgatattactgtgtgcgcgcacgaccatatcagctggcaccttctgggcatgagtagcggtcctgaactgttcagtatacattttaatgggcaggtgctggaacagaaccaccataaagtgagtgctataaccttggttagcgccacttcaaccacggccaacatgacggttgggcctgagggaaagtggatcatttcaagccttacacctaaacacctgcaggcgggcatgcaggcctacattgatatcaaaaattgtcccaagaaaactcggaacctgaagaagataacacgcgaacaaaggcggcacatgaaaaggtgggagtactttattgctgctgaagaggtcatctgggactatgcgcctgtcataccagctaacatggataaaaaatacaggagtcagcatctagataacttctccaaccaaataggcaaacactataagaaggtaatgtatactcaatatgaggacgagagttttacaaagcataccgtcaatcccaatatgaaggaggacggtattttgggcccaatcattagagctcaggtcagggatacactgaaaatagtttttaagaacatggcttcccggccctactcaatctacccacatggcgtaaccttctccccttacgaggatgaggttaactccagcttcactagcggcaggaataatacaatgatcagggcagtgcagcccggtgaaacatatacctacaagtggaacatactggagttcgacgagccaaccgagaacgatgcccagtgtctgacacgaccctattattcagatgtagatatcatgcgggacattgctagtgggctgattggactcctgctgatttgtaagagcaggagcttagacaggcgcgggattcagcgcgccgcagacatagaacagcaagccgtatttgcagtctttgatgagaacaagtcttggtatctggaagataatatcaataagttctgtgaaaaccccgacgaagttaagagggacgatccaaaattttacgagagtaatataatgtcaacaattaacggatatgtaccagagagcattactactcttggattctgcttcgatgatacagtccagtggcacttttgcagcgtgggcacgcagaatgaaattttgacaatccactttactggacatagtttcatctatgggaagagacacgaagatactctaaccctgtttcccatgcgcggggagtcagtcactgtaaccatggataacgtaggaacttggatgttgacatccatgaactcctcaccgagatctaaaaagctgcgacttaagttcagagatgttaagtgtatacctgacgatgacgaggactcttacgagatatttgagcctccagagtccaccgttatggccactcgcaagatgcacgatagactggagccagaagacgaggagtccgatgcagattacgactatcagaaccggctggctgcagctctggggataagaagtttccggaacagtagtctgaatcaggaggaagaagagtttaacctgacagcgctagctctcgaaaatggcactgagtttgtgtcttctaacacagacatcatcgtaggcagtaattattcatctccaagtaatatatcaaagttcacggttaataatcttgccgaaccacagaaagcaccgtctcaccaacaggctacgaccgctggatcccctctgagacatctcattggcaaaaactccgtcttgaactcctctaccgcagaacactccagcccctatagtgaggatccaattgaagaccccctgcagccagacgttactgggatccggctgctgtcccttggggccggggagtttaagagccaagagcacgccaagcacaagggaccaaaggtcgagcgggatcaggcagccaaacaccgcttttcctggatgaaactgcttgcgcataaggtcggccgacatctatcccaggataccgggtcacctagtggcatgcgaccctgggaggatttgccaagtcaggatactggttcaccttcacgcatgaggccctggaaggatccaccttccgaccttctactgctcaagcagtctaacagttctaagatcctcgtgggtagatggcacctggcctctgagaaaggctcttatgagataatccaggacaccgatgaagataccgcagttaacaactggttgatttcacctcaaaatgccagcagagcctggggggagtccactcccctggccaataagccgggcaagcagtcaggacaccctaagttccccagagtaaggcacaagtccctgcaggttcggcaggatggaggcaagtcgcgactgaagaagagccagttcttaattaaaacgagaaaaaaaaagaaggaaaaacacactcaccatgcacccttaagcccccgcacattccaccccctgcgctccgaagcttacaatacattttccgagcgaagactcaagcatagcctggtccttcacaaaagcaacgagaccagtctgcccactgatcttaaccaaactctaccttctatggattttggatggatagcgagccttccggatcacaatcagaacagcagtaatgataccggccaggccagttgtccaccaggcctatatcagaccgttccacctgaggagcattatcagactttccccatacaggaccctgatcaaatgcattccactagcgacccgtcccaccggagctcatcccctgaactctcagaaatgttagaatacgaccggagccacaaaagctttccaactgacatatcacaaatgtctccgagttctgagcatgaggtgtggcagactgtgatctccccagatctttctcaagttactctgagtccagagctaagtcagaccaacctatctccggacttaagtcacactactctgtcaccggaattaatccagagaaatctgagtcccgcccttggacagatgcccatctctccggacctgagccatacgactctttcccccgatttaagccataccactctgagtctcgacctgtcccagacaaatctgtccccggagctgtcacagacaaacctgagccctgccctaggccagatgcctttgagcccagacctcagtcacaccaccttatcactggattttagccagaccaatttgtcgcccgagctgtctcacatgacgttatcacccgagctgtcccagaccaatctgagcccagccctcggccagatgcctatctctcctgacttgtcgcatacaacactttctctggacttttcccagactaatctgtctccagaactgagtcagactaatcttagtccagccctcggccagatgcccctgagcccagacccgtctcacaccacattaagtctggacctctcacagaccaatctttcgccagaactcagtcaaaccaatctttcccctgacctttccgagatgcccctctttgcagacctgagtcagatccccttgacccccgacttggatcagatgacgctctcaccagacttaggggaaacggatctcagccctaatttcgggcaaatgtcactctccccagacttgagtcaggttactttatcaccagatatctccgacaccacattgctccccgacctgtctcagatatctcctcccccagatctggaccagatattctaccccagcgagtccagccagtctcttctcttgcaggagttcaacgagagctttccataccctgacctgggccagatgcctagtccgagcagcccaacactgaatgacacgtttctttccaaggagttcaaccctttggtcatagtgggcctctcgaaggacggtacagactacatcgagatcattcctaaagaagaggttcaaagttccgaagacgactatgcggagattgactatgtgccatatgacgatccctacaagaccgacgtacgtacaaacatcaattctagcagagatccggacaacatagcagcctggtacctccgatcgaacaatggaaacagacgcaattattatatcgccgcagaagaaatttcatgggactactctgagttcgtccagcgggaaaccgacatcgaagacagcgacgacataccagaagatacaacttacaaaaaagtggtcttcagaaagtacctggatagcacattcacaaaacgggatcctagaggagaatacgaggagcacctcggtatccttggccccattattcgggctgaagttgatgatgtgattcaagttaggtttaagaatctggcttcccgtccctactctctgcacgctcatggcctgagctatgagaagtcatccgaaggaaaaacctacgaggacgacagccccgaatggttcaaagaggacaacgccgttcagcctaacagctcatatacgtacgtgtggcacgccaccgagcgctctggtcccgagagccctggctccgcatgtcgggcatgggcttattactcagctgttaaccctgaaaaagatatccatagtgggttgattggaccactcctcatatgccaaaagggcatcctacacaaggactccaatatgcctatggatatgcgggaattcgtgctgctgtttatgactttcgatgagaagaagtcatggtactatgaaaagaaatctcgctcttcctggagacttacctcatccgagatgaagaaatcgcatgagttccacgccatcaacggaatgatctacagccttcccggtctaaaaatgtatgagcaggaatgggtgcgactccatctgctgaacatcggagggtcccaagatatccacgtagtgcactttcatggtcagactctgctggagaacggaaataaacaacaccaactaggtgtctggccgctcctgcccgggtccttcaaaactctcgaaatgaaggcttccaaaccgggctggtggctacttaacacagaggttggagagaatcagcgcgcggggatgcaaacccccttcctgataatggacagggattgccgcatgcctatggggctctctacaggaatcataagcgattcacagatcaaggcttcagaatttctggggtattgggaaccacgattggcccgcctgaacaacgggggctcttataacgcttggtcggtggaaaaactggctgccgaattcgctagcaagccctggatccaggtggatatgcagaaagaagtcatcatcaccggaattcagacccaaggggccaagcactatctcaaatcatgctatactactgagttttacgttgcttatagctctaaccagattaattggcagatctttaagggcaactcaactcgaaatgtgatgtactttaacggaaactctgacgcttcgacgattaaggagaaccagtttgaccctcctattgttgccaggtacatccggatcagccccaccagggcatacaatcggccaaccttacggctggagcttcagggttgcgaagtgaatggctgttcaactcctcttggtatggagaatggcaaaatcgaaaacaaacaaatcaccgctagcagctttaagaagtcttggtggggagactactgggaacctttccgcgccagactgaacgcacaggggagggtgaacgcttggcaggctaaagccaacaacaataagcagtggctagagatagacttactgaagatcaaaaagattacggcaatcattactcaggggtgtaaatccttgtcatccgagatgtacgtaaagtcgtacacaattcattactcggaacagggcgttgagtggaagccgtaccgattgaagtcctcgatggtggacaagatcttcgaggggaataccaataccaagggtcatgtaaagaatttctttaatccccctatcatttctagattcatacgcgttattccgaaaacctggaaccagtcgatcgcactgcgattagaactttttggatgcgatatctac

SEQ ID NO: 9032 - DNA, 6672 bp, Artificial Sequence
  Description of Artificial Sequence: Synthetic coding sequence
atgtttcctggttgccctagattatgggtgctggtggtcttaggaacttcttgggtgggctgggggagtcaagggacggaagctgcacagctccgacagttctatgttgccgcacagggaatatcctggtcctatcgccccgagccaacaaatagctcccttaatctcagcgtgaccagtttcaagaaaatagtctacagagagtatgagccttattttaagaaggaaaagcctcagtccacaatctcagggctgctgggacctaccctctatgcggaggtgggagatatcattaaggtgcacttcaagaacaaggcagacaagcccttatcgatccatccccaaggcattcgctactccaaactgagcgagggcgctagctaccttgaccacacctttccagctgaaaagatggacgatgccgtagcacctgggagggaatatacttatgagtggagcatttctgaggattccggtccgactcacgatgaccctccctgtctgactcatatttattacagtcatgagaacctgatcgaagacttcaacagtggtctcatcggcccacttctgatctgtaagaagggcaccctgacggaggggggaacccagaagaccttcgataagcagatagtgttactctttgcggttttcgacgaatccaagagctggagccagagcagttctctgatgtatactgtgaacggctacgtaaacggcactatgcccgatatcaccgtgtgtgcccatgatcacataagctggcacctgctggggatgagtagcggccccgagcttttttccatacattttaacggccaagtcctggagcagaaccaccacaaggtgtccgcaattaccctggtgagcgcaaccagcaccactgccaatatgaccgtaggacctgaaggtaaatggatcatctcctccttaacaccgaagcacctgcaggccgggatgcaggcctatatcgacatcaagaattgtcccaagaagaccagaaatcttaagaaaattacccgcgagcagcgtcggcatatgaaacgctgggaatacttcatcgcggcagaagaagtcatctgggattacgccccggttataccagcgaatatggacaagaagtacagaagccagcacctcgacaacttcagcaatcagattgggaagcactataagaaggtgatgtacacacaatacgaggacgagtccttcacaaagcataccgtgaacccaaatatgaaggaggacggcatcctggggcccattatcagggcacaggtgagggatacactgaaaattgtgttcaagaatatggctagcaggccttacagcatatatcctcacggcgtcacattttctccttacgaagacgaggtgaatagtagctttacatctggtaggaacaatacgatgatccgggcagtgcaaccaggcgagacatatacctacaagtggaacatcctcgagttcgatgagcctactgagaatgacgctcagtgtttgaccaggccatactatagcgacgtcgatatcatgcgcgacattgcctccggcctgatcggtctgctgctcatttgcaagagccgcagcctggaccgacgtggtatccaacgggcagctgacatcgagcaacaggccgtgttcgcagtcttcgacgagaacaagtcttggtacctagaggacaacattaataaattctgcgagaatcctgacgaggttaagcgtgatgaccctaagttctacgagtctaacatcatgagtaccatcaacggatacgtgcctgagtctataactaccttaggattctgcttcgacgacactgttcagtggcatttctgttccgtgggcacacagaacgagattctgacgatccactttacaggtcatagcttcatatacggcaaacgacatgaagacaccttaaccctgttccccatgagaggcgagtctgtgacagtaacaatggataacgtgggtacttggatgctgacctccatgaactcttcgcctcgctcaaaaaagctccggctgaaattcagggacgtcaagtgtattcctgacgacgatgaagattcatatgaaatctttgaaccccccgagtctaccgtaatggccacccggaagatgcacgaccgactcgaacccgaggatgaggaaagtgatgccgactacgactatcagaacagacttgccgccgcccttgggattaggagttttcggaattcgtcgctgaaccaggaagaggaggagttcaatttgaccgcactcgcactggagaacggcacagagtttgtgtccagtaacactgacatcattgtgggctccaactatagtagcccctcaaacatctcaaaattcaccgttaataacctggccgagccccagaaggcacccagtcaccaacaggcaaccactgccggcagcccccttcgacacctgataggtaaaaattctgtgctcaacagctcaactgccgagcattccagcccatacagcgaggatcccattgaggacccgctacagcctgacgtcacagggatccgcctcttgtcgttaggtgccggagagttcaagagccaggagcatgcgaagcataagggccccaaggtggagcgcgaccaggcggcaaagcatagattcagctggatgaagctcttggctcataaagtgggccggcacctgtctcaggacactggaagccctagcggaatgaggccttgggaggatctgcccagccaagacacaggcagccccagtagaatgcggccttggaaagaccccccaagcgacctgctgctcctgaagcagagtaactcctctaagatcctggttggaagatggcacttggcaagcgagaaaggatcttacgaaatcatacaggataccgatgaggatacggccgtcaataattggctgatatcaccacaaaacgctagccgagcatggggcgagagtacaccactcgccaataaacccggcaagcagtctgggcatcccaagtttcccagagtgcgtcataaaagcctccaggtgagacaggacggcgggaagagtcggttaaaaaagtcccagttcctgataaagacacgtaagaagaagaaggagaagcacacacatcatgcacccctctctcccaggacctttcatccactaagatcagaggcctacaacacctttagtgaaagacggctgaagcatagcctcgtgcttcataagtcaaatgaaacgtctctgcctacagacctgaatcagactctgcccagtatggattttggatggatcgcatcactgccagaccacaatcagaattcctcaaacgacacgggccaggcttcatgcccaccagggctttatcagacagttccgccggaggagcactatcagacttttccgatccaggacccagatcagatgcactccacgtccgaccccagtcaccgatcctcttctcccgagctgtccgaaatgctggaatacgaccgatcacataagtcctttccaacagacatctcacagatgtcacccagctcggaacatgaagtgtggcagacagtgatctcacccgatctttctcaggtgaccttgtccccagagcttagtcagacgaatctctctcccgacctctctcacacaacattgtcacctgaactgattcaaagaaatttgagccctgccctgggacagatgcctatatcgcctgatctgtcacacactaccttgagtcccgatctgagccacaccactttatctcttgacctttcgcagaccaacctgagccccgagctctcccagaccaacttgtctcccgcactgggacagatgcccctgtctcctgatctgagccacactacgctgtctttggacttctcccagacgaatttgtcacctgaactctcacacatgaccttgtctcctgaactcagtcagactaacctgagcccggccttaggccagatgccgatatctccagatctatcacatactacgctctcgctggattttagccagactaatctgtcacccgaactgtctcagactaacctctccccagctttgggacaaatgcctctcagccccgatccttctcataccacgctgagcctcgacctgagccagaccaacttgtcccctgaactgagccaaactaatctgtccccagacctttccgagatgcctctgtttgcggacttgtcccagatcccgttgaccccagatctggaccagatgactctgtctcctgatctgggagaaacagatctgtcacctaatttcgggcagatgagcctgtcccctgatttgtcgcaagtcaccctgtcccccgatatttcagatacgacactgctcccagatctttcacaaatcagcccgccccccgacttagaccagattttctacccttccgagtctagtcagagcttgctgctacaagaattcaacgaatccttcccataccctgacttggggcaaatgccctccccctcttcccctaccctgaacgacacctttctgtctaaagagttcaacccgctggtgatcgtagggctctccaaagacggaactgactacatcgagatcatacctaaggaggaagtgcaatctagtgaggacgattacgccgagatcgattacgtgccctacgatgacccgtacaaaacggacgtcaggacgaacatcaactccagcagggacccagacaatattgccgcatggtatctaagatctaataacggcaatcgaagaaactattacatagcagccgaggaaatttcctgggactactccgagtttgtccagcgtgaaacagatatcgaggacagcgacgatattccggaggacacaacctacaagaaagtggtatttagaaaatatctggattccacctttacaaagcgggatccccggggggagtacgaggaacacctgggcattcttggccctatcatcagggcagaggtggatgacgtcattcaggttagattcaaaaacctggcctctcgcccctatagtctccacgcccatggcctcagctacgaaaagtcctccgaagggaaaacatacgaagacgactccccagagtggttcaaggaggataatgctgtgcagcctaactctagctacacatatgtttggcacgccactgagcgatctggtccggagagccccggttcagcttgccgggcttgggcttactacagcgctgtgaaccccgaaaaggatatacatagcggtctcatcggacctcttcttatctgtcaaaagggcattttacataaagactccaacatgccaatggatatgcgggagttcgtgctattgttcatgactttcgacgagaaaaagagttggtattatgaaaagaagtcaagatcttcatggcggctgaccagttctgaaatgaagaagagtcacgagtttcacgcgatcaacggaatgatctattccctccccggcctgaagatgtatgagcaggagtgggtgcggcttcaccttctaaacatcgggggctcccaggacattcacgtcgtgcattttcacggacagaccctgcttgagaatggcaataagcaacatcagttgggtgtctggcccttactccctggatctttcaaaaccctcgagatgaaggctagcaagcctggctggtggctcctgaatactgaagtgggcgagaaccaacgggctggaatgcagacacccttcctcatcatggaccgcgactgccgcatgccgatgggcctgagcactggcatcatatctgatagccagattaaggcgtcggagttcctggggtattgggagccccggctcgcccggttgaacaacggcggatcatacaacgcctggagtgtagagaagctcgccgcagaatttgcaagtaagccctggattcaggttgatatgcagaaggaggtcataatcactgggatccagacccagggggctaaacactacctgaagtcgtgttataccaccgagttctatgtggcttacagtagcaaccagatcaattggcagatctttaagggaaattcaacgagaaacgttatgtacttcaacggcaattccgatgcaagtaccattaaggaaaatcagtttgatcctccaatcgttgcccggtacatacgaatcagcccgacccgggcctataatagacccacattacgcctcgaactacagggctgcgaggttaatgggtgttccaccccactgggcatggaaaatgggaaaatcgaaaacaaacagatcaccgccagttcatttaagaagagctggtggggagactactgggaacccttccgagcaaggctgaacgcacagggtcgagtgaacgcctggcaagcaaaagctaacaataataaacagtggctggaaattgatcttctaaagataaagaaaattaccgcgataattacccaaggctgcaaaagcctgtcaagtgagatgtacgtcaagtcctacaccatccattacagcgagcagggggtggagtggaagccgtaccggctcaagtcctctatggtagataaaatcttcgagggcaacacgaacactaagggacatgtgaagaattttttcaacccacctatcatttctcgctttataagagtcatcccaaagacttggaaccagagtattgcactcaggttggaactcttcgggtgcgatatctac

SEQ ID NO: 9033 - DNA, 6672 bp, Artificial Sequence
  Description of Artificial Sequence: Synthetic coding sequence
atgtttcctgggtgccccagactgtgggttctggtggtcctggggaccagctgggtcgggtggggctcgcagggaaccgaagcggcacaactgcgccaattctacgtggcggcccaaggcatctcctggtcctaccggcctgaaccgacgaacagctcgctgaaccttagcgtgacgagttttaagaagatcgtgtaccgcgaatacgagccttacttcaagaaggaaaagcctcagtccactatctccggcctgctgggaccgactctctacgcagaggtaggagacatcatcaaggttcactttaagaacaaggcagataagccgctgagcatccaccctcagggaatccgttactctaagctctccgaaggagcctcgtacctggatcatacttttcccgccgaaaagatggatgatgccgtggcccctggtagagaatacacctacgaatggagtatttcagaggattcgggaccaactcacgatgacccaccctgcctgacccacatctactactcgcacgaaaatctgattgaagatttcaactccggtctgatcgggccactgctgatctgcaagaagggcactctgactgaaggaggaactcagaaaactttcgataagcagatcgtgcttctgtttgccgtattcgacgaatcgaagtcgtggagccaaagcagctcgctgatgtacaccgtgaacggatacgttaatggcactatgccggacataaccgtgtgcgctcacgaccacatcagctggcacctcctggggatgtccagcggaccggaacttttttccatccactttaatggccaggtgctcgaacaaaatcaccacaaggtgtccgcaatcacccttgtgtcggctacctcaaccaccgcaaacatgactgtcggacctgaaggcaagtggatcatctcatctctgacgcccaagcatctccaagcagggatgcaggcgtacattgatatcaagaattgccccaagaaaactcgcaatctgaaaaagattactagagaacagagacgccatatgaaacggtgggagtacttcatcgccgctgaggaggtcatctgggactatgccccggtcattccggctaacatggacaagaagtaccgttcccagcatctggacaactttagtaaccaaatcggaaagcactacaagaaggtgatgtacacccagtacgaagatgagtcattcaccaagcacaccgtgaacccaaatatgaaagaggatggaatcttgggaccgattatccgcgcccaggtgagggacactttgaagatagtgttcaagaatatggctagccgcccttactcaatttacccacacggcgtgactttcagcccttacgaggatgaggtcaactcgagcttcaccagcgggcggaacaacaccatgatccgcgctgtgcaaccgggagagacttatacttacaaatggaacatcctcgagttcgacgagccgactgagaacgacgcacagtgcctgactagaccgtactactcggacgtggacatcatgcgggacatcgcctcaggcctgatcggactgcttctgatatgcaaatcgcgttcgctcgaccggcggggtatccagagagcagctgatatcgaacagcaagcagtgttcgccgtgtttgatgagaataagtcctggtacctggaggacaacatcaacaagttctgcgaaaatccggatgaagtcaagagagacgacccgaagttttacgaatcgaacatcatgtccaccatcaatggatacgtccctgagagcattactactctgggattctgcttcgacgacaccgtgcaatggcacttctgttcggtgggtactcaaaacgaaatcctcaccatccattttaccggacattcctttatctacggtaagcggcacgaggacaccctgaccctttttccaatgcgcggtgaaagcgtgaccgtgacgatggataacgtcggaacttggatgctcacctccatgaactcgtccccccgctcaaagaaactccgcctgaaattccgcgacgtgaaatgtatccccgacgacgatgaagatagctacgaaatcttcgaaccgccggaatccactgttatggccacgagaaaaatgcatgacagactggagccagaggacgaggaatccgatgcagactacgattaccaaaatcgcctcgctgctgccctgggaatcagatccttccgaaactccagcctcaaccaagaagaagaggaattcaatttgaccgcgctggccctggaaaacgggaccgaattcgtgagctcgaatactgatatcatcgtgggatcaaactactcctcaccttcaaatatcagcaagtttactgtgaacaatctggcggagccacagaaagcaccatcccaccagcaagctactaccgcaggatcacctctgcgccacctgatcggaaaaaactctgtcctgaacagctccacggcagagcactcctcgccgtatagcgaggacccgatcgaagatcctctgcagccggatgtcaccggcatccggttgctctcacttggcgccggggaattcaaatcgcaagagcatgcaaagcataagggaccgaaagtcgagcgcgaccaagcagccaagcaccggttttcgtggatgaagctgttggcccataaagtcggtcgccatctctcgcaagacaccggatccccgagcggcatgcggccatgggaggacctgccgtcgcaggataccggtagtccttctcggatgcgcccgtggaaggatccaccgtcagacctgttgcttttgaaacagagcaactcttccaaaattctggtcggaagatggcatctggcctccgagaaggggtcatacgagatcatccaggacaccgacgaagatactgccgtaaacaactggttgatatcacctcagaacgcctcaagagcctggggggagagcacgccgcttgcgaataagcctggaaagcaatcgggtcacccgaagttcccacgggtgaggcacaagtccctgcaggtgcgccaggacggaggcaaaagccgccttaagaagtcgcagttcctcataaagacgcggaagaaaaagaaagaaaaacacacccatcacgcgccgttgtcaccccgaacctttcatccgctccggtcggaagcctacaacaccttttctgaaagacgcttgaagcactcattggttctccataagtccaatgaaacctcactgccaaccgacctgaaccagactctgccatcgatggactttggatggatcgcttcgctgccagaccacaaccagaatagctcgaacgataccggccaggccagctgtcccccagggctctaccagacggtgcccccagaggaacactaccaaactttccccattcaagaccccgaccagatgcattcgactagcgatccgtcccatcgcagctcgtcaccggagctgtctgagatgctcgaatacgatcggtcccacaagtccttcccaactgatatctcccagatgtcaccgtcctccgagcacgaagtgtggcagaccgtcatctcccctgacctcagccaagtcaccctgtccccggaactctcgcaaactaatctgtcccctgacctgtcgcacaccactttgtcgccagagctgatccagagaaacctgtcaccggctctcggtcaaatgccgatatcacccgacctcagccacacgacgctgtcaccggatcttagccacacgactctgagcctggatctgtcccagacgaacctcagcccggaactgagccaaacgaacctttccccggcacttggacaaatgcctttgagcccagacctttcccacactacgttgtcgctggacttcagccaaactaatttgagtccagaactgtcgcatatgaccctgtcgccagaactgtctcaaacgaatctctcaccagccctgggacagatgcctatctcgccagatctgtcacacacgaccctgtcccttgacttttcacaaaccaacctgtcacctgaactgtcgcagaccaatctgtcgcctgcacttggtcaaatgccactgagcccggaccctagccataccaccctttccttggacctctcccagaccaacctttcacctgagctgtctcaaactaacttgagcccggatctgagcgaaatgcccctgttcgcggatctctcacaaattcccctgacgccagatctcgaccagatgaccctctccccggatctgggcgagacggacttgtcacctaatttcggccagatgtccctctcaccagacttgagtcaggtgaccctctcgccggacatttcagacactactcttctgcctgacttgtcccagatcagccctcccccagacctcgatcaaatcttttacccgtcagagtcatcccagtccctcctgctgcaggagttcaacgagtcattcccctaccccgacctcggccagatgccgtccccgagctcgccgaccttgaatgacactttcttgtcgaaagagtttaatccactggtgatcgtcggtctgtccaaggatgggaccgactacatcgagatcatcccaaaggaggaggtgcagtcgagcgaggacgactacgccgaaatcgactacgtcccgtacgatgacccgtataagactgatgtgcgcactaatatcaactcctctcgcgacccggacaatattgcagcctggtacctgcgctccaacaatggaaaccggcggaattactacatcgccgcagaggagatttcctgggattactcggaattcgtgcagcgggaaaccgacatcgaggactccgatgacatcccggaagataccacgtataagaaagtcgtgtttaggaaatacctcgacagcactttcactaagcgtgaccctagaggtgaatacgaagaacacctgggaattcttggaccgatcatccgcgcggaggtggacgacgtgattcaggtgcgcttcaagaacttggccagcagaccttacagcctccacgcacatggactctcgtatgagaagtcgagcgaaggaaagacgtacgaggacgactccccggaatggtttaaggaagataacgcagtgcagccgaactcatcgtatacttacgtgtggcatgcgactgaacggtcgggaccggagtcaccagggtcggcgtgtagggcttgggcctactactccgctgtcaacccagaaaaagacattcactccggactcatcggacctttgctgatctgccagaaggggatccttcataaggattctaatatgccaatggacatgcgcgaattcgtcttgctctttatgaccttcgacgaaaagaaatcgtggtactacgaaaagaagtccaggtcgtcatggcggctcacttcatcagaaatgaagaagtcgcacgagttccatgcgatcaatgggatgatctacagcctgccagggctcaagatgtatgagcaagaatgggtcagactccatctgctcaacatcggaggaagccaagatatccacgtcgtgcatttccacggtcagactctgttggagaacggcaataagcagcatcaactcggagtgtggccgctgctcccaggatccttcaaaactctcgagatgaaggcgtccaaacccggatggtggctcctgaacactgaagtcggagaaaatcagagagccggtatgcagactcccttcttgatcatggaccgcgactgccggatgccgatgggactgagcaccggaatcatcagcgattcccaaatcaaggcgtcagaatttctgggatactgggaacctaggctggcccggttgaataacgggggttcctacaacgcctggagcgtggaaaaactcgccgcggagttcgcctcaaagccgtggattcaggtggacatgcagaaagaagtgatcatcaccggaatccagacccagggcgctaagcactatctcaagagttgttacaccactgagttttacgtggcgtattcgtccaaccagatcaattggcagattttcaagggaaattcgactcgcaatgtgatgtacttcaacggcaactcggatgcgtcgaccataaaggagaaccagtttgatcctcctatcgtggctaggtacattcggatctcaccgactcgggcctacaaccgcccgactctgagactggagctgcagggctgcgaagtcaacggatgctcgactccgctgggaatggagaatgggaaaatcgaaaacaagcaaattactgcctcgtcattcaaaaagtcttggtggggagactactgggagcccttccgagcgcgtctgaacgcccagggacgggtgaatgcatggcaagcgaaagccaacaataacaagcagtggcttgagattgacctgttgaagatcaagaagatcacggcaattatcacccagggttgcaaatccctttcatccgaaatgtatgtgaaatcgtacactatccactactcggaacagggtgtcgaatggaaaccgtacaggcttaagagcagcatggttgataagatcttcgaaggaaacaccaacactaaagggcacgtcaaaaactttttcaatccaccgatcatctccaggttcatccgcgtgatccctaagacttggaatcaatcaattgcactgcgcctggaactcttcggatgtgatatctac

SEQ ID NO: 9034 - DNA, 6672 bp, Artificial Sequence
  Description of Artificial Sequence: Synthetic coding sequence
atgttcccaggatgtcctaggttgtgggtccttgtggtgctgggcacctcgtgggtgggatggggcagccaagggactgaagccgcccagctccgacagttttatgtcgcagcacagggtataagctggagctaccgcccagaacctaccaactcctcgcttaacctttcggtcacctccttcaagaagattgtgtatagggaatacgaaccctactttaagaaagaaaagcctcaaagcaccatttccggtctgctgggaccaaccctgtacgcggaagtgggcgacataatcaaagtccatttcaagaataaggcagacaagccactttcgattcatcctcagggtattaggtactccaagctgtcagagggagcgtcctacctcgatcacaccttccccgcagaaaagatggatgatgcggtggcccctgggcgggaatacacctatgagtggagcattagcgaggactccggacctacccacgacgatcctccatgtctgactcacatctattactcccatgagaatcttatagaagatttcaacagcgggctgataggtcctcttctcatctgcaagaaaggaacccttacggagggtggaacccaaaagacctttgataaacaaatcgtgctcctctttgccgtctttgatgagtcgaaatcgtggtcacaatcgagctcgctcatgtacaccgttaatggatatgttaacggcaccatgcctgacatcaccgtgtgtgcacacgatcatatctcatggcatcttcttggaatgtcctccggccccgagcttttttcgatccatttcaatggacaggtgcttgaacaaaaccatcataaggtgtccgcaattaccctggtgagcgcaacctccactaccgcgaatatgacggtggggccagagggaaagtggataatcagctccctgacgccgaaacaccttcaagccggcatgcaagcctacatcgatatcaaaaactgcccaaagaaaacccgcaatctgaagaagatcactagggagcagcgtagacatatgaaaaggtgggagtacttcatcgccgcagaagaagtcatctgggattacgcacctgtgatcccagccaacatggataagaagtatagatcgcagcacctggacaactttagcaatcaaataggcaagcattacaaaaaagtcatgtacacccagtacgaagatgaatcgtttactaagcataccgtcaacccaaatatgaaggaagatgggatcctgggtccaattatcagagcacaagtgcgcgacactttgaagatagtgttcaaaaacatggcgtcgcgtccatactcgatttacccgcacggcgtgaccttcagcccatacgaagatgaggtaaattcctcttttacttcaggaaggaataacactatgatccgtgcggtgcaacctggtgaaacctacacttacaaatggaacatacttgagtttgacgaaccaactgagaacgatgcacaatgcctgacgcggccttactattccgacgtggacattatgagagacattgcatcgggactgataggactcctcctgatctgtaaatcgcggtcactggacagacgtggtattcaaagagctgcagacatagaacagcaggccgtgtttgcagtctttgatgaaaacaaatcttggtacttggaggacaatatcaacaagttttgtgagaaccctgatgaggtgaaaagggacgatccaaagttttacgaaagcaatatcatgtcgactattaacggttacgtccccgaatccatcaccactctgggattttgttttgacgatacggtgcaatggcatttttgttcagtcggaacgcagaacgaaattctgaccatacacttcactggacatagctttatctatgggaaacgccatgaagataccctgaccctgttcccaatgagaggagaatcggtgaccgtgactatggataatgtcggtacttggatgcttacctccatgaactcatcgccccgctccaaaaaactccgacttaagttcagggatgtcaagtgcattcccgacgatgatgaggattcatacgagatttttgagccaccggaatcgaccgtgatggctacgaggaagatgcatgaccgactggagcctgaagatgaagagtcggatgcggattacgattaccagaacagactggcagcagcattgggtatcaggtcatttagaaactcgagcttgaaccaggaggaagaagagtttaacctgacggcattggcactcgaaaatggtaccgagtttgtgtcatcgaacactgatatcatcgtgggaagcaattacagctcgccttcgaacatttcgaaattcactgtcaacaacctggccgagccccagaaggcgcctagccatcaacaggcaaccaccgcaggctcgcctttgcggcatctcatcggcaagaattccgtgctgaattcgtccaccgcagaacatagctcgccctactcggaagatcctattgaagatcctctccaacctgacgtgaccgggattagacttctctcacttggtgcaggagagtttaagtcgcaggaacatgccaagcacaaaggccccaaagtggagcgggatcaagcagccaaacatagattttcttggatgaagctcctcgcacacaaagtgggaaggcacctttcacaagatacgggctcacccagcggtatgcgaccttgggaggacctgccatcgcaggataccgggtcaccttctcgaatgcggccttggaaggatcctcccagcgaccttctccttcttaagcagtccaactcgagcaagattcttgtcggccgttggcatctcgcttcggagaagggaagctacgagatcattcaagataccgatgaggacaccgcggtgaacaactggctgatctcaccacaaaacgcatcaagagcttggggcgaatccacccctctggcaaacaagcctggcaagcagtcaggtcatccaaagttcccccgcgtgaggcataagtcccttcaagtgagacaagatggcggtaaatcgagactgaagaagtctcagtttctcattaagaccaggaagaaaaagaaggaaaagcatacccatcacgcgcctctttcaccacgcactttccaccctctgcggagcgaagcctacaatactttttccgaacgaagattgaagcattctctggtgctgcataagtcaaatgaaacctccttgcctactgatctgaaccaaactctgccatccatggattttggctggatagcctcccttcctgaccacaaccaaaattcgtccaacgataccggtcaggcctcgtgccctccaggactctaccagaccgtgcccccggaagagcattaccaaaccttccctattcaggatccggatcagatgcatagcacctccgacccatcgcatcgctcgtccagcccagaactttcggaaatgcttgagtatgatcggtcacacaagtcctttcccactgacatttcacaaatgtccccttcgtcggaacatgaggtgtggcaaactgtgatcagccccgatctgtcccaagtcacgctctcacctgagcttagtcagaccaacctttcaccagacctcagtcacacgaccctttccccagaacttattcagcggaatctgtcgcctgcactggggcaaatgcctatctcgccggatttgtctcacacgactctttccccagacctgtcacataccaccctgagcctggatctgagccagaccaacctgtccccagaactgagccagactaatttgtcgcccgccctcgggcagatgcccctctcgccagatctttcccacaccaccctgtcgctggattttagccaaactaatctgtcgccagaacttagccacatgactttgtcacccgaactctcgcagactaacctttcgccagcactgggccaaatgccaatttcgccggatcttagccacacgacgcttagcttggatttcagccagacgaacctctcacccgaactttctcaaaccaacctgtcacctgctcttggacaaatgcctttgtcgcctgaccctagccatactacgctttctcttgatctttcccagaccaatctctccccggagctctcacaaacgaaccttagcccggatctttccgagatgcctctttttgccgacttgtcgcaaatccccctcacgccagatcttgatcagatgaccctgtcgccagaccttggagagactgacctctccccaaatttcgggcagatgtcactttcacctgatctgtcacaggtgactctcagccctgatatttcggatactactctgcttccagatttgtctcagatcagcccacctccggacctggatcagatattctaccccagcgaaagctcccagtcactgctcctccaggaattcaacgaaagttttccataccctgatttgggccagatgccatctccttcgagcccaaccctgaatgatacttttctgtccaaggagtttaacccgctggttatcgtgggacttagcaaggatgggactgactacattgagatcatccctaaggaagaagtccagtcgtcagaggacgattacgccgagattgactatgtgccttacgatgatccttataagactgatgtgcgaacgaacatcaactcctccagggatccggataacattgcagcgtggtacctgcgatcgaacaatggtaatcgtagaaattactacattgcagcagaagaaatttcgtgggactactcggaattcgtccagcgggaaaccgatattgaggactcggatgacattccggaagatacgacgtacaagaaggttgtgtttagaaagtacttggacagcacgttcactaagagagatccaaggggagagtacgaggagcacctcggaatcctcggtccaatcattcgcgcagaagtcgatgacgtgatccaagttcgcttcaagaacctggcgagccgcccctactcccttcatgcacacggacttagctacgagaagtcgtctgaaggaaagacgtacgaggatgatagcccagagtggttcaaggaagataacgcagtccagccaaactcgtcgtacacctacgtctggcacgcaactgaacggtccggtcctgaatcccccggatcggcgtgcagagcctgggcatactacagcgcggtgaatccagagaaggacatacattccggactgattggtcccctcctcatatgtcagaagggaatactgcataaagatagcaatatgccaatggatatgagggaattcgtgctgctgtttatgacttttgatgagaaaaagtcatggtattacgaaaagaagtcccgttccagctggcggcttacttcatcggaaatgaaaaagtcccacgaatttcatgcgattaatggaatgatttactcgctgcctggactgaagatgtacgaacaggagtgggtgcgcctgcaccttctgaacataggaggaagtcaggatattcatgtggtgcactttcatggacagacgcttctggagaacggtaacaaacagcaccaacttggagtgtggccactcctccctggatcgtttaagactctggaaatgaaagcatcgaagcccggctggtggcttctcaataccgaagtcggggagaaccagcgcgcaggaatgcagactcccttccttatcatggaccgtgattgtcggatgcctatgggattgtcgacgggaataatcagcgactcccagataaaggcatcagagttcctggggtattgggaacctagacttgcccgacttaacaacggtggttcatacaatgcgtggtccgtggaaaagttggctgccgagtttgcatccaagccgtggattcaggttgatatgcagaaggaagtgatcattaccggcattcagactcaaggagccaagcattacctgaaatcatgctacactaccgagttttacgttgcatacagctcgaatcaaatcaattggcagatctttaaaggaaattcgactcgaaacgtgatgtacttcaacggcaactctgacgcatcgaccatcaaggagaaccaatttgacccgccaattgtggctcgctacataagaatttcaccaaccagagcgtacaacaggcctaccctgcgccttgaactccagggttgtgaagtcaacggatgttccaccccgctggggatggaaaacggtaagatcgaaaacaagcagataactgcctcatcgtttaagaagtcgtggtggggcgattactgggagccgtttagggcacgtctcaatgcacaaggaagagtcaacgcgtggcaagcaaaggcgaacaataacaagcaatggttggaaattgacctgctgaaaatcaagaagattactgcgatcattactcagggttgtaagtccctgtcctccgaaatgtacgtcaagtcgtacaccatccattacagcgagcagggagtcgagtggaaaccttacagactcaagagctccatggtggataagatttttgaaggcaataccaacactaagggacatgtcaaaaactttttcaacccacccatcattagtcgctttatccgtgtgatccctaagacttggaaccagtccatcgcactccgactcgaattgttcggatgcgacatctac

SEQ ID NO: 9035 - DNA, 6672 bp, Artificial Sequence
  Description of Artificial Sequence: Synthetic coding sequence
atgtttccgggttgtccccgtttgtgggtgttggtggtgttggggacctcctgggtcggttggggttcgcaaggaaccgaagccgctcagcttcgccagttctacgttgcagctcagggtatttcgtggtcctaccgccccgaacctaccaactcgtccctgaatctgagcgtgacttcctttaagaagatagtctacagagagtacgaaccttacttcaagaaggaaaaacctcagtcaactattagcggccttcttggccctaccctttacgcagaagtgggcgatatcattaaagtgcatttcaagaacaaggcagacaaacccctttcgatccatccacaaggaataagatacagcaagctcagcgaaggagcctcctacctggatcacaccttcccagcggagaagatggatgatgctgtggctcctggtcgagaatacacctacgagtggtccatcagcgaggactcaggacccactcatgatgatcccccttgtctgacccacatttactactcacatgaaaacctgattgaggactttaacagcggcctgattgggccactgctgatttgtaagaaggggactctcacggaaggaggtacgcaaaagacttttgataaacaaatagtgcttctctttgccgtctttgacgaatccaagtcctggtcacaatcctcaagcctgatgtacactgttaatggatacgtgaatggaacgatgcctgatataactgtgtgtgcacatgatcatattagctggcacctccttgggatgtcgtcaggacccgaactgttttccatccatttcaatggacaggtcctggaacaaaatcaccataaggtgagcgcaattacccttgtgtcggccacttctactaccgctaatatgactgtcgggccggaagggaaatggataatcagcagccttaccccaaagcatctccaagcaggtatgcaagcatacattgatatcaaaaactgcccgaagaaaaccaggaatcttaagaagattactcgagaacagagacggcacatgaagagatgggaatacttcatcgcggcagaagaggtgatttgggattacgcccctgtgataccagccaatatggacaaaaagtaccggtcacaacatcttgataacttctcgaatcaaataggtaaacattacaaaaaggttatgtacactcaatacgaggacgagagcttcaccaagcataccgtgaatcctaatatgaaggaagatggaatcctcggccctatcattcgggctcaagtccgagatactctcaaaatcgtgtttaagaatatggcatcacggccttactcaatctacccacacggtgtgacctttagcccatacgaagatgaagtcaactcgtcattcactagcggaagaaacaataccatgatacgagccgtgcagccaggagaaacctatacctacaagtggaatatactggagtttgatgagccaactgaaaacgacgcacagtgtttgactagaccatactactccgacgtggatatcatgagggatattgcgtcaggccttatcgggctcctgctgatatgtaagtccaggtcactggatagacgcggcattcagcgggcagccgacattgagcagcaggccgtctttgcagtctttgatgagaacaagtcatggtacttggaggataacattaacaagttttgcgagaaccctgatgaagtgaagcgagatgacccaaagttctacgaaagcaacattatgagcactattaacggatatgttcccgaaagcattaccaccctcggcttttgtttcgatgacactgtgcagtggcatttttgtagcgtggggacccagaatgagattctgactattcacttcaccggtcactcgttcatctacggaaagcggcacgaagatacccttaccctgtttcccatgagaggtgaatcggtgactgtgacgatggataacgtcggtacttggatgctgacgtccatgaactcatcgcctagaagcaagaagctgcgactgaagtttcgcgacgtcaaatgtattcctgatgacgatgaggattcctacgagatttttgagccaccagaatcaacggttatggcaaccaggaagatgcatgaccggcttgagccggaggatgaagaatcagatgcagattacgattaccagaatagactggccgcggccctgggcattagatcgttccggaattcctccctgaatcaagaagaagaggaattcaacctgactgcacttgcacttgagaatgggactgagtttgtgtcgtccaacactgatatcattgtgggttcgaactattcttccccatctaacatttcgaagtttaccgtgaacaacctcgcagaaccccaaaaggcaccttcacaccagcaagcaactaccgcaggatcgccgcttagacaccttattgggaaaaactcagtgcttaactcatccaccgcagaacattcgagcccctacagcgaggaccctattgaagatccgctccagcccgatgtcactggcatcagacttctgagccttggtgcgggagaattcaaatcacaagagcatgcgaaacataaagggcctaaggtcgagagggaccaagcagccaagcacagattttcgtggatgaagttgctcgctcacaaagtgggacgccacctgtcccaggacactggctccccttccggtatgcgcccttgggaggatctgccatcccaggataccggatcaccatcaagaatgcgtccttggaaagatcccccttctgatctgttgctgctgaaacaatctaactcgtccaagattctcgtggggcgatggcacttggcttcagaaaaaggatcttatgaaatcatacaggatacggatgaggacaccgcagtgaacaattggctgatctcccctcaaaacgcatccagggcatggggggaaagcactccccttgccaacaagccgggaaagcagtccggtcatcctaagtttccgagagtgcgtcacaagtcgctgcaggtccggcaagatggaggaaagtcacggctcaaaaagtcgcagtttctcattaagactaggaaaaagaagaaagaaaagcatactcatcacgcgccccttagcccacggactttccaccctctgaggtcggaggcctacaacactttctccgagcggagactgaagcacagccttgtgctccataaatcgaacgaaacctcgctccctactgacctgaatcaaacccttccatctatggactttggctggattgcctccctgcctgatcataaccaaaattccagcaacgacaccggacaagcatcgtgcccgccaggtctgtaccaaactgtgccgccagaggagcactaccaaacctttccaatacaagatccagatcaaatgcattcgaccagcgacccttcccatcgctcatcgtcgccagagctgtcggagatgttggaatacgaccggagccataaatcttttcctactgatattagccagatgtccccttcaagcgagcatgaagtctggcagaccgtgatttcgccggacctttcacaagtgaccctgtcaccagagctgtcacaaaccaatttgtcaccagacctttcccataccaccctgagccccgaactgatccaaaggaacctctcgccagccctggggcagatgccaatatcgcctgacctctctcacactacgctgtccccagatctgtctcatactacgctctctctcgacctttcccagaccaacctgagcccagaactgtcacagaccaacttgtcacccgctctgggccagatgcctctgtcgccggatctctcccatactacgctgtcgttggacttctcccagactaatctttcacccgagctgtcgcacatgactctgtcccctgaacttagccaaaccaacctttcgccagcgcttggccaaatgcccatttcacccgacctgtctcacaccactctttccctcgatttttcgcaaactaacttgtcgcccgaactctcgcagacgaacctgtcgcctgcgctcggacaaatgcctctctcgcctgacccctcgcatactaccctgagcctcgacctgtcacagactaacctttctcctgaactgtctcaaaccaatctgtcaccggacctcagcgagatgcctctcttcgcggatcttagccaaatccctctcactcctgacctggaccaaatgacgctctcgccagatcttggtgaaaccgatctgagcccgaattttggccaaatgtcgctgtcacctgacctttcccaagtgaccctttcccctgacatttcggacaccactctgctgccggatctgtcccaaatctccccgccaccagatctcgatcagatcttttacccatcagaaagcagccaaagcctccttctccaagaattcaacgaatcgtttccttaccctgacttgggacagatgccgagcccctcttcgcctacccttaatgatactttcctctcgaaagagttcaaccctctcgtgattgtggggctcagcaaggacggaaccgactatattgagataatacctaaggaagaagttcagagctcggaagatgattacgcagaaatcgattacgtgccatacgacgacccttacaaaaccgatgtgcgaactaacatcaattcgtcgcgtgatccagacaatatcgctgcatggtacttgcggtcaaacaacggtaaccgcagaaactactacatagcggccgaagagatctcgtgggattactcggagtttgtgcagcgggaaacggatatagaggatagcgatgatattccagaggataccacctacaagaaggtcgtgtttcggaaataccttgattcgacctttactaagcgcgatccccgcggcgaatatgaagaacatttgggcatacttggtccgatcataagagcggaagtggatgatgtcattcaagtccgctttaagaaccttgcgtcccgcccgtactccctccatgcacatggacttagctacgagaaatcctcggagggaaagacttatgaagatgattcccccgagtggtttaaggaggacaacgccgtccaaccaaattcatcgtacacttatgtgtggcatgcaaccgaacgctcaggtcctgaatcccctggatccgcatgtagagcatgggcctattactcagctgtgaatccggaaaaggatatacattcgggtcttattggacctcttttgatctgccaaaagggtatcttgcataaggattccaatatgccaatggacatgcgagagtttgtccttctctttatgacctttgacgaaaagaagtcgtggtactacgagaagaaaagccgctcctcctggcgtcttacctcatccgagatgaagaagtctcacgagtttcatgccataaatggtatgatttacagccttcctggacttaagatgtacgaacaggaatgggtcagactgcatcttttgaatattggcggatcccaggacatacatgtcgttcactttcatggtcagacgctgctggaaaatggcaacaaacagcaccagcttggagtgtggccacttctgccaggatcattcaaaactctggagatgaaggcgtcaaagcctggatggtggttgcttaacaccgaagtgggagaaaaccaaagggcggggatgcaaaccccatttctgatcatggaccgggattgtaggatgccaatgggactttccactggaattatctcggactcccagattaaggcatctgaattccttggttactgggaaccacggcttgcacggctcaataatggcggatcatataacgcatggagcgtggaaaagctggcagcagaatttgcatcgaagccctggatccaagtcgacatgcagaaggaagtgatcataacgggcattcaaacgcaaggtgcaaaacattatctgaagagctgttacaccacggagttttacgtggcctactcgtctaatcagattaactggcaaatcttcaagggtaatagcactcgtaacgttatgtactttaacgggaattcggacgcctcgactatcaaggagaatcaattcgatccaccaatcgtcgctaggtacattagaatttcacctacgcgggcctacaaccgacctacccttcgtctggaactccaaggatgcgaagtgaacggttgctccactcctcttgggatggaaaacggcaagatcgagaataagcagatcaccgcatcgtcgtttaagaaatcgtggtggggggattattgggaacctttccgtgcaagactcaacgcacagggtcgtgtcaacgcctggcaagcaaaggcaaacaataacaaacaatggcttgaaattgacctgctcaaaatcaagaagattaccgcaattatcacccagggttgtaaatcgctgtcgtcagaaatgtacgtgaaatcttacaccatccattactcggaacaaggggttgagtggaaaccgtatcgcctcaagtcgagcatggtggataagatttttgagggaaatacgaacacgaagggacatgtgaagaacttctttaacccgcccattatcagccgtttcatcagagttatcccaaaaacctggaaccagtcgattgccctcagactggaactctttggatgcgacatctac

SEQ ID NO: 9036 - DNA, 6672 bp, Artificial Sequence
  Description of Artificial Sequence: Synthetic coding sequence
atgttcccgggatgcccgcggctctgggttctggtggtcttggggacttcgtgggtggggtgggggtcccaaggaaccgaagcggcacaactgcggcagttctatgtcgccgcccagggcatctcctggtcctacaggccggaaccgactaattcgtcgctcaacctctccgtcacctcgtttaagaagattgtgtaccgcgagtacgaaccgtatttcaagaaggaaaaaccgcaaagcaccatttccggcctgctcggtccgaccctgtacgcagaggtgggggacataatcaaggtgcacttcaagaacaaggccgacaagccgctctcgatccacccccaggggatcagatactcaaagctctcggagggagccagctacctggaccacaccttccctgcggagaaaatggacgatgcggtggccccaggacgtgagtatacctacgagtggagcatttcggaagattccggtcctactcacgacgacccgccgtgcctgacccacatctactacagccacgaaaatctgatcgaagatttcaattccgggctgatcggacctttgctgatctgcaagaagggaacccttactgaaggcggtacccaaaaaactttcgacaagcagattgtgctgcttttcgcggtctttgatgaatccaaatcttggtcccaatcgtcctccctcatgtatactgtcaatggatacgtgaacggaactatgccagacatcactgtctgcgcccatgatcatatctcatggcatctgttggggatgtcctcgggcccggaactcttctcgatccactttaacggacaggtgctggaacagaatcatcacaaggtcagtgccatcacccttgtgagcgccacttcaaccaccgctaacatgaccgtcgggcctgaaggaaagtggataatcagttctctgaccccaaagcatctgcaggcaggaatgcaggcgtacatcgatatcaagaactgcccgaagaaaactcggaatctcaagaagatcacgagagaacagcgtagacatatgaagcgctgggaatacttcatcgctgcagaggaagtgatctgggactatgcgccagttatccctgccaacatggacaaaaagtatcgctcgcagcacctggacaatttcagcaaccaaataggcaagcactacaagaaggtgatgtacacccaatacgaggacgagtccttcacgaagcacactgtgaatccgaacatgaaagaggatggtatcctgggccctatcatcagagcccaagtgagagatactctgaagatcgtctttaagaatatggcctcaagaccctactccatctacccgcatggcgtgacgttttcgccctatgaggacgaagtgaacagctcgtttacctccggtcgcaacaacaccatgatcagagctgtccagccaggtgaaacttacacctacaagtggaacatcctcgaatttgatgagccaaccgagaacgacgcgcagtgtctgacccggccttactattcggacgtggacattatgagggacatcgcgtccggcttgatcggactgctgctgatctgtaagtcgagatcacttgacagacgcggcatccagagagcggctgacatcgaacagcaagctgtttttgcagtgttcgacgaaaacaagagctggtacctcgaggacaacatcaataagttttgcgagaacccggatgaggtgaaacgcgacgatcctaagttctacgaatccaatatcatgtccacgattaacgggtacgtcccggagagcatcaccaccctcggcttttgcttcgacgataccgtgcaatggcacttttgttccgtcgggacccaaaacgaaatcctgacgattcactttacgggccacagcttcatctacggtaagcgacatgaagatacgctcactcttttccctatgcgcggagaatctgtgactgtgacgatggacaacgtgggcacgtggatgcttacgtccatgaattcgtcgccgcggtcaaagaaacttcggctcaaatttcgggacgtgaagtgtatcccggacgatgacgaggattcctacgagatctttgagcctcccgagtccacggttatggctaccaggaaaatgcatgaccggctggaaccggaagatgaggaatccgacgcggactacgattaccagaatagactcgcagcagcattgggaatccggtcgttccggaactcaagcctcaaccaggaggaggaggagttcaatctgacggccctggccctggaaaacgggaccgagttcgtgtcatccaacaccgacatcattgtcggatccaattactcgtcgccgtcaaacattagcaagttcaccgtgaataacctggcagaaccacagaaggcgccgagccaccagcaggcaactaccgcaggaagcccgctgcgccatctcatcggaaaaaactcggttctgaactccagcactgctgagcactcgtctccttactcagaggacccgatcgaggatccgctgcaaccagacgtgaccgggatccggctgctgtccctcggcgctggggagttcaagtcacaggaacacgccaaacataaagggcccaaggtcgagagggaccaggcagcaaagcatagattttcctggatgaaactcctggcgcacaaagtcggacggcacctgagccaagataccggatcaccgtctggcatgcggccttgggaggatcttccaagccaggatactggttctccgagcagaatgcgcccgtggaaagacccaccatcggacttgctcctgctgaaacaatcgaacagctcgaagatccttgtggggcgctggcacctggcctcggaaaaaggttcgtacgaaatcatccaggatacggacgaggataccgccgtgaataactggttgatctccccgcagaacgcgagcagggcttggggtgaaagcactccactggccaacaagccaggcaagcagtcgggccatcctaagtttcctcgagtgcgccataagtcattgcaggtgcgccaagatggaggcaaatcacgactcaagaagagccagttcctgatcaagactaggaaaaagaaaaaggagaagcacactcaccacgctcccctctcaccgaggaccttccaccctctgcggagcgaggcctacaatactttttccgaacgacggctgaaacactcactcgtgctgcacaagtcgaacgaaacctctttgccaactgacctcaatcagactctcccatcgatggacttcggatggatcgcatcgctcccggatcacaatcaaaactcgagcaatgacactggccaagccagctgcccgccaggactgtaccagaccgtgccgcctgaagaacattaccagacctttccaatccaagatccagaccagatgcattccacttcggatccatcgcaccgctcttcgtcacctgaactctcagagatgctggaatacgatagatcccataagtctttcccaactgatattagccagatgtccccctcgtcggagcacgaagtgtggcagactgtgatctcgccagacctcagccaagtgaccctgtcccctgagctgtcgcaaaccaatctttcgcccgatctgagccatactaccctgagccccgaactgattcagcggaacctgtcgccggctctcggacagatgccgatctcccccgacctctcgcacaccactttgtcccccgacttgagtcacaccaccctgtcgctggatctgtcccagactaatctgagcccggagttgagccagacgaatttgtcacccgccctgggtcagatgcctctctcgccggatctttctcatactactctcagcctcgatttcagccagactaacttgtcgcctgaactgtcgcacatgactttgtcgccagaactgtcgcagactaatctttcccctgccctgggacagatgcccatctcccctgacctctcacacactaccttgtcgctcgacttcagccaaaccaacttgtcgccagagctgtcccagaccaacttgagcccagcgctcggacaaatgccactgagccctgatccttcccatacgaccctctccctggatctttcacaaaccaacctgagtccggagctcagtcaaacgaacctttcaccggatcttagcgaaatgccgctgttcgcggacctgtctcaaatcccgcttaccccggacctcgaccaaatgactctctcaccggatctgggagaaaccgacctctcccccaatttcggacagatgtcactctctccggacctgtcgcaggtcaccctctcgccggacatctctgatactactctgctcccggacctgagccaaatctctcctccaccggatttggaccagatcttctacccgtcggaaagctcgcaatctctgctgcttcaggaattcaatgagtcattcccataccctgacctgggtcaaatgccgagcccatcttccccaactctgaacgacacgttcctgtccaaagaattcaaccccctggtgattgtcggactgagtaaagacggcaccgattacatcgaaatcatccctaaggaggaagtgcagtcctccgaggatgactacgctgaaatcgattacgtgccctacgatgacccgtacaaaaccgacgtgcgcaccaacatcaactcgagtcgcgatccggacaacatcgccgcctggtaccttcgatcgaacaacggaaatcggcgcaactactacatcgcagcggaggagatctcgtgggattactccgaatttgtgcaacgcgaaactgacatcgaggattcagacgatattccagaagatactacctacaaaaaggtcgtgttcagaaagtacctggactcaaccttcaccaaaagagatccgcgaggcgaatacgaggagcacttgggcatcctgggaccgattattcgggcggaagtcgacgacgtgatccaagtacggttcaagaacctcgcgtcgaggccatacagcctccatgcgcacggccttagctacgagaagtcgtccgaaggaaagacttacgaagatgacagtccggaatggttcaaagaggacaacgccgtgcagccgaattcgtcatacacctacgtctggcacgctactgagaggtccggaccggaatccccaggctccgcgtgccgggcatgggcgtactactcagccgtgaacccagaaaaagacatccattcaggactgatcggacccctgctcatctgccagaagggaattctccacaaggactctaacatgccaatggatatgcgcgaatttgtgctgttgttcatgaccttcgacgagaagaaaagctggtactacgaaaagaagagccgctcgtcttggcggctgacttccagcgaaatgaaaaagtctcacgagttccatgcaatcaacggaatgatctactccttgccgggactgaaaatgtacgagcaagaatgggtgcgcctgcaccttctcaatattgggggaagtcaagacattcatgtcgtccatttccacggacaaaccctgcttgagaatggcaataagcaacatcagttgggtgtctggccgctgctcccggggagcttcaaaactctggagatgaaggcctcaaagccaggttggtggctccttaacacggaagtgggagaaaatcagagggccggtatgcaaaccccattcctgatcatggaccgcgattgtcgcatgcctatgggactttccactggcatcatatcggactctcagattaaagcatccgagtttctgggatactgggaaccacgcctggcccggctgaacaatgggggatcgtacaacgcttggtccgtcgagaagctcgccgccgagttcgcctcaaagccttggattcaggtggatatgcaaaaggaagtgatcatcaccggaatccagacgcagggcgcaaagcattacctgaagagctgttacactactgagttttacgtcgcctacagcagcaatcagatcaactggcagatcttcaaaggaaactccaccagaaacgtgatgtacttcaatggcaattcagacgccagcaccatcaaggaaaatcagttcgatccgccgatcgttgccagatacattcggatctctccgacgagagcgtataatcggccgactctccggctcgagctccagggatgcgaagtgaacggatgctcgactcctctgggtatggaaaatggaaagatagaaaacaagcaaatcactgccagctcattcaaaaagtcgtggtggggagactattgggaacctttccgggctcgcctgaacgcacagggacgcgtgaatgcgtggcaggccaaggccaacaataacaagcagtggctcgagatcgacctgctgaagatcaagaagattaccgctatcatcacgcagggttgcaagtcactcagctcggaaatgtacgtcaagtcgtacaccatccactattctgaacagggagttgagtggaagccttacaggctgaaatcatcgatggtggacaagatcttcgaaggaaacactaacaccaaaggccatgtgaaaaacttcttcaacccacccatcatctcacggttcataagagtcatcccgaaaacttggaatcagtccatagccctcaggctggaattgttcgggtgcgacatctac

SEQ ID NO: 9037 - DNA, 6672 bp, Artificial Sequence
  Description of Artificial Sequence: Synthetic coding sequence
atgtttcctggctgcccacgtctttgggtcctggtggtgctcggtacctcctgggtgggctggggatcgcaaggaaccgaagcagcacagctgagacaattctacgtcgcagctcaaggtatatcgtggtcatacaggcctgaaccaaccaattcctcgctgaatctgtcggtcacgtcgtttaagaagatagtgtaccgggagtacgagccatactttaagaaagaaaaaccccagtcgaccatttcgggtctgctgggacctacgctttacgcagaggtgggggacatcattaaggtgcacttcaaaaacaaggcagataagccactgtcaattcatccacagggaatccggtacagcaagctctcagagggtgcatcctacctggatcatacctttccagcagaaaagatggatgatgcagtggcccctggacgagaatacacttacgaatggtcaatttccgaagattccggaccaacgcacgatgatcctccttgtctgacccatatctactactcgcacgaaaacctcattgaggatttcaattcgggtcttattggacctctccttatttgtaagaagggaaccctgactgaaggtggaacccaaaagaccttcgataagcagattgtcctgctgttcgctgtgtttgatgaatcgaagtcctggagccaatcttcgtctcttatgtacaccgtgaatgggtacgtcaacggaactatgccggatatcactgtgtgcgcacatgatcatatatcctggcatctcctcggcatgagcagcgggccagaactgttttctattcactttaacggtcaggtcttggaacaaaaccaccacaaagtgtcggccattactctcgtgagtgccacctcaactaccgcaaacatgactgtgggacctgaagggaagtggattatctccagccttactccaaaacatctccaagccggaatgcaggcgtacatcgacattaagaactgccctaaaaagacccgcaacctcaagaagattactagagaacagcggcggcatatgaaacgctgggagtacttcattgcagcagaagaagttatttgggattacgcaccagtgattccagccaacatggacaagaagtaccgctcgcagcatcttgacaacttctctaatcagatcggaaaacattacaagaaggtgatgtacactcaatacgaggacgagtcgttcaccaaacataccgtgaacccgaacatgaaggaggacggcattcttggccccattatcagagcgcaggtccgcgacactcttaagattgtctttaagaacatggcgtccagaccttattcaatttaccctcatggagtgactttctccccttatgaagatgaggtgaatagctcattcactagcggaagaaacaatactatgatacgtgctgtgcagcctggtgaaacttatacctacaaatggaacattctcgaattcgacgagccgactgaaaacgatgcccagtgtcttacccggccatattactcagacgtggatatcatgagggatatagcctccggattgattggattgttgctgatctgtaagtcccggtcactggatcggagagggattcaacgcgcggcagatattgaacaacaggcggtgttcgcagtgtttgacgaaaacaaatcgtggtatcttgaagataacatcaacaaattctgcgagaaccccgacgaagtgaagagagatgatccaaagttttacgagtcgaacattatgtcaactatcaatggttacgtccccgaatccattactactctggggttttgttttgacgatactgttcaatggcatttttgttccgtggggacgcaaaacgagatccttactatacattttactggacattcattcatatacggtaagcgtcatgaagatacccttaccttgtttcctatgagaggagaatccgtgaccgtgaccatggataacgtgggtacctggatgttgacctcaatgaattcgtcacctcggagcaagaaattgcgccttaagtttcgtgacgtgaaatgtatcccagacgacgacgaagattcgtacgagatttttgaaccacctgaatcgactgtcatggcaactcgcaagatgcatgatcgactcgagcctgaggacgaagaaagcgatgctgactacgattaccaaaatcggcttgcagcagccctcggaattagatcgtttaggaacagctcgcttaatcaagaggaggaagagtttaacctcaccgcgctggccctcgaaaatggtacggagttcgtgtcgtccaacactgatatcattgtgggaagcaactactcctcgccaagcaacatatccaagtttacggtgaacaaccttgcagagcctcaaaaggcccctagccatcaacaggccaccaccgcgggatcacctttgagacatcttatcggaaaaaactcggtgttgaacagcagcaccgctgaacattctagcccttactctgaagatccaatagaagatcccttgcagcccgacgtgactggtattagacttctttctttgggggcaggcgaattcaaatcccaggaacatgcaaaacataagggaccaaaggtggagagagatcaagcagccaagcatagattttcatggatgaaactgctggcgcacaaggtgggacgccatctgtcccaggacaccggatcgccctcgggtatgaggccttgggaggacctgccctcgcaagataccggttcgcctagccgcatgcgcccttggaaggatcctccctccgatctgctgctcctcaagcaaagcaactcgagcaagatcctggtcggaagatggcacctggcatcggaaaagggatcctacgagatcatacaagatactgacgaggacaccgcagtcaataactggctgatttccccacaaaatgcttcgagagcatggggagaatcaactccgcttgcaaacaaacctggaaaacaatcagggcacccaaagttccccagggttcgccacaagagccttcaagtgagacaagatggagggaagtcgagactgaagaagagccaatttctgattaagacccgcaaaaagaaaaaggaaaagcatacgcatcacgcaccactttcccctcgtaccttccatcctctccggtcggaagcatacaataccttttcggaaagacgtctgaagcattcgctggtgcttcataagtcaaatgagacttcgcttcccaccgacctgaaccaaacccttccatcaatggattttggttggattgcatccctgcctgatcataaccagaattcatccaacgataccggtcaggcgtcgtgtcctcccggactttaccaaaccgtgccaccggaagaacattaccaaacctttcctattcaagaccctgatcagatgcacagcacttctgacccttcacacagaagctcgtcccccgagctgtcggaaatgctggagtacgatcggtcgcacaagtcctttccaactgatatttcacagatgagcccttcctcagaacacgaagtttggcagacggtgatttcgccagacctttcacaagtgacgctttccccagaactgtctcagaccaaccttagtccagatctcagccatacgactctgtcaccagagcttatacagcgtaatctgtcaccagcactcgggcaaatgccgatctccccagatttgtcacacactactctgagccccgacctgtcgcatactaccctctcactggacttgagccagactaacttgtcaccagaacttagccaaaccaatttgtctccagctttgggccagatgccactgtcgcctgatctgtcccacacgacgctgtccttggactttagccaaactaacttgtccccggagctgagccatatgaccctgtcgcccgagctgagccaaactaatctctcgcctgccctggggcaaatgcctataagcccagacctgtcacacaccactctgtcactggatttttcacagactaatctgtcgccagaactctcacagactaacctttcaccagcccttggacaaatgcctctttcaccagatccttcacacaccacccttagcctcgatctgtcccagactaacctcagccctgagctttcccaaacgaacttgtcacccgatctttccgagatgcctctgtttgccgacctcagccaaatccctctgactcctgaccttgatcagatgaccctgtcacctgatcttggcgagacggacctgtcaccgaactttggacaaatgtcgcttagccctgatctgtcacaggtgaccctctccccagacatttcagacaccactcttctcccggatcttagccaaatcagcccccctcctgatcttgaccaaatcttttacccttccgaatcgagccagagcttgcttctccaagagttcaatgaatcttttccgtaccccgatctcggtcaaatgccgtcaccatcgtcccctactttgaatgatacttttctgagtaaggaattcaacccccttgtgattgtgggtctgtcgaaagatgggacggactatattgaaatcatcccaaaggaagaagtgcagagcagtgaggatgactacgctgaaattgactacgtgccgtacgacgatccatacaaaactgatgtgagaactaacatcaattcctcgagagatcccgataacattgcagcctggtatctgcgctcgaataacggcaacaggcggaactactacatagccgccgaagaaatctcgtgggattacagcgagtttgtccaacgggaaactgatatcgaagatagcgacgacatcccagaggataccacgtacaaaaaagtggtctttagaaagtacctcgattccacctttaccaaacgggatcccagaggagagtacgaagaacatctgggaatcctcgggccaattatcagagcagaagtggatgatgttatccaggtacgcttcaagaatcttgcatcccgcccatatagcctccatgcacatggactctcctacgagaagagctcagaaggaaagacctacgaagatgactcccctgagtggtttaaggaggacaacgccgtccaacctaactcttcatacacttacgtgtggcacgcaactgagagatccgggcccgaatcgcctggctccgcatgccgagcgtgggcatactactccgcagtcaatcctgaaaaagatatacattcggggcttattggtccgcttctgatatgtcagaagggaatccttcacaaagattccaatatgcccatggatatgcgtgagtttgtcctcttgtttatgactttcgacgagaagaaatcgtggtactacgaaaagaagagcagatcatcatggcgccttacttccagcgaaatgaaaaagtcccacgagtttcatgcgatcaatggtatgatatacagtctcccaggcctgaagatgtacgagcaggagtgggtcaggctccatctgttgaacattggagggtcccaagacattcacgtggtgcattttcacggccaaactcttctggaaaatggaaacaaacaacaccaactgggggtgtggccgcttctgccaggctccttcaaaactctggagatgaaggcatcaaaaccaggttggtggctgcttaacacggaagtgggagaaaaccaaagagcgggaatgcaaacgcctttccttatcatggatagagactgccgaatgcctatggggctcagcactggaattatctccgactcccagattaaagcaagtgagtttctgggatactgggaaccaaggctggctaggctgaataatgggggatcgtacaacgcctggtccgtggaaaaactcgcggcagaatttgcgtcgaaaccttggatccaggtcgacatgcagaaggaagtgatcatcactggtatccagacccagggggccaagcactacttgaaatcgtgttacaccaccgagttttacgtcgcttactcgagcaatcagattaactggcaaatctttaaggggaattccaccagaaatgtcatgtacttcaatggtaactcggatgcaagcaccattaaagagaaccaatttgatccccctatcgttgccagatacattcgcatttcaccaaccagagcttacaaccgtccaacccttcgactggagctccaaggatgtgaagtcaacgggtgtagcactcctctgggtatggaaaatggcaagattgaaaacaaacagataaccgcatcgagcttcaagaagtcgtggtggggagactactgggaaccgttcagggcacgccttaatgcgcagggtagagtcaacgcttggcaggcaaaagccaacaacaacaaacaatggcttgaaattgacctgttgaagatcaagaaaatcactgcgatcatcacccaaggatgtaagtccctgtcatcagaaatgtacgtcaagtcatacaccatacactacagcgaacaaggagtggagtggaagccctacagactgaaatcatccatggtcgataagatattcgaagggaacaccaatactaagggacacgtcaagaatttctttaaccctcctatcatctcccggttcattcgtgtgatcccaaagacttggaaccaatcgattgcactgcgcctggaactgtttggttgtgacatttac

SEQ ID NO: 9038 - DNA, 6672 bp, Artificial Sequence
  Description of Artificial Sequence: Synthetic coding sequence
atgtttcctggctgccctaggctgtgggtgctcgtggtccttggtacctcatgggtcggatggggatcccagggcaccgaagcggcccaactgaggcagttctacgtcgccgcacagggaatcagttggtcttaccgccctgaaccgacgaacagctcattgaacctgtccgtgaccagctttaagaagatagtttaccgtgaatacgagccatactttaagaaggaaaagcctcaaagcactatttcgggtttgcttggtccaaccttgtacgcggaagtgggcgatatcattaaggtgcatttcaagaataaggcagataaaccgctgtcaatccatccccaaggtattcgttacagcaagctctctgaaggcgcgagctacctggaccacacttttccagcggaaaagatggatgacgctgttgctccgggccgggaatacacttacgaatggtccatatccgaggatagcgggcctacgcatgacgatcctccttgtcttactcacatatactactcgcacgagaatcttattgaagatttcaactcaggattgataggtcctctccttatttgtaagaagggaactcttactgaaggagggacgcaaaaaacctttgacaaacaaatcgtgctgctgtttgccgtctttgatgaatcgaaatcctggtcacaatcatcgagcctgatgtacacggtgaacgggtacgttaatggcaccatgccagacattaccgtctgtgcccatgatcatatttcctggcatctccttggaatgtcgtcgggacccgagctgttcagcatccatttcaacggtcaagtgctggagcaaaaccatcataaagtgtctgcaattaccttggtcagcgccacttccaccactgcaaatatgaccgtggggccggaaggtaaatggattatctcgtcactgactccaaagcacctgcaggcaggcatgcaggcatacattgacattaagaactgtccaaaaaagactcggaacctgaagaagattacccgcgaacagcgccgacacatgaaaagatgggagtacttcatcgcagcggaagaagtgatatgggactacgctcctgtcattcccgcaaacatggacaagaagtatagaagccagcaccttgataacttcagcaaccaaattggaaagcactacaagaaagtaatgtatacccagtacgaagatgagtcattcacgaaacacactgttaatccaaatatgaaggaagatggtatacttggaccaattatcagggcccaggtcagagacaccctgaaaattgtgtttaagaacatggcaagccgtccttactcgatctaccctcacggagtgactttttccccatacgaggacgaagtcaactcctcattcacctccggcagaaacaacaccatgataagggcagtgcagcctggagagacttacacctacaagtggaatatactcgaatttgatgaacccacggaaaacgatgctcaatgccttactagaccttactacagcgacgtcgacatcatgagagacatcgcttcaggactgattggactcctgcttatctgtaagtcccgcagtttggaccgccgggggattcaacgggccgccgatatcgaacaacaagctgtgttcgcagtgtttgacgaaaacaagagctggtacctggaagataacattaacaagttttgtgaaaaccctgatgaggtcaagagggatgatccgaagttttacgagtcgaacataatgtcgaccatcaatggttacgtccctgagtccatcactaccctgggattttgttttgatgataccgtccagtggcatttctgttcagtgggaactcagaacgagatcctcaccattcattttacgggtcactccttcatctacggcaaaagacatgaagataccctgactctttttcctatgaggggagagtcggtaactgtgaccatggataacgtgggtacctggatgcttacttcaatgaactcatcaccgagatccaaaaagctgagactgaaatttcgtgatgtaaaatgtattcctgatgatgatgaagattcatatgagatttttgaaccccctgaaagcaccgtgatggcaaccagaaaaatgcatgaccgccttgaaccagaggatgaagaaagcgatgcagactacgactaccaaaaccggcttgctgccgcgcttggaattagatccttccgcaattcctcactcaatcaagaagaagaggaattcaacctgaccgcgctcgcacttgagaatggaactgagtttgtctcttccaacaccgacattatcgtcggatcaaactactcaagcccttcaaacatttcgaagttcacggtgaacaacttggcagagccccagaaggcccccagccaccagcaagccactaccgcaggatcaccactccgacatctgattggtaaaaactcggtgcttaactcgagcactgcagaacatagcagcccatactcagaggaccccatcgaagatccacttcaacctgacgtgaccggtatacgcctgctgagcctcggggcaggcgagtttaagtcgcaggaacatgccaagcataaggggcctaaggttgaacgagatcaggcagcgaagcatagattttcctggatgaagctcttggcccacaaggtgggacggcatctgagccaagacaccgggtcgcccagcggaatgcggccgtgggaagatttgcccagccaggatacgggctccccctcaagaatgcgtccatggaaagacccgccctcagatctcctccttcttaagcagagcaactcgtccaaaattctcgttggacggtggcatctcgcctcggaaaagggttcgtatgagatcatccaggatactgatgaagatactgccgtgaataactggctgatctcgccacaaaatgcatcgagagcatggggcgaatcaaccccattggcaaataagccaggaaagcagagcggccacccgaaatttcctagagtgcgccataagtcgctgcaagtgcggcaggacgggggaaagtcgcggttgaagaagtcccagtttctcattaagacccggaagaagaaaaaggaaaagcatacccatcacgcaccactgtcgccacgaaccttccatcctctccgtagcgaggcgtacaatactttttcagaacggcgacttaagcattccctcgtcttgcataagagcaacgaaacgagccttccaacggatttgaaccaaaccctgccttccatggattttggctggatcgcctcccttcctgatcataaccaaaactcatctaacgacaccgggcaagccagctgtcctccgggcctttaccaaaccgtccctccggaagagcactaccaaaccttcccaattcaagatccggatcaaatgcactctactagcgatccctcacataggtcctcttcacccgaactttccgaaatgctggaatacgacagatcccataaatcgtttcccactgatatctcgcaaatgagcccatcctccgaacatgaggtgtggcagaccgtgatttcgccagatctttctcaagtcactctgagtcccgaactgtcacaaactaacctttcccctgacttgtctcacaccaccctcagtcccgaacttatccagcgcaacctttcgccagctctgggtcagatgccaatctcgcctgacctgagccacaccaccctttcgcctgaccttagccatactactctgtcacttgacttgtcgcagactaatctgtctcccgagctgtcccagacgaacctctcccccgcactcggacaaatgccactttcgccggacctgtctcataccaccctgtccctggatttttcgcaaactaacctgtcgccagagctttcccatatgacgctgtcgccagaactctcgcaaactaatcttagcccagcactgggacagatgcccattagtcctgacctgtcgcataccactctgtcattggacttcagccagaccaacttgtcccctgagctctcccagactaaccttagccccgcacttggccaaatgcctttgtcgccagacccttcccataccaccctctcgctcgacctgtcccaaactaatctctcccctgaacttagtcaaacgaatcttagtccagacctgtccgagatgcctctttttgccgatctgtcgcagatacccttgaccccagacctggatcaaatgacgcttagccctgacctgggtgaaaccgacctgtccccaaatttcggtcaaatgtcgctgtcaccagacctctcgcaggtgaccctttcgccagacatatcagatactactctgcttccggatctttcccaaatatcccctccgcctgatctggatcaaatcttttacccgtcggagtcctcgcagtccctcctgctgcaggaattcaacgaaagttttccatatcctgatctcggccaaatgccaagcccttcctcccctacgctcaatgatacctttctgtcgaaagagttcaacccgcttgttattgtcggactctcgaaagatgggactgattacattgagattattccgaaagaggaagtgcagagcagcgaggatgattacgcagaaattgattatgtgccctatgatgacccttacaaaaccgacgtgcgtactaacattaacagctcgcgggatcctgataacattgccgcatggtaccttagaagcaacaatggtaatcgaagaaattactacatcgcagctgaagagatctcgtgggattacagcgaattcgtccaacgtgaaaccgacatcgaggacagcgacgatattccagaggatactacttacaagaaggtcgtttttcgcaagtaccttgattccacctttacgaagcgggatcctagaggggaatatgaggaacaccttggtattctgggacccattatccgcgcagaagtggacgacgtcatccaagtgcggttcaagaatcttgcatcacggccttactcgcttcacgcgcacggtctttcctacgagaagtcctcggagggaaagacttacgaagatgattcacctgaatggtttaaggaagataatgcggtccagcctaactcctcgtatacctacgtgtggcatgcaactgaaagatcgggtccagaatcgccaggctccgcatgccgggcatgggcctactactccgcagtgaaccccgaaaaggatattcactcaggcttgatcggtccgcttctcatctgtcaaaagggaattctgcacaaagattcgaatatgccaatggatatgcgtgagtttgtcctgctgtttatgactttcgacgagaagaaatcatggtactacgagaaaaagagtagatcttcgtggcgactgacttcatctgaaatgaaaaagtcgcacgaatttcatgccattaatggtatgatttactccctgccgggtctgaagatgtatgaacaagaatgggtgaggcttcacctcttgaatatcggcggatcccaagacattcatgtggtgcattttcatgggcaaactctgcttgagaatggcaataagcaacatcaacttggagtgtggcctctgttgccaggatcattcaaaactctggagatgaaggcatcaaaacccggttggtggctcctgaacacggaagtgggagagaatcaacgcgctggtatgcagacgccttttctcattatggatagagattgtcgcatgcctatggggctttctaccggaatcatctccgattcgcagataaaagcaagtgaatttctcgggtactgggaaccacgacttgccagactcaataatggaggttcctacaatgcgtggagcgtcgagaagctggcggcagaattcgcatcgaagccttggattcaagttgatatgcaaaaggaggtgattatcactgggatccaaactcagggtgcaaagcattacctgaagagttgctacaccaccgagttttacgtggcgtactcctcgaatcagattaactggcagattttcaaaggaaacagcacccggaatgtgatgtacttcaacggaaactccgatgcttccactattaaggagaaccagttcgaccctcccattgtggcaaggtacatcaggattagcccaacccgagcatacaacaggcctactctgcgactcgaactgcagggctgcgaggtgaacggctgcagcaccccactgggaatggagaacgggaagattgaaaacaagcagattaccgcatcgtcatttaagaagtcctggtggggtgactactgggagccttttcgagcaagactcaatgcacagggaagagtcaacgcctggcaagcgaaggccaacaacaataagcaatggctggaaatagatctcctgaaaatcaagaaaatcaccgccatcattacccagggatgtaagtcgttgtcgagcgaaatgtacgtgaaatcctacaccattcactactcggaacaaggagtagaatggaaaccctacagactgaaatcctcaatggtcgataagatatttgaagggaatactaatacgaagggtcacgtgaagaatttctttaacccacccattatctccagatttatccgtgtgattcccaagacctggaaccagtcgatcgcattgaggttggaactctttggttgcgacatatat

SEQ ID NO: 9039 - DNA, 6672 bp, Artificial Sequence
  Description of Artificial Sequence: Synthetic coding sequence
atgttccctggctgtccccgcctttgggtgctcgtggtgttgggtacatcttgggtgggctggggctcacaagggaccgaagctgcccagttgcgtcagttctacgtagcggcccagggcatttcctggtcctacagaccagaaccgaccaactcgtcattgaatctatctgtcacctcgtttaagaaaattgtttatcgagagtacgaaccctatttcaaaaaggaaaaaccccagagtaccatttccggcctgctcggcccaacattgtatgccgaagtcggcgatattataaaggtacacttcaaaaataaggctgataagccccttagcatccatccccaaggaatcaggtactcgaaactgtcagagggcgcttcctacctggaccatactttccctgccgaaaaaatggacgacgccgtcgctcctggtagagaatatacttacgagtggtcaatctcggaggatagcgggcccacccatgacgatccaccttgtttgacccacatttattactcacacgaaaacctgatagaggactttaattctggtctgatcgggccacttctcatctgtaagaaggggactctgacagaaggaggcacccagaagacgttcgacaagcaaatcgtgttgctttttgcggtgttcgatgagagtaagagttggtctcagtcctcatcgctcatgtatactgtcaatggctacgtgaacgggacaatgccggatattacagtctgcgcccacgatcatatttcttggcatctactcgggatgtcttcaggcccggaattgtttagcattcattttaatggccaggtcctcgaacaaaatcaccacaaagtttccgccatcaccctggtgtccgcaacatctaccactgcaaacatgacggtgggcccagagggtaaatggattattagcagtctcacaccgaaacatctgcaagctggcatgcaagcctacatcgacatcaagaattgtccaaagaaaaccagaaatctcaagaagattacaagagagcaacgtcgacacatgaaacgatgggagtactttattgcagcagaagaagtgatctgggactatgccccagtgataccagcgaatatggataagaaatacaggtcccagcacttggacaattttagtaatcaaataggtaaacactataaaaaagtgatgtacacacagtacgaggacgaaagcttcacaaagcacaccgttaacccaaacatgaaggaggacggcattctcggacctatcattcgagcacaggtgcgagatacactgaagatagttttcaaaaatatggctagtagaccctattctatttatcctcatggggtgactttctcgccctacgaggatgaggtaaatagctctttcacctccggaaggaataacaccatgatccgagccgtgcagcctggagagacctatacttacaagtggaacatcttggagtttgatgaacccacagaaaatgatgcacagtgtttaactcgaccgtattatagcgatgtcgacataatgcgagatatagcctccggactgattggtcttttactgatctgtaagagtcgatccctcgatcgaagaggcatccagcgcgccgccgacatcgagcaacaggccgtcttcgcagtgttcgatgaaaacaagagctggtacctcgaagacaatattaacaaattttgtgaaaatcctgacgaagttaagcgggacgaccctaaattctatgaatctaatataatgagcactataaatgggtatgtgcctgagagcatcactacactggggttttgcttcgacgatactgtgcaatggcacttctgttccgttggaacccagaatgagatccttaccatccacttcactgggcactccttcatctacgggaagcgacacgaagacacattaaccctcttcccaatgagaggtgaatctgtgactgtaaccatggataacgtaggcacgtggatgctgacttctatgaactcttccccacgatcgaagaaactccgactaaaattccgagatgtcaaatgtattcctgacgacgacgaagactcctatgaaatcttcgagccccctgaaagcacagtgatggccactcgcaaaatgcacgacagactcgagcccgaggacgaggaaagtgacgccgactatgactatcagaatagactagccgccgctctgggcatcaggtcttttcgaaattcatcactgaatcaggaagaggaagagttcaacctcaccgccctcgcgttagagaatggtacggagttcgtctcttctaatactgatatcattgtggggagtaactacagttctcctagcaatatctccaaatttaccgtcaataacctggcagaacctcagaaggcgccatctcatcaacaagccactactgcaggcagccctctaaggcacctcatcggaaagaactccgtgcttaactcgagtacagcagaacactcaagcccttatagtgaagacccaattgaggacccattgcagcccgatgtaacaggtattcgactgctgtctctgggcgcaggcgaatttaaatctcaagagcacgcgaagcacaagggtcccaaggtggagcgggatcaggcagctaagcatagatttagctggatgaaactcctggcccacaaggtcggtaggcacctcagtcaagacacgggtagtccttctgggatgaggccttgggaagacctcccttcccaggacactgggtcacccagccgaatgagaccttggaaagatccacccagcgacctgttgctgctcaaacagagtaacagctctaagatcttggttgggcgatggcacctcgccagcgagaaaggcagctacgaaatcattcaggatactgatgaggatacagccgtgaataattggctcatttctccacagaatgcgtccagagcatggggggagagtacccctttggccaacaaacccgggaaacagtctggccaccccaaattcccgagagtgcgacataaaagcttacaggtgaggcaggatggcggcaagtcacgactgaaaaagtctcagttcctcatcaaaaccaggaaaaaaaaaaaggagaaacatactcaccatgccccactctcccccagaaccttccatcccctgaggagcgaggcttacaacaccttctcagagagacgattgaaacatagcttggtgctccataaatctaacgaaaccagccttcctacagacctgaaccaaacacttccaagtatggacttcggctggatcgctagcttgcctgatcacaaccagaattctagtaacgacaccgggcaggcatcatgccctcctggtctctaccagaccgtcccgccggaggaacattaccagacattcccaattcaagatcccgaccagatgcattccacttcagatccaagccaccgatcatcgtctcccgagttgtcagaaatgctggaatacgatcgttcccacaaatctttccccacggatatatctcagatgtcaccatcatctgagcacgaagtatggcagacagtgatttctcctgatctaagccaggtgacgctttcccctgaactctctcagacaaatctcagtccagatctgtctcatacaaccttgagccctgaactcatccaacgaaatttgtcaccagctcttgggcagatgccaatatccccagacctgtcccacacaacactgagccccgatctatctcatacaacattgtctctggacttgagccagacaaacttgtctcctgagctgtcccaaacaaatttgagcccagccctgggccagatgccactgtcccccgatttaagtcacacaacactctcgctggacttctcccagactaatctttcaccagagctcagccatatgaccctctccccagagctgtctcaaactaacctgtccccggccctaggacagatgcccatcagcccggatctctcacacactactctgtctctcgattttagccagaccaacctgagtcctgagctgtctcagactaacctgagtcctgccctgggccagatgcccttatcacccgatccctcccacaccactctgtcactggacctctctcagacaaacctttcccctgaactgagtcagactaacttaagtccagatctttctgaaatgcccctgtttgcggacctgtcccagataccgctcactcccgatctggaccagatgaccctgtctccagacctgggggaaaccgatctgagccccaacttcgggcagatgagtttatccccagatttgagtcaggtgacgctgagcccagacatctctgacaccaccttgctcccagacctctctcagatcagcccaccccccgacctagatcaaatcttttacccaagtgagtcttcccagtcactgttgctccaggagttcaatgagagcttcccatatccagacctcggccagatgccatcaccgtcctctcccacactaaacgacactttcttaagtaaagaattcaaccctctggtgattgtgggtttgagtaaagatggcacagactacatcgagattatcccgaaagaagaagtgcaaagctccgaggatgattacgcagagatcgactatgtcccctatgatgacccgtataaaactgatgtgaggaccaacattaactccagcagggatcccgataacattgcagcttggtacctgaggagcaacaatgggaaccgaagaaactattatatcgcagccgaagagatcagctgggactattcagaatttgttcagagggagactgacatcgaagatagtgatgatatccccgaggacactacctataagaaggtggtgtttagaaagtacttggattctacgtttactaagagagatccacgaggtgaatatgaggaacacctgggcatcctgggccccataatacgtgcggaggtagacgacgtgatccaagtgcgatttaagaacttggccagcagaccctattccctacatgcacatggcctctcttatgagaaatcttccgaagggaaaacctatgaggatgatagccctgagtggttcaaggaggataatgctgtacagcctaatagtagttacacctatgtctggcacgccactgaaaggtccggccccgagagccccggcagtgcatgcagagcctgggcctactattcagcagtgaatcccgaaaaggatattcattcgggtctgattgggcctctactgatatgtcagaaggggatactccacaaagattccaatatgcccatggacatgagagagtttgtgctgctctttatgaccttcgatgaaaagaagagctggtattacgagaaaaaaagtcgatcttcctggaggttgacgtcgtccgagatgaaaaagtctcacgagtttcacgccataaatggcatgatctactccttgccgggtctgaaaatgtatgaacaggaatgggtaaggctacacctgctgaatatcggaggcagtcaggatatccacgttgtgcacttccacggacagactctgctggaaaacggaaacaagcagcaccagcttggcgtgtggccccttttgccagggtcttttaaaaccttagaaatgaaggcatcaaagcctggatggtggctcctcaacacagaggttggcgagaaccagcgagcaggcatgcaaaccccttttctcataatggaccgagactgccgaatgccaatgggattgtcaaccggcatcatcagcgactcccaaatcaaagcctcagagttccttgggtattgggaaccaagacttgccaggttgaataacggcggttcttacaacgcatggtcagtggagaagctcgctgcagagttcgcaagcaaaccctggatccaggtggatatgcagaaggaagttattatcaccggaattcagacccagggtgcgaagcactacttaaagtcttgctataccactgaattttatgtggcctacagctctaaccagatcaactggcaaatcttcaagggaaatagcaccaggaatgtgatgtactttaatggtaactctgacgcctctaccattaaggaaaaccagtttgacccaccaatcgtcgcccgctacatcaggatctcccccacaagggcctataaccgaccgaccctcagactcgagttacaaggttgtgaagtgaatggatgctcaacccccctcggtatggaaaacggtaaaattgaaaataagcagatcactgcctcctcatttaagaagtcgtggtggggggactattgggagcctttcagggctaggttgaatgcgcaaggccgagtgaacgcctggcaagctaaggctaataacaacaagcaatggttagagatcgatctcctgaagattaaaaagattaccgcaataattactcagggttgtaaaagcctcagttccgagatgtacgtcaagtcctacactatccattactcagaacagggagtcgagtggaagccatacaggctgaagagctcaatggtggacaaaatcttcgaggggaacaccaacaccaagggccacgtaaaaaacttcttcaaccctccaatcatctctagatttattcgagtgatccctaagacttggaaccagtctatcgctttgagactggagctgtttggatgtgatatctac

SEQ ID NO: 9040 - DNA, 6672 bp, Artificial Sequence
  Description of Artificial Sequence: Synthetic coding sequence
atgttcccaggctgtcctcggctttgggtgttagtggtgctgggaacatcctgggtaggctggggatcccagggaaccgaggcagctcagctgaggcagttctacgtggccgcccagggcatatcttggtcttatcgtccagaaccaaccaacagttcactgaatctgtctgtcacctcctttaagaaaatagtatacagggagtacgaaccttactttaagaaagaaaagcctcagtctaccataagtgggttattagggcctacactgtacgctgaggtaggcgatatcatcaaagtgcacttcaagaacaaggctgataagcccctgagcatccatccacagggcattagatacagcaagttgtccgaaggagcatcctacctggatcataccttcccagccgagaagatggacgacgccgtcgctcctggccgggagtatacttatgagtggtccatcagcgaggatagcggccctactcacgacgaccccccttgcctcacccacatatactatagtcatgagaacctaatcgaggatttcaacagtgggctaataggcccccttctgatctgcaagaaggggacattaacagagggcggaacacagaaaacctttgacaagcaaattgtgctgctgttcgcagtttttgatgagtccaagtcttggtctcagagctcctcacttatgtacacagttaacggctacgtcaatggcacaatgcctgacattaccgtgtgtgctcacgatcatatcagttggcacctgctcggtatgtcatccgggcccgaactgtttagtatccattttaatggccaggtgctagaacaaaatcaccacaaggtgtcagctatcactcttgtgtcagctacatctacaactgctaatatgaccgtgggccccgagggcaagtggataatctcttccctaacccctaagcacctccaggccgggatgcaggcttacatagacattaagaactgtcctaaaaagactcggaatctgaaaaagatcaccagggaacagaggcgccacatgaagcggtgggagtattttatcgccgctgaggaggtgatatgggattatgctcccgttattccagcaaacatggacaagaaatacagatcacaacacctggataactttagtaaccagatcggcaaacattacaagaaggtgatgtacacccagtatgaagacgaatccttcacaaagcatactgttaaccccaacatgaaagaagacggtatcctcgggccaattattcgcgcccaagtcagggataccttaaagatagttttcaagaatatggcctctagaccttacagtatctacccacatggcgtgaccttcagcccatatgaggatgaagtgaattcttctttcactagcggccggaataatactatgattcgggccgtgcagcccggggagacctatacatataagtggaacatactcgagttcgacgagcccactgagaacgacgcacagtgtctgactcgcccttactattccgacgtcgatataatgagggatatagcctccggcctgattgggttgctgctcatctgtaaaagccgcagcttagaccgtagaggcatacaacgtgccgcagacatagaacagcaggccgtgttcgccgtgtttgacgaaaataaaagctggtatctggaagacaacatcaacaaattttgtgaaaatcctgacgaggtcaagcgcgacgatcctaaattttatgagtccaatatcatgagtaccattaatgggtacgttcctgagtccataaccactctgggcttctgtttcgacgatactgtgcaatggcacttctgcagcgtgggaacccagaatgagatcctgactatacactttactggacactcttttatttatggaaagcggcacgaagacacattgacactctttcctatgcggggtgaaagtgtgaccgtcaccatggataacgttggcacctggatgctcacatctatgaatagctccccacgtagcaaaaagctgcgcttaaaattccgggacgtgaagtgtattcccgacgatgatgaggacagttacgaaatcttcgaaccacctgaatctaccgtgatggccacccgcaaaatgcacgacaggttagagcctgaggatgaggaatccgatgccgattatgattaccaaaataggctggccgctgccttaggaattagatccttcagaaacagttctctcaatcaggaggaagaagagttcaacctaaccgctctagcactggagaacggaacagagtttgtcagcagcaacaccgatattatagttggttccaactactctagtcccagcaacatctctaagtttacagtgaataacttagcagagcctcagaaggctccctcacaccaacaggccactaccgcaggcagcccactgaggcacttaatcgggaaaaactccgttcttaactccagtaccgctgaacattctagtccttattcagaagaccctattgaagaccccctccaacctgacgtgacaggcataaggctcctgtcactgggtgccggcgaattcaagtcccaggaacacgcaaagcacaagggtcccaaggtcgaaagggaccaggccgccaaacaccggttctcctggatgaaactcctcgcccacaaagtcggccgccacctaagccaagataccggttctccaagtggaatgaggccatgggaagacctgccatctcaggatacaggctctccctcccggatgcgaccttggaaagaccctcctagcgacctcctgctactgaaacaatctaattcttccaagatccttgtggggcgctggcatctggctagcgaaaaaggctcatacgagatcatccaggataccgacgaagacactgccgtgaacaactggttaataagccctcaaaatgcctcccgcgcatggggtgaatctacccctttagccaacaaaccaggcaagcaaagtggccatcccaagttccccagggttaggcacaagtccctgcaggtcagacaggacggaggcaagagtcgactcaagaagagtcagttcctgattaagactcggaagaagaaaaaagagaaacatacccatcacgccccactatcaccacggaccttccatcctctgcgatccgaggcctacaataccttttccgagagaagattaaagcacagtctggtactacataagagcaatgaaacttccttaccaaccgatctcaatcagaccttaccctccatggacttcggctggatagcttccctgccagaccacaaccagaacagtagcaatgatacaggccaagcttcctgtccaccaggcctgtatcagactgtccccccagaagagcactatcagaccttccccattcaggatcctgatcaaatgcatagtacatctgatccttcccaccgctctagctcccccgaactgtcagagatgctagagtacgatagatcccacaagtcctttccaacagatataagccagatgtcaccaagttctgagcacgaggtgtggcaaaccgtgatcagtcctgatctaagtcaggtcaccctctctcctgaactgtcacaaactaatttgagtcctgacctgagccataccacattatctcctgagctgattcaacgcaacctctctcccgcccttggacagatgcccatcagcccagacttgtcccatactacactgagtccagatctgagccacaccactctgtcactagacctgtcccaaactaatctgtccccagaattgagccagaccaacctcagtccagccttgggtcaaatgccactctcccccgatctgagtcacaccacactttcccttgattttagccaaacaaacttatcccctgagctgtcccacatgaccctgagcccagaactctcccagaccaatctgtctcctgccctggggcaaatgcctatctctcctgacttgtctcacactacactgagcctcgacttttcccagaccaatctgagccctgaactcagccaaaccaatctgagtccagccctgggccagatgcctctgagtcccgatccctctcataccaccctgagtttagacttgtcccaaacaaacctgagtcctgagctgtctcagaccaacttaagccccgatcttagcgaaatgcccctgttcgctgacctgtctcagatcccactaacccccgatctggaccagatgactttaagtcctgatcttggcgagacagatcttagccccaattttggccagatgtcactgtcccctgatctaagtcaggtgaccctgtctcccgacattagcgatacaaccctcctgcccgacctgtctcagatatccccaccacccgatttggaccagattttctatcctagtgaaagctcccagagcttactcctgcaggagtttaatgagtctttcccatatccagacctgggacaaatgcccagcccaagtagccctactctgaatgatacattcctgtctaaagaatttaaccccttagttattgttggcctgtcaaaggatggcacagactatatcgagattatcccaaaggaggaagttcagtcaagtgaggacgactatgctgagatcgattacgtgccctacgacgacccatataagactgacgtccggaccaacatcaattcttccagggaccctgacaatatcgctgcctggtacctgcgatccaataacggcaacaggcgcaattactacatcgccgccgaagaaatttcctgggactactccgaatttgttcaacgcgagaccgatatcgaggatagcgatgacattcccgaagatacaacctataaaaaggtcgtgtttcggaagtatctggactccaccttcacaaagcgtgacccacggggggagtatgaagagcacctaggcatactggggccaatcattcgggcagaggtggacgacgttatccaggtcaggttcaagaatcttgcttctcggccctacagcctgcacgcccatggcctgagctacgagaaaagttctgagggcaaaacatacgaagacgattccccagaatggtttaaagaagataacgccgtgcagcccaactcaagttacacctatgtgtggcatgctaccgaacgaagtggccctgaaagtccaggcagtgcatgccgggcttgggcctactacagtgccgttaacccagaaaaagatattcattccggactgattggtcctctgctgatttgtcagaagggcatcctgcataaagatagcaatatgccaatggatatgagagagttcgtgctactgttcatgacctttgacgagaaaaagtcctggtactacgagaaaaagagccggtcctcatggcgactgacatcctctgagatgaaaaagtcccacgagttccatgcaataaacggcatgatatactcattgcctggcctgaaaatgtacgagcaagagtgggtgcgtctgcatctcctgaatatagggggctctcaggatattcatgtggttcacttccacggtcagactttgctcgagaatggaaataagcagcaccaactaggggtttggccactcctccctggaagctttaagaccctcgagatgaaagcctctaagcctgggtggtggctactgaatacagaggtgggtgaaaaccaacgcgccggcatgcaaaccccttttttaataatggaccgggattgcagaatgcctatggggctatctaccggaatcatcagtgacagtcaaattaaagctagtgagttcctaggatactgggaacctcgtctggccaggctaaacaatggcgggagttacaatgcttggtccgtggagaaactcgccgccgaatttgcatctaagccttggatacaagtggatatgcagaaggaagttatcataaccggcatacagacccagggcgctaaacactatctaaagagttgctacaccacagagttttatgtggcttactcttctaaccagattaattggcaaatctttaaagggaattctaccagaaatgtgatgtattttaacggcaactcagatgcatccaccataaaagagaaccagttcgacccacctatcgttgccaggtatatacgcattagtcccaccagagcctataacagaccaactctgcgcttggagctgcaaggctgtgaggtgaacggctgctctactccactgggcatggagaatggcaagatagaaaacaaacagatcactgcttcttctttcaagaaatcatggtggggggactattgggaacctttccgggctcgcttaaatgctcaaggccgcgtgaatgcttggcaggctaaggccaataataataaacagtggctagaaattgatctgctgaaaataaagaagattaccgccattattacccagggctgcaaatccctatcaagtgagatgtatgtcaagagttacaccatacactatagcgagcaaggtgtagagtggaaaccctaccggctgaagagcagtatggtggacaagatattcgagggaaataccaatactaaaggacacgtcaagaacttcttcaatccaccaattatatctcgctttatacgggttatccccaaaacttggaatcaaagtatcgcactgagactggagctgtttggatgcgacatttat

SEQ ID NO: 9041 - DNA, 6672 bp, Artificial Sequence
  Description of Artificial Sequence: Synthetic coding sequence
atgttcccaggctgtccgcgactttgggtgcttgtcgtgttgggtacctcttgggtaggctgggggagtcaaggcaccgaggcggctcaactccgccagttttacgttgctgcgcaaggaatatcgtggtcctacagacccgaaccgactaactcttcactgaatttaagcgtgactagcttcaagaagatcgtgtacagggaatacgagccttacttcaaaaaagaaaagcctcagtcaacgatttccggcctgttgggcccaactctttatgccgaggtcggagacatcatcaaggtgcatttcaagaacaaagctgacaaaccgttgtcaatccacccccaagggatccgctatagcaaattgagcgaaggggcaagctatctggatcacaccttcccagccgagaaaatggacgatgctgttgctcctgggagagagtacacctacgagtggtccatctcagaggacagcggccctacccacgatgatccaccatgccttacccacatatactatagtcatgaaaacttgatcgaagactttaactccggactgattggtcctctgctgatttgcaagaagggcacccttaccgagggcggaacccagaagaccttcgataaacaaattgtcttgctgtttgcagtttttgatgagtccaagagttggagtcaaagcagttctcttatgtacactgtcaatggctacgtcaacggcactatgcccgacatcactgtctgcgcccatgatcacatcagttggcatctgctcggaatgagttcaggacccgaactgttcagtatccacttcaatgggcaggtgctggagcagaaccatcataaagtttctgctattacactcgtgagcgccaccagcacgaccgcgaacatgacagtgggccctgagggaaaatggatcataagcagcctgacacctaaacaccttcaagccggaatgcaggcatacatcgatatcaagaactgccctaagaaaacacgcaatctcaagaaaatcaccagggagcaacgccgtcacatgaagcgctgggagtactttatcgctgctgaagaggtgatatgggattacgcgcctgtcatcccagccaacatggacaaaaagtatcgtagccagcacctggacaacttctctaaccagatcgggaaacactataagaaagttatgtacacgcagtatgaggacgaatctttcactaaacacaccgtgaatcctaacatgaaagaagatggcattctgggaccgattatcagagctcaggtcagggatactttgaagatagtcttcaaaaacatggcatccaggccctatagcatctacccccacggagtgacattcagcccctatgaagacgaggtaaactcatcctttaccagcggcaggaataacaccatgattcgggctgtacaacctggcgaaacctacacatataagtggaatattctggaattcgacgaacctacagagaacgatgcacagtgtctgaccagaccctattactctgacgtcgatatcatgagggatatcgctagcggtctgattgggctgcttctgatctgcaagagccgttcgctggataggagaggcatccagagggcagccgatatcgagcaacaggccgtatttgctgtctttgacgagaacaaatcctggtatcttgaagataatatcaacaaattctgcgagaaccccgatgaggtcaaaagggacgatcccaaattttacgagtctaacatcatgtccacaattaatggatatgtgcctgagagcatcactacgttaggcttctgctttgacgacacagtgcaatggcacttctgttcggtcggaacacagaacgagatcttgaccattcattttaccggacacagctttatatatggcaagcgtcatgaagacacgctcacactgtttccaatgcgaggagagtcagtgactgtcacaatggataacgtcggcacctggatgttgacctccatgaacagctcaccacgcagcaagaagctgaggctgaagtttagagacgttaagtgtatcccggatgatgatgaagactcatatgaaatctttgagccacctgagtccaccgtcatggcaacgaggaaaatgcatgacaggctcgagcccgaagatgaagagtctgacgcagattatgattaccaaaaccgccttgccgccgccctgggaatcagaagctttagaaactcatctcttaaccaggaggaggaagagttcaacttgacagccctggctttggaaaacggcaccgagtttgtgtctagtaacaccgatataatcgtgggaagcaactacagctctccctccaacatttctaagttcacagtgaacaatctggccgaaccgcagaaagcaccatcgcaccaacaagcaactacagccggcagcccgctcaggcaccttatcggaaagaacagtgtactgaatagtagcacagctgagcactctagcccctattccgaggatccaatcgaggacccattacagcccgatgttactggcatccgacttctgagcctgggcgctggggagttcaagagccaggagcacgcaaagcataagggtcccaaagtcgaacgggatcaggccgcaaagcatagattcagctggatgaagctccttgcacataaagtgggcaggcacctttcacaggacacagggagccctagtggtatgaggccatgggaagaccttcccagccaagacactggaagccctagcaggatgcgtccttggaaggacccaccctcggatttgttgcttctcaagcagagcaatagttcaaaaattctggtgggccgctggcacctggccagcgagaagggatcatatgagatcatacaggataccgatgaagatacagctgtgaacaactggctcatctctccacagaacgcgtccagggcctggggagaatcaaccccccttgcaaacaaacctggcaaacagtcaggacatcccaagttccctagagtgagacacaagagcctgcaagttagacaagacggcgggaaaagccgcttgaaaaagtctcaatttcttattaaaacgaggaaaaaaaaaaaagaaaaacatacgcaccacgcaccactgagcccgagaactttccacccgctccgtagtgaggcttataacacattctctgagcgccgactgaaacatagtttggtgcttcataagagcaacgagaccagtctgccgaccgacttgaaccagactctgccaagcatggattttggatggattgccagcctcccagatcacaaccaaaattctagcaacgatactggacaggcaagttgtcccccaggactgtaccagaccgtgcccccggaggaacattaccaaacattccccatacaagatcctgatcagatgcattccacatctgatcccagccataggagttcatcccctgaactgtcggagatgttagagtatgataggagccacaaaagctttccaacagacatctcccagatgtctcctagttctgagcacgaggtctggcagactgtcatcagtcctgatctctctcaagtgacactaagccccgaattgagtcagaccaacttgtcaccagatttgtctcacacaacgttgagtcctgagctgattcagcgcaatttgagcccggctctcggacagatgcccatctctcccgacctgtctcatacaaccttgtctccggatctgtctcacaccactctcagtttggacttaagccaaactaatctgagtcctgagctcagccaaactaacctgagccctgcccttggtcaaatgcccctttccccagacctgtcacacacgactctgagcctcgacttctcacagactaaccttagcccagaactgtcccacatgactctcagtccggaactgtctcagaccaacctgtctcctgcattagggcaaatgccaatttctcccgatctgagccacacgacactgagcctcgatttcagccaaaccaatctgtctcccgaactgagccaaaccaacttgagtcccgccctgggacagatgcctctgtcacccgacccctcacataccaccttgagcctcgatctgtctcaaactaacctcagtccagagttaagtcaaactaatctctctccagatctgtctgaaatgccgctgtttgctgatcttagccagatcccactgacgcccgatcttgatcagatgaccttatcgcctgacctgggagaaaccgacctttctcctaattttgggcaaatgagcctctcgcccgatctgagccaagtgaccctgagcccagatattagtgacaccaccctgttgccagacctgagtcaaatcagcccccctcctgacctggaccaaatcttctacccatcggagagctcccagtctctgctgctgcaggagttcaatgaatcatttccatacccggatttgggccaaatgccttcaccttccagtccaaccctgaacgacacatttcttagcaaggaatttaaccctctcgtgatcgtcggcttgtcgaaggatgggacagactacatcgagatcatcccgaaagaggaagtgcagtcttctgaggatgattatgcagagatcgactacgttccctacgatgatccctacaaaaccgatgtgcggaccaacattaactcgtccagggaccctgataacatcgcggcctggtacctcagaagcaataatggcaatcgccgcaactattacattgcggctgaggaaatttcttgggactacagcgagtttgtccagagagagaccgatatcgaagattccgatgatatccccgaggatactacatacaaaaaggttgtgtttaggaaatatctggattcaacctttacaaagcgggaccccagaggcgaatacgaggagcacctgggaatccttgggccgattatacgggctgaggtagatgacgttatccaagtcaggttcaaaaacttggcaagcaggccctattctctccacgcacacggactttcttacgagaaatccagcgaggggaagacttacgaagatgatagccctgagtggttcaaagaagacaacgccgtccaaccaaactcgagctacacatacgtgtggcatgctacagaaaggtcaggccctgagagcccgggaagtgcttgtagggcatgggcttactatagcgctgtcaatccagaaaaggatatacacagtgggcttattgggccgttgttaatttgccagaagggcatccttcacaaagatagcaatatgcccatggatatgagagaatttgtgctgctgttcatgacatttgatgagaaaaagagctggtattacgagaagaagagccgcagttcatggaggttgacctcaagcgaaatgaagaagagtcatgaattccacgcgatcaacggcatgatctattccttgcccggcctgaaaatgtatgagcaagagtgggtgcgcctgcacctgctgaacattggtggcagccaagatatccatgttgtccatttccatggtcagacgctacttgagaatggtaacaaacaacatcaactcggggtatggcccctgctgcccggcagctttaaaacgctggaaatgaaagcaagtaagcctgggtggtggctgttaaacactgaagttggcgagaaccagcgggccggcatgcagacgcccttcctgatcatggatcgcgactgtaggatgccaatgggactctccacagggatcattagtgattcccagattaaggcctcagagtttctgggctactgggagcctcgactggcccgtcttaacaacgggggaagttacaacgcctggagcgtggagaagttagccgcagaattcgcaagtaagccctggatacaggttgacatgcaaaaagaagtgatcatcacaggcatccaaacacagggtgccaagcattatctcaagtcatgttacaccactgagttctatgtggcttatagtagcaatcagattaattggcagattttcaaaggcaactccaccaggaacgtgatgtactttaatgggaattccgatgcctcaaccattaaagaaaatcagtttgaccctccaatcgtcgcgcggtacatcagaatcagtccaaccagggcctacaaccggcccaccctccgccttgaactgcagggatgtgaagtgaacggttgttccactccactgggaatggagaacggcaagattgaaaataaacagataacagcaagttctttcaaaaagagctggtggggcgattactgggaaccttttagagctcggctgaacgcccagggaagggtgaacgcgtggcaggccaaggctaataataacaagcagtggcttgagattgatctgctgaagatcaagaaaattaccgcaatcattacccagggctgtaagagtctctcatcagagatgtacgttaagagctacactatacactacagcgagcagggcgtagaatggaaaccatacagactcaaatctagtatggtggacaaaatctttgaaggcaacaccaatactaagggccatgtgaaaaatttctttaaccctcctatcatctctcgctttatccgggtgatacctaagacatggaaccaatctatagctttgagactggagctgttcggatgcgacatctat

SEQ ID NO: 9042 - DNA, 6672 bp, Artificial Sequence
  Description of Artificial Sequence: Synthetic coding sequence
atgtttcccgggtgccctagactgtgggtgctggtggtgcttggcacgtcttgggtgggctggggatctcaaggcactgaagccgctcaactccgccagttctatgtggccgcccagggaatcagctggagttataggccagaacctactaactcctctctcaacttgagcgtaacctccttcaaaaaaattgtgtaccgcgagtacgagccctatttcaagaaagaaaagcctcagtccaccatcagtggacttctcggccctaccctgtatgctgaagtcggcgacattatcaaggtgcacttcaagaataaagcagataagcctctcagcattcatccacaaggcataaggtactccaaactcagcgagggggcaagttatcttgaccatacgttccctgctgaaaagatggatgacgcagtcgcgccagggcgcgagtacacctacgagtggtccatttcagaggacagcggaccaacccatgacgaccctccatgtctcacacatatatactattcccacgagaacctgattgaggacttcaactccggcctgattggacccctgctcatttgtaagaaaggcactctgacggaggggggcacccagaagacctttgacaaacagatcgtcttgctgttcgccgtgtttgatgagtcaaagtcatggagccagtccagttccttgatgtatacggtgaacggatatgtgaacggaacgatgcctgacatcacagtgtgtgcacacgaccatatatcatggcaccttctggggatgagcagcggtcccgaactcttttctattcacttcaacggccaggtgttggagcaaaaccaccacaaggtgtctgcgattaccctcgtgtccgccacatccactacagctaatatgactgtcgggccagaaggtaaatggatcattagttcacttactcccaagcatctgcaggcaggcatgcaggcatacatcgacatcaaaaattgtccaaaaaaaacgaggaacctcaagaagatcactcgagaacagagaagacacatgaaacgatgggagtatttcatcgcagcagaagaggtgatttgggactacgcaccagtaatacccgccaatatggacaaaaagtaccgaagtcaacacctcgataatttctcaaatcagatcggcaaacactataagaaggtgatgtatacacagtatgaagatgagagttttacaaaacataccgtgaaccccaatatgaaggaagacggtatcttgggtcccattattagggctcaagtgagagacactctgaaaattgtgttcaagaacatggcttccaggccttactctatctatcctcatggggttactttctcaccatacgaggacgaggtgaattcatcttttacgtccggtagaaacaatactatgatccgagccgtgcagcccggtgaaacatacacatataaatggaatatcctggaattcgatgagcccactgaaaacgacgcccagtgcctgacaaggccatattatagcgacgttgatattatgcgcgatattgcgtccgggctgatcgggctcctgctgatttgcaagagcaggagtctcgacagaagaggaatccagagagcggcagacattgagcagcaggcagtcttcgcagtatttgacgagaacaagagctggtatttggaggacaacatcaacaaattttgcgagaaccctgacgaggtaaaacgcgacgatcccaagttctacgagtctaatatcatgagcaccatcaacggctacgtaccagagagcattactaccctgggattctgtttcgatgacactgtgcagtggcacttttgcagtgtgggaactcagaacgaaatcctgaccatacattttaccggccattcttttatctacggcaaacgacatgaggataccctgaccttgttccccatgcgcggagagtctgtcactgtcacaatggacaatgtaggtacctggatgctgaccagcatgaatagtagtcctaggagtaagaaattgcgcctgaagttcagggacgtaaagtgtattcccgacgatgacgaagatagttatgagatctttgaacccccagaaagtacagtgatggcaacacgcaagatgcatgacagactggagcctgaggatgaggaaagcgatgctgattacgattatcaaaaccgcctcgccgctgcactgggtatcagaagtttccggaacagcagcctgaaccaggaggaggaagaatttaacctgaccgcgcttgccctggaaaacggtaccgagttcgtgtcaagcaacacagacatcatagtgggctccaactacagctccccttctaacattagtaagtttacggtgaacaacctggctgagccgcagaaggccccttcccatcagcaggcgacgaccgccgggagtcctctccggcaccttattggaaagaactccgttcttaattctagtactgcggagcattcaagcccttattcagaagacccaatcgaagacccactccaaccggacgtgactggcatcaggctgctcagtttgggcgctggtgaattcaaatcccaggagcatgccaagcacaaggggcccaaggttgagcgggaccaagccgctaaacataggttctcttggatgaaattgctggcacataaagtgggaaggcatctgtcacaggacacaggatcccctagtggcatgaggccctgggaagatcttccgagtcaagacactggctcccccagcaggatgcgaccctggaaggaccctccaagtgatctgctcctgctgaagcagagtaactcttcaaagatcctggtcggccgatggcatctggcgagcgaaaagggttcttacgagatcatacaagacacagatgaagatacggctgtgaataactggctgatttccccacaaaatgcttccagggcatggggagagtccacaccactcgcaaacaaacctggaaagcagtccgggcaccctaaatttccacgggtgcggcacaagagcctgcaggtgaggcaggacggcggaaagtctcggctgaaaaagtcacagtttctgatcaagacaaggaagaagaagaaagaaaagcatacccaccacgctccgctgagccctaggacgttccatccactgcgatcagaggcatataataccttttcagaaagacgactgaagcactccttggtgctccataagtcaaatgagaccagcctgccgaccgacctcaaccagaccctccctagcatggacttcggctggatagcctctcttcctgatcacaatcagaattccagcaacgacacggggcaggccagttgccctcccggactgtatcaaaccgtgcccccagaggagcactatcagacattccccatccaggaccctgaccagatgcattctacaagtgatccctcccacaggtcctcttctcctgagctttccgagatgctcgagtacgaccgcagtcacaaaagctttccgacggacatatcacaaatgtcccccagcagcgagcacgaggtgtggcagacggtgatcagccccgacctctctcaagtgactctgagccccgaattgagtcaaaccaacctctcccccgacctcagccacactacgctgtcacccgaactgattcagcgaaacctctctccggcgctcggccagatgcccatctctccagatctgagccacaccacgctgtcacctgatctgtctcacacaacactcagtctggatttgagccagacgaatctgtcacccgagctgtctcaaacaaatctttctcccgccctggggcagatgcctctgtcacctgacctgtcccacaccaccctgtctctggactttagccagaccaacctgagccctgaactttctcatatgaccctgagccccgagctgagtcagactaatctcagcccggctctggggcagatgcctattagccccgacctgagtcacactactctgtcacttgatttctctcagaccaatctgagccccgaactgagccagaccaacctgagcccggctctgggtcaaatgcccctgtcacctgatccaagccacacaactctgtccctggatctgtctcagacaaatctgtccccggagctgtcccaaacaaacctctcaccagatctgtctgaaatgcccctcttcgcagacctgtcacagatccccttgactccagatctggatcagatgacactctcccctgaccttggtgagaccgacctctcaccgaactttggtcagatgtccctctctcctgatctctcccaggttaccctgtccccggatatttccgacactactcttctccccgacttgagtcaaatatcccctccaccagatttggaccagatcttctatccgtctgagtccagtcagtccttgctccttcaggagttcaacgagtcctttccgtaccctgatctgggacagatgccttccccctctagcccgacactcaacgacacttttctctcaaaggaatttaatcccttggttattgtggggctgtccaaggacgggacagactacattgaaatcatccccaaagaggaggtgcaatcttccgaagacgactacgccgaaattgactatgtcccctacgacgatccatacaagactgacgtgaggaccaacatcaattcttccagggaccctgataacatcgccgcctggtatctgcgcagtaacaacggcaatcggcgaaactactatatagccgccgaggagatatcctgggactacagtgagttcgtacagagagaaacagatatagaggatagtgacgatattccagaagacacgacgtacaaaaaggtggtctttaggaagtacctcgattccacattcactaagagagaccccagaggggagtacgaagagcacctgggtatactgggtccaattattagggccgaggtcgacgacgttatccaggttcgctttaaaaacttggcaagtagaccttacagtcttcatgcgcacggactcagttacgagaagagctctgaggggaagacgtatgaggacgactcacccgaatggtttaaggaagataatgcggtccagccaaattcttcttatacatatgtttggcacgccacagaacgctctggccctgaatcccccggcagtgcgtgtagagcatgggcttactattcagccgtcaaccctgagaaagatattcacagcgggctgatcgggccgttgctgatttgccagaaagggatattgcataaagacagtaacatgcctatggatatgagagaattcgtacttctgttcatgaccttcgacgagaaaaagagctggtactacgagaagaagagccgcagctcctggcggctgacctccagcgaaatgaaaaaaagtcatgaatttcacgccataaatggcatgatctatagtcttcccggcctgaagatgtacgagcaggagtgggtgcgcctgcacctgctgaacatcggaggatcccaggatatccacgtcgtgcacttccatggccaaacactcctggagaatggaaacaaacaacaccagctgggggtttggccactgctgcccggttcctttaaaacattggagatgaaggccagcaagcccgggtggtggctcctgaacaccgaagtcggtgaaaatcagcgagccggaatgcaaacccccttcttgatcatggacagggactgtcgcatgcctatgggtctgagtaccggtatcatatcagatagtcaaatcaaagccagcgagttcttgggatactgggagcctagactggctaggctgaacaatggcggctcctacaatgcctggtccgtggagaagctggctgcagagtttgcgagcaaaccatggattcaagttgatatgcagaaggaagtgatcattaccggaatccagacccagggcgccaaacattaccttaaaagctgctataccacagagttctacgttgcgtatagctcaaaccagattaattggcagatcttcaaaggtaatagtactcgcaacgtaatgtactttaacggcaactccgatgccagcaccatcaaagagaatcagtttgatcccccaatcgtggctcggtatatcaggattagtcccacaagggcctataacagacctactctgcgccttgagctgcaagggtgcgaagtgaatggttgctctacccccctggggatggaaaacggaaagatcgagaataagcaaataaccgctagctcatttaagaagagctggtggggcgactactgggagccgttcagagcccggttgaatgcgcagggccgggttaatgcttggcaagcgaaggcgaacaataataaacaatggcttgaaatcgatcttctcaaaatcaagaagataacagcgatcattacccaaggatgtaaatctctgtccagcgaaatgtacgttaaaagctacacaatccactattccgaacagggtgtcgaatggaaaccttatcgactcaaaagttctatggtcgacaaaatctttgaaggcaacaccaacacaaagggtcatgtgaagaattttttcaacccgcctattatcagccgcttcattcgcgtcatccctaaaacttggaaccagtctatcgcgctgaggctcgagctgttcggttgcgacatctac

SEQ ID NO: 9043 - DNA, 6672 bp, Artificial Sequence
  Description of Artificial Sequence: Synthetic coding sequence
atgttccccggatgcccacgcctgtgggtattggtagttctgggcacctcctgggtgggatggggttcccaaggaaccgaagccgcacagctccggcaattttacgtggctgcccagggaatttcctggtcataccgacccgagccgaccaactcatccttgaatttgtctgtgacttctttcaaaaaaattgtgtatagggagtatgaaccttactttaaaaaggagaagccccagagtacaatttccgggctcctgggaccaactctgtatgccgaggtgggagatatcattaaagtacatttcaaaaacaaggccgataaacctttgtccatccatccccaaggcatacgatacagtaagctttccgaaggggcctcatacctagatcatacctttcctgcggagaaaatggacgacgccgttgccccaggtcgagagtatacctacgagtggtccatttccgaggattcaggccctacacatgatgatcctccttgcctcacccatatctactactcccacgaaaatctcattgaggacttcaatagcggcctcatcggacctcttttgatttgtaagaaaggcactttgacggaggggggaactcagaagacttttgataagcagatcgtgctcctgttcgcagtcttcgacgaatctaaatcttggtcccagtcttcatcactcatgtataccgtgaatggatatgtcaacggtactatgcccgacattactgtgtgcgcgcatgaccacatctcatggcacttactaggcatgagctccggccctgagctattcagtatccactttaacggacaggtgctggaacagaaccaccataaggtctctgcaatcaccctggtgtccgcaactagcaccacagctaatatgacagtgggtcccgaaggaaaatggattattagcagtctgaccccgaaacatttgcaagcgggcatgcaggcctatatcgacatcaaaaactgtccaaaaaagactcggaatctcaagaagatcacgcgtgaacaaagaagacatatgaagaggtgggaatacttcatcgccgcggaggaagtgatatgggattatgcacctgtgatcccggccaacatggataagaagtacagaagtcagcatctggataatttttctaaccagataggtaaacattataagaaagtaatgtatacacaatacgaagacgaatcattcacaaagcacaccgtaaacccgaacatgaaagaggacggtatcctcggtcctatcatacgggcccaagtgagagatacattgaagatagtgttcaaaaacatggcctcaagaccatattcaatctacccacatggggtgactttttccccatatgaggacgaagtgaacagctcctttacgagtggaagaaataatactatgattcgcgctgtccaacctggtgaaacgtatacttacaagtggaacatcctggagttcgatgagccaacagagaacgacgctcaatgtctgaccaggccctattactctgacgtggacatcatgagagatattgccagtggcttaattggactgctcctgatttgcaagtctcggtccctggaccgaagggggattcagcgagctgcagatatcgaacaacaagccgtgtttgcggtgtttgatgagaacaaatcctggtacctagaggataacattaataagttctgtgagaacccagatgaggtgaaacgtgacgaccccaagttctatgagtctaatatcatgagcaccatcaatgggtacgtacctgagtccatcacaactctcggattctgtttcgacgacaccgtccaatggcatttctgctccgtggggactcagaacgagatcctcaccatacacttcaccgggcacagctttatttacgggaagcgccacgaggatacattgacactgtttccgatgagaggggaatccgttacggttactatggacaatgttggtacttggatgctgacctctatgaactccagtccacggagcaaaaaactacgactcaaattccgggatgttaagtgtatcccagacgatgacgaggatagctacgaaatcttcgaaccaccggaaagcacggtgatggctacaaggaaaatgcatgaccgcttggaacctgaagacgaggaatctgatgcagactatgattaccagaaccggctggcagccgccctgggtattagatctttccgtaattcttccctgaaccaagaggaagaagagttcaatctaaccgccttggccctggagaatggcactgagtttgtgtcctcgaacaccgatattattgtgggatcaaactattcttccccttccaatatttcaaaattcacagtgaataacctggctgaacctcagaaggccccttcacatcaacaggcaaccaccgcgggctccccgttaaggcacctcattggcaagaatagtgtgctgaacagttccaccgctgagcactcgtcaccctactctgaggatccgatcgaagatccactgcaaccagatgtcaccgggattaggctgctgagtctcggagcgggggaattcaagagtcaggagcacgccaagcataaaggaccaaaagtggagcgtgatcaagcagcgaaacacagattttcctggatgaagctgctggcacacaaggtgggccggcacctgagccaggatacgggctcaccgtccggaatgcgtccatgggaagacttaccttcccaggacaccggctcgccgagcagaatgcggccctggaaagacccacctagcgatttgctactgcttaaacagtcaaactcctccaaaattctcgtcggcaggtggcacttggcttccgaaaaggggagttacgagattatacaggatactgatgaggacacagctgtaaacaactggctcatcagccctcagaacgcctctcgcgcctggggggagagtacacccttggccaacaaaccaggcaagcagtccggtcacccgaagtttccccgggtcagacacaagagccttcaggtgaggcaggatgggggcaaaagcagactgaaaaagagccagtttctcattaagacccggaagaaaaagaaagagaagcacacgcaccatgcccccttgagtccacggaccttccaccctctgcggtcggaagcctacaacacgttttccgaaaggaggcttaaacactccctcgtgctgcataagtctaatgagacttctctgcccacagaccttaatcaaacgctcccatctatggattttgggtggattgcctcactacccgaccacaaccaaaatagcagtaacgacacgggacaggcttcctgcccgcctgggctctaccagacggtgcctcccgaggaacactatcagacttttccaatccaagatcctgaccaaatgcactctacatcggatccatcgcacaggtcaagcagccctgagctctcagaaatgttagagtatgataggagtcacaagagctttccaaccgacatctcacagatgagtccatcttcagaacatgaagtgtggcaaacggtcatctccccagatctaagccaggtcacattgagccccgagctgagtcaaactaacctgtcccctgatctttcccataccaccctcagcccagagctcattcagcgaaacttgtcccccgcgttgggccagatgcctatctctcccgatctgtctcacaccaccctatcccctgacctctcacatacaacactgagtctggatctaagccagaccaacctgtcccccgagctgtcccagaccaaccttagcccagcccttggccagatgccgttgagtccagacctcagccacacaacgttgtccctcgatttctcacagaccaacctgagccctgaactgtcacatatgacactgagccctgaactgtcccagacaaatctttctcccgccctggggcagatgcctatctccccagacctgagtcacacaacgctcagcttagacttcagccagacaaacctttctcctgagctttcccaaaccaatctctctccggcgctgggccagatgcccctttcaccggacccaagccacactaccctgtcgttggacctgtctcagaccaacctctcccctgagctctcccagacaaatctgtcacctgatctttctgagatgccgctgtttgccgacctgagccagattccactgaccccggatctggaccaaatgactttatcacctgacctaggcgaaactgacctgtctcctaactttgggcagatgtcactatcgcctgacctctcccaggtgacactctcgcctgacatctcagatactacactcttaccagacctatctcagataagtcctcccccagacctcgatcagatcttttaccctagcgagagtagtcagagtctgctccttcaagaatttaatgagagcttcccttatccggatcttgggcagatgccctctccctcctctcctaccctcaacgataccttccttagcaaggagttcaatccccttgtcattgtggggttgtccaaggatggcacagattatatagaaatcatcccgaaggaagaggtgcagagcagcgaggatgattacgccgaaatcgactacgtgccctatgatgacccctacaaaacagatgttcgtactaacattaactcaagcagggatccagacaatatagccgcctggtatcttcggtcaaacaatggtaacaggaggaactattacatagccgcagaagaaatctcctgggactatagtgagtttgttcagcgagaaacagacatcgaagattcagacgatattccggaggataccacctataaaaaggtagtgtttcgaaaatacctcgattccaccttcacaaagcgtgatccccgcggcgagtacgaagagcatctgggtatcttgggacccattattcgggccgaagtcgacgatgttatccaggttaggttcaagaatctggccagccggccatacagcttgcatgcccacggcttgagttacgaaaaatcaagtgaaggcaagacctacgaggacgacagccccgagtggttcaaagaagacaacgcggtacaacccaacagctcttacacttacgtgtggcacgccaccgaacggagtggccccgaaagccccggctcagcctgccgggcttgggcctattacagtgctgtgaatcccgagaaagatatccattcaggcctcattggtccccttctgatctgccaaaagggcatcctgcacaaggattccaacatgcccatggatatgagggaattcgtgttgctctttatgacatttgatgaaaaaaagagctggtactacgaaaaaaagagcagatccagctggagactaacatcatccgaaatgaagaagagccacgaatttcacgccattaacggtatgatttacagcctgccaggcctgaaaatgtacgagcaggaatgggtgaggctgcatctgttgaacattgggggctcccaggacatccacgtggtccactttcatggacagactttactcgaaaatggaaacaagcagcaccagctgggagtctggccccttttacccggttcattcaagacccttgagatgaaggcatcaaagccgggctggtggctgttgaataccgaggtgggtgagaatcagcgggctgggatgcagacgccgttcctgataatggatagggattgccgcatgcccatgggacttagcacaggcatcatatcagacagccaaataaaggctagcgagttcctgggctactgggaaccgcgcctcgctcggctcaataacggcgggtcctacaatgcatggagtgtggaaaagttggccgctgagtttgccagcaaaccatggattcaggtggatatgcagaaggaagtgattataaccggtatccagacacagggagctaagcattacttaaaaagctgttacaccacagaattttatgttgcctatagctccaaccagattaattggcagatcttcaagggtaactcaacccgaaacgtaatgtactttaatggcaacagcgatgcgagcactattaaggaaaaccagtttgacccaccaatcgtcgctcgttatatccgcatcagtccgaccagggcatacaacaggcctacacttcgcctagagctccaggggtgtgaagtcaacggttgtagtaccccactgggtatggagaacggaaaaatagagaataaacaaataactgccagcagtttcaagaagtcatggtggggcgactactgggagccatttagagcgaggctcaatgcccagggaagagtaaatgcctggcaggctaaggcgaataataacaaacaatggctggagattgacctcctcaagatcaaaaaaattaccgccattattactcagggctgtaagtccctgtcatctgagatgtacgtgaaaagctacacaattcactactctgaacagggagtggagtggaaaccgtaccggcttaagtcctctatggttgacaaaatttttgagggaaatacgaataccaaagggcatgtcaagaactttttcaaccccccaatcattagcagatttatcagagtgatacctaagacttggaatcaatctatcgccttgaggctcgaactattcggctgcgatatttat

SEQ ID NO: 9044 - DNA, 6672 bp, Artificial Sequence
  Description of Artificial Sequence: Synthetic coding sequence
atgtttcctggatgccccaggttgtgggtgctcgtcgtccttgggacctcttgggtgggttgggggagccagggtaccgaagccgcacagcttcgacagttctacgtggcggcgcagggtatctcgtggagctacagaccggagccgactaactcatcgctgaacctctcagtcactagcttcaagaaaatcgtctatagagaatacgaaccctactttaagaaagaaaaaccgcagtcgaccatctctggcctgcttggaccgaccctgtacgccgaggtgggagatatcattaaggtgcactttaagaacaaagcagacaaaccgttgtcgatccacccgcagggaattcgctactcaaagctgtcggagggagcctcgtacctggaccataccttccctgccgagaagatggacgatgcggtagcgccaggacgcgaatacacgtacgaatggtcgatttccgaggattctgggccaacccatgatgatcctccctgcctcactcacatctactactcacacgagaatcttattgaggacttcaactcgggacttatcgggcctctcctgatatgtaagaagggtactctcaccgagggaggcacccagaaaaccttcgacaaacaaattgtcctgctgttcgcagtatttgacgaaagcaagagctggagccagagctcgtcactgatgtataccgtgaatggatacgtcaatggcactatgccggatattaccgtctgcgcgcacgaccatatctcctggcatcttctcggaatgtcctcgggacctgaactcttctcaatccacttcaatggccaagtcctggaacaaaatcaccacaaagtcagcgcaatcactctggtatccgccacttccaccaccgccaacatgactgtgggaccggaaggcaagtggatcatctcctcgctcactcctaagcacctccaggcgggcatgcaggcgtacattgacatcaaaaactgccctaagaaaactcgaaacctgaagaaaatcacccgcgagcaacggagacatatgaaaagatgggaatacttcattgccgctgaagaagtcatttgggattacgccccggttattcccgcaaatatggataagaaataccggtcccagcacctggacaacttttcgaaccaaatcggaaaacattacaagaaggtcatgtacacccagtacgaggacgagagcttcaccaagcatactgtcaatccaaatatgaaggaggacgggattctgggaccaatcatcagagctcaagtgagggacaccctgaaaatcgttttcaagaacatggcttcgcgcccttactcaatctaccctcacggagtgaccttctcgccgtacgaggatgaagtcaactcatcattcacttccggcagaaacaatactatgatcagggccgtgcagccaggggagacttacacttacaagtggaatattctggagttcgacgaacccaccgaaaacgacgcccagtgcctgaccaggccgtactactctgacgtggacatcatgcgggatatcgcctccgggctgatcggcttgctgttgatctgcaaatcgcggagcctggaccgccgcgggatccaacgcgccgctgacatagaacaacaagccgtgttcgctgtgtttgatgagaacaagagctggtacctggaggataacatcaataagttctgcgagaatccagacgaggtgaagcgggacgatccgaagttttacgaatcaaacatcatgagtaccatcaacggctacgtgccagagtccattaccactctcggtttttgttttgacgataccgtgcaatggcacttctgcagcgtgggaacgcagaacgagatccttacgatccactttacgggacactcatttatctatggtaagagacacgaggacactctgaccctgttcccgatgcggggagagagcgtgaccgtcacgatggacaatgtcggaacctggatgctcaccagcatgaatagctcgcctcggtccaagaaactgaggctgaaattccgggatgtgaaatgcatcccggacgatgacgaggactcctatgagatattcgagccgccggagtccactgtcatggcgacccgcaagatgcatgataggttggaaccggaggacgaagagagcgatgccgactacgactaccagaaccgcctggcagcggcactgggcattcgtagcttccggaattcatctctgaatcaagaggaagaagaattcaacctcactgcattggcccttgagaacgggactgaattcgtcagcagcaatactgacatcatcgtgggttcaaactactcatctccgtctaatatcagcaagttcaccgtgaacaacctcgcggagccacaaaaggcaccgtcccaccagcaggccaccactgcggggtcacccctccgacatctcatcggcaagaactcggtgctgaacagctcgaccgcagagcattcgtccccatactcggaggatcctattgaggatccgctccagccagacgtgaccggcatccgcctgctttccctgggcgctggagaattcaaaagccaggagcacgcaaagcataaaggacctaaggtggaacgggatcaggccgcaaaacaccggttctcgtggatgaagctgctggctcacaaagtgggcagacatctcagccaggataccggaagcccctcgggaatgcggccgtgggaagatctgccatcgcaggacactggctccccgagcagaatgcgtccgtggaaggatccaccatccgatctgctcctgttgaaacaatcgaatagttcaaaaatcctggtcggtcgctggcacctggcatcagagaagggctcatatgagatcatccaagataccgatgaagatacggctgtgaacaactggctgatctcaccgcaaaatgcttcgcgcgcatggggtgaatcgactccgctcgctaacaagccgggaaaacagtctggacacccgaagttcccacgcgtgagacataagtctctgcaggtgaggcaagacggtggaaagtcgaggctgaagaaatctcaatttctgatcaagaccagaaagaaaaagaaggagaaacatactcatcatgccccgctgtcgccacggacctttcacccactgaggtcagaagcatacaacaccttctcggaacggaggctcaagcattccttggtgctgcacaagtcgaacgaaacgtcacttccgaccgacctcaaccagaccctgccctcaatggattttggatggatcgcgtccttgccggaccacaaccagaattcgtccaacgataccggacaagcctcgtgcccgccaggactgtatcagacggtgcctcctgaagaacactaccagaccttccccatccaggaccccgaccagatgcactcgacctccgaccccagccatcgctcgtcctcgccggaactgtcggaaatgctcgaatacgatcggagtcacaagtccttcccgactgacatctcccagatgagcccttcctcagaacatgaggtgtggcagacggtgatctcgcctgatctgtcccaggtcaccctgtccccggagctctcccagaccaatcttagccccgacctttcccacactactctttctccggaactcatccagcgaaacctgagtccggctcttggtcaaatgccgatctcaccagatctgagccatactactctgtcgccagatttgtcccataccactctgtccctggacctgtcgcaaacgaacctttcgccagagttgagccagactaatctgtcgccagctctgggacagatgcctctgtccccggacctgagccacacgacgctctcgctcgatttcagccagactaacctttcccctgaattgtcgcacatgactctctcaccagaactcagtcagactaacttgagtcccgcgttgggccaaatgcctatcagccctgacctgagtcatacgaccctgagcctggactttagtcagacgaacctgtcccctgaactctcgcagacgaacttgtcgccggcactgggacaaatgccactgtctccggacccatcgcacaccaccctgagcctcgacctgtcgcagacgaatctttccccagaattgtcacagactaacctgtcgcctgacctgagcgaaatgccgctgtttgcggacctcagccagatcccgctcactcccgacctggatcaaatgaccctgtcccccgacctcggggaaactgatctgtcgccaaacttcgggcagatgtccctgtcaccggatctcagccaagtgacgctgtccccagatatcagcgacactactctgctccccgacctgtcacagatctccccgccgccggatttggaccaaatcttttacccgtcggagtcgagccagtctttgctgctgcaggaattcaatgaatccttcccataccctgacctcgggcagatgccgtccccttcctcccccactctgaacgacacttttctctccaaggagttcaacccattggtcatcgtgggactctcaaaggatggaaccgactacatcgaaatcatcccgaaagaagaagtgcaatcgtccgaagatgactacgctgaaatcgactatgttccgtacgacgacccatacaaaaccgacgttcgcactaatatcaactccagccgggatccggacaacatcgccgcgtggtacctgcggtccaacaacggcaacagacgaaactactacatcgccgcggaggaaatctcttgggactactccgagttcgtgcagcgcgagacggacatcgaggactcagatgacatccctgaagatactacctacaagaaggtggtgttcagaaagtacctggattcaactttcaccaagagggaccctcgcggagagtatgaggaacaccttggaatcctgggtcccatcatccgcgcagaggtggacgatgtgatccaagttcggttcaagaacctcgcctcccgcccatactccctgcatgcacacggattgagttacgaaaaatcctcagaaggaaagacctacgaagatgattccccggagtggtttaaggaggacaatgctgtccaacctaactcatcatacacctacgtgtggcatgcaaccgaaagatcaggtccggaatcgccgggctccgcgtgtcgcgcctgggcctactactccgccgtcaaccctgaaaaggacatccactcagggctgatcgggccgctcctcatatgccagaagggaatcctgcataaagattcgaacatgccaatggacatgcgcgagtttgtgctcctcttcatgactttcgatgaaaagaagtcctggtactacgagaagaagagccgctcgtcttggcgcctgacctcgtcggagatgaagaaatcgcacgaattccacgccatcaatggaatgatttacagcctgccaggactcaagatgtacgaacaggaatgggtccgcttgcacttgctgaatatcggaggaagccaggacatccacgtcgttcatttccacggacagactctgcttgaaaacggcaataagcaacatcaactcggagtgtggcccctgttgccgggttcattcaaaactctggagatgaaggcttcaaagccgggctggtggctgctgaacaccgaagtcggagagaaccagagggctggcatgcaaaccccgtttctgattatggatcgggattgtcggatgcctatgggactctccactgggatcattagcgactcccagatcaaggcttcagagttccttggatactgggaacctcgccttgcccggctgaacaacggtggatcatacaacgcatggtctgtcgagaagttggccgcagaattcgcttcgaagccgtggattcaagtggacatgcagaaagaagtgatcatcaccggaatccagactcagggcgcgaaacactacttgaagagctgctacaccactgaattctatgtggcgtattcatccaaccaaatcaattggcaaatcttcaaaggaaacagcactcgcaacgtgatgtacttcaatggcaattccgacgccagcaccatcaaggaaaatcaatttgacccgccaatcgtggccaggtacatccgcataagtccaacccgggcgtacaatagaccaactctgcgcctggaactccagggatgtgaggttaatggttgctcaacccctctcggaatggagaacggcaaaatcgagaacaagcagattactgctagctccttcaagaagtcgtggtggggcgactactgggagccattccgcgcgcggctcaacgcccaaggaagagtgaatgcttggcaagcaaaggccaataacaacaagcagtggctggaaatcgaccttcttaagatcaaaaagatcactgcgatcattacccagggctgcaagtcgctgtcctctgaaatgtacgtgaagagctacactatccactacagtgaacaaggggtggaatggaagccataccggctcaagtcaagcatggtggataagatcttcgagggtaataccaataccaagggacatgtgaagaacttcttcaacccaccgatcatatcgcggtttattcgcgtgattccaaaaacgtggaatcagagcatcgccctccggctcgaactcttcggttgtgacatttac

SEQ ID NO: 9045 - DNA, 6672 bp, Artificial Sequence
  Description of Artificial Sequence: Synthetic coding sequence
atgtttccgggatgtcctcggctttgggtgctggttgtgcttggaacctcatgggtcggctgggggtcccagggtactgaagcagcccagctcagacaattctacgtggcggcacaaggtatatcgtggtcgtaccgccctgaaccgaccaattcctcgcttaatctctcagtgacgagctttaagaaaattgtgtaccgagagtacgagccatactttaagaaagagaagccgcaatccactatttccgggctgcttggtccaactctttacgccgaagtgggagatatcattaaagtccactttaagaataaggctgacaagccactttccatacatcctcaaggtattcgttactcaaagctgtccgaaggggcgtcgtacctcgatcatacttttcctgccgaaaagatggacgatgcagtggctccaggtcgagagtacacctacgaatggtccattagcgaggactcgggacctacccatgatgacccaccttgcctcacccatatctattactcgcacgagaacctcatcgaggacttcaattccggactgatcggaccgcttctcatttgtaagaaaggcaccctgacggagggtggaacccaaaaaactttcgataagcagatcgtccttctttttgccgtctttgatgaatccaagtcatggtcccaatcgagctcccttatgtacactgtgaacggctacgtgaacggaactatgccggatatcactgtgtgtgctcacgatcacattagctggcacctcctgggcatgtcatcgggccctgaactgttttccattcactttaatggtcaggtgctcgaacaaaatcaccataaggtgtcggcaattacgctggtcagcgcaacctcaacgacggccaatatgactgtgggtccagaaggaaaatggattatctcgtcactgacccccaagcatctgcaagcgggcatgcaagcctatattgacattaagaattgtcctaagaaaactaggaatctgaagaaaatcaccagagaacaacggcgacacatgaagagatgggaatacttcattgccgccgaggaagtgatttgggattacgcacccgtgattccagcaaacatggataagaagtaccgcagccaacatctggacaacttctcaaaccagatcggtaagcattacaaaaaggtgatgtacactcagtacgaggacgagtcatttaccaagcacaccgtgaacccgaacatgaaggaggacgggatcctcggacctatcatccgcgcacaagtgagggacaccctgaagattgtgtttaagaacatggccagcagaccatatagcatatatccacatggagttaccttttccccttacgaagatgaggtcaattcatcatttacttccgggaggaacaataccatgataagagcggtgcaacctggtgaaacttacacttacaagtggaacattctggaatttgacgaaccaactgaaaatgatgcccaatgtctcactaggccatattactccgacgtcgacataatgcgcgacatcgcatcaggcctcattggacttttgctcatctgtaaatcgcgttccctggaccgaagagggattcagagagcagcagatatcgagcaacaagccgtctttgcagtctttgatgagaataagtcatggtacctggaagataacattaacaagttttgtgaaaaccctgacgaggtcaaacgtgatgatccaaagttttacgagagcaacattatgtccaccatcaacggatacgtgccagaatcgatcaccaccctggggttttgtttcgacgacacggtgcagtggcatttttgctcagtgggaacccaaaatgaaattcttactattcattttaccggacactcgtttatctatggaaagcgccatgaggacactcttacgcttttcccaatgcggggagaatccgtgaccgtcacgatggataacgtcggaacttggatgctgacttctatgaactcatcgcctcggtcgaagaaactgagactgaagtttcgggatgtgaagtgtattcccgatgacgatgaagatagctacgaaatcttcgaacctcctgaatcgactgtcatggcaactcgaaaaatgcacgaccgtctggagccagaggacgaagaatccgacgccgattacgattaccagaatcgactcgcagctgcacttggcatcagatcctttcggaactcatcgcttaatcaagaagaagaggagttcaatctgacggcactggcgcttgagaatggaaccgaattcgtgtcctcaaataccgacattattgtgggaagcaattactcttccccgagcaacataagcaagtttaccgtgaacaatcttgccgaacctcaaaaagctccatcgcatcagcaagcgactacggcaggttctcctttgcggcatcttatcggcaagaattcggtgctgaacagcagcaccgcagaacacagcagcccgtactcggaggatcctatcgaggaccccttgcagcctgatgtgactggaattagactgctgtcactcggagcaggcgaattcaagtcccaggaacatgctaaacataaaggccctaaggtcgaaagagatcaggcggcgaaacatcggttctcttggatgaagctgcttgcccataaggtgggccgccatttgtcccaagacactggatcgccctcgggaatgcgtccatgggaggacctgccttcgcaagataccggatccccctcgagaatgcgtccttggaaagatcccccttcggatcttcttctgcttaaacagtccaactcctcgaagatcctcgtcggacggtggcatctggcgtccgagaagggatcttatgaaatcatacaagataccgatgaggatactgcagtgaacaactggctcatttcgccacagaacgcatcgcgagcatggggtgaatcgacgcctttggccaacaaacctggaaaacaatccggtcatcctaagtttccgagagtccggcataagtcgttgcaggtgagacaggacggtggcaagtcgaggcttaagaagtcccagtttctgataaagactcgaaaaaagaaaaaggaaaaacatactcatcacgcaccacttagcccacgaaccttccatccactgaggtccgaagcgtacaacactttttccgagagacggcttaagcactcgcttgtgcttcataagagcaatgaaacttcacttcctaccgatctgaaccaaactctcccatctatggattttggttggatcgcctcgttgcccgatcataaccaaaactccagcaacgatacgggtcaggcatcgtgtccaccaggactttaccaaactgtgccccctgaagaacattaccagactttccctatacaagatcctgaccagatgcacagcacctcggacccaagccataggtcatctagccctgagctgtccgaaatgctcgaatacgacagatcccataagtcattcccaaccgacatatctcaaatgtcgccttcgtcggaacatgaagtttggcaaactgtgatctcccctgacctgtcgcaagtgactctttcgccagaactctcacagactaacctttcccctgatctgtctcatactacgctgtcacctgagcttatccaaagaaacttgagtccagctcttggccagatgcccatttccccggacctttcccacaccacgctttcaccggatctctcgcacaccactctttcgctcgatctttcccagactaatctctcacccgaattgtcacagacgaatctgtcgcccgcacttggtcagatgcctctgtcgccggatctttcgcatactactctctcactcgattttagccaaaccaacttgtcgcccgagctgtcgcatatgaccctttcaccggagctttcgcagaccaacctgtctcctgcgctgggtcaaatgcccatctcaccggatttgtcccacactactctgtccctggatttctcacaaacgaacctttccccagagctttcgcaaaccaatctttcgccagcacttggtcaaatgcctctgtccccggatccctcgcataccactctgagccttgatctgtcgcagacgaacttgagccctgagttgtcccagacgaatcttagtcccgatctttcagagatgcctctcttcgcagatttgtcccagattcccctgactccagatctcgatcagatgaccctcagccccgatttgggtgaaactgatctctcccctaactttggccagatgtcactctcacctgatctgtcacaggtgactctgtcccccgatatttcggacactactcttctgccagaccttagtcaaatttcgccgcctccagaccttgaccagatcttctaccccagcgagtcatcccaatcgctcctgctccaggaattcaacgagtcgtttccttacccagacctggggcagatgccaagcccatcgtctcccacgctcaacgacactttcctgtccaaagaattcaaccctctggtgatagtgggtctttcgaaggatggtactgattacatcgagattatccccaaggaagaagttcagagttccgaggatgattacgcggagattgattacgtgccttacgatgatccctataagaccgacgtgaggaccaatatcaattcgtcacgtgatccagacaacatagcggcctggtaccttcgcagcaataacggtaaccgtagaaactactacatagccgcggaagaaatctcatgggactactcggagtttgtccagcgggaaactgacatcgaggactcggacgatattccagaagataccacttacaagaaggtggtgtttcgcaaatacctcgattctacctttactaagagagatccccgcggagaatacgaggaacaccttggcattctgggtcccattatcagagcggaagtggatgatgtgattcaggtcagatttaagaacctggcaagcagaccttactctctgcacgcgcatggcctgtcctacgaaaaatcttccgaagggaaaacctacgaagatgacagcccggaatggttcaaggaagataatgcagtccagccgaacagctcatatacctatgtctggcacgccaccgagcggtccggacccgaatcccctgggtccgcctgtagggcatgggcctactactcggcggtcaatcccgaaaaggacatccacagcggtcttattggacctctgctgatttgtcagaagggaattcttcataaggacagcaacatgccaatggatatgcgcgaattcgtcctgctgtttatgaccttcgacgagaaaaagtcgtggtactacgagaagaagtccagaagctcatggaggctcacttcgtccgaaatgaagaaaagccacgaatttcatgccattaacgggatgatctactcgcttccagggctgaaaatgtatgaacaggaatgggtgcggctccatcttctgaacatcggcggatcgcaggatattcatgtcgtccactttcatgggcagaccctcttggaaaacggtaacaagcagcatcagcttggggtgtggcctctgcttcctggtagcttcaaaaccctggagatgaaggcatcgaagccaggctggtggctcctgaacaccgaggtgggcgagaaccaacgcgcaggtatgcaaaccccattccttatcatggatagagactgtaggatgccgatgggactctccaccgggattatcagtgattcccagatcaaagcatcggaattcctcggatactgggaaccccggctggcaagattgaacaatggaggatcatacaacgcctggagcgtggaaaagctcgctgcagaattcgcttcaaagccatggatccaagtggatatgcaaaaggaggtgatcataaccggtattcaaactcagggagctaagcattacctcaagtcgtgttacaccacggaattctatgtggcgtactcgtcgaaccagattaactggcagatctttaaagggaattccactcgaaacgtgatgtactttaacggtaattccgatgcctccactatcaaggaaaatcaatttgatcctccaatcgtggcaaggtacattcgcatctcgccaacgagggcatataacagacctactctgcgcctggaactgcaaggatgtgaagtcaacggttgttcgacgccactcgggatggaaaatgggaagatagaaaacaagcaaattacggcgtccagcttcaagaagtcatggtggggagattattgggaaccctttcgcgcccggcttaatgcgcagggtagagtcaatgcatggcaggcgaaggcgaacaacaataagcaatggctcgaaatcgatcttctgaaaatcaaaaagataaccgcaattatcactcagggttgcaagtcgctgtcctcagagatgtacgtgaagtcatacactatccactactcagaacagggcgtggaatggaaaccataccgcctgaagagctccatggtcgacaagatttttgaaggaaacaccaacaccaaggggcacgtgaagaactttttcaatccccccattatctcgcgctttattcgggtgatccctaaaacctggaatcaatctatcgcgttgcgtcttgaactcttcggatgtgatatctac

SEQ ID NO: 9046 - DNA, 6672 bp, Artificial Sequence
  Description of Artificial Sequence: Synthetic coding sequence
atgtttccaggatgcccacggctgtgggtgctggtggtgctcggaactagctgggtgggttggggctctcaaggcaccgaggccgcccaactgcgccagttttacgttgccgcgcagggcatctcctggagctatcgcccagaaccaaccaattcttcacttaacttgtcagtgacatcttttaagaaaatcgtctatagggagtacgaaccttacttcaaaaaagagaaacctcagtccacaattagtggcctgctcggacccactttgtatgctgaagtgggcgatatcatcaaggtgcattttaaaaataaggccgacaagcctctctcaattcacccccaggggatccggtacagtaagctgtctgagggcgccagctatctggatcacactttcccagccgaaaagatggacgacgctgtggcgcccgggcgggagtatacctatgaatggtctatcagcgaggatagcggccccactcatgatgatcctccctgcctaacacacatttactactcccatgagaatctcatagaagacttcaactccggactgatcgggccccttttgatttgtaagaagggtacactaacagaaggggggactcagaagacttttgataaacaaatagtgttgctgtttgcagtcttcgacgagagtaaatcatggtcccagtcttctagcttgatgtacacggttaacggctacgtgaacggcaccatgcccgatataacagtctgtgctcatgatcatattagctggcatctgttaggaatgtcaagtggaccagagttgttctctattcacttcaacggccaagtgttggagcagaaccaccacaaggtatctgccatcacccttgtctccgctactagcactaccgccaatatgactgttgggcccgaaggcaagtggatcatatcttcgttgacaccaaagcatctacaggcgggcatgcaggcgtatatagacataaagaattgccccaaaaagaccaggaatttgaagaagattactcgggaacagcggcgtcacatgaagcgttgggagtatttcattgccgccgaggaggtcatctgggattatgctcccgtcatcccagccaatatggacaaaaagtaccggtcccaacatctggacaatttcagcaaccagattggtaagcattataagaaggtgatgtacacacagtatgaggacgagagtttcacgaagcacaccgttaacccaaacatgaaggaagacgggatactggggccaatcatcagggcccaggtcagagacacgctgaaaatagtttttaaaaacatggccagcagaccctactcaatttacccccatggcgtgacttttagtccatatgaggacgaggtaaactcctctttcacatccgggcgtaataacacaatgattcgcgcagtgcagccaggagaaacctacacatataaatggaatatcctggaatttgacgaaccaacagagaacgatgctcagtgtctcacgcgcccttattacagcgatgtggatataatgcgagacatcgcaagcggtctgatcggacttttgcttatatgtaagtcgcgttcacttgatcgacgcggaattcagcgagccgctgacatcgagcagcaggcggtcttcgcagtgttcgatgagaacaagagctggtatctggaggacaatatcaataaattttgcgaaaaccccgatgaagtcaaacgggacgaccctaaattttatgaatcaaacattatgtcaaccatcaacggttatgtgccagaaagcatcacaacactgggattttgtttcgatgatacagtccaatggcacttttgttccgtgggtacacaaaacgaaatcctgactattcacttcaccgggcactctttcatctacggtaagagacatgaagatacccttactttgtttcctatgcggggagaatcggtcacggtgacgatggataatgtcggcacttggatgcttaccagtatgaatagttctccacggagtaagaagttaaggctaaaattcagggatgtaaagtgtatccctgatgacgacgaggactcatacgagatttttgaacctccagagtcgaccgtgatggctactagaaaaatgcacgatcgcttagagccagaggacgaggagtcagacgccgattatgactatcaaaatagacttgccgccgctcttggcattcgatcattccgcaattcaagtctcaatcaggaggaagaagagtttaatttaaccgcgttagcactagagaatggcacagagtttgtttcctccaacacagacataatcgtagggagcaattattcatcaccctctaatattagtaagtttacggtgaataatcttgctgagcctcagaaagcacccagtcaccaacaggctaccactgctggctccccccttcggcatctgatcggtaagaacagcgtgttgaatagcagcaccgctgaacactcttcgccctattctgaggaccccatcgaggacccattgcagcccgatgtaacaggcattcgtctgctgagtctgggtgcgggcgaatttaaaagccaggagcacgctaaacacaaaggtcctaaagtggagcgggaccaagcggccaaacaccgcttcagttggatgaaattgctggctcacaaagtgggacgccacctgtcacaggacacagggtcaccaagtgggatgcggccatgggaagatctccctagccaggataccggttcaccaagccgcatgagaccgtggaaggatcccccatctgaccttctcttgctgaagcagtctaactcctccaaaatcttagtgggaaggtggcacctggctagtgaaaagggaagttacgaaatcatccaggatacagatgaggacaccgccgtgaacaattggctgatttctcctcagaatgccagccgtgcctggggtgagtctacaccactggcaaacaagcccggaaagcagtccgggcaccctaaattcccccgagtacggcacaagtcactgcaagtgcgccaggacgggggtaaatctcgtctgaaaaagtcccagttcctaatcaaaacgaggaagaagaaaaaggaaaaacacacccaccacgcaccgttgtccccgagaacattccatcccttgagatccgaagcctataataccttctctgagcggcggctgaagcactcgctggtccttcataagtctaacgagacatcgctgcccacggatctgaaccagacattgccttctatggattttggttggattgcgtccctccctgatcataaccagaattcatctaacgatactgggcaggcttcttgtccccccggcctgtaccagactgttcctcccgaggagcactatcaaacattccctatacaggaccctgatcagatgcactccacctccgacccttcacatagaagttcgagcccggaactgtctgagatgttagaatacgatcggtctcataaatcattcccgacagacatttcccagatgagcccctcttctgaacacgaggtctggcaaacagtaatttcgccggacctttcacaggtgacactctcccccgagcttagccaaactaatctttctcctgacctgtctcataccaccctctcacccgagcttatccagagaaacctgagccccgccctcggtcagatgcccatctcccccgacctgtctcacacaacactttcacctgacctgtcccatacaaccttatccctggatttatcacaaacgaacctgagcccggaactatctcaaactaaccttagccccgccctcggccagatgccactgtcccctgatctcagtcatacgacgctttcccttgactttagtcagaccaatttgagccctgaattgtcacatatgaccctttctccggagttgagtcagaccaacctgtcccccgctctggggcagatgcctatatctcctgacctgagccacacaacactttctctcgatttttcccagaccaacctcagcccggaactgtcgcaaacgaatctctctcctgccctcgggcagatgcccctgtccccggatccaagccacaccaccctctcgttagatctcagccagactaatttatccccagagctgtctcaaacaaatctttcccctgacctgtctgaaatgccactgttcgctgatctgtctcagataccactgacccccgacctcgatcagatgacactcagccccgatctgggtgaaacggacttgtcccctaactttggccagatgtccctctccccagatctgtctcaggtcacattgtctcccgacatcagcgacaccaccttgctgcctgacctttcacagatctctcctcctccagacctggaccaaatattttacccatcggaaagctcgcagagcctgctcttgcaggagttcaatgaaagtttcccctatccagacttagggcagatgccctccccatcttcacccacattgaacgacacctttctgtcaaaagagttcaatccccttgtgatagtcggactgagtaaggacggaacagactatattgaaatcattccaaaagaggaagtgcagagtagcgaggacgattacgcagaaatcgactatgtcccctatgacgacccttataaaacggacgtgcgcacaaatattaattcaagccgagacccggacaatatcgcagcatggtatctgaggagtaataatggcaacagaaggaactattacattgcggcagaggaaatctcatgggattactcggaattcgtgcagagggagactgacattgaggactccgatgatattcctgaagataccacttataagaaggtagtgttcagaaaatacctggattcaacctttactaagcgggaccctcggggagagtatgaggaacacctagggatcctggggccaattatccgggcagaggtggatgacgttattcaggtcaggttcaagaatctggcctcacgaccctattctttacacgcacacggcctgtcatacgaaaagtcctccgaggggaagacctacgaagacgacagcccagagtggttcaaggaggacaatgctgtccagcctaactccagctacacatacgtgtggcatgccaccgagcgcagtgggcctgagagccctgggtcagcgtgtcgtgcctgggcctactactccgcggttaacccagagaaagacatacactctggcttaattgggccgctactgatttgtcagaaagggattctccacaaagacagcaacatgcctatggatatgagggaattcgttctcctctttatgacatttgatgaaaagaaatcatggtattatgaaaagaagagtcgatcatcttggcgactaacctcttccgagatgaaaaagtcacatgagtttcatgcgattaacggaatgatctatagtctgcctgggctgaagatgtacgagcaggaatgggtaagactgcacctcctgaatataggcgggtcgcaagacatccacgtggtccactttcatgggcagactctcctagaaaacggcaacaagcagcatcagctaggcgtatggccgctcctccccggctcttttaaaactttagaaatgaaggcgtccaagcccgggtggtggctgctgaacactgaagtaggggaaaatcagagggcggggatgcagactccgtttctcattatggatcgcgactgccgaatgccaatgggtttgagcactgggattataagtgattcacagatcaaggctagcgagttcctgggctactgggagccgcgtctggccagattaaataacggaggctcttacaacgcctggagtgtcgagaagctggccgcggagtttgctagcaagccatggatccaggttgatatgcagaaggaagttatcatcaccgggatccagacccaaggggcaaaacattatctcaaatcatgctatacgactgagttctatgtggcttatagcagcaaccagataaactggcagatctttaagggaaactctaccagaaacgtcatgtacttcaacggcaattctgatgcaagcacaattaaggagaaccagtttgacccaccgatcgtcgctaggtacattagaataagccctaccagagcctataatcgccctaccctccggttggaactccaggggtgtgaggtcaacggttgctccaccccattgggcatggagaatggaaagatcgaaaataaacaaatcacagcgtcaagttttaagaaatcctggtggggggattactgggagccatttagggctcgtttgaatgcccaagggagggtgaacgcgtggcaggctaaagctaacaacaacaagcaatggttagagatcgacctcttaaaaattaagaagatcaccgcaatcatcacgcagggttgtaaatccctctctagtgaaatgtatgtcaagagttacacaatccattattcagagcagggcgtggagtggaagccttaccggctcaaatcttcaatggtggataagatcttcgagggcaacacaaacacgaaagggcatgtgaaaaatttctttaatcccccaatcatatctaggtttatccgcgtgattcctaagacatggaatcagtccattgcattgcgccttgagctctttggatgtgatatctac

SEQ ID NO: 9047 - DNA, 6672 bp, Artificial Sequence
  Description of Artificial Sequence: Synthetic coding sequence
atgtttcccggctgtccccgattgtgggtgttagtagtcctgggcacatcctgggttgggtggggatcccagggaaccgaagctgcccagctgcgtcagttctatgtcgccgcccagggcatctcatggtcctatcgcccggaaccaactaattcgtctctgaacctttccgtgaccagctttaaaaaaatcgtttacagggagtacgaaccctactttaaaaaggagaaacctcagtctacgatcagtgggttactcgggccaactctctacgctgaagtcggcgacattataaaggtgcactttaagaataaggctgataaaccgctgtctatacatccacagggaatacggtatagcaaactgagcgaaggtgcgagttatctcgaccacacgtttcctgctgagaaaatggacgatgccgttgcccccggtcgagaatatacatacgaatggtcaatttctgaggattctggcccaactcatgacgaccccccatgcctgacgcacatatattactctcacgagaacctcattgaggactttaattctggcctgattgggcctctgcttatctgtaaaaagggaaccctcactgaggggggtacacagaagacatttgacaaacaaattgtgctgcttttcgcggtgtttgacgagtccaagtcttggagtcagagcagcagtctcatgtatacagtcaacggatatgtgaacggaacaatgcctgacatcacagtatgcgcccatgaccacatcagttggcacctattgggaatgtctagcggcccggaattgttttcgatccactttaacggccaggtcctggagcagaaccaccataaggtgagcgccatcacactagtgagtgccacatctacaaccgcaaacatgactgttgggcccgaaggcaagtggatcatctcctccctcactcccaaacacctgcaggcaggcatgcaagcgtatatagatataaagaattgtccaaaaaagacgcgtaatctgaaaaagattacccgcgaacagagacggcatatgaaacgctgggaatattttatcgctgcagaagaggtcatctgggattacgcccccgtgattccggcaaacatggacaagaagtaccggtctcaacacctggacaacttctcaaaccagatcggtaaacattacaagaaggtgatgtatacacagtacgaggacgaaagttttacaaagcacaccgtgaatcctaatatgaaggaagacgggatacttggacccatcatcagggcacaggttcgtgatacattgaagatcgtgtttaagaacatggcctcccggccatactccatctacccacacggggttacttttagcccgtacgaggatgaggtgaactcctcttttacttctggtcggaataataccatgattcgggccgtccagccgggggagacttacacctacaagtggaacattctggaattcgacgagcccacggaaaacgatgcgcagtgccttacgaggccatactactcggatgtcgacatcatgcgggatatcgcttccggtctgattggcctgttgcttatctgcaaatcccggtcactggaccgccggggcattcagagggccgctgatattgagcaacaggccgtctttgctgtgttcgatgaaaacaagagctggtacttggaggataatatcaataagttctgtgaaaatcccgatgaggttaaacgtgacgatcctaaattttatgaatctaacatcatgtcgacgataaatggttacgtccccgaatctataactactcttggcttctgcttcgatgacaccgtgcaatggcacttttgctctgttggcacccagaatgagattctgactattcatttcacagggcactccttcatttacggcaaaaggcacgaagacactcttactctattccccatgaggggcgaatccgtgaccgtgactatggataatgtggggacatggatgttgacatcgatgaacagctcacctcgtagcaaaaaactccgccttaagtttcgcgatgtcaaatgcatccccgacgacgatgaggatagttatgagatctttgagccacccgaatcaacagtcatggccacgcgaaaaatgcacgaccgactcgagcctgaggacgaggaaagtgatgccgactatgactaccagaataggctcgccgcagccctaggcattaggagcttcaggaactcctctcttaaccaggaggaggaggagttcaatctgaccgcattagctttggagaacgggacagaatttgtgagcagtaacaccgacattatcgtgggcagtaactacagtagcccctccaatatctcaaagttcacagtgaataacctcgccgagccccagaaagctccttcccaccaacaagccacaaccgcaggatccccacttcgccacctgatcggcaagaacagcgtactgaacagctccacggctgaacacagctccccttacagtgaggaccccattgaagaccccctccagcccgacgtcaccggcatcagactgctgtccttaggcgccggggaattcaaaagccaagagcacgcgaaacataaaggccccaaagtagagagagaccaggccgcgaaacatcgcttctcctggatgaagctgcttgctcataaggtcggacggcacctctcacaggatactgggtccccctcaggtatgaggccctgggaggacctcccttctcaggacaccggttccccttcgaggatgaggccttggaaagatcccccctcagatcttcttttattaaaacaatctaacagcagcaagatcctggtaggacgctggcatctagccagtgagaagggaagttatgagatcatacaggacacagacgaggacactgccgttaacaattggctaatcagcccccaaaatgcttcacgggcgtggggtgaaagtacccccttagctaacaagcccggcaagcagagtgggcatccgaagtttccaagagtgaggcataagagtctgcaggtccgacaggatggggggaagagcagattaaagaagtcccagtttctgattaagacgcgcaagaaaaagaaagagaagcacactcaccatgcccccctctcaccccgtaccttccaccccctacggtcagaggcttacaatactttctccgaacgcaggctgaaacacagcctcgttctccacaaatcaaatgaaacgtcactcccaacagatctgaatcagacactgcctagcatggacttcggatggatcgcaagtttacccgaccacaaccaaaatagtagtaacgataccggtcaggcatcatgtccaccagggctgtaccagaccgtgccaccagaagagcactaccaaaccttccccatccaggatcctgaccaaatgcattccacctccgatccttcccatcgatcaagttccccagaactctcagagatgctggagtacgatcggtcacacaagtcattcccaacggatatcagccaaatgtccccttcctccgagcacgaggtttggcagactgtgatctcccccgatctgtcacaagtcaccctttccccagagttgtcacaaaccaatttgtccccggaccttagccacaccacactatcacccgagctaatacagcgaaacctgagccccgccctgggccagatgccaattagccctgatctctctcacaccacactaagccccgatctctcgcatactactctcagtctggacctgtcacagaccaatctgtctccagagctctctcagaccaacctgagccccgcactggggcaaatgccactgagtcctgacctcagtcacacgacgctttcgctagacttctctcagactaacttgtccccggagctctctcatatgacgctctcgcccgagttatcccagactaatttatcccctgcgcttgggcagatgccaatctcacccgatctgtcccacacaaccctctccttggatttcagccagaccaatttgtcgcctgagctgagccagactaacctgtcccctgcccttggacagatgccactttcccctgacccttcccacaccaccctgagcctggatctctctcagacaaatttatccccggagctgtctcagacaaacctaagccctgatcttagtgagatgccattgtttgctgatctgtctcaaatccctctgacccccgacttggaccagatgacactgtccccagacctgggcgaaaccgacctttcaccgaactttggccagatgtctctctctccagatctttctcaggtaaccctcagcccagacattagtgacacaacactccttcccgacttatctcaaatttctccgcctcccgatttggaccagatcttctacccctctgagtccagccagagcctgctgctccaagaatttaatgaatcatttccctatcccgatttggggcagatgccatccccttcttctcctactttaaacgacaccttcctcagcaaagagtttaacccattggtgattgtcggcctctccaaggatgggaccgactatattgagataattcctaaagaggaggtgcagtcctctgaggatgattacgcagagattgattatgtgccctatgatgatccttacaagacagatgtcaggacgaacatcaatagcagcagggatcccgataatattgctgcctggtacctgcgatcaaacaatggtaacaggcgcaactactacattgctgccgaagaaatcagctgggactactccgaatttgtgcagcgggagacggacattgaggactctgacgacatccctgaagacacgacctacaaaaaagtcgtgttccgtaagtatctggacagcaccttcacgaaaagggacccccggggcgagtacgaggagcatctgggaattttgggccctatcattcgtgcggaggtggatgatgtcatccaggtgagattcaaaaacttggcatcccgtccatatagtctgcatgcccacggcctgtcctatgagaagagctctgagggaaaaacctacgaggatgactctcctgagtggtttaaagaggacaacgcagtgcagcccaattcctcttatacatacgtgtggcatgcaacagagcggagtggcccagagagtcccggatcggcctgccgcgcgtgggcctactacagcgctgtcaatcccgagaaggacattcacagcggcctcatagggcccttgctgatttgccagaaaggtattcttcacaaagactctaatatgcccatggacatgagagagtttgtgctgctgttcatgacctttgatgagaaaaagtcttggtattacgagaaaaaatcacggtccagttggcggctgacgagctctgagatgaaaaagtctcacgaattccatgccattaatgggatgatctactcactgccaggccttaagatgtacgagcaggagtgggtaagactccatctactgaacatcgggggctcacaagatattcacgtggtgcacttccatggccagacactccttgaaaacggaaacaagcagcaccagctgggcgtctggccactgctccccggatccttcaaaacattggagatgaaggcatctaagccaggctggtggctcctaaacacagaggtaggcgagaaccagcgtgccgggatgcagacacctttcctgataatggaccgcgactgcaggatgcccatgggactgagtacaggcattatttcggacagccagatcaaagcttcagagttcctgggatactgggaacccagacttgcccgcctgaacaatggaggcagttataacgcttggtccgtggagaaactggcagccgaattcgcgtcaaagccttggattcaggtggatatgcaaaaggaggtgatcatcaccggcatccagacacagggagctaagcattatctgaagtcttgctatactacggagttctacgtggcctactcctccaaccagattaactggcagatcttcaaaggtaatagtaccagaaatgtcatgtacttcaacggcaatagcgacgcttcaaccattaaggaaaaccaattcgatccacctatcgtagcacggtatatccgcataagtcctacaagagcctacaatcgtcctaccttaagacttgagttacagggctgcgaagtgaacggatgcagcactcctctgggcatggagaacgggaagattgaaaacaaacagattactgccagtagcttcaagaagtcctggtggggtgactactgggagcctttccgcgccagactaaacgcacaaggtcgagtcaacgcctggcaggcgaaggctaacaataataagcagtggcttgaaatcgacttgctgaaaataaagaaaatcactgcaattatcacccagggttgtaaaagcctgtcttcggagatgtacgtgaagagttacaccatacattattctgaacagggcgtggagtggaagccgtaccgccttaaatccagcatggtagataagatctttgaaggtaacactaacacgaaagggcacgtgaaaaatttcttcaacccacctatcatcagtaggtttattcgggtgattcctaaaacctggaatcagtccatcgcccttaggctcgagctgttcggttgcgacatctat

SEQ ID NO: 9048 - DNA, 6672 bp, Artificial Sequence
  Description of Artificial Sequence: Synthetic coding sequence
atgttccccggatgcccccgcttatgggtgctcgtggtcctgggaacaagttgggttgggtgggggtcccaaggcaccgaggccgcgcaactgcgtcagttttacgtggccgctcagggcattagttggagctatcgaccagagcctacaaatagctcattaaacctgtccgtgactagttttaaaaagatcgtgtaccgagagtacgagccatactttaagaaggaaaagccacagtctaccatcagtgggttgcttggtcccacactgtacgcggaagttggcgacatcattaaagttcacttcaagaataaggctgacaagccactaagtatccacccacaaggaataaggtactcgaaactgagtgagggcgcgtcttacctggatcatacattccccgctgagaagatggacgatgctgtggcacccggccgggagtatacctacgagtggagtatcagcgaagacagtggccccacccatgacgatcctccttgtttgacacatatttactactcccacgagaatctgatcgaggactttaactcgggactcattggtcctctcttaatctgtaaaaaaggcactctgaccgaaggtggtacgcagaaaaccttcgataaacagattgtgttgctgtttgccgtgttcgacgaatccaaatcctggagtcagtccagctctctgatgtacactgtgaatggctacgtgaacggtaccatgccggacattacagtgtgtgcccatgatcatatcagctggcatctcctcggaatgagcagcggcccagagctgttctctatacacttcaacggacaggtgctagaacaaaaccatcacaaggtgtcagcaatcacattagtgagcgcaactagcacaaccgcgaacatgacagtcggccctgagggaaaatggatcattagctctctgaccccaaaacacctgcaggcgggtatgcaggcatatatcgacattaagaactgtccgaaaaaaacacggaatctcaagaaaatcacccgagagcagagaaggcacatgaagcgctgggagtactttatcgcagctgaggaggtgatttgggactacgcccccgttatccctgctaatatggacaagaagtacaggtcgcagcatttggataacttcagcaatcaaattggcaagcattacaagaaggtcatgtatactcagtatgaagacgagtcttttacaaaacataccgtcaaccccaatatgaaagaagatggtatcctgggccctatcatccgtgctcaggtccgtgacaccctgaagatcgtctttaagaatatggcctcgagaccttatagcatatatccccatggagtaacgttttcaccgtacgaggacgaggtcaatagcagcttcacttcaggcagaaataatacgatgatacgcgctgtacagcctggcgaaacatatacctataagtggaacattctggagtttgacgagccgacagagaatgacgcccagtgtctgaccagaccatattactcggacgtggatattatgagagatattgcatccggcctcataggcctgcttttaatctgtaaatcaagatctctcgacagacggggcatccagagggccgccgacattgaacagcaggcagtgtttgccgtcttcgacgagaacaagtcgtggtatctggaagataatatcaataagttctgtgagaaccctgatgaagtgaaacgggatgaccctaaattttatgaaagtaacatcatgtccactataaacggatatgtgcccgaaagcattaccactttaggcttttgcttcgatgacacagttcagtggcacttctgtagcgtaggcacccaaaatgaaattctcactatccatttcaccgggcatagcttcatttacggcaagagacacgaagatactttgactctattccccatgcgcggagagagtgtgacagtgacaatggataatgtgggcacgtggatgctaacctctatgaattcttcgccacggagcaagaagcttaggctcaaatttagggatgtgaagtgcatccccgacgacgatgaagacagctacgaaatattcgagcctcccgagtccaccgtgatggccacccgtaaaatgcacgatagacttgaaccggaggatgaagaatctgatgccgactacgattatcagaatagactcgccgccgccttgggaatcaggtcattcaggaattcatccttaaatcaagaagaagaggagtttaatctcacagccctggcactggagaacggtaccgaattcgtctccagtaacaccgatattatcgtcgggtcaaactacagttctcctagcaacataagcaagtttaccgtgaacaatctggcggagccacagaaagcccccagtcatcaacaggcaacaactgccggaagtccactgcgacatctcatcggaaagaattccgtcctaaattcatcaacagcagaacactcatccccctattcggaagatcctatcgaggaccctttgcagcctgatgttaccggcatccggttattgagtttgggggctggcgaatttaaatcacaggagcacgcgaagcacaaggggccaaaagtggagcgagaccaggctgcaaaacacagattctcgtggatgaagcttttggcccacaaggtgggccgccacctttcgcaggacacaggtagtcccagtgggatgaggccttgggaagacctgccctctcaggacacggggagcccttcacgtatgcgtccatggaaggatccacccagtgacctgttgctactcaagcagagcaactcaagcaaaatcctggtgggaaggtggcatcttgccagcgagaaagggagctatgaaattattcaggatactgacgaggacactgcagtcaataattggctgatcagcccgcagaatgcgtctagagcgtggggtgaatcaactcctctggctaacaaacctgggaagcaaagcggacatcccaagtttccaagagtgcgccacaaaagcctgcaagtgcgccaggatggcggcaaaagccgacttaagaagtcccaattcctgatcaagacccggaaaaaaaagaaggagaagcacactcaccatgccccgctgtctccacggacctttcaccctcttcggagtgaagcgtataataccttcagtgagagacgcttgaaacacagtctcgtactgcacaagagcaacgaaacgagtctcccaaccgatctcaaccagacattgccgtcgatggatttcggttggattgcgtcgttaccagatcataaccagaacagctccaacgacacaggacaagcatcgtgccctcctggcctgtaccagactgttcctcccgaggagcattatcagacatttccaatacaagatccggatcaaatgcacagtacttcagatccgagccataggtcatcctccccagaattgtctgagatgctagaatacgatcgttcacacaaaagtttcccaaccgacatcagccaaatgtccccttcatctgaacatgaggtgtggcaaacagtcatctccccagacctcagccaagtgaccctgtccccagaactgtcacagacaaacctgagccccgacctcagccacaccaccctcagtccagagctcattcagaggaacttgtcgcccgccctcggtcagatgcccatcagtcccgacctgtctcacaccacactgagccccgatttgagtcacaccaccctctcactcgacctgagccagaccaatttgtcaccagagctgagccaaaccaatttgagtcctgccctgggccaaatgcctttgtctccagacctgtcccacactaccctatcgcttgacttctctcaaaccaatctgtcacctgagctcagccacatgacattaagccccgagctgtcccagacaaatctgtcgccagcactcggccaaatgcccatatcccccgatctctcccatacaacattgtcccttgacttttctcagacgaacctgtccccagagcttagtcagaccaacctctcacccgctctcgggcagatgcccctgagtccagatccgagccacacaacactttccttggatctctcccagacaaatctgtcccctgaactgtcacaaacgaatctgtcaccggatctgagcgagatgcccctgttcgccgacctgtcccagattcccctgacacccgacctggaccagatgacgctctctcctgacttgggtgaaacagatttgtccccaaattttgggcagatgtcgctgagcccagatctgtctcaggtcaccttatctcctgacatttcggataccacgttgttgccagatctctcccagatctcgcctccaccagatctggatcaaattttttacccatccgagtcctcccagtccctgctcctgcaggagttcaatgaatccttcccatacccagatctcggccaaatgccctcaccatcgtcacctaccctgaatgacacgtttttgtccaaagaatttaaccctctagtgatagtaggcctctctaaagatggaaccgattacatcgaaatcatcccaaaggaggaagtccaatctagcgaggacgattatgccgagatcgactatgtaccttacgacgatccatataagaccgacgtgagaacaaacataaatagctctcgggatccagataatatagctgcctggtatctgcgtagtaataatggaaatcggagaaattactacatagccgctgaggagatctcctgggactactccgaattcgttcaaagggagacggacattgaggatagcgatgatattcccgaggatactacatacaaaaaggtggtgtttaggaagtacctagactctactttcactaagcgcgatcccaggggggagtacgaggaacatcttggcatcctgggcccaatcatccgcgccgaggtcgacgacgtcatacaggtccgcttcaaaaacttagcgtcccggccctattcccttcacgcccacggtctgtcgtatgaaaaaagctccgaaggaaagacttatgaggacgactcccccgaatggttcaaagaagacaacgctgtgcagcccaactcctcctatacttacgtgtggcacgcaaccgagcggtcaggtcccgagtccccgggaagcgcctgtagagcctgggcttactattccgcagtgaacccagaaaaagacattcattccggactaatcggacctctgctgatctgtcagaaaggcattctgcataaagactccaatatgccgatggacatgagagagttcgttctgttgtttatgacatttgacgagaagaagtcctggtactacgaaaaaaagtctaggtcctcgtggagactgaccagctcggagatgaagaagtcccacgagtttcatgcgataaatggtatgatttacagtctccccggcctcaaaatgtatgagcaggaatgggtacggttgcacctgctgaatatcggaggaagtcaggatatacacgtggtgcactttcacggtcagactctgttggagaacgggaacaaacagcaccagctcggcgtttggccccttttaccagggagctttaagaccctggagatgaaggccagcaaaccaggctggtggctgttgaacacagaagttggggaaaaccagagggccggtatgcagaccccattcctgatcatggacagggactgccgcatgccaatgggcctgtctacgggcataatctccgatagtcagattaaggcctctgagtttctgggctattgggaaccccggctcgcgaggctgaacaacggaggatcttataacgcatggtccgttgagaaactcgcagcagaattcgccagcaaaccatggatccaggttgacatgcagaaagaagtgatcatcactggcatacaaactcagggcgcaaagcactatctcaagagctgttacaccacagagttttacgtggcttatagcagtaatcagatcaactggcaaatttttaaagggaattccacccgaaatgtgatgtactttaacgggaactcagatgcctctaccattaaggaaaaccaattcgatccacctatagtcgcccgttatattcgcatctctccaacccgggcttacaaccggcctacactcaggttagaactccagggctgtgaagtgaatggatgctccacgcccctcggcatggagaatggaaagatcgaaaacaagcagataaccgcttcctcatttaagaagtcatggtggggcgactattgggagccgttccgagctaggttgaatgcccaaggcagagttaatgcctggcaggcaaaggcgaataacaacaaacagtggttggagatagatctgctcaaaatcaagaagataacagcgattatcacccaaggctgcaagtcgctctcatcggagatgtacgtgaagagctataccatccattactctgagcaaggggtggagtggaagccatatcggttgaaatccagcatggtagacaagatcttcgaggggaacacaaacacgaaaggccacgtgaaaaacttttttaatccccccataatttcaagatttatcagggtgatccccaagacctggaatcaaagtatagcacttcggcttgagctctttgggtgcgatatttac

SEQ ID NO: 9049 - DNA, 6672 bp, Artificial Sequence
  Description of Artificial Sequence: Synthetic coding sequence
atgttccccgggtgccctcgactgtgggtcctagtggtgcttggcacctcatgggtaggctggggctcacaaggcacggaggcagctcagctccggcagttctatgtggccgcccaggggatttcatggagctacaggcccgaacctactaattcttctctaaacctcagtgtcaccagctttaaaaagatagtgtaccgggaatacgagccatattttaagaaagagaaaccacagtctaccatctctgggcttctcggaccaactctctatgccgaggtgggcgatattatcaaggtccatttcaaaaacaaagctgacaaacctctctcaattcacccacaagggatccgttactcaaaactctcagagggtgcctcttacctcgaccatacctttcccgctgaaaagatggatgacgccgtggcccccggccgcgaatatacatacgaatggtctatttctgaggattccggcccgactcacgacgaccctccctgcttgacgcacatctactattcccacgaaaacctgatcgaggactttaactccggccttatagggcctctgctaatttgtaagaaaggcacacttacggaggggggcacgcagaagacctttgacaaacagattgtgctgctgtttgccgttttcgacgaatcgaagagttggtcgcaatcaagctccttaatgtacacggtgaatggctatgtcaacggtacaatgccagacattacggtgtgcgcacacgaccatattagctggcaccttttaggaatgtcgagtgggcccgagctgttctctatccattttaacggacaggtgctggagcagaaccaccataaagtctccgcaattactttggtttctgcaaccagtacgactgcgaatatgacggtggggccggagggcaaatggataatatccagcctcacccctaagcatctccaggccggaatgcaagcgtatatcgatatcaagaactgtccaaagaagactcggaacctgaagaaaattactcgggaacagcgccgccacatgaagcggtgggagtacttcattgcagctgaggaagtaatttgggactacgcccccgttatccccgctaacatggataagaagtaccgatcccaacacctagacaacttctcaaaccagatcggaaaacattacaaaaaagtgatgtacacacagtatgaggacgagtcatttaccaaacacaccgtcaatccaaacatgaaggaagatggcatcctgggcccaattattagagctcaggtgcgggacactctcaaaatcgttttcaaaaatatggcatcacggccatacagcatatacccccatggagtgaccttctccccatacgaggatgaagtgaactcttcttttacatctggccggaacaatacaatgattcgagccgtacagccaggcgagacctacacctacaagtggaacatattggagtttgatgagccaactgaaaacgatgctcagtgtttgaccagaccatactattctgacgtggacattatgcgcgacatagctagcggactaattggactgctgctgatttgcaaatccagaagccttgaccggaggggcatacagcgggcggccgatatcgagcaacaagcagtgtttgccgtgttcgacgagaacaagagctggtacctagaagacaacatcaataagttttgcgagaatcctgacgaggtgaagagagacgacccgaaattttacgagagtaacatcatgtcaacaattaatggctatgtacccgagtcaatcacaaccctggggttctgtttcgacgacacagtgcagtggcatttctgttcagtcggcacacagaatgagattctcaccatccatttcacagggcatagcttcatttacggcaaacggcatgaagatacattgactctcttccccatgagaggtgagagcgttacagttaccatggataacgtgggaacctggatgctcacttctatgaattcttcccctcggtccaaaaaactacgactgaagtttagagatgtgaaatgcatccctgatgatgatgaggacagttatgagattttcgagcctccagagagcactgtcatggcaactagaaaaatgcacgatcgactggaacctgaggatgaagaatcggacgctgactacgactatcaaaatagactcgctgcagccttaggcattaggtcgtttcgaaatagttccctgaatcaggaagaggaggagttcaacctgaccgcccttgctttagaaaatggtaccgagtttgtgtcctccaatacagacattatagtcgggtctaactacagttcgccttcaaacatttctaagtttactgtgaacaatctggcagagcctcaaaaggctcctagtcaccagcaggctaccaccgccgggtctccactgcggcacctgatcggcaagaattctgtcctcaattctagcacagctgagcattccagcccatatagcgaggaccccatcgaagatccattgcagccagacgtaacaggtatccggctcttgagccttggcgctggggagtttaaatcccaggagcacgcaaaacacaaaggccctaaagtggaaagggaccaggccgctaagcacagattttcttggatgaagttgctggctcacaaggtggggagacatctgtctcaggacacaggcagcccgagcggtatgagaccctgggaggacctaccaagccaggacaccggcagcccctccagaatgcggccctggaaggatccaccttccgatctccttctcttgaaacagagcaacagtagtaaaatcctcgtggggagatggcatctggcatccgaaaagggctcttatgagattatacaggatacagacgaggataccgccgttaataactggttgatttctccccagaatgcgagtagggcctggggcgaatcgaccccactggctaacaagccggggaagcagtccggacaccccaaatttccaagggtgaggcacaaatctctccaggtgcggcaggacggtggcaaatccaggctgaaaaaatctcagttcctgataaaaacccggaaaaagaaaaaggagaaacacactcatcatgctccactgtcacctcgaactttccacccactgcggtcggaggcatataatactttctctgagaggcgccttaagcacagcctggttctgcataagagcaatgaaactagcctccccaccgatttgaatcagactctgccctcaatggattttggctggatagctagtcttcctgatcataatcagaattcaagtaacgacaccggccaggcctcatgccctcctggcctgtaccaaaccgtgccacccgaggaacactatcaaacattccccatacaagacccagatcagatgcacagcacaagtgacccgtcccaccgatcgtcatcccctgaactgtccgagatgctcgagtatgaccggtcccacaaatcctttccgacagacatcagtcagatgtccccttcaagcgagcacgaagtatggcagacagtaatttccccggatctgtcacaagtgaccctctccccagagttatctcagaccaatttgtctcctgacctttcccatacaaccctctctcccgaactgatccaacgcaacctgagcccagcgctcggccagatgcctatctctccggatctaagccatacgacactgtccccagacttgagccacactactctgtctctagacctctctcagaccaacctctctcctgaactcagccagaccaatctatcaccagctcttggccaaatgcctctgagcccggacttgtctcacacgaccttgtcactggattttagccagaccaacctctctccagaattatcacacatgactctgtctcccgagctgtcgcaaacgaacctgtcacctgccctcggccagatgccaatcagccctgatctgagtcatacgaccttgagtttggattttagccagaccaatctgtctcccgaactcagccagaccaatttgtctcctgctcttgggcagatgcctctgagccccgacccctcccacaccacactgtcacttgacctgtcccagactaacctgtctcccgaactgtcccaaactaatttgagcccagatttgtccgaaatgcctctgtttgccgatctaagtcagattccacttactccagatctggaccagatgaccttgagtcccgaccttggagagacagacctctctcctaatttcggccagatgagcctgtccccagatctgtcccaggtgactttgtctccagacatatccgacaccacccttctgccagatttatctcaaatcagtccacctcccgatctggaccaaattttctatccctcagagagctctcagagtcttctcctgcaagagttcaacgagtcttttccctaccccgaccttggtcaaatgcctagccccagcagccctacacttaacgataccttcctatccaaggaattcaatcccctggtcattgtgggactgtcaaaagatgggactgattatatcgagatcattcctaaagaagaggtccagtccagcgaggatgactacgcagaaattgactatgtgccatatgacgacccatacaagacagacgttcgcacaaacataaattccagcagagatccagacaacatcgccgcctggtacttgaggtcaaacaatggaaatcggagaaattattatatcgccgctgaggaaatctcttgggattacagcgagttcgtccaacgtgaaaccgacatagaggactccgatgatattcccgaggatactacatacaaaaaggtggtattccggaaatatctagattccaccttcaccaaaagggaccccagaggcgaatatgaggagcacctcggtatccttggacccattatcagggcggaagttgacgacgtcattcaggtccgttttaagaacttggcttctaggccctattccctgcacgcacacgggctgtcatatgaaaagagctccgaaggcaagacctatgaagatgattctcccgaatggtttaaagaagacaatgcagtgcagccaaattcctcctacacttatgtctggcatgccacagaaaggtctgggcccgaatccccagggtcagcctgcagggcttgggcttattattccgccgtgaatccagagaaagacatacacagcggactgattggaccgctgctcatctgtcaaaagggcatacttcataaggatagcaatatgccgatggatatgcgagagtttgttttgctgtttatgaccttcgacgagaaaaagtcttggtattatgagaagaagagcagatcatcttggcggctcacctcgagcgaaatgaagaaatctcatgagttccatgccattaacggtatgatatactcactaccagggctgaagatgtatgagcaggaatgggtaaggctgcatctcttgaatatcgggggttcgcaagacattcatgtcgtgcactttcatggtcagacactgctcgaaaacggcaataaacaacaccagctgggggtatggccgctcttacctggatccttcaagaccttggaaatgaaagcatctaaacccggctggtggttgttgaacaccgaggttggggagaaccagcgcgccggaatgcagaccccctttctcatcatggatagggactgtagaatgcccatgggtcttagtacgggaatcatttctgatagccaaatcaaagcctcggagtttttgggctactgggaacctagactggctaggttaaataatgggggttcatataatgcttggtcagtggaaaagttggctgccgagttcgcatccaagccatggatccaggtggatatgcaaaaggaagttattatcactggcatccagacccaaggtgctaagcattatctaaagtcctgttacacaacagaattctacgtagcttactccagcaaccagatcaattggcagatctttaagggaaactctacgcgcaatgtgatgtactttaacggtaacagtgatgcatccacaatcaaggagaaccagttcgatcctcccatcgtcgcacgctatattcgcatttcccccactcgtgcatataatcgccctaccttgcggctggagctccaggggtgcgaagtgaacggttgttctacccccctggggatggagaacggcaaaatagagaataagcagatcacagctagctcgttcaagaaatcctggtggggggactactgggaaccattcagagcccgtcttaatgcccaaggccgggtgaacgcctggcaggcaaaggccaacaacaacaagcagtggctcgagattgatctcttgaaaatcaaaaaaatcacagcaatcataacacagggatgcaaatccctcagcagtgagatgtatgtaaagagttataccattcattactccgaacagggggtggagtggaagccctatcggctgaaatcctccatggtggacaagatattcgaagggaataccaacacgaagggtcacgttaagaacttttttaaccctcccataattagccgattcattagggtcattccaaagacttggaaccaaagcatcgccctgagactcgagctgttcggatgtgacatttat

SEQ ID NO: 9050 - DNA, 6672 bp, Artificial Sequence
  Description of Artificial Sequence: Synthetic coding sequence
atgttcccaggttgtccaaggctgtgggttctggtagtgctgggaacctcttgggtgggttggggttcacagggcacggaggctgcccagctccgacagttttacgtcgccgcacagggcatcagctggtcctaccgaccagaaccaacgaatagcagcctgaatctttcggtgaccagtttcaagaagattgtgtaccgcgaatatgagccttacttcaagaaagagaagccgcaatccacaatttccggactactcggaccgacactatacgccgaggtaggagatatcataaaggtccactttaagaacaaggccgacaagcccctctcgattcacccacagggcatccgctattcgaagttgagtgagggtgccagttaccttgaccatacattcccagcagagaagatggatgatgcggttgctcccggacgagagtacacctacgaatggtcgatctcagaggattccggtccaacccatgatgatcccccctgtttgacccatatctattactcccatgagaacctgatagaagatttcaacagcggcctaatcggaccccttcttatatgtaagaagggcacgctgacggagggcggtactcagaagacgttcgataagcagatcgtacttttgttcgcagttttcgatgaatctaaatcctggtcccagtcgagctccctgatgtataccgtgaatggctacgtcaacggcaccatgcccgatatcacggtgtgtgctcatgatcacatttcgtggcacttgctgggtatgtcgagtggccccgagttgttctcgatccacttcaacggacaggtccttgagcagaatcaccacaaagtgtctgctataaccctcgtgagcgctacaagcaccacggcgaatatgacggttggccctgagggaaagtggatcatatcctccctgacgccgaagcatcttcaggccggaatgcaggcgtacatagacatcaagaactgtcccaagaagacccgcaatctgaagaagattacgcgcgagcaacgccgtcacatgaaacgctgggaatatttcatagccgcggaagaagtgatctgggattacgccccagtgattccggccaatatggataagaagtaccgctcccagcacttagataacttcagcaatcagatcgggaagcattataagaaggttatgtatacccagtacgaagatgagtcgttcacgaagcacaccgtgaatccgaacatgaaggaggatggtatcctaggaccaattatcagggcccaggtgcgcgatacgcttaagatcgtattcaagaacatggcttctcgcccatattccatctacccccacggcgttactttctcaccatacgaggacgaggtgaattcaagtttcacgtcgggccggaataacaccatgatcagggccgttcaaccaggagagacctacacctataagtggaacatattggaattcgatgaaccaacggagaacgacgcccagtgtctgacccgaccctattacagcgacgtggatatcatgagagacattgcgagtggccttattggccttctgttaatctgtaagtcacggtctctcgaccgccgaggaatccagcgagctgctgatatcgagcaacaggccgtgttcgcggtattcgacgaaaataagagctggtatctggaggataacatcaacaaattttgcgagaacccggacgaagttaagcgcgatgatcccaagttctacgagtcaaatatcatgtccacaatcaatggctacgtgccagagagtattaccaccttgggtttctgcttcgacgacacagtgcagtggcacttctgcagcgtgggcacccagaacgagattttgaccattcactttactggccatagctttatttatggcaagcgccacgaggatacgttgacgctgttcccaatgaggggcgagtcagttacagtcacaatggacaacgtcggtacatggatgctaacttccatgaactcttccccacgctcaaaaaagctgcgcttgaagtttagggacgttaagtgcatcccagacgacgacgaggactcgtacgaaatatttgagccaccagagtccactgtcatggccacgaggaagatgcacgatcgtctggagcccgaggacgaagaatcggatgctgattacgattaccagaacaggctggcagccgcacttggcatcagatccttccgtaactcctcgttgaaccaggaagaggaagaattcaacctgacagccctggcactggaaaacggtacagaatttgtttcctcgaacaccgacataattgtgggctccaactactcttcaccatcaaatatttcgaagtttaccgtgaataacctggccgagccacagaaggcaccatcccaccagcaggccactaccgcaggatcccccctgcgtcatttgataggcaaaaatagtgtattgaactccagcaccgctgagcacagctccccgtatagcgaagacccaatcgaggaccccttacaacccgatgttactggcatccggcttctctccctgggcgccggcgaattcaaaagtcaggagcacgccaaacataagggaccgaaggtggagagggatcaagcggccaaacatcgcttcagttggatgaagttgctggcccataaggtcggccggcacctgtcccaggacacaggctcgccctcgggcatgcgtccttgggaagatctgccctctcaggatacagggtcaccgtcacgcatgcgtccgtggaaggacccaccgagcgatcttctactcctaaagcagagtaactccagcaagatcctagtgggtcgctggcaccttgcctccgagaaaggatcgtacgagataatccaggacactgacgaggacacagccgttaataattggctaatttcaccgcagaacgcctccagggcttggggtgagtccactccactcgctaataagccaggcaagcagagcggacatccaaagtttccgcgtgttaggcacaagtctttgcaggtgcgacaggacggtggtaagtctcgcttgaagaagtctcagttcctgataaagacacgaaagaagaaaaaggaaaagcatacgcatcacgcaccgctatcaccaaggacgttccatcccctgagaagtgaggcatacaacacattctcagagcgtcggctcaaacattcgctggtgctccataagtccaatgaaacgtcgttgcctacagatctgaatcaaacccttccgagcatggacttcggctggatcgcatccctcccggatcacaaccagaactcatcgaacgacaccggacaggcaagctgcccacctggcctgtaccagaccgtgccgcccgaggaacactatcaaacctttccgatccaggatccggatcagatgcatagcaccagtgacccctctcaccgaagctcttcccctgagctgtccgagatgttggagtacgatagaagccacaagagtttcccgacagacataagccaaatgagcccttccagcgagcatgaggtttggcagacggtgatatcccccgacctctcgcaggtgacgctgtctcccgagctttcacagactaatttgagtcccgatctgagtcacaccaccctatcgccagaattgattcaacgaaacctgtcgccggcacttgggcaaatgcctatatcacctgatctatcccataccaccctgagcccagatctcagccacaccacattgagcctggacctcagtcagaccaacctgtcccccgagctgagtcagactaatctgagcccagcacttggtcaaatgcccttgtcgccggatctcagccacaccacgctgagcctagatttctctcagaccaacctatcacctgagttgtcccatatgactctgagtcctgagctgtcgcagacgaatctatcgcctgccttaggccagatgcccatctctcccgacttatcccataccaccctgtcgctcgacttctcccaaacgaacctgtcgccagagctgtcgcagacgaacttgagcccggctctgggacagatgccattgagtcccgatccgtcgcataccacccttagcctcgatctaagtcagaccaatctttccccagaactgagtcagactaacttgagtcccgatctgagtgagatgcccctgttcgccgatctgtcacagatccctctcacgccggacctggaccagatgaccttgtcacccgacctaggcgagaccgatctatccccgaactttggccagatgtccctgtcgcccgatctgtcccaggttacgctgtcgcccgatatatcggacacaacactgcttcccgatctgagccaaatatctccccccccagacctggatcagatattctacccatccgaaagctcgcaaagtctgctgttgcaagagttcaacgagtccttcccctaccccgacctgggccagatgccctcgcccagctcgcccaccctaaacgacacgtttctgagcaaagagtttaaccccctagtgatcgttgggctgtcaaaggacggcacggactatatcgagatcatccccaaggaggaggtccagagctcagaggacgactatgccgagatcgattacgtgccttatgacgacccctataagacggacgtccgcacaaatataaactcgtctcgtgaccctgacaacatcgccgcatggtacttgcgatccaataatggtaatcgccgcaattattacattgctgccgaggaaatttcctgggattactcggagtttgttcagcgtgaaaccgacatcgaggacagcgacgatataccagaggatacgacatacaaaaaggttgtgttccgaaagtatctggacagcactttcaccaagagagatccgcgtggcgagtacgaggaacacctcgggattcttggccccatcatacgtgccgaggtggacgacgtcatccaggtgcgctttaagaacctggccagcagaccgtacagccttcacgctcatggcttgtcctacgaaaagagttcggagggtaaaacgtacgaggatgatagcccagagtggttcaaggaagacaatgcagtccaacccaactcatcgtatacgtatgtgtggcatgcgacagagcggagcgggccagagtcgccgggaagtgcgtgtcgggcatgggcgtactactcagctgtcaaccccgagaaagatatccactcgggactcataggcccactacttatctgccagaagggcattctccataaggattcgaacatgccaatggacatgcgggagtttgtgttgctgtttatgacattcgatgaaaagaagagctggtactacgaaaaaaagtcacgttcctcatggcgtctgacgtccagcgagatgaaaaagagccatgagtttcatgctataaatggaatgatttactcgctccccggtctaaagatgtacgagcaagagtgggtcaggctacatctcttgaatattggtggctcgcaggatatccacgtggtacacttccatggacaaacgctgttggagaacggtaataaacaacaccagctcggcgtatggccgcttctgccgggcagtttcaagacgctagagatgaaagcaagcaagccgggctggtggctgctgaatacagaggtgggagagaaccagcgcgcgggcatgcagacaccatttctcattatggatcgcgattgtagaatgccaatggggctgtcgaccggcataatttccgactcccagataaaggcctccgagttcctggggtactgggagccacgccttgcgcgcctgaataacggcggtagctacaacgcttggtccgtcgaaaaactggctgcggaattcgccagtaagccgtggatccaagtggatatgcaaaaggaagtcataattacaggcatccagacccaaggtgccaagcactacctcaagtcttgctataccacagaattctacgttgcttactcctcgaaccaaattaattggcagattttcaaaggtaactcgacgaggaatgtcatgtactttaatggcaacagcgatgcctccacgatcaaagagaaccagtttgacccgccaattgttgcgcgttatatccgcataagcccgactcgagcctacaatcggccgacgcttcgcttagaactccagggatgcgaagttaacgggtgctccactccattgggcatggagaatggcaagattgagaataagcagatcacggcatcatcttttaagaaaagctggtggggcgattactgggaaccatttcgagcgcgtttgaacgcccaaggccgtgtgaacgcgtggcaagccaaggctaataacaataaacaatggttagaaatagaccttctgaagatcaagaaaatcactgcgataatcactcagggctgtaagtctctctccagtgagatgtacgtgaagagctacaccatccactactccgagcagggagtagaatggaagccataccggctgaaaagctccatggtggataagatcttcgagggcaatacaaataccaaaggacatgtgaagaacttctttaaccctccaattatcagtaggttcattcgcgtgatacctaagacctggaatcaaagcatagcattgcgcttagaactgtttggctgcgacatatac

SEQ ID NO: 9051 - DNA, 6672 bp, Artificial Sequence
  Description of Artificial Sequence: Synthetic coding sequence
atgtttccaggatgtccgcgcttatgggtgctggtcgtgctgggtacatcttgggtggggtggggatcacaaggaacggaggccgctcaactgagacagttttacgtagcggcacaaggaatctcttggtcatatcgcccggaaccgacgaactcatcattgaacttgtcagtcacgtcttttaaaaaaattgtttatcgtgaatatgaaccgtactttaaaaaagaaaagccgcagtctacaatttcaggtcttctggggccgaccttatatgcagaagtaggggacattataaaggtgcactttaagaataaggctgataagccgttatctatccaccctcaggggattcgttactccaaacttagcgaaggagcatcatacttagatcatacctttccggcggagaaaatggatgatgctgtggcgcctggccgtgagtatacgtacgaatggagcatttcagaggattctggccctacacatgatgatcctccatgtttaacgcacatttattattcccatgaaaacttgattgaagattttaacagtggtttaatcggtcctctcttgatttgcaaaaaaggtacgttaacagaaggagggacacaaaaaacatttgacaaacaaatcgtcttgctttttgccgtgtttgacgagtcaaaatcttggtcacagtcatcatctctcatgtatacagtgaatggctatgttaatggcaccatgccggatatcacagtctgtgcccatgatcatatttcatggcatctcctggggatgtcgtcaggccctgagttattttcaattcattttaatggtcaggttttagaacaaaatcaccacaaagtcagtgcaattacgcttgtaagcgcaacatcgacgacagctaacatgacagtcggccctgaaggaaagtggattatctccagcctgactccgaaacatttgcaagccggtatgcaagcgtacattgatattaagaattgtcctaaaaaaacgagaaaccttaaaaagatcacgcgcgaacagcggcggcatatgaaacgctgggaatattttatcgcggcggaggaagtcatttgggactacgcgcctgttattccggcgaacatggataaaaaatatcgcagccaacacctggataatttttctaatcaaatagggaaacactataaaaaagtgatgtacacacaatatgaggatgaatcttttacgaaacatacagtgaacccgaacatgaaagaagacggcatacttggacctatcatacgcgcgcaagtgcgcgacacactgaagatcgtgtttaaaaacatggcaagccgcccgtatagcatctatcctcatggagtcacatttagtccttatgaagacgaagtgaacagcagctttacctctggtcgcaacaacacaatgattagagctgttcagccgggtgaaacatacacatacaagtggaatatccttgaatttgatgaaccgacagaaaatgatgcacagtgcctgactcgtccatattattctgacgtggatatcatgagagatatcgcttcaggactcatcggcttgctcttaatatgtaaatctcggtccctggacaggagaggcatccagcgtgctgcggatattgaacaacaggccgtatttgcagtctttgatgagaacaaatcttggtatttggaggataacattaacaaattttgtgaaaatcccgatgaagtgaagcgtgacgacccgaaattctatgagtcgaacattatgtctacgattaacggctatgtaccggagtccattacaacattgggattttgctttgatgatacggtccaatggcacttctgtagcgtgggaacacagaacgagatcttgacaattcacttcacaggacatagtttcatttatggaaaaagacatgaagacacgcttacgctgtttccgatgcgcggcgaaagcgtaactgtcacaatggataatgtcggcacctggatgttgacgtctatgaactctagcccacgcagcaaaaagctgcgcctgaaatttcgtgacgttaagtgcatccctgacgacgatgaagattcgtacgagatctttgaacctccggaatcaactgttatggccacgcgtaaaatgcatgatagactggaaccagaagatgaagaaagtgatgcggattatgattaccaaaatcgcttagctgccgcactcggaatacgctcttttagaaactcttcactgaaccaggaagaagaggaatttaatctaacggcactagccttagaaaatggtacagaatttgtgagctccaacacagacataatcgttggaagcaattactccagcccgtctaatatcagtaaatttaccgtaaataatcttgcagaaccccaaaaagccccgtctcaccaacaggcaaccacggcaggttcgcctcttagacaccttattggcaaaaattctgtgttgaactctagcaccgcagagcactcatcgccttatagtgaagacccaatcgaggatcccttacagccggacgtcacaggtatcagattactttctcttggagccggagagtttaaatcacaggaacacgccaaacataaaggaccgaaagtagagagagatcaggcggctaaacatcgtttctcatggatgaaattgcttgcccataaagtaggacgccatctctcacaagataccgggagcccgtctggcatgcggccttgggaagatctcccttctcaagatacaggttccccgtcaagaatgcgtccctggaaagaccccccatccgacttgcttttattaaagcagtcaaactcatccaaaattcttgtcggcagatggcatttggcgtccgaaaaggggtcttacgaaattattcaggatactgatgaagacacagctgtgaataattggctaatctctccacagaacgcaagtcgcgcgtggggagaatcgactccgctagctaacaaaccgggcaaacagtcaggacatccgaaattcccgagggtgagacataagtctctgcaggtacggcaggatggtggcaaatcgagattaaaaaaatcacaatttttaattaaaacacgtaaaaagaaaaaggaaaaacacacccatcacgcaccgttatctccgcgcacatttcatccactgaggagcgaggcctacaatactttctcagagagacggctaaaacactctctggttctccataaatccaatgaaacatcactacctacggacttgaaccaaactttgccttctatggattttggatggatagcatccctgccagatcataaccaaaattcttcaaatgacacaggacaggcctcttgcccgcctggcttataccaaaccgtgccaccggaagagcactatcagacatttccgattcaagatccggatcaaatgcatagcacgtcagatccttcacatcgatccagctctccggaactttctgagatgctggaatacgaccggtcacataaatcatttccgacagatatctcgcagatgagcccgtcgtcagaacacgaagtgtggcagacggttatttctcctgatttgagccaagtgacgctgagcccagaactttctcagacgaatctgtcaccggatctctcccacactacgctgtcaccagaattgatccaacgtaatctctcgccggcattaggacagatgccaatctctccggacttgtcccacacgacgctgtcacctgatttaagccatacaactttgtccttggatttgtcacagacaaatctttctccagagttgagtcaaaccaatctgtctccggcgttgggtcagatgccgctttccccggatctgagtcacactacattatcgctcgacttctcgcaaacaaatctatcgccggagctctcacatatgacactaagccctgaactttcccagactaatttgtctccggcacttggacagatgccaatttcacccgacttgtctcacacgacgcttagcttagatttttcacaaacgaatcttagccctgaactgtcacaaacaaatctctctccggccttaggccaaatgccgctttcaccagatccttcacacacgacgttgtctctcgacttatcccagactaatttatctccggaactgtcccagacaaacttatcaccggatttatcagagatgcctttattcgccgacctctcacagattccgttaacaccagacttggatcaaatgactctgtcaccggacctaggggaaacagacctgagtccgaacttcggccaaatgtcgctgtctcctgacttatctcaggtcacgttgtccccggatatttcagatacgacattgttgccggatctttcacagatttcaccaccgccagacctggaccagattttctatccgtccgaatcctcacaatcactgctgcttcaggaatttaatgagtcttttccgtatccggacttaggccaaatgccttctccatctagcccgacacttaacgatacgttcctctcaaaagaatttaatccgctagtcattgtaggactttctaaagatggcacggattatattgagattatcccgaaagaggaagtgcagagttccgaagatgactacgcagaaatcgattatgtcccgtatgacgatccatataaaacggatgttcgtacaaatattaattcttctcgtgatccggacaatatcgctgcgtggtatttacggagcaataacggaaatcgccgaaattactatatcgcggcagaagagatttcatgggactattcggaatttgtgcagcgggagaccgatattgaagattcagacgacattccggaggatactacctacaaaaaagttgtgtttcgcaagtatctggatagcacattcacgaagcgtgatcccagaggggagtatgaggaacatttgggtattttaggtcctataattcgcgcagaagtggacgatgtcattcaagttaggtttaaaaaccttgcatcgaggccgtacagcttacatgctcatggattgtcatatgaaaaatcttcagagggaaagacatatgaagacgatagccctgaatggtttaaagaagataatgcagtccaaccaaattcatcttacacgtatgtttggcatgctacggaacggtcaggcccggagtctcctggatcagcgtgtagggcttgggcgtactattctgcggtgaatccggaaaaagatattcattccggattgataggccctctacttatctgtcagaagggtattctgcataaagattcaaacatgccaatggatatgcgagagtttgtcttgctgttcatgacgttcgacgaaaaaaaaagctggtattatgaaaaaaaatctcgatcatcttggcggttgacatcctcagagatgaaaaaatcgcatgaatttcacgcgataaatggaatgatatacagtttaccgggattgaaaatgtatgaacaagaatgggtgagattgcacttgctcaatattgggggcagccaagatatccacgtggttcactttcacggccagacgctactggaaaatggtaataaacaacaccaactgggagtctggcctctgctgcctggctcttttaagacactggagatgaaagcttctaaaccaggatggtggcttcttaacactgaggtaggggaaaatcaaagggcgggaatgcagaccccatttctgattatggatagagactgcaggatgccaatgggcttatctacgggcattatctcagattcccagattaaagctagcgagttcctgggctattgggaaccgagattggcacgccttaataatggagggagctataacgcgtggtctgtcgaaaagctggccgccgaatttgcaagtaaaccatggattcaagttgacatgcaaaaagaagtcatcattacgggcatacagactcagggcgcgaagcattatctgaaatcttgctatacaacagagttctatgttgcctacagcagtaatcaaataaattggcagatctttaaaggcaattctacacgcaacgttatgtatttcaatggtaactccgacgcatccacgattaaggaaaaccaatttgaccctccgattgtggcaagatatatcaggatcagcccgactcgggcttacaacaggccgacgctgagactagaactccaagggtgcgaagtgaacgggtgttctacaccactgggcatggaaaatggaaaaattgagaataagcaaattaccgcatcgagttttaagaaatcttggtggggagattattgggagcctttccgcgcacgactgaacgcccagggccgggtgaatgcatggcaagcaaaagcgaataacaacaaacagtggctggagatagatctcttaaaaatcaagaaaattacggcaatcatcacgcaaggctgtaagtctctgtcttcagaaatgtacgtcaagagctatacgatccactattcggaacaaggagtagagtggaaaccgtatcggttgaaaagctcgatggtagataaaatctttgagggaaatacaaatactaagggccatgtgaagaactttttcaaccctcccattatttctaggtttattagagtcatccctaaaacgtggaatcagagcatcgcactgagactcgaactttttggatgcgatatttat

SEQ ID NO: 9052 - DNA, 6672 bp, Artificial Sequence
  Description of Artificial Sequence: Synthetic coding sequence
atgtttccaggctgtcctcgcctgtgggtactagtggtcttgggcactagctgggtcgggtggggatcccaggggaccgaagctgcccagctgaggcagttctatgtcgcggcccaagggatttcctggtcttaccgtccagagccaacaaactcctcactgaacttgtccgtgacatcattcaaaaagatcgtgtaccgggagtatgaaccatactttaagaaggagaagccacagagtacaatctctggactgctggggccaactctctatgccgaggtcggggatatcattaaggtgcacttcaaaaacaaagcagataaaccgctgtccatccatcctcagggtataaggtattccaagctttcggaaggggcttcatacctagatcatactttccccgccgaaaaaatggacgacgccgttgcacccggccgagagtacacctatgaatggtcaatctctgaagacagtggacccacacatgacgacccgccttgtctgacgcatatatattatagccacgaaaatcttatcgaagacttcaattctggcctcatcggacctcttttgatttgcaagaaggggacactgacagaagggggcacccagaaaaccttcgacaagcagatcgtgctgctgttcgccgttttcgatgagagtaaatcttggagccagagttcctccctgatgtacactgtgaacggatatgtcaacggcacaatgccagacatcaccgtctgcgcccacgaccatatctcttggcatctcctcggcatgtcttccgggcccgagttgttctctattcattttaatgggcaggtgctcgagcaaaaccatcataaggtttccgcaatcactctagtgagcgctacgtccacaactgccaacatgaccgttggccctgagggcaagtggattatctccagcttgacccctaagcatctgcaggcgggaatgcaagcctacattgatatcaagaattgccccaaaaagactcgcaatctcaagaaaattactcgggagcagcgtaggcatatgaaacggtgggaatacttcatagccgcagaggaggtcatttgggattacgccccggtgatccccgccaacatggacaagaagtatcgctcgcaacacctcgacaatttctccaatcagattggaaaacattacaagaaggtaatgtacacgcaatatgaggacgaatcattcacgaagcacaccgttaaccctaacatgaaggaggatggaatcttaggccctatcatcagagcccaggttagagacactttaaaaattgtattcaagaacatggctagcagaccgtactctatttacccacacggcgtgacctttagcccttacgaagatgaagtaaattccagctttacatcaggtcgaaacaacaccatgatcagggcagtgcagcccggagagacttatacgtacaaatggaacatcctcgaatttgatgaacccaccgagaacgatgcacagtgtctcaccagaccatactattccgacgtggatatcatgcgagacattgcaagcgggctcataggactgctactgatctgtaaatccagaagtctggacagacgaggtattcaacgcgccgctgacatagagcaacaggcggtcttcgccgtttttgacgagaataagtcatggtatctggaagacaacatcaataaattttgcgaaaaccctgatgaagtgaaacgagacgaccccaaattctacgagtctaatataatgagtacaatcaatggttacgtccccgagagtatcaccacgcttgggttctgttttgatgacactgtacaatggcatttctgctccgtcggtacacagaacgagattcttactatccactttactggacacagttttatctatggcaaacggcacgaggatacccttaccctctttccaatgcggggggagtccgtgacagtgacgatggacaatgtggggacttggatgttaacctccatgaattcttcccctcgttctaaaaagttgcgactgaagttccgcgatgttaagtgtattcccgatgatgatgaagattcctatgaaatcttcgaacctcccgaaagtactgtcatggctaccaggaagatgcacgatagactggagccggaggatgaggagtccgatgccgactacgattaccaaaacagactagcagctgctcttggtatacggtctttccgcaacagttcactgaaccaggaagaagaagaatttaatctgactgccctggccctcgagaacggaacagagtttgtgtcatctaacactgatattatcgtcggtagcaactatagtagccctagtaacatatccaagtttacggtgaataacctggccgagccccagaaggctccgagccatcagcaagcaactacagcaggtagccccctcaggcacctaataggaaagaactcagtgcttaacagctcaacagcagagcacagttcaccttattccgaggaccctatcgaagacccgctgcagcccgatgtgacaggcatccgactccttagtttgggtgctggagagtttaaatcgcaagaacatgccaaacacaaagggcctaaagtggaaagagaccaggcagcgaagcaccggttttcctggatgaagctgctagcacataaagtggggagacatctctcccaggatactggcagtccttctggcatgagaccatgggaagatctgcccagccaagatacgggatccccgtctcggatgcgtccatggaaggatccgcctagcgaccttctgttgctgaagcagagcaactccagtaagatcctggtgggacggtggcatctcgcaagcgaaaaaggtagctacgagattatccaggatacagacgaagatacagccgtgaacaactggctgatctccccgcaaaatgcatctagggcttggggcgagagcaccccactggccaataagcccggtaaacagagcggacaccccaaattccctcgcgtgagacataaatctctgcaagtccggcaggacggaggcaagtctaggcttaagaaatctcagtttctcattaagacacgcaagaagaaaaaagaaaaacacactcatcacgcccccctgagcccgaggacgttccaccccctccgctcagaagcatacaataccttcagcgaacggcggttaaagcactccctggtgctccacaagagcaacgagacctcattgcccacggacttgaaccagacactcccttcaatggattttggctggatagcgtctctgcctgatcataaccaaaattcctctaacgacacggggcaggccagctgccctcccgggctttatcagaccgtaccgccggaggagcattatcagacgttccctatccaggatcccgatcagatgcattcgactagtgacccttcgcatagaagctccagcccagagctgagtgaaatgctcgagtacgatagaagtcataagagctttcctactgacattagtcagatgtctccgtcatctgaacacgaggtatggcagaccgtgatcagccccgatttatcccaggtgactctgtcacctgagcttagtcagacaaacctctcccctgacttgtctcatactacactatcgcccgagctgatacagcgcaatctgagcccggccctagggcagatgcccattagccccgacctctctcacaccactctcagtccagatttgagtcacactacgctctcgttggatctgagtcagacaaatttgtctccagagttgtcccagacaaacctgagccccgcactgggccaaatgcccttaagccctgatctgtcccacacgacgctatccctggatttcagtcaaaccaacctcagcccggagctcagtcacatgactctctcacccgagttgtctcagaccaatctgagcccagctctcgggcagatgccaatctcacccgatttgtcccacacaactctgtctctggacttcagccagacaaacctctcaccagaattgtcacagactaacttgtccccagcgctgggtcagatgcccctgagcccggatccgtctcacacgactttaagcctggacctaagccaaacaaatctgtctcccgaactgtcccaaaccaacttatccccagatctcagtgaaatgcccctgttcgcagatttgagccagatccccctgacaccagacctcgaccagatgacactctcccctgatctgggagaaaccgacttaagtcccaactttggacagatgagtctgtcacctgacctgtctcaggtgacactgagccctgatatctcggataccaccctgctccccgatctgagccagataagcccacccccagatctcgatcagattttctacccctccgagtcaagccaatccctgctgctccaggagttcaacgagtcttttccctacccggacctgggccagatgccaagcccctcatcccccaccctcaatgatacctttcttagcaaagaatttaatcccctggtgatcgtaggcctgtccaaagacggcacagactatatcgagattatcccaaaggaggaagtgcagtcgtcagaggacgattatgccgaaatagactatgtcccttatgacgatccctacaagacagacgtccgaaccaacattaattccagccgtgaccccgacaacatagcggcgtggtaccttcgctcgaacaacgggaatcgcaggaattactatatcgccgctgaggagatcagttgggactacagcgagttcgtgcagcgtgaaaccgacatagaggatagcgatgacattcctgaggatactacttataagaaagtcgtgtttcgtaagtatcttgattcaacgttcacaaagcgggatccaagaggtgagtatgaggagcatctgggcatattggggcctatcattagagcagaagttgatgatgtaatccaggtccgctttaagaacctagcaagccgtccctatagtcttcacgcccacggattgagctacgaaaaaagtagcgagggcaaaacttacgaggacgattcccccgaatggtttaaagaggacaacgctgtgcagccgaatagtagttacacgtacgtgtggcacgccactgagaggagtggaccagagtcgccagggagcgcttgccgcgcatgggcatactacagcgcagttaaccctgagaaggatatccacagcggcctaattggccctctcctcatttgccagaaaggaatcctgcataaagacagcaacatgcccatggatatgcgggagttcgtgctcctgttcatgacttttgatgagaaaaagtcttggtactacgagaaaaagtccagaagttcgtggcgactgacctcgagcgagatgaagaaatcacacgaattccatgcaattaacggtatgatctattctctgcccgggctgaagatgtacgagcaagagtgggtcagactgcacctgctaaacattggaggatcgcaggatatacatgttgtgcactttcatgggcagactctgctcgaaaacgggaacaaacagcatcagctgggagtttggcccttactccccggtagtttcaagacattggagatgaaggccagcaaacctggatggtggttgctaaacaccgaagtaggcgaaaatcaaagggcgggaatgcagaccccattcctcataatggatagagattgtagaatgcccatgggtctgagtactggaataattagcgattctcagatcaaagccagtgagttcttaggctactgggagccaagactggcacggcttaataacgggggaagttacaacgcctggtcagtggagaaactggctgcagaatttgcatctaaaccttggattcaggtggatatgcagaaggaagtcattataactggaatccagacacaaggggctaaacattacctcaaaagctgttacacgacggagttctatgtggcctattctagtaaccagataaattggcaaatctttaaagggaattcaacacgaaacgtgatgtactttaacggaaacagtgatgcctccactattaaggagaaccagttcgatccgcctattgtagcccgttacattcgcatcagcccaacccgcgcctacaaccgcccaacactgagattggagttacaaggttgcgaagtgaacgggtgctctacaccgttaggcatggagaatggcaaaatagaaaacaagcagattacggccagcagtttcaagaaatcttggtggggcgattactgggaaccatttcgagcaagactaaacgctcaggggcgggtgaatgcatggcaagctaaggcgaataataacaagcagtggctggaaatagatctgttgaaaatcaagaagatcaccgctattatcacccaggggtgcaagagtctgtccagcgaaatgtacgtgaagagctacactatacactattcagaacagggggtagaatggaagccataccgtctaaaatcttctatggtggataagatttttgagggaaatacaaacaccaaaggtcatgtgaagaatttctttaacccaccaataataagccgtttcattagagtgataccaaaaacatggaatcagagcatagcgctgcgattggaactatttggatgcgacatctac

SEQ ID NO: 9053 - DNA, 6672 bp, Artificial Sequence
  Description of Artificial Sequence: Synthetic coding sequence
atgtttccgggctgccctcgcctgtgggtgctggtcgtcctgggaacctcgtgggtgggatggggttcccagggaactgaagcggctcagctgcggcagttctacgtggcagcccagggaatctcgtggtcatatagaccggaacctaccaactcgtccctcaatctgtccgtgacttccttcaagaaaatcgtgtaccgcgagtatgagccgtactttaagaaggaaaaacctcagtccaccatcagtggactgctgggacccactctgtacgctgaagtgggtgacatcatcaaggtgcatttcaaaaacaaggccgacaagcccctgtcaattcatcctcaaggcattcggtactccaagctctccgaaggtgcctcatacctggaccacacgttcccggccgagaagatggatgacgcagtcgcgcccgggagagagtacacctatgaatggtccatctcggaagattcgggacccacccatgacgatccgccgtgtctgactcatatctactacagccacgagaacctgatcgaagatttcaactccggactgatagggccacttttgatatgcaagaagggcaccctcacggaagggggcacccagaaaactttcgataagcaaatcgttctgcttttcgccgtctttgacgagagcaagtcgtggagtcaatcgtcgtcccttatgtatactgtcaacggatatgtaaatggaaccatgccggacattaccgtctgtgcccatgaccatatctcctggcacctgctgggaatgtcctcagggcctgaattgttctcgattcactttaacggccaggtcctggaacaaaaccatcacaaagtcagcgccatcactctggtgtcggctacgagcaccactgccaatatgactgtgggacccgaaggaaaatggattatctcctcgctcactccgaagcacctgcaagcaggtatgcaggcgtacatcgacatcaagaattgcccaaagaaaacgcggaacctcaagaagatcacccgcgaacaacggagacacatgaagcgctgggagtactttattgctgccgaggaggttatctgggactacgccccagtcatcccggctaacatggataagaagtatcggtcacagcaccttgacaacttctccaaccagatcggcaagcactacaagaaggtgatgtacactcaatacgaagatgaatcgttcaccaaacacaccgtgaatccaaatatgaaggaggatggaatcctcggccccatcatccgcgcccaggtccgcgataccctgaaaattgtgttcaagaacatggcctcgcggccttactccatctacccacacggggtgacgttttcaccgtacgaggacgaagtcaattcgtccttcacttccggccgcaataacaccatgattagagccgtgcaacctggagagacttatacttacaagtggaacatcctggagttcgacgaaccaaccgaaaacgatgcccagtgcctgactaggccgtactactcggatgtggacattatgcgcgacatcgcatcaggacttattggcttgctgctgatatgcaaatcgcggtcgctggatagacggggaatccagcgggcggcagatatcgaacaacaggccgttttcgccgtgttcgatgaaaacaagtcctggtacttggaagataacatcaacaagttctgcgaaaacccggacgaagttaaaagagacgacccgaaattctacgagagcaacataatgtcgacgattaatggatacgtcccagagtcgatcaccaccctgggattttgctttgatgacaccgtgcagtggcacttctgtagcgtcggaacccagaatgagattctgaccatccatttcaccgggcactcattcatctacggaaaacgacatgaagatacgctgactctgttcccgatgcggggagaatcggtgaccgtgaccatggacaacgtgggcacctggatgctgacctccatgaactcgtccccgaggagcaaaaagctgagactgaagttccgcgacgtgaagtgcatcccggacgacgacgaggactcctacgagatcttcgagccgcccgagtccaccgtgatggcgaccaggaagatgcatgatagactcgaaccggaggacgaagaatccgatgcggactacgactaccagaaccggcttgcagccgccctgggaatccggtcgttccgcaactctagcctcaaccaggaggaggaagaattcaacctgactgcgctcgctctggagaacggaactgaatttgtgagctcgaacacggatatcatcgtgggatcgaattactcctctccgtctaacatctcgaagtttactgtcaacaatttggctgagccgcagaaggcaccttcccaccagcaagcaaccactgcgggaagcccactgagacacctcatcggaaagaacagcgtgctgaattcgtctactgctgagcatagctccccgtacagcgaggatcctatcgaggacccacttcaaccggacgtcaccggcatccgtctcttgtccctgggagctggcgaattcaagtcgcaggaacacgcgaagcacaagggacccaaggtcgaacgcgatcaagcggcaaagcaccgcttctcttggatgaagctcctggcgcacaaggtgggtcggcacctctcgcaggacaccggcagcccgagcggaatgaggccatgggaagatctcccgagccaagacacgggatcaccgtcccgcatgcgcccatggaaagaccccccgtcagatctcctcctgctgaaacaatcgaacagtagtaagatcctcgtgggacgatggcacctcgcctccgaaaagggaagctacgagatcatccaagatactgatgaggacacggcggtgaacaactggttgatctccccccagaacgcgtcccgcgcctggggggaatcaacgccgctggcaaacaaacctggaaaacaatcaggacaccctaagttcccacgcgtgcggcacaagtcgctccaggtgagacaggacggcggaaagagtcgcttgaaaaagagtcagttcctgatcaaaaccagaaagaagaaaaaagaaaagcacacgcatcatgcgccgctgagtccgcggacctttcatcctctcagatccgaagcatacaacacctttagcgagagacgcctgaaacattcacttgtgttgcacaagtcaaatgagacttcgctgccaaccgacctgaatcagaccctgccgtctatggacttcggatggatcgcttcccttccagaccacaaccagaattcgtcgaatgacactggacaagcgagctgcccgcccggcttgtaccagaccgtcccaccagaggagcattaccaaaccttccccattcaggatccggatcagatgcactcgacgtcggatccgagccaccgctcgagcagcccggaactcagcgagatgctggaatacgaccggtcgcacaagtcattcccaaccgacatcagccagatgtcaccgtcgtcagaacatgaggtctggcagacggtgatctcacccgacctctcgcaagtaaccctctcgccagagctctcgcaaacgaacctctcacctgacctgtcgcatactactttgtcgccggaacttattcaaagaaacctttcgccggccctgggacagatgcctatctccccggatctgagccacaccaccctcagccctgacctctctcacactaccttgtcgctggatctgtcacagactaatctctcgcccgaactgagccagactaacttgtcgccagcgttgggtcaaatgcccctgtccccagacctctcgcataccacgctttcactcgacttttcacagaccaacctgtcgccagaactctcacacatgactctgagcccggaactgagccaaaccaacctgagcccggctttggggcaaatgccgatctcaccggacctttcccacactactttgtctctggactttagccaaacgaatctgtcgccagagttgtcccagactaacctttcacctgcgctcgggcagatgcccttgtcgcccgatccctcgcacacgaccctctcactcgatctgtcccaaaccaatctctccccggagctgtcccaaactaatctgagcccagatctgagcgagatgcctctcttcgccgatctgagccagatacctctcactcctgaccttgatcaaatgaccctgtccccggatttgggggaaaccgatctttcaccaaacttcggccaaatgtccctgtcgccggacctcagccaggttaccttgtcgccagacatctcagacaccaccctcctcccagacctgtcccaaatcagccctccaccagatctcgatcagatcttctacccctctgagtcctcccagtcgctcctgctgcaggagttcaatgaatccttcccttacccagatttgggccagatgccctcaccatcgagcccgacgttgaacgacaccttcctctcgaaagagttcaacccactggtcatcgtggggctgtcgaaggacgggaccgactatatcgagatcatcccgaaagaagaggtccagtcatccgaggacgactatgcggagatagactacgtcccatacgacgacccgtataagactgacgtgcggactaacatcaatagctcccgagatcctgataacatagccgcatggtaccttcgcagcaacaacggtaaccggaggaattactacatcgcagcagaagaaatctcgtgggactactcggaatttgtccaacgtgaaactgatatcgaggactccgacgacatcccggaagatactacttacaaaaaggtggtgttcagaaagtacctggacagcacttttactaagcgggatccgaggggagagtacgaagaacatctcggaatcctgggccctatcattcgggcggaagtggatgatgtgatccaggtccgctttaagaacctcgcatcccgaccgtactcgcttcatgcccacggcctgtcgtacgaaaaatcttcggaaggtaagacttacgaagatgattcaccggaatggttcaaggaagataatgcggtccaacctaattcctcatacacttacgtgtggcatgcgaccgagcggtcgggaccggagtcaccaggcagcgcctgccgcgcttgggcgtactactccgctgtgaaccctgagaaggatatccatagcggtctgatcggaccactgctgatctgtcaaaaaggtatcctccacaaagattcgaacatgccgatggacatgcgggaatttgttctgctgttcatgacgttcgacgaaaagaaatcatggtactacgagaagaagtcacgcagcagctggcgcctgacttcgtcggaaatgaagaagagccacgagttccatgccataaatggaatgatctactcactgccaggactgaaaatgtatgagcaagaatgggtgaggctccaccttctgaatatcggggggtcccaggacattcacgtggtgcatttccacggccaaacgctgctcgaaaatggaaacaagcagcatcaactgggagtgtggcctctgcttcctggatcgttcaagactctcgaaatgaaggcgtccaagcccgggtggtggcttctgaacaccgaggtcggcgaaaaccagcgcgcaggcatgcagaccccgttcctgatcatggaccgtgactgcaggatgccgatgggactgtcaactggaatcatcagcgattcccagatcaaggcctcggaattcctcggctactgggaaccgcgcttggcccgcttgaataatggtggaagctacaatgcttggtcggttgaaaagctggccgctgaatttgcatcaaagccgtggatccaagtcgatatgcagaaggaagtgattatcactggtattcagacccagggcgccaaacactacctgaagagctgctacaccaccgaattctacgtggcttactccagcaaccagatcaactggcagatcttcaagggaaactcgacccgcaatgtcatgtacttcaacggaaattcggacgccagcaccatcaaagagaatcaattcgacccgcccatcgtggcccgctacatccgaatctccccgacccgcgcatacaatcggccgactctccggcttgaattgcaggggtgtgaggttaatgggtgctctaccccactgggcatggagaatggcaagatcgaaaacaagcaaatcactgcttcctcattcaaaaagtcctggtggggggattattgggagccatttcgggcacgcctgaacgcccagggtcgagtgaacgcctggcaggcaaaggcaaacaataacaaacagtggttggaaatcgacctgctgaagataaagaagatcactgcgatcattactcagggatgtaagtccctttcgtcagagatgtatgtgaagtcatacaccattcattactccgaacagggtgtggagtggaagccgtacagactcaagtcgtcaatggtggacaagatttttgagggtaacaccaataccaaaggacatgtgaagaacttcttcaaccctcccattatcagccgcttcatcagagtgatcccgaaaacgtggaaccagtccatagctctccgcctggaattgtttggatgcgacatctat

SEQ ID NO: 9054 - DNA, 6672 bp, Artificial Sequence
  Description of Artificial Sequence: Synthetic coding sequence
atgtttcccggatgccctcgtttgtgggttcttgtggtgctgggtacatcatgggtcggatggggaagccagggtactgaagccgctcagttgcgtcagttttacgtggctgctcagggcatcagctggtcataccgccccgaacccaccaacagctcattgaatctctctgtgacttcattcaaaaagatcgtctatagggaatatgaaccttactttaagaaagaaaaacctcaatctactatttctggactgctgggtccaacactttacgctgaggtgggagacatcattaaggttcatttcaagaataaggctgataagccactcagtatccaccctcagggcatcagatattctaagctctcagagggagcttcctacctcgatcatacttttccagcagaaaaaatggatgatgccgtggctccaggaagggaatacacatatgaatggtcaattagcgaagattcaggccctacacacgacgatcctccttgcctcacacatatttactactctcatgagaatctgattgaggattttaactccggattgatcggccctctccttatttgcaagaagggtaccttgactgaaggtggaacccaaaagactttcgacaaacagatcgtgctgctgtttgccgttttcgacgagagtaaaagctggtcacagtcttcctcactcatgtacaccgtgaatggttatgtgaacggaaccatgcctgacatcactgtatgcgcccatgatcatatatcctggcacttgttgggtatgtcctccggaccagaactgttctcaatccacttcaacggtcaagtactcgagcagaaccaccataaggtcagtgctatcactctggtgtccgccacttccaccacagcaaacatgacagtcggcccagaaggaaagtggattatcagctccctgacaccaaaacatctccaggccggaatgcaggcctacatcgacatcaagaactgcccaaagaagacacgcaacctgaagaagatcacaagggagcaaaggaggcacatgaagcgctgggagtacttcatcgctgccgaggaagtcatttgggactatgcccccgtgatcccagccaatatggacaagaagtaccgtagtcagcacctggataacttctccaatcagatcggaaagcactacaagaaggtgatgtacacccaatacgaggatgagagctttacaaaacatacagtgaacccaaacatgaaggaagatggaatactcggtccaattataagagctcaggtgagggataccctcaagattgttttcaagaatatggcttccaggccctactctatttatcctcatggagtgacttttagcccctacgaagacgaggtcaattcctccttcaccagtggccgcaacaacaccatgataagggcagtccagcctggagagacatacacttataagtggaatattttggagtttgatgagccaacagaaaatgacgcacagtgtttgacccgtccatattactctgatgttgacattatgagagatatcgcctctggactgatcggccttcttctgatctgcaagtccaggtccttggacagacgcggcatacagcgtgctgctgatatcgagcagcaggctgtgtttgctgtcttcgacgaaaataaatcatggtatctcgaagacaacatcaacaaattctgcgagaaccccgatgaagtgaagcgcgatgatcctaaattctacgagtccaacatcatgtcaaccatcaatggatacgtgcccgagagcatcactacactcggattttgttttgatgataccgttcagtggcacttctgcagtgtaggtacacagaacgagatcctcactatccatttcacaggacactcttttatttatggaaagcgccatgaagatacactgaccctgtttcctatgaggggagaaagtgtaacagttaccatggacaatgtaggcacatggatgcttaccagcatgaactcttccccacgttccaaaaagctccgtttgaagttcagggacgtgaagtgcatccccgacgacgatgaggacagctacgagattttcgaaccccccgagtctactgttatggccactaggaaaatgcacgaccgtctcgagcctgaggatgaggagtctgacgcagactatgactaccagaatcgtctggcagccgctctgggaattcgttcatttaggaattcctctctgaaccaagaggaagaagagttcaatctgacagctctggctttggaaaacggtaccgaattcgtatcaagcaacaccgacataatcgtgggaagtaactacagctctcccagcaacatttccaaattcacagtgaataacctggccgagccacagaaggccccaagccatcagcaggccaccaccgccggctccccccttcgtcacctgatcggcaagaacagcgtactgaactcttctacagccgagcacagttccccttactctgaggatcctattgaagatcccctgcagcccgacgtgaccggtatcagattgttgtccctgggcgctggagagtttaagagtcaggaacacgccaaacacaagggacccaaggtggagcgtgaccaagcagccaagcatcgcttcagttggatgaaactgttggcccacaaggttggcaggcatctgtctcaggatacaggttccccttcaggaatgagaccctgggaggacctgccttcacaagacactggaagtccctccaggatgcgcccctggaaagaccccccttctgatctgttgctccttaagcagtcaaactcttccaagattctggtgggccgttggcacctcgcttctgaaaagggctcctatgaaattatccaggatacagatgaggacaccgccgttaacaattggctgatctctccccagaatgccagcagagcctggggtgaatccaccccacttgccaacaaacctggcaaacagtcaggtcaccccaaattcccacgtgtaaggcacaagagtttgcaagtccgccaggacggaggcaaaagtagacttaagaaaagtcagtttttgatcaagacaaggaagaagaagaaggaaaagcatacacatcacgccccactgagccctaggactttccaccccttgaggtctgaggcatacaacaccttttccgaaagaaggctcaagcatagcctggtcttgcataagtcaaacgagaccagtctgcctactgatctgaaccaaaccttgccaagcatggatttcggatggatcgcatctctccctgaccataatcagaatagcagtaacgacaccggtcaggcatcttgtcctcctggcctgtaccagaccgtcccacccgaagagcattaccagaccttcccaatccaggacccagaccagatgcactccacctccgacccctctcaccgcagttcatcacccgaactgtctgagatgctggaatatgataggtcacacaagagctttcctaccgacatttctcaaatgtcccccagctctgagcatgaggtatggcagaccgtaatatctcctgacctcagtcaggttaccttgtcacccgagctttcccagactaatctgagtccagatctgtctcacacaacactgtccccagaactgattcagaggaatctttccccagctcttggtcaaatgcccatctctccagacttgagccacacaaccctctcccctgatctctcacacacaactctgagtctggatctctcacagactaatctcagccccgagctgtctcagacaaacctgtcacctgctctgggccagatgcccctctcaccagacctcagccacaccactctctccttggatttttctcagaccaacctctcacccgaactgagccatatgacactgtctcctgagttgagtcagaccaacctctcacctgccttgggacaaatgccaatctctcctgatcttagtcatacaacccttagccttgacttttcacagacaaatctgtctccagagctgtcccagaccaacttgagccctgctctgggacaaatgcccctttccccagatccaagtcatactacactcagcctcgatctgagccagaccaacctgtcccctgagctgtcacagactaacttgtctcctgatctgtccgagatgccacttttcgcagacctctcacaaatcccactcacccccgatctggatcagatgaccttgtcccccgatctgggtgagaccgatctgtcacccaactttggccagatgtctctctcccccgatctgagccaggtaaccctgagcccagacatctccgacaccaccttgctcccagacctgtctcagatctcacctcccccagatctggatcagatcttttatccttccgaatccagtcaatccttgcttcttcaggaattcaacgagagctttccataccctgacttgggccagatgcctagcccctcttcacccactctgaatgacactttcctttccaaggaattcaatccccttgtgatagttggtctgtcaaaagatggaaccgattatatagagattatccccaaggaagaagttcaatcctcagaagacgattatgcagagatcgattatgttccctacgatgatccctacaaaaccgatgttcgcaccaatatcaattccagcagagatcctgacaacatcgccgcttggtatctgcgttcaaacaatggtaaccgccgcaattactacattgccgcagaggagatttcatgggactactccgagtttgtacaacgcgagacagacattgaggactccgatgacatccctgaggacacaacttacaagaaggtagtattcagaaagtacctggactcaacattcaccaaaagggatccccgcggtgaatatgaggagcacctgggtatcttgggtcctattatccgcgctgaggtggatgatgtgatccaggtcaggttcaagaatcttgcctctcgtccttattcactgcatgctcacggtttgtcctatgagaaatcttccgaaggaaagacttacgaggatgacagtcctgagtggttcaaggaggacaacgccgtacaacccaattcctcctatacctatgtttggcatgccactgagcgctctggtcctgagagccctggttctgcatgtcgtgcatgggcttattacagcgctgtgaacccagagaaggacattcacagcggcctcatcggacctctcctcatctgccagaagggcatccttcacaaggattcaaacatgcccatggatatgcgcgagttcgtcctcttgttcatgacttttgacgaaaagaagagctggtactacgagaagaaatcaagaagctcctggcgcctcacttcctccgagatgaagaaatcccacgagttccacgctatcaatggaatgatatactcactgcctggtcttaagatgtacgagcaggagtgggtgagattgcatttgctcaacatcggtggttctcaggacatccatgttgtccactttcatggccaaactctgcttgagaatggtaataagcagcaccagctgggtgtgtggccactgctgccaggtagctttaagactctcgagatgaaggcttcaaaacctggttggtggctcctcaacactgaggtcggtgaaaaccagcgcgccggaatgcaaacccccttcctcatcatggacagagactgccgtatgccaatgggcctgtcaaccggaatcatcagcgacagccaaataaaagcatccgagttcctgggctactgggaacctcgcttggccagactcaacaacggaggatcatataacgcttggagcgttgagaagttggcagctgaattcgcatcaaaaccttggatacaagtagacatgcaaaaagaggtgataatcaccggaatacaaacacagggagctaagcactacctcaagtcttgctacaccacagaattttacgtggcatattccagtaaccagataaattggcagattttcaagggaaactccactcgtaacgttatgtacttcaatggaaactctgacgcctcaacaattaaggagaatcaattcgaccctccaattgtagcaaggtatattaggattagtcctaccagagcatacaacagacccacacttagactcgaattgcagggttgcgaggttaacggatgttcaactcctctgggaatggaaaacggaaaaatcgagaataagcaaatcacagcctcctcatttaagaagtcttggtggggagactactgggagccctttagggcccgccttaacgcccagggtagggtgaatgcatggcaagccaaggcaaacaacaacaagcaatggctggagatcgaccttcttaagatcaaaaaaatcacagctataattacccagggatgcaaaagtctgagttctgagatgtacgtcaaatcttacactattcactactccgagcaaggagtggagtggaagccttataggctgaaaagttctatggtcgataagatctttgagggtaacacaaacaccaagggtcacgtcaaaaacttcttcaatccccctattattagcaggttcatcagagtgatccccaaaacttggaaccagagcatcgcccttcgccttgaactctttggctgcgatatttac

SEQ ID NO: 9055 - DNA, 6672 bp, Artificial Sequence
  Description of Artificial Sequence: Synthetic coding sequence
atgtttcccggctgcccccgcctgtgggtgttggtggtactagggacgagttgggtgggatggggaagccagggcaccgaggccgcacagttgaggcaattctacgtggcagcacagggaataagttggagttatagacctgaacccaccaattcatcactcaacctcagcgtgactagtttcaaaaagattgtgtacagggagtatgagccatatttcaagaaggagaagcctcaatcaactattagcgggttgctgggcccgaccctctacgctgaggttggcgatatcataaaggtccatttcaaaaacaaggctgataagcccctgtccattcatccacagggaatccgctactctaagctctctgagggcgcgtcctatctggaccacaccttcccggctgaaaagatggacgacgcggtggcgccagggcgcgagtacacttatgagtggtccattagcgaagacagtggaccgactcacgatgacccaccctgtctcacacatatctactactctcacgaaaacctgattgaggattttaattcaggactgatcggcccattgctgatttgcaagaagggcacactgaccgaaggaggaacccagaaaacgttcgataagcagatcgtgctgcttttcgcagtgtttgatgagtcaaaaagctggagccagagcagcagcctcatgtacacggtcaacggctatgtgaacggaaccatgcccgatattaccgtttgcgcacacgatcatatctcttggcacctcctaggaatgagcagcgggcccgagctgttttcgatccattttaatggccaggtgctcgagcagaatcaccacaaggtgagtgctattaccctggtgtcggccacaagcacgacagctaatatgaccgtcgggcccgaagggaagtggatcatcagctcacttacccccaaacatctgcaggcggggatgcaagcttatattgacattaaaaactgcccaaagaaaactaggaatcttaaaaaaatcacacgtgaacaacgtagacacatgaagagatgggaatactttattgccgcagaggaggtgatttgggattatgccccggtgatccccgccaatatggataaaaagtaccggagccaacaccttgataacttcagcaaccagatagggaagcattataagaaggttatgtatacccagtacgaggatgaaagtttcacgaagcatactgtcaacccaaatatgaaagaggacggaattctagggcctataattagggcacaggtgcgcgacacgctgaagatcgtttttaagaatatggcctctaggccctactctatatacccacatggcgtgaccttctcaccttacgaggacgaagtcaactcatctttcacctccggaagaaacaacacgatgataagagccgtccagcccggggagacctatacctacaaatggaacatcctggaattcgacgagcccactgaaaatgatgcccagtgcctgacgaggccttattattctgacgtcgatattatgcgggatattgcgagcggcttaatcggactcctgctaatttgcaaatccagaagcctggatcggagaggaattcaacgcgcggcggacattgaacaacaggcggtcttcgcagtttttgacgagaacaagtcttggtaccttgaggataatatcaataagttttgtgaaaatcccgatgaagtcaaaagggatgatcctaagttctacgagtccaatatcatgtccaccatcaacgggtacgtgccagagtcaatcacgacattgggattctgcttcgacgacaccgtgcagtggcacttctgctccgtcggcacccagaacgaaattcttaccatacatttcacagggcattcatttatctacggcaagaggcatgaggataccctgacactgtttccgatgcgaggagagtctgtgactgtaaccatggacaatgtcggcacctggatgctaactagcatgaactcaagtcctcgctcaaagaagctgcggctgaagttcagggatgtgaagtgcatccccgacgacgatgaagattcttacgaaatttttgagccacccgagtccacagtgatggccacacggaagatgcacgataggttagaaccagaggacgaagagagtgacgcagactacgactatcagaataggttggcagcagcattagggataagatcattccgcaactcaagtctgaaccaagaggaggaggagttcaacctgaccgccctcgccctcgagaatggcacagagtttgtgagtagcaacaccgatattatagtaggaagcaattatagctcaccctcaaacatatctaaatttacagtgaacaatctcgcagagccacagaaggccccatcacaccaacaggcaaccactgccggatccccactgcggcaccttataggcaaaaattctgtattaaactccagcactgctgagcactcctctccatatagcgaagatcccatcgaggacccgttgcagcctgatgtgaccggcatcagactgttgagcctcggcgctggagagttcaaatcgcaagaacacgctaaacacaaaggacccaaagtggagcgggaccaggccgcgaagcatcgtttctcatggatgaagctcttggcgcacaaagtggggagacatcttagtcaggacaccggatccccatctggaatgcgtccatgggaggacctcccttctcaagatacggggtccccctctagaatgcggccatggaaagatccaccttcagacctgcttctcctaaagcagagtaactcaagtaaaatactggtcggccgatggcatctagcctctgaaaaggggtcctacgagatcatacaggacacagatgaagacactgccgttaataactggctgatttcacctcagaatgcctccagagcctggggcgaatccaccccacttgccaacaagcccggcaagcagtcgggccatcctaagtttcctcgggtccgccataagagcctccaggtacgacaagatggcggaaagtcacggctgaaaaagagccagtttcttattaaaaccaggaagaagaagaaggagaaacatactcatcacgcacctctgtcacctaggacatttcatcctctgcgctctgaagcatacaatacattctctgagagacgtctgaaacattccttagtgttgcataagagcaacgagaccagtttgcccactgatctcaaccagacgctcccgagcatggactttggatggatcgctagcctgcccgaccacaatcagaattcgagcaatgatacaggacaggcctcttgcccacctggactgtatcaaaccgttccaccagaagagcattatcaaacattcccaattcaagatcccgaccagatgcacagtacctcggatccctcccatcgcagctctagcccagaactgagtgaaatgctggaatacgaccggagtcataaaagcttccctaccgacatttctcagatgtctccatcctcagaacacgaagtatggcaaactgtgataagccctgacctgtcacaggtgacactgtcccctgagttaagtcagacaaatctgtcccccgacctctcgcatactaccttgtcgcctgagctcatacaaagaaatctgagccccgcactggggcagatgcctattagcccagacttatcccataccacactgtcgcctgatctcagccacaccaccttgagtctcgacctgagccaaacgaatctttcacccgagctatctcaaactaatttgtctccagccttggggcagatgccccttagtcccgacctctcccatactaccctgtctttggattttagtcagactaacctctccccagagctctcgcatatgactctcagtccggaactaagtcaaaccaacctgagcccagcccttgggcagatgccaatatccccggacttgtcccataccaccttgagcctcgatttcagtcagaccaacctatcgccagaactgtcccagactaacctctccccggcccttgggcagatgcccctgtctccagacccctcccatactacgctcagtctggacctgtcacagactaatttgtccccagaactttcccaaacaaacctgtctcctgacctttcagaaatgccgttgtttgccgacttgtcccagattcccctgacacctgaccttgatcaaatgaccctcagcccggaccttggcgaaactgacctgtctcccaattttgggcagatgagcctgagccctgacctgtcacaagtcaccctaagtccagatatcagtgataccaccctgctccctgacctgtcccaaatttctccacccccagaccttgaccagatcttttatccttccgaatcttcacagtccctgctgctgcaagagttcaatgagtcttttccttaccccgacctaggccaaatgccaagtccgagttctccaactttgaacgacacctttctgtccaaggaatttaatcctctggttatagttggcctttccaaggacggcaccgattatatcgagattatccctaaagaagaggtccagtcctccgaggatgattacgccgaaatcgactatgtgccgtatgatgacccttataagaccgatgtacgcaccaatattaactccagtagagatccagataatatagccgcttggtacctgagatcaaacaatgggaacagacgcaattattacattgctgccgaagagataagttgggactattcggagttcgttcaacgagaaaccgatatcgaggactcagacgacataccagaagatactacttataagaaagtggtctttcgcaagtatctggactctacattcaccaaaagagaccctcggggagaatatgaagagcatctggggatcctcggccctatcatcagagcagaagtggacgatgtgattcaggtgcggttcaaaaacctggcctctcggccctatagtttacacgcccacggattatcgtatgaaaaatcttctgaggggaaaacttacgaggatgactcccctgagtggttcaaggaggataacgctgtgcaaccaaattcttcatatacatacgtgtggcacgccactgaacggtctggcccagagagtccggggtccgcttgccgcgcatgggcctactacagtgccgtgaaccccgagaaggatattcattctggtcttattgggccactgctcatctgtcagaagggaatcctgcataaggatagcaatatgccaatggacatgcgcgagttcgtacttctgtttatgacctttgacgagaaaaagtcctggtattacgagaagaaaagcagatccagttggcgactgacatcttctgagatgaaaaaaagccacgagtttcacgctatcaacgggatgatttactcgctcccggggctgaaaatgtacgagcaagaatgggtgagactgcacttactgaacattggcggatcacaagatattcacgtggtgcatttccacggccaaacactgcttgaaaatggaaacaagcaacaccagttgggagtgtggccgctgctgccaggtagcttcaaaaccctggagatgaaggcatctaaacccggatggtggctcttgaatacagaggtcggagaaaaccagagggcggggatgcaaacacccttcttgattatggatagagactgtaggatgccgatgggcttaagcacaggcataatcagtgactctcaaatcaaggcctccgagttccttggctattgggagccgaggttagcacggttgaataatggagggtcttacaatgcatggagtgtcgaaaagcttgccgccgaattcgcatcgaaaccatggattcaggttgacatgcagaaggaagtgatcataactggaatccagacacagggcgccaaacactatctgaaatcctgctatacaacagagttttatgtggcctattcaagtaaccagattaactggcagatctttaagggcaattcaacccgtaatgtgatgtattttaacgggaacagcgacgccagtactatcaaagagaaccaatttgatccgccaattgtagcaaggtacatacgcattagccccacccgagcttacaataggcccacactgagactagaactccagggatgtgaggtgaacgggtgtagcactcctttgggtatggaaaatggtaagatcgaaaataaacaaatcaccgctagctcctttaaaaaatcctggtggggcgactactgggaaccatttcgcgctcggctgaatgcccaaggacgcgtcaacgcttggcaggcgaaggctaataataacaagcagtggttagagatagacttacttaagatcaaaaagatcaccgctataattacccaaggctgcaagagtctatcctctgagatgtatgttaaaagttatactatacactatagtgaacagggggtggaatggaaaccatatagattgaagtcctctatggtggacaaaatttttgagggcaatactaatacaaagggacatgtgaagaacttctttaatcctccaatcataagtagattcatccgggttattcctaaaacctggaaccagagtatcgcactgcgactagaactgtttggctgtgatatctac

SEQ ID NO: 9056 - DNA, 6672 bp, Artificial Sequence
  Description of Artificial Sequence: Synthetic coding sequence
atgtttcctggatgccctaggctgtgggtgctggttgtgctgggcacaagctgggtcggctgggggtcacaagggaccgaagcagcccagctgagacagttttacgtcgccgcacagggcatttcatggtcctaccggcccgagccaactaatagttctcttaatctctccgtaacttctttcaagaaaattgtttatagggagtatgagccgtactttaagaaggagaaaccgcagtctactatctccgggctgttggggccaaccctctatgctgaggtgggtgacatcattaaggtgcatttcaagaacaaagcggataagcccctgagtatccatccccagggtatccgctattccaagctgagcgaaggcgcatcttacctcgaccacacattccccgccgagaagatggacgatgccgtcgcccctggaagggagtacacctatgaatggagcatatctgaggattctggccctactcatgacgaccctccctgccttacgcatatctactattctcatgaaaatttgatcgaggattttaacagcgggcttatcggccctctgctgatttgcaaaaaaggaacactgacagagggcgggacacagaagacctttgacaagcagattgtgctcctgtttgctgtgttcgacgagtccaagagttggagtcagagtagttccctgatgtatacagtcaacggctacgtgaatgggacaatgcccgacattacagtgtgcgcacacgaccacatcagttggcatcttttggggatgtcaagcggccccgaactcttttccatccacttcaatgggcaggtactggagcagaaccatcacaaagtgtctgctattacgctggtgtccgcaacaagcaccaccgcaaacatgaccgtcgggccggagggtaaatggattataagtagtctcacacccaagcatctgcaggcaggcatgcaagcgtacatcgatattaaaaattgtcccaaaaaaacccgcaacctgaagaagatcacaagggagcagcggcgacacatgaaacgatgggaatacttcatagcagcagaagaagtaatctgggattacgccccagtaatcccagctaacatggataagaaatatcgcagtcagcatctcgacaatttctccaatcagattggcaagcactacaaaaaggttatgtacactcaatatgaggatgagtccttcacgaaacatacggtgaatccaaacatgaaagaggatgggattctgggacccatcattagagcacaggtccgggacaccctgaagatcgtctttaagaatatggcttccaggccttacagcatctaccctcacggagtcacattctccccgtatgaagacgaagtgaatagctccttcacgtcaggcagaaacaatactatgatccgggctgttcagcctggagagacctatacttataaatggaatatccttgaattcgacgaacctaccgagaacgacgcccaatgcctgacccgaccatactattccgacgttgatatcatgagagatattgctagtgggctcatcggtctgctcctgatctgcaagagcagaagcttggaccgccgcgggatacagcgcgcagcggatattgagcaacaggctgtattcgccgtatttgatgagaataagtcctggtacttggaagataacattaacaaattctgcgagaatcctgacgaggtcaaaagagatgaccccaaattctacgagtccaacattatgagcactatcaacggttatgtccctgagtcaattaccacactcggtttttgtttcgatgacacagtccaatggcacttctgctccgtcgggacccagaacgaaatcctgaccatacattttaccggacactccttcatttatggcaagagacatgaggatacgttgacgctgttcccaatgcgaggagaatccgtaacagtaaccatggataatgtcgggacttggatgcttacttcaatgaattcctctccaaggtcaaagaaactgcggctgaagttccgcgatgtcaagtgcattcctgatgacgatgaggattcttatgagatcttcgaaccccctgagagtactgtgatggcgacaaggaaaatgcacgatcggctcgaacccgaagatgaggagtcagacgccgactacgattaccagaacaggcttgcggccgcactggggattagaagcttccggaactctagtcttaatcaggaggaagaagagttcaacctgacagctcttgctctggaaaatggcacagagtttgtgagctccaacacagacataatcgtgggttcaaactattcttcaccttctaacatcagcaagttcactgttaacaacttggccgagccgcagaaggcccccagccaccaacaagcaactactgccggatctccactgcgacacctgatcgggaaaaactccgtgctgaattcctctaccgccgaacattcatctccatacagtgaggaccccattgaggatccattgcaacccgatgtcaccggaattcggttgctctcccttggggccggcgaattcaagagccaggaacacgctaagcataaggggccaaaagtggagcgcgatcaagcagcaaagcatagattcagttggatgaagctgcttgcgcataaggtggggagacacctgtctcaggataccggctctccatcaggcatgagaccatgggaggacctgccttcccaggacactggctcaccttcccggatgagaccttggaaggatcctccttctgatctgctgttgctgaagcagtccaattctagtaagattctcgtggggcggtggcacctggcctctgaaaaaggttcctatgagatcattcaagataccgacgaggatactgcagttaacaactggctcatatcaccccagaacgccagcagggcctggggggaaagtactcccttggcaaataagcctggaaagcagtctggccatcccaagtttccgagggtccgccataaaagcctgcaagtgcggcaggacggcggaaagtcacggctgaagaaatctcagttcctcattaaaaccaggaagaaaaagaaggagaagcatacccaccatgctcccctgagccctcggaccttccatcccctgcgcagcgaggcatataatactttcagcgaaaggagactcaagcactcactcgtgctgcataagtctaatgagacatccctcccgaccgacttgaatcagactctgccctccatggacttcggctggattgcgagcctgccagatcacaatcagaactccagcaacgacaccggccaggcatcctgccctcccggcttgtaccaaaccgtacccccggaggaacactatcagaccttccccatccaggatccagatcagatgcacagcacctcagatccatctcaccggagtagtagccccgaactctccgaaatgcttgaatacgacagaagccacaagagcttcccaaccgacattagccagatgagccccagctctgagcacgaagtatggcaaactgtcatttccccggatttgtcccaggtgactctgtcccctgagctgtcccagaccaatttgtcccctgatctttcccacacaacccttagccccgagctgatccagaggaacctgtctccggccctcggccagatgccaatttctccagatctgtcacacaccaccctgagccccgacttgtctcacactactctgagcctggacctgtcccagactaatcttagccctgaactgtcccagactaatttgagtcccgccttgggacaaatgcccttgtcccctgatctgagtcacaccactttgagtcttgatttctcacagacaaacctgagcccagagctgtcccacatgacactgtctccagagctgtcccaaacaaacctttcccctgccttggggcaaatgcccatctccccagacctttcacacaccacactgtctctggacttttctcagaccaacctgagcccagaactctcacagactaatctgtctcctgctcttgggcagatgcccctttctccagatccatcccacaccactttgtccctggacctctcccagacaaacctcagtcccgagctttctcagacaaatctttcacccgacctgagcgaaatgcctctcttcgctgacctgtctcagatcccactcactcctgacctggaccaaatgaccctgagcccagatctgggagagaccgacctttccccgaattttggccagatgagtttgagccccgatctcagccaggtcaccctgagccctgacatctccgataccactttgctgcccgatctgtctcagatctcccctcccccagatcttgatcagatcttctatccgtccgagtcttcacagtctctgctcctgcaggagtttaatgaatcttttccataccccgatctcgggcagatgccgagccctagttctccaactctcaatgacacattccttagcaaggagtttaatccgctcgttatagtcggcctgagtaaggatggcacagactacatcgaaatcatccccaaggaggaggtgcagtcctctgaagacgactacgcggagatcgattatgtgccctacgatgacccttacaagaccgacgtgcgcaccaacatcaactcatcacgcgaccctgacaacatcgcagcgtggtacctgagatccaacaacggtaaccggcgcaattattatatcgccgcggaagagatttcttgggattacagcgagttcgttcagagggaaactgatatagaagactcagacgacattccagaggataccacttacaaaaaggtggtgtttagaaagtatcttgactcaacattcaccaagagggatccccgcggtgagtacgaggagcaccttggcatactgggccctattataagggccgaagttgatgatgtcatccaggttaggttcaagaacttggcctctagaccgtatagtctgcacgcgcacggactgtcctacgagaaatctagcgaagggaagacctacgaagacgattcacctgagtggtttaaggaagataatgccgtacagcctaatagtagttacacctatgtttggcatgccactgagagatctggcccagaaagtcccggttccgcctgtcgggcatgggcgtactacagtgccgtcaatcccgagaaggatatacatagcgggctgattggcccgctgctcatctgtcagaagggcatcctgcataaggacagcaacatgccaatggacatgagggaatttgtgcttctcttcatgactttcgacgaaaaaaaatcctggtattatgagaaaaaatccagaagctcttggcggctcacttcatcagagatgaagaagtctcacgaattccacgccataaatggaatgatttactctcttccgggcctgaaaatgtacgagcaggagtgggtgcggctgcacctcctgaacatagggggatcccaagatatacatgtggtccatttccacggacaaaccttgttggaaaacgggaataagcaacatcagctgggagtctggccgctgctgcccggctcttttaagaccctcgagatgaaggcttccaaacccgggtggtggctgcttaacacagaagtcggtgagaaccagcgggccggtatgcagactcctttcttgatcatggaccgagattgcagaatgccaatgggtctgagtacagggattatctccgatagccagataaaggcatctgagttcctcggctattgggaaccccggctggccaggctcaataacgggggcagctataatgcttggtcagtggaaaaacttgctgcagagttcgcgagcaagccatggatacaagtggatatgcaaaaggaggtgataatcacagggatccagactcaaggagctaagcactatctgaagagctgttataccaccgagttctatgtggcctacagctccaatcagatcaactggcagatttttaagggtaattccacccgaaatgtaatgtattttaacggcaatagcgacgcttccacaatcaaagaaaaccaattcgatccaccgattgttgcacgctacattagaatctcccccacaagagcctataataggccgacccttcgactggaactccaaggctgcgaagtcaacggttgctccacgccactcggaatggagaacgggaaaatcgagaacaagcagattaccgcaagctcatttaaaaagtcttggtggggagattactgggagccattccgggcccggctgaatgcacaaggtagagtcaatgcctggcaagccaaagcaaataacaacaaacagtggctggagatcgatctgctcaagataaagaagatcaccgcgataatcacacagggctgtaagtctttgtccagtgaaatgtacgtcaagagctacactattcattatagcgagcaaggggtggagtggaagccctatagactcaaatcaagcatggtcgacaagatcttcgaagggaacacaaataccaagggccacgtgaaaaatttcttcaatccccctattatttctaggttcattagagtgattccgaaaacttggaaccagagcatcgcactgaggctggagcttttcggctgcgacatctat

SEQ ID NO: 9057 - DNA, 6672 bp, Artificial Sequence
  Description of Artificial Sequence: Synthetic coding sequence
atgttccctggatgtccacgattatgggtattggttgtgctgggcaccagttgggttggatggggatcccaaggtacagaggctgcccaattaaggcaattctatgtagctgcccaaggaatctcctggtcatatagaccagagcctactaattctagcctgaatttatccgtaacatcttttaagaagatagtttatagggaatatgaaccttacttcaaaaaggaaaagcctcagagcactatttcgggtcttcttgggccgacgctttacgctgaagtaggtgacataatcaaggttcatttcaaaaataaagccgacaagccattgtctattcatccacaaggtatccggtatagcaaacttagcgagggtgctagttatctagatcatacttttccagcagagaaaatggatgatgcagttgctccaggccgtgaatatacttacgagtggagtatctctgaggactctgggcctacacatgacgatcctccttgtttaactcacatctattactctcatgagaacttgatcgaagacttcaattcaggattaattggaccattactcatttgtaagaagggcactttgacagaagggggtacccaaaagacttttgacaagcaaatagttcttcttttcgccgtatttgacgagtctaaatcatggtctcaatcatcctcattaatgtacaccgtcaatggttacgtaaacggcactatgcctgacattacagtttgtgctcatgatcatatcagctggcatcttctcggaatgtcctctggtcccgaattgttttccatccactttaatgggcaggttttggagcaaaaccaccacaaggtgtcggcgatcacgctggtatctgccacctccactaccgcaaatatgaccgttgggcctgagggaaaatggattatcagctctttgactccaaaacacttacaagctgggatgcaggcttacatcgatatcaagaattgtcccaaaaaaactcgtaatttaaaaaagattactagagagcagagaaggcacatgaagaggtgggaatactttatagcagcggaagaggtaatctgggattacgctccagttattcccgctaacatggataaaaagtatcgttctcagcacctcgacaatttcagcaaccaaattggaaagcattataagaaggttatgtatactcaatacgaggatgaatctttcactaaacataccgttaacccgaatatgaaagaggatggtatattaggtccaattatcagagcgcaggtccgtgatacccttaaaatagttttcaaaaacatggcatcgaggccatactccatttatcctcatggcgtgacatttagtccgtatgaggatgaggtgaattcttcttttacgtctggccgaaataacactatgatacgagctgttcaacctggcgaaacatacacttataaatggaatatcttggaatttgatgaacctactgagaacgacgctcaatgccttacaaggccctattactccgatgttgatattatgagagatatcgcatcgggcttgatcggcttactactgatctgtaagagcagatcactagataggcgcggcattcaacgcgctgcagatatcgaacagcaagctgtattcgccgtctttgacgaaaacaagtcgtggtatctcgaggataacattaataagttttgtgaaaaccctgatgaagttaaacgtgatgaccctaaattttacgaatctaacattatgagcactataaatgggtatgtcccagagtcaattaccaccttaggattctgcttcgacgacaccgtacagtggcatttctgcagcgttggtacccagaacgagattctcactatacatttcactggccattcattcatctacggtaaaaggcatgaagataccttaactcttttccccatgcgaggggaatctgttactgtgactatggataatgttggcacttggatgttgacatctatgaactcatctcccaggagcaagaaacttagacttaaattccgtgacgttaagtgtattccagatgatgacgaggactcctatgaaattttcgagccacccgagtctacagtcatggctacacggaaaatgcatgatcgattagagccagaagatgaggaatcagatgctgattatgattatcagaacagattagccgctgccctaggcattcgtagtttccgaaactcttcgctcaaccaagaggaagaggagttcaacctgacggcgttagctctagagaacggaacggagtttgtttcttccaatacagatatcattgtcgggtccaactacagctctccatcaaacatttctaagttcaccgttaacaaccttgccgagcctcagaaagcaccctcacatcaacaggcaaccacggctggttcccccttgaggcatcttatcggaaaaaactcggtattaaattcttccactgctgagcattcatcgccttattccgaagacccgattgaggatcctcttcaacctgatgtaacaggcatccgcttattaagtttaggggctggagagtttaagtctcaggaacacgccaagcataaaggaccaaaggttgaacgggatcaagctgctaaacaccggttctcttggatgaaattgttggcccataaggtggggagacatctatcgcaggatacaggttctccgagcgggatgaggccttgggaggatttgccatcgcaggatactggcagcccctctcgtatgagaccatggaaagatccaccctctgaccttttgctactcaaacaaagtaacagttccaaaatcctcgtggggagatggcatcttgcttcagaaaaggggtcttacgagatcattcaggataccgatgaagatacagctgtaaataactggctaatctcaccccaaaatgccagtagggcctggggtgagagcactccacttgcgaataaacccgggaaacagtcaggacatcctaaatttccaagggttcgtcataagagccttcaggttaggcaagacggaggaaagagtcgtctgaaaaaatcacaatttctgatcaaaaccaggaagaaaaaaaaagagaaacatacacatcatgcgccattgtcacctagaactttccaccctctccgcagtgaggcttataatactttctcagagcgacgtcttaagcattctcttgttttgcacaagtcaaatgagaccagccttcccactgatctgaatcagacattgccatctatggattttggatggattgcttctcttccagaccataaccagaattcctcaaacgatacagggcaagcatcctgtcctcctggtctctaccagacagttccaccagaggagcattatcagacattcccaatccaagatcccgatcagatgcacagcacttccgacccatcgcatcgctcatccagccctgagctctcagaaatgttggaatatgacagatctcataaatcctttcccaccgacatatcacaaatgtcaccttccagcgaacatgaagtatggcagaccgttatcagcccggacctatctcaggtaacattgagccccgagctatcccaaactaacctttctcctgatttgtctcacaccactttgagtcccgaacttatccaaagaaatctaagccctgcccttggtcaaatgcccatctctccagacttgtcccatacgaccctctctccagatctcagtcatacaactttatctctggatctctctcagacaaatcttagcccagagttgagtcaaactaaccttagcccggcacttgggcagatgcctcttagccccgatctgtcacacactaccctttcgcttgacttctcccagactaatctatctccggagctttcgcatatgacactttcgccggagctcagccagacgaacctttctcctgctctgggccagatgcctatttctcctgacctctcgcacacaaccttgtctctcgacttctctcaaaccaacttgtctcctgaactgagtcaaactaatttgtctcctgcgcttggtcaaatgcctttgtccccagatcctagtcataccactttgagtctcgatttatctcagactaatctaagcccagagctatctcaaacgaacttatctcctgatctctccgagatgccattatttgcagatttgagtcaaattccactgacgccagacttggatcaaatgaccctgtctcccgatttgggagaaaccgatctttcaccaaattttggacaaatgagtctttctccagacttatcccaggttactttatcacctgatatttcggatacaacactacttccagacctttctcaaataagtccgccaccagatctggatcaaattttctatcctagcgaatcaagtcagtctttacttcttcaggagttcaatgaaagttttccttatcccgatttaggtcagatgcctagcccatcttcgccaactctgaacgatacattcctgtctaaggagtttaacccactggttatcgtcggtctctccaaagacggtacggattacatcgagatcattcccaaagaggaggttcaatcctcagaagacgactatgctgagattgactatgtgccttacgatgacccatataagaccgacgttagaactaacatcaacagctctcgggaccccgataacatcgcagcatggtacttgaggtcaaataacggtaatcgcagaaattactacatagctgctgaggagatttcttgggactactcagagtttgttcaaagggagactgatatcgaagactcggatgacattccagaagatactacctacaagaaagtggttttccgtaagtatcttgattccactttcactaaacgagacccaaggggcgaatatgaggaacatcttggtattcttgggcctattattcgtgcagaagtggatgatgtaatccaagtgagatttaagaacctggctagtagaccatattctcttcacgcacatggtctcagttacgagaaaagctctgaaggaaagacatatgaggatgattcacccgaatggtttaaggaagataacgctgtccagccgaactcttcctatacttatgtctggcacgctaccgaaaggtccgggccagagtcccctggatctgcatgccgtgcttgggcatattattctgccgttaatcctgagaaagatatccactctggacttatcggcccattattgatctgtcaaaaaggtattcttcataaggacagtaacatgcctatggatatgagagagttcgtgttgttgtttatgacctttgatgagaaaaaatcatggtactacgagaaaaagagtaggtctagttggcgtttgacctcttccgaaatgaagaagtcccacgaatttcatgcgatcaacggtatgatatactctttgccaggtttgaaaatgtacgagcaagaatgggtgagacttcatcttttgaacattggaggttctcaagatattcatgttgttcacttccatgggcaaacactcctggaaaatggtaacaagcagcatcagttgggtgtgtggccacttttgcccggatcttttaaaacccttgagatgaaagcctctaagcctggctggtggttgttgaatactgaagtgggagagaaccagagagcaggaatgcaaactccattccttattatggatcgtgattgtagaatgccaatgggcttatctacaggtataatttcagatagtcagatcaaagcctcggagtttctaggctactgggaacccagacttgccaggctgaataatggaggctcttataatgcttggagtgttgagaagttggccgctgagttcgctagtaaaccctggatacaggtagatatgcagaaggaggtaattatcaccggcattcagactcaaggagccaagcattacctgaaatcgtgttacaccacagaattttacgttgcttatagttccaatcagatcaactggcagattttcaaggggaattctactcggaatgtgatgtactttaatggaaattccgatgccagcactattaaggagaaccaatttgatccaccgattgttgctagatacattcggatttctcccactagagcttataatcgaccgactcttaggttagagttgcaaggttgcgaggttaatgggtgcagcacacctttaggaatggagaatggtaagatagagaataaacaaatcacagcatcttcatttaagaaaagttggtggggtgattactgggaaccattccgtgctcgtcttaacgcacagggtagggttaatgcatggcaagccaaggccaataataacaagcaatggctcgaaatagatctgcttaaaatcaaaaagataaccgctataataacccagggctgtaagtcgctatctagtgaaatgtacgttaagtcctacactatccactactctgagcagggtgtagagtggaaaccttatagactaaaatcatccatggtcgacaaaatctttgaaggcaacacaaacacaaagggacacgttaaaaacttcttcaatccaccgattatttcccgtttcatcagagtaatcccaaagacctggaaccaatccattgctcttcgtttagaattgttcggttgtgatatctat

SEQ ID NO: 9058 - DNA, 6672 bp, Artificial Sequence
  Description of Artificial Sequence: Synthetic coding sequence
atgttccctggatgccctcggctctgggtgctggtggtgctgggaacttcttgggtgggatgggggtcccaggggaccgaagccgctcagctccgccagttctatgtggccgcgcagggcatttcctggtcgtaccgcccagaaccgactaactcgagcctcaacctgtcggtgacttcattcaagaagatcgtgtaccgcgaatacgaaccgtactttaagaaagagaagccgcaatccaccattagcggactgctggggccgaccctctacgcggaggtgggcgacattatcaaggtccacttcaagaacaaggcggacaaaccactgtcgatccacccgcaaggaatccggtatagcaagctgtccgagggagcttcgtacctggatcatacttttcccgctgagaaaatggacgatgccgtcgccccaggtcgggagtacacctacgaatggtccatttcagaagattcgggtccgactcatgacgacccaccatgcctcactcatatctactacagtcacgagaaccttatcgaggacttcaactcgggactcatcggtcctttgctcatctgtaagaagggcaccctgaccgagggaggaactcagaaaacctttgacaaacaaatcgtgctgctgttcgctgtgtttgatgagtcgaaatcgtggtcccagtcgagcagccttatgtacactgtgaacggatacgtcaacggaaccatgccagacatcaccgtgtgtgcccatgaccacatcagctggcacttgctgggaatgtcctcgggaccagagctgttttcgatccacttcaacggccaggtcctggaacagaaccaccacaaggttagcgcgattacgctggtgtcggccacttccactaccgccaacatgaccgtggggccggagggaaagtggatcatctcgagcttgacgccgaagcaccttcaggctgggatgcaggcttacatcgacatcaagaactgccctaaaaagacccggaacctgaaaaagattaccagggaacagcgccggcacatgaaacggtgggaatacttcatcgccgccgaggaggtcatctgggactacgccccggttattcctgcaaacatggacaagaaatatcgcagccagcacctggacaatttctccaatcagatcggaaagcactacaagaaggtcatgtacactcaatacgaggacgagagcttcaccaagcacaccgtgaatccaaatatgaaggaagatggtattctcggcccgatcatccgcgcccaagtgcgggacactctgaaaattgttttcaagaatatggcctcacggccatacagcatctacccgcatggtgtgactttcagcccgtatgaggatgaggtgaactcatcattcacttccggacgaaacaacaccatgatccgcgccgtccaacctggagaaacttacacctacaagtggaacatcctggagttcgatgagccaactgaaaacgacgcgcagtgcctgacccgcccgtactattccgacgtggatatcatgcgagatatcgcgtccggactcatcggactgctgctgatctgtaagtcccggtcgctggaccgtaggggcatccagcgcgcagccgacatcgaacagcaagcggtgttcgccgtctttgacgagaacaaatcttggtatctggaggacaacatcaataagttttgcgagaaccctgatgaggtgaaacgcgacgatcctaagttctacgaatctaacatcatgtcgactatcaacggatacgtgccggagtcaatcactactctgggattctgctttgacgacaccgtgcagtggcacttctgttccgtcggcactcagaatgaaatccttaccatccactttactggtcatagcttcatttacggtaaacgccacgaagataccctcaccctgttccctatgcgcggtgagtccgtcaccgtgaccatggataacgtcggaacctggatgctcaccagcatgaattcgtcaccccgctcgaagaaacttaggcttaagttccgggacgtcaaatgcatcccggatgacgacgaagatagctacgagatttttgaaccaccggaatcgactgtgatggccactcgcaagatgcacgacagacttgaaccggaagatgaggaatcggatgccgactacgactaccagaatagactggctgccgcattgggcattcgctccttccgcaactctagcctgaaccaggaggaagaggaattcaacctcaccgcactggccttggagaatggaaccgaattcgtgtcgagcaacaccgacatcattgttggttccaactactcctcgccatccaatatctcaaagttcaccgtgaataatctggccgagccgcagaaggcaccaagccatcagcaagccaccaccgcgggaagcccacttcggcacctgatcggcaaaaactcggtgcttaattcatctaccgcggaacacagctcaccatactcagaagatccaattgaagatccgctgcaaccggacgttaccggcatccggctgctgtcgcttggtgcgggagagttcaaaagtcaggagcatgccaagcataagggaccgaaagtggaacgggatcaggcggcaaagcaccggttctcctggatgaagctgctggcgcataaggtcgggcggcatttgagccaggacaccggaagccccagcgggatgcgcccctgggaggacctgccttcacaggacactggaagcccatcccggatgcgcccgtggaaggacccaccgagcgacctgctgttgctcaagcagtctaactcgagcaagatcctggtcggcagatggcacttggcctcggagaaaggatcctatgaaatcattcaagacaccgacgaggataccgctgtgaacaattggctgatctccccgcaaaatgcctcgcgggcgtggggcgagagcactccgctggcgaacaagccaggtaagcaatcgggtcacccaaagttcccgagagtgagacataagtcgctccaagtccggcaggacggagggaagtcacgcctcaagaagtcccagttcctcattaagaccagaaagaagaagaaggaaaagcatacccaccacgcccctctgtccccccggaccttccacccgctgagatcggaggcttacaacactttctccgaaaggcggctcaagcattccctggtgctgcataagtccaacgagacgtcactgccgaccgacctcaaccaaactctgccgtccatggactttggatggatcgcttcgctgcccgaccataaccagaactcctcaaacgacaccggacaggcgtcgtgccctccgggactgtatcagactgttccgccagaagaacattaccagacctttcctatccaagacccggaccagatgcactcgaccagcgatccttcccaccgcagctcgagcccggaactgtccgaaatgctggaatacgacagatcacacaagtcgtttccaaccgatatcagtcaaatgtcgccctcttcagagcacgaggtgtggcaaaccgtgatctcccctgatctgtcgcaagtcaccctctcaccggaactgagccaaactaacttgagcccagatctttcccacaccactctgagtcctgagcttatccagcggaaccttagcccagcgctcggacagatgcctatttcgccggacctgtcccacactaccctcagcccggacctctcacacaccactctcagcctggatctctcgcaaactaacctctcccccgagctgtcacaaaccaacctctcaccagctctcggccaaatgccgctctcccccgatctctcacataccactctgagcctcgacttctcccaaaccaacttgtcgcccgaactctcccacatgactctttcaccagaattgtcacagactaatctgtccccggccctcgggcagatgcctatctcgcctgatctgtcacatactactctctcgctcgatttttcgcaaaccaatctttcacctgaactgtcccagactaacctgtccccagcgcttgggcaaatgcctctctcgcctgaccccagccacactactctgtcattggatctgtcccagaccaatttgagccccgaattgtcgcaaactaatctctcgccagatctctcagagatgccccttttcgcggacttgtcgcaaatcccactgaccccggacctggatcagatgaccctctcgcccgacttgggagagactgacctctcaccgaactttggacagatgtcactgtcgcctgacctcagccaagtgaccttgtccccggacatcagtgacacgacgctcctgcccgatctgagccagatctcgcctccacccgatctcgaccaaatcttctatccatccgaatcgtcgcaaagccttttgctccaggagttcaacgaatcctttccctacccagacctgggccaaatgccttcgccgtcgtcaccgactctgaacgataccttcctctcaaaggagttcaaccccttggtgatcgtgggtctttcaaaagacggcaccgactatatagagatcattcccaaggaagaggtgcagtcgtcagaggacgactacgccgaaatcgattacgtcccctacgatgacccttacaaaaccgacgtgcgaacgaatatcaactcctcgcgggacccggacaacatcgctgcctggtacctcagatcgaataacggaaacagacgcaactactacatcgcagcagaagaaatctcgtgggattactccgagttcgtgcagcgggaaaccgatatcgaagattcggatgatattccggaggacaccacgtataagaaagtggtgttccggaaatatctcgacagcactttcaccaagcgcgacccgcgaggagaatatgaagagcatctgggaattctgggaccgattatccgcgccgaagtcgatgacgtgatccaggtgcggttcaagaacctggcgagccgcccatacagcctgcatgcccatggactgagctacgagaaatcatccgaaggcaagacttatgaagatgattcacctgagtggtttaaggaggacaacgccgtgcagccgaactcctcgtacacttacgtctggcatgcgactgagcgctccggaccggaatccccgggatcagcgtgccgggcgtgggcgtactactccgccgttaacccggaaaaagacatccattcaggcctcatcggcccactgctgatttgccagaagggaatcctgcacaaagattccaatatgccgatggacatgcgcgaattcgtcctgctgtttatgacgtttgatgaaaagaaatcctggtactacgaaaagaagtccaggtcatcctggaggctcacctcgtccgagatgaagaagtcccatgagttccatgcgatcaatggaatgatctactcgctcccgggcctcaagatgtacgaacaagagtgggtccgcctgcacctgctgaacatcggtggatcgcaggacatccacgtggtgcacttccatggacaaaccctgctggaaaacggtaacaagcagcaccagctgggtgtgtggcctctcctgccgggatcgttcaagactctggagatgaaagccagtaagccagggtggtggctgttgaataccgaggtcggagagaaccaacgggcaggtatgcagactccctttctgatcatggaccgggattgtcgcatgccgatgggtctgtcgacgggtatcatcagcgactcccagatcaaagccagcgaattcctcggctattgggagccgcgactcgcacgcctgaataacgggggatcgtacaatgcctggtccgtcgaaaagctggctgctgagttcgcgtcaaagccatggattcaggtggatatgcagaaggaagtgatcatcactggcatccaaacgcaaggggccaagcattacctgaaaagctgctacaccactgaattctacgtcgcatactcctcgaaccagatcaattggcagatctttaagggcaactccactagaaacgtgatgtacttcaacggaaattcagatgcctcgactatcaaggaaaaccagttcgacccgccgattgtggcgcgctacatccgcatctccccgacgcgggcatacaaccggccgaccctccgcttggaactccagggatgcgaagtgaacggatgcagcacgccgctgggaatggaaaacggaaagattgagaataaacagatcactgcgtcctccttcaaaaagtcgtggtggggagactactgggaaccgtttcgcgctagacttaacgcacagggacgcgtgaatgcttggcaggctaaagccaataacaacaaacagtggctcgaaatcgaccttttgaagatcaaaaagatcacggccatcatcactcagggttgcaagtccctgtcctcagaaatgtacgtcaagagctacaccattcactactccgaacaaggagtggagtggaagccttaccgcttgaagtcctcaatggtggacaaaatctttgaaggaaacaccaacaccaagggccatgttaagaatttcttcaaccccccgattatcagcaggttcatccgtgtgattcctaaaacgtggaatcagagcatcgccctgcgcctcgagctcttcggatgcgacatctac

SEQ ID NO: 9059 - DNA, 6672 bp, Artificial Sequence
  Description of Artificial Sequence: Synthetic coding sequence
atgtttccaggttgccctcggctctgggtgttggtagttttgggaacaagttgggttgggtggggatcacaaggcacggaagccgcacagttgcgacaattctatgttgctgcacaaggcatatcttggtcttacagaccagagccaactaactcttctctcaacttgtcagtcacatcatttaagaagattgtttatagagaatatgaaccctatttcaaaaaagaaaagccacaatctactatatctggccttttaggaccgacattgtatgctgaagttggagatattatcaaagttcatttcaaaaataaggccgacaaaccactatcgattcacccacagggaatacgttatagtaagctgtctgaaggagcatcttatttagatcatacttttccagctgagaaaatggacgatgcagttgctccaggacgtgaatatacatatgaatggtcaatatcggaagacagtggaccaactcatgacgatccaccttgcctcactcatatttactacagccatgaaaacctaatagaggatttcaattcagggctcattggtccactgcttatatgcaaaaaaggaactcttactgaaggaggaactcaaaaaactttcgataagcaaattgtcctccttttcgcggttttcgatgaatcaaagtcctggtctcagtcctcttcgctaatgtatacagtgaatggatacgtcaatggaacgatgccagatataacggtatgtgctcatgatcatatttcgtggcacttattaggaatgtcctccggacctgaattgttctctattcacttcaacggacaggttctggaacaaaatcatcacaaggtgagtgcaataacccttgtatctgctacttcaacgaccgcaaatatgacagtaggcccagaaggtaaatggataatttcgtcattgacaccaaaacatctgcaggcaggcatgcaggcttatatcgatattaagaactgccctaagaaaacacgtaatttaaaaaaaattacccgagaacaacgtcgtcatatgaaacgttgggaatatttcattgcagcagaggaggtaatttgggattatgctccagtcatcccagccaacatggataaaaagtaccgatcacaacatttggataatttctcgaatcagatcggaaaacattataagaaagttatgtatactcagtatgaggatgaatcgttcacgaagcatactgttaaccctaacatgaaagaggacggtattttaggtccaatcattagggcacaagttagggatacattgaagattgtcttcaagaatatggccagtcggccgtattctatatatccacacggagttactttttcaccatacgaagatgaagtcaatagctcgttcacgtcaggacggaataacactatgatcagggctgttcaaccaggagaaacctacacctataaatggaatattctcgaattcgacgaacccacagaaaacgatgcccagtgtttgactagaccatattattctgacgttgacatcatgagagacatagcttccggactaattggtttgcttcttatctgcaagtctcgttcactcgatcgtcgtgggatccaacgtgctgccgatattgaacaacaagcggtattcgctgtgtttgatgaaaacaaatcgtggtatttggaggataatattaataaattctgtgagaatccagacgaagtgaagcgtgatgatccaaaattttatgaatccaatattatgagtactattaacggatacgtgccagagtcgattacaacccttgggttttgcttcgacgacacggtccaatggcacttctgctcagtgggtacccaaaacgagatattgacgatccattttacagggcactcgttcatttatgggaaacgacatgaagatacacttacgcttttcccaatgcgcggagaatcggttaccgtcactatggataacgttgggacctggatgttgacatccatgaacagctcgccgcgttcaaaaaagctccgactcaaattccgagatgtcaagtgtatcccagatgacgatgaagactcatatgagatctttgaaccaccagagtcgactgttatggctaccaggaagatgcatgaccgactagaacccgaagacgaggagtcagatgcagattatgactatcaaaatagacttgcagccgcactgggaatcagatcgtttagaaattcgtccttgaatcaagaagaagaggaatttaatctcaccgctctggcactcgagaacggaacggagttcgtgtctagtaatacggatataatcgtcggaagtaactattcgtctccaagtaatatttccaagtttaccgttaataacttagccgaacctcaaaaggcaccgtcacaccagcaagctaccacggcaggatcaccactccgtcatctgattggcaaaaactccgtcttgaatagctcaactgctgagcattcatcaccatatagtgaggatcctatagaggatcctctccaaccagatgtgactggtatccgattgttgtctctgggcgctggggagtttaaatcgcaggaacatgccaaacacaagggaccaaaggtggaacgagatcaagctgccaagcatcgtttctcatggatgaaattactcgctcacaaggtcggtagacacctctcgcaagatactggatcgccatcaggaatgcgaccctgggaggatcttccatcacaagataccggatctccatcgcgaatgcggccatggaaagatccaccatccgatcttctgttgctaaaacagagcaactcatccaaaattcttgtgggtcggtggcatcttgcctcagaaaaaggatcttatgaaattatccaggatacagacgaagatacagccgttaacaactggcttatttcgccacaaaacgcctctcgggcttggggtgaatcaacgccgttagcgaataaacccggtaagcaaagtggacaccctaagtttcctagagttaggcataagtcactacaagtccgtcaagatggtggaaaaagtcgactaaaaaaaagtcaattcttaatcaagacaaggaaaaaaaaaaaagaaaaacatactcatcatgctccactctctccaaggactttccatccactacgttcagaggcctataacacttttagcgaacgtcgtttaaaacactctcttgttctgcacaaaagtaatgaaacatcactgccgactgacctcaatcagacattgccttccatggatttcggatggatcgcatcgctgcctgatcataatcaaaattcaagcaatgatacaggacaggcctcctgtccaccaggactgtatcaaaccgttccaccggaagagcactatcaaacatttccaatacaagatccagaccagatgcattccacttccgatccgtcccatcgtagttcatcacctgaactctcagagatgttggaatacgacagatcacataaatcttttccaacagatatctcacaaatgtcaccaagttccgaacacgaagtgtggcagacggttatttcacctgacttgtcgcaagtgacattgtctcccgaattgtcccaaacaaacctcagcccagatttgagtcatacaactctttcgccggagttgattcagcgcaacctaagcccggcattgggacagatgcccatctccccagatcttagccatactacattgtcaccggatctgtctcataccactctctcacttgatttatcgcagacgaacctttcgcctgagctctcgcagactaatctctccccagctcttggtcaaatgcccctgtcacctgacttgtcgcatactactctctctttagatttctcgcaaactaatctttcgccagaattgtctcatatgactttgtctccagagctttcgcaaacgaatttgagcccagctcttggacaaatgccgatttccccagacctttctcacaccacactctccttagatttctctcaaactaatctatcacctgaacttagtcagacaaatttgtctccggctttaggacaaatgccactctctccagatccatctcatacaacgcttagtttggacctttcacagaccaatctttctccagaattgtctcaaactaatttgtcaccagatctttctgagatgcctttatttgcggatctttcacaaatccctctcactccggacctcgatcagatgactctttcacctgacttgggagagactgacctgtcacctaatttcggacaaatgagtctcagtccagacctttcacaagtcacattatccccagatatttcagatactacactgctgcccgatctgtctcaaatttctcctccaccggatcttgatcaaatattctatccatcagaatcttcacaatcattgcttcttcaagaatttaacgaatccttcccgtatccagatctaggtcagatgccgtccccaagttcgccgaccctgaatgacactttcctgtcgaaggaattcaatcctttggtcattgtgggactctctaaggacggaacggattacatagagatcattccaaaggaagaggttcaaagttcagaagacgactatgccgagattgattatgtaccctacgatgatccatataagaccgatgttaggacaaacatcaacagctcgcgtgacccggataacatagctgcctggtatttacgctccaataatggaaatagaagaaattattacattgcagctgaagagatctcatgggattactcagagttcgtccaaagagaaacggatattgaagactcagatgacatcccagaagatacaacttataagaaggttgtgttccgcaaatacctcgattcgactttcactaaacgggatccaagaggagagtatgaagaacatctgggaatattgggcccgatcatacgtgctgaggtcgatgatgtaattcaagtccgtttcaagaatttagcttcccgtccttatagccttcacgcacacggactttcttacgaaaaaagtagcgagggaaaaacatatgaagacgattcaccagagtggtttaaggaagataatgctgttcagccaaactcatcttacacatacgtttggcatgcgaccgaaaggtctggtccagaatcgccgggttcggcttgtcgtgcctgggcatactattcagcggtgaacccagaaaaagatatacactcgggtttgattggaccacttctgatctgtcagaaaggcattttgcacaaagattctaatatgcccatggatatgcgagaatttgtattgcttttcatgacgtttgatgaaaaaaaatcctggtattacgaaaagaaatcgcgatcgagttggcgattaacatcgagtgagatgaaaaaatcacatgagttccacgctataaatggaatgatctacagtctgcctggactcaaaatgtatgaacaagagtgggtccgcttgcatttattgaacattggaggatcccaggatattcatgtcgtccatttccacggccagactcttctggagaatggaaataaacaacatcagcttggagtatggcccctgctcccaggctcgtttaagacattagagatgaaagctagcaagccgggatggtggttgctcaataccgaagttggagagaatcaaagggctggaatgcaaacccctttcctaataatggaccgagactgtcgtatgccaatgggattgtctactggcattatcagtgacagtcagattaaggcaagcgagttcctaggctattgggaaccacgcttagcccgactgaataacggaggcagttataacgcatggtctgtcgagaagcttgctgcagagttcgcctctaagccctggattcaagtggatatgcagaaagaagttataataactggtatccaaacacagggagccaaacactatcttaaatcctgctacacaactgaattttatgtcgcatactcatcgaatcaaatcaactggcagatcttcaagggaaactcaacacgaaatgtcatgtacttcaatggcaactcagatgcgagtacaattaaagaaaatcagtttgatccaccgattgttgcgaggtatattaggatatcgccaactcgtgcttacaatcgcccaaccttaagactggaattgcagggatgtgaagttaatggatgcagtactccactgggaatggaaaatggcaaaattgagaataagcaaataactgcatcctcttttaaaaagagttggtggggtgattattgggaaccattcagagctcgtcttaatgctcaaggaagagttaacgcttggcaggccaaagctaacaataataagcaatggcttgagatcgatttgttgaaaatcaagaagattactgccatcatcactcagggatgcaagtcgttgtcatctgagatgtatgtcaaatcttacacgattcactactcggaacagggagttgagtggaagccgtaccgcctgaaaagctcaatggtagataaaattttcgagggaaatacaaacactaagggacatgttaagaattttttcaaccccccaattatttctcgtttcataagggttatcccaaaaacttggaatcaatctattgctttgcggctggaactcttcggttgcgacatctat

SEQ ID NO: 9060 - DNA, 6672 bp, Artificial Sequence
  Description of Artificial Sequence: Synthetic coding sequence
atgttccccggatgtcctaggctctgggtgctggtcgtgctggggacatcgtgggtcgggtggggctcccagggaaccgaagctgcacagctgcgacagttttatgtcgccgcgcaaggaatctcctggtcgtaccgtccagagccgaccaatagcagtttgaacctttcagttacttctttcaaaaaaatagtgtaccgcgaatacgaaccctactttaagaaagaaaagccacagtctaccataagcgggcttttgggtccaacactctacgccgaggtgggagatataattaaagttcacttcaagaacaaggccgataagccgctgagcatccacccccaaggcatacgatactctaaactgagtgaaggagcatcctatctagaccataccttccccgcagaaaagatggacgatgctgtggctcctggccgggagtacacctacgaatggtctatctctgaagattccggacccactcacgacgaccccccttgtctgacgcacatctactacagtcatgagaatctgatcgaagattttaactctggtcttatcggccccctgctgatctgcaagaagggaacacttaccgagggtggtacccaaaaaacatttgataagcagatcgtgctgctgtttgccgtctttgacgaaagcaagtcttggtctcagagttcgagtctgatgtacaccgtaaatggatacgttaatgggacgatgcccgatataacagtctgcgctcacgatcacatctcttggcacctccttggtatgtcttctggaccagagctgttttccatacactttaacggccaggtactcgagcagaaccatcataaggtctcagccattaccctggtctcagctacgtccacaacggcgaacatgacagttggacctgaaggaaagtggatcatatcctctctgacaccaaagcacctacaagccggaatgcaagcatatattgacatcaaaaactgcccaaagaagacccgaaacctgaagaaaattacacgagaacagcgccgacacatgaaaaggtgggagtactttattgccgccgaggaggtgatctgggattatgcccctgtgataccagctaacatggacaagaaatacaggagccaacaccttgacaactttagtaaccagataggcaagcattataaaaaggtgatgtacacacagtacgaagatgagagctttacgaagcataccgttaaccccaatatgaaagaagacggaatcttggggcctattattagggcccaggtacgtgacacactcaaaatcgtcttcaagaatatggccagccgaccctactccatatatcctcatggggtgacattctccccgtatgaagatgaggttaattcatcatttacatccggacgtaacaataccatgattcgtgccgttcagcccggggaaacatacacatataagtggaacatccttgagtttgacgagcccaccgaaaacgatgcccaatgtctcacaaggccatactactcagatgtcgacatcatgcgagacatcgccagcggactgatcggactgctgcttatctgcaagtcccgatctctagacaggagaggcattcaaagagcagcggacatagagcagcaggcggtgttcgcagtgttcgatgaaaacaaatcgtggtacctagaggacaacattaataagttttgtgagaacccagacgaggtgaaacgagacgaccctaagttctatgagtccaatattatgtctacaattaacggctacgtccccgaatccattacaacactgggattctgttttgacgacacggtgcaatggcacttctgttccgtcgggacccagaatgagatcttgactatacatttcaccggccattcatttatctacggcaaacgtcacgaagatactctcacactatttcctatgagaggtgaaagtgttactgtgacaatggacaacgttggaacttggatgttgaccagcatgaattcgagccctcgcagtaagaaactccgattaaaattccgagacgtgaagtgcatcccagacgacgatgaagacagctatgaaatcttcgagcccccggaatcaacagtcatggctactcgtaagatgcacgaccgtttagaaccggaggacgaggaatccgacgctgattatgactaccagaaccgactggctgccgctctcggtattaggagctttcgaaacagcagtcttaaccaggaagaagaggaatttaatttaacggccctggcgctggagaatggcaccgagttcgtctcaagcaacacggatataatagtgggaagtaattatagctccccaagtaacatatccaaattcactgtgaataaccttgccgaaccacagaaggctccttctcatcaacaggctaccacggcagggagccccctacgacacctgattgggaaaaatagcgtcctcaacagctccacggcagagcatagttccccctactctgaagaccccattgaggaccccctgcagcctgacgtgacaggcatccgactgcttagtttaggagctggcgagttcaaatcccaggagcacgccaagcacaaaggaccgaaagtggagagggaccaggccgccaagcacaggttttcgtggatgaagctgttagcccacaaggtcggaagacatctcagccaggatacgggatccccttctggcatgagaccatgggaggacttgccgtcccaggacaccggaagtccgagtcggatgcgaccttggaaggacccccccagcgacctcctcctccttaagcagagcaattctagcaagattctggtcggaaggtggcacctagcatctgaaaaaggatcttacgaaataatccaggatacagacgaggacaccgctgtgaataactggctgatcagtccgcagaacgctagcagggcttggggagaatctacaccactagcgaataagcccggaaaacaaagtggacaccctaagttccccagggtcaggcacaagagcttgcaggttagacaggacgggggcaagtctaggctcaaaaagagccaattcttgattaagacccgcaagaaaaaaaaggaaaaacacacccaccatgcacccctctcccccaggaccttccatcctctgaggtctgaggcttacaacactttctcagagaggcgactgaaacactcactggtcctgcataaaagcaacgaaactagcctcccaactgacttgaatcagaccttacccagtatggactttggatggatcgcttctctgcctgatcataaccagaatagctcaaacgatacaggtcaagcctcgtgtcctcctggcctataccagaccgtcccacccgaggagcattaccagaccttcccaatccaagaccctgatcagatgcattccacaagtgacccctctcatcgttcctcatcaccagagctttcagaaatgctggagtatgatcgatctcataagtctttccctacagacatctctcagatgtccccgtcttctgagcacgaagtctggcagaccgtcattagtccggacctctcacaggtgacactctccccagagctcagccagaccaacctgtcgccggacctatcacatactaccctatccccggagcttattcagcgaaacctttctccagcgctgggccagatgcctatcagtccagatttgagtcacactacgctgtcgcctgacttatcacataccacactttcccttgatttgtcccaaacaaacctctctcccgagctgtctcaaaccaatctgtcaccagccttggggcagatgccgctgagccccgacctgtcccacaccaccttgagcctggatttctctcagacaaatctgtcaccagaactgtcccatatgactttgagtcctgagctttcacaaacaaatctatccccagcactcgggcagatgcccatcagccccgatctttcgcacacaacactgtcgctggatttttcacagaccaatctaagcccagagctctctcagaccaatctttctcccgctttgggacagatgcccctttctcctgaccctagtcacacaactctgagcctggatctgtcccagaccaatctttcaccagaactttcacagacaaacttgtctcccgatctgagcgagatgccacttttcgcagacttgtcacagattccacttacccccgacctggatcagatgactctttcgccagatctgggtgaaaccgatcttagtcccaactttggtcagatgagtctgtctcctgacctgagccaagttacactgtcaccggacatttctgatacaactctgctgcccgatttgagccagatatccccccctcctgatctggatcagattttttatcctagcgagagtagtcagtctttgctcctgcaagagtttaatgagtcttttccatacccagacctcgggcagatgcccagccctagctctccgactctgaacgatactttcctgtcaaaggaattcaaccccctggtaattgtcggcctgagtaaggacggtacagattacatagagatcatccctaaggaagaggtccagtcgtccgaggatgactacgccgagattgattatgtgccttacgatgacccttacaaaactgacgttcgcaccaacatcaacagctcaagggaccccgacaacattgcagcctggtatctaaggagtaacaacggaaatcgacgtaattactacatcgctgccgaagaaatcagctgggattacagcgagtttgtgcagcgagagaccgatatagaggattccgacgatattcccgaagacacaacctacaagaaagtggtcttcagaaagtatctggacagtacgttcaccaaaagggatcctaggggggaatatgaggaacacctgggaattctgggacctatcatccgggctgaggtggatgatgtcattcaggttcgattcaaaaatcttgctagccgtccctattctttacacgcccatggcctgagctacgaaaagtcttctgaaggcaaaacatacgaagatgactcacctgaatggtttaaagaggataacgcggtccagcccaatagctcatatacctacgtgtggcacgcgaccgagcggagtggccccgagtctcctggcagcgcttgtagggcctgggcctattactccgcagttaatccagagaaggatatccattcgggtctgattggccccctgctgatttgccagaagggaatcctgcacaaagattctaacatgccgatggatatgcgagaattcgtgctgctgttcatgaccttcgatgaaaagaaatcatggtactatgagaagaagagtcgatcttcgtggcggctgacttcttcagaaatgaagaaaagccacgaatttcatgctattaacggaatgatttattctctgcccggcctcaagatgtacgaacaggaatgggtgcgacttcatctgctgaacattggggggagccaggacatacatgtggtgcattttcatggacagactctccttgagaatggcaataagcaacatcaactcggcgtgtggccccttctacccggctccttcaaaacgttagaaatgaaagcttccaagccaggctggtggctgcttaacactgaggtaggagagaaccagagggcaggcatgcagactccatttctcattatggatcgtgactgcagaatgcccatggggctgtccacgggtatcatctccgacagtcaaattaaggcctctgagttcttggggtattgggagccacgactggccagactcaacaacggcgggtcttacaacgcgtggtcagtagagaagttggccgcagagtttgcaagcaaaccctggatccaggtcgatatgcagaaagaagtgataataacagggatccagacacagggggccaaacactatctcaagagctgttacactactgaattttatgtggcctattcttccaaccagattaattggcaaattttcaagggtaactctactaggaacgtaatgtacttcaatggcaattctgacgcatccactatcaaagaaaatcaattcgatcctccaatcgtggcacgatacatcaggatatctcctacacgtgcttataacagaccgactctgagactcgagttacaaggctgtgaggttaatggctgctccacccctttgggtatggagaacggaaaaatcgaaaacaagcaaatcaccgcctcctcattcaagaagagctggtggggagactactgggagcctttcagggcaagacttaatgcgcagggcagagtaaacgcttggcaagcaaaggctaataacaataagcagtggcttgaaatagatctattaaaaatcaagaaaataaccgccattatcactcaagggtgtaaatccttatcatccgaaatgtacgtgaagtcgtacactattcattactctgaacagggtgttgagtggaaaccttaccgactcaaatccagcatggtggataaaattttcgaagggaataccaacacaaaggggcacgttaaaaactttttcaatcccccaataatcagccgattcatcagagtcattcccaagacctggaatcagtcgatagccttgaggctggaacttttcggatgtgatatctat

SEQ ID NO: 9061 - DNA, 6672 bp, Artificial Sequence
  Description of Artificial Sequence: Synthetic coding sequence
atgttcccgggatgtccaagactgtgggtgctcgtggtgttgggaacctcatgggtcggatgggggtcccagggaacggaagcggcgcagctcaggcaattctatgtcgctgcccaaggaatctcctggtcttaccgccccgagcctaccaacagctcattgaatctgtcggtcaccagcttcaagaagatcgtctaccgggaatacgaaccgtactttaagaaggaaaagccccaatcaactatctcaggcctgctgggacctaccctctacgccgaggtgggagacatcatcaaggtgcacttcaagaataaggcggacaaaccactgtctattcacccacaaggcattaggtactcaaagctgtccgaaggtgcttcgtacctcgaccacaccttcccagccgagaagatggacgacgctgttgcccctggacgcgagtacacctacgagtggtcaatttcggaagattccggacctactcatgacgacccgccgtgcctgacccatatctactactctcatgaaaaccttattgaggatttcaattccggactcattggaccgctcctcatatgcaaaaagggcaccttgactgagggaggcacccagaaaacctttgacaaacagatcgtcctcctgtttgcagtgtttgacgagtctaaatcctggtcccagtcatcgtcccttatgtacaccgtcaacggatatgtgaacggaactatgccagacatcactgtgtgcgctcatgatcatataagctggcacctgctgggaatgagctcgggaccggaactgttctcgatccacttcaatggccaagtgctggagcagaatcaccataaagtgtcggctatcactcttgtgagcgcgacttcgaccacggcgaacatgacggtgggaccagaaggaaagtggatcatttcatcactgaccccgaagcacctccaagcaggcatgcaggcctatatcgatatcaagaattgccccaaaaagactcggaacctcaaaaagatcactcgagagcaacggcgccatatgaagaggtgggaatacttcatcgcggcagaggaggtgatctgggactacgcgccagtcatccctgccaatatggacaagaagtaccgctcgcagcacctggacaacttctctaaccagatcggcaaacattacaagaaggtgatgtacacccagtacgaagatgagagcttcaccaaacacaccgtcaaccccaatatgaaagaggacggcattctgggcccaatcataagagcgcaagtcagagatacgctgaagattgtgttcaagaacatggcctccagaccctactccatttacccgcacggagtcacgttctcgccgtacgaggacgaagtgaactccagctttacttcgggacgtaataacactatgatccgcgcggtccaacctggcgaaacgtacacctacaagtggaacatcttggagtttgacgaaccaactgagaacgatgcccaatgcttgacccgcccttactacagcgatgtggacatcatgcgtgacatcgcctccgggctgatcgggctcttgctcatctgcaagagccgcagcctcgatcgacgtggaatccagagggccgccgacatcgaacaacaggcggttttcgcggtgttcgatgaaaacaagagctggtaccttgaggataacatcaacaagttctgcgagaacccggatgaagttaagcgcgacgaccctaaattctacgagtcaaacattatgtccaccatcaatggctacgttcctgaatcgatcaccacgctgggtttttgtttcgatgataccgtgcagtggcacttttgctccgtcgggactcagaacgaaatcctcactatccatttcactgggcattcgttcatctacgggaagcgccatgaggacaccctgaccctgttcccaatgcgcggagaatccgttaccgtgactatggataacgtgggaacgtggatgctcacgagcatgaactcctcacctagatccaagaaactccggctgaagttccgagatgtgaagtgcataccagatgacgacgaggattcatacgaaatcttcgagccgccggaatcaactgttatggctaccagaaagatgcacgaccggctcgaaccagaggacgaagaatccgacgcagactacgattaccagaatagactggctgcagcgctgggaatccggtcgttccggaattcttccttgaatcaggaggaggaagaattcaatctgaccgctctcgcattggagaacggaacggagtttgtcagctccaacaccgacatcatcgtgggctcgaactactcgtccccatcgaatatctcaaaattcaccgtcaataacctcgcggaaccgcagaaagccccgtcacaccagcaggctactaccgcagggagcccgctcagacaccttatcggaaaaaactccgtgctgaattcgtcgactgccgaacattcgtcaccctactcggaagatcccatcgaagatcctctgcaacctgacgtcacggggatccggctgctgagcctcggggccggggagttcaagtcacaagagcatgctaagcataaaggccccaaggtggaaagggaccaagccgcaaagcaccgctttagctggatgaaactgttggcgcacaaagtgggccgccacctgtcacaagataccggttcgccctcgggaatgcgtccttgggaggacctgccatcccaagacaccggttccccatcgaggatgcggccttggaaagatccgccgtccgatctgttgctccttaagcagtcgaactcatcaaaaatcctcgtgggacgctggcacctggcgtcagagaagggatcgtacgagatcatccaggacactgacgaggacaccgccgtgaacaactggctgatctcgccgcaaaatgcctcgcgcgcgtggggtgaatcaacgcccctggccaacaaacctggcaagcagtcgggtcacccaaagttcccaagagtgcggcacaagtcacttcaggtgcggcaggatggtggaaagtcgcggctgaagaaatcacagtttctcatcaagacgcgcaagaaaaagaaagagaagcacacccaccatgcccccctgtccccgcggactttccacccactccggtccgaagcatataacaccttctcggagcgacggctgaaacattccctggtgctgcataaatccaacgagacttcccttccaaccgatttgaaccaaactctcccaagcatggacttcgggtggatcgcgtctttgcccgaccataaccagaactcctcgaacgatactggtcaagccagctgtccgcccggtctttaccagaccgtgccacccgaagagcattaccaaacttttccaatccaggacccggatcagatgcactcgacctccgatccgtctcaccggtcaagctcgccggaattgtctgaaatgctggaatacgatcgctcccataagagcttccccactgatatcagccaaatgtcaccgtcatcggaacacgaagtgtggcagactgtgatctcgcctgacctctcccaagtgaccttgtcaccggaactttcgcaaaccaatctttcaccggatctctcgcataccaccctgagcccggaactcatccagcgcaacctctcgcctgcacttggacaaatgccaatctcgccggatctgtcgcacactactctcagccccgatttgtcacatactactctgtcactcgacctgtcgcagactaatctttcgcctgaactcagccaaacgaatttgtccccggcactgggtcagatgccgctgtctccggacctcagccacaccactctgtcgctggacttctcacaaaccaacctctccccagaactcagccatatgacccttagccccgaactgagccagactaatctctcgccggccctgggacagatgccgatctccccagatctgagccataccaccctctcactggatttttctcaaaccaacttgtcacctgaactgtcccagacgaacttgtccccggcgctgggccaaatgccactgtccccggatccttcacacaccactttgtcactggatctctcccaaacgaacctgtctccggaactttcacagactaaccttagcccggacttgtcggaaatgccgctctttgccgacctctcccagatccctctgacccccgacctggatcagatgacgctgtcccctgacctcggtgaaaccgacctcagcccgaacttcggacaaatgagcttgtcgcctgatttgtcacaggttactctgagcccagatatttcggacacgacgctgctgccggacctgtcacaaatatcaccgcctccggacctggaccagattttctacccaagcgaatcgtcccagtcactgctcctccaagagtttaacgaatcgtttccctaccccgacctgggccagatgccgtccccgtcgtcaccgactctgaatgacacttttctgagcaaggagttcaaccctctggtgatcgtgggtctttctaaggacggaaccgactacatcgaaatcatcccgaaggaagaagtgcagtcatccgaggacgactatgccgagatcgattacgtgccatacgacgacccttacaagactgatgtgagaaccaatatcaactcctcacgggacccagacaacattgccgcttggtacctgaggtctaacaacggtaacagacgaaactattacattgccgcagaagagatcagctgggattactcggagttcgtgcaaagagagactgatatcgaagattccgacgatatcccagaggacacgacttacaagaaagtcgtgttccgcaagtacctggactccacctttactaagcgggatccgcgcggagaatatgaggagcaccttgggatcttggggccgattattcgcgcagaagtcgacgatgtcattcaggtgcgatttaagaatcttgcatcgcgcccttactcactgcatgcgcatggtctgagctacgaaaagagctccgagggaaagacttatgaggacgattcaccggagtggttcaaggaggacaatgccgtgcaacccaacagctcctatacctacgtgtggcacgcaactgaacggtctgggccagaatcgccgggatcggcatgtagagcctgggcctactactcagcagtgaatccagaaaaagatatccactccggcctgattgggccgctgctgatttgtcagaaaggaatcttgcacaaggactccaacatgccgatggacatgcgcgaatttgtgctgttgtttatgactttcgacgagaaaaagtcatggtactacgagaagaaatcccggtcctcctggcggctcacctcctcagagatgaagaagagccatgagttccatgccatcaacggaatgatttacagcctgccaggtctgaagatgtacgaacaagaatgggtgcggctgcacctgctgaatatcggcggatcccaggatatccatgttgtgcacttccacggacagaccctgctggaaaacggcaacaaacagcaccaactgggagtctggcctctgctccctggatccttcaagacccttgagatgaaggcctcgaagccgggatggtggcttcttaacactgaagtcggagagaaccaacgggccggaatgcagactcccttcctcatcatggacagagactgccgcatgccgatggggctgtccactggcatcatttcggattcacagatcaaagccagcgaattcctcgggtactgggaaccccgcttggcaagactgaataatggcggatcttacaacgcttggtcggtcgaaaagctggccgcggagttcgcaagcaagccgtggatccaggtcgatatgcagaaagaagtgattatcaccggaatccagactcagggggccaaacactacctgaaatcctgctacaccactgagttctacgtcgcgtacagctcgaatcagattaactggcagatcttcaagggcaacagcactaggaacgtcatgtacttcaatggaaattcggacgcatccactatcaaggagaatcagttcgacccacccatcgtggctcgctacatccgcatctcgcctacccgcgcttacaaccgcccaactctgaggttggagctgcaggggtgcgaagtgaacggatgtagcaccccgctgggaatggagaacggcaagatcgagaataagcaaatcaccgcctcatcgttcaagaaatcgtggtggggggattactgggaaccattcagagctcggctgaacgcccagggccgcgtgaatgcttggcaggccaaagctaataacaataagcagtggctcgagatcgaccttttgaaaatcaagaagatcaccgcgatcatcacccaagggtgcaagtcgctgtcctcggaaatgtacgtgaagtcctacactatccactactctgagcagggagtcgaatggaagccttatcggcttaagtcctcgatggtcgacaagatctttgaaggaaatactaacacgaagggccacgtgaaaaacttcttcaatccgccgatcatcagccgcttcatacgcgtgattccaaagacttggaaccaatccattgcgttgaggctcgaactgttcggatgcgatatctac

SEQ ID NO: 9062 - DNA, 6672 bp, Artificial Sequence
  Description of Artificial Sequence: Synthetic coding sequence
atgtttcctggctgcccaaggctctgggtgcttgtggttctggggacgagctgggtgggttggggttcgcaaggcaccgaagcagcacagctgagacagttctacgtcgcagcacaaggaatctcgtggtcgtaccgcccagaaccgactaattcgtcgctcaacctctcggtgaccagctttaagaaaattgtctaccgagaatatgaaccgtacttcaagaaggaaaagccacagtccactatcagcgggctccttggacctaccctctatgccgaggtcggtgacattatcaaagtccactttaagaataaggcggataaacctctgtcgattcacccacaaggtatccggtactcaaagctgagcgaaggtgcctcataccttgaccacaccttccctgctgagaagatggatgatgccgtggcccctggtagggaatacacctacgaatggtcgatctccgaagattccggcccgactcatgatgatccaccctgcttgactcacatttactactcgcatgaaaacctgatcgaggacttcaactcaggactgattggccctcttctgatttgcaagaagggtactctcaccgagggtggtactcagaaaactttcgataaacaaatcgtcctgcttttcgccgtgttcgatgaatccaagtcctggtcgcaatcttcttcgctgatgtacaccgtcaacggctacgtgaatggaaccatgccggatattactgtttgcgcacacgatcacatttcatggcatctgcttggaatgagctccggtccggaactgttttccatccatttcaacggccaggtgttggaacaaaaccaccataaggtgtccgcaattactctggtgtcggcaacctcaaccaccgccaatatgactgtgggacccgagggcaaatggatcataagcagcctgactcccaagcatctccaagctggaatgcaggcctacattgacataaagaactgtcccaagaaaactagaaacctcaagaagattaccagagaacaaagacgccatatgaagcggtgggagtactttatcgccgcagaagaggtgatctgggactatgcaccagtgatccctgctaacatggacaaaaagtacaggagccaacatctcgacaacttctccaatcaaattggcaagcactacaagaaagttatgtacacgcagtatgaagatgagtcctttaccaagcacaccgtgaaccccaatatgaaagaagatggaatcttggggcctattatccgagcgcaggtgagggataccttgaagattgtctttaagaacatggcttcaaggccctactcaatatacccacatggagttaccttctccccgtatgaggatgaagttaattcctcgtttactagcggacgtaacaataccatgattcgtgcagtgcagcctggtgaaacctacacctataagtggaatattcttgaatttgatgaaccaactgaaaatgatgctcaatgccttaccagaccgtactactcggatgtggacattatgcgagacattgctagcgggcttatcgggcttctgcttatttgtaagagccgatccttggatagaaggggtattcaacgcgctgccgatatcgagcagcaagcagtgtttgcagtctttgatgaaaacaagtcctggtatctggaggacaacatcaataagttctgcgaaaatcctgatgaagtgaagcgtgacgaccccaagttttacgagtcaaacattatgtcgacgattaacggatacgtgccagaatcgattaccacccttggcttttgttttgacgataccgtgcaatggcatttttgctcggtcggaacgcagaacgaaattctcaccatccattttactggccattcctttatctacggtaaaagacatgaggacactctgacgctgtttccaatgcgcggagaatctgtgaccgtgactatggataatgtgggaacgtggatgcttacctccatgaactcgtcacctaggtccaagaaactgcgcttgaagttcagagacgtcaagtgtattcctgatgatgatgaggattcttacgagatttttgaacccccggaaagcactgtcatggccaccagaaagatgcacgacagactcgagccagaggatgaagagtcggatgcggactacgactaccagaaccggcttgcagcagcgctggggatccgctccttccgaaattcatccctcaaccaggaggaagaagagttcaatctgaccgcactggcacttgaaaatggaaccgagtttgtcagctcgaacaccgatatcatagtgggatcgaattactcgtctccctccaacattagcaagtttaccgtgaacaatctggcagaaccccaaaaggcaccatcccatcagcaggcaacgacggccgggagccctttgagacacctgatcggcaaaaacagcgtgcttaactcctcgaccgcggagcatagctcgccatatagcgaagatcctatcgaggatcctctgcagccagatgtgacgggaatcagattgctgtcattgggggcgggtgaattcaaaagccaggaacatgcaaagcacaagggacctaaggtggaacgagatcaggcagcaaagcatcggttctcgtggatgaagttgctggcccataaggttgggagacatctctcccaagatactgggtcaccatccggtatgcggccgtgggaagatctgccttcgcaagacaccggatccccctcacgaatgaggccttggaaggatccaccttcagaccttcttctgcttaagcaatcgaactcctcgaaaattcttgtcggtagatggcatctggcgtctgaaaagggatcgtacgaaatcattcaagacacggatgaagatactgcagtgaacaattggctgatttcgcctcaaaatgcatccagagcatggggggaaagcactcctctggcaaacaagccagggaagcagagcggtcatcccaagtttccccgcgttcgtcataagtcacttcaagtccgccaagatggaggaaaatccagacttaagaaatcccagttcctgatcaaaacgcgcaagaagaaaaaagaaaagcacactcatcatgcacccctgtcccctaggacttttcatcctcttcggtccgaagcctacaacacgttcagcgagcgcagactcaaacacagccttgtgctgcacaaaagcaacgaaacctctctgccgactgatctgaaccaaactctgccatcgatggacttcggatggattgcctcgcttccggatcataatcagaactcgagcaacgacaccggtcaagcatcctgtccccctggactctaccaaaccgtccctcccgaagagcattaccaaacgtttcctattcaagaccccgaccagatgcatagcacttccgacccatcacatcgctcttcgtcccctgaactctccgaaatgctcgaatacgatcgaagccacaagtccttccctacggatatatcccagatgtcgccttcatcagagcacgaagtctggcagaccgtgatttcccctgatttgtcacaggtgacgctctccccagaattgtcgcagaccaacctcagcccagatctctcccatactaccctctctcctgaattgatacaaagaaatctttcgcctgcacttggacaaatgcctatttcgcctgatcttagccataccacgctcagccctgacctgtcccacaccacgctgagcctcgatctgtcgcaaactaatctttcgccagaactctcgcagactaatctgtcgccagcactggggcagatgccactgtctcccgatctgtcccataccacccttagcctggatttttctcagactaacttgtcgcccgaactttcccacatgactctttccccagagcttagccagaccaacttgtcccctgcactgggtcagatgcccatcagcccagacctctcacacaccactctgtcgcttgacttctcacagaccaatctttcaccggagctgagccaaaccaacctgtcccccgcccttggtcagatgccactctcacctgacccctcacatactactctgagcctggacttgtcacaaacgaacctttcccccgagttgagccaaacgaacctcagccctgatctctccgagatgcccctttttgcagacctgtcgcaaattccgctcacccctgatctcgaccaaatgactctgtccccagatctcggtgaaactgatctgtccccgaattttggacagatgagcctttcgcctgacctctcgcaagtcactctttcacctgacattagcgatactacgctccttcctgatctgtcgcagatctcgcctcctccggacctggaccagatcttttatccttcggagtcatcacaatcccttcttctgcaagagtttaacgagagctttccatacccggaccttggtcaaatgccctcgccatcctcaccaactcttaatgacacttttctgtccaaggagttcaacccccttgtgatcgtcgggcttagcaaagacggtacggattacatagaaatcattccaaaggaggaagtccagtcgtcggaagatgactacgcagagattgattacgtcccttatgatgacccctacaaaactgatgtgagaaccaatatcaacagctcccgggatcctgataacattgcggcatggtacctcagatcaaacaatggaaatcgtcggaactattacattgccgccgaagaaatatcatgggactactcagagtttgtgcaacgcgaaaccgatatcgaagattcagatgacatcccagaagatactacctacaaaaaagttgtctttagaaaatacctcgattcaacttttactaaacgcgacccccgaggtgaatacgaggaacatctgggcattcttgggccaatcatacgcgcagaggtggatgatgtgatccaagtccgctttaagaatcttgcaagccgtccatacagcttgcatgctcatggcttgtcatacgaaaaatcgagcgaaggaaagacttatgaagatgactcgccggaatggtttaaagaggataacgcagttcagcctaattcctcgtacacttatgtctggcacgccacggagcgctcgggacccgagtcacctggatccgcatgtcgtgcatgggcatactactccgccgtgaacccggagaaggatatacactcagggctgattggaccgctgctcatttgtcagaagggcatactgcacaaagattcgaacatgccaatggatatgcgggaatttgtgctgttgtttatgacttttgatgagaagaagtcatggtattacgaaaagaagtcacgctcgtcctggcgacttacttcctccgagatgaagaagtcacatgaattccatgctataaacggaatgatctattcactgcctggcctcaagatgtacgaacaggaatgggtccggttgcatctcctgaacattggaggaagccaagatatacacgtggtgcatttccacggtcaaaccctgcttgaaaacggcaacaagcagcatcaacttggtgtgtggcctcttctgcccgggtcgttcaagactcttgagatgaaggcgtcaaagccaggatggtggctgcttaacaccgaagtgggagaaaaccaaagagcaggcatgcagaccccttttcttatcatggatagagactgtaggatgccaatgggtctttccaccggaattatctccgactctcagattaaggcatccgagtttcttgggtactgggaaccgaggcttgcccggcttaacaacggtggatcgtacaacgcgtggtccgtggagaaactggcagcagaatttgcctcaaaaccttggatacaagtggacatgcaaaaagaagtgattatcactggtattcaaacccaaggcgcaaagcactatctcaagtcgtgttacacgactgaattctacgtggcctatagctcgaatcaaatcaactggcagattttcaagggcaactcgactcggaatgtgatgtactttaatggaaattcagatgcgtcgacgatcaaggagaaccagttcgatccacccatcgtcgctcgctacattaggatcagcccgactagagcgtacaaccgcccgacccttcgacttgaactccaaggttgtgaagtgaacggttgttctaccccactgggaatggaaaacggcaagattgagaataagcagattaccgcctcgtcgtttaagaaatcctggtggggcgattactgggaaccattccgggcacgtctcaatgcgcagggacgggtgaacgcttggcaggctaaggcaaacaataacaaacaatggcttgagattgacctgcttaagatcaaaaagattaccgcgatcattacccaaggatgcaaaagcctgtcatctgaaatgtacgtgaagtcgtacacgatacattactccgagcagggcgtcgaatggaagccataccgtctcaagtcctcaatggtcgacaagattttcgaaggaaacacgaataccaaaggacatgtcaaaaactttttcaatccaccaatcattagccgctttatacgcgtgattcctaagacctggaatcaatcaattgccttgaggctcgagctgtttggctgtgacatttac

SEQ ID NO: 9063 - DNA, 6672 bp, Artificial Sequence
  Description of Artificial Sequence: Synthetic coding sequence
atgttcccaggatgtccccgcctttgggttttagtggtgctagggacaagttgggttggatggggatcccagggaactgaagctgcacaacttcgtcagttttacgtggctgcccaggggatctcttggtcttataggcccgaaccaactaattcatcccttaatctgtcagtgacttcctttaagaaaatcgtatatagggaatatgaaccttattttaagaaagaaaaaccacagtctactatctccggattactcgggccaacattgtatgccgaggtgggagatataatcaaagtccatttcaaaaacaaagccgacaaacctctctcaatccatccacagggaatccggtatagtaagctttctgaaggggctagttaccttgaccacacattcccagctgaaaagatggacgatgcagtggcccccggacgagaatacacttacgaatggtctatctccgaagattccggacctactcacgatgatccaccctgcttaacacacatttattacagtcatgagaacctgattgaagattttaactcagggcttattggacccctcttgatatgtaaaaaggggacattaactgaaggggggactcagaaaacattcgataaacaaatagtgctgctgttcgccgtttttgatgaatctaaatcatggtctcagagttcctcattgatgtatactgtcaacggatatgtgaacgggactatgcccgacattacagtgtgtgctcatgatcacatttcctggcacctgctaggaatgtctagtggacctgaactgttcagtatacatttcaacggacaggtcctggaacagaatcatcataaggtatctgcaatcactctggtgtctgccacaagtactacagcgaacatgactgtgggaccagaaggaaaatggatcatctcctctctcacacccaaacatctgcaagcagggatgcaggcctatatcgatatcaagaactgtcccaagaagacaagaaatttgaagaaaatcactagggaacagcgtaggcatatgaagcggtgggagtactttatcgcggctgaggaggtgatctgggattacgctcccgttattcccgccaatatggataagaaatatcggtctcagcatctagataatttttctaaccaaataggaaaacattataaaaaagtcatgtatacacaatatgaagatgaatcatttacaaagcacactgtgaatcccaatatgaaagaagatgggatactcgggccaatcattagggcacaggtacgggatactctaaaaattgtgtttaaaaatatggcatctcggccctatagtatctaccctcatggggtaacattcagtccatatgaggatgaggtgaatagttctttcacaagtggacggaacaacacaatgatacgcgcggtccagcctggggaaacttatacttacaaatggaacatcctcgaatttgatgaaccaactgagaacgatgcgcagtgccttacaagaccttattattccgatgtggatataatgcgggatattgcttctgggcttatagggcttctcctgatttgtaaatcacgctcactcgatcgacgggggatccaaagagccgccgacatcgaacagcaggccgttttcgcagtcttcgatgaaaataaatcttggtatctggaagataacattaataagttctgtgaaaaccctgatgaagtaaaacgggatgatccgaaattttatgaatccaatatcatgagtacaataaatgggtacgtgcctgaatccataacaacattgggattctgcttcgatgatacagtacagtggcacttctgttctgttgggactcagaacgaaatcctcactatacacttcacagggcatagtttcatatatgggaaaaggcacgaggacactctgactctattccctatgcggggggaatcagttacagtcactatggacaacgtgggaacttggatgctgacatccatgaattcttctcccagatccaaaaaacttaggttaaaattccgagatgttaaatgtatacccgatgacgatgaggactcatatgagatctttgagccaccagagagtacagtgatggcaacaagaaaaatgcacgaccggcttgagcccgaagatgaagaaagtgatgcagactatgactatcagaatcgactggcagctgctctcgggattcggtccttcagaaacagtagtctgaatcaggaagaagaggagtttaatctcacagccttagctctcgaaaacgggacagaattcgtaagtagtaacacagatatcatcgtcggaagtaattatagttccccttccaacatctccaagtttactgtaaataaccttgctgaaccacagaaagctccaagtcaccagcaggctacgacagccgggagtccactcaggcacctcattgggaagaacagtgtgctgaattcttcaactgcggaacatagttccccctattccgaagatccaatcgaagatccccttcagcccgatgttactgggatacgactcctttctctcggggctggagaattcaaatcccaggaacacgccaagcacaaaggacctaaagtggaacgcgatcaggccgccaaacatcgcttttcttggatgaagctcctcgctcataaggtaggaaggcacctttcacaggacacagggtcaccctctgggatgaggccttgggaagatctccccagtcaggatactggaagtccttccagaatgcggccctggaaggatccccccagtgatctcctactcctgaagcaatcaaattcatctaaaatactagtcgggagatggcatttagcctcagaaaaagggtcctacgaaataatccaggatacagatgaggatactgctgtgaataactggcttatctctccccagaatgccagtcgggcgtggggggaatccactccactggccaacaaaccaggaaaacagtccggacatcccaaattcccgagggtgaggcataaatctttgcaggtccggcaggatggggggaaatcccggttgaaaaaaagtcagtttctaataaaaacacgaaaaaagaagaaagaaaaacacacacatcacgctccactctcccccagaacttttcatcctttacggtctgaagcgtataacacattctccgagagaaggctcaaacacagtctcgttcttcacaagtcaaatgaaacatcccttcctacagatttaaatcagacacttccttctatggatttcgggtggattgcatccctccctgaccataatcagaactcatctaacgatactgggcaggcctcatgccccccaggactctaccagactgtaccgcctgaggagcattaccagactttccccatacaggatccagaccagatgcattctacatccgacccatcccaccggtcatcgtcccctgaactctcggaaatgcttgaatatgatcgcagtcacaaatctttccccacagatatctcacagatgagtccatcctccgaacatgaagtgtggcagactgtcatctctcccgacctcagtcaggtgacgttgagtcccgaattatctcagacaaacctctccccagatctctcccatacaacactgtctcccgaactgatccagagaaacttgtccccagccctcgggcagatgcctatatccccagacctttcgcacactacactgtctcccgatctgtctcatacaacactctcactggatctctcacagacaaacctctcacctgagttgagtcagactaatctctcccctgctctcggacagatgccactgagtcccgatctctcccatacaacactttctctggacttttctcagacaaatctatctcccgagctgtcacatatgactctgagtcccgaattatctcagactaacctgtctccagcgctggggcagatgcctatatcgcctgatctttctcatactactctatctcttgatttttcccagacaaacctatctccagaactctctcagactaatctctctcccgcgctgggacagatgcccctctctcccgacccttcccatacaacactttccctcgacttatcccagacaaatttgagtcctgaactgagtcagacgaacctctcaccagatctttctgaaatgcctctgttcgcagatctttcacagattcctctgactccagatctggatcaaatgacactgtcacctgatcttggagagacagacctgtctcctaatttcgggcagatgtctttatccccagatctttcccaggtaacactctctcccgatatttccgatactacactgcttccagatctatctcagatctcccccccacccgatttggaccagatcttttatccctcagaatcgagtcagtctctactgctgcaggaattcaacgagagttttccctatcctgatctcggacagatgccttctccctcctcccccacacttaatgatacatttctgtcaaaggaattcaatccactcgtcatcgtggggctatcgaaggatggaacagattatatcgaaataataccaaaggaagaagttcagtcctcagaagatgattacgcagagatagattatgtgccatatgatgatccctacaaaacagatgtcagaacaaatatcaactcaagtcgcgatcccgataatatcgctgcttggtatctgaggtctaataacgggaataggcggaactattatattgccgcagaagaaatatcctgggattattcagaatttgttcagagggagacagatatcgaggattccgacgatatacccgaagacacaacatataaaaaagtggtattcagaaagtacctcgatagtactttcacaaaaagggatcctcgaggagaatatgaagaacatctcggaatcctagggcccattatcagagccgaggttgatgatgttatacaggtgagattcaaaaaccttgcaagtcggccatattctctccacgcccacgggctcagttatgaaaagtcaagtgaaggaaaaacatatgaagatgattccccagaatggttcaaagaggacaacgccgtacagcctaattcatcgtatacgtatgtatggcatgccactgagcgttccggacccgagtcccctggatccgcttgtagggcctgggcttattattcagccgtgaatcctgaaaaagatatacatagtgggctgatcgggcccctattaatctgccagaaagggatcctgcacaaggattccaatatgccaatggatatgcgcgagtttgtgttactcttcatgactttcgacgagaaaaaatcctggtattacgagaaaaagagtaggagttcttggagactgacttcatccgaaatgaagaaatctcacgagtttcacgccataaacggaatgatatattcattaccaggactgaagatgtatgagcaggaatgggtccggttacacctgctgaatataggaggatcacaggatatccatgtggtccactttcacgggcagacattactcgaaaacgggaacaagcagcaccagcttggagtgtggcctctcttacctggatcattcaaaactttagagatgaaagcctccaaaccagggtggtggcttctcaacacagaagtcggagaaaatcagcgggctggaatgcagactccttttctcatcatggatagagattgtcgaatgcctatgggattatcaacaggaattataagtgactcacagataaaagcttccgaatttttgggatattgggaaccccgcctggcaaggcttaataacggaggatcctataacgcctggtctgtcgaaaaactggcggccgaattcgcttctaaaccatggatacaggttgatatgcagaaagaagtcataatcactgggattcagacacaaggagcgaaacactacctcaaatcttgttatacaactgaattttatgttgcctatagttccaaccagattaattggcagatctttaaaggaaactcaactagaaacgtgatgtattttaacggaaactcagatgcctcaacaataaaggaaaaccagttcgatcccccaattgtagcacggtatatcaggatatctcctacacgggcttataatagacctactctgaggctggaacttcaaggatgcgaggtcaatggatgttctactccactagggatggaaaacgggaaaattgagaataagcagataactgctagttcattcaagaaatcttggtggggggattattgggaaccttttagagccagattgaatgctcagggaagagtgaatgcctggcaggctaaggcaaacaacaataaacagtggcttgaaatcgaccttctaaaaatcaaaaaaatcactgcgattatcactcagggatgcaaatccctttcttcagaaatgtacgttaaatcttatactattcattatagtgagcagggggtggaatggaaaccttacagactcaaatcttccatggtcgataaaatcttcgaggggaatactaacactaaagggcacgtgaaaaatttcttcaacccaccaattatttcccgattcatccgggtcatccctaagacttggaatcagtctatcgctctgcgactcgaactgtttgggtgtgatatatat

SEQ ID NO: 9064 - DNA, 6672 bp, Artificial Sequence
  Description of Artificial Sequence: Synthetic coding sequence
atgtttcccggttgcccccgactgtgggttctcgtcgtgctagggaccagctgggtcggatgggggagtcaaggaaccgaagcggcgcagctgaggcagttttacgttgccgcgcagggcatcagctggtcctatagaccagagcccactaattccagcctcaatttgtccgtgaccagctttaaaaaaattgtctaccgcgagtacgagccctacttcaagaaggagaagcctcagtccacaatctctggtctgctgggacctacgctgtacgctgaagtgggtgacatcatcaaggtgcacttcaaaaacaaagccgataagcctctgagcattcatccccaaggaatccggtacagtaaattaagcgaaggggcatcttatctggaccacaccttccctgcagagaagatggacgacgcagttgctccgggccgcgagtatacatacgaatggtccatttcagaagactctggccccacccatgatgacccaccttgtcttacccatatatactatagccatgaaaatctgatagaggatttcaattctggcctcattggccccctattgatctgtaagaaaggcacactaacagaggggggcacacagaagacctttgataaacagattgtcttactgttcgcggtgttcgacgaatccaagtcctggtcccagtctagtagcttaatgtacacagtcaatgggtatgtcaacggcacaatgcctgacatcacagtttgcgcccatgatcacatctcctggcatctcttaggcatgagtagtggcccagaactgtttagtattcatttcaacgggcaagtgttggaacagaatcaccataaggtgtcagccataaccctagtgagcgctacctccactaccgcaaacatgactgtcgggccggagggtaaatggatcatttcctcactgactcctaagcacctgcaagccggcatgcaggcatacattgacattaagaattgccctaaaaagacaaggaacttgaaaaaaattaccagggaacagcgccggcatatgaaaaggtgggaatactttatcgctgccgaagaggtgatctgggactacgcacctgtaatccctgctaatatggacaagaaatatagatctcagcatttggataatttcagtaatcagatcggtaagcattataaaaaagtgatgtacacacagtacgaagacgagtcatttacaaaacatactgtgaatcccaatatgaaggaggacggaattctcgggccaattatcagagcccaggtgagagacacactgaaaattgtgtttaagaacatggcttcacggccctattcaatctacccccacggggttactttctcaccctatgaagatgaggtcaatagttccttcacttcaggtcgcaacaacaccatgattagggccgtccagcctggggagacttacacttataagtggaacattttagagttcgacgagcccacagagaatgatgctcagtgccttaccagaccttattattcagatgtggacataatgcgcgacatagctagtggccttattggattgctcctgatctgcaagagccggagcctggatcgcagaggcatacagcgggcagcagatatcgagcaacaggccgtcttcgccgtcttcgacgagaacaaaagctggtatttggaagacaacatcaataaattttgtgagaaccctgacgaggtcaagagggacgacccaaaattttacgaatctaatatcatgtccacgatcaacggttacgtgcccgagtccatcactactctgggattttgttttgatgatactgttcagtggcacttctgttctgttggcacacagaacgagatacttaccatccatttcacagggcattccttcatctatggtaaacgacatgaggatactctcaccctgttccccatgagaggagagagtgtgactgtgaccatggacaacgtggggacctggatgctgacaagtatgaactctagccctcgcagcaaaaagctcagattaaaattcagggacgtcaaatgcattccggatgacgacgaggattcctatgagatcttcgagcccccggagagcactgttatggctacaaggaaaatgcacgaccgcttagagccagaagacgaggaatcagacgccgactatgactaccaaaatcgcctcgccgcagccttgggaatacggtccttccgcaattcctctctgaaccaggaagaggaggagttcaatctcactgccctagctctggagaacggaactgagttcgtatccagtaatactgacattattgtcggttctaactactcctccccaagtaatatttcaaagttcaccgtgaataacctggccgaaccccaaaaggcccccagtcaccagcaagcgacgacggcagggagtcccctgcgccacctgatcggcaagaatagcgttctaaatagcagcacagccgagcactccagcccatacagtgaggaccccatcgaggatcccctccaacccgacgtgaccggtattaggctgctttcgctgggcgctggggagttcaagagtcaagagcacgcaaagcacaaaggtcccaaagtcgagcgcgatcaagccgccaagcatcgctttagctggatgaagctgctggcgcataaagtcgggagacatcttagccaggatacaggatcgcccagtgggatgcggccgtgggaggacctgcccagccaagatactggtagccccagccgaatgaggccctggaaggacccgccgtcggatctgttgctgctgaaacagtcaaactcaagtaaaattctagtggggcgatggcacctggctagcgaaaaaggatcctatgaaattatccaggataccgacgaggacactgcggtcaataactggcttatttcacctcagaatgctagccgggcctggggggaaagcacacccctggcaaacaaaccagggaagcagtccggccaccctaaatttccccgggtcaggcataagtctttgcaggtacgccaggatggtggtaagtcccggctgaaaaaatcacaattcctcattaaaaccagaaagaaaaaaaaagagaagcacacacaccacgcccctttgtctcctagaacatttcatcccctgcgctcagaagcctacaacacgtttagcgagagaagactcaagcattccctggttttacacaagtctaacgagaccagccttcccactgacctgaaccagactctgcctagcatggacttcggttggatagcctccctaccagaccataatcagaacagttcaaatgatacagggcaggcctcctgtccccccggcctgtatcagactgtccccccagaagaacactatcagaccttcccaatccaggatcccgatcagatgcactctacatctgatcccagtcatcggagtagcagtccagagctcagtgagatgctagaatacgatcgcagtcacaagagtttccccactgatatctcacagatgtctccatcaagcgagcacgaggtttggcaaacagtaatttccccggacttgagtcaggtgacgctgtcccctgagctgagccagaccaacctgtcccctgatctcagccatacaacactgtctcctgaactaattcagcgcaatctttctcccgccttgggccagatgccaattagccccgacctctcacatactactttgagccctgacttgagtcatacaactctttcactggacctctcacagactaacctgagcccagagctgtcccagacaaacctctcacccgccctcggccagatgcccctgtccccagatctgtcccacaccaccctgtccttggatttcagtcagaccaatctttcacctgagctaagtcacatgacactctcccccgaactgtcacagaccaatctctcacctgccctcggacagatgcctatctcaccagaccttagtcacactacgctgtcactggatttttctcagactaacctcagccctgaactctcgcagaccaatttatcgccggcgctcggacagatgcccttatcaccagacccatctcacacaactctgtcactcgatctcagccaaaccaacctgtcccctgaattgagccagacgaatctctctccagacctttctgagatgccacttttcgccgacctcagtcagatccctctgacacccgatctggaccagatgaccctcagccccgacctcggggaaacagatctttcccccaatttcgggcagatgtctctgagccctgatcttagccaggtaacactttctcctgacatcagtgatacaacactactccccgacctgagccaaatctccccgccacctgatctagatcagatattttaccctagtgagtcttcacaatcactgctactgcaggagtttaatgaatctttcccatatccagaccttggccagatgccatccccctcaagtcccacattaaatgataccttcctctctaaagagttcaaccctctggtcattgtaggcctctcgaaagacggaaccgactatatcgaaataattccaaaagaagaggtgcagagcagtgaggacgactatgccgagatagactacgtgccctacgatgatccctacaaaaccgacgtgcgaactaacatcaacagcagtcgcgaccccgataacatagctgcgtggtatctgcgatccaacaatgggaaccgaagaaactactatatcgccgcagaggagatcagttgggactatagtgagttcgtgcagcgcgagaccgacattgaggattcagatgatatccctgaggacacgacctataaaaaggtagtttttcgcaagtaccttgatagtactttcactaagcgggaccctcggggagaatacgaggagcacctgggcatcctgggtcccattataagggcggaagtggatgacgtgattcaagttcgcttcaagaatttggcctctcgcccctacagcctccacgctcacggtctgtcttacgaaaagagttctgaaggtaagacctatgaggacgacagtcccgagtggtttaaagaagacaacgcagtacagcccaatagttcctacacctacgtgtggcacgctacagaacgctccggccccgagtccccaggctcagcgtgcagagcgtgggcatattatagcgcagtgaatccggagaaagatatacacagtggtcttatcggcccactgttaatatgtcaaaagggaattctccacaaggatagcaacatgcctatggacatgagggaattcgtgctcctcttcatgacatttgacgaaaaaaagtcctggtattacgaaaagaaatcaaggtctagttggcgccttaccagtagcgagatgaagaaatcacatgagttccacgcgattaacggtatgatctatagtcttcctggcctcaaaatgtatgaacaggaatgggtgcgtctgcatctgctgaacatcggcggctcccaggatatccacgtggtgcactttcacggccaaacactgttagagaacggcaacaagcagcaccaactaggcgtatggcctctcctgcccggaagcttcaagacgctcgagatgaaagcttccaagcccggatggtggttactcaacaccgaagtgggggaaaaccaaagagcggggatgcaaacaccattcctaatcatggatagggactgcaggatgcccatgggcctgagtacaggcatcatttccgattcccagattaaggccagcgagtttctaggatattgggagcctagacttgcccgattgaacaatggtggatcgtataatgcttggagcgttgagaaactggccgcggagttcgccagcaagccctggattcaggttgatatgcaaaaagaggttatcatcaccggaatacagacccagggcgccaagcattacctgaaatcatgttacactacagaattttacgttgcctactcttccaatcagattaactggcagatttttaaaggcaactcaactcgaaatgtgatgtacttcaacgggaattcagacgcatctacaatcaaggagaatcagtttgaccctcctatcgtcgctagatatatccgcatctctccaacaagagcctacaatcggcccaccctgcggctggaacttcagggctgtgaggtgaacggctgctccaccccactaggtatggagaacgggaaaatcgaaaacaaacaaataacagcctcgtcttttaaaaagtcttggtggggggactactgggagcctttccgtgcgcgtttgaatgcccagggaagggtcaacgcttggcaggccaaagccaacaacaataaacagtggctggagatcgacctgttgaaaattaagaaaatcaccgccataatcacccaaggatgtaagtctctgagcagcgagatgtatgttaaatcatatacgatccattattctgaacaaggcgttgaatggaagccatataggctgaaatcaagcatggtcgataagatcttcgagggtaacacaaacactaaaggccatgtaaagaacttctttaatcccccgatcatcagccgattcattcgcgtgatccctaagacctggaaccagtctatcgccctacgcctggaactgttcgggtgcgacatctat

SEQ ID NO: 9065 - DNA, 6672 bp, Artificial Sequence
  Description of Artificial Sequence: Synthetic coding sequence
atgtttccggggtgtccgagactctgggtgcttgtggtgttgggaacgtcgtgggtggggtggggatcacaaggaaccgaagcggcacagctgcggcagttctacgtggccgcgcaggggatctcgtggagctacaggccggaaccaacgaactcgagcctgaatctgagcgtgacctcctttaagaagatcgtgtaccgcgaatacgaaccatactttaagaaagaaaagccccaaagcactatatccggactgctgggaccgaccctttacgccgaagtgggagatatcattaaggtccacttcaagaacaaagccgacaagccactgtccatccatcctcaggggattcgctattcgaagctgtcggagggtgcttcgtacctcgaccatactttcccggcggagaaaatggacgacgccgtggcccctgggcgggagtacacttacgaatggagcatctcagaggattcaggacctacccacgatgatccaccgtgcctgactcatatctactattcacatgagaacctgatcgaggacttcaactctggactgatcggccctctcctgatctgtaagaagggcacgctcactgagggaggaactcagaaaaccttcgacaagcaaatcgtcctgttgttcgcagtgtttgacgaatccaagtcctggtcccagagcagctcactgatgtacaccgtcaatgggtacgtgaatggaaccatgccagacataactgtatgcgcacatgaccatatctcgtggcaccttctgggcatgtcctcgggccctgaactcttttcaatccactttaacggtcaggtgctcgagcagaaccaccataaagtgtcagccatcaccttggtgtccgccacttcaaccaccgccaacatgaccgtcggccctgaaggaaaatggatcatttctagcctcaccccgaaacatctgcaggccggaatgcaagcgtacatcgacattaagaactgcccaaaaaagactcgcaatctgaaaaagattaccagagagcaaaggcggcatatgaagaggtgggagtactttatcgcagcggaggaagtgatctgggattacgcccctgtgatcccggctaacatggacaaaaagtaccgaagtcaacatctggacaatttctcaaatcagatcggaaaacactacaagaaggtgatgtacacccagtacgaagatgaatcattcacgaagcataccgtgaaccctaacatgaaagaagatggtattctcggtcccatcattagggcccaagtccgggacactctgaaaatcgtctttaagaacatggcctccagaccgtacagcatctacccgcatggagtgactttttcgccttatgaagatgaagtgaattcatcattcacctcgggccgcaataacaccatgatccgggctgttcagcccggggaaacttacacctacaagtggaatatccttgagttcgatgagccaactgaaaacgatgcgcagtgcctgacccggccgtactactcagacgtggacatcatgcgcgacatcgcctccgggctgatcgggctgctgctgatctgcaaaagccggtcactcgatcgcagagggatccagcgcgcggccgacatcgagcaacaggccgtgttcgcagttttcgatgagaacaagtcctggtacctcgaggacaatatcaacaagttttgtgaaaacccagacgaagtgaaaagggatgacccgaaattctacgaaagcaacattatgtcgaccataaacggttacgtgccggaatcaatcaccactctcggattctgcttcgacgatacggtccaatggcatttctgcagcgtgggaactcagaacgagatcctgactatccatttcacgggtcactctttcatctacggaaagcggcacgaagataccctcaccctcttcccgatgcgcggggagagtgtgaccgtgaccatggacaatgtgggaacctggatgctgacctccatgaattctagccctcgctcgaagaaactccggctcaagtttagagacgtgaaatgcattccggacgacgatgaggattcgtatgagatcttcgaaccgccggaatcgaccgtgatggcgaccagaaagatgcacgacagactggagcccgaggatgaagaaagcgacgccgactacgattaccaaaaccgcttggcagcagccctgggaattcggtcattccggaactcgtcgctcaatcaagaggaggaggagtttaacctcactgccctcgcgctggaaaatggaactgagttcgtctcttcgaacacggacatcatcgtgggctcgaactacagctccccaagcaacatcagcaagttcaccgtgaataacctggccgaaccgcaaaaggcaccgagccaccagcaagctaccaccgctggatccccgctgcgccaccttatcggaaagaattccgttctcaactcgtcgacggcggagcacagctctccatactccgaggacccaatcgaagatccgctgcagcctgatgtcactgggatccggctgctgtcactgggtgcgggagagttcaaatcccaggaacacgccaagcataaaggcccgaaggtggagcgcgaccaggctgctaagcaccgcttcagctggatgaagctgcttgcccataaggtgggccgacatctctcacaagacaccggctcgcccagcggcatgcggccgtgggaggacctgccatctcaagatactggctccccgagcagaatgaggccgtggaaggacccgccatccgatcttctgctgctgaagcagtctaactcctcgaagatcctcgtcggacgatggcacctggcttccgagaaagggagctacgagattatccaggataccgatgaagatactgccgtcaataactggctcatctcaccgcaaaatgcgtcgcgcgcgtggggcgaatcgactccactggcaaacaagccgggcaaacagtcaggccaccctaagttcccgcgagtgcgccacaaatcccttcaggtccgccaagacggaggaaagtcacggcttaagaagtcgcaattcttgataaagactaggaagaaaaagaaggaaaagcatactcatcacgcaccactgtcgccccggactttccacccgctccgtagtgaagcgtataacaccttcagcgaacggcgtctgaagcactcgctggtgttgcacaagtccaacgaaactagccttccgactgatctcaaccagaccctcccctccatggactttggatggatcgcgtccttgccggaccacaatcaaaactcgtccaatgacacgggccaggcatcttgcccgccaggcctctaccagaccgtgccgccagaggagcactaccagactttcccgatccaggacccagaccaaatgcatagcacttcggacccgtcgcacagatcctcgagccccgaactgtctgagatgttggaatacgaccggtcacacaagagcttcccgacggacatttcgcagatgtccccatcaagcgaacacgaggtgtggcagaccgttatcagtcctgatctgtcgcaggtgactctctcgccggaactgtcgcaaactaacctctcgcccgatttgtcacataccaccctgtctcccgagctgatccagagaaatctctccccggcgctgggtcaaatgccaatcagcccagatttgtcccacacgaccctttcgccggacctgtcacacacgacgctctcgcttgatcttagtcaaactaatctctcaccggaactgagtcagaccaatctctcgccagctctcggtcagatgcctctgtccccagatctctcgcacactaccctgtcgctggatttctcacagaccaatctgtcaccggagctgtcccacatgaccctgtcgcccgagttgtcacagactaacctgtccccggctctgggacagatgccgatttcaccggatctgtcgcatactaccttgtcgctcgacttttcgcagaccaacttgtcccctgagctgtcgcaaacgaatctgtctcccgcgcttggtcaaatgccgttgtccccagacccatcgcacactactctgtcgctggacctgtcccagacgaacctctcaccagagctctcccaaactaacctttcgcctgacctcagcgaaatgcctctgttcgctgaccttagtcaaatcccgcttactccggacctcgaccagatgacgctctcgcccgacctcggggaaactgacctcagccctaacttcggccagatgtctctgtcccccgacctttcgcaagtaaccctgtcccctgatatatctgacactacccttctccctgacttgagtcagatcagcccaccaccggacctggaccaaatcttttacccgagtgaatcctcgcagagcttgctgctgcaggagttcaacgaatccttcccgtaccctgatctgggccaaatgccatcgcccagctcaccgaccttgaatgataccttcctttccaaggaattcaatcccctggtgatcgtgggattgtccaaggacggaactgactacattgagatcattcccaaggaggaagtgcaatcctcggaggacgattacgctgaaatcgactacgtcccgtacgacgacccttacaaaaccgatgtgcgcactaacatcaattcatcccgggatcccgacaacatcgccgcttggtatctgaggtccaataatggaaatcgcagaaactactacatcgccgcggaagaaatcagctgggactactcggaatttgtgcaaagagaaactgatatcgaggactcggacgacatcccagaggatactacttataagaaagtggtgttcagaaagtacctggactccaccttcactaagagagatcctcgcggcgaatacgaagagcatttgggcatcctcggaccgatcattcgcgcagaggtcgacgacgtgattcaggtgaggttcaagaacttggccagccgcccttactcactgcacgcccacggactcagctacgaaaagtcctcagagggcaaaacttacgaagatgactcaccagaatggttcaaggaagataatgccgtccagcctaactcttcatacacctacgtctggcacgcaaccgagcgctctggaccggaatcccctggctcggcatgcagggcatgggcctactatagcgctgtgaacccggaaaaagatatccactccggtctgatcggaccactgttgatttgccaaaagggcattctccataaggatagcaacatgccaatggacatgcgggaattcgtgctgctgttcatgacctttgatgaaaagaagtcatggtattacgagaagaagtccagatcgagctggagactgacttccagcgagatgaaaaagtcccacgagttccatgccatcaacggaatgatctacagcctccccggactcaagatgtacgagcaagaatgggtccgcttgcacttgttgaatatcggagggtcacaggatattcacgtggtccatttccacggacagaccctcctggaaaatgggaacaagcagcatcagttgggagtttggccgcttcttccggggagcttcaagaccctggagatgaaggcttcaaaaccaggatggtggctgctgaataccgaagttggcgaaaaccaacgggccggtatgcagactccgtttctgattatggaccgggattgtaggatgcctatgggactgtcaacgggtatcatctccgactcgcagatcaaggcttcggaattcctcggatactgggaaccgagactggccagacttaacaacggtggatcctacaacgcctggtcggtcgaaaaactggccgccgaatttgcatccaagccgtggatccaagtcgatatgcagaaggaagtaatcatcaccggaatccagacccagggcgcaaagcactacctgaagtcatgctacaccactgagttctacgtcgcatactcctcaaaccagatcaactggcagatctttaaaggaaactccacccgtaacgtcatgtacttcaacggaaactccgatgcttcgactatcaaggaaaatcagttcgacccaccaatcgtcgcccgctacatccggatcagcccgactcgcgcctacaacagacctaccctgcgccttgaactgcagggatgtgaggtcaatggatgctcaactccgctcggcatggagaacggtaagatcgagaacaaacagattactgcgagctccttcaaaaagagctggtggggtgactactgggagccttttagggcacgtttgaatgcgcagggacgcgtcaacgcgtggcaagccaaagcgaacaataacaaacaatggctggaaatagacctcttgaagatcaaaaagatcaccgcgatcatcactcagggctgcaagagcctctcctcagaaatgtatgtgaaatcgtataccatccactactcggaacagggagtggagtggaagccataccgcctgaagagctcgatggtggataagatcttcgaaggcaacaccaatactaagggacatgtgaaaaactttttcaatccgcccatcatatcccgattcattcgcgttatcccaaagacctggaatcaaagtatcgccctgcggctcgaacttttcggatgtgacatctac

SEQ ID NO: 9066 - DNA, 6672 bp, Artificial Sequence
  Description of Artificial Sequence: Synthetic coding sequence
atgttccctgggtgtcctagactgtgggtgctggttgtgctcggaacatcatgggtggggtggggatcccagggcaccgaagcagcacaacttagacagttctatgtcgccgcacaaggcatttcctggagctacaggcccgaacccacaaacagctcactcaacctgtctgtcaccagctttaaaaaaattgtataccgggaatacgagccatatttcaagaaggagaagccacaatccaccatcagcggcttgctgggaccaaccctatacgccgaagttggtgacattatcaaggtgcacttcaagaataaagccgacaagccgttgtcaatacatccccaaggaattcgctattcgaagttgagtgagggcgcttcatacttggaccatactttcccagcagaaaaaatggacgatgcagtggcacccgggagagaatacacttacgagtggagcatctctgaggattcaggaccaacacacgatgaccccccgtgcctgacacacatctattactcccacgaaaacctgatcgaggatttcaattccggtctaatcggcccgttgttaatttgtaaaaaaggtaccctcaccgaaggaggcacccagaaaaccttcgataaacagattgtactcctctttgcggtgttcgacgagtccaagtcatggagtcaatcatcttccctaatgtacacggtgaatggatatgtgaacggaactatgcccgacattacagtttgcgcacatgaccatatttcttggcacctcctgggtatgtcctcggggcccgagctgttttctatccattttaatggccaggtactggagcagaatcaccacaaagtgagtgctatcacactagttagtgctacctccaccactgcaaacatgacagttggtcctgaggggaagtggattatttccagtctcacccctaagcacctgcaggccgggatgcaggcctacattgacatcaaaaattgtcccaaaaaaacaagaaatctaaaaaaaataactcgcgaacaacggcgccatatgaaaaggtgggagtacttcatcgcggccgaagaagtgatctgggactatgccccagttatacctgccaatatggacaagaagtatcggtcccagcacctggataacttctcaaaccagattgggaagcactacaaaaaggttatgtatacccagtatgaggacgagagcttcactaaacataccgtgaatccaaacatgaaggaagatggaatcctgggtcctattatccgcgcccaagtccgggataccttgaagattgtttttaaaaacatggccagtcgaccgtacagtatctaccctcatggagtaacctttagcccctatgaggacgaagtcaattctagttttacctctggccgtaacaacacaatgatccgcgcggtgcagcctggagaaacatacacttacaagtggaatatcctggaattcgatgaacctaccgaaaatgatgcacagtgcctaacacgcccctattactccgatgtggacattatgcgcgatatagcttcggggctgattggcctcctcctaatttgcaagtcacgcagtcttgaccggagaggaatccagcgagcagccgacatcgaacaacaagcagtgtttgctgtctttgacgaaaataagtcatggtacttggaagacaatatcaataagttttgtgaaaatcctgatgaggtgaagagggatgaccccaaattctatgagtctaatatcatgtcaacaattaacggatacgtgcctgaaagcataacaacactgggtttttgttttgatgacacagtgcagtggcacttttgtagtgttggaacgcagaatgagatcctgactatacatttcacggggcattcctttatctacggcaagcggcacgaagataccctgacactgtttccgatgcgcggagaaagcgttaccgttactatggataacgtcgggacttggatgctgacgagcatgaactccagccctcgctctaagaagctgcgacttaagtttcgcgacgtgaaatgtatacccgatgacgatgaagactcttacgaaatctttgaaccaccagagagcacggtcatggccacaaggaagatgcacgacagactggagccggaagatgaagaatctgacgcagattacgactatcagaacagactggctgccgccctgggtattcggagctttagaaactcgtcactgaatcaggaggaagaagagtttaacctaacagccctggccttagaaaacggtactgagtttgtctccagcaatacagatatcatcgtgggctctaattactcttcccccagcaacatatcaaaattcaccgtcaacaatctggccgaaccccagaaagcaccgagtcaccagcaagctacaaccgctgggagtccccttcggcacttgattgggaaaaacagcgtgttgaactcctctactgccgaacactcttccccttactccgaggacccgatagaagatccccttcagcctgacgtgacaggtatccgtctactgtcattgggtgcaggggaattcaaatcgcaggaacacgcaaagcacaaggggcccaaggtggaaagggaccaggccgcaaagcatagattttcttggatgaagcttttggcccacaaagtgggaaggcacttgtcccaggatactggaagcccttctggaatgagaccctgggaggaccttccctcacaggataccggcagcccttcaaggatgaggccgtggaaggaccccccctctgatctcctcctcttaaagcaatccaattcctcaaaaatcctggtcggtaggtggcacctggcttctgagaagggctcttatgaaatcatccaagacacagacgaagacactgctgtaaataattggctgatatccccccaaaacgccagccgggcttggggagagagtacccccctggcgaacaagccaggcaagcagagtgggcatcctaagttccctcgcgtgcggcataaatctctccaggtgaggcaggatggcggcaagagccgccttaagaagtcccagttcctgattaaaaccaggaagaagaagaaagaaaagcatacacatcatgctccccttagccccaggacgttccacccgctcagaagcgaggcttacaacaccttcagtgagcgacgactgaagcatagcctggtgctgcataaatcgaacgagacctcattgcccacagacctgaaccagactctaccaagtatggactttggttggattgcctctctgcccgaccataatcagaactccagcaacgacacagggcaggctagctgcccccccggactataccaaaccgtgccgcctgaagagcactaccagacatttccaatccaggatccggatcagatgcactccaccagtgaccccagccatcgaagctcatcgcccgaattaagtgaaatgttagagtatgaccgcagccacaaatcttttcctaccgatatatctcaaatgtcacctagttctgagcacgaggtgtggcaaaccgtgatttccccagatttatcgcaggtgaccctgtctcctgagctctctcagaccaatctttcgcctgacctgtcacacaccaccctttctcctgagttgatccagcggaacctcagccccgcgctcggacagatgccgatttcaccggacctgtcacacactacgttatcgccggatctgtctcacacgacactgagcctggatttatctcagactaatctctcacccgagttgagccagaccaatttgagccctgcgctgggccaaatgcctctgagtccggatctaagtcatacaactttgtcgctggactttagtcaaaccaacttatcccccgagttgagccacatgacactgtctcccgagctgtcccagacaaatttgagtcccgcgttgggacagatgccaatatcccccgacctgtcccacacaactttatccctagatttttcccagactaatctctctcccgagctgtctcagacaaatttgagtcccgcactgggccaaatgccactctccccggatcccagccatacaaccctgagtcttgatctgtcgcaaacaaacttgtccccagaattatcccagaccaacctatcacccgacttatccgagatgcccctctttgcagaccttagccagattcctctgacgcccgatctcgaccagatgactctcagcccggacctgggtgaaacagatctctctcctaatttcgggcagatgtccctgtcgccagacctgtctcaggttactctctcaccagacatttccgacaccactctgttaccggacctgtcacagatctcaccccctccggatctagaccagatcttctatcccagcgaaagtagtcagagtctccttcttcaggagtttaatgagtcattcccataccctgacctcggacagatgccttctcccagttcccccacgcttaacgacactttcctgagcaaagaattcaatcccttggttatagtaggcctcagtaaagacggaactgactacatcgagatcatcccgaaggaagaggttcaaagctctgaggacgattatgccgagattgattatgtgccttatgatgacccctacaaaaccgacgtccgcacaaacattaacagcagtcgggaccccgacaatatcgccgcctggtatcttaggtccaacaacggaaaccgccggaactactacatcgcagcagaagaaatcagctgggactacagcgagtttgttcagcgtgagaccgacattgaggattccgacgacatccccgaagacactacttacaaaaaggtcgtcttcaggaaatatctggactcaacgttcaccaagagggaccctagaggcgagtacgaggagcacctaggcattctgggccctataatacgcgctgaagtggacgacgtaatacaagttagatttaaaaacttggccagccgaccttattctctgcacgcccacggtctctcctatgagaaatcttcagaggggaagacctacgaagatgatagtccagaatggtttaaggaagacaatgctgttcagccgaacagctcttatacatacgtttggcacgccaccgagcggtccggaccagagagccccgggtccgcctgtcgggcatgggcctattattctgcggtaaatccagagaaggatatacacagtggtttaattggaccactgctgatctgccagaagggaatcctgcataaagacagtaacatgcccatggatatgcgcgagtttgtcctgctgtttatgaccttcgacgagaagaagtcatggtattacgaaaaaaagtcacgctcaagttggagactcacaagttcagagatgaagaagagccatgaattccacgccattaatggaatgatttacagcctgcctgggttgaaaatgtacgagcaggaatgggtaagactccaccttttgaacattggcggatctcaggacatacacgtcgtgcactttcatggtcagactttgctcgaaaacggcaacaagcagcatcagcttggagtctggcccttgctgccaggcagcttcaagaccctggagatgaaggcaagtaagcctggctggtggcttctcaataccgaggtcggggaaaatcaaagagccggaatgcaaacacctttccttatcatggatcgggactgccgtatgccaatgggcctgtccacaggaatcatcagtgatagtcagatcaaggcttcagagttcctcggttattgggaacccagattggccaggcttaacaatggggggagttataatgcctggtccgtagagaaattagcagctgagttcgccagcaagccgtggatacaagtagacatgcagaaagaggttatcatcacaggcattcagacgcagggagcgaagcactatcttaagtcatgctatacaaccgagttctatgttgcttatagcagcaaccagattaactggcagatcttcaaggggaacagtacgagaaacgtaatgtactttaatggcaacagtgatgctagtaccattaaggagaaccagtttgacccaccgattgtcgcccgatacataagaatcagcccaacccgggcatacaaccggcctacgctaaggcttgagcttcagggatgtgaagtcaatggatgtagcacaccgctgggcatggaaaacggaaaaatagagaacaaacagatcacagcgagctctttcaagaagagctggtggggtgattattgggagcccttccgtgcccgactgaatgcccagggacgggtgaatgcttggcaggccaaggccaataataacaaacagtggctggagatagacctcctgaagatcaaaaagattaccgcgataataacgcaaggatgcaagtccctgtcctccgagatgtatgttaagtcatatacgatccactacagcgagcaaggcgtcgagtggaagccatatagacttaaatctagcatggtcgacaaaatattcgagggcaatacgaacacaaaaggccacgttaagaacttcttcaaccctccaattatttcacggtttattcgtgtgataccaaagacctggaaccaaagcatcgcactccggcttgaactgttcgggtgtgatatctac

SEQ ID NO: 9067 - DNA, 6672 bp, Artificial Sequence
  Description of Artificial Sequence: Synthetic coding sequence
atgtttccgggttgtcctagactgtgggtgctggtcgtgcttggcaccagctgggtgggttggggatctcagggcactgaggcagcccaactgcgccagttttacgtggctgcacaaggaatttcatggtcgtacagaccagaacccaccaactcaagcctcaacctgtcggtgaccagcttcaagaagatagtgtaccgcgaatacgagccttactttaagaaggaaaagccacaatctactatttcaggtcttttggggccgactctgtacgccgaggtgggagacatcattaaagtgcatttcaagaataaagcagataagccattgtccatccacccccaagggatacggtactcaaaactgtccgaaggtgcatcctacctggaccatacgttccctgccgaaaagatggatgacgcagtggcgccgggaagagagtacacttacgaatggtcaatctccgaggactcaggacctacccacgatgatcctccgtgtcttactcatatctactacagccacgaaaatcttattgaggactttaactcggggctcattggccctctccttatttgcaagaagggcaccttgaccgaaggagggacccagaaaacctttgataagcagatcgtgttgctctttgcagtgtttgatgaaagtaaaagctggtcacagtcctcatcccttatgtatactgtgaacggatacgttaatggtaccatgcctgatattaccgtctgtgcccatgatcatatctcatggcatctcctcggaatgtcgagcggcccagaactgttctccattcactttaacgggcaggtgctggaacagaaccatcataaagtgtccgctatcactctggtgtccgcaacctctaccaccgccaacatgaccgtcggtcctgaaggcaaatggatcatctcgtcactgacgccaaaacatctgcaagcaggaatgcaagcctacattgacatcaaaaactgtcccaagaaaactcggaacctcaaaaagatcactcgagaacaaagaaggcacatgaagcgttgggaatactttattgccgcagaagaggtcatctgggactacgcacctgtgattcccgccaatatggataagaaataccggagccagcatcttgataacttttccaaccaaattggaaagcactacaagaaagtgatgtacacccaatacgaagatgaaagttttactaagcataccgtgaatcccaacatgaaagaagatggtattctgggacccattatcagagcccaggtgagggacaccctcaagattgttttcaagaacatggcaagcagaccctattcgatctacccacatggtgtgacgttctcgccgtacgaggacgaggtcaactcctcatttacgtcaggacgcaacaacaccatgattcgagcagtgcagcctggtgaaacttacacctataagtggaacatccttgagtttgatgaacctaccgaaaacgatgcacagtgtctgacgcgtccctactactcggatgtggacataatgcgggatattgcatcagggctgataggacttctgcttatttgtaagtcccgctcacttgaccggcgcggtattcagagagcagcagatatcgaacagcaagccgtgtttgctgtgtttgacgaaaacaagagctggtacctcgaagataacattaacaagttttgtgaaaacccagatgaggtcaagagagacgacccgaagttttacgagtccaatatcatgtccacgattaacgggtatgtccccgaaagcattaccacccttggattttgttttgatgataccgtccaatggcacttttgttcggttggtactcaaaatgaaattctgactatccactttactggccacagcttcatttacgggaagcgccatgaggacacccttaccctctttccaatgcgcggagaatcggtcacggtgaccatggataacgtgggtacctggatgctcacttccatgaacagctcacctcggtctaagaaactgcgtttgaagtttcgggatgtcaaatgtatcccagatgatgatgaagattcgtacgagatcttcgaaccacctgaatcaacggtcatggcaactcgaaagatgcatgatagacttgaacctgaagatgaagagagcgatgcagattacgattaccaaaaccgtctggcagcagcccttggtattaggagctttaggaattcgtctctgaatcaagaagaggaagagtttaatctgactgccctggcgctggaaaacggaaccgaatttgtctcctcgaacacggacattattgttggctcgaactattcctcgccttcgaatatctccaagtttactgtgaacaacctcgcggaaccgcaaaaggcaccctcacaccaacaggcgaccactgcaggctcccctcttcgccacctgattggtaagaacagcgtgctcaattcgtcaactgccgaacattcgtccccatacagcgaagatcctattgaggaccctcttcagcctgacgtgaccggaataagactgctgtcactgggagcaggtgaattcaaaagccaggagcatgcgaagcataagggacctaaagtggaaagagatcaggcagcaaaacataggtttagctggatgaagctgttggcccacaaggtgggacgccatctgtcccaggataccggatctcctagcggaatgcggccgtgggaggaccttccctcacaagatactggcagcccatccagaatgcgaccatggaaggatccccccagcgaccttcttctcctgaagcaatcgaactcatccaagatcctggtgggcagatggcatctggcatcggaaaagggcagctacgaaatcatccaggataccgatgaggacactgctgtgaacaactggcttatctcccctcaaaacgcatcccgcgcatggggtgagtctaccccattggcaaacaagcctggcaagcagagcgggcacccaaaattcccacgcgttcgtcacaaatctctgcaggtccgacaagatggaggaaaatcgcgactcaagaaatcccagttcctgattaagactcggaagaagaaaaaggagaagcatactcaccatgctcccctttcccctcgcaccttccatcctctgcggtcggaagcctacaataccttctccgaaagacgtcttaaacactccttggtcctgcacaagtctaacgaaaccagcctcccaaccgaccttaatcaaactctgccatccatggactttggatggattgcaagcctgccagatcacaaccaaaactcttccaacgatactgggcaagcgagctgccctccaggattgtaccaaacggtgccgccagaagagcactaccaaacctttccaattcaggatccagatcagatgcattcgacctcggacccatcgcatagatcgagctctccagaactcagcgagatgcttgagtacgatcggtcccacaaatcatttccaactgatatcagccaaatgtcaccatcatcagaacatgaagtgtggcaaaccgtgatctcccctgacctttcgcaagtgaccctgtcccccgaattgagtcaaactaatctgtcaccagatctctcgcatactactctgagccccgaattgattcaaaggaatctctcgcccgcgttgggacagatgccaatatcccctgacttgtcacacactaccctttctccagatctcagccatacgaccctctccctggatcttagtcagactaacctttcgccggagctgagccagacgaatttgtcgccagccctcggtcaaatgccactgagcccagacctgtcgcacaccacgctttccctggatttttcacaaactaatctcagccctgagctgtcgcacatgactcttagcccagaattgtcacagactaacctcagcccagcactgggacaaatgccgatttcgccagatctctcccatacgactctgagcctggacttttcccagaccaaccttagcccagagctgagccaaactaacctttccccagccctgggtcaaatgcccctctccccagatcctagccacaccaccctgtcgcttgacctctcgcagacgaacctgtcacctgaactttcccaaaccaacctctcaccagacctgtccgagatgcccttgtttgctgatctgtcacaaatccctctgactcctgaccttgaccaaatgacgctgtccccagatctcggtgaaaccgatctttcgcctaactttggtcaaatgtcattgtcaccggacctttcccaagtcactctctcccctgatatctcagataccacccttcttcccgaccttagccaaatctctcctccaccggaccttgatcagatcttttacccatccgaatcatcccaatcgctcctgctgcaagaattcaacgaatcattcccctaccctgatcttggacagatgccttcaccctcctcccccactcttaacgataccttcctcagcaaagagtttaaccccctggtgatagtcggtcttagcaaagatgggaccgactacattgaaatcatacctaaagaggaagtgcagtcctccgaggatgactatgcagaaatagactacgtgccctacgacgacccttacaaaacggatgtgagaaccaacattaacagctcaagagatcctgacaatattgctgcatggtacctgcggtcaaacaatggaaatcgccgtaactactacatcgccgcagaagaaatttcgtgggactacagcgaatttgtccagagagagacggatattgaagattcggatgacattcccgaggacaccacctacaagaaggtggtgttcaggaaataccttgattccactttcactaagagggatccaaggggtgagtacgaagaacatctgggtatcctcggaccaatcataagagctgaggtggatgatgtgattcaggtgcgctttaagaatcttgcgtccagaccttactcactgcacgcccacgggctgtcatatgaaaagtcatcggagggaaaaacgtatgaggacgatagccctgagtggttcaaagaggataatgccgtgcagccaaactcgtcctacacttatgtatggcatgctacggagcggtccggacctgagtcgccaggatccgcatgcagggcatgggcctactacagcgcggtgaaccctgagaaggatatccattcgggcctgattggccccctgcttatttgccagaaaggcattctccataaggattccaacatgcctatggatatgcgcgagttcgtccttctgtttatgactttcgacgagaagaaatcatggtattacgagaaaaagtcacgatcctcctggagattgacgtcgtccgagatgaagaaaagccacgaatttcatgccattaatggtatgatctattcccttccggggctgaagatgtacgaacaagagtgggttcgccttcacctcctgaacatcggtggctcacaggatatccacgtggtgcattttcatggtcaaaccctcctcgaaaacggtaacaaacaacatcagcttggagtttggcccttgctgccgggttcattcaaaactctcgagatgaaggcatcaaagccaggttggtggcttctcaacacggaagtgggagaaaaccaacgggcaggtatgcaaaccccatttcttatcatggacagggattgtcgcatgcctatgggtttgtcgactggaatcatatcagactcacaaatcaaagcatcagagtttctcggttattgggaacccagactggcacgtctgaacaatgggggttcttacaacgcatggtcggtggaaaaacttgcggcagagtttgcgtcgaaaccttggattcaggtggatatgcaaaaggaagtgatcattaccggcattcaaactcagggagcaaagcactacctcaaatcgtgctacactactgaattctacgtggcctattcatccaatcagattaactggcagatctttaaggggaactcaaccagaaacgtgatgtacttcaatggtaattcagacgcatcaactataaaggagaatcagtttgaccctccaatcgtggcgagatacatccgtatcagccccactcgggcatacaaccggcccactctgagactggaactccagggatgtgaagtgaacggatgctcgacccctcttggaatggaaaatggtaagatagagaacaaacaaattaccgcaagttcctttaagaagtcttggtggggagattactgggagcccttcagagcaaggcttaatgcacaaggaagggtgaatgcatggcaggccaaagctaataacaacaagcaatggttggaaattgatcttctgaagattaagaagattaccgcgatcataactcaagggtgtaaatctcttagctcggaaatgtacgtgaagtcatacactatacattactccgaacaaggggtcgaatggaaaccttaccggcttaagtcatccatggtggacaagatttttgaaggtaacactaatactaaaggtcatgtcaagaacttcttcaacccacctatcatctcacgctttatacgggtcatcccgaaaacctggaaccagtccattgcactcagactggaactgtttgggtgtgacatatat

SEQ ID NO: 9068 - DNA, 6672 bp, Artificial Sequence
  Description of Artificial Sequence: Synthetic coding sequence
atgtttccaggctgcccccggctgtgggtactggtggttttaggcacaagttgggtaggttgggggtctcaaggcactgaggcagcccagctaaggcagttctacgtcgcagcacaggggatctcttggagctaccgccctgaacccacaaactcatccctgaacctgtccgttacaagttttaaaaagatcgtgtatagagagtatgagccttactttaaaaaggaaaaaccccagagtactatcagtggcctgttggggcctaccctctacgctgaagtgggagatattattaaggtgcatttcaaaaataaagcagacaagcctctctcaattcatccccaaggcattagatacagcaaattaagcgagggggcctcttatctagatcatacattcccagccgagaaaatggatgacgccgtagcgcccggacgtgaatacacttacgagtggagtattagtgaggactctggccccacgcacgatgaccccccttgtctcactcacatctattattctcacgagaatttgattgaagactttaactccggcctgatcggaccactccttatctgtaaaaaggggaccctgacagaaggagggacgcaaaagacattcgataaacaaatagtgctcctgtttgctgtgttcgatgagtccaagtcctggtcacagtcctcttcgctgatgtataccgtcaatggttatgtcaatggaacaatgcccgatatcacagtgtgtgcacacgatcacatttcatggcacttgcttgggatgtcttccgggcccgagttgttctcgatccacttcaacgggcaagtcctcgagcagaaccatcacaaggtgtccgccattacattagtatcggctacctctacaaccgctaacatgactgtgggccccgagggaaagtggatcataagttctttgacgccaaagcacctgcaagccggcatgcaggcctacattgacattaaaaactgcccaaagaagacccgcaaccttaaaaaaatcacacgcgaacagcgcagacatatgaagcgttgggaatatttcatcgcagccgaggaggtaatctgggactacgccccggtgattcctgcaaatatggataagaaatatcgaagccagcatctagacaacttttccaaccagattggcaagcactacaaaaaagtgatgtatacacagtacgaggatgagagtttcaccaaacatactgttaacccaaacatgaaggaggacggcattctcggtccaataattagagctcaggtcagagacacgctgaagatcgtctttaagaacatggcatctagaccttactccatatatcctcacggagtcacattcagtccctacgaagatgaggtcaattcgtcctttacaagcgggcgcaataacaccatgatcagggctgtgcaaccaggcgagacctatacgtataaatggaatattcttgaattcgacgagccaaccgagaacgatgcacaatgccttacgaggccctactactccgatgtcgacatcatgcgcgacatagcgagcggattaatcggactcctgctaatctgtaagagtagatcactggacagacgaggcatccaacgggccgcggacattgagcagcaggccgttttcgccgtgttcgacgaaaataagtcgtggtacctggaagataacatcaacaagttctgcgagaatcctgacgaggttaagagggacgaccccaaattctatgagagcaatatcatgtctacaataaatggctacgtgccagagtccatcactaccttgggtttttgtttcgacgacacagtgcagtggcatttctgctctgtgggcacacagaatgaaattctgactattcactttaccggccacagctttatctacggtaaacgtcacgaggacactctcacactcttcccgatgcgcggagaatccgtgaccgtcactatggataatgtagggacctggatgctgacgtcaatgaacagctccccccgcagtaagaaactccgcctgaagtttcgggacgtaaaatgcatcccagatgacgacgaagatagttatgagatctttgaacctcccgagtccactgtgatggccactaggaagatgcacgaccgcctggaacccgaggacgaggaaagtgacgccgattatgattaccagaatagactcgcggctgcgctcggcatccggtcctttaggaacagcagcctgaatcaggaggaagaggagtttaatctcacagcacttgctctcgaaaatgggaccgaattcgttagctcaaacacagatataatagtcggatccaattactcttccccaagcaacatcagcaagttcactgtgaataatcttgcggagccccaaaaggcaccaagccatcagcaggctacaactgcaggcagtccccttcgtcacttgattggcaaaaattcagtcctgaactccagcaccgcagagcattcttccccttactccgaggatccaattgaagatcccctgcagccagacgtgacgggaattagactcctgtctttgggggccggcgagttcaaatcacaggaacacgccaaacacaaggggccaaaggtggaacgagatcaagcagccaagcacaggttttcatggatgaagttactagctcacaaggttggcaggcacttgagtcaagacaccggctccccttcgggcatgaggccatgggaagacttaccctcacaggacaccgggagcccgtctagaatgcgtccctggaaagaccccccctcagacttgcttctgttgaaacagtccaactcgtcaaaaatattggtcggtcgttggcacctggctagtgagaaggggtcttacgagataatacaggacacagatgaagacactgctgtgaacaactggctaataagtcctcagaacgcttctagagcatggggggaaagtacccctcttgcgaataaacccgggaagcagagcggccatcccaaattcccgagagtgaggcataagtcattgcaagtccggcaggacgggggaaaaagccgcttaaagaaatctcagttcctgattaagaccagaaagaagaaaaaggagaaacacacacaccatgcacccttgagtccaaggaccttccatcctctaagaagcgaagcctacaataccttctccgaacggagactcaagcactccctggttctccacaagtctaatgaaaccagcctgcctacagatcttaatcaaactcttccttcaatggactttggatggatcgcaagcttgcccgatcacaatcaaaattcgagtaatgataccgggcaagcctcgtgccctcccggcctgtaccagacagtaccaccagaggaacattatcagaccttcccaatccaggatcctgatcagatgcacagcacgtcagatccttcccaccgttctagtagccccgagctgagcgagatgctggagtatgatagatctcataagagtttcccgacagatatctcacagatgagtccctctagtgagcatgaggtttggcagactgttatctctcctgatctgagtcaggtgacccttagccccgagttgagtcaaacaaatttaagcccagaccttagccacaccacactcagccccgagttgattcagcgcaatctttcacctgctctgggtcagatgcctatatccccggacctcagccatacaacattgagtcctgaccttagccataccacactgtccctggaccttagtcagactaatctgagccccgaactctcccagacgaacttgagcccagctctaggacaaatgccacttagccccgacctgtcacatacgacgctttctctcgatttttcgcaaacgaatctgtctcccgaactcagtcacatgaccctgtcccctgaactgagccaaacaaacctgtcgcctgccctcgggcagatgcccataagtcccgatctgtctcataccaccctctcattggatttttcacagactaacttaagtccggagctatcccagaccaacctgtcaccggccctcgggcagatgccactcagccccgacccaagccataccacgctaagcctggacctcagccagaccaacctcagtcccgagctgtctcagaccaacctgagccccgatctcagtgagatgcccctatttgctgacctgtcgcaaatcccgctgacacctgatttggaccagatgactctgagtcccgatcttggagaaaccgatttatctcccaatttcgggcaaatgagcctgagcccagacttgagccaagtgacactgagtcctgacatctccgatactaccctcctgccagatctctcacaaatctcgcccccacctgacctcgaccagattttctatccctccgagtcgagccaatccctcctgttgcaggagtttaacgagagcttcccataccctgacctcgggcaaatgccaagcccatcttctcctacactgaacgataccttcttgtcaaaagagttcaatcccctggtgatagttggcctgtccaaggatggaacggattatattgaaattattcctaaagaagaggtacagtcctcagaagacgattacgctgagatcgattacgttccctacgacgatccgtataagactgacgtgcggacgaacataaactcatccagggatccagataacatagctgcctggtatctgcggtctaataacgggaataggcgaaactactatattgctgcagaggagatctcttgggactactccgagttcgtgcagagagaaacagatatcgaggactcagatgacatccccgaagatacgacctacaagaaggttgtgttccggaagtatttggatagtacctttaccaagagagatcctcgaggcgaatatgaagagcacctaggcatcctgggacccattattagagccgaggtcgatgacgtgattcaagtgcgtttcaaaaatctggcctcacggccatacagccttcatgcccatggtttgagctacgagaaatccagcgaaggcaagacctatgaagatgattcccctgaatggttcaaggaggataacgccgttcagccaaactcaagttacacatacgtatggcatgccaccgagaggagcggccccgagagtccaggaagcgcttgtcgagcgtgggcatattattccgccgtcaaccctgaaaaggatatccattcgggcctcattgggccactactgatctgccaaaagggaatcctccacaaggattctaatatgccgatggatatgagagagtttgtcttgctcttcatgacatttgacgaaaagaagtcctggtactacgagaagaaatctaggagctcctggaggctcaccagctccgagatgaagaagagccacgagtttcacgcaattaacgggatgatctatagtctgcctggcctgaaaatgtatgagcaggaatgggtccggttgcatctcctaaacatcggcgggtcccaggacattcacgtggttcattttcatggtcagactcttctggaaaatggcaataagcagcaccagttgggggtgtggccactgctgccagggagtttcaagaccctcgagatgaaggcgtcaaaaccaggctggtggcttctgaacactgaggtaggggagaaccagagggccggtatgcagaccccctttctgataatggatagagactgtcgaatgcccatgggcctttcaactggcatcatctccgactcacagataaaagctagcgagtttctgggttactgggagcctcggctggctagactgaataatggcgggtcctacaacgcgtggtcagtcgaaaagctcgccgccgagttcgctagcaaaccatggatacaagtggatatgcagaaggaggtgatcataaccgggatacagacccagggcgctaaacattatttaaagagttgttataccaccgagttctacgtggcctatagctccaatcagattaactggcagatctttaaagggaactctactagaaatgtgatgtactttaatggcaactcggacgccagcactatcaaggagaatcagttcgatccacccattgtagccagatacatccggatcagcccaacccgagcttacaacagacctacactccgcctcgaactgcagggctgcgaggttaatggttgcagtaccccattggggatggagaacggtaagattgaaaacaaacagataactgcctcatctttcaagaagagttggtggggcgattactgggagccttttcgcgccaggctcaacgcccaaggaagggtcaacgcatggcaagccaaggctaacaataataagcagtggctggagatcgacctactgaagattaaaaagattaccgcaattattacccaaggctgtaagtcgctgagctccgagatgtacgtgaagagctataccatacactactccgagcagggtgtggaatggaagccgtatcgtttgaagtcgtccatggtagacaaaatctttgaggggaatacaaacacaaaggggcacgtgaaaaactttttcaatccgcctattatctcccgcttcatacgcgtgattccaaagacctggaaccagtcaattgccctacggctagagcttttcggttgcgatatttat

SEQ ID NO: 9069 - DNA, 6672 bp, Artificial Sequence
  Description of Artificial Sequence: Synthetic coding sequence
atgttcccaggctgcccacgcctgtgggtcctcgtcgtcctaggcacaagttgggtagggtgggggagtcagggaactgaagctgcgcagctaaggcagttctacgtggccgcccagggcataagctggtcctatagacccgaacctactaattcatccctcaacctgagcgtaacttctttcaaaaagatcgtttatcgggaatacgagccctactttaagaaagaaaaacctcaaagtaccatctcgggcctcctcggccccaccctctatgcagaggtgggggacatcatcaaggtacattttaagaacaaggccgacaagccactgagcatccatccacagggtatccggtactccaagctgtcagagggcgccagctacctagaccacacctttcctgccgaaaaaatggacgatgctgtggcacctggtagagaatacacctatgagtggtcgattagtgaggattccggacctacccatgacgacccaccatgcctcacccacatttactacagccacgaaaacctgatagaggacttcaatagcggccttataggtcccctgttaatctgtaaaaaaggaacactgactgaggggggcactcagaagactttcgataagcagatcgtcttactgtttgccgtttttgacgaaagcaaatcttggagccagtcaagtagtctgatgtacactgtgaatggctacgtcaatggaacaatgcccgatataacggtgtgtgcccacgaccacatatcctggcacctgctgggtatgagctcaggtcctgaactcttttccattcattttaatggtcaggtactggagcagaatcatcataaggtgtccgccattaccctggtctctgctacatccaccaccgctaacatgacagtaggacccgaagggaagtggatcatttcgtcgcttactcccaaacaccttcaggccggtatgcaggcctacatcgatattaaaaattgtccaaagaaaacgcgtaacctcaaaaagataacaagggagcagcgcagacacatgaagcgatgggagtactttattgctgccgaggaagtcatctgggactatgcacctgttattcccgccaatatggacaaaaaatacaggtcccaacatctcgacaatttcagtaatcaaatcggaaagcattacaagaaggtcatgtatacccagtacgaggacgaatctttcacgaaacacaccgtgaaccccaacatgaaggaggacggaatcttaggccccatcatccgggcacaggtgcgtgacactcttaagatcgtttttaagaatatggcttcgcggccgtactccatatacccccacggcgttacatttagtccttacgaagatgaagtaaactcttcatttacttcgggtcgtaacaataccatgatccgtgcagtgcaaccgggagagacctacacgtacaaatggaatatcttagaatttgatgagcccacggaaaacgacgcacaatgcctcaccaggccatactactccgatgtcgatatcatgagagatattgcttctggtctgatcgggcttctgttgatatgcaaatctcggagcttggaccgccgtggcatccaacgggcagctgatatcgagcagcaggccgtgtttgccgtctttgacgagaacaaatcatggtacctcgaagacaatataaataagttttgcgagaatcccgatgaggtgaagcgggatgatccaaagttctatgaatcgaatatcatgtctacgatcaacgggtatgttcctgaatccatcaccacgctaggcttttgttttgacgacaccgttcagtggcacttttgcagcgtgggcacccaaaacgaaattctgacaatacatttcaccggacatagcttcatctatggtaagcgacacgaggacactctgacgctgtttcccatgagaggggagtcagtgacagtcacaatggacaatgtagggacatggatgttaacttcaatgaattccagcccccgttcaaagaaactgagattgaagtttagagacgttaaatgcattccagacgatgatgaagactcttatgagatcttcgagccacccgagtcaacggttatggcaaccagaaaaatgcatgatcgtcttgaacccgaggatgaggagtccgacgcggattacgattaccagaatcgcctagcggctgctctcggaattcggtcatttaggaactccagcctgaaccaggaagaggaggagttcaacctgactgctttggcactggaaaacggaactgagtttgtgagcagcaatactgatattatcgtagggagtaactattctagcccttcaaatatcagtaaattcactgtgaacaatctagctgagcctcagaaagcccctagccatcagcaggccaccactgcgggcagcccactgaggcatttgattggaaaaaactctgtgctcaacagcagtacagcggaacacagttccccctactccgaggatcccatcgaagacccactgcagcctgacgtcactggcattaggctgctaagtctgggcgcaggcgagtttaagtctcaagagcacgctaaacacaaaggtcccaaggtggagagggaccaggcagccaaacatcgcttctcttggatgaaattgctggcgcataaggtcggccgccaccttagccaagacacaggatctccgagtgggatgcgcccgtgggaagacctgccatctcaggatacaggcagcccaagccgaatgcgtccttggaaggatccaccatctgatcttctgttgcttaagcaaagtaattcatcgaaaatcctggttggccggtggcacctggcctctgagaaaggatcgtatgagattatccaggacaccgatgaggatacagcagtcaacaactggctgataagcccacagaacgcatcacgcgcttggggcgagtctaccccactcgctaataaaccaggaaaacagagtggccaccctaagtttccccgagtgcgtcataagagcctccaggtgaggcaggatggaggcaagtcacgacttaaaaagtctcaattcctgatcaagacccggaaaaagaagaaagaaaaacacactcaccatgctcccctttccccacggacctttcacccacttcgctctgaagcctacaacaccttcagcgagcggagattgaaacattccctcgttctccataaaagtaatgagaccagcctgcccacggacctgaatcaaactctgccctcaatggattttggctggatcgcctcccttcccgaccataatcagaattcaagtaatgataccggccaagcctcttgccctcccgggttgtatcagacagtcccccctgaagagcactatcagacctttccaatacaggaccccgaccagatgcattccactagcgacccgtcacataggagctcgtctcctgagctttcagagatgcttgagtacgatagaagccacaaatcttttcccactgacatcagccagatgtcaccatcctccgaacatgaggtgtggcagacagttatatccccagatttgagccaagtgacgttgtctcctgagctgtcacaaacgaatctgtccccagatctgtcccacactaccttgtcaccagagctgatacagcgcaatttgtcaccagccctggggcagatgccaatctcccccgacctttctcacactacgttgtctcctgacctgtctcatacaaccttatcgctggatctgagccagaccaatctgagccccgagctatctcagacaaacttgtccccagctctgggacagatgcctctctcccctgatcttagccatactaccctgtctctggacttctcccagaccaacctctccccagaactctcccatatgaccctatcccccgaattgtcccaaaccaatctgagtccagcactggggcaaatgccaatatcccccgacttgtcccatacaactctctcgttggacttctcccaaacaaacctgtccccagagctcagccagactaatttaagccctgccctgggacagatgcccctctcccccgatccatcacacacaaccctaagtttggacttgtcccaaaccaacctctccccggaactgagtcagacgaatctgagtcccgacctgagcgagatgcccttgttcgctgatttgtcccagatcccactgacccccgacctggatcaaatgaccctttcccccgacttgggcgagacagatctgtcccccaactttgggcaaatgtcactatctcctgacctcagtcaggtaactctcagccccgacatatccgataccaccctcttacctgacctcagccaaatctcaccaccgcccgatctggaccagatcttttacccttccgagagctcccaaagtctcctgctgcaggaattcaatgagtcgttcccctatcccgatctggggcaaatgcccagcccttcaagcccaacactaaatgacacatttctctctaaggagttcaaccctctagtcattgtggggctctccaaggatggtactgactacattgaaattatcccgaaggaagaggtgcaatcatccgaagacgattatgccgagattgactacgtcccatacgacgacccgtacaagaccgacgtcagaactaatatcaacagttcacgggaccccgataacatcgccgcctggtacttaaggagtaacaatggcaacagacggaattactacattgctgcagaggaaatctcctgggactatagcgaattcgtgcagagggaaacagatattgaagattcggatgacatccccgaagatacaacttataaaaaggtggtttttagaaagtacttggatagcaccttcactaagcgcgacccccgcggggaatatgaggagcatctgggaattctgggtcccattattcgcgcggaggtagatgatgtaatacaggtgaggttcaagaacttagcctctcggccttacagccttcatgcccatgggctctcatatgagaagagcagcgagggcaaaacttacgaagatgacagccccgagtggtttaaggaggacaacgccgtgcaacctaattctagctacacttacgtgtggcatgccacagaaagaagtggcccagagagccccggctcagcctgccgtgcgtgggcctactacagcgctgtgaacccggagaaggacatccattctgggttaattggcccattgcttatttgccaaaaaggaatcctgcacaaggactcaaatatgccaatggacatgcgcgaatttgtcctcctttttatgacttttgatgagaaaaagtcttggtactatgagaagaagagtcggtcttcctggagactcactagttccgagatgaagaaatcccacgaatttcacgccataaacggaatgatatactcactcccagggctaaagatgtatgaacaggagtgggtcaggctgcacctgctgaatattggcggatcccaagatattcacgtcgtgcacttccatggacagaccttgctcgagaatggtaataaacaacatcagttgggtgtctggccactgttgcccggtagcttcaagactctcgagatgaaggcaagcaaaccaggctggtggctgcttaatacggaggtcggtgagaatcagcgggctggcatgcagactcccttcctgattatggatagagactgccgtatgccgatggggctgtctacagggattattagtgacagccagatcaaagcaagtgagttcttgggctattgggagcccagactagctcgacttaacaatgggggcagctataatgcatggtctgtcgagaagctggcggctgaattcgcctcgaaaccatggatccaggtcgacatgcagaaggaggtgataattaccgggatccaaacacagggggcaaaacattacctgaagagctgttataccacggagttttatgtggcttactcctctaatcaaataaactggcagatcttcaagggaaattctaccaggaatgtgatgtacttcaatggcaattctgatgcctccaccataaaagaaaatcaattcgacccccccatcgtggccagatatattcggatctcccctactagggcctataacaggccaaccctcaggctggagctgcagggctgtgaagtcaatgggtgctcaacaccacttggcatggaaaatggtaaaatcgagaataaacaaattacagctagcagttttaagaaaagttggtggggcgattactgggagcccttccgggcacgcttgaatgcccaaggccgtgtgaacgcctggcaggcaaaagctaacaacaacaagcagtggctggagatcgacctgcttaaaatcaagaaaatcaccgctattatcactcagggttgtaagagcttaagctccgaaatgtacgtgaagtcatacactatccattattctgaacagggtgttgaatggaaaccctaccgactgaaatccagcatggtggacaagatatttgaaggaaacactaacactaaaggtcacgttaagaatttttttaacccaccaatcatttcaagattcattagagtcatccccaagacttggaaccaaagtatcgcactgcgacttgagctgtttggctgcgacatatat

SEQ ID NO: 9070 - DNA, 6672 bp, Artificial Sequence
  Description of Artificial Sequence: Synthetic coding sequence
atgtttccaggatgccctcgtctgtgggtgcttgtggtcctcggcacttcgtgggtgggctggggctcccagggcactgaagccgctcagctgcggcaattctacgtggctgctcagggtatctcttggtcctataggcccgagcccaccaatagctcactgaacctgtccgtaacgagttttaaaaaaattgtttaccgggagtatgaaccctactttaaaaaggaaaaaccacagtctacaatcagtggattgctgggcccgactctttacgcagaggtgggtgacatcatcaaagtgcacttcaagaacaaggccgacaaacccctgtccatccatccccaaggtattcggtattcaaaactctccgagggagccagctacttagaccatacgtttcccgccgagaagatggatgatgcagttgctcctggcagagagtatacttacgagtggagcatctctgaggactcaggacctactcacgatgaccccccttgcttgactcacatctattacagccacgagaatctcatcgaggactttaattccggcctgatcgggccactgctcatctgcaagaagggtacattaacggaaggcgggacacaaaaaacattcgataagcaaattgtgttactgttcgctgtattcgacgaatccaaatcctggtcccagtcttccagccttatgtataccgtaaacggctatgttaatgggactatgcccgacattacagtgtgcgcacacgatcatatttcctggcacctgcttggcatgagcagtggccccgaactcttctctatacacttcaacgggcaagtgttagagcagaaccatcacaaagtgagtgctatcaccctggtgtctgctacaagcacaaccgctaacatgactgtagggccggaaggtaaatggatcatctcgagcctgactcctaaacacctgcaagccggaatgcaggcatacattgatatcaagaattgtccaaaaaaaacaaggaacttaaagaagatcacgcgtgagcaacggcggcacatgaagcgatgggagtactttatcgccgcagaagaggtcatctgggactatgcgcccgtaatccccgccaacatggataagaagtatcgcagtcaacatctcgacaacttctctaaccagatcggaaagcactacaagaaggtgatgtatacgcagtacgaagacgaaagttttaccaaacacacagtgaatcctaacatgaaggaggatggaattctggggcccatcataagggcccaggtgagggacaccctgaagattgtctttaaaaatatggccagccgtccatattcgatctacccccatggcgtcacttttagtccgtacgaggacgaagttaatagttcattcacgagtggccgtaacaacacaatgatcagggccgtacagcccggtgagacctacacatataagtggaatatcttagaattcgatgagcccacagagaatgatgcccaatgcctgacccggccgtactactcagacgtggacattatgagggacatagcctccggccttatcgggcttcttctgatctgcaaatcaagaagcctggacagacgtggaatccaaagggcggcagacattgagcagcaggcagtctttgctgtgttcgatgaaaacaagagttggtacctggaagacaatattaacaaattctgtgaaaaccctgatgaggtgaaacgggacgatcctaaattctatgagtctaacattatgtccacaatcaatggctacgtgcctgaatctataacaaccctgggattctgtttcgatgacactgttcagtggcacttttgtagtgtaggtacccagaacgaaatcctgacgatccacttcacaggtcacagctttatctatggcaagcgccacgaggatacgctgaccctgttccctatgagaggggaaagcgttacggtgactatggacaatgttggcacatggatgctcacatccatgaatagctctcctagaagcaaaaaactgaggttaaaattcagagacgtcaagtgtatcccagatgatgacgaggatagctatgagatctttgaaccacctgaaagcactgtgatggccacgagaaagatgcacgatagattagagccagaggacgaggaatctgacgcagactatgattatcagaacaggctggcggccgctctgggcatacgatcatttcgcaacagcagtctgaaccaagaggaagaggagttcaacctcactgcacttgctcttgagaatggcacagagtttgtgagctccaatactgacatcattgtcgggagtaattactcttcacccagcaacatatcaaaattcactgtgaataatctggctgagccgcagaaggccccatcacatcagcaggccacaaccgcagggagtcccctgcgtcatcttattggtaaaaactccgtcttaaattctagcacagctgaacactcaagcccctatagcgaagatcccatcgaggaccctctacagccagacgtgacagggatcagactgctgtcattgggcgcgggcgagttcaagtcacaggagcacgccaaacataagggacctaaagtcgaaagagaccaggctgccaagcaccgtttctcctggatgaaactgctagcgcataaggtcggaaggcatctgagccaggatacgggctccccatcgggaatgagaccctgggaggatctaccctctcaggatactggcagcccaagtagaatgagaccctggaaggaccctccttctgatcttttactgcttaaacagagcaattcatcgaagatcctggtgggtcgctggcatctggcgtcagaaaaaggttcttatgagattattcaagacaccgatgaggacacagcggtgaacaactggctcatctcaccccagaacgcttcccgcgcctggggagaaagcacacctttggcaaacaaacccggcaaacagtctggtcacccgaaatttccccgggtgaggcataagtcgctacaagtgcgtcaagacgggggcaagtcaagactcaagaaatctcagttcctgattaaaactcgaaaaaagaagaaggaaaagcacacccatcacgctcctctgtcaccaaggacattccaccctctgagatctgaagcatataacactttttctgagcggagactaaagcatagcctggtgctgcacaaaagcaatgagaccagcctgccaacggacttaaaccaaaccctgcctagcatggacttcgggtggattgcgtcactgccagaccataatcaaaattcatcaaacgacactggccaggcctcatgcccgcccggattgtaccagactgtcccccctgaggagcattaccaaacgtttcccatccaggatcccgaccagatgcatagtacctccgacccgtcccacagatcaagttctcctgagctctccgaaatgctcgagtacgaccggagccacaaatcctttccaacagacattagtcagatgtccccatcgtctgagcacgaagtgtggcagaccgtgatcagccccgacctgagccaggtcacattgtctcccgagctgtctcagacaaatctctctccggacctcagccacaccacactgtcacctgaactgatccagagaaacctctcacctgctctaggccaaatgcccatctcccctgacctaagccacaccaccctgtcacctgatctctctcatactaccctgtcactggatctcagccagaccaacttgagccctgagctttcccagaccaatctcagtccagcactgggccagatgcccttgtccccggatctgtcccataccacactgtcactggacttcagccagactaatttgagccccgagttgtcccacatgacgctgtcccctgaactgagccagaccaaccttagtcccgctcttggtcagatgccaatttctcccgatctgagtcatactaccttgtctctggatttctcgcagactaacttatctcccgaactctcacagaccaacctgtcaccagcactggggcagatgccacttagtcctgatccgagtcatactaccctatctctcgacctaagtcagaccaacctctcgccggaactgagccagactaacctgtcccctgacctgtccgagatgcctctgttcgcagacctctcacagattccccttactcctgatctggaccagatgacactgtcaccagacttgggtgagactgatctgtctcccaattttggacagatgtctctgtctcctgatctcagtcaggtcacattgtccccagacatcagcgacaccactttgctaccagatctgtcacagatctcgccccccccggacctcgaccaaattttttacccgtcggagtccagccagtcattactccttcaggagtttaatgaatcattcccttatccggacctgggtcagatgcctagcccaagctcaccaaccctaaatgatacgttcctgtccaaagagtttaatcctctggtcatcgtcggtctcagcaaggatggcaccgactacattgagatcattccaaaggaggaggtgcagtcatccgaggatgattatgcagagattgactacgttccttacgacgacccctataagacggatgtcagaacaaacatcaattctagtagggacccagacaatatcgcggcctggtacttgcgatctaataacgggaatcggcggaattattacatagcggcagaagaaatttcttgggattactcagaattcgttcagagggaaacagacattgaggacagcgatgatatccccgaagatactacttataagaaagttgttttcagaaaatacctcgatagcacctttactaaaagagatccgagaggcgagtacgaggagcacctcggcattctgggaccgattatcagagctgaagtcgacgacgtcatacaggtcagatttaaaaaccttgccagccggccctatagcctgcacgcgcacggactgagctatgagaagtctagcgaagggaaaacatacgaagatgattcacccgaatggttcaaagaggacaacgccgtccagcccaatagctcctatacctacgtctggcatgccactgagagatcaggacccgagtcacccggatctgcttgtcgggcctgggcctactacagtgcagttaacccagagaaggacatccactctgggcttatcgggcccctgctaatctgccagaaaggcattcttcataaagactctaatatgccgatggacatgagagaattcgtgctcttgttcatgactttcgacgaaaaaaaaagttggtactacgagaaaaagtctcgatctagttggagattgaccagtagcgagatgaaaaaaagccatgagtttcatgctatcaacggaatgatttacagtctgcccggccttaaaatgtatgaacaggaatgggtgaggctacatctacttaatattggcggatcccaggacattcacgtggtgcactttcatgggcagaccctcctcgaaaacgggaacaaacagcaccagcttggcgtgtggcctttactgcctggtagttttaagacactggaaatgaaggcgagcaaaccggggtggtggctgctgaacactgaggtgggggaaaaccagcgtgccggcatgcagacaccctttctgatcatggaccgggactgtagaatgcccatgggactgagcacaggaattatttctgactcgcaaatcaaggcaagcgaattccttgggtactgggaaccccgactggcacggctgaataacggcggatcttataatgcttggtcagtggagaagctggccgccgaatttgcgagcaagccatggatccaggtggatatgcagaaagaggtgattattacaggtatccagacacagggcgccaagcattacctcaagagttgctatactactgagttttatgtggcatattcatccaatcagattaattggcagatctttaagggtaactctacacggaatgtgatgtactttaacggaaactctgatgcatctacgatcaaggaaaaccagttcgacccccctatcgtggcgcggtatattcgcatttctcccacaagggcttataataggccgaccttgcgcctggagctccaagggtgcgaagtaaatggctgcagtacaccgctgggaatggagaacggtaagattgagaacaaacagatcacagccagctcattcaaaaagtcttggtggggggactactgggaaccattcagagcaaggctgaacgcccagggaagagtcaatgcctggcaggctaaggcaaataacaacaaacagtggctagaaattgacctgctgaagattaagaaaattaccgccattataactcaggggtgtaagtccctttcctccgaaatgtacgttaagagttacaccatccattattccgagcagggggtcgaatggaagccttacagacttaagagcagtatggtagacaaaatcttcgaaggcaatacaaacacaaaagggcacgtaaaaaatttcttcaaccctcctattatctctaggttcattcgtgtgattccgaagacttggaatcagagtatcgctttgcggctggaactgttcgggtgcgatatctat

SEQ ID NO: 9071 - DNA, 6672 bp, Artificial Sequence
  Description of Artificial Sequence: Synthetic coding sequence
atgttcccgggatgccccaggctgtgggtactcgtggtgctgggcacgtcttgggtcggatggggtagccagggaacggaggccgctcagttgcgtcagttctacgttgccgcccagggtatcagctggtcttaccgtccagagcccacaaacagctctctgaatctttccgtaacgtccttcaagaaaatagtttatcgcgaatacgagccttacttcaagaaggagaagcctcagagcaccattagtggcctcctggggcccactttgtatgccgaagtcggtgatatcattaaagtgcatttcaagaataaggccgataagccgttgtctatccatccgcagggcatccggtacagtaagctttccgagggcgctagctacctcgaccacaccttccccgcggaaaagatggatgatgcggtcgccccgggtcgggagtacacgtacgagtggtcaatttctgaggactccgggcctacccatgacgacccgccctgcctcacccatatctattacagccatgagaatctcatcgaggatttcaactccggccttattggtcccctgctcatctgcaagaagggcaccctgactgagggaggcacacaaaagaccttcgataaacagatcgtcttgctgttcgccgtcttcgacgagagcaagtcctggtcccagagctcgtctctgatgtacactgtcaacggatacgtgaatggaactatgcctgacatcactgtctgcgcccacgaccacatctcctggcacctcctcggtatgtcttccggccctgaacttttctccatccactttaacggccaggtgttagagcagaaccatcataaagtcagcgccatcactcttgtgtctgctacaagtaccactgctaacatgacggtgggccctgagggcaagtggatcatatcttcgcttaccccgaagcatctccaggcgggtatgcaagcctacatcgacatcaagaattgccctaagaagactcggaaccttaagaagatcacccgcgagcagcgccggcacatgaagcgctgggagtattttatcgcggcagaggaggtcatctgggattacgctcccgttatcccggctaatatggacaagaagtacaggtctcagcacctcgacaacttttctaaccaaatcggtaagcattacaagaaagttatgtacacccagtacgaggacgaatctttcactaagcacaccgtcaacccgaacatgaaggaggacggcatcttgggccccatcatccgagcccaggtacgcgacacgttaaagattgtgttcaagaacatggcatctcgtccttactccatctatcctcacggcgtaacgttctccccctatgaggacgaggtcaattcctcctttacgagtggccgcaacaatacgatgattcgggccgtccagccgggcgagacttacacctacaagtggaacatcctcgagttcgacgagccgacggagaatgatgctcaatgcctgacccgcccatactactccgacgtcgacatcatgcgcgacatcgcaagcggcctgatcggactcctgctgatctgtaagagccgctctcttgaccgacgtggtatccaacgtgccgcagacatcgaacagcaggctgtctttgctgtctttgacgagaataaatcctggtacctggaggacaacataaacaagttttgcgaaaacccagacgaagtgaagcgggacgacccgaagttctacgaatcaaacatcatgtccactatcaacggctatgtccccgaaagcatcactactttgggtttctgcttcgatgacacggtacagtggcatttttgctcggtcggcacccagaacgaaatcctgaccattcactttaccggccactccttcatatacggaaagcgtcatgaggataccctcaccctctttcccatgcggggtgagtcagtaaccgtcaccatggataatgttggaacttggatgctcacgtcaatgaactcctcgcctcggtctaaaaagctcagactcaagttccgcgacgtgaagtgcatccccgacgacgacgaagactcttacgagatattcgagcctcctgagtccactgtcatggcaacccggaagatgcacgaccgtctggagcccgaggacgaggagagcgacgcagattatgactatcaaaaccgtctcgcagctgcactgggtatccgttcgtttcgcaacagcagtttgaaccaggaggaggaggagttcaacctgacggccttggccctggagaacggtacggagttcgtctccagtaacactgacattatcgtgggatccaactactcctctccgtcgaacatctctaaattcacagtcaacaacctggctgaaccccaaaaggcgccttcacaccagcaagctaccactgcaggctctcccctgcgccaccttatcggcaagaactctgtcttgaacagttccactgccgagcactcctctccatatagcgaggacccgatcgaggaccccctgcagccagatgtcactggtatccggctgctgtcgctgggagccggcgagtttaagtctcaggagcacgccaagcacaagggtcccaaggtggagcgtgaccaggcggccaagcaccgtttcagttggatgaagttgcttgcgcacaaggttggtaggcacctgtcgcaggatactggttcaccttctggcatgcgtccctgggaagacttgccgtcgcaggacacaggtagcccctcgcgcatgcgcccctggaaggatcctcccagtgatctgctgctcctcaagcagagcaacagctccaaaattctggtcggtcgctggcacctcgcttccgaaaagggctcctacgaaattattcaagacacggatgaagataccgctgtcaacaactggcttatctccccccagaacgcctcgcgtgcatggggcgagtcgacgcctctagccaacaaacctggtaagcagagcggacacccgaagttccccagagtccgtcacaagagcttgcaggttcgccaggacggtggaaaatccagactcaagaagtctcagtttctgattaagacccgcaagaagaagaaggagaagcatacgcaccatgctcccctctcgccgcgcaccttccacccgctgcgcagcgaggcctacaataccttctctgagcgtcggctcaagcacagcctcgtgctccacaagtccaacgagacctccctgcctaccgatcttaaccaaaccctcccctctatggacttcggctggatcgccagcctccccgaccacaaccaaaatagctctaacgataccggccaagcttcctgccccccaggcctgtatcagactgtcccccccgaggaacattaccagacgtttccaattcaggaccctgaccaaatgcatagtacgtccgaccccagccaccgatcctcgtctccggagttgtccgaaatgctggaatacgatcgttcccacaaaagcttccccaccgatatctctcagatgtcgcccagctccgagcacgaggtctggcaaactgttatcagcccggatttgtcccaggttacgttgagtccggagctctctcagacgaacctctcgccagacctcagccataccaccctctctcccgagctcatccagcgaaatctttctccggctctcggtcaaatgcctattagccccgatctgtctcacaccactctctctccggacctttcccataccactctctcgctagacctcagccagaccaacctctctcccgagttgtcacagacgaacctctcaccagcgctcggacaaatgcccctctctcctgatttgtcacataccaccctgtccctcgacttctcccagacgaacctgagccctgagttatcccacatgaccttgagccccgaactgtcacaaaccaacctatctcctgctttgggtcaaatgcccattagcccggacctctcccacaccactttgtctctggatttctcgcagactaacttgtcccccgaattgagccagaccaacctaagtccggccctgggtcagatgcctctgtctccagacccttcacacaccaccctctccctcgaccttagccagaccaacctgtcccccgaattgtctcagaccaacctttcaccagacctgtcagagatgccgctcttcgctgacctctcccagatccccctcacacctgacctcgaccagatgacactgtcgccagacctgggtgaaaccgatctctctcccaacttcggtcagatgtccctcagcccggacctctcccaggtcactctctccccggacatcagcgatactactttgctgcccgatctctctcaaatctcccctccccctgatctggatcaaatcttctatccctccgagagctcccagagcttgctgttgcaggaattcaatgagagttttccctaccccgacttgggtcaaatgccgtcccccagctcaccgacactgaatgatacattcctaagcaaggagttcaacccacttgtgatcgtcggtttgtctaaggacggcacagattacattgaaatcatcccgaaggaggaggtccaatcctccgaggacgactatgccgagatcgactacgtcccctatgacgatccctataagaccgatgttaggaccaacataaattcctcccgtgacccagacaacatagccgcctggtacttgcggagcaacaatggtaaccggcggaattactatatcgccgctgaggagatctcgtgggactactcagagttcgttcagagagagacggacatcgaagatagcgacgacatacctgaagacaccacctacaagaaagtcgtattccggaagtacctggattcgacatttactaagcgggatccacggggcgagtacgaggagcatctgggtatcctcggcccgattatacgggccgaagtcgacgatgtgattcaggtgcgatttaagaacctggcctcccgtccctactccttacacgcacacggtctctcttatgagaagtccagcgaggggaagacctacgaggatgacagcccggaatggttcaaagaggacaacgctgtccagcccaactcgagctacacctacgtgtggcatgccaccgagagatccggcccggaatccccgggttcagcgtgtcgcgcctgggcttactactcggcggtgaaccccgagaaggacatccacagtggtctcattggcccgctactgatttgccagaagggtattttgcacaaggactcaaatatgccgatggacatgcgcgagtttgtcctcttgttcatgacgtttgatgagaaaaaatcctggtattacgagaagaagagcagatcgtcctggcgtcttacttcttcggagatgaagaagtcacacgagttccatgccattaatggcatgatctacagcctgcccggtctgaagatgtacgagcaagagtgggtgcgtctgcacctgctcaacattggtggatcccaggacattcacgtagtccacttccacggacaaaccctgttggaaaatggcaataagcagcaccagctgggtgtctggcctttactccctggtagcttcaagactttggagatgaaggcgagcaagccaggttggtggttgctgaacaccgaggtcggtgaaaaccagcgagccggtatgcaaacccctttccttatcatggaccgtgactgtcgcatgccaatgggcctcagtactggtatcatcagcgattcccagataaaggccagcgagttcctgggttactgggagcctcgtctggcccggctgaataacggtgggtcctataacgcctggtctgtggaaaaattggctgccgaatttgcctctaagccttggatccaggttgacatgcagaaggaggtcatcattaccggtatccagacccagggcgccaagcactatctcaagtcatgttacacgacggagttttacgtggcctactcttccaaccagatcaactggcagattttcaagggtaatagcaccaggaacgtcatgtacttcaatggaaatagcgatgcctccaccataaaggagaaccagttcgatccaccgatcgtggctaggtatattcgcatctcgcccactcgagcctataaccgaccgaccctccgtctcgaacttcagggctgtgaggttaacggctgtagcacccctttgggcatggagaacggcaagattgagaacaagcagattactgccagttccttcaagaagtcatggtggggtgactactgggagcccttccgcgctcggttgaatgcgcagggtcgcgtcaacgcttggcaggctaaggctaacaacaacaagcagtggctggagattgatttgctgaagatcaaaaagatcacggctattatcacccagggttgtaagtctctctcatcggaaatgtatgtcaagtcctacactatccactacagcgaacagggtgtcgagtggaagccctaccgtttgaagtccagtatggtcgataagatcttcgagggaaacactaacaccaaaggtcatgtaaagaacttcttcaaccccccgatcatctcccgatttattcgagttatccctaagacatggaatcagagcatcgcactccgcctcgagctctttggctgcgatatctac

SEQ ID NO: 9072 - DNA, 6672 bp, Artificial Sequence
  Description of Artificial Sequence: Synthetic coding sequence
atgtttcccggttgtcctagactgtgggtcctggtggtgttgggtacttcttgggttggctggggcagtcagggtaccgaggccgctcaactccgccagttctatgtcgcggcccagggtatctcttggagttatcgccccgaacccaccaattcatcccttaatttgtcagtaacatccttcaaaaaaatagtatatcgcgaatatgaaccatacttcaaaaaagagaagccgcagtctacaatatccggtcttctgggaccgacactgtacgcagaggtcggcgacattatcaaggtacattttaaaaataaggccgataagccactgagcatccacccgcaaggtatcagatacagtaagctgtccgagggcgctagctacctggaccacactttccccgctgagaaaatggatgacgctgtggctccaggcagggagtatacatatgaatggtctattagcgaagactctggtcccacccacgacgacccaccttgtcttacacatatttactactcacacgagaatcttatcgaagacttcaactccggactcatcggacccctcctcatttgtaaaaaaggcactctgaccgagggtggcactcagaaaacgttcgacaagcaaatagtcctcctgtttgccgttttcgacgagtccaagtcatggtcccagagcagcagtcttatgtacaccgtgaacggctatgtcaacggaacaatgcctgatataactgtctgcgcgcacgatcacatttcatggcacctcctcggtatgagcagcggcccagagctcttctccattcactttaatggccaggtacttgagcagaaccaccacaaagtatctgctatcactctggtttcagctaccagcaccactgcaaacatgactgtgggtccggaaggtaagtggatcattagcagtctgacacctaaacacctgcaagccggcatgcaagcctacatcgacatcaagaactgtccgaagaaaactaggaatttgaaaaaaatcacacgcgaacagagaagacacatgaaacgctgggagtacttcatagccgccgaggaagtgatttgggattacgcaccagttatcccagctaacatggataagaagtacagatcacaacatctggacaatttctccaaccagatcggaaaacattacaaaaaggttatgtacacacaatacgaggacgagagctttactaagcacactgtcaaccctaacatgaaggaggatggaattttgggaccgattatcagggcccaggtcagagacactctgaaaatcgtatttaagaatatggctagcaggccctactccatatatcctcacggagtcacatttagcccgtacgaggacgaggtcaatagtagcttcacaagcggtagaaacaatacaatgatccgcgctgttcagcctggagaaacttacacatacaagtggaacattctggagttcgatgagcccaccgaaaatgacgctcaatgcttgaccaggccgtactacagtgacgtggacataatgagggatatcgcatcaggtctgatcggactcctcctcatttgcaaatcccgcagcttggatagaaggggaatccaaagagccgccgatatcgaacagcaagcagttttcgctgtgttcgatgagaataagtcctggtacctggaggataacataaataagttctgcgagaaccctgatgaggtcaagagggacgatccgaagttttacgaatccaacatcatgagcacgatcaatggctatgtgccagagtcaataactaccttgggtttctgtttcgatgacacggtgcagtggcacttttgctccgtgggaactcaaaacgagattcttacaatccatttcacaggacactcctttatctacggcaaaagacacgaagataccctcactctgttccctatgaggggcgagagcgtgactgtgaccatggataatgtcggcacatggatgctcactagtatgaacagctccccccgctccaagaagctccgcctcaagttcagagatgtcaagtgcatccccgatgatgacgaagattcatacgagatcttcgagccaccagagtcaacagtgatggccacacgcaaaatgcatgaccgcctggagcctgaggatgaggagagcgatgccgattacgactatcagaacagattggccgccgcactcggaattagatccttcaggaactcatccctgaaccaggaggaagaagaattcaatttgaccgctctggctctcgaaaacggaaccgaatttgtgagttccaatactgacatcattgtgggctccaactacagttccccctctaacatttccaagttcactgtcaataatctcgctgagccgcaaaaggccccctctcatcaacaggcgaccacggccggtagcccgctgcgccacctcatcggaaagaattctgtgcttaacagttctaccgccgagcattcctctccttattccgaagatcccatcgaagacccgctgcagcccgatgtaaccggcatcagactgctgtccctgggtgctggcgagtttaagtcacaggagcatgccaaacataagggccctaaagtggaaagggaccaagccgccaagcatagattctcctggatgaagctcctcgcccacaaggtaggcaggcacctttctcaggacacaggtagcccttccggaatgaggccttgggaggatctgccttcccaggatacaggaagccccagtaggatgagaccctggaaggatcctccttcagaccttctcctcctcaaacagagcaactcttctaagattctggttggcaggtggcatctcgcttctgagaaaggctcatacgagatcatccaggatacagatgaggacacagcagtaaataactggctcatctctccgcagaacgcaagtagggcatggggtgagtcaacgcccctcgccaacaagcccggtaaacaaagtggtcatcccaagttccccagggtgcgccacaaaagtctccaagtgcgccaagacggcggaaagagccgcctcaagaagagccagtttctgattaagacaaggaaaaagaagaaggagaagcatacccaccacgcccccctgagcccgaggactttccatccactgcgctctgaggcatataacaccttttctgaaagaaggctcaaacacagccttgtattgcacaagtcaaatgagaccagtctgccaacggatcttaatcagacattgccttctatggactttggctggattgctagcctcccagatcataatcaaaactcatcaaatgacactggacaggcttcctgcccgccaggcctttatcagaccgtgccgccagaagaacactaccaaacatttccaatccaggaccccgaccaaatgcattctacctctgacccgagccacagaagctcatctccggaactgtctgagatgctggagtacgatagatctcataagagtttcccaactgatataagtcaaatgagtccctctagcgaacacgaggtatggcagacagtgatatcacccgacttgagtcaggtgaccttgagccctgagctgtcacagactaacctgtcacctgacctgtctcacacgaccctgagcccggaattgatccagcgcaacctgtccccggcactgggccaaatgcctatctccccggacctgtcccatacgacattgtctccagatctgagccatacgacactcagcctggacctgtcccagacgaatctctctcccgagttgtcacagacaaacctgtctcctgctctgggccagatgcccctgagtcccgatctgtctcacacaactctgtctctggacttttcccaaactaatctgtcacccgagctcagccacatgaccctgtcaccggagctgtctcagactaacctttcaccagccctgggacagatgccaatttctcccgacctgtcccacaccacgcttagcctcgacttctcacaaacaaacctttctcctgagctgtctcagactaatctttctcccgctttgggccagatgcctctgagcccagatcccagccacaccactttgagcctggacctgtctcagaccaatctctctcccgaactttcacagaccaacctgtcaccagatctcagcgagatgcccctgttcgctgatctgtcccagatacccctcactccggacttggatcagatgaccctttccccagatctgggcgagactgacctgagccccaacttcggtcaaatgtccttgagccccgatctgtcccaggttacattgagccctgacatctccgacaccacgctcctgcctgatctgagccagatcagcccgccacccgacctggatcagatcttttacccctctgagagcagccagtctcttttgttgcaagagttcaatgaaagctttccctacccagacctcggacagatgccaagtccgtccagtcccactctgaacgacactttccttagtaaggaattcaaccctctggtgattgtaggcctgagtaaggacggtaccgactacatcgaaattattccgaaggaagaggttcaatcatccgaggacgattacgccgagattgactacgtaccttacgatgacccttacaagacggacgtaaggaccaacataaacagctccagagatcctgacaacatagcggcctggtacctgcgcagtaacaacggtaataggcgcaattactacatcgcagcagaggaaatttcttgggattacagcgaattcgtacagcgcgagacggacattgaggacagcgacgatattccggaggacacgacctataaaaaagtcgtgtttcgcaagtatctcgacagtacgttcacaaagagggatccgaggggcgagtacgaggagcacctcggtatcctcggtcccatcatcagggctgaggtggatgatgttatccaggttaggttcaagaaccttgccagcagaccctatagcctccacgcgcacggactgtcctacgaaaagagttcagaaggcaaaacctatgaagatgattctcccgaatggttcaaggaggacaatgcggtccagcctaactcctcttacacgtacgtatggcatgccacagaacgctctggccccgagagtccaggcagcgcttgcagagcctgggcttattactctgcagttaatcccgagaaagatattcattccggattgatcggtcccttgctgatctgtcagaaaggcatcctccacaaagattcaaacatgccaatggacatgagggagttcgtgctgttgttcatgactttcgatgaaaaaaaatcatggtattacgaaaaaaaatctagatcatcctggagactgacctcaagcgagatgaagaagtcccacgaattccatgccatcaatggaatgatctatagtttgcccggcctcaagatgtacgaacaggagtgggtgagacttcacctgctgaacatcggcggctcccaggacatccatgttgtgcactttcatggccagaccttgttggaaaacggtaataaacagcatcagctcggtgtctggcctctgctgcccggcagcttcaagacactggagatgaaagcatcaaaaccgggatggtggctgcttaacaccgaggtaggagagaaccaaagagccggcatgcagaccccattcctcattatggacagggactgtagaatgcccatgggcctcagcacaggaatcatcagcgactctcaaatcaaggccagtgagttcctgggatactgggagccccgcctggcacgcctgaataacggcggcagctacaacgcttggagcgtcgagaagttggcagccgaatttgcgtccaaaccttggatccaagtggacatgcagaaggaagtcattattaccggcatccagacacagggtgccaagcactatctgaagtcttgctacaccactgagttttacgtcgcctactccagcaatcagatcaactggcaaatcttcaaaggaaatagtacccgcaatgttatgtatttcaatggaaactccgatgccagcactatcaaggagaatcagttcgaccctcccatcgtggcccgctatattcgcatttccccaacaagggcttacaaccgccctaccctcagactggaacttcagggatgcgaagtgaacggatgcagtactccccttggtatggaaaatggcaagatcgaaaataagcagattacagccagttctttcaagaaatcttggtggggtgattattgggaaccttttagagctaggctcaacgctcagggaagagttaacgcttggcaagccaaagcgaataacaataagcaatggctggaaattgaccttctcaagatcaaaaaaattaccgctataatcacacagggatgtaaaagcctcagttctgagatgtacgtgaaatcttatactattcattacagtgagcaaggcgtggaatggaagccttataggctgaagtcatccatggtggataagatttttgagggcaataccaacaccaaaggacatgtgaagaactttttcaaccccccaattatcagtaggtttattagagtgatcccaaagacctggaaccagtccattgccctgagacttgagctgtttggttgcgacatctat

SEQ ID NO: 9073 - DNA, 6672 bp, Artificial Sequence
  Description of Artificial Sequence: Synthetic coding sequence
atgttccccgggtgtccgcggttgtgggtgcttgtcgtgctagggactagctgggtaggatggggttcacagggtaccgaggctgcacaacttcggcaattttacgtggctgcccaagggatatcctggtcctaccgacccgaaccaacgaactccagcttgaatttgagcgttacttctttcaaaaagatcgtataccgcgaatacgagccgtattttaagaaggaaaagccgcagagcaccattagtggcttgttaggacccacactctatgctgaagtgggagacattattaaagtccatttcaaaaacaaggcagacaagcccctgtctatccatccacagggaattcgatattcaaagctttccgagggcgccagctatctggatcacaccttcccagcggaaaagatggacgatgctgtggcaccgggccgggaatacacctacgagtggagcatttcagaggactctgggcccacccacgatgatccaccttgtctgacgcacatctactatagtcatgagaatcttattgaagattttaactccggactgatcggacctcttctgatttgcaagaagggaacattaacagagggaggaacgcagaaaacgtttgacaagcagatcgtgctcctattcgcagtatttgacgagagtaagtcttggagtcagtctagttctctgatgtacacagtcaacggttatgttaatggcaccatgccagatatcaccgtctgcgcccacgatcacatctcatggcacctgctaggaatgtcttccggacccgagctcttctccattcattttaacgggcaagtgctcgagcagaatcaccataaggtatctgccattacactggtgtctgcaaccagtaccacagccaacatgacagttggacctgaaggaaaatggatcatatcttccctcacaccaaagcacctacaggccgggatgcaggcatacatcgacattaaaaactgccctaagaagacccgtaacttgaagaaaataacgagggaacaacgcagacatatgaagcgctgggagtattttatcgcagcggaggaagtcatatgggactatgcaccagtgattccagctaacatggacaagaagtatcgatctcagcacctggataacttctcgaatcagatcggcaaacactacaaaaaggtcatgtacactcagtacgaggatgaatcattcaccaaacataccgtgaaccccaatatgaaggaggatggaatcttggggcccataatccgggcccaggtacgggacacactgaagatcgtgtttaagaacatggcatcaaggccgtactctatttacccccatggtgtgactttctccccttacgaagacgaggtgaattcttccttcacgtcgggccgcaacaacactatgatccgcgccgtccagccgggtgagacctatacgtacaaatggaatatcctggagtttgacgagcctactgaaaatgatgcccagtgcttgactagaccatactattcagacgtggacattatgcgcgacatagcgagcggcttgataggactgctcctgatctgtaagtctcgctccttggataggcgtggcatccagagagctgcagacatagaacaacaagccgttttcgctgtgttcgatgagaataagagctggtacctcgaggacaacatcaacaagttttgtgagaatccagatgaggtgaaacgtgacgatcctaaattctacgagtccaacatcatgagtacaattaatggctatgtgcctgagagcatcacaacattagggttctgcttcgacgacacagtgcagtggcacttctgttcagtgggaactcagaacgaaatattaacgatccactttaccggccattccttcatttatggaaaacgccacgaggatacactgacattgttcccaatgaggggggaaagtgtgacggtgaccatggacaatgtgggcacttggatgcttacttccatgaatagttcaccgcggagcaagaagctccgactaaaatttcgggacgtgaagtgtattcctgacgatgacgaagattcctatgagattttcgaacctcccgagtctacggtgatggccacacggaaaatgcatgatagacttgaacctgaggatgaagagtctgatgctgactatgactaccagaatcgcttggccgccgcactggggatccgctcttttcgcaactcttctctgaaccaggaggaagaagaatttaacctaactgctcttgcccttgaaaacggtacggaattcgtgagctcgaacaccgacataatcgtgggtagcaattactcctctccctccaacatttccaaatttactgttaataacctggctgaaccgcagaaggccccgagccatcagcaggccacaactgcaggctcacccctccgccatctgatcgggaagaactctgtacttaattcctctaccgccgagcatagttcaccctatagtgaggatcctattgaggatccactgcagcccgatgtcaccggcatcagactgctgagcctgggcgccggggaattcaagtctcaggagcatgctaagcataagggccccaaggttgagagagaccaggccgccaagcatagattctcgtggatgaaactgctggcacacaaggtaggaagacatctgtctcaggataccggcagcccaagtggcatgcggccctgggaagacctgccatcccaagatactggttcccctagtcggatgaggccttggaaagatccgccaagcgacttgctcttgctgaagcagtccaacagcagcaagatcctcgtggggcggtggcacttggccagtgagaagggttcctacgagattatccaggacacggatgaggatacggccgttaacaattggctgataagtccccagaacgcttctcgggcctggggggagtcaactccgttggcgaataaaccagggaagcaatcgggacacccgaagtttccaagagtccggcataaaagcctccaggtcaggcaggatggtggtaagtcaaggctgaagaagagtcagttcctcatcaaaacaagaaaaaagaaaaaagaaaagcacacacatcatgctccactgagtccaaggacattccaccccctgcggtctgaggcatacaacactttttccgagagaaggctgaagcattctctggtcctccataagagtaacgagacctctttacctactgatctgaatcagacgttgcccagcatggacttcggatggattgcatcactccctgatcataatcagaacagctccaacgacactggccaagcatcttgtcccccggggctctaccaaacagtgccccctgaggagcactatcaaaccttccctattcaagacccggaccagatgcactcaacatccgacccaagtcatcggtcatccagccccgagctcagcgaaatgctggagtatgatcggtctcataaatctttcccaaccgacatatcccagatgtccccctcatctgaacacgaagtatggcagacagtgatctctccagatctgagccaggtgaccctgtctccagagctgagccagaccaacctgtccccggatctgtcccacactacactcagccctgaactgattcagcgaaacctgagccccgcgttgggacaaatgccaatctccccagacctcagccacaccacactgtccccggatttatcccacacgacgttgtctcttgacctgagccagaccaatctcagcccagaactgagtcaaacaaacctgtcccccgcattgggtcagatgcccctcagtccagacttaagccacacgaccttgagtctcgacttctcccagaccaatctcagcccggaactctctcacatgacattgtcccctgaactcagccagacaaacctctcccctgcactgggccagatgcccattagccctgacttaagccataccacactgtcattagatttctctcagacgaatctctccccagaattgtcccagaccaacctgtccccagccttgggccagatgccactgtctcccgacccgagtcatacaacgctgtccttagacctgagccagactaacttatctcccgaactgagtcagaccaaccttagtccggacctgtctgagatgcccctgttcgccgacctgtctcaaatccctctcacccccgatcttgatcaaatgacactcagtcccgatctgggcgaaactgacttgagcccaaactttgggcagatgagcctgtccccagacctttctcaggtcactctatctccagacatcagcgataccacgctcctgccagatctgagtcagattagtccacctccggacttggatcaaattttttatccctccgaatccagccagtcattgttgttgcaagagtttaacgagagttttccataccccgacctgggtcagatgccgagcccatcaagccccacactaaatgatacttttctttcaaaagaattcaatccccttgttatagtcggactgtcaaaagacggaacggactatattgagatcatcccaaaggaggaagtccaatctagcgaagatgactacgcggagatcgactacgtgccctatgacgatccctataagacagatgtacgcactaacatcaattcttcccgcgaccccgataatatcgctgcttggtacctgcgctccaataatgggaaccggcgcaactactatattgctgctgaagaaatctcatgggactactcagaattcgttcagcgggagaccgatatcgaagacagcgacgacataccagaggacactacctacaagaaggttgtcttcagaaagtacctagacagcacattcactaaaagagatcctcgaggggagtatgaagagcacttagggatactgggcccaatcatccgggcagaagtggatgatgtgatacaggtgcgatttaaaaatctggcctctcggccttattcccttcacgcccacggcctttcatacgagaagtcttcagaagggaaaacctatgaggatgactccccagagtggtttaaggaggataacgcggtccaacctaatagctcctacacgtatgtctggcacgcaaccgaacggtcaggtccagaaagccctgggtcagcctgccgcgcctgggcatactacagcgcagtgaaccctgagaaggatattcattctggccttatcgggcccctgctcatttgtcagaaggggattctgcacaaggactctaatatgcccatggacatgagggagttcgtcctcctgtttatgacatttgatgagaagaaatcttggtattacgaaaaaaagagcaggtcaagttggcgacttacttcctccgagatgaagaagtctcacgagttccatgccattaacggtatgatatatagcctgcccggccttaaaatgtatgagcaggagtgggtgcgtctgcaccttcttaatataggtggatctcaggacatccatgtggtacacttccatgggcagacactgcttgaaaacggcaataagcagcatcagctgggggtctggcctctgctgccaggctccttcaagactttggagatgaaggcctcaaagcctggttggtggctccttaacaccgaggtgggggagaaccaacgcgcggggatgcagaccccattcctcataatggaccgtgactgccggatgccgatgggactcagcactggcattatctccgattcccaaatcaaggcctctgagtttctgggatactgggagccaagactcgcacgcctgaataacggcggttcgtacaacgcctggagcgtggagaaactcgcagccgaattcgcctctaagccttggattcaagttgacatgcagaaggaggtgataatcacggggatccaaactcagggagctaagcattatcttaaaagttgttacacaaccgagttctacgttgcctatagttccaaccaaattaactggcagatcttcaagggcaattccacccggaatgttatgtacttcaacggcaactctgatgcatccaccatcaaggaaaaccaattcgacccaccaattgtggcaagatatatccggatcagtcctacacgggcctataacagaccgactctccgattggagctgcagggatgcgaggtgaacggatgctccacaccgcttgggatggaaaacgggaaaattgagaacaaacagattacagcctcgtcctttaagaagtcatggtggggcgactactgggagcccttcagggccaggctcaacgcccagggcagggtaaacgcatggcaggcaaaggccaataacaacaagcaatggctggaaatcgacctcctgaaaatcaagaagataactgcaatcataacgcagggctgcaaatccctctctagtgagatgtacgtgaagtcctacacaattcactacagtgaacaaggcgtggaatggaagccatatagactgaagagctccatggttgataagattttcgaaggaaataccaacactaaaggtcacgtcaaaaatttctttaatccacccattatctccagatttataagggtgatcccaaaaacctggaaccaatctatagcccttaggctcgaactattcgggtgcgatatctac

SEQ ID NO: 9074 - DNA, 6672 bp, Artificial Sequence
  Description of Artificial Sequence: Synthetic coding sequence
atgttccctggctgcccgcgcctttgggtgctggttgtgctcggaacttcgtgggtgggttggggttcacaaggcactgaggccgcccaactgcgccagttttacgtcgcggctcagggtatctcgtggtcgtaccgccctgagccgactaattcctcgctgaatctctcggtgacttcgttcaaaaagattgtgtatcgggaatacgaaccatacttcaagaaagaaaagccgcagtccactatctccggattgctgggcccgaccctgtacgcagaggtgggggacatcatcaaggtgcactttaagaataaggccgacaagccactttcaatccacccacaaggaattaggtactctaaactgtctgaaggagcttcatacctcgaccacactttccctgcggaaaagatggacgacgccgtcgccccgggaagggagtacacgtacgagtggtcaatctcggaagattcaggacctacccatgatgatccaccttgcctgactcacatctactactcgcatgaaaatctcatcgaagatttcaattctgggctgatcggcccacttcttatctgcaagaaggggactttgactgagggagggacccaaaaaaccttcgataagcagatcgtgctgctcttcgcggtttttgatgaatcgaagtcgtggtcgcagagctcgtcactgatgtacacggtgaatggatacgtcaacggcactatgccggacatcaccgtgtgcgcgcacgaccacattagttggcatttgctcggcatgagcagcggaccggaacttttcagcatccatttcaacggccaagtcctggaacaaaaccaccataaggtcagcgccatcaccctcgtcagcgcgacctcgactactgcgaacatgaccgtcggaccggaaggaaagtggatcatcagcagcctgacccccaaacacctccaggccggaatgcaggcctacatagatatcaaaaactgccctaaaaagaccagaaatctgaagaagattacgagagaacaaaggcgtcatatgaagcgctgggaatacttcatagcagccgaagaagtgatctgggactacgcgccagtcattcctgcaaacatggacaaaaagtatcggagccaacacctcgacaacttctcaaaccaaatcggaaagcattacaaaaaggtgatgtacactcagtacgaggatgaatccttcaccaaacataccgtcaatcccaatatgaaggaagatggtatcctggggccgattattcgcgcgcaggtcagagacactctgaagatcgtgttcaaaaacatggcctccagaccttactcgatttacccacatggggtgactttctccccgtacgaggacgaagtgaatagctcatttacttcgggacggaacaatactatgatcagggcagtgcagccaggagaaacctacacctacaagtggaatatcctcgagttcgacgaaccgaccgagaacgatgcgcaatgcctgacccggccttactactccgatgtggatatcatgcgggacatcgcgagcgggttgatcggcctcttgctcatctgtaagtccagatccctggaccgccgcggcatccagcgcgcagctgacatcgagcagcaggcggtgtttgccgtgtttgatgaaaacaagagctggtatctcgaggacaacattaacaagttctgcgagaatcctgacgaggtcaagcgagatgatccgaaattctacgagtcgaacatcatgtccaccattaacggctacgtgccggaatccatcaccactcttggtttctgcttcgatgacactgtccaatggcacttctgctccgtgggcacccagaatgaaatcctcaccatccactttactggccattcgtttatctacggcaagcgccacgaagatactctcactctgttcccgatgcgcggagagtccgtgacggtcaccatggacaacgtcgggacctggatgctgactagtatgaacagtagcccgcggtccaagaagttgcgccttaagtttagggatgtcaaatgcatcccggatgatgatgaagattcctacgagatttttgagccgccggagagcacggtgatggcaacgagaaaaatgcacgaccggctcgaacctgaggacgaagaaagcgacgccgactacgactaccagaaccggctggccgctgcgctgggaatccggtctttcagaaattcctccctgaatcaggaggaagaggagttcaacttgactgccctggccctggaaaatggcaccgaatttgtgtcctcaaacaccgatatcattgtggggagcaactactcgagcccaagcaatatctccaagtttactgtgaacaatctggcagaaccgcagaaggctccaagccatcaacaggcaaccactgctggctcgcctctgcggcacctgattggcaagaactcggtgctgaactcctctacggctgaacattcgtcaccgtactcagaagatccgatcgaggacccactgcagcccgacgtcaccgggattcgcctgttgtcgctgggcgcgggcgaattcaaatctcaggaacatgcgaagcacaagggacctaaggtggaaagagatcaagccgccaagcataggttcagctggatgaagctcctggctcacaaggtcggacgccatctctcacaagacactggatcgccaagcgggatgcggccatgggaggatctcccatcccaagacaccggctcgccgtcgcgcatgcgaccgtggaaagaccctccgtcggatctgctgctgctcaagcagtccaactcatcaaaaatcttggtcggtcgatggcacctcgcctcggagaaaggctcctatgagatcattcaggataccgatgaagataccgccgtgaacaactggttgatctcgccacagaatgcctcgcgggcatggggagaatccacccccctggccaacaaaccggggaagcagtcgggacaccctaagttcccgcgcgtccggcataagtcgctgcaagttcgtcaggacggtggaaagtcccgcctgaagaagagccagtttctgatcaagactcggaaaaagaaaaaagaaaagcacactcaccatgcccccctttccccaaggaccttccaccccctgcggtcagaagcgtacaacactttctccgagcggcggctcaagcactcactcgtgctccacaagtcaaatgaaacctccctgccgaccgacctcaatcagaccctcccaagcatggattttggctggattgcctccctccctgaccataatcagaactcctcgaatgatactggccaggccagctgcccgcctggactgtaccagaccgtgcctccagaggagcactatcaaaccttccctatccaagacccggaccagatgcactcgacgtccgatccaagccacagatcgtcatccccggaactgtcggaaatgctggaatacgaccgctcgcacaaatcattcccaaccgacatctcccagatgtcccctagctcggaacatgaggtctggcagaccgttatctcgccagatctgagccaggtcactctttcaccggaactttcccagaccaatctttcaccagacctctcccacaccactttgagcccagaactgatccagagaaacctctcgcctgcgctgggtcaaatgccgatatctcctgacctgagtcataccaccctgtcgcctgaccttagtcataccactctctccctggatttgtcacagacgaacctttcccctgagctcagtcagactaatctctcgccggcattgggccaaatgcctttgtcccctgacttgagtcatactactctgtctctggacttctcccaaactaatctgagtcctgagctttcccacatgactctgtcaccagagctctcacagacgaatttgtcgcccgctcttggtcagatgccgatctcccccgatctgtcacacacgaccctgagccttgatttctcccaaacgaacctgtctcccgaactgtcccagacgaacctgtccccggcgctggggcaaatgccgctgagtccggatccttcgcacactacccttagcctcgacctgtcgcagaccaacctgtctccggaactctcacagactaacttgagtccggacctctcagaaatgccactcttcgccgacctgtcccaaatcccactcactccagatctcgatcagatgactctctcaccagatctcggtgaaactgatctgtcccccaacttcggacaaatgtcattgtctcccgatctctcgcaggtgaccctgtctccagacatctcggacaccacgctcctgccggatctttcacaaatctcaccacctccggacctggaccaaatcttctaccccagcgaatccagccagtccctgcttctccaggaattcaacgagtcatttccgtacccggacctcgggcagatgccttcgccttcgtcgcccaccctcaacgatactttcctgtcaaaggagtttaacccattggtgatcgtcggactttcaaaggacggtaccgactacattgaaatcatcccgaaggaagaagtgcaatcgtcggaggacgactatgcagaaatcgactatgtgccttacgatgacccgtacaagaccgatgtccgcactaacatcaactcgtcccgggaccctgacaatattgccgcatggtacctgaggagcaacaacggcaacagaagaaattactacatcgcggctgaggaaatcagctgggactacagcgagttcgtccagcgcgagacggacatcgaggatagcgatgacatcccagaagataccacctacaagaaagttgtattccgcaaatacctggattccaccttcactaaacgggacccgagaggcgagtatgaggaacacctgggaatccttggaccgattatcagagccgaggtggacgatgttatccaagtgagattcaagaacctggcgtcgcggccgtactccctgcacgcgcatggactctcctatgaaaaatcgtccgagggaaagacctacgaagatgactccccagagtggttcaaggaggacaacgctgtgcaaccgaactcgagctatacttatgtgtggcacgccacggagcgatcaggacccgaaagccctggaagcgcctgtagggcatgggcctactactcggctgtaaacccagagaaggatatccactcgggactgatcggaccgctgctcatctgtcaaaaaggcattctccacaaggacagcaatatgccgatggacatgcgggagttcgtcctcttgttcatgacgttcgatgagaaaaagtcgtggtactatgaaaagaagagccgctcgtcatggagactgacttcatcagagatgaagaaatcgcacgaattccatgctatcaatggtatgatctactccctcccgggactgaagatgtacgaacaagaatgggtgcgcctgcatttgctgaacatcggaggatcacaggatatccacgtggtgcactttcacggacaaacccttctggaaaacggcaataagcagcatcaactcggtgtgtggccactcctgcccggatcattcaagactctggagatgaaggcttcgaaacctggctggtggctgttgaacactgaggtcggagagaaccagcgcgcaggtatgcaaaccccgtttctcatcatggatcgagactgtcgcatgccaatgggattgagcaccgggatcatctccgattcgcaaatcaaggcctcagaattccttggatactgggagccccggttggcgcggcttaacaatggtggaagctacaacgcttggagcgtggagaaactcgccgccgaatttgcgtctaagccgtggattcaggtggatatgcagaaggaagtgatcattaccggaatccagactcagggcgccaagcactaccttaagtcctgctacactaccgagttttacgtggcgtactcaagcaatcaaatcaattggcagatcttcaaaggtaattcaacccggaatgtgatgtacttcaacgggaacagcgacgcgtcgaccatcaaagaaaaccagttcgacccgccgatcgtggctcgttacatccgcatctcccctactcgcgcgtacaacaggccaaccttgagacttgaactgcaaggatgtgaggtgaacggatgttctactccgctgggaatggaaaacggaaagatagagaacaagcagatcaccgcgagctcttttaagaagtcatggtggggagactactgggagccgttccgcgcgaggttgaacgcacagggacgcgtaaacgcctggcaggcaaaggccaacaacaataaacagtggctggaaattgacctgttgaagatcaagaaaatcaccgctatcatcactcagggctgcaagagcctgtcgtcagaaatgtacgtgaagtcatacactatccactactctgagcaaggtgtggagtggaagccgtaccgtctgaaatcgtcgatggtggacaaaatcttcgaaggaaatactaacaccaaggggcatgtgaagaacttcttcaatcctccgattatctcccgcttcattcgcgtgattccaaagacctggaatcagtcaatcgccctgcggcttgagctttttggatgcgacatctac

SEQ ID NO: 9075 - DNA, 6672 bp, Artificial Sequence
  Description of Artificial Sequence: Synthetic coding sequence
atgttccccggctgtcctcggctgtgggtgttggttgtactcggcaccagctgggtaggctggggcagccaaggaactgaagctgctcagctgcggcagttttacgttgcagcccaaggtattagttggagctatagaccagagcctaccaacagcagtctgaacctctccgtgaccagctttaaaaagattgtatatcgggagtatgagccttactttaagaaggaaaagcctcagtctacaatctcaggtcttttgggcccgactctgtacgctgaggtgggagacattattaaggtccactttaagaacaaggctgacaagccactgtccatacaccctcaaggcattcggtattctaagctctccgaaggtgcaagctacttggaccacacctttcccgccgaaaagatggacgatgcagtggcgccagggagggagtacacctacgagtggtccatctccgaagactcaggaccaacccacgacgaccccccctgcctgactcacatctattatagccacgagaacctcatcgaagattttaacagcggcctcatcggacctcttctcatctgcaagaagggcactctcacagagggcgggactcaaaaaaccttcgacaagcagattgttctgctcttcgcagtcttcgatgagtccaagtcttggtcccaaagcagtagcctgatgtacactgtgaatgggtatgtgaacggaaccatgccagacatcacagtgtgcgcacacgaccacatatcatggcatctgctgggaatgagttcagggccagaactgtttagcatccacttcaacggccaggtgctcgagcagaatcatcataaggtgtctgccatcaccttggtgtctgccacgtccaccacagcgaatatgacggtcggcccggaaggaaagtggatcatctccagtctgacaccaaaacacttgcaggccgggatgcaggcctacatcgacattaaaaactgcccaaagaagacccgcaacctcaaaaaaataaccagggagcaaaggagacatatgaaaagatgggaatatttcatcgcagcagaggaagttatctgggattacgcccctgtcatacccgctaacatggataaaaaataccgatcacagcacttggataatttctctaaccaaattgggaagcattacaagaaagtcatgtatacgcaatacgaggatgaatcttttaccaaacatactgtgaaccccaacatgaaagaggatggcatactcggccccattatcagagcccaagtcagggataccctgaagatcgtctttaaaaacatggctagcagaccttactctatctacccacacggcgtaacatttagcccatacgaagatgaggtgaatagctccttcaccagcggaagaaacaacacaatgattagagccgttcagccgggggagacatatacatacaaatggaatatcctcgaattcgacgagccaacagagaatgacgctcagtgtcttacacgcccttactacagcgacgtggatattatgagagacatcgctagtgggctcattggcctgctgctgatttgcaagtctcggagcctggataggcggggtatccagagggcagcagacatcgagcagcaggccgtcttcgcagtctttgacgagaacaagtcatggtatctcgaagacaatatcaacaagttctgcgaaaacccggatgaggtcaaacgcgacgaccctaagttctacgagtcaaacatcatgtctaccattaacgggtacgtccctgagagcatcaccaccctcggcttctgcttcgacgatacagtgcaatggcacttctgttctgtgggcacccaaaatgaaattctcacaatccacttcaccggacacagtttcatctatggtaaacggcacgaagacactctcacgctcttcccaatgcggggcgagtcagttaccgtgactatggacaacgtgggcacgtggatgctgacaagtatgaacagcagcccacgctccaaaaaacttagattgaaattccgcgacgtcaagtgtattcccgatgacgacgaggattcctacgagatttttgaaccaccagagtccacagtaatggctacacgcaagatgcacgataggctggagcctgaggacgaggaaagtgatgccgattacgactaccagaatcgcctggcggctgctctcgggatacggtcattcaggaactcatctcttaaccaggaggaggaggagttcaatttgacggcccttgcattggagaatggcacagagtttgtgtcaagcaacacagacatcatagtcgggtccaattattcaagcccaagtaacatttctaagtttacggtgaacaacctggcggagcctcaaaaggctccctcccaccaacaggctaccacagctggcagtccccttagacatctcatcggaaagaactcagtgttgaactcttcaacagctgagcatagtagcccttacagcgaagacccaatcgaggacccactccaaccagacgtgaccggtatcaggctgctgtccctgggggctggagaattcaaatcacaagaacacgccaagcataagggtccgaaggtggagcgcgatcaggccgctaagcatcggttctcctggatgaaactcttggcccacaaagtcggacggcacttgagtcaggacacgggctctccatcaggaatgagaccatgggaagatctgccctcccaagacactggttctcccagtaggatgagaccttggaaggatcccccatctgatctcctgctccttaagcagtctaattcctctaagatcctggtcgggagatggcatctggcgagcgagaagggcagttatgaaattatacaagatactgacgaggataccgccgttaataattggctgatttctccccaaaacgccagcagagcatggggagagtcaacccctctcgccaacaagcctggcaagcagtcaggccatcctaaattccctcgggtgcgccacaagagccttcaagtgcgccaagacggaggaaagtcacgactgaaaaaatcccaatttctgataaagactcgaaagaagaagaaagagaagcacactcatcacgcgcctctgtcacctagaacattccaccctctgaggtctgaagcctacaacacttttagcgagcggagattgaaacacagcctggtgcttcacaagtccaatgagacttcccttcccactgatctcaaccagactctgccatcaatggacttcggatggatcgcctctttgcccgaccataaccagaacagctctaacgatacgggacaggccagttgtcccccgggcctgtatcagacagtgcctcctgaggagcattatcagactttcccaattcaagaccctgatcagatgcacagcactagcgacccatcacatagatcttcttctcccgagttgtcagaaatgctcgaatacgacaggtcccacaaaagctttcctactgacatcagccaaatgtccccctccagcgagcatgaggtctggcagacagttatcagccccgatttgtcccaggtgaccttgagtcctgagctgtcacaaacgaacctttctcccgacctctcacacacaaccctttctcccgagctcatccagagaaaccttagtccagccctgggccagatgccaatttcccctgatctgagtcacactacactgagcccagaccttagtcacaccacgctgagcctggatcttagccagacaaatctgtcacccgagctgtcccagaccaatctgtctcccgctttgggccagatgcccttgagtcctgatctgagccacactacattgagtttggactttagtcagaccaacttgtcaccggagctgtcacacatgactttgagcccagaacttagtcagaccaatctcagtcctgcccttgggcagatgccaatctccccggatttgtcccatactacactgagcctggatttctcacaaactaacctgagtcctgagctttcacaaaccaatctgagtccagcactgggacaaatgcctctgtcacccgatccgtcccacaccactctgtctcttgatctgagccaaacaaacttgtcacctgaactctctcaaactaacctcagtcccgacctgtctgagatgccacttttcgctgatctgtctcagatccctctcactccggacctggatcaaatgacactcagcccggaccttggggaaactgatctttcaccgaattttggacaaatgtccttgtcccctgatctttcccaggtcaccctctctcctgatatctcagacacaacgctgttgcctgacctctcccagatctccccgcccccagatctcgatcagattttctatccgtctgaatcatcccagagcctgctgctgcaggagtttaatgaaagttttccatacccagaccttgggcagatgccatctcctagtagccccacccttaatgacacttttctgtccaaagagttcaaccctctggttatagtaggactgagcaaggacggcaccgactatatagaaataatccccaaagaggaagtgcagtctagcgaagatgactacgcagaaatcgactatgtgccgtatgatgacccgtacaagaccgacgtacgcaccaatataaactcatcaagagaccccgataatattgcagcatggtatctcaggagtaataatggcaacaggcgaaactactacattgcggctgaagaaataagttgggactatagtgagtttgtgcaacgagaaacagacatagaggattctgatgatattcccgaggatacaacttacaaaaaggtcgtctttcggaaatatctcgactccactttcacaaagcgggacccacgcggcgagtacgaggagcatctgggaatcctcggaccaattatccgggccgaggtggatgatgtgatccaagttcggttcaagaaccttgccagccggccctactccctgcatgctcacggattgtcttacgagaaaagcagtgagggaaagacatacgaggatgactctcccgaatggttcaaagaggacaacgccgtccagcctaacagctcctacacttatgtttggcacgcaaccgagcggtctggcccggaaagtcccgggagcgcttgcagggcctgggcctactactctgctgtgaaccccgagaaagacattcactcaggactgatcgggccactgctcatttgccagaagggcatacttcataaggattctaatatgcctatggatatgcgcgaatttgtgttgttgttcatgacgtttgatgagaaaaaatcctggtattatgaaaaaaagagcagatcctcttggcgcctgacctccagcgagatgaaaaagagtcacgagtttcacgccattaatggcatgatctacagtttgccagggcttaaaatgtatgagcaggagtgggttaggctgcacctcctgaatatcggtggctcccaggatatccatgtggttcatttccacggtcaaacccttctcgaaaatggcaataaacagcaccagctcggggtctggccccttcttcctgggagttttaaaacactggagatgaaggcttcaaagccaggatggtggctccttaacacggaggtgggtgagaaccagcgcgccggcatgcagacaccttttctgatcatggatcgggactgtcgaatgcctatgggactcagtaccggcattattagcgacagtcagattaaagcttctgagttcctgggatactgggaacccaggctcgccaggctgaacaatgggggcagctataatgcctggagcgtcgagaaactggcagctgaatttgctagtaagccgtggatccaggtcgatatgcagaaggaagtgatcatcacgggcatccagacacagggggccaagcactacctcaaaagctgctataccacggaattttacgtggcctactcatccaaccagatcaactggcagattttcaagggtaatagcacaaggaacgttatgtacttcaacggaaactctgacgcgtctacgatcaaggagaatcagtttgaccctcccatagtcgcacgctacatcaggatcagccctacacgagcttacaatcggccaacgctcaggctggagctgcaaggttgtgaggtgaacggctgctctacccctctgggtatggagaacggtaagattgaaaacaaacagatcacagcctcctcattcaaaaaatcttggtggggcgattactgggagccattcagggctcgactgaacgcccagggacgagtgaacgcctggcaggcaaaagctaataacaataaacagtggcttgagatcgacttgcttaagattaaaaagattacagctatcataacccaggggtgtaagagcctcagctctgagatgtacgtcaagtcctatactatccactactccgagcagggtgtcgagtggaaaccatacaggctgaaatccagcatggtggataaaatctttgagggtaatacgaacacaaaaggtcatgttaaaaatttttttaatcctccgattattagtaggtttatcagagttatccctaagacatggaaccagagcatcgccttgcggctcgagctctttgggtgcgatatctac

SEQ ID NO: 9076 - DNA, 6672 bp, Artificial Sequence
  Description of Artificial Sequence: Synthetic coding sequence
atgtttcctgggtgtcctcggttatgggttctggtggtcctcggcacctcttgggtgggctggggtagccagggtaccgaagctgcacaacttcgccagttttatgttgccgctcaaggtatctcctggtcatacagacctgaaccaacaaattcatcacttaacctgtctgtcacaagcttcaaaaagatcgtgtatcgagagtacgaaccgtactttaaaaaagagaagcctcagtctaccatctcagggttattgggccctaccctgtacgcggaggtaggggatatcatcaaagtccactttaagaacaaggctgataaacctctcagtatccatccccaaggtatcagatacagcaagttatctgaaggcgcaagttatttagaccacacattccccgccgagaaaatggatgacgccgtggcccctggtagggagtacacctacgagtggagcatttctgaagacagtggcccaacacatgacgatcccccatgcttgacccatatctattactcccatgaaaacttgatcgaagactttaacagtggattgatcgggcccctgctgatctgcaagaagggcaccctgactgagggtggcactcaaaaaactttcgacaaacaaatagtgctgctcttcgctgtgttcgacgagagtaagagctggagtcagtcaagcagccttatgtacacagtgaacggatacgtgaacggcaccatgcccgacattacagtgtgcgcacacgatcatatatcatggcatcttctgggtatgtcgtcaggccctgaactgtttagtattcactttaatggacaggttttagagcaaaaccaccataaagtgtctgccattaccctggtttctgctacttcaactacagctaacatgaccgtagggcctgaggggaagtggatcataagcagtctgacccccaagcacctgcaggctggaatgcaggcttacatagatattaaaaactgtcctaagaaaacaagaaacctgaagaagatcacccgcgagcagcggagacacatgaagagatgggagtacttcattgcggcagaagaggtgatctgggactatgcccctgtgattccggcgaacatggacaagaagtacagaagccaacaccttgacaattttagcaaccagatcggcaaacattataaaaaggtgatgtatacccagtacgaagatgagagtttcacaaaacacactgtcaatcccaacatgaaagaggatggcatcctgggaccaatcatccgtgcacaggttagagacacactgaagattgtctttaaaaacatggctagccgcccatacagcatctaccctcacggcgtcacatttagcccatacgaggacgaggtgaactcttcctttaccagcgggaggaataacacaatgatccgcgctgttcaaccaggtgagacctacacctataagtggaacattctggagttcgacgaaccaacagagaacgacgctcagtgtttgacaaggccatactacagcgacgttgatataatgagggacattgcaagtggcttgattgggctcctgctgatctgtaaatccagaagcctcgacaggaggggcatccagagagccgcggatatcgaacagcaggctgtcttcgccgtctttgatgaaaataagtcatggtaccttgaagataacataaacaaattttgtgaaaaccctgacgaagtgaaacgcgatgatcccaagttctacgaatcaaacattatgagcaccattaatggttacgttccagaaagcattactacactgggcttttgtttcgacgataccgtgcaatggcacttctgctccgtgggtacccagaatgaaatcttgacaatacattttactgggcacagcttcatttatggaaaaaggcatgaagataccctgaccctttttcccatgaggggagagtcagttacagtcaccatggataacgttggaacctggatgttgacatctatgaacagctcgccgcgatcgaagaagcttcgcctcaaatttagggacgttaagtgtatcccagacgacgatgaagattcttacgaaatcttcgagccacctgagtccacagtgatggctaccagaaagatgcatgatcggcttgagccggaggatgaagagtccgatgccgattatgactatcagaacaggctggccgccgccttgggaatccgctcatttcggaactcaagccttaaccaagaggaggaggagtttaacttgaccgctttggctctggagaatggcaccgaattcgtctctagcaataccgatattatagtcggatctaactacagctctccctccaatataagtaagtttaccgtgaacaacttggccgagcctcagaaggcccccagccatcagcaagccaccaccgccggttcaccactgcgacacctgataggtaagaacagtgtgcttaatagctcgacggccgaacacagcagcccctactcagaagatccaatcgaagatcccctccaaccagacgtgaccggcatacgccttcttagcctgggagctggcgaattcaagtcgcaagagcacgctaagcataagggacccaaggtggagagggatcaggccgcaaagcataggttcagctggatgaagctgctggcacataaggtcggaaggcacctgagtcaagatacaggcagcccgagcggaatgagaccctgggaagatttgcccagccaggacaccggatctccatcacggatgagaccctggaaagaccccccatcagatctgcttctgctgaagcagagcaactcctctaaaatcctcgttggccgctggcacttggccagtgagaagggaagctacgaaatcatccaagacacagatgaggacaccgcagtcaacaattggctgatctctcctcagaacgcttcacgcgcctggggagagtctacccccctggctaacaagcccggcaagcaatccggacatccgaaattcccccgagtgaggcataaaagcttgcaggtgaggcaagatggcggcaaaagcaggttgaaaaagagtcaattcctcatcaaaacccggaagaagaaaaaggaaaaacatacccatcacgcaccactgtctccgagaactttccatcctttgagatctgaggcttacaacacattcagcgaacgcaggttgaaacactctttggtgctgcataagtcaaatgagaccagtctgcccaccgaccttaaccagacgctcccctctatggattttggctggatagcaagcctgccagatcataaccaaaactccagcaacgatacaggacaggcaagttgcccgcctggcctctatcaaacagtgcctccagaggaacactaccaaacttttcccatccaggaccctgaccaaatgcacagcacaagtgacccatcccacaggagcagcagtcctgagctttccgagatgctcgagtacgatagatcgcataagagctttcccactgacatcagtcagatgtccccatcttctgaacatgaagtttggcagacagtgatatctcctgatttgagtcaggtcacactgtctcccgaactgagtcaaaccaatttgagtcccgatctttcccacaccactctgtctcccgagttgattcaaaggaacctcagcccagcactgggacagatgcctatcagtccagacctgagtcacacaacactcagccctgacctcagccacaccaccctttcacttgatctgtcacagacaaacctgagtccggagttgtctcagactaacctgtctcccgctctgggacaaatgcccctgtctcctgacctgtcacacaccacactgagtctcgacttcagccaaaccaacctttctcctgagctgtcacatatgaccttgtcccccgaattgtctcagaccaacctgtctcctgctctgggtcagatgcccatctctccagatctgtcccacacaacactgagcctggatttctcacaaactaacctgagccccgaattgtcacagacaaacctaagcccggccctgggacagatgcctcttagccctgatcctagccacactacattgtcacttgacctgagccaaacaaacctttcccccgagctctcacaaacaaacctgagtcctgatctgtctgagatgccccttttcgctgacctttctcaaattccacttacaccagacctggaccagatgactctgtcccccgacctcggcgagactgacctgtcaccaaacttcggccagatgagcctgagccccgatttaagtcaggttacgctctctccagatattagtgacacaacacttctgccagacctgagccagatctctccccctccagatctggatcaaatattctacccatcagagagctcccaatctttgctgctccaagagtttaacgaaagctttccgtaccctgatctgggacagatgccatctccttcaagtcctactctgaatgacacttttctctctaaggagtttaacccacttgtgatagtcggcctttccaaggatggtacagattacatcgaaattatccctaaagaagaagtgcaaagttctgaggacgactacgctgagattgactacgtcccttacgacgatccttataaaaccgacgtgcgcactaacataaactcatcaagagacccagataacatagctgcatggtaccttaggtctaacaatggcaacagacgcaactattacattgctgcagaagagattagttgggactatagtgaattcgttcaaagagaaactgacatcgaagactccgacgatatacctgaggacactacctacaaaaaggtcgtcttcaggaaatacctggactcaacatttaccaagagagaccctagaggggaatacgaagaacacctggggatcctggggcccatcatcagagccgaggtggacgatgtcatacaggtgagatttaaaaacctggcttctaggccttacagcctgcatgcccacggcctgagctatgaaaagagctcagagggaaagacatacgaggacgacagccctgagtggttcaaagaagacaacgccgtccagcctaactcaagttacacttatgtctggcatgctacagaaaggtcgggtcccgaaagcccagggagtgcatgtcgggcatgggcatactattctgccgtgaatccggagaaggacattcactctggcctgataggacctctgttaatatgtcagaagggaattcttcataaggattcaaatatgccaatggatatgcgcgaattcgtacttctctttatgaccttcgacgaaaagaaatcttggtactacgagaaaaaaagccgatctagctggaggctgacatcaagcgaaatgaaaaaaagccatgaattccatgcgatcaatggcatgatctacagcctgccaggtctgaagatgtacgaacaggaatgggttaggttgcatctcctcaacatcgggggctcgcaggatattcacgtcgtacactttcatggccagaccctcctggaaaacggtaacaaacaacaccaattgggcgtgtggccactgcttcccggctctttcaagactcttgaaatgaaagcaagcaagccagggtggtggcttcttaacaccgaggtgggagaaaaccaaagagcaggcatgcagacacctttccttattatggaccgcgactgcaggatgcctatgggactgtccactgggatcatttcagactctcagattaaggccagcgaatttctggggtactgggaaccccgtttggccagattgaataatggcggcagctacaacgcttggtctgtcgagaaactcgcagctgaatttgcatcgaagccctggatccaagttgacatgcaaaaggaagtcataatcacaggcatccagacacagggtgccaagcactacctgaaaagctgctataccaccgaattctacgtggcctacagtagcaaccaaatcaactggcaaatttttaaaggaaattcaaccaggaacgtcatgtattttaacggcaacagcgacgctagtacaatcaaggagaaccagtttgatcctcccatcgtagcccggtacatcaggatctcaccgactcgagcatacaacaggccaacccttagattagaattgcaggggtgtgaagtgaacggctgcagcacaccccttggtatggagaacggcaagatcgaaaacaagcagattaccgcatcctcttttaaaaagagctggtggggcgactactgggaaccttttcgggcacgtttgaacgcgcagggaagggtaaatgcttggcaggccaaggctaacaataataaacaatggcttgaaatcgatctgctaaagatcaagaaaattacagcaatcatcacgcagggctgcaagagccttagctccgaaatgtacgtgaaaagctacaccatacactacagcgagcagggtgttgagtggaaaccctatcggctgaagagcagcatggtggataaaattttcgaggggaacaccaatacaaagggacacgttaaaaatttttttaatcctccgatcatatcacgtttcatcagggtcatcccaaaaacttggaaccagagcattgctctgagacttgaactgttcggatgcgacatttat

SEQ ID NO: 9077 - DNA, 6672 bp, Artificial Sequence
  Description of Artificial Sequence: Synthetic coding sequence
atgtttcccggctgcccaaggctgtgggtgctggtggtccttgggacttcttgggtcggctgggggagtcagggcacggaggcagcgcagctgcgacagttttacgtcgccgcacagggtataagttggtcttaccggccagagcccacgaactcctcacttaatctttccgtgactagcttcaagaaaattgtatatagagagtacgagccatacttcaagaaagagaaaccccagtcaaccatttctggtttgctgggaccaactctctatgcagaggtgggggacattatcaaagtccactttaaaaacaaggcagacaaaccattgagcatccacccacaggggattcggtattccaaactttccgagggagcctcctatcttgaccacaccttcccggccgagaaaatggacgacgcagtggcacccgggcgcgagtatacatacgagtggtcgataagtgaggattccggacctactcatgacgaccccccttgtctcacgcacatctactactcccacgaaaatctgattgaggacttcaacagcggcctcatcggtcctctgctgatctgtaagaagggaaccctcacagagggcgggacacagaagacctttgataagcagatcgtcctgctttttgcggttttcgatgagtccaagagctggtctcagagttcctctctgatgtacacagttaacgggtacgtgaacggtactatgccggatatcacagtctgcgcccatgatcacatttcttggcatcttcttggaatgtctagcgggcctgagctatttagtatccatttcaacgggcaggttcttgagcagaatcaccataaggtgtccgcaataaccctggtgtccgctaccagtaccacggctaacatgacagtggggccagaaggtaaatggatcatttcttccctgacgcccaagcaccttcaagccgggatgcaggcatacatcgatattaagaactgccctaagaaaactcgtaatttaaagaagattaccagggaacagcgacggcacatgaaacggtgggagtactttatagcagcagaagaggtgatatgggattacgctccagttatacccgctaatatggacaagaagtacagatctcagcacctcgacaatttctccaaccaaatagggaaacattataaaaaagtaatgtatacacaatacgaagatgagtcctttacaaagcacaccgtcaatcccaatatgaaggaagacggcatactgggtccaataattcgggcacaagtgagagatacccttaagattgtcttcaagaatatggcctcccggccctatagcatatacccacatggagtgacctttagtccttatgaggatgaggttaatagctccttcaccagcgggcgaaacaacaccatgatccgggcagtacagcccggggaaacgtacacgtacaaatggaacatattagagttcgatgaacccaccgaaaatgacgcccagtgtttgaccaggccttactactccgatgtagacatcatgcgtgacatcgcaagcggcctcattgggctccttcttatctgcaaatcacgaagcttagaccgtcgagggattcaaagagccgctgacattgagcagcaagcagttttcgctgtttttgatgaaaataaaagttggtacctggaggacaatattaacaaattctgcgaaaatcccgacgaagtcaagcgcgacgatccaaagttttatgaatctaatatcatgtccacgattaatggctatgttccggaatctataacaactctgggattctgctttgatgacacagtacagtggcatttctgttctgtggggacccagaacgagatcttgactattcatttcacgggccactcttttatctatggcaaaaggcatgaagacacattgactctgtttccaatgaggggcgagagcgtgacagtgaccatggataacgtgggtacctggatgctaactagtatgaattcgtcaccgcggagtaagaagctacggctgaaatttagagacgttaaatgcatccctgacgacgacgaggattcatacgaaatcttcgagccacctgagtccactgtaatggcaacccggaagatgcacgacaggctcgagcccgaggatgaggaatctgacgcagattacgattaccagaacagactggctgccgcactgggtattcgtagctttaggaactcttcgttgaatcaggaggaagaggagttcaacctcactgctcttgctttggaaaatggcactgaatttgtgtcatccaacaccgatataatcgttggatcaaactacagttcaccctctaacatctccaaatttaccgtcaataacctggccgagccacagaaggcacctagccaccagcaggccaccaccgcggggtctcctctccggcatctgattggaaagaattccgttctgaactcctccactgccgaacactcatcaccgtacagcgaagatccaattgaagaccctctgcaaccggatgttacaggaattagacttctgtctcttggcgctggtgagttcaagtcacaggagcatgccaagcacaagggccctaaagtggagcgagaccaggcggccaaacatcgattttcatggatgaagttgctcgcccacaaggtcggtcgacacctgagtcaagacacaggttctccctctgggatgaggccctgggaagatttgccatcacaagacaccggcagcccttcaaggatgcgaccctggaaagacccaccttcggacctgctcctcctgaaacagtcaaattctagcaagattctagtaggtcggtggcacctagctagtgagaagggtagctatgagataatccaggatacagacgaagacaccgctgtgaataactggcttatctccccacaaaatgcctcacgcgcatggggggaaagtactcctttagcaaacaagcctggaaaacagagcggacaccccaagttcccacgggtaagacataaatctttgcaagtgagacaggatggggggaaatcccgactgaagaagtctcaatttctgattaagacaagaaagaaaaaaaaggagaagcacactcatcacgcaccattgtcaccaaggaccttccatcctcttagaagcgaggcatacaacaccttcagtgagagacgtctgaagcattcactggtgctgcataagtctaatgagacatccctccccaccgatctcaaccaaaccctgcctagtatggattttgggtggatcgcgagcctgcccgaccataatcaaaactcatcaaacgacacgggccaggcctcatgcccacctgggctctaccagaccgtgcctccggaggagcactaccagacgtttcctatccaggacccggaccagatgcacagcacaagcgatccatctcaccgatcctcctcccccgaattgtcggaaatgctggagtacgatagaagtcacaagtcatttccaacagatatttcacagatgtcaccttcctccgagcacgaagtgtggcagaccgtgatctctcccgatctttctcaagtgaccctcagcccggagctctcacagacaaacttgtcacctgacctatctcacactaccctcagcccagagctaattcagagaaatctttcccccgccctcggtcagatgccgatcagccctgatctgagtcacacaaccctatcacccgatctctcacataccaccctttcactcgatctgagtcagaccaatttgtcccccgaacttagccaaaccaacttgtcccctgcgctgggccaaatgcccctgtcacctgatctcagtcacacaacgctctcgctggacttctcccagaccaacttgtctccggagttatcgcacatgacactgtcccccgaactttcccaaactaatttgagcccagccctagggcagatgcctatatcccctgacttgtcccacactactctgtccctggacttctctcagaccaacctgtctccagaactatcccagactaacctgtccccggcactgggccagatgccattatcccccgacccaagtcacaccactctctccctggatctgtctcaaaccaacctcagccccgagctgagtcagacaaacctgagccccgacctgagtgagatgcctttgttcgccgacctgtcccagatccccctgacaccagatttggaccagatgaccctcagcccggacctgggggaaactgatctgtctccaaatttcgggcagatgtcacttagtccggacctgtcacaggttacattatcgcccgacatctctgataccactctgctgcctgacttatcacagatctcccccccccctgatctggatcagatcttttatccatcagagtcgagccagtcattgttgcttcaggagtttaacgagtcctttccttatccagacctggggcagatgcccagcccgagctccccaaccttaaacgatacattcctttctaaagaattcaatccactagtaatcgttggcctttccaaagatggtactgattacatcgaaatcattcctaaggaggaagtccagagttctgaggacgactatgcagaaatcgactatgtcccttatgatgacccgtacaaaactgatgtccgcaccaacatcaacagttccagagatccagacaacatcgctgcttggtacctccggtcaaacaacggaaaccgtaggaactactacatcgcggcggaagagatcagttgggattatagtgagttcgtgcagcgagaaacagacatcgaggattccgacgacatacctgaggatactacatacaaaaaggtcgtgtttaggaagtacctcgattcaaccttcacaaaaagggacccccggggtgagtacgaggaacacctgggcatattaggccctatcatccgggctgaagtagacgatgtgatccaggttcgattcaaaaatctagcgtctaggccttatagtcttcacgctcacgggttgagttacgagaagtctagcgaaggcaaaacgtacgaggatgacagccccgagtggttcaaggaagacaatgccgtgcagcccaattcgtcatacacgtacgtctggcatgctactgagcgatccggccctgaaagccccggtagtgcctgtagggcctgggcgtattacagcgcagtaaaccctgagaaagatatacattcaggcctcattggcccactgttaatttgccaaaagggaatcctgcataaagatagtaacatgcccatggatatgagggaattcgtcttgctgttcatgacctttgatgagaagaaaagttggtactacgagaaaaaaagccgatctagctggcgactcacatcgagcgagatgaaaaagtcgcacgagttccacgctatcaacggcatgatctactctttgcccggactgaagatgtacgaacaagagtgggtcaggctgcacctgctcaacattgggggttcccaggatattcatgtggtgcacttccacggccagacattacttgagaatggcaacaaacagcaccagctcggggtatggccattacttcccggtagcttcaagaccttggagatgaaggcctccaaacctggatggtggctgctgaacacagaggtgggagaaaaccagcgcgccggtatgcagactccctttctgattatggaccgagattgtcgcatgcccatgggactcagcacaggcatcatcagcgattcccaaatcaaggccagtgagtttctcgggtactgggagccccgcttggctcgtttaaacaatggcgggtcttacaacgcttggagcgttgagaagcttgctgccgagttcgccagtaaaccttggatacaggtagacatgcagaaggaagtaatcatcactggtatccagacgcagggagccaagcactatctcaaaagttgctacactaccgaattttatgtggcctactcaagtaaccaaatcaattggcagatcttcaaaggtaacagcacccgtaatgtgatgtatttcaacggcaattctgatgcatcaactatcaaggaaaatcagttcgacccaccaattgtcgcacggtatattagaatttcacctacaagagcttacaaccggcccacgctgcgactggagctccaaggttgcgaagtgaacggctgttctacaccactgggaatggaaaatggtaagattgaaaataaacagattacagctagcagctttaaaaagagctggtggggcgattattgggagcccttccgggccaggcttaacgcccaagggcgggtcaatgcctggcaagccaaggctaataacaataagcagtggttggagatcgacctactcaaaattaaaaaaattaccgccatcatcacccagggttgtaaatcactgagttcggagatgtacgtgaaatcttacacaatccactattccgagcagggagtcgagtggaaaccctacagactgaagtcatcgatggtggacaagatatttgagggcaacactaataccaaaggacatgtgaagaacttctttaaccctccaattatttcacggttcatacgggtaatccccaagacctggaaccaatccatcgcgcttagacttgaactttttgggtgcgacatttat

SEQ ID NO: 9078 - DNA, 6672 bp, Artificial Sequence
  Description of Artificial Sequence: Synthetic coding sequence
atgtttcctggatgcccccggctgtgggtgttggtcgtcctcggaacctcatgggtcggctggggatcacaaggtactgaggcagcccaacttagacaattctatgtcgcagcccaagggatctcgtggagctatagacctgagcctactaattcatccctcaacctgtcggtgacctcctttaagaagatagtataccgcgaatacgagccgtacttcaagaaagaaaagccgcaatcgacgatctccggactgctgggcccgactctctacgcggaggtgggagacatcattaaggttcatttcaagaacaaggccgataaaccgctgtctatccatccgcagggaatccgctactccaaactcagcgagggtgcatcttacctcgaccatactttccctgcagagaaaatggacgacgcagtggccccgggacgcgaatacacttacgaatggtccatcagcgaagattcaggaccgacgcatgacgaccctccctgcctgactcacatctactacagccatgagaacctgatcgaggacttcaactcaggactcatcgggccgctgttgatctgcaagaagggtaccttgactgagggagggacccaaaagacctttgataaacaaatcgtgttgctgttcgcggtgtttgatgagtccaagagctggtcgcagagcagcagcctgatgtacaccgtgaacggatacgtcaacggaactatgcctgacattactgtgtgcgcccacgaccacatctcctggcacctcttgggaatgagctccgggcccgagttgttctcgatccatttcaacggacaagtcctcgagcagaaccaccataaagtgtccgccattaccctggtgtccgccacgtcgactaccgcaaacatgacggtcggaccagagggcaaatggatcatcagctcacttaccccgaaacatctccaggcgggcatgcaggcttatatcgatatcaaaaactgccccaagaaaacccgcaatctcaaaaagatcacccgggaacagcggcggcacatgaagagatgggaatactttatcgcggccgaggaagtcatctgggactacgcgccagtcattccagccaacatggataagaagtaccggtcgcaacatctggataacttctcgaatcagatcggcaagcactataagaaggtcatgtacacccaatatgaggatgagagctttaccaaacacactgtgaatcccaatatgaaagaggacggaatcctgggcccgatcatccgggcccaggtgcgggatactctgaagattgtgttcaagaacatggcatccagaccctattccatttacccacacggagtgactttttccccgtacgaagatgaggtcaattcgtccttcacctcagggcgcaataacaccatgatccgggccgtgcagccgggggagacttatacttacaagtggaacattcttgagttcgacgaacctactgagaatgacgctcaatgcctcacccggccgtactacagcgatgtggacattatgagagacatcgcgagcggactcatcggactgctgctgatctgcaagtcacgctcactggatcgccgcggaatccagcgcgcagccgatatcgagcaacaggcggtgttcgccgtattcgatgaaaacaagtcatggtacctggaggacaatatcaacaaattctgtgagaacccggacgaagtgaagagggacgacccaaagttctacgagtcgaacattatgagcaccatcaatgggtacgtgccggagtcgatcacgaccctcggcttctgcttcgacgacactgttcaatggcatttctgtagcgttggaacccagaatgagatcctgactatccacttcactggccactcgttcatctacggaaagcgccatgaagatacgctgaccctgttcccaatgcggggagaatccgtgaccgtgaccatggataatgtgggaacctggatgctgacctcaatgaattcctcgccgcggtcgaaaaagctgcgcctgaagttcagggatgtgaagtgtatcccggacgatgatgaagattcttacgagatcttcgaaccgccggagtcgaccgtgatggccacccgtaagatgcacgaccggctggaaccggaagatgaggagtcagacgccgactacgactaccagaataggctggcagccgctctggggatcagatccttccgtaactcctcgttgaaccaggaagaggaggaattcaacctgaccgcgctcgcgcttgaaaatggaaccgaattcgtgtcctccaacactgatatcatcgtgggctccaactactcctcaccctccaacatctcaaagtttaccgtgaacaatcttgcagaacctcaaaaagcgccgtcgcatcaacaggcgaccactgccggatcaccgctgcgacacctgattggcaaaaactcagtcttgaacagcagcaccgccgaacactcgtccccgtacagcgaagatccgatcgaggaccctctgcaaccagatgtgactggcatccgcctgctgtcgctgggcgccggggaattcaaatcccaggagcacgccaaacacaagggcccaaaagtcgagagggaccaggctgcaaagcaccggttctcctggatgaagctccttgcacataaggtcggacgccacctgtcccaggacactggatccccctccggaatgaggccttgggaggatctgccgtcccaagatactggttcaccgtctcgcatgcgcccatggaaagaccccccgtcagacctgctgcttctcaagcagagcaatagcagtaagatcctggtcggacggtggcacctggcctctgagaagggatcctatgaaatcatccaggatactgacgaggacaccgccgtgaacaattggctgatctcgccgcagaacgcatcacgcgcctggggcgaatcaacgccgcttgcgaataagccgggaaagcagtccgggcacccgaagttcccgcgcgtgcgccacaagtcgctccaggttaggcaggacggcggcaagagccgtctcaagaagtcccaattcctgatcaagaccaggaagaaaaagaaggagaagcatactcaccacgctccgctgtcgcctcggactttccaccccctgaggtcagaggcgtacaatactttttctgaacggcgcttgaagcacagcctggtcctgcacaaatcgaacgagacttcgcttccgaccgacctcaatcagaccctgccaagcatggatttcgggtggatcgcctcactcccagaccataaccagaattcctccaatgacaccggccaggcctcgtgtcccccgggattgtaccagaccgtcccgccggaagagcattaccaaaccttcccaattcaggacccagaccagatgcattcgacctcggacccgagccacaggtcctcatcgccggaactgtcagagatgctggagtacgaccggtcgcataagtcattcccgaccgatatctcgcagatgtcgccgtcatcggaacatgaagtgtggcagacggtgatcagtcccgacttgtcacaagtgaccctttcgccagagctttcacagacgaatcttagcccagatttgtcacacactacgctgagccctgaattgattcagcggaacctttctccggccctcggacagatgccgatctccccggatcttagccatactactctctcccctgacctcagccacactaccttgtctctggatttgagccagaccaacctgagcccagaactctcgcagactaacctttcccccgcgcttggtcaaatgcccctgagtccggacctttcgcacaccaccctctcgctggacttctcccagaccaacttgtcacctgagctctcgcacatgactctctcacccgagctgagtcagacgaatttgtctcccgcccttggacagatgcccatctcgccggacttgagccacaccaccctttcgttggatttctctcagacgaacttgtcgcctgaactctctcaaaccaatctgagccccgcactgggccaaatgccgctgtccccagatccctcgcataccactctgtcgctcgacctctcccagacgaacctgtcacctgaactgtcccagactaacctctcgccggacctgagcgagatgccgctgttcgcagacctcagccagattccactgacccccgacttggatcaaatgacgctgtctcctgacctgggagaaaccgatctgtccccgaactttggacagatgtccctgtccccggacctgtcacaggtcaccctgtcgccggacatctctgataccactctgctgcctgacctgtcacaaatctcgcctccaccggatctcgaccagatcttttacccatccgaatcctcacagagtctgcttctccaagaattcaacgaatcatttccgtacccagatctcggccagatgccttcgccatcgagcccaacgctgaatgacactttcctgagcaaggagttcaacccactcgtcatcgtgggactgtcgaaggatggaactgactacatcgagatcattcctaaggaggaagtccagagctcggaggacgactacgcagagattgattacgtcccttatgacgacccatacaagactgatgtccgcaccaacatcaactcgagccgcgacccggataacatcgctgcgtggtacctgcggtcgaacaacggcaaccgccgcaactactacatcgccgctgaagaaatctcctgggactactcagaattcgtgcaacgggaaactgatatcgaagatagcgatgacataccggaggacaccacctacaaaaaagttgtgttcaggaagtacctggattcgactttcaccaagcgggatccgcggggtgagtacgaggagcacctgggaatcttgggaccgatcatcagggctgaagtcgacgacgtgatccaggtccgctttaagaacctggctagccgaccgtactccctccatgcccacggactgagctacgaaaaaagctccgaaggaaaaacttacgaggacgattcgccagagtggttcaaagaggacaacgcggtgcagccgaactcgtcctacacttacgtctggcacgccactgaacgctcgggcccagaatcgccaggctctgcatgccgggcgtgggcttactactcagccgtcaatcctgaaaaggacattcactccggattgatcggcccgcttctcatttgccagaaaggcattctgcacaaagattcgaacatgccaatggacatgagagaattcgtgcttctcttcatgaccttcgatgagaagaagtcgtggtactacgaaaagaaatcgcggtcaagctggagactgacgtcctccgaaatgaagaagagccatgagttccatgcgattaatggaatgatctacagcttgccgggccttaagatgtacgaacaggaatgggtgagactgcacctgctcaacatcggtggatcccaggacatccacgtggtccacttccatggacagactctgctggagaatggaaacaagcagcaccagctgggagtctggccgctgctgccgggctcattcaagactctggaaatgaaggcgtccaagccaggatggtggctgctgaacactgaagtgggagagaaccagcgcgcgggtatgcaaactccgttcctgatcatggacagagattgccgcatgccgatgggactcagcactgggatcatctctgattcacaaatcaaggcgtcggaattcctgggctattgggagccgaggctggcgcggctgaataacggaggatcgtacaatgcatggtccgtggaaaagctggcagcggaattcgcttcgaagccgtggatccaggtcgacatgcaaaaagaagtcattatcactggaatccagacccagggcgcaaagcattacctgaaatcctgctacaccaccgaattctacgtggcatactcctcgaaccagatcaactggcaaatcttcaaagggaactcgactcggaatgtgatgtactttaacgggaactcggacgcgtccactatcaaggaaaaccagtttgacccgcctatcgtggcgaggtacatccgcatctcacctaccagagcgtacaaccggcccactctgcgactcgaactgcaaggatgcgaggtgaacggatgctccacccctctgggaatggaaaacggtaagattgagaacaaacaaatcactgcaagctccttcaagaaaagctggtggggagattactgggaaccgttcagggcccgacttaacgcgcaggggcgcgttaatgcgtggcaggcaaaggcaaataacaacaaacaatggttggagatcgacctgctgaagatcaagaaaatcaccgccatcatcactcaaggatgcaaaagcctgtcctcggagatgtacgtgaaatcgtacaccatccattattccgaacagggagtggagtggaagccgtaccgcctcaagagctcgatggttgacaaaatcttcgagggcaatactaacaccaagggccatgtcaagaactttttcaacccgccgatcatcagcaggttcatccgcgtgatccctaaaacttggaaccagtcgattgctctgcggctcgaactgttcggatgtgacatctat

SEQ ID NO: 9079 - DNA, 6672 bp, Artificial Sequence
  Description of Artificial Sequence: Synthetic coding sequence
atgtttccaggatgtccaagactctgggtgcttgtcgtgcttgggacctcatgggtgggctggggctcgcaggggaccgaggccgcccagcttcggcagttttacgtggcggcacagggaatttcatggtcgtacagaccggaaccaaccaacagctcgctgaacctctcggtgacctcgtttaagaaaattgtgtaccgtgaatacgaaccgtacttcaaaaaggagaaacctcaatcaaccattagcggcctgctgggacccaccctctacgcagaggtgggagatatcattaaagtgcatttcaagaataaggccgataaacctctcagcatccaccctcaaggcattcgctactccaagctgtccgaaggagcatcgtacctggatcatactttcccagcggaaaagatggacgacgccgtggccccgggccgcgaatacacctacgaatggtcgattagcgaagatagcggtcctacgcatgacgatccaccttgtctgacccatatctactactcacatgagaatttgatagaggacttcaattccggactgattggtcctctgctcatctgtaagaagggaactctgactgagggaggaacccaaaagacttttgataaacaaatcgtgctgctttttgccgtgtttgatgagtcgaaaagctggtcccaatcctcctcccttatgtacaccgtgaacggctacgtcaacggcaccatgccggatattactgtctgcgcacatgaccatataagctggcatctgctgggtatgtcatcgggacctgaactgttctctattcatttcaatggtcaggtgctcgaacaaaaccaccacaaggtttccgccattactctcgtgtcggcaacctcgactactgcaaatatgacggtgggacctgaagggaagtggattatctcgtcacttacgcccaagcacctgcaagccggtatgcaggcgtacattgacattaagaattgcccaaagaaaactagaaacctgaagaaaatcacgagagaacagagaaggcacatgaagagatgggaatacttcatagcagcggaagaagtgatttgggattacgcacctgtgataccagcaaacatggataagaagtatagatcccagcacttggacaacttttcgaatcaaattgggaagcactacaagaaggttatgtacacgcagtacgaagatgaatcatttacgaagcacaccgtgaacccaaatatgaaggaggacggaattcttggacctattatcagagcacaggtccgtgatactctgaaaatcgtctttaagaatatggcttcccgtccatacagcatttaccctcacggcgtgaccttttcaccatacgaagatgaggtcaattcatcgtttaccagcggtcgcaataacacgatgattagggccgtgcagcctggtgaaacctacacttacaagtggaacattctcgaatttgacgaaccaaccgaaaatgatgcacagtgtctgacccgtccatactacagcgacgtggatatcatgcgcgatatagcatcaggtttgattggacttcttcttatctgtaaatcacgctcgctggatagacggggaatccaaagggcagcagatatcgagcagcaagcagttttcgcagtattcgatgaaaacaagagctggtatttggaagataacatcaacaagttttgtgagaatcctgacgaggtcaagagagacgatccaaagttttacgaatcaaacattatgagtacgataaatggttacgtgccggaaagcattaccaccctgggtttctgcttcgatgacactgttcagtggcatttttgctccgtcggcacccaaaatgaaatccttaccattcactttactggccattcgtttatctacgggaagcgccatgaggataccctcaccctctttccgatgagaggtgaatcggtcactgtgaccatggacaacgtggggacttggatgctgacttcgatgaactcttcgccaagatcaaagaaactcagactgaaattcagagacgtgaagtgcatcccagacgatgatgaagatagctacgagatattcgaacccccagaatccacggtgatggcgactaggaagatgcacgacagacttgaacctgaagatgaggagtccgacgctgactacgactaccagaatagactggcagcagcactgggcatccggagcttccggaactcctcgctgaatcaggaagaagaagaattcaatctcacggcccttgcgttggaaaacgggacggaattcgtctcctcgaataccgacattattgtcgggtccaattacagcagcccatcgaacattagcaaattcactgtgaacaacctggcagaacctcagaaagcaccctcacatcagcaggccactaccgcggggtcccctcttagacacctcatcggaaaaaactccgtgctgaactcgtccactgccgagcatagctccccatactccgaggatcctatagaagatccccttcagccagatgtgactggtatccgacttttgtccttgggggcaggcgaattcaaatcccaagaacatgcaaagcataagggtccaaaggtggaaagggaccaggctgcaaagcatcgtttctcgtggatgaagttgctcgcccataaggtgggtcggcatctgtcccaagatactggctccccttccggaatgcggccatgggaggacctcccatcccaagacactggatccccgtcccggatgcgaccctggaaggacccaccttctgacttgctgcttcttaagcaatccaattcctccaaaatcctcgtgggtagatggcaccttgcatcagaaaagggaagctacgagatcatccaggatactgacgaagatacggcagtcaacaactggcttatttctccccaaaatgcgtcgcgtgcttggggggaaagcactccgctggcaaacaagccaggcaagcagtcgggacaccctaagtttccgagggtgaggcacaagagcctgcaagtgcgtcaggatggaggtaaaagcaggttgaagaaatcgcagttcctgatcaagactagaaaaaagaagaaggaaaagcatacccaccacgcaccattgagtcctcggacctttcatccactgaggtcggaagcatacaacacctttagtgaacggcgactgaagcactcactggttctgcacaaatcaaatgaaacctcgctgcctaccgatctcaatcaaaccttgccttccatggacttcggctggatcgcatcactgcctgatcacaatcaaaattcgagcaatgatactggtcaagcctcgtgcccacctggcctctaccagactgtcccacctgaagaacattaccagacttttcctattcaagacccagaccaaatgcatagcactagcgatccatcgcaccgttcctcttcacctgagctgtccgaaatgcttgaatacgaccgaagccataagagctttcctactgatatctcgcaaatgtcgccctcctccgaacatgaagtgtggcaaactgtgatttcccctgacctgtcacaagtgactcttagcccggaactctcgcaaaccaacctttcgccggatctgtcccacactaccctgtcaccagagctcattcagcgcaaccttagccctgcacttggtcaaatgcctatttccccagatctctcgcacaccaccctgtctcctgatctcagccacactacgctgtccctcgatctttctcaaactaacctgtcgcccgaactgtcccagactaacctgtcccctgcactgggtcaaatgcccctgtcgccagatcttagccataccactctttctcttgatttttcacaaaccaatctttcccctgaactctctcacatgactttgtcaccagaactctctcagacgaacttgtcgcctgctctcggccagatgccaatttccccagacctttcacataccaccctctcgctggatttttcgcagacgaatctgagtcctgaacttagtcaaacgaatctgtcgcccgctcttgggcagatgccgcttagccccgatccctcgcatactactctgtccctcgacctgagccagactaatctctcaccagaacttagccaaactaacttgtcaccggatctttccgagatgcctctgtttgcagatctgtcccaaatacccctcacgccagatctcgaccagatgactctgtcgcctgacctgggagaaactgaccttagcccaaacttcggtcaaatgtcactgtcgccggatctcagccaagtcaccttgtcgcccgacatatccgataccactcttcttccagatctttcgcagatttcccctccgcccgatcttgatcagatattctacccttccgaaagctcccagtcgctcctgcttcaggagtttaacgaatcattcccatatcccgatttgggtcagatgccctcgccaagcagccccaccctcaacgacacttttctgagcaaggagttcaatccactggtgatcgtgggcctttccaaggacggtaccgactacattgagattatccctaaggaagaagtgcagtcgtcagaggacgattacgcggaaatcgactacgtcccttacgatgatccttacaagacggatgtcagaactaacattaactcgtcgcgcgatcctgataacattgccgcatggtacctccggtcaaacaatggaaacagaagaaattactacatcgcagccgaggaaatctcctgggattactcggaatttgtgcaaagggaaaccgacattgaggatagcgatgatataccagaggataccacctacaaaaaggtcgtgtttcgaaagtacctggatagcacctttactaaacgggacccacggggtgaatacgaagaacacctgggtatactgggaccaatcatccgagcagaagtcgacgatgtgattcaagtgcggtttaagaacttggcctcacgaccatactccctgcacgcacatggactgtcgtacgagaaaagcagcgagggcaagacctacgaagatgatagccctgaatggtttaaggaggataacgcagtgcagccaaacagctcatacacctacgtctggcatgccactgagcgaagcggccccgaatccccaggatccgcatgccgcgcgtgggcctactacagcgcagtgaaccctgagaaggacattcattcgggacttattggcccattgcttatttgtcaaaagggtatcttgcataaggactctaacatgcccatggatatgcgagaatttgtgctcctgtttatgaccttcgacgaaaagaaatcctggtactacgagaaaaagtcgcggagttcgtggcgcctgaccagcagcgagatgaagaaaagccacgagtttcacgccatcaacggtatgatctacagtctgcccggtctgaagatgtacgaacaagaatgggtgcgtctgcatttgctgaatattggtggcagccaggacattcatgtggttcatttccacggacagaccctgcttgaaaacggtaataagcaacatcagctgggtgtgtggccacttctgcctggatcattcaagacgctggaaatgaaggcctcgaagcctggctggtggctgctgaataccgaagtcggggaaaatcaaagagccggcatgcaaactccttttctgatcatggatcgggattgtcggatgccaatgggattgagcactgggatcatttcagatagccaaatcaaggcatcagagtttttgggctattgggaaccaagactggcaaggctgaacaacggcggtagctacaatgcatggtcggtcgagaagctcgcagccgagtttgcttcgaaaccttggattcaagtggatatgcaaaaggaggtgatcataaccggaatccagacgcaaggtgcaaagcattacctcaagagctgttatacgactgagttttacgtcgcatactcgagcaatcagataaactggcagatcttcaagggaaactcaactaggaacgtgatgtactttaacggtaattccgatgccagcaccatcaaagagaaccagttcgaccctcctatcgtggccagatacattcgcatttcaccaaccagggcgtataatcggcccaccttgcgccttgagcttcaagggtgcgaagtcaacggatgcagcactcccctgggaatggaaaacggcaagattgagaacaagcagatcacggcatcgtcgtttaagaagagctggtggggtgactattgggagccgtttagagcgcgccttaacgcccaaggtcgggtcaacgcgtggcaggccaaggcaaacaacaacaagcaatggctggagattgatcttttgaaaatcaaaaagatcactgccattatcactcaggggtgtaagagcctttcctccgagatgtacgtcaaatcctacactatacattactcggaacaaggtgtcgagtggaagccatacagacttaagtcctccatggtggataagatctttgaaggcaacaccaataccaagggacatgtgaagaacttctttaacccaccaataatctcccgctttatcagagtgattcctaaaacttggaatcaatcgattgcgctgagactggaactctttggttgcgatatctac

SEQ ID NO: 9080 - DNA, 6672 bp, Artificial Sequence
  Description of Artificial Sequence: Synthetic coding sequence
atgtttccgggttgtccgcgtttatgggttttagttgtattaggtacgtcgtgggtaggttggggttcgcaaggtacggaagcggcgcaactacgtcaattttatgttgcggcgcaaggtatatcgtggtcgtatcgtccggaaccgacgaattcgtcgttaaatctatcggtaacgtcgtttaaaaaaatagtttatcgtgaatatgaaccgtattttaaaaaagaaaaaccgcaatcgacgatatcgggtttactaggtccgacgctatatgcggaagtaggtgatataataaaagtacattttaaaaataaagcggataaaccgctatcgatacatccgcaaggtatacgttattcgaaattatcggaaggtgcgtcgtatttagatcatacgtttccggcggaaaaaatggatgatgcggtagcgccgggtcgtgaatatacgtatgaatggtcgatatcggaagattcgggtccgacgcatgatgatccgccgtgtctaacgcatatatattattcgcatgaaaatctaatagaagattttaattcgggtttaataggtccgttactaatatgtaaaaaaggtacgttaacggaaggtggtacgcaaaaaacgtttgataaacaaatagtattattatttgcggtttttgatgaatcgaaatcgtggtcgcaatcgtcgtcgctaatgtatacggttaatggttatgtaaatggtacgatgccggatataacggtttgtgcgcatgatcatatatcgtggcatttactaggtatgtcgtcgggtccggaattattttcgatacattttaatggtcaagttctagaacaaaatcatcataaagtatcggcgataacgttagtttcggcgacgtcgacgacggcgaatatgacggttggtccggaaggtaaatggataatatcgtcgctaacgccgaaacatttacaagcgggtatgcaagcgtatatagatataaaaaattgtccgaaaaaaacgcgaaatttaaaaaaaataacgcgtgaacaacgacgtcatatgaaacgttgggaatattttatagcggcggaagaagttatatgggattatgcgccggtaataccggcgaatatggataaaaaatatcgttcgcaacatttagataatttttcgaatcaaataggtaaacattataaaaaagttatgtatacgcaatatgaagatgaatcgtttacgaaacatacggtaaatccgaatatgaaagaagatggtatactaggtccgataatacgtgcgcaagtacgtgatacgctaaaaatagtatttaaaaatatggcgtcgcgaccgtattcgatatatccgcatggtgtaacgttttcgccgtatgaagatgaagtaaattcgtcgtttacgtcgggtcgtaataatacgatgatacgagcggtacaaccgggtgaaacgtatacgtataaatggaatatattagaatttgatgaaccgacggaaaatgatgcgcaatgtctaacgcgaccgtattattcggatgttgatataatgcgagatatagcgtcgggtctaataggtctattactaatatgtaaatcgcgttcgttagatcgtcgaggtatacaacgagcggcggatatagaacaacaagcggtttttgcggtttttgatgaaaataaatcgtggtatttagaagataatataaataaattttgtgaaaatccggatgaagttaaacgtgatgatccgaaattttatgaatcgaatataatgtcgacgataaatggttatgtaccggaatcgataacgacgctaggtttttgttttgatgatacggtacaatggcatttttgttcggtaggtacgcaaaatgaaatactaacgatacattttacgggtcattcgtttatatatggtaaacgacatgaagatacgctaacgttatttccgatgcgtggtgaatcggttacggtaacgatggataatgtaggtacgtggatgctaacgtcgatgaattcgtcgccgcgttcgaaaaaattacgtctaaaatttcgtgatgtaaaatgtataccggatgatgatgaagattcgtatgaaatatttgaaccgccggaatcgacggtaatggcgacgcgaaaaatgcatgatcgactagaaccggaagatgaagaatcggatgcggattatgattatcaaaatcgtttagcggcggcgttaggtatacgttcgtttcgaaattcgtcgctaaatcaagaagaagaagaatttaatttaacggcgttagcgttagaaaatggtacggaatttgtatcgtcgaatacggatataatagtaggttcgaattattcgtcgccgtcgaatatatcgaaatttacggtaaataatttagcggaaccgcaaaaagcgccgtcgcatcaacaagcgacgacggcgggttcgccgctacgtcatctaataggtaaaaattcggtattaaattcgtcgacggcggaacattcgtcgccgtattcggaagatccgatagaagatccgctacaaccggatgtaacgggtatacgtctactatcgttaggtgcgggtgaatttaaatcgcaagaacatgcgaaacataaaggtccgaaagtagaacgagatcaagcggcgaaacatcgattttcgtggatgaaattattagcgcataaagtaggtcgtcatttatcgcaagatacgggttcgccgtcgggtatgcgtccgtgggaagatttaccgtcgcaagatacgggttcgccgtcgcgaatgcgaccgtggaaagatccgccgtcggatctactattactaaaacaatcgaattcgtcgaaaatattagtaggtcgatggcatctagcgtcggaaaaaggttcgtatgaaataatacaagatacggatgaagatacggcggtaaataattggctaatatcgccgcaaaatgcgtcgcgtgcgtggggtgaatcgacgccgctagcgaataaaccgggtaaacaatcgggtcatccgaaatttccgcgtgtacgacataaatcgttacaagttcgacaagatggtggtaaatcgcgattaaaaaaatcgcaatttttaataaaaacgcgaaaaaaaaaaaaagaaaaacatacgcatcatgcgccgttatcgccgcgaacgtttcatccgttacgttcggaagcgtataatacgttttcggaacgacgtctaaaacattcgctagttttacataaatcgaatgaaacgtcgctaccgacggatttaaatcaaacgctaccgtcgatggattttggttggatagcgtcgttaccggatcataatcaaaattcgtcgaatgatacgggtcaagcgtcgtgtccgccgggtttatatcaaacggttccgccggaagaacattatcaaacgtttccgatacaagatccggatcaaatgcattcgacgtcggatccgtcgcatcgatcgtcgtcgccggaattatcggaaatgctagaatatgatcgttcgcataaatcgtttccgacggatatatcgcaaatgtcgccgtcgtcggaacatgaagtatggcaaacggttatatcgccggatttatcgcaagttacgctatcgccggaactatcgcaaacgaatttatcgccggatctatcgcatacgacgctatcgccggaattaatacaacgaaatctatcgccggcgttaggtcaaatgccgatatcgccggatttatcgcatacgacgttatcgccggatctatcgcatacgacgttatcgctagatttatcgcaaacgaatttatcgccggaattatcgcaaacgaatctatcgccggcgttaggtcaaatgccgctatcgccggatttatcgcatacgacgttatcgctagatttttcgcaaacgaatttatcgccggaactatcgcatatgacgttatcgccggaactatcgcaaacgaatttatcgccggcgttaggtcaaatgccgatatcgccggatttatcgcatacgacgttatcgctagatttttcgcaaacgaatttatcgccggaactatcgcaaacgaatttatcgccggcgctaggtcaaatgccgttatcgccggatccgtcgcatacgacgttatcgctagatttatcgcaaacgaatctatcgccggaattatcgcaaacgaatttatcgccggatctatcggaaatgccgctatttgcggatctatcgcaaataccgttaacgccggatctagatcaaatgacgctatcgccggatttaggtgaaacggatttatcgccgaattttggtcaaatgtcgctatcgccggatttatcgcaagttacgttatcgccggatatatcggatacgacgctattaccggatttatcgcaaatatcgccgccgccggatttagatcaaatattttatccgtcggaatcgtcgcaatcgttactactacaagaatttaatgaatcgtttccgtatccggatttaggtcaaatgccgtcgccgtcgtcgccgacgttaaatgatacgtttctatcgaaagaatttaatccgttagttatagttggtctatcgaaagatggtacggattatatagaaataataccgaaagaagaagtacaatcgtcggaagatgattatgcggaaatagattatgttccgtatgatgatccgtataaaacggatgtacgaacgaatataaattcgtcgcgagatccggataatatagcggcgtggtatttacgttcgaataatggtaatcgacgtaattattatatagcggcggaagaaatatcgtgggattattcggaatttgttcaacgtgaaacggatatagaagattcggatgatataccggaagatacgacgtataaaaaagtagtttttcgaaaatatttagattcgacgtttacgaaacgtgatccgcgtggtgaatatgaagaacatttaggtatattaggtccgataatacgagcggaagtagatgatgttatacaagtacgttttaaaaatctagcgtcgcgaccgtattcgctacatgcgcatggtctatcgtatgaaaaatcgtcggaaggtaaaacgtatgaagatgattcgccggaatggtttaaagaagataatgcggtacaaccgaattcgtcgtatacgtatgtatggcatgcgacggaacgatcgggtccggaatcgccgggttcggcgtgtcgagcgtgggcgtattattcggcggtaaatccggaaaaagatatacattcgggtctaataggtccgttattaatatgtcaaaaaggtatattacataaagattcgaatatgccgatggatatgcgtgaatttgttctattatttatgacgtttgatgaaaaaaaatcgtggtattatgaaaaaaaatcgcgatcgtcgtggcgtttaacgtcgtcggaaatgaaaaaatcgcatgaatttcatgcgataaatggtatgatatattcgttaccgggtttaaaaatgtatgaacaagaatgggtacgtttacatctattaaatataggtggttcgcaagatatacatgtagttcattttcatggtcaaacgctactagaaaatggtaataaacaacatcaactaggtgtatggccgttactaccgggttcgtttaaaacgctagaaatgaaagcgtcgaaaccgggttggtggttattaaatacggaagtaggtgaaaatcaacgtgcgggtatgcaaacgccgtttctaataatggatcgagattgtcgtatgccgatgggtttatcgacgggtataatatcggattcgcaaataaaagcgtcggaatttctaggttattgggaaccgcgtctagcgcgtttaaataatggtggttcgtataatgcgtggtcggtagaaaaattagcggcggaatttgcgtcgaaaccgtggatacaagtagatatgcaaaaagaagtaataataacgggtatacaaacgcaaggtgcgaaacattatctaaaatcgtgttatacgacggaattttatgttgcgtattcgtcgaatcaaataaattggcaaatatttaaaggtaattcgacgcgtaatgtaatgtattttaatggtaattcggatgcgtcgacgataaaagaaaatcaatttgatccgccgatagtagcgcgatatatacgaatatcgccgacgcgagcgtataatcgtccgacgttacgtttagaactacaaggttgtgaagtaaatggttgttcgacgccgttaggtatggaaaatggtaaaatagaaaataaacaaataacggcgtcgtcgtttaaaaaatcgtggtggggtgattattgggaaccgtttcgtgcgcgtctaaatgcgcaaggtcgtgtaaatgcgtggcaagcgaaagcgaataataataaacaatggctagaaatagatctattaaaaataaaaaaaataacggcgataataacgcaaggttgtaaatcgttatcgtcggaaatgtatgttaaatcgtatacgatacattattcggaacaaggtgtagaatggaaaccgtatcgtttaaaatcgtcgatggtagataaaatatttgaaggtaatacgaatacgaaaggtcatgtaaaaaatttttttaatccgccgataatatcgcgttttatacgtgtaataccgaaaacgtggaatcaatcgatagcgttacgtttagaattatttggttgtgatatatat

SEQ ID NO: 9081 - DNA, 6672 bp, Artificial Sequence
  Description of Artificial Sequence: Synthetic coding sequence
atgtttcccggttgccccagactctgggttctagtggtgttgggaaccagctgggtgggatggggatcacagggaaccgaggccgcacagctgcgacaattctatgttgctgcccagggtatcagctggtcttaccgccccgagccaactaattcctcactcaacctttccgttacttcgttcaaaaagattgtgtatcgggagtatgagccgtacttcaaaaaggaaaaaccccaaagcaccataagcggccttctgggacccaccctgtacgccgaggtaggggacatcatcaaggtgcattttaaaaacaaagccgataaaccgttgtctatccatccccaggggatcagatacagtaagctctccgagggagctagttatcttgatcacacctttccagccgagaagatggatgatgccgtggcacccggccgcgagtacacatacgaatggtctatcagtgaggatagcggtccaacacatgacgatccaccttgcctaacacacatatactacagccacgagaacctcatcgaagactttaatagtgggctcatcgggcccctgctgatttgcaagaaaggaaccttaaccgagggggggacgcagaagactttcgacaaacagatcgtcctgctgtttgcagtctttgatgaatccaaaagttggtcacaatcaagtagtctgatgtatactgttaatggctatgtgaatgggacgatgccggatatcaccgtctgcgcccacgaccacatctcctggcacctgctgggaatgtccagcggccccgaactcttcagcatccattttaacggccaggtgctcgaacagaatcaccacaaggtgtccgccattaccttggtgagtgccactagcaccaccgctaatatgacggtgggccctgaggggaagtggattatttcttccttgacacccaagcaccttcaggcaggaatgcaggcctatattgacatcaagaactgcccaaaaaagaccaggaatttgaagaaaataacgagggaacaacgccgccacatgaagcggtgggaatacttcatcgcggctgaagaggtgatttgggactacgcccctgtcattcccgccaacatggacaagaaatatcgctctcagcatcttgacaacttttctaaccagattggcaagcactataaaaaggtaatgtacacccagtacgaggacgagtctttcactaaacacacagttaacccaaacatgaaggaggacggtatactcggccctatcatacgggcccaggttagggacactttaaaaatagtgtttaagaatatggcttcgcgcccatacagcatctacccgcacggggttaccttttctccctacgaggacgaggttaacagctcttttacctcagggcggaataacactatgattagggctgttcaacctggcgagacttacacctacaaatggaacattttggaatttgacgaaccaactgaaaatgacgcgcagtgccttacacgcccgtattacagtgacgtggatattatgcgggatatcgcgtccggcttgatcggcttgctgctgatttgtaaaagcaggagcctggataggcgcggaatccagagagccgccgacatcgaacagcaggctgtcttcgctgttttcgatgaaaataaatcctggtacttggaggacaacatcaataagttctgcgaaaaccctgacgaggtcaagcgggacgatcccaaattctatgagtcaaatattatgagcacaattaacggatacgttccagagtccattaccactcttggattctgtttcgatgacaccgtccagtggcatttctgctcagtgggtacacaaaacgaaatcctgaccattcactttacaggccacagctttatatatggtaaaaggcatgaagataccttgacgctctttcccatgcgaggggagtctgtgaccgttacaatggacaacgtcggtacatggatgctgacaagtatgaattcctctccacgcagcaagaagctgcgcttaaaatttcgggatgtcaagtgcattcctgatgacgacgaagactcttacgagatcttcgaaccgccagaatctactgtgatggcaacaagaaagatgcatgaccgcctcgaaccagaggatgaggagtccgatgctgactatgactaccaaaatcgactcgccgccgctctgggtattaggtccttccgtaattcttctcttaatcaggaggaggaagagttcaacctaacagctctcgcattagagaatgggacagaatttgtttcatctaacaccgacatcatagtggggtcaaactactcttcccccagcaatataagcaagttcacagtcaacaatctagcagagccacaaaaggctcccagccatcagcaggctactacggccggctcccctctacgccacctcatcggcaaaaatagcgtactgaattcctctacagccgaacattcctctccttactcagaggatccaatcgaagatcctttgcagcctgacgtaacaggcatcaggctactgtctctgggcgcaggagagtttaagtctcaggagcacgccaagcataaggggcccaaagtcgaaagggaccaagccgcaaaacacagattttcctggatgaagctgttagctcataaggtaggccgtcatttgtcccaggataccggatcccccagtggcatgaggccgtgggaagatctcccaagccaggataccggcagtccaagcaggatgcgcccctggaaggatccacctagtgacctccttttactcaagcaatccaattcatctaagatactggtcggtcgttggcacctggcctccgagaagggatcgtacgaaattatccaagatacagacgaggacaccgccgtcaataactggctgatatcaccccagaatgccagccgagcatggggggagtcaactcccttggccaataaacctggcaagcagtcaggtcacccgaagttccccagggtgaggcataagagcctacaggtacgacaggatggcggtaaaagccgcctcaagaagagccagtttctgatcaagacgaggaagaagaaaaaagaaaaacacacccatcacgcccctctgagcccaaggacctttcatcctctaagaagcgaggcctacaatacctttagtgaaagacggctgaagcattccctggtgttgcataaatctaatgagactagtttaccgacagatcttaatcagaccctaccaagcatggattttggttggatcgcgtctctccccgatcataatcaaaatagctcaaacgatacagggcaggcctcctgtcctccaggcttgtaccagactgtcccgccagaggagcattatcagactttccctatccaagacccagaccagatgcacagtacatcagacccctcccacaggtcaagctctcctgagctgtcagagatgctcgaatatgatagatcccacaaatcttttcctaccgacattagccagatgtcgccgagcagtgaacacgaagtatggcagacagttatttcacctgatctctctcaggtaaccctttcgccagaattgagtcagactaacctctcccccgatctgtcacacacaaccttgtcgcccgagttgatccagcgcaatctcagtcccgccctaggccaaatgcctattagccccgacttgtctcacactaccctttccccagatctgtcccacactacactgagtctagacctaagtcagactaacctgtctccggagctgagtcagactaatctgtctcctgctttggggcaaatgcctttaagtcccgatttatctcacaccacactgagcctggatttttcacagactaacctgtcccctgaactgtctcatatgactctcagcccggagctatcccagacaaacttgtcccccgctcttggtcagatgcccatctcccctgacctttcccataccacattgtccttggacttttcccagaccaatttaagtcccgagttgtcccagacaaatctctcacccgcattgggacagatgcctttgtcccccgacccaagtcacacaactttgagtctggacctgtcgcaaaccaacctgagtcccgagttgtcccagacaaatctttcacctgatctgtcagagatgcccttattcgctgatctgtctcagattccattaactccagatttggaccagatgacactttctcccgacctgggcgagactgacctttctcccaacttcggccagatgagtctgagcccggacctgtcccaagttaccttaagtccagacatttctgatacaacacttctgcctgatctgtcccagatttctcccccaccagacttagaccagattttctacccttcagagtcaagccagtccctgttgcttcaggaattcaatgagtcattcccttatccggatctgggccagatgccaagcccgtccagtcctaccttgaacgatacatttctgagcaaggagtttaaccccttagtaattgttggcctctccaaggacgggaccgactatatcgaaattataccaaaggaggaagtgcaatctagcgaggatgactacgcagaaatcgattacgttccatacgacgacccttacaagacggatgtgaggacaaacattaactctagccgcgaccctgacaatatcgcagcttggtacctgagatccaacaatgggaatcggagaaactactatattgcagcagaagaaatctcgtgggactattctgagttcgtccaaagagagactgacatcgaggattcggacgatattcctgaggacaccacctataagaaggtcgtgtttaggaagtacctggatagcacatttactaagagagaccctagaggagaatatgaagagcatcttggcattttaggacccatcatccgtgctgaggtcgacgatgtgatccaggtccgattcaagaacctagcaagtcgaccctattctctacacgcacatggcctgagctacgaaaagagtagcgagggcaaaacgtatgaggatgattcgcccgagtggttcaaagaggataatgcagtccagccaaactcgtcctacacatacgtatggcacgcaacggaacgctctggacccgagtctccagggagtgcgtgccgggcctgggcatactactcagcagtgaaccctgagaaggacatccacagcggactcattggtccactactcatctgccagaagggcatcctacataaggattccaacatgcccatggatatgagggagttcgtgctgctgttcatgaccttcgatgaaaagaagtcatggtattacgagaaaaaaagcagaagcagctggagactgaccagtagcgaaatgaagaagtcacacgagtttcacgcaatcaacgggatgatttattccctgcccggcctgaagatgtatgaacaggagtgggttcgtctgcacttgcttaatattggcggatctcaggacatccacgttgttcatttccacggccagactctcttggagaatggcaacaaacagcatcaattgggggtgtggccactgctccctggctcattcaaaacacttgagatgaaagcttccaagcccggctggtggttgctgaataccgaggtgggagagaatcagagggccggcatgcaaactcccttcctgatcatggatcgagactgtcgaatgcccatgggcctgtctacagggatcatctctgacagtcagatcaaggcctcagagttcttaggatactgggaaccccgcttagctcgactgaataacggaggctcatataatgcctggagtgtcgagaaactggctgccgaattcgcctccaagccatggattcaggtggacatgcagaaagaggtcattatcaccgggatacaaacgcagggcgccaagcactatctgaagtcttgttatacaacagagttctacgttgcctactctagtaaccaaataaattggcagatttttaaggggaacagcaccaggaacgtgatgtattttaatggaaatagtgacgcttccaccatcaaggagaaccagtttgatccccccattgtcgcacggtacatccgcatcagccctactcgggcctataaccgccctactttgaggctcgaattacagggctgtgaggttaacggttgttctacccccttaggaatggaaaatggaaagatcgaaaacaagcagatcactgcctccagtttcaaaaagtcctggtggggcgattattgggagcctttcagagccagacttaacgcccagggccgcgtgaatgcatggcaggccaaagctaacaataacaaacagtggctcgaaatagatttattaaaaatcaaaaaaattacagccataatcactcaggggtgcaaaagtctcagtagcgagatgtatgtgaagtcgtataccatacactacagtgaacaaggggttgagtggaagccctatcggcttaaaagctcaatggtagataaaattttcgaagggaataccaacaccaagggtcacgtcaagaatttttttaaccctcccatcatctcacgctttattagagttatccctaagacctggaatcagtcaatcgccctgaggctggagttattcggttgcgacatctac

SEQ ID NO: 9082 - DNA, 6672 bp, Artificial Sequence
  Description of Artificial Sequence: Synthetic coding sequence
atgtttccagggtgccctaggctctgggtgttggtggtgttgggtacgtcgtgggtgggctggggctcccaaggcaccgaggccgcacagctgaggcagttctatgtggccgcgcaaggtatttcctggtcataccgccctgagcctacgaattcgtcccttaacttgtccgtcactagcttcaagaagatcgtgtaccgcgaatacgaaccctacttcaaaaaggaaaaaccccagtcgaccatttccggactcctgggacccaccctttacgctgaagtcggagacatcattaaagtgcatttcaagaataaggcagataagccgctgtcgattcatccgcagggtatccggtactcaaaactttccgaaggtgcctcgtatctcgatcacacctttccggctgaaaagatggatgatgccgtggcacctggacgggaatacacttacgaatggagcattagcgaggattcgggtcctacgcatgatgacccaccctgtctcactcatatctactacagccatgagaacctgatcgaggacttcaactccggcctgattggccctctccttatttgtaagaagggaacccttaccgagggtggaacccaaaagactttcgataagcagatcgtcctgctgttcgcagttttcgacgaatcaaagtcatggtcgcagtcatccagcttgatgtacacggttaatggttacgtcaacggcaccatgccagatattactgtgtgtgcccacgatcatatctcctggcatctgctgggtatgtccagtggtccagagttgttttcgattcactttaacggccaggtcctcgagcaaaatcatcataaagtctcggcaatcaccctggtcagcgcaacctcgaccaccgccaacatgaccgtcggacccgagggcaagtggatcatctctagcctgactccgaagcatctgcaagcaggaatgcaagcctacattgacatcaaaaactgtccaaaaaagacccgaaatcttaagaaaatcacccgtgaacagagacgacacatgaagagatgggaatactttattgccgcggaagaagttatttgggattacgcgcctgtgataccagctaatatggacaagaaataccgctcccaacatcttgacaacttctcgaaccagatcggtaagcattacaagaaagtgatgtacactcagtacgaagatgagtcgtttactaagcacactgttaaccccaacatgaaggaagatggaatcttgggtcctatcattcgcgcgcaagtgagagatactctgaagattgtctttaagaacatggcgtcacgcccttactcgatttacccacacggcgtcaccttttccccctatgaagatgaagtcaattcctcgttcacgtcgggaagaaacaacaccatgatccgagcagtgcaaccaggcgagacttacacgtacaagtggaacattcttgagtttgatgaaccgactgaaaatgatgcacaatgtctcacccgcccttactacagcgatgtcgatatcatgagagatattgcaagcggactgattggactgctcttgatctgcaagtcgcggtcgctcgaccgcaggggaatccagcgggcagcagacattgagcagcaggcagtgtttgcagtctttgacgagaataagagctggtacctggaggacaatatcaacaaattctgtgaaaaccctgatgaggtgaagagggacgaccctaagttttacgaatccaacattatgagcacgataaacggatacgtcccggaatcgattacgaccctgggattttgctttgacgataccgtgcaatggcacttctgctcggtgggaacccaaaacgagatccttacgatccactttactggtcactcctttatctacggtaagcgccatgaggatactcttacccttttccctatgcggggtgaatccgtgaccgtcactatggataacgtgggaacttggatgctgacctccatgaattcctcaccacggagcaaaaaactgagactgaaatttcgagatgtgaagtgcattccagatgacgatgaagattcctacgagatctttgaacctccagagtcaactgtcatggcaacgagaaagatgcatgatcggctggaacctgaagatgaagaatcggacgccgactacgattaccagaacagactcgccgccgcgcttgggattaggagctttcgcaattcctcgctgaaccaagaagaggaggagtttaaccttactgccctcgcacttgagaacggaaccgaatttgtgtcgtccaacaccgatatcattgtcggatccaactactccagcccatcgaacatctcaaagtttactgtgaacaaccttgcggagccgcagaaggccccaagccaccaacaggctaccaccgctgggtcacccctccggcatcttatcggaaagaactctgttcttaattcgtcaaccgcggaacatagcagcccctacagcgaggatccgattgaagatccactgcagccggatgtgactggtattcggcttctgtcgctgggagccggggaattcaaatcccaagaacacgcaaaacacaaaggacctaaggtggagcgggaccaggcggcgaagcatagattctcatggatgaaacttctcgcacacaaagtcggtcgtcaccttagccaggatactggttcgccttccggaatgcggccttgggaggacttgccatcacaggacaccggcagcccttcaagaatgcggccgtggaaggatcctcctagtgacctcctgcttctgaagcaaagcaattcgtcgaagatccttgtgggtcgctggcaccttgcatcggaaaagggaagctatgagattattcaagacaccgatgaggacactgcagtgaataactggttgatttccccacaaaacgcctcgagggcctggggagagagcacccctcttgccaacaaaccaggcaagcaatctggccacccgaaatttcccagggtgagacacaagtcactccaagtgcgccaggatggtggtaagtcgcgcctcaagaagtcgcagtttctgattaagaccagaaaaaagaagaaggaaaagcacacgcatcacgcgcctctcagccccaggacttttcatcctctgcgcagcgaagcgtacaatacctttagcgagagacgtcttaagcattctcttgtgcttcataagagcaatgaaacctcacttccaactgatctgaaccagactctgccttccatggatttcggttggattgcgtcgcttcctgatcataaccaaaactcctcgaatgacactggacaagcatcctgtccacccggcctctaccaaaccgtgccaccagaggaacattaccagacctttcctatacaggatcctgatcaaatgcattccacttccgaccctagccaccggagctcgtcccccgaactctcagagatgctcgaatatgatcgctctcacaaatcgttcccaaccgacatctcgcaaatgtccccaagctcggaacacgaagtgtggcaaactgtcatcagcccggacctttcacaagtgactctttcgccggagctgtcgcagacgaacctcagccccgacctctcccatactaccctgagcccagaattgatccaacgtaacctctcgcctgccctgggacagatgccaatttcacccgatctgtcccatactacgctctcgcccgatctgtcacacaccaccctgagccttgacctgtcgcagaccaatctctctccagaactctcccaaactaacctttcccccgcactcggccagatgccgctttcaccagatctgagccataccaccctttcgctcgatttttcacagactaatcttagtccagagctgtcgcacatgactctgtcgcctgagctttcacagaccaacctgagcccagcactgggacaaatgcctatatcgcccgatctttcgcataccactctgtcgctggacttctcgcaaaccaatctttcccctgaactctcccagaccaatctttcgccagcacttggccaaatgccgctcagcccagacccttcgcacactaccttgtcacttgacctgagccaaaccaatctgtcaccagaactttcgcaaaccaacttgtctcccgatctcagtgaaatgcctctgtttgctgatctgagccagattcctctcacgcctgacttggatcagatgactcttagccctgacctgggagaaaccgacctgtcccctaatttcggacagatgtccctgtcgcctgacttgtcccaagtcacccttagcccagatatcagcgatactacccttcttccggatctctcccagattagcccaccacccgacctggatcagattttctacccatcggaatcctcgcagtcgttgcttcttcaggagttcaacgagagctttccttaccctgatctcggtcagatgcctagccctagctcacctactctgaacgacacttttctcagcaaagagttcaaccctctggtgattgtgggtctgtccaaagacgggaccgactacatagagattattcccaaggaggaagtgcaatcctccgaggacgattacgccgagatcgattacgtcccatacgatgatccctacaagactgacgtgagaactaacattaactcctcacgcgacccagacaacatagcggcctggtacctgcgttcgaacaacggaaacaggaggaactactacatagcagctgaggagatctcatgggattactccgagtttgtccagagggaaactgatattgaagattccgatgacatccctgaagatactacctataagaaggtggtgtttaggaaatacctggattcgactttcactaagagagatcctagaggagaatacgaagagcatctcggtatcctgggaccaattatccgagctgaggtggacgacgtcatacaggtcagattcaaaaacctcgcatcacgcccatactccttgcacgcacatggactctcctacgaaaagtcctcggagggtaaaacttacgaggatgactcgccagagtggtttaaggaggataacgcagtgcaacccaattcgtcgtatacttacgtgtggcacgctaccgagcgctccggaccagaaagtcccggatccgcatgtagagcctgggcgtactactcggcagtgaatcctgagaaggatatacattccggacttatcggacctctgctgatctgccaaaagggcattctgcacaaggattccaacatgccaatggatatgagagaattcgtgctgcttttcatgaccttcgacgaaaagaaatcctggtactacgaaaagaagtcacggagctcctggcggttgacctcatcggaaatgaagaaaagccacgaattccatgcgattaacggtatgatctacagccttccaggactgaagatgtatgaacaagagtgggtgcgccttcaccttctcaacataggaggatcgcaggatatccacgtggtgcattttcatgggcagaccctgctcgagaacggtaataagcagcatcaactgggcgtgtggcctctgcttccgggatccttcaaaaccctggaaatgaaagcatccaagcctggatggtggctgcttaataccgaggtgggcgagaaccagcgggccgggatgcagacgccttttctcataatggatagagattgtcggatgccgatggggctgagtactggcattatctcggattctcagattaaggcgtccgaatttcttgggtactgggaacctcgacttgcaagactgaataacggaggttcgtacaacgcctggtccgtggagaagctggcagcagaattcgcctccaagccgtggattcaagtggacatgcaaaaggaagtcattatcactggcattcaaacccaaggggcaaagcattacctgaagagctgttataccaccgagttttacgtggcctactcgtctaaccagatcaactggcaaatcttcaagggaaacagcaccagaaacgtgatgtacttcaacggaaactcggatgcgtcgactattaaggagaaccaatttgatccacctattgtggcacggtacatccgcatctcccctaccagagcatacaatcggccaaccctgcgccttgagctgcaagggtgtgaagtgaacgggtgttcgacccccctgggcatggaaaatggtaagattgaaaacaagcaaattaccgcctcgtcatttaagaaatcgtggtggggagattactgggagcccttccgtgctcggcttaatgcccagggtcgcgtcaatgcttggcaagcaaaggccaacaacaacaagcagtggcttgaaatcgacttgcttaagatcaaaaagataaccgccataatcactcaaggttgtaaatctctttcatccgagatgtacgtgaaaagctacactattcattactcagagcagggcgtggaatggaagccgtaccggctcaagtcctcgatggtcgacaagattttcgaaggtaacaccaatactaagggacatgtcaagaactttttcaatcctccgatcatttccaggttcatccgggtcattcctaaaacctggaaccaatcaatcgctctgagactggaactctttgggtgtgatatctac

SEQ ID NO: 9083 - DNA, 6672 bp, Artificial Sequence
  Description of Artificial Sequence: Synthetic coding sequence
atgtttcctggttgcccgagactttgggtcctggtggtcctgggcacttcatgggtgggttggggatcgcaaggaacggaggcggcccaacttaggcaattctacgtcgcagcccaaggtatttcctggtcataccgcccggagccaaccaattcaagcctgaatctgtcggtgaccagctttaagaaaattgtgtaccgcgagtacgaaccctactttaagaaagagaagccacaatcgactatctccggacttcttggacctaccctttacgcagaagtgggggatatcatcaaggtccactttaagaataaggcagacaagcctctttcgattcatccacagggaatccgctactcgaaactgtccgagggcgcatcgtaccttgatcatacctttcccgccgagaagatggatgacgcagttgcacctggtagagaatacacctacgaatggtcgattagcgaagattcgggaccaacgcatgacgatccaccatgtctgacccacatctactactcacacgaaaatctgatcgaggacttcaattcaggactgatcggccctcttttgatttgtaagaagggaactctgactgaaggaggaactcaaaagacctttgataagcagattgtcctgcttttcgccgtgtttgatgaaagcaagagctggtcgcaaagctcatcgctcatgtacaccgtgaacggatacgtgaatggaaccatgcccgatatcacggtctgcgcccacgatcatatttcctggcatttgctcggcatgtcatcgggtcctgaactcttctcaatccactttaacggtcaagttctggagcaaaatcatcataaagtgtcagccattactcttgtctcggccaccagcactaccgcaaacatgactgtgggtcctgaaggaaagtggatcatttcctccttgactccaaagcatttgcaggcgggtatgcaagcatacatcgatatcaagaattgcccaaaaaagacgcgtaacctgaaaaagatcaccagagaacagcgcagacatatgaaacggtgggagtactttatagccgcagaagaagtcatttgggattacgcacccgtgatccctgcaaatatggataagaagtaccgtagccagcatctggataacttttccaatcaaattggtaagcactacaagaaggtgatgtacacccagtacgaggatgaatcgttcaccaagcatactgtgaatcctaatatgaaggaggatgggatccttggacccataatccgggcacaagttcgcgatacccttaagatcgtgtttaagaacatggctagccgcccatactcgatttatcctcacggagtgactttctcaccttacgaggacgaggttaattcctcctttacgtcagggagaaacaacaccatgattagagcagtgcaacctggagaaacttacacctacaaatggaatatcctggagttcgacgagccaactgaaaacgatgcccagtgtctcacccgtccgtactacagcgatgtcgacattatgagagacatcgcctccggactgattgggcttctgctgatttgtaagtccagatccctggaccgtaggggaatccaaagggccgccgatattgaacagcaagcggtgttcgcagtctttgacgaaaacaaatcatggtacctggaggataacatcaataagttttgtgaaaaccccgatgaagttaagagagatgatccgaaattctacgaaagcaacattatgtccactattaacgggtacgtgcctgaatccattactactctgggattctgcttcgatgacaccgtccaatggcacttttgctccgtgggtactcaaaacgagattcttacgatccatttcactgggcattcattcatatacgggaagagacacgaggataccctgacccttttccctatgcggggagagtcggtcaccgtgaccatggacaacgtgggaacttggatgctgacttctatgaactcgtcccctaggtcgaagaaacttaggcttaagtttagagacgtgaagtgtattccagacgatgacgaggatagctacgagattttcgaaccccccgagtcgaccgtcatggccactaggaaaatgcatgatagacttgaacctgaagatgaagaatccgacgcagattacgattaccaaaatcgccttgcggctgcacttggaattagatcctttagaaatagctcgctcaaccaggaggaagaagaattcaatctgaccgccctcgcacttgagaacggaaccgagttcgtctcatcgaacactgacattattgtgggatcgaactacagcagcccgagcaacattagcaagtttacggtgaataacctcgccgagcctcaaaaggctccatcccatcaacaggccaccactgccggatcccctcttcgtcatctcattgggaagaactccgtcctgaactcctcaactgcagagcatagctccccttactccgaagatcctattgaagatccactgcagccagatgtgaccggtattagactgctctcgttgggagcaggagagtttaagagccaagagcatgcaaagcataagggacctaaggtcgaaagagatcaagcagccaagcaccgattttcctggatgaagctgcttgcacataaagtcggaaggcacctttcgcaagataccggctccccttcgggaatgcgcccctgggaggaccttcccagccaggacaccggatcaccatcacgcatgcgtccttggaaggatcctccctctgatctgctccttcttaaacaatcaaatagctcgaagattctggtggggcgatggcatctggcatccgagaaggggagctacgaaatcattcaggatacggatgaggacaccgccgtgaacaactggcttatttctccacagaacgcatcaagagcatggggtgaaagcactcctctcgccaacaaacctgggaagcagtcaggccatccaaagtttcctcgcgtcagacacaaatcgctgcaggtgcggcaggatggaggtaagtcgcgcctgaagaagtcgcagtttcttatcaaaactagaaagaagaagaaggagaagcatactcatcatgcgcctctttcaccgcgcacgtttcacccactgcggtcggaggcatacaatacttttagcgaaagacgattgaagcatagcctggtccttcacaagtcaaacgaaacctcgcttcctactgatctgaaccaaactctgccatcgatggacttcggttggattgcaagccttccagatcataaccagaattcgtcgaatgacaccggtcaggcatcgtgccctccaggcctctaccaaactgtgccacccgaagaacactaccaaacctttcctattcaagatccagaccaaatgcattcaacctccgatcctagccaccgtagctcgtcccccgaattgtcggaaatgctggagtacgatcggtcgcacaagagctttccaacggatatctcgcaaatgtccccgtcatcggaacacgaggtgtggcaaactgtgatctctcctgaccttagtcaagtcaccctgagcccagagctgtcacaaactaatctttcgcccgacctctcacacactactttgtcaccagagcttattcagcgcaacctcagcccagcactgggacaaatgccgatttcacccgatctttcccatactacgctctcccccgacctttctcataccactctgtccctggacctcagccagacgaacttgagccccgaactgtcccaaaccaacctttctcctgcgctgggtcagatgccgctttcccctgacctttcacatacgactctctcgctggacttttctcagacgaaccttagcccagagcttagccatatgactctgtccccggaattgagccagaccaacctgagccccgcgctcggccaaatgccaattagcccagacctttcgcacaccactttgagcctcgatttctcgcaaactaacttgtcgcccgaactttcccaaacgaatttgtcgcctgcgcttggccaaatgcccctgagcccggatcctagccataccaccctgtcgctggatctctctcaaactaacctgtccccagagctgagccaaacgaatctgtcgccagacctgtctgaaatgcctctcttcgcagatctcagccaaattcctctcacccctgacctggaccaaatgactctctcacctgatcttggcgaaaccgatctgtcccctaacttcggacagatgagcctttcgcctgatctgagccaggtcactctttcaccggacatatctgacactaccctcctcccggacttgagccagatttcgcccccaccagatctggatcagatcttctacccctccgaatcgtcgcaatcactgctgcttcaggaattcaatgaatcctttccttaccctgatcttggacaaatgccatccccatcctcccctaccctgaatgacacgttcctttccaaggaattcaatcctctggtgattgtgggactttcgaaggatggaaccgattacatcgagattattcccaaggaggaagtgcaatccagcgaagatgactacgcggaaatcgattacgtgccttacgatgacccctacaagaccgacgtccggaccaacataaactcatcgcgggatccagataacattgcagcgtggtatctgcgctcgaataacgggaaccggcggaactactacattgcagctgaggaaatctcgtgggactactcagaatttgtgcagcgggagactgatatagaggacagcgacgacatccctgaggataccacctacaaaaaggtagtctttcgaaagtacctggacagcactttcaccaaacgggatccgagaggggagtacgaagaacacctgggaatactgggtcctatcattcgggctgaagtggatgacgtgatccaagtgcggttcaagaacctggcatcacgcccttattcgctgcatgcacatggtctttcgtatgagaagtcctcggagggtaagacctacgaagatgactcccctgaatggttcaaggaagataacgcagtccaacctaactcctcctacacctacgtctggcatgcaaccgaaagatcgggaccagaatccccaggttccgcgtgtagagcctgggcatattactcggcagtgaacccagagaaggacatccactccggcctgattggtcctttgctcatatgtcaaaagggaatcttgcataaggactcgaacatgcctatggatatgagagaatttgtgcttttgtttatgaccttcgatgagaagaaaagctggtactacgagaaaaagtcgcgatcaagctggcgtcttacgagctcagaaatgaagaagtcccacgaatttcacgcgattaatggaatgatctactccctgccaggtctgaagatgtacgaacaggaatgggtgcggcttcacctcctgaacatcggtggctcccaagatattcatgtggtgcacttccacggacaaacgctgctcgaaaacggtaacaagcaacatcagctcggggtgtggcctctcttgcctggatcgtttaagacccttgaaatgaaggcctcgaagccgggttggtggcttcttaacactgaggttggtgagaaccagagggcaggtatgcaaaccccattcctcatcatggatcgggattgtagaatgcctatgggactcagtaccggaatcatatcggattcgcagatcaaggcttcagagtttcttgggtactgggagccacggctggccagacttaacaacggagggtcctacaacgcatggtcagtcgagaagttggcagcagaattcgcctcgaagccttggatacaggtggatatgcagaaagaagtcatcattaccggaattcaaacccagggagcaaagcattacctcaagagctgttacaccaccgagttttacgtcgcatactcctcgaaccagatcaattggcaaatctttaaaggaaattccactagaaacgtcatgtactttaacggcaactcagatgcctcaacgatcaaggaaaaccaatttgatccgccaattgtggctcgctacatccgtatcagccccaccagagcatacaacaggccaaccctgaggcttgaactgcaggggtgtgaggtcaacggatgctcaactcccctgggtatggaaaacggaaagattgaaaacaagcaaattaccgcatcgtcttttaagaagtcctggtggggggattactgggagccctttagagcccgtcttaacgcacaaggacgagttaatgcatggcaggcaaaggcaaataacaacaagcagtggcttgaaattgatctcttgaaaatcaaaaagatcacggcaatcattactcagggttgtaaatcgctgtcctcagaaatgtacgtgaaatcatacactattcattacagcgagcaaggggtcgagtggaagccgtaccgcctgaaaagcagcatggtcgataagatcttcgagggaaacaccaacaccaagggacacgtcaaaaacttctttaaccctccgatcatcagccgctttatccgagtgattcctaagacttggaatcagagcatagcccttaggctggagcttttcgggtgcgacatatac

SEQ ID NO: 9084 - DNA, 6672 bp, Artificial Sequence
  Description of Artificial Sequence: Synthetic coding sequence
atgtttcccggctgcccgaggctgtgggtcctggtggtgctgggcacaagttgggtgggctgggggtcccagggaaccgaggctgctcagctgaggcagttctacgtggcagcccagggcataagctggagttatcgcccggaaccgactaattccagcttgaatcttagcgtgacatccttcaaaaagatcgtgtacagggagtatgagccatactttaaaaaagagaaaccacaatcaaccatcagtggcctcctgggaccaaccctgtatgcagaagtgggtgacataataaaagttcattttaaaaacaaagcggacaagccacttagtattcatccacaggggatccgctactcaaagctcagcgagggggcctcatacttagaccatacatttcccgctgagaaaatggacgacgctgtggctcccgggagggaatacacctacgaatggtctatcagcgaggactcaggtccaactcatgacgaccccccatgtctaacgcatatttattactcacatgaaaatctgatagaggacttcaattcagggctcattggccccctgcttatctgcaagaaaggcactctgaccgaaggcggtacccagaagacctttgataagcaaattgtgctgctgttcgcggtcttcgacgaatctaagtcttggagccagtcatcctcacttatgtacacggtgaatggttacgtgaatggcaccatgccggatattacagtatgcgcccacgaccacatcagttggcatctcctgggaatgagcagcggtccagagcttttctccattcatttcaatggtcaggtgctggagcagaatcatcacaaagtgtctgccattaccctcgtgtcagccacttccaccaccgcgaatatgacagtcggccctgaaggcaagtggataataagcagcttaactcccaaacacttgcaggcaggcatgcaggcgtatatcgacatcaaaaattgtcccaagaaaacgagaaacctgaaaaaaatcacccgtgagcagagaagacacatgaagcgctgggaatattttatagctgctgaggaagtgatctgggactacgctcctgtgatccctgcaaacatggataagaagtatcgttctcagcatttagataacttttctaatcaaatcggtaaacattacaagaaggtcatgtacacgcaatatgaggacgaatcgtttacaaagcacaccgttaacccaaatatgaaagaagatggcattctggggccaattataagagcacaagtgagagacaccctgaaaattgtcttcaagaacatggcttctaggccctactcaatctacccccacggggttaccttctccccttacgaagatgaggttaacagctcttttacgtccggacggaataacactatgattagggctgtgcagccaggagagacttacacttacaagtggaatattctggagttcgatgagccaacagaaaatgacgcgcagtgcttgacccggccatactactccgatgtggacatcatgcgggacatcgcttcagggctgattggcctgttactgatttgtaaatctaggagcctggacaggcgtggcatccagagagcagcagatatagaacagcaggccgttttcgccgtattcgatgaaaacaagtcctggtatctggaagacaatatcaacaaattttgtgagaacccagacgaggttaaaagggacgatccgaaattttacgaatcaaacatcatgtccacaataaatgggtatgttcctgagtcgatcaccaccttgggcttctgttttgacgacacagtccagtggcacttctgttccgtggggacccaaaacgagatcctgactattcactttacggggcatagtttcatctatggtaagagacacgaagacaccctgacactgttcccaatgcgaggagaatccgtgacagtaaccatggataatgtgggcacttggatgctaacgtccatgaatagctctccgaggtccaagaagctccgtttaaagtttcgggacgttaaatgcattcccgatgatgatgaagactcttacgagatcttcgaacctcctgaatcaactgtgatggcgactaggaagatgcacgacagactggaacccgaggacgaggaaagcgacgcggactacgactaccagaacagactagctgccgccctggggatacggtcttttcgaaacagctcactgaatcaagaggaggaggagtttaatctgactgccttagcactcgagaatggaaccgaatttgttagttcgaatacagatataatagtggggtctaactactcaagtccaagcaatattagtaaatttaccgttaacaacctggccgaacctcagaaggctcccagccaccaacaggctacgacggccggatcccccctgcgacacctgattggcaagaattccgtgctgaactcttcaactgccgagcactcttctccttacagcgaggatccgattgaggatccactgcagccagacgtgactggaattagattgttaagtttgggagccggagagttcaaatcccaggaacatgccaagcacaagggccccaaggtcgagcgggatcaagctgccaagcaccggttcagctggatgaagcttctggcccataaagtgggcaggcatctttctcaagatacaggttcgccttccgggatgcggccctgggaggatctgccctcccaggacactggatcaccttctagaatgcggccttggaaggatcccccctctgacttgctgttgcttaaacagagcaattcctctaaaatccttgtggggcgttggcacctggccagtgagaagggctcctacgagataattcaagacacggacgaggatactgccgtgaacaattggcttataagtccacaaaatgcttctcgggcatggggagagagtacccccctcgcaaataagccgggtaaacagagtggacatccgaagttcccacgggttaggcacaagtctttacaggtacgtcaggacggcgggaagtcacggttaaagaagtcacaattcctcatcaagacaagaaaaaaaaaaaaagagaaacatacccaccatgctcctttgagtccacgtaccttccatcccttgcggtcagaggcctataatacgttctccgagcggagactgaaacactctctggtgctgcataaatctaatgaaacgagcttacccaccgatcttaatcagaccctgcctagcatggacttcgggtggatcgccagcctgcccgaccacaaccagaatagttctaatgatactggacaagccagctgcccccccgggctgtaccaaacggtgcctcccgaagaacactaccagaccttccccatccaggaccctgaccaaatgcatagcacaagtgacccaagtcatcggtccagtagccccgagttgtctgagatgctggagtacgaccgatctcacaaatcattccctacagatatatcccaaatgagtccctcctccgaacatgaggtgtggcagacagtgatcagccccgatcttagtcaggtcacactgtccccagagttgtctcagaccaacttgtctcctgatctctctcacaccaccttgtctccagagcttattcagcgaaatctttcccccgcgctcggccagatgcccattagccccgatctttctcatacgactctttcacccgacctatcgcacacaacgctatcgctggacctgtcccagaccaacctgagtccggaactctctcaaaccaatctgtcacctgcactgggacagatgccattgtccccagacttgagtcacacaacactgagcctggactttagtcagactaatttgagccccgaactttctcatatgacgctgtctcctgaactgagccagacaaacctctcgccagcccttggccaaatgccgatcagcccagatctctcccatacgactctgtccctggacttttcccagacaaatctgtcccctgaactgtcccagaccaatttatcccccgccctggggcagatgcctctgtcaccagacccatcccataccaccctgtcccttgacctgagccaaactaacctgagccctgagctgagccagactaaccttagtccagacctgagcgagatgcccttattcgcggacctgtcacagatccccttaacccctgatctcgaccagatgactctatcaccagacctgggggagaccgacctgtcacccaactttggtcagatgtccctaagccccgacctgtcacaggtcacgcttagccccgatatttcggacaccacattgctacccgatcttagtcaaatctccccacctcctgacctggatcagatattttatcctagtgaatcgtctcagagcctacttctgcaagaatttaatgagtcattcccttatcccgatctgggacagatgccatcaccttcatcgcccaccctgaacgacacttttttgtcaaaggagtttaatccccttgttatcgttgggctctctaaggacgggaccgactacattgaaattattcccaaagaagaagttcagagctcagaggatgattacgctgaaattgattacgtcccttacgatgatccctacaaaactgacgtgcgtaccaatataaacagttctcgcgatcctgataacatcgcagcttggtacttgcgttcgaataacggcaataggagaaactactacatcgcagccgaggagattagttgggattactctgaattcgtccagcgggagaccgatatcgaggactccgacgatattcccgaagatacaacatacaagaaggtggtattccgaaaatatctggactccacattcaccaagagagatccaagaggtgagtatgaggaacacttaggaatactagggcccattattagggctgaagtggatgatgtcatccaggttcgcttcaaaaatctggcatcccgcccatactccctgcatgcccacggcctctcatacgagaagagttcggagggaaaaacctatgaagatgacagtccagagtggttcaaggaggacaatgcagtccagccaaactcaagctacacctacgtttggcacgccacggaacgttctggacctgaaagcccaggcagcgcctgtcgagcttgggcctattatagtgcagttaatcccgagaaagacatccactcgggtctaatcgggcccttgttgatctgtcagaaaggcattctccacaaggattccaacatgccaatggatatgagggagtttgtgctcctgtttatgacgttcgacgagaagaaatcttggtactacgagaagaagtcaagatcctcctggaggctcactagttcagaaatgaagaagtcacatgagtttcatgccataaatggcatgatctacagccttcccggactgaagatgtacgaacaggaatgggtgcgactccacttattgaatatcgggggcagccaggacatacatgtggtgcactttcacggtcagacgctgctcgagaacggcaacaaacaacatcagctgggcgtgtggcctctgcttcccgggtcattcaagaccctggaaatgaaggctagtaagcctggttggtggttactcaatactgaggtgggcgagaaccagcgggcagggatgcagacaccttttcttattatggaccgcgactgcaggatgcccatggggctctcaacggggattattagcgatagccagatcaaggccagcgagtttctgggatactgggaacctcgactagcccgactgaacaacggaggaagttacaatgcttggtccgtggagaagcttgccgccgaatttgcctctaagccttggatccaggtggacatgcagaaggaggtcatcatcacaggcatccagactcagggggcaaagcattacttgaaatcctgctataccacagagttctatgtcgcttatagcagcaaccagataaattggcagatattcaagggcaattctactcgcaacgttatgtatttcaatggcaactcagatgccagtacgattaaggagaaccagttcgaccctccaatcgtggctaggtacatccgaatcagtcccacccgggcctataaccggcccacattaaggctcgagctacagggttgcgaagtcaatggctgctccaccccgctgggcatggagaacggaaaaatcgagaacaagcagatcactgcaagctcattcaaaaagagttggtggggggactattgggaaccgttcagagctaggctgaacgctcagggaagagtgaacgcttggcaggccaaggcaaataacaataagcagtggcttgaaatcgatctgttgaagatcaagaagataaccgctattatcacccaggggtgcaagtccctctcctccgaaatgtatgtgaaaagctacaccatccattacagcgaacagggcgtggaatggaagccctacagactgaagtcctcaatggttgacaaaattttcgagggaaacacaaacacaaagggccacgtgaagaattttttcaatcccccgattatatctaggttcatcagagtcatcccgaaaacatggaaccagagcattgccctccgactcgagttgttcggctgcgacatctac

SEQ ID NO: 9085 - DNA, 6672 bp, Artificial Sequence
  Description of Artificial Sequence: Synthetic coding sequence
atgttccccggctgtccacgcctttgggtgcttgtggtgctgggtacgtcgtgggtaggatggggttcgcaaggcaccgaagcagctcagctccgccagttttatgtggcggcacaagggattagctggtcatatagacctgaacccactaacagttcgttgaacctcagcgtgacgagctttaagaagattgtgtacagggaatacgaaccttactttaagaaagaaaaaccacaatcgaccatttcaggactgcttggaccaactctttacgctgaagtgggagacattatcaaggtgcactttaagaataaggcggacaaacctctctcgattcatccacaaggcatacgatactccaagctgagcgagggagcctcatacctggaccacactttccctgcagaaaagatggatgacgcagtcgcaccgggcagagaatacacgtacgaatggtcaatatccgaggattctggaccaacgcatgacgatcctccttgtctgacgcacatctactactctcatgaaaatcttattgaagatttcaattcgggtctgataggcccattgcttatttgcaaaaaaggaacccttactgaggggggaacccaaaagacgtttgataagcagatcgtgctcctgttcgcagtctttgatgagtccaaatcctggagccaaagctccagccttatgtacactgtgaatggttatgtgaacggaactatgccagatattactgtttgtgcgcatgatcacatttcttggcaccttcttgggatgtcatcaggccctgaactgttctcgattcacttcaatgggcaggtgctggaacagaaccaccataaggtgtcggccatcactcttgtgtcagccacttcaactaccgcaaacatgaccgtcgggcccgagggtaagtggattatctcgagtctcacgccgaagcatcttcaggcaggtatgcaagcctacatcgacatcaaaaactgtcctaaaaagacgagaaacttgaagaaaatcacgcgtgaacaacggcgccacatgaagcgctgggagtactttattgcagcggaggaagtgatttgggattacgcccctgtcatccccgccaatatggacaaaaagtaccgctcccaacatttggacaactttagcaaccaaattggaaagcactacaagaaggtgatgtacacgcagtacgaagatgaatcgtttactaaacatactgtgaaccctaacatgaaagaggacggtatccttggccctatcattagagctcaagtgagggacaccctgaaaattgtgtttaagaacatggctagccgcccctacagcatctaccctcacggagtgacgtttagcccctacgaggacgaggttaattcctcattcacctcgggacgtaacaacacgatgattagagctgttcaaccaggagaaacttatacctacaagtggaacattctggagtttgatgaaccaaccgagaacgacgcgcagtgtcttactagaccttactactcggatgtggacattatgcgtgacatagcatctggactgataggccttctgctgatctgtaaatcgcgctccctcgaccggagaggaattcaacgcgccgcagatatagagcaacaggcagtgtttgcagtctttgacgaaaacaagtcctggtaccttgaggacaacattaacaagttttgtgaaaacccagatgaagtgaagagagatgatcccaaattctacgaaagcaatatcatgagcactatcaatgggtacgtgccagaatcaattaccactctcggattctgttttgatgatactgtgcaatggcatttttgctcggtgggcactcaaaatgaaatcctgactattcatttcactggacattcgtttatctacggcaaaagacatgaagatactttgaccctctttccaatgcggggtgaatccgtcaccgtcacgatggataacgtcggaacctggatgctgacttccatgaacagcagtcctcgcagcaaaaagctgcggcttaagttcagagacgtgaagtgcattcctgatgatgatgaggactcctacgagatatttgaaccacctgagtcgaccgtgatggcaactagaaagatgcatgatcgtctcgaaccagaggacgaagaaagcgatgcagattacgattaccagaatcggctggcggctgctctcggaataagatctttccgcaactcatcgcttaaccaagaagaagaagaattcaacctgacggcgcttgcactcgagaacgggaccgagtttgtcagcagcaacacggatatcatcgtgggatcgaattactcaagcccatctaacatctcgaagtttaccgtgaataatctggcagaaccccaaaaggcaccatcccatcaacaggcgacgaccgccggatcccctcttcgccatcttatcggaaagaatagcgtgcttaactcatcaaccgcagaacactcctccccgtactcggaagatccaattgaagatccactccagccagatgtgaccggcattcgcctgctgtctcttggcgccggcgaattcaagtcccaagaacacgcaaagcataagggtccaaaggtggaacgagatcaagcagcgaagcatcgatttagctggatgaagctgcttgcacataaggtcgggaggcacttgtcccaagacaccggctctccgtccggtatgcgcccttgggaggaccttccgtcacaagataccggttctccatcgcgaatgaggccttggaaggacccgccgtcagacttgctgcttctcaaacagtcgaattcatcgaagattctcgtgggtagatggcacctggcctccgagaaggggtcatacgaaatcatccaggacactgatgaagatactgcagtcaacaattggcttattagcccacagaatgcatcccgggcatggggcgagtcgacccctttggccaacaaacccggaaagcagagcggacatcctaagtttccaagagtgagacataaatcccttcaagtccggcaagatggggggaagtcgcggctgaagaaaagccagtttctgattaagacgagaaagaagaagaaagaaaagcacacccatcatgcgcctctgtcgccgagaaccttccatcctcttcgttcggaagcctacaacaccttctcggaaaggagactgaaacactcgctggtgctgcataagagcaatgagactagccttcccaccgatctgaatcaaactctgccatcgatggatttcggttggatcgcatcgctcccggatcataaccaaaattcttcaaacgacaccggacaagcctcatgtcctcctggactctaccagactgtccccccggaagagcactaccaaacttttcctattcaagatccagaccaaatgcacagcacctccgacccgtcccatcgttcgagctcacctgaactctcagagatgctggagtacgacaggtcccataagagcttccccactgacatatcgcagatgtccccgagctccgaacatgaagtgtggcagaccgtgatctcgcccgacctgtcgcaagtgacgctgtcgccagaactcagccaaaccaacctctcaccggacctgtcccataccactttgtcaccagaattgatccagcgtaacctgtcgccagcacttggccagatgcccatttcaccagatctgagccataccactctgtctcctgatctcagccataccaccctctccctggatctttctcaaaccaaccttagcccagaactctcacagaccaatctgtcaccggcactggggcaaatgccgctttcgcccgatctctcacacactaccctgagccttgacttttcgcaaaccaacctgtccccagagctgagccatatgaccctcagccctgagctttcacaaaccaatttgtccccagcactcggacagatgccaatatcaccagacctgagtcataccaccctttcgcttgattttagtcaaactaatctctccccggaattgtcgcaaaccaatctctcacctgcactgggccagatgcctctcagccctgatccttctcatactactctgtcgttggatctcagccagaccaacctttcacctgagctgagccagaccaatcttagcccggacttgagcgagatgccgctgtttgctgaccttagccagattccccttacccctgaccttgatcagatgaccttgagccctgatctgggtgaaaccgacctttcccccaactttggacaaatgtccttgtcacctgatctttcgcaggtgaccctgtctccagacattagcgacaccactttgctgcccgatctgtcgcagatttcccctccgccagatctcgatcagatcttttacccttccgaatcttcacaatcgctgcttcttcaggagtttaacgaatcatttccctacccggatcttggccaaatgcctagcccctcgtcgcctactcttaacgacacttttctttcgaaggagttcaacccactcgtcattgtaggactcagcaaggacggaaccgactacattgaaatcattccaaaggaagaagtccaatcctcggaagatgattacgcagaaatagattacgtcccatacgatgatccgtataagactgatgtgcgcactaacattaactcaagcagagatcccgacaacattgccgcatggtaccttcggtccaacaacggaaataggcgaaattactacatagccgccgaggaaataagctgggactactccgagtttgtgcaacgggagacggacatcgaggattcggatgacattcctgaggataccacttacaagaaagtggtgtttcggaagtacctggatagcacgtttaccaaacgggatcccagaggggaatacgaagaacatctgggcatccttggtcctataatcagagcggaagtcgatgacgtgatacaagtgcgctttaagaacctcgcaagccggccctattcgctgcacgcacatggtttgtcgtacgagaagtctagtgaaggaaagacttacgaagatgattcgcctgaatggttcaaagaagataacgcagttcaacccaatagcagctacacttacgtttggcatgcaaccgagaggtctggtcctgagtcacctgggagcgcttgtagggcgtgggcttactactcagcagtcaatcctgagaaggacattcattcgggactgattggtcctcttcttatctgccaaaaaggaatcctccataaggactcgaatatgcctatggatatgagagagttcgttcttctgtttatgacttttgatgaaaagaaatcgtggtactacgagaagaagtcgagatcctcctggcgcctgacttcctccgaaatgaagaagtctcacgagttccacgccattaacgggatgatttactcgcttccaggtctgaaaatgtacgaacaggaatgggtccgtctccaccttctgaatattggtggcagccaggatattcacgtggtccattttcatggacagactctgctggaaaatggaaacaaacaacaccagcttggtgtgtggccacttctcccgggttcattcaagactcttgaaatgaaggcaagcaagcccgggtggtggcttctgaataccgaagtaggtgagaatcagagagcggggatgcagaccccttttctgatcatggatcgtgactgcaggatgccaatgggtctgtccaccgggatcatttccgacagccagattaaagcctctgaattccttggatattgggaaccccgccttgcacgactcaacaatggaggttcatacaacgcctggtcagtggaaaagctcgcagccgaatttgcatctaaaccttggattcaggtcgatatgcaaaaggaggtgattatcactggtatacaaactcagggcgccaaacattatcttaagagctgctataccactgaattctacgttgcgtactcatccaaccagatcaattggcagatattcaaggggaatagcactaggaatgtgatgtatttcaatgggaactccgatgcttcaaccattaaagagaaccagtttgaccctccaattgtggcacgatacattagaatctcaccaacccgggcctataaccgtccaactctgaggctcgagcttcaaggttgtgaggtcaacggatgtagcacccccctgggcatggaaaacgggaagatcgagaacaagcaaattaccgcgtccagcttcaagaaatcatggtggggagattactgggaaccttttagagcacggctcaacgcccagggtcgggtcaatgcatggcaggccaaagcaaataacaacaagcagtggcttgaaatagatcttcttaagataaagaaaatcactgcaatcatcactcaaggttgcaaatcactgtccagcgaaatgtacgtgaagtcttataccattcactactcggagcaaggagtggaatggaagccataccggctgaaatcttcgatggtcgataagatctttgagggaaacaccaacactaaaggacatgttaagaactttttcaaccctcccatcattagcagattcataagagtgattcctaagacttggaaccagtccattgcactgcgtctcgagttgtttggatgcgatatctac

SEQ ID NO: 9086 - DNA, 6672 bp, Artificial Sequence
  Description of Artificial Sequence: Synthetic coding sequence
atgtttcctggttgtccaagattatgggtattagttgttttaggtactagttgggttggatggggtagtcaaggaacagaagcagctcaattaagacaattttatgttgcagcacagggaatttcatggtcatatcgaccagaaccaacaaattcatcattaaatttatcagtaacttcatttaaaaaaattgtttatagagaatacgaaccatatttcaaaaaagaaaaaccacaaagtactatttctgggttacttggacctacattatatgctgaagttggtgatattattaaagtccattttaaaaacaaagccgataaaccattatctatacacccacaaggaattagatatagtaaattatctgagggagctagttatttagatcatactttcccagcagaaaaaatggatgatgccgtcgcacctggtcgtgaatatacttatgaatggtcaattagtgaagatagtggacctactcatgatgatccaccatgtttaacacatatatattattcacatgaaaatttaatcgaagattttaattcaggattaatcggaccattacttatttgtaaaaaaggaacgttaacggaaggtggaactcaaaaaacattcgataaacaaattgttttgctttttgcagtttttgacgaatctaaaagttggtctcaatctagtagtttaatgtatactgttaatggttatgttaatggtactatgccagatattactgtttgtgctcacgatcacattagttggcatttattaggaatgtcttcaggtccagaattattctcaatacatttcaatggacaagtattagaacaaaatcatcataaagtttcagctattacattggtatctgcaacatctaccactgcaaacatgactgttggaccagaaggaaaatggattattagttcattaacacctaaacatttacaagctggtatgcaagcttacattgacataaagaattgtccaaaaaaaacaagaaatttgaagaaaattactagagaacaacgtagacatatgaaaagatgggaatactttattgcagctgaagaagttatttgggactatgctcctgtaattccagctaatatggataaaaaatatagaagtcaacatcttgacaattttagtaatcaaattgggaagcattataaaaaagttatgtatacacaatatgaagatgaatcttttactaaacatacagttaatccaaatatgaaagaagatggaattttgggaccaattataagggctcaagttagagatacacttaaaattgttttcaaaaatatggcatcaagaccatactcaatttatccacatggagtaactttttctccatatgaggatgaagtaaattcatcattcacttctggaagaaacaatactatgataagagctgtacaaccaggagaaacttatacatataaatggaatattttagaatttgatgaaccaacagaaaatgatgctcaatgtttaacaagaccatattattcagatgttgacattatgagagatattgcatctggattaattggacttcttttaatttgtaaaagtcgatcattagatagaagaggtattcaaagagctgcagatatcgagcaacaggcagtttttgcagtttttgatgagaacaagagttggtatttagaagataatattaacaaattctgtgaaaatccagatgaagttaaaagagatgatccaaaattttatgaaagtaatattatgtctactattaacggatatgttcctgaaagtattactactttaggattctgttttgatgatactgtgcaatggcatttttgtagtgtaggaactcaaaacgagatacttactattcatttcactggacattcatttatttatggaaaacgtcatgaagatactttgacgcttttcccaatgagaggtgaatctgtaactgttactatggacaatgtaggaacttggatgcttactagtatgaatagttctccaagatcaaaaaagcttagacttaaatttagagatgttaaatgtatccctgacgatgatgaagattcttatgaaattttcgaacctcctgaatctacagttatggctacaaggaaaatgcatgatagactagaaccagaagatgaagaatcagatgcagattatgattatcaaaatagattagcagctgcattaggaattagatcatttagaaattcttcattaaatcaagaagaagaagaatttaatcttactgcactagcacttgaaaatggaacagaatttgtttcttcaaatacagatattattgttggttctaattattcatctccatcaaacatttcaaagttcactgtaaataatttagcagaaccacaaaaagctccaagtcatcaacaagccactacagctggatcaccattaagacacttaattggtaaaaattcagttcttaactcatcaacagctgagcattcatcaccatattcagaggatccaattgaagatcctttacaaccagatgttactggaattcgtttattatctttaggggctggagaattcaaatcacaagaacatgctaaacataaaggtccaaaggtagaaagagatcaagctgctaaacatagattctcatggatgaagttattagcacataaagtcggtagacacttaagtcaagatactggttcaccatcaggaatgagaccttgggaagacttgccaagtcaagatactggatcacctagtcgtatgagaccatggaaagatccaccaagcgatttattattattaaagcaaagtaatagttctaagattctcgttggaagatggcatcttgcaagtgaaaaaggaagttatgaaataattcaggatacagatgaagatacagcagtaaataattggttaatatcaccacaaaatgctagtagagcatggggtgaatctactccattagcaaataaacctggaaaacaatctggacatccaaaatttccaagagttagacataaatctcttcaagttagacaagacggtggaaaaagtagattaaaaaaatctcaatttttaattaaaacaagaaaaaaaaagaaagaaaaacatacacatcatgctccactttcaccaagaacatttcatccattaagatcagaggcatataatacattttctgaaagaagattaaagcattctcttgttctacataaaagcaacgaaacatctcttccaactgatcttaatcaaacattaccttctatggattttgggtggattgcatcacttccagatcataatcaaaattctagtaatgatacaggacaagcttcatgtcctcctggactttatcaaactgttccaccagaagaacattatcaaacttttccaattcaagatcctgatcaaatgcattcgactagtgatccttctcatcgtagttcatcaccagaattgagtgaaatgcttgaatatgatagatcacacaagtcatttccaactgatatttcacaaatgagtccaagctcagaacatgaagtttggcaaactgttatttctccagatttatcacaagttacattatctccagaactctcacaaacaaatttatctccagatttaagtcatacaactctttctccagaacttattcaaagaaatctttcaccagctttaggacaaatgccaatttcaccagacctttctcatacaactttatcaccagatttaagtcatacaactctttctttagatttgtcacaaactaatctttcacctgaattatcacagactaatttatcacctgcacttggacaaatgccattatcgccagatctatctcatacaaccttaagtttagatttctctcaaactaatttatcaccagaactttcacatatgacactttccccagaattatcacaaacaaatctttcaccagcattaggtcaaatgcctataagtccagatctttctcatacaacattaagtttagatttttcacaaacaaatttatccccagaacttagtcaaacaaatcttagtccagctttaggacaaatgcctttatcaccagatccatcacatacaactcttagtcttgatttaagtcaaactaatttatcaccagaacttagtcaaaccaatctttctccagacttatctgaaatgccattatttgctgatcttagtcaaattccattaactccagaccttgatcaaatgactttatcacctgatttaggtgaaactgatttatccccaaattttgggcaaatgagtctcagccctgatttaagtcaggttacactttctccagatatttcagatacaactcttcttccagacctttctcaaatttctcctccacctgaccttgatcaaattttttacccttcagaatcatctcaatcattattattacaagaatttaatgaatctttcccttatccagatcttggtcaaatgccaagtccaagttctccaacacttaatgacacttttctttcaaaagaatttaatcctcttgtcattgtaggacttagcaaagatggaactgattatattgaaattattccaaaagaagaagttcaatcaagtgaagatgattatgctgaaattgattatgtcccatatgacgatccttataaaacagatgtaagaacaaatattaattcttcaagagacccagataatattgcagcatggtatttaagaagtaataatggtaatagaagaaactattatattgcagcagaagaaatttcatgggattattctgaattcgtacaaagagaaacagatattgaagattctgatgatattcctgaagatacaacatataaaaaagttgtttttcgtaaatatttagattcaacttttacaaaaagagatcctagaggagaatatgaagaacatcttggtattttaggtcctattattagagctgaagttgatgacgttattcaagttagatttaagaatttagcatcaagaccatattcacttcatgctcatggactatcatatgagaaatcatctgaaggaaagacctatgaagacgattcaccagaatggtttaaagaagataacgctgttcaacctaatagttcatatacatatgtttggcacgcaactgaaagaagcggaccagaaagtcctggaagtgcatgtagagcttgggcatattatagtgctgttaacccagaaaaagatattcactcaggacttattggaccattattaatttgtcaaaaaggaatacttcacaaagattctaatatgccaatggatatgagagagttcgttcttttgtttatgactttcgatgaaaaaaaatcatggtattacgaaaaaaaatcacgaagtagttggagattaacttcatcagaaatgaaaaaaagtcatgaattccatgctattaatggaatgatttatagtctacctggattaaagatgtatgaacaagaatgggttagacttcacttattaaatattggaggaagtcaagatattcatgttgttcattttcatggacaaacattattagaaaatggaaataaacaacatcaacttggtgtatggcctttattaccaggatcttttaaaacattggagatgaaagcttcaaaaccaggttggtggctacttaataccgaagttggtgaaaatcaaagagcaggaatgcaaactcctttcttaattatggatagagattgtagaatgcctatgggtcttagtacaggaataattagtgattctcaaataaaggcttctgaatttttaggttattgggagcctagattagctagattaaataatggaggttcttataatgcttggtcagttgaaaaattagctgcagaatttgcatcaaaaccttggattcaagttgatatgcaaaaggaagttattattactgggattcaaacacaaggtgctaaacactatttaaaatcatgttatacaactgaattctatgttgcttattcatcgaatcaaattaattggcaaattttcaagggtaacagtactcgaaatgttatgtatttcaatgggaattcagatgcatcaacaataaaagaaaatcaatttgatccaccaattgttgctcgatatattagaatttctccaacaagagcttataatagaccaactcttcgattagaattacaaggttgtgaggtaaacggatgttcaactcctcttggaatggaaaatggaaaaattgagaataaacaaattacagcatctagtttcaagaaatcatggtggggagattattgggaaccatttcgtgccagacttaatgcacaaggtagagttaacgcttggcaagcaaaagcaaataataataagcaatggttagaaattgatcttttaaaaattaaaaaaattactgctattattactcaagggtgtaagtctttatcaagtgaaatgtatgttaaatcttatacaattcattactcagaacaaggtgttgaatggaaaccatatagacttaaaagttctatggttgataaaatttttgaaggaaatactaatactaaaggacatgttaaaaatttttttaatccaccaattatttcacgatttattagagttattccaaaaacttggaatcaatcaatagcattaagactagaactttttggttgtgatatatat

SEQ ID NO: 9087 - DNA, 6672 bp, Artificial Sequence
  Description of Artificial Sequence: Synthetic coding sequence
atgtttcctggatgcccgcggctctgggtcctggtggtcctgggcacttcgtgggttgggtgggggtcacagggcactgaagccgcccaactgagacagttctacgtggctgcacagggcatctcatggtcataccggccggaaccaactaactcatccctgaatctgtccgtcactagctttaagaaaatcgtgtacagagagtacgaaccctacttcaaaaaagagaagccccagtccactatctccggactgctgggtcctaccctgtacgccgaggtcggagatatcatcaaggttcatttcaagaacaaggccgacaagcctctcagcattcacccacagggaatccggtacagcaagctgtcggaaggagcctcgtacctcgatcatactttcccagctgaaaagatggacgacgccgtggcgccgggacgggagtacacctacgaatggtcaatctcagaggactcaggacctacgcatgacgatcctccttgcctgacccacatctactattcgcacgagaacctcattgaggacttcaattccggattgatcggtccgctgttgatttgcaaaaaggggactctcacggagggcggtacccaaaagacgttcgacaagcagatcgtgctgttgttcgcggtctttgatgaatcgaaaagctggtcgcagtcgtcatcgttgatgtacacggtgaacggttacgtgaacggtaccatgccggacatcaccgtctgcgcgcatgaccatatttcatggcacctgctgggcatgtcctcaggaccggaattgttctcgatccactttaacggccaggtgctggaacagaatcaccataaagtgtcggcgatcactcttgtgtcagccacttcaactactgccaacatgaccgtcggtccggaaggaaagtggattatctcatcgttgactccgaagcacctgcaggccggtatgcaagcctacatcgatatcaaaaactgcccgaagaaaaccagaaacctcaagaaaatcactcgggaacagaggagacatatgaaacggtgggagtacttcatcgccgcggaggaagtaatctgggactacgctcccgtgatcccggcaaatatggacaagaaatacagatctcaacacctggacaatttcagcaatcagatcggcaagcattacaagaaggtgatgtacactcagtacgaagatgagtcgttcactaagcacaccgtgaacccaaacatgaaggaggatggaatcctcggtcctatcatcagggcccaggtgcgcgacacgctcaagatcgttttcaagaacatggcttcgcggccgtactcaatctacccgcacggagtgaccttctccccgtacgaggacgaggtgaattcctcgttcacgtcaggacgaaataacacgatgattcgcgccgtgcagccgggagaaacctacacttacaagtggaacatcctcgagttcgatgagcctactgaaaacgacgcccagtgtctgactagaccgtactacagcgacgtggatatcatgcgcgatatcgcctcaggactgattggactcttgctgatttgtaaatcgagatctctggataggcgcgggatccaaagggcggccgatattgagcaacaagccgtctttgccgtgttcgacgaaaacaaatcgtggtacctcgaggacaacattaacaagttctgcgagaatccggacgaagtcaaaagagatgatccgaagttttacgaaagcaacataatgtcgactatcaacggatatgtcccggagtctatcaccaccctggggttctgcttcgacgatacggtgcaatggcatttttgtagcgtcggaacccagaacgagatcctgactatccatttcaccggccactcctttatctacggtaagcgccacgaagataccctgactctcttccctatgcggggtgagtccgtcaccgtcactatggacaatgtgggcacctggatgctgacttcgatgaactcgtctcctcggtccaagaaactgcgcctcaagtttcgtgatgtgaagtgcatcccagacgatgatgaggactcatacgaaatctttgaacctcctgagagcaccgtgatggcaactaggaagatgcacgatcgtctggagccggaagatgaagagtcggacgcggactacgactaccaaaaccggctggcggcagctctgggaatccgctcattccgcaatagctcgctcaatcaggaagaagaagagtttaacctgacggctctcgcgctcgagaatggaactgagttcgtgtcatccaacaccgacatcatcgtcgggtccaattactcaagcccaagcaacatttccaagttcactgtgaacaatctggcagaaccccaaaaagcgccatcgcatcaacaagcgacgactgccggttcccctctgcggcacctcattggaaaaaactcggtgttgaattcgtcgaccgcggagcactcatccccatacagcgaagatcctatcgaggacccgctgcaaccggacgtcactggaatcaggctgctctcgcttggcgcaggcgagttcaaatcccaggagcatgctaaacacaagggaccgaaggtggagcgagatcaagctgcaaagcacagattctcatggatgaagctgctggctcacaaagtgggacggcacctttcacaggacactggaagcccgtccgggatgcggccatgggaggacctcccatcgcaggatacgggtagcccatctcgtatgcgtccttggaaagatccccccagcgacctgctgctcctcaagcagtcgaacagttcaaagatcctcgtcggacgatggcaccttgcttcagaaaaaggatcctacgagatcatccaggacacggacgaggacaccgctgtcaataactggctgatttcccctcagaatgcctcgcgcgcgtggggagaatcaacccccctggctaacaaacctggaaagcagtcaggccaccccaagttcccgcgggtgcggcataagagcctccaggtccggcaagacggaggaaagtccagactgaagaaatcacagtttctgattaagactcgcaagaaaaagaaggagaaacacacccatcacgcgcccctgagccctcggacctttcacccgctgcggagcgaagcgtataacaccttctcagagcggagacttaagcactctctcgtgctccataagagtaacgaaaccagcctcccaaccgacctgaaccagactctgccctcgatggacttcggatggattgcctcattgcctgaccacaaccaaaactcctccaacgataccggacaagcatcctgcccaccggggctctaccagacggtgccaccggaagaacactaccagactttcccgatccaagacccggaccagatgcacagcacctccgacccgtcgcaccgaagctcaagcccagagttgagcgagatgttggaatatgacaggtcgcataagagcttcccaactgacatctcccagatgtcaccgtcatcagaacatgaggtgtggcaaaccgtcatctccccagacctttcgcaggtcactctttcgccggaattgtcccaaaccaacctttcgcctgatctgtcgcatactacgctgtcgccagaattgatccagcgaaatctgtcgccggcattgggtcagatgcctatctcgcctgatctcagccataccactctgtcaccggacctcagtcatactaccctcagcctggatctgagccaaactaacctctccccagagttgtcacagactaacctgtcgcctgcattgggccagatgcccctgagtccagatctctcgcatacgactctctcgctggacttcagccaaaccaatcttagccccgaactgagccacatgaccttgtcgcctgagcttagccaaacgaacttgtcgcccgcgctgggacagatgcccattagccccgacctgtctcacacgactctctctctcgatttttcacagactaatctgtcgcccgaactgtcccaaactaatctcagcccagccctgggacaaatgccactgagccccgacccatcgcacaccaccctgagccttgacctgtcacagacgaatttgtccccggagctctcccagaccaatctctcgcctgacctctcagagatgccactgttcgcagaccttagccagatcccgctcacccctgatctcgatcaaatgactctgtcgccagacctgggagaaaccgacctgtcgccaaactttggtcaaatgtccctgtcacctgacctttctcaggtgacgctctcgcccgacatctcagataccacgctgctgccagatctgtctcagatttcgccaccaccagatctggaccagatcttctacccttcagagtcctcccagtccctgctgctccaggaattcaatgagtccttcccgtaccccgacctgggccaaatgccctccccgtcgtcccccactctgaatgacactttcctgtccaaagagttcaatcctctcgtcatcgtgggactgtccaaggacggaaccgactacatcgagatcatcccaaaggaagaagtccagtcgtccgaggacgactacgctgagatcgactacgttccctacgacgacccttacaagaccgatgtgcggactaacatcaactcatcccgggatccggacaatattgcggcctggtacctgcggtcaaacaatggaaatcggagaaattactacatcgccgcagaagaaatctcgtgggactactcggagttcgtgcagcgggagacggatatcgaggactcagacgacatcccggaagatactacttacaaaaaggtggtgtttagaaagtatctcgatagcactttcaccaaacgcgacccgagaggagagtacgaagagcacctgggaatcctcggaccaatcatccgcgccgaagtggatgatgtgattcaagtgcgctttaagaacctggcgtcgcggccctattcgctgcatgcccatggcctgagctacgagaaatcctcggagggaaagacctacgaggatgactccccggaatggttcaaggaggacaacgccgtccagcctaactcgtcctatacttacgtgtggcatgcaactgaacggtcaggaccggagagcccgggatcggcctgcagggcgtgggcttactactccgccgtcaaccctgaaaaggatattcacagcggactgatcggaccgcttctcatttgccaaaagggaattctgcacaaagattcgaacatgcctatggacatgcgcgaatttgtgctgctgttcatgacctttgacgagaaaaagtcttggtattacgagaagaagtcgcggtcctcctggcgccttacttccagcgaaatgaaaaagtcccatgaattccacgccatcaacggcatgatctacagcctgccgggtctgaaaatgtacgaacaggaatgggtccgcctccacctgctgaacatcgggggatcccaggacatccacgtggtccacttccatggtcaaactctgctggaaaacggaaacaaacagcatcagttgggcgtgtggcccctgctcccaggctccttcaagaccctggaaatgaaggcctccaagccgggatggtggctgcttaatactgaagtgggagagaaccagagagccggaatgcagactcctttcctcatcatggaccgggactgccgcatgccgatgggactgtcgaccggaatcatctccgattcccagattaaggcgtcagaattcctcggctattgggaaccccgcctggccagactgaataatggtggctcctacaatgcctggtccgtggagaagttggcagccgaattcgcatcgaagccgtggatacaggtcgacatgcagaaggaagtgatcattaccggtatccagacccaaggcgccaagcactacttgaagtcatgctacaccaccgagttttacgtggcctacagtagcaaccagattaactggcaaatcttcaaagggaatagcactagaaacgtgatgtacttcaacggaaactccgacgcctcaaccatcaaggaaaatcagtttgatccgcctatcgtcgctagatacattcgcatctccccgactcgggcatacaaccggcccactctgcggctggagctccaaggttgcgaggtgaacgggtgcagcacgccactgggtatggaaaatggaaagatcgaaaacaaacagattactgcgtccagcttcaagaagagctggtggggtgattattgggaacctttccgcgcgcggcttaacgcgcagggccgcgtgaacgcctggcaggccaaagctaataacaacaagcagtggctcgaaattgacctgctgaagattaagaagatcacggctattatcacccaggggtgcaagtcgttgagctctgaaatgtacgtgaagtcgtacactatccattacagcgaacaaggcgtggaatggaaaccataccggctcaaatcgtccatggtggataagattttcgagggaaacactaacaccaaaggacatgtaaagaacttcttcaatccgccaatcatttcaagatttatccgcgtgattcctaagacttggaaccagtctatcgcgctccgccttgaactcttcggatgcgacatctac

SEQ ID NO: 9088 - DNA, 6672 bp, Artificial Sequence
  Description of Artificial Sequence: Synthetic coding sequence
atgtttccaggctgtccgcgtctgtgggtcctggtggtccttggaacctcctgggttggatggggatcccaaggtactgaagcagcacaactcagacagttttatgtggctgcccaaggtatttcctggagctacagaccagaacctaccaatagctcgctgaacctgtccgtgacctcctttaagaagattgtgtaccgggagtacgagccatacttcaagaaagaaaagcctcagtccaccatttccggactgttgggtcccactctctacgcagaagtgggtgatatcataaaagtgcacttcaagaataaggcagataagcccctgtcgatccacccccaaggcattcgttacagcaagttgtcggaaggtgcctcctacctcgatcacacttttcccgcggaaaagatggatgacgctgtagccccaggaagagaatacacttacgaatggagcatttctgaagatagcggacctacgcacgatgaccccccttgtctgactcacatatactactcgcatgaaaaccttattgaggacttcaattcggggctgataggccctctcctgatctgtaagaaaggcaccctgacggagggtggtacgcagaaaaccttcgataaacaaattgtgcttctgtttgcagtgttcgacgaaagcaagtcgtggagccagagttcaagcctcatgtacactgtgaatggttacgtgaatggaacgatgcccgatatcactgtgtgtgcccacgatcacatctcgtggcacctgcttgggatgtcctccggacctgaactgttttcgatccactttaatggacaagttctggaacaaaatcatcacaaggttagcgcaatcactcttgtctccgcaacctcaacgaccgctaatatgactgtgggacccgaaggtaaatggatcataagctccctcaccccaaagcacctccaggctgggatgcaggcgtacattgatatcaaaaactgtccaaaaaagactcgaaatctgaagaagataacgcgcgagcaacgcagacacatgaagagatgggaatactttatcgctgcagaagaggtcatctgggattacgcgccagtgattcctgcaaatatggacaagaagtaccgatcccagcatctggataacttttctaaccaaatcggaaaacactataagaaggttatgtacactcaatacgaggacgagtcgttcactaagcataccgtgaatccaaatatgaaggaagatggcatcctgggtcccattatcagagcacaagtcagagacacccttaagattgttttcaagaatatggccagcaggccatactcaatttaccctcatggagtgactttttctccgtacgaagatgaagtcaattcctcatttacctcaggccgcaacaatactatgattcgcgcggtccagccgggagaaacttacacctacaagtggaatattctggaattcgatgagcccaccgaaaacgacgcccaatgccttaccaggccgtattacagcgatgtggacattatgcgagacatcgcaagtggccttatcggcctccttctcatttgtaagtcccgttcgctggatagacgtggtattcaacgcgcggcagatattgaacaacaggcagtgttcgcagtctttgatgagaacaaatcgtggtatctggaagataacattaacaaattctgtgaaaatcctgacgaagtgaagcgagacgaccctaagttttacgaatccaacattatgagcaccatcaatggatacgtgccggaatccattacgactctcggtttttgttttgatgacactgtgcagtggcacttttgtagcgtggggacgcaaaatgaaatactgactatccacttcaccggtcattcatttatctacggcaagcggcatgaggacactcttaccctcttcccaatgcgaggagagtccgtgactgtcactatggataatgtagggacctggatgctgacctccatgaactcatcgccccgctcgaagaaacttagactgaaatttcgggatgtgaagtgtataccagatgatgacgaggatagctatgagattttcgagccacccgaatcaaccgtcatggcaactagaaagatgcatgataggcttgagcctgaggacgaagaatctgacgcagactacgattaccagaaccgcttggcagcagcacttggaatccgctcttttcgtaactcgtcactgaaccaggaagaggaggagttcaaccttacggctcttgcacttgagaatggtaccgaattcgtgtcatcaaataccgacattatcgtgggtagcaactactcgtcaccaagcaatatctcaaagtttacggtcaataatctcgccgaacctcaaaaagcgccttcgcatcagcaggcaacgactgccgggagcccactgcgccacctcattggaaagaatagcgtcctgaatagctcgaccgcagaacactcctcgccttactccgaggatccaatcgaggacccccttcaaccggatgtgaccggcatacggcttttgagcctgggagcaggggagttcaaatcccaagaacatgcgaagcacaagggacccaaggtggaaagagatcaagccgctaaacacagattttcctggatgaaacttctggctcataaagtcggacgtcacctgagccaagataccggcagcccttccgggatgcggccctgggaggaccttccttcgcaggatactgggtcaccctcgaggatgcgtccttggaaggatcctccttccgatcttcttctgctgaagcagtcgaactcgtccaagattctggtcgggagatggcacctggcatcagagaaaggatcctacgagattattcaggataccgacgaagataccgcagtgaataactggctgatctcgcctcagaatgcctcgcgggcctggggagagagcactccgctggctaataagccaggtaagcaaagcggacatcctaagtttccaagagtgagacataagtcccttcaggtgcgacaggatggggggaagagtagacttaagaaatcccaattcttgattaagacccgcaagaagaaaaaggaaaagcacactcaccatgcacctctgtcgccacgaaccttccatccactgagatccgaggcatacaatacttttagcgaaagacggctgaaacattcacttgtcctccacaagtccaacgaaacctcgctccctactgatctcaaccaaacccttccttccatggatttcggatggattgcctcgcttcctgatcataatcaaaactcttcaaacgataccggccaagcgtcgtgtcctcctggcctctaccagaccgtgcctccggaagaacactaccagacctttccaattcaagacccagaccagatgcattccacttccgacccttcccacagatcctccagcccagaactctcagagatgctcgagtacgatagaagccacaaatcattccccaccgatatcagccagatgagtccttcctcagaacatgaagtctggcagactgtgatcagccctgacctttcacaagtcacgctctcgccagaactgtcgcagacgaacctcagccccgatcttagccatactaccctctcgccagagcttatacaaagaaatctctcgcccgcattgggacaaatgccaatttcgccagacctgtcgcataccaccctgtcacccgacctgtcgcacactaccctgtcgctggacctctcgcaaactaatctgtcccctgaactgagtcaaactaacttgtccccagcgcttggccagatgcctctcagcccagatctctcccataccaccttgtccctcgatttttcgcaaacgaacctctccccagagctgtcgcacatgactctcagccctgaactttcccagacgaacctgtcgcccgcacttggccaaatgcctatctcacctgacctgtctcacaccaccctgtcgctcgacttttctcagaccaacttgagccctgaactgtcacaaactaatctttcccctgcgctggggcagatgcccctttccccagatcctagccacaccactttgtcgctcgacctttcacagaccaacctgtcgcctgaactctcacaaaccaacttgtcgcccgatctgtcagagatgccattgttcgcagatctttcccaaattccacttacccctgacctggatcaaatgacccttagccctgatctgggagaaaccgatctgtcgcctaactttgggcaaatgagcctcagtcctgatcttagccaagtcaccttgtctcctgacatttcggatacgactctgctgcctgacttgagccaaatttcgccaccaccagaccttgaccagatattctatccttcggaaagctcccagtcgctcctgcttcaagagtttaacgagtcctttccttaccccgatctgggacagatgccttcgccatcgtcaccaactctgaacgatacttttttgtccaaggaattcaacccactggtcattgtcggtctgagcaaagacggaaccgactacatcgaaatcattccgaaagaagaagtgcaatcgagcgaggatgattatgctgagattgactacgtgccttacgacgatccctacaagacggatgtgcggaccaacataaactcctcacgtgaccctgacaacattgctgcatggtacctgcgatcaaacaacggaaatcggcgaaactactacattgcggcagaggaaataagctgggactactcggagttcgtgcaacgggaaactgatattgaagattcggatgatattcctgaagatactacctacaagaaagtggtgttcagaaaatacctggactcaacttttaccaagcgggatccccggggtgagtatgaagaacaccttggaattctgggtccaataatccgcgcagaagtggatgatgtgatccaagtcaggtttaagaacctggcatcacgaccttactcacttcatgcacatggtctgtcctacgaaaagtcctccgagggaaagacctacgaagatgattcgccagaatggttcaaagaggacaacgcagtgcaacccaacagcagctatacctacgtctggcacgctaccgaacggagcggaccagaatcccctggttcagcatgtcgagcttgggcatattactccgctgtgaaccctgaaaaggatattcattccggacttatcggacctctcctcatatgtcagaagggaattcttcacaaggattccaatatgcctatggatatgcgggaatttgtgctccttttcatgacttttgacgaaaagaagagctggtactacgaaaagaagtccagatcgtcttggaggcttacctcctcagagatgaagaaatcgcacgaatttcatgcaataaacggcatgatttactcccttcccggtctgaagatgtacgaacaagaatgggtcagactgcatctgctgaatatcggggggagccaagatatccacgtcgtccattttcatggtcagacccttctggagaatggtaataagcaacaccagcttggagtgtggcctctcctcccgggcagcttcaaaaccttggaaatgaaggcatcaaagcccggatggtggctccttaacactgaagtgggagagaaccaacgagcaggaatgcagacgccattcctcattatggatcgagattgtaggatgccgatgggactgtccaccggtattatctccgactcccagattaaggccagcgagtttcttggttattgggaaccaaggcttgctaggttgaataacggaggttcgtacaatgcatggtcagtcgagaagctggcggccgagtttgcatcgaagccatggattcaagtggatatgcaaaaagaagtgatcattacgggaatccaaacccaaggcgccaagcattacctgaaatcgtgttacacgaccgagttctacgtggcgtactccagcaaccagattaactggcagatctttaaaggtaactccactcgcaacgtgatgtactttaacgggaactccgacgcatccaccattaaggagaaccagtttgaccctcctattgttgcaagatacatacgcatctcccctacccgcgcttacaatcggccaaccctccgtctggaactccaaggctgtgaggtgaatggttgctcaactcctctgggcatggaaaatggaaagatagagaacaagcaaattaccgcatccagcttcaagaaatcctggtggggtgattactgggagccattccgcgccaggctgaacgcccaagggagagtgaatgcgtggcaagcgaaggccaacaacaacaagcagtggctggaaattgatcttttgaaaatcaaaaagattaccgcaatcattacccaagggtgtaagagcctgtcatccgaaatgtacgtgaaatcttacaccattcattactcggaacaaggggtggaatggaaaccataccgcctgaagagctcgatggtggacaagattttcgaagggaacactaacactaaggggcacgtgaaaaacttctttaatcctccaatcatctctcgtttcattcgtgtcatacccaagacctggaaccaatcaatcgcgcttcgcctcgagctttttggatgcgacatctac

SEQ ID NO: 9089 - DNA, 6672 bp, Artificial Sequence
  Description of Artificial Sequence: Synthetic coding sequence
atgttcccgggatgtccccgtttgtgggtcctcgtagtccttggaacctcatgggtcggttggggatcccaaggaacagaggccgcacagctgaggcagttttatgttgctgctcaaggaatctcgtggagctatcgtccagaacctacaaattcgtccctgaacctcagcgtcacttcgttcaaaaagatcgtttaccgagaatatgaaccctattttaaaaaggaaaagcctcagtctaccatctccggtctattgggtccaaccctatatgccgaagtgggggatataatcaaagtgcacttcaagaataaggcggataaacctttgtcgattcacccacaaggaatacgttattctaagctgagcgaaggagcatcgtacctcgatcacacattccccgctgagaagatggatgatgccgttgccccaggtcgcgagtacacttatgaatggagtataagtgaggattctggaccaacccacgacgatccgccgtgtttgacccatatctactacagtcatgagaatctgattgaggattttaacagtggcctcataggtcctcttctgatttgcaaaaaaggtactttgacggagggaggaactcagaaaactttcgataaacagatcgtcctcctttttgccgtctttgacgaaagcaagtcttggagccaaagctccagcctaatgtatactgtcaacggatacgtcaatggtactatgcctgacattaccgtttgcgcgcatgatcacatctcttggcatctcctaggcatgtcgtcaggtcccgagctgtttagcattcatttcaatggacaggtccttgagcaaaaccaccataaggtctctgccattacccttgttagcgcgacttccaccaccgcaaacatgactgtcggtccggagggcaagtggataatcagttcactcacacccaaacacctccaggccggcatgcaggcgtacatcgatattaagaactgcccgaaaaaaacacgaaaccttaagaaaatcacgcgtgaacagcgacgacatatgaagagatgggaatatttcatcgccgctgaggaagttatctgggattacgctccggtcattcctgcaaatatggacaagaagtaccgttcccagcatttagataacttctcaaatcagatcggaaagcactataaaaaagtcatgtacactcagtacgaggatgaatctttcactaaacatacggtgaatccaaacatgaaggaagatggcatactaggtccaatcatcagagcgcaggtccgcgacacgctcaagattgtcttcaagaatatggcctcaagaccttatagtatctaccctcatggtgtgactttctcgccttacgaggacgaagtgaactcaagtttcacatctgggagaaataatacaatgatccgagctgtgcaacctggggagacatacacctataagtggaacatactcgagttcgacgagcctacagagaacgatgcccaatgtttaacacgaccatattattccgacgtcgacattatgcgcgacatcgcatctggtcttattggcctgctgctcatctgtaaatcgcgcagtctcgaccgaagaggaatccagcgcgctgccgacatagagcagcaggcagtgttcgcggtcttcgacgagaacaagagttggtacctggaggataacattaacaaattttgcgagaacccggatgaggttaagagagacgatcccaaattctatgagtccaatatcatgtctacgatcaacggttacgtccctgagtccatcaccactctcggcttctgcttcgatgatactgtgcaatggcacttctgcagcgtggggacacaaaacgagatactaaccatccattttacaggacattccttcatctatggcaagaggcacgaagacacgctcactctttttcccatgcggggggaatctgttacggtcactatggataacgttggaacatggatgctgacgtccatgaattcgtcgccgcgatctaagaagcttcgacttaagtttcgggacgtcaagtgtatcccagatgacgatgaggacagttatgagatctttgagcccccggagtccacagtgatggccacaagaaagatgcacgataggctggagccggaggatgaggagtctgacgctgattacgattaccagaacaggctcgccgcggccttaggaatacggtcgttccggaactcctcgttgaatcaagaggaggaggagtttaatctcacggccctcgcccttgagaacggcacggagttcgtgagctcgaacactgatatcatagtggggagcaactacagctcaccctctaatatctccaaattcacggtaaataacctcgctgaacctcagaaggcgccttcgcatcagcaggccaccaccgcaggtagtccgctcaggcacctcatcggcaaaaattctgtcttgaatagctccaccgctgagcatagctctccgtattccgaagacccgattgaagatccgcttcaaccagatgttactggtatacgattgctgtcgctgggcgctggtgagtttaagtcgcaggaacacgccaaacataaaggaccaaaggttgaaagggatcaggctgctaagcataggttttcctggatgaagcttctcgcgcacaaagtcgggcgccatctctctcaggatacgggttcaccatcaggtatgagaccgtgggaggaccttccatcgcaggacacagggtccccttcccgcatgcgtccctggaaggatccgccgtcagatctcctgcttctgaaacaaagcaattcctcgaagatcttggtgggccgctggcaccttgcgagcgagaaaggctcctacgaaatcatacaggacaccgacgaggatactgcagttaacaattggctaatttcgcctcaaaatgcaagtcgggcttggggagagtcgactcctctggccaacaagcccggtaaacagtccgggcatccgaaattcccacgggttcgacataaatctctccaggtgcggcaggacggagggaagtcccgactaaagaagtctcagttccttatcaaaactcgcaagaaaaaaaaggagaaacatacgcaccatgctccgcttagtccgagaacctttcatcctcttcgctctgaggcttataatacattttcggagcggcgcctgaagcattctctagtgttgcataaatccaatgaaacctccttgcccaccgacttgaaccaaacacttccttcgatggactttgggtggatcgccagtctccccgatcataatcagaattcgtcgaatgataccggccaggcatcctgtcctcctggcctgtatcaaaccgtgccacctgaagagcactaccaaacgttcccaatacaagaccccgaccagatgcattccacatccgatccgtcgcacagatcgtcttccccagagctctcggaaatgctcgagtatgatcggagccacaagtctttccccacggacatctcgcaaatgtctccctcgtccgaacacgaggtgtggcagactgtaatcagcccagatctctcacaggttaccctatcgccggagctgtcacagaccaacctatccccggatctgtcccacacgacacttagcccggaactgatacagcgcaacctctcacctgcgttgggtcaaatgcccattagtcccgatttgtcacacactaccctaagccccgatctatcccatacgacattaagtctagacctttcccagactaacctgtcgccggagttgtcccagaccaaccttagcccggctcttgggcagatgcccctttctccagatctgtctcatacaacgctgtcactggatttttcgcaaaccaatctctcgccggagttgtctcatatgaccctttcacctgaactctctcagacaaatctgtcacccgctttgggtcaaatgccaatctcgcctgatctatcccacaccacactaagtcttgacttctcccagaccaatctgtccccggagctttctcaaactaacctgagtccggcactgggtcaaatgcctttgagtcccgacccaagtcataccacactgagtctggacctgtcgcagactaatctttctcccgagctatcccaaaccaatttgagtcccgacctttccgagatgcccctcttcgctgatctttcacagatccctctgactcctgacctcgaccagatgaccctttctcctgatctcggcgaaacggacttgtctccaaacttcggtcagatgtcgttgagtcctgatctgtcccaagtcactctttccccagatatctccgatacaaccttacttccagatctctcgcagatttcacccccacctgatctggaccagattttctatccgagtgagtcatcccagtcactgcttttgcaggaattcaatgaatcttttccctatcctgatctcggacaaatgccgtctccgagcagccctacactgaacgacacctttctttccaaggaattcaacccactagtcatagtgggcttatcgaaagacggcacggattacatagagattattccgaaagaggaagtgcagtcgtcggaggatgactacgctgagattgattacgttccttatgatgatccgtataagacggatgtccggactaatataaactcctcgagagaccctgacaacatcgcagcctggtacctccggtcgaacaacggcaatcggcgtaactattatattgcggcagaagagatttcctgggactattccgagtttgttcaacgagaaaccgacatcgaagacagcgatgacatcccggaagataccacgtacaagaaggtggtatttcgcaagtacctcgactcgacctttactaagcgtgatccccgtggcgaatacgaagaacacctcggaatcctcgggccgatcatcagggccgaagtggacgacgtcatccaagtacggtttaaaaacttggcgtctcgtccttatagcctccacgctcacggcctttcttacgagaagtcttcagaaggaaagacgtacgaagatgattcgcctgagtggtttaaggaagataacgccgtgcagccgaactcctcgtacacatatgtttggcacgctacggagagaagtggccccgagagtccgggctccgcctgccgcgcttgggcgtactatagtgcggtcaacccggaaaaggatatccattccggtcttatcggcccgctcctgatctgtcagaagggaattttgcataaagactcaaatatgccgatggacatgcgagagtttgtgctcctattcatgaccttcgacgaaaaaaagtcctggtattacgaaaaaaaatctcgttcttcctggcgccttacctctagcgagatgaaaaaatcacacgagtttcacgccattaacggaatgatttattcgttacccggacttaaaatgtatgagcaagagtgggtcaggttgcatcttctgaacataggtgggtcacaagatattcacgtcgtacacttccatgggcagactttgctcgaaaatggcaacaagcagcatcaattgggcgtttggccgctccttccaggtagcttcaaaacactggagatgaaggcttcaaagcccggatggtggctcctcaatacagaagtcggtgaaaaccaacgcgctggtatgcaaacgccttttctcattatggatagagactgcagaatgcccatgggactcagtaccgggatcatcagcgatagccagatcaaggccagtgagtttcttggatactgggagccacgacttgcccgcttaaacaatggcggcagttacaatgcttggtccgtggagaagctggccgctgaatttgcgtcgaaaccctggattcaggtcgacatgcagaaagaggtcattataaccgggatccaaactcagggcgctaagcactatttgaaatcctgttatactaccgaattctatgtcgcttactcaagtaaccagattaactggcaaatcttcaaggggaatagtacacgaaacgtgatgtacttcaatgggaactccgacgcatccacgatcaaagaaaaccaattcgatccccccatcgtcgcccgttacatcaggatttctcctactcgtgcttacaacaggcccactcttcgcctagaactccaggggtgtgaggtgaacggctgcagtacacctttgggcatggagaatggcaaaatagagaataaacaaatcactgcgtcgtcttttaagaaatcatggtggggggactattgggagccgttcagagcacgcctaaacgcgcagggccgggtcaacgcttggcaggcgaaagcgaacaacaataaacaatggctggagatcgacttgcttaaaattaagaaaatcacagctatcattacccagggctgtaagtctttaagcagtgagatgtacgttaagtcatacacaatccattactctgaacaaggtgtcgaatggaaaccctaccgactgaagtcgtctatggtcgataaaatctttgaggggaacacaaacacgaaagggcatgttaagaattttttcaatcctccgatcatctctcgttttatacgtgtaatcccgaagacctggaaccagtcaatcgcattgaggttggagctcttcggatgtgacatatac

SEQ ID NO: 9090 - DNA, 6672 bp, Artificial Sequence
  Description of Artificial Sequence: Synthetic coding sequence
atgttccctggttgccctcgtctctgggtgcttgtagtgctcggcactagctgggtgggctggggatctcagggcaccgaggccgcccagctccgtcagttctacgtggctgctcagggaatctcctggtcttaccggccagagccaaccaatagcagtttgaatctctccgtcaccagctttaaaaaaatcgtgtaccgggagtatgagccatacttcaaaaaagagaagccccagtccacaatttctgggctgttgggtcctaccctgtacgccgaagtcggagacatcattaaggttcactttaaaaataaggccgataaaccacttagcatccatccacagggcatacggtactcaaaactctccgaaggagcttcttatctggaccacacattccctgccgagaaaatggacgacgctgtggcccctgggagggaatatacgtatgagtggtctatctcggaagactctggacctacccatgacgacccaccatgcttgacgcatatatactactctcacgaaaacctgatcgaggatttcaacagcggcctgattggtcccctactgatctgtaagaagggcactctgactgaaggagggacccagaaaactttcgacaaacagatcgtcctgctttttgcagtcttcgatgaatccaagagctggagtcagagctcttcactgatgtacactgtaaacggttacgtcaacggcaccatgcccgacattaccgtctgcgcccacgatcacattagttggcacctgttgggtatgtcttcagggccagagctcttttcgattcatttcaatggccaggtcttggaacagaatcaccacaaggtttcagcaataactctcgtgtctgcaaccagcaccactgccaatatgaccgtgggcccggaaggaaagtggatcatctcctccctcaccccaaaacacttgcaggcaggcatgcaggcctatattgatatcaagaattgccctaagaagacacggaacctgaagaagatcaccagagagcagcgacggcatatgaaaaggtgggagtacttcatcgctgccgaggaagtgatctgggactatgcccccgtcattccagctaacatggacaagaaatacagatcccagcacctggacaatttctcgaatcagattggaaagcattataaaaaagtcatgtacacacagtacgaggacgagtcattcactaaacacacggttaaccctaacatgaaggaagatggcatcctgggacccatcatccgtgcgcaggtccgcgacacacttaagatcgtttttaagaatatggctagccggccctattcaatctacccacacggtgtcacattcagcccttacgaggatgaagtgaattcatcgttcacaagcggccgaaacaacaccatgatccgcgcagtgcagccgggagaaacctatacatataagtggaacatactagagttcgatgagccaacagagaacgatgctcagtgccttacgcgcccttactactctgatgtcgacattatgcgcgacatcgcttccggcctgatcggcctgctccttatttgcaagagcaggtccctcgaccgtaggggtattcaacgggctgccgatattgagcagcaggccgttttcgccgttttcgacgagaacaaatcctggtacctggaagacaatatcaataagttttgcgaaaacccagatgaggtaaagcgagatgaccccaaattttacgaaagcaatattatgtccactataaatggctacgttcctgaatccattactacgcttgggttttgttttgacgacactgtgcagtggcatttttgcagcgtgggtacacaaaacgagatcctgacaattcattttactggacactcctttatttatggcaaacggcacgaggatacactcacactcttccccatgagaggcgaatccgtcaccgttacgatggacaacgttggaacgtggatgctcacatccatgaattcaagtccaaggtccaaaaagctacgcctaaagtttcgagacgtgaagtgcatccctgacgatgatgaggactcatatgaaattttcgagcctcccgagagcactgtgatggccacccgaaagatgcacgatcggctcgagcctgaggacgaggaatctgatgctgattatgattatcaaaacagactggcggccgccctagggatccgatcttttcggaacagctcattgaaccaagaagaagaagaattcaacctgacagccctggcccttgaaaacggcaccgaatttgtaagctcgaacactgatattatcgttgggagcaattactccagcccctctaacatctccaagttcaccgttaacaatcttgcagaaccgcagaaagctccatcccatcagcaggcaacgaccgccgggtccccgctgaggcacctaattggtaagaacagtgtcttgaactcgtccactgcagaacactcctccccctacagcgaggaccccattgaggaccccctccagcccgacgtcaccggcattcgtcttctgtcactcggggccggagaattcaaatcgcaagaacatgccaaacataagggaccgaaagtggagcgtgatcaggccgccaagcatagattcagctggatgaaattgctggctcataaagtgggccggcatcttagccaggacaccggttcaccctcaggtatgcggccatgggaggacctgccaagccaggacacaggatctccaagccgcatgagaccttggaaggatccaccatccgacctcctactcctaaagcagagtaactcctccaagatcttggtaggacgatggcaccttgcttcagagaaaggatcttatgagattatacaggacactgatgaggacactgccgtgaacaattggcttatcagcccacaaaacgccagtcgcgcctggggcgaaagcacccccctggccaataagccgggcaaacagtccggacaccctaaatttcctcgcgtccgccacaagtcgctgcaagtgcgccaggacggtggcaaaagcaggctgaagaaaagccagtttttgattaagactcgtaagaagaagaaggagaagcacacccaccacgctcccttgagccctcggactttccacccactgagatctgaagcatataatactttttctgaacgccgcctgaagcattctctcgttcttcacaagagcaacgaaaccagtcttccgaccgatctcaaccagacactgcccagcatggatttcgggtggatcgcctcactgccagatcacaaccaaaactcatcaaacgatacgggccaggcctcctgcccacctggactgtatcaaacggtccccccggaagagcactaccagacatttccaatccaggaccccgaccaaatgcacagtacctcagatccctctcatcgatctagctcgccggagctcagtgagatgctcgaatacgacaggtcccacaagtccttccctacggatatttctcagatgtccccctcgtctgagcatgaagtctggcagaccgtgatttctcctgacctttcacaggtgactctgagccctgagttgtcccaaacaaacctaagcccggacttgtctcatactaccctgtcaccggagctaatccagcgcaaccttagtcccgcactcggtcagatgcccatctctcccgatctcagccatacaacgctctcgcccgacttgagccatacaaccctatccctggacttgagccagacgaacctgagtccagagctttctcaaactaacttgagcccggctctgggacagatgccactcagtcccgacctttcgcacaccactctaagcctcgatttttcccaaaccaatctcagtccggaactgtcacacatgacattgtctcctgaactaagccagactaatctgtcacctgccctcggccagatgccaattagccccgacctttcccacaccactttgtcccttgactttagtcagaccaatctgagtccagagctgtcacagacaaatctatcccccgcacttgggcagatgccgctgagtcccgacccttcacacactactctgagcctagacctgagccagacaaatctgagccccgagttatctcagacaaacctgtctcccgacctgtcagagatgcccttgtttgccgacctgtctcaaatcccgttgacccccgacctggaccaaatgactctgtctccggatctgggcgagaccgatctgagccctaacttcggccaaatgtcactttcccccgacctctcacaggtaacactctcccccgatatatccgataccaccctgctgcccgacttgagccagatttcccctccacccgaccttgatcagatattttatccaagtgagtcatcccagtcactcctacttcaggagttcaatgaaagtttcccctatcccgacttggggcagatgccatccccaagttcacccacgctgaatgataccttcctctcaaaggagtttaacccgcttgtgatcgtggggctttccaaggatggcaccgattacattgaaatcatccctaaggaggaggtgcagtcctctgaggatgattatgcagagatcgactacgtgccttatgacgacccttataaaaccgatgtgagaactaacataaactcgtccagggatcccgacaacatcgctgcctggtacctgaggtccaacaatggcaatcgccggaattactatattgctgccgaggaaatcagctgggactatagcgagttcgtgcagagggagacagatattgaagattccgacgacatccctgaagacaccacttataagaaagtcgttttcagaaaatatctggattccacctttactaaacgagatccgagaggtgaatatgaggaacaccttggcatcctgggtcctatcatacgcgcggaagtcgatgacgtaatccaagtccggttcaaaaacctggcttctcggccgtatagtctccacgctcatgggctgtcttacgagaaaagtagcgaaggaaagacctacgaggatgacagccccgagtggttcaaagaagacaacgcggtgcaacccaactcctcttacacctatgtctggcacgcaaccgagcgatctggtccagaaagtcctgggtccgcctgtcgggcctgggcctactacagcgccgtcaatccagagaaggacatacattcaggcctgatcgggcccttactgatttgtcaaaaggggatcctgcacaaggactcaaatatgcccatggatatgcgggagtttgtattgctgttcatgacgtttgacgaaaagaaaagttggtactatgaaaagaaaagccgatcgagttggcgcctgaccagttccgaaatgaagaagagccatgagttccacgcaatcaacggaatgatctactcacttccgggcctgaagatgtacgagcaggagtgggtgcggctgcatcttctcaatatcggagggtcccaggatattcatgtagttcattttcacggacaaacacttctcgagaacgggaacaagcaacaccagctgggcgtgtggcccctcctgccgggcagtttcaagaccctggaaatgaaggctagtaagccagggtggtggctgcttaacaccgaggtgggggagaatcagagggctgggatgcagaccccttttctgattatggatcgggattgccgcatgccaatggggctgtctacaggcatcatcagcgatagtcagatcaaagcatccgagtttctgggttactgggagccaaggctcgcaagactgaacaatggaggcagttataacgcctggtccgttgagaagttggcagctgaattcgcgtccaagccttggattcaagtcgatatgcagaaagaagtcatcatcaccggcattcagacacagggagccaagcactatcttaaatcctgttatactactgaattttacgttgcctactcctcaaaccaaattaactggcaaatctttaagggaaacagtactcggaacgtaatgtacttcaatgggaactctgacgcatccacgatcaaggagaatcagttcgacccacccatagtggcacggtacatacgtatcagcccaacccgcgcttataatcggcctacccttcgcctggaactccagggctgcgaagttaacgggtgctcaactccactgggtatggaaaatggaaaaatagaaaacaagcagattacagccagttcgttcaagaagtcctggtggggggattactgggagcccttcagagcccgactgaatgcccagggaagggtcaatgcctggcaggccaaggcaaacaacaacaagcagtggctggagattgacctgctgaagattaagaagataaccgcgattattacacagggctgcaagtcactgtcctccgagatgtatgttaaatcttatacgatacactatagcgaacagggtgtcgagtggaagccctatagactcaaaagctccatggtggacaagatattcgagggaaacaccaacacaaaggggcatgtaaaaaacttttttaatcctcctatcatctcacggttcattcgtgtaattcctaaaacgtggaaccagtcaatcgctctccgcctggagttgttcggctgcgatatctac

SEQ ID NO: 9091 - DNA, 6672 bp, Artificial Sequence
  Description of Artificial Sequence: Synthetic coding sequence
atgttccctgggtgccctcggttgtgggttctggtcgtcctggggacctcctgggtgggctggggctctcagggtactgaggccgcccagcttcggcaattctatgttgcagcccaagggatcagctggagttaccgccctgaacctaccaactctagcctgaacctgtctgtcacttcattcaaaaagatagtgtatcgagaatatgagccctactttaagaaggagaagccgcagtccacaatatcagggctcctgggacccactttgtatgccgaggtgggcgatatcatcaaggtgcactttaagaacaaagctgataaaccactgagcatccacccccagggaatccgttattctaaactgtccgagggggcctcctatctggatcataccttccccgcagagaagatggatgatgctgtcgctcccgggcgcgaatacacatacgagtggtccatcagcgaagactcagggcctacgcacgacgatccaccgtgcctgacccacatatattacagccacgagaatttgattgaagatttcaactccgggctgatagggccgctgctgatctgcaagaaaggcacattgaccgaggggggcactcagaaaactttcgacaagcagattgtgttgctgttcgcagtctttgatgagtcaaagtcttggtcccaatcaagtagcctcatgtataccgtgaatggctacgtgaacggaacgatgcccgatatcaccgtgtgcgctcatgatcacattagttggcatctgttggggatgtcgtcaggccccgagctgtttagtattcactttaacggtcaggtgctggagcagaaccatcacaaggtgagtgcaatcaccttggtcagtgcgacaagtacaaccgctaatatgaccgtcgggcccgaaggcaagtggatcattagcagtctcacaccaaagcatctgcaggcaggtatgcaggcttacattgatatcaagaattgtcccaagaaaactcgcaaccttaagaagataacacgtgagcagcggcgccacatgaagaggtgggagtatttcatagctgctgaggaagtgatctgggattatgccccagtgatccccgctaatatggacaagaagtacaggagccagcatctggataatttctccaatcagatcggcaagcactacaaaaaagtgatgtacacccagtacgaggatgagtctttcacaaagcacacagtgaaccccaacatgaaggaagatgggatcctggggcccataatacgcgcccaggttcgcgacacactcaagattgttttcaagaatatggcgagtagaccctattctatataccctcacggcgtcacattttccccctatgaagatgaggtgaacagctcgttcacctccggtaggaataacaccatgattagggccgtgcaacctggggagacatatacctacaaatggaacattctcgagtttgacgaaccaacagaaaatgacgcccagtgcctgacaaggccttactactctgacgtggatatcatgcgggatatagccagcggactgattggtctgttgttaatctgtaagagcaggtcgttggacagaagaggtatacagcgcgccgccgatatagagcaacaagcagtgtttgctgtcttcgacgagaataagtcatggtatctcgaagataacataaacaaattttgcgagaaccccgatgaggttaagagagatgaccctaaattttacgagtccaatattatgtctacaatcaatgggtacgtccctgagtccatcacaaccctggggttttgcttcgacgatacagtgcaatggcacttctgctcagtgggtactcagaacgagattttgacgatccacttcacaggccatagctttatttacggcaaacggcatgaagacacgctgacactttttcccatgcgcggcgaatcagtcaccgtgacgatggacaatgtaggaacttggatgctgacctcaatgaactcttcaccaaggtcaaaaaagctgcgcctgaagttcagggatgtgaaatgcatacctgacgatgacgaggatagttatgagatatttgagccaccagagagcacagtgatggccacgagaaaaatgcacgataggctggagcctgaggatgaagagtcagacgcagattacgactaccagaaccggctggctgcagcactggggatacgctctttcaggaattcatcgttaaaccaggaggaggaggagttcaacttgacggctctggcgctagaaaacgggaccgaattcgtctccagcaatactgacatcattgttggctcgaactacagctctcccagcaatattagcaagtttacagtgaacaacctggccgaacctcagaaagcgcccagccatcagcaagctacaacagcgggctctccgctgagacacctcatcggcaagaacagcgtgctgaattcctcaactgctgaacattcgtctccctatagcgaggaccccattgaggatccgttacaaccagatgtgacaggaattaggctgctcagtctcggtgccggagagttcaaatcacaggaacacgccaaacacaaagggccaaaggtcgaaagagatcaagcggcaaagcatcggttctcttggatgaagcttcttgcgcacaaagtcggtagacacctatcccaggatacaggaagcccatctggcatgagaccctgggaagacctaccctctcaggatacagggtctcctagtaggatgagaccctggaaggatccccccagtgacctgctcctcctcaaacagagcaattcttccaagatactcgttggacgctggcacctcgcatcagagaagggctcttacgagattatccaggacactgacgaggacaccgccgtgaacaattggctaatttcacctcaaaacgccagccgtgcttggggggaatccacgccactggccaataaaccgggaaagcagtcagggcaccccaagtttcccagagtaaggcataagagcctgcaagtgaggcaggatgggggaaagagccggcttaaaaagagccagttccttatcaaaacaagaaagaagaaaaaggagaaacatactcatcacgcccctctgtctccccgcacgtttcatccactcaggtccgaggcttacaatacattcagtgagcggagacttaagcattctctagtgctacataagagcaatgaaacttcactgccaaccgacctaaatcagacccttcctagcatggactttggttggatcgcatcgctgccagaccataaccaaaattcttctaatgacacgggtcaagcatcatgcccacctggcctgtaccagacagttcctccggaggaacactatcagacgttcccgatccaggacccagaccagatgcactctactagtgatcccagccaccggagtagtagcccagagctgagcgaaatgttggagtatgaccggagccacaagagcttccctacggatatttctcagatgtcgccaagcagtgagcacgaggtttggcagacggtcatttcacccgaccttagccaggtgactcttagccccgaattgtcacagacaaacttaagtcccgatctgtcacacaccactttatccccagagttgatacaacggaacctttcccccgccctggggcagatgcctatttctccggatctcagtcacactacactctctcctgaccttagtcacacaacgttgagcctggatttgagtcagactaacctgagccccgagctgtcgcagaccaacctgtcccctgccctgggacaaatgccattgtctcccgatctgtcacacaccaccttatccctcgacttctcccagactaatctgtctcccgaactatcccatatgacgcttagtcccgagttgagccagacaaatctgtcgcccgcgcttggccagatgccaatctcccctgatctatctcataccactttatcccttgatttctcccagaccaatctgtctcctgaactcagtcaaactaacctgtccccggctctcggtcagatgccgctctccccagatccctctcacacgactttgagtctggacctgtcacagaccaacctctctcccgagctgagccagacaaatctatccccagatttatccgagatgcctctgttcgctgacctgtcgcagatccctctgaccccggatctggaccagatgaccctcagccccgacctcggagaaacggatctgagtccaaacttcgggcagatgtctctgtctcctgacctatcccaggtgaccctcagcccagacatttctgatacgacattgttacctgatctatctcagatctcgccacccccggacttggatcaaattttctacccatccgaatcttcccagtcattacttctccaggagtttaacgaatcattcccataccctgacctaggccagatgccctcccctagctcgcctaccctaaacgatacattcctttctaaggagtttaacccacttgtgatcgtggggttatcgaaggatggcacagactacatcgagattattcccaaagaagaggtgcagtcaagcgaggatgattacgccgagattgattacgtgccctatgacgacccgtacaagaccgatgtgcgaacaaatattaatagtagtcgtgatccggataacattgctgcttggtacctgaggtccaacaatgggaacagacgaaactactacattgctgctgaggagatcagctgggactactcagagtttgtgcagcgcgagacagacatcgaagattccgatgatatcccagaggataccacctacaaaaaggtagtcttcaggaagtacttggactctactttcactaaacgcgatccacgaggagaatacgaggaacatctcggcatcctgggcccaattattcgtgcagaggtggatgatgtgatccaggtcagattcaagaacctggcctcccgcccgtacagtctacacgctcacggcctttcttacgagaaaagctctgagggcaaaacttatgaggatgacagccccgagtggtttaaagaagataacgcggtgcagccaaacagctcctatacctacgtgtggcacgctacggagagatcaggcccagagtcccccgggtccgcctgtcgtgcttgggcttattattctgcagtcaatccggagaaagacatccattcagggttgataggaccactgctcatctgccagaagggaatccttcacaaagactcaaacatgcccatggatatgcgcgagttcgtcctgctgtttatgacttttgacgaaaagaaatcctggtattacgaaaagaaaagcagatctagctggaggctgacaagctccgagatgaagaagtcccatgaatttcacgccataaatggtatgatctacagtctgcctggacttaagatgtacgaacaggagtgggttcgcctgcacctcctgaatatcggggggtcacaagatatccacgttgtacacttccatggccagacacttctggagaatggaaacaagcagcaccaattgggtgtctggcctttgctgcccgggtcgtttaaaacgctggaaatgaaagcctccaaaccaggttggtggctccttaacacggaggtaggggagaaccagagggctgggatgcagacgccatttttgattatggaccgagactgtcgcatgcctatggggctctcaactggaattataagtgattcccagatcaaagcctcagagttcctgggatattgggaacctcgtctcgcccgcttaaacaacggtgggtcctataatgcatggtcggtcgaaaagttagctgccgagttcgcaagcaaaccgtggatccaggttgatatgcagaaagaggtaattatcaccggaatccagacacagggcgccaagcattacttgaaaagttgttatacgacagaattctacgtggcctacagctctaaccagattaattggcagatttttaagggcaactccactagaaatgtgatgtattttaacgggaactctgacgcgtcaaccataaaagaaaatcagtttgacccaccgatcgtcgcccgttacatccgtattagccccacgagagcttataacagaccaacactacgccttgagttgcaaggctgtgaagtgaacggttgctctacgccattgggaatggaaaatggtaagatagaaaataagcagataacagctagttccttcaagaagtcctggtggggggattactgggagccgttccgagcgcgcctgaatgcacaggggcgcgtgaatgcctggcaggccaaagccaacaacaataaacaatggctggagatcgatcttctgaaaatcaagaaaatcaccgcaattatcacccagggatgcaagagtctgtcgtctgaaatgtacgtgaagagttacactattcattacagcgagcaaggggtggagtggaaaccttatcgtctgaaatcatctatggtcgataaaattttcgagggcaacaccaatactaagggccacgttaaaaatttctttaacccccctataatatctcggtttattcgcgttatccctaagacatggaatcagtcgatagccctgagactggaactgttcggttgcgacatttat

SEQ ID NO: 9092 - DNA, 6672 bp, Artificial Sequence
  Description of Artificial Sequence: Synthetic coding sequence
atgttccccgggtgcccccgtctgtgggtgctggtcgttctcggcacaagttgggttgggtggggtagtcagggaaccgaagccgcccaacttagacagttctatgtggccgcccagggaataagctggtcctatagaccagagcctacgaatagttccttgaacctttccgtgacttccttcaagaagatcgtctatcgtgaatatgagccctactttaagaaggagaaaccccagtctactatcagcggcctgctgggtcctacactgtacgccgaagtgggggacatcatcaaagtgcactttaagaataaagctgataaacccctgtcaatccaccctcaaggtattcgctattccaagctgagcgagggcgctagctacttagatcacaccttccccgcggagaagatggacgatgcagtggctcccggccgcgaatacacttatgagtggtcaatctctgaggacagcggccctacacatgatgaccctccttgcctgactcacatttattattctcatgaaaatctgatcgaagattttaattccggactaattgggccccttctgatctgcaaaaagggaaccctcacagaggggggaacacagaagactttcgacaaacagatagtcctgttattcgccgtattcgacgagagcaagagctggagccagtcaagttccttgatgtataccgtgaacggctacgtgaatggaacgatgcctgatatcacagtctgcgctcacgaccatatcagctggcacctgctcggcatgtcatccgggcccgagctcttttcaatccatttcaacggacaggttctggaacaaaaccaccataaggtgtcggcgatcaccctcgtctctgccacgtccaccactgcaaatatgacagtcggcccagaaggtaagtggataatatcctcacttacacctaaacacctccaagcgggcatgcaggcctatatcgatattaagaactgtccaaagaagacccggaaccttaagaagatcacccgcgagcagcgacggcatatgaaaaggtgggaatacttcatcgcagctgaggaggtgatctgggactatgccccagtgatccccgcgaatatggataagaaatatagatcacagcacttagataatttctctaatcagatcggcaaacactacaaaaaggttatgtatactcagtatgaagatgaatctttcacaaagcataccgtgaaccctaatatgaaggaggatggaattctgggtcctattattcgagcgcaagtgcgtgatactctaaagatcgtattcaaaaatatggccagcaggccttactccatctaccctcatggtgttaccttttccccgtacgaagacgaggttaacagttcatttacaagcgggcgaaacaacactatgattcgagcagtccagcccggcgagacatatacctacaagtggaacatacttgaattcgatgagccaactgagaatgacgcgcagtgcttgacccgaccatattacagtgacgtggatattatgagggacattgcaagcgggttgatcggcctcctcctaatctgtaagtcgagatctttagaccggcggggaatccagcgagcagcggacatagagcaacaggcggtgttcgctgtctttgatgaaaacaaatcctggtatcttgaggacaacatcaacaagttttgcgaaaaccctgatgaagtcaagcgcgacgaccctaagttctatgagagcaatataatgagtacaattaatggatacgtacccgaaagtatcaccactctgggattttgctttgacgataccgtacagtggcatttttgctctgtcggaactcagaacgaaatactgaccatccacttcaccgggcacagcttcatctacggtaaacgacatgaagacacactgacactttttccaatgcgcggtgaatctgtgacagtgaccatggacaacgtcggaacgtggatgctgaccagcatgaactcgagtccccgatccaaaaaactgaggcttaagtttcgggatgtaaagtgcatccctgatgacgatgaagactcctacgaaatcttcgagcccccagagagcaccgttatggccacacgcaaaatgcacgaccggttggaacctgaagacgaggagagcgatgccgattacgactaccagaatcgccttgctgctgctctgggcattcggtctttcagaaacagctctttaaaccaggaagaggaggagtttaacttaactgccctcgctctggagaacggtaccgagttcgtgtcatcgaacaccgacataatagtcggcagcaattattctagcccctcaaatatctcgaaattcaccgtaaacaatctggcagaacctcagaaggcgccttctcaccaacaggcaacaactgccggatctcctctacgccatttaatagggaagaatagtgtgcttaattcttctactgccgagcattcgtcaccatacagcgaggaccctatagaggaccctctgcagcctgacgtcacaggcatccgcctgctgtctctaggagcaggggaattcaaatcccaagaacatgctaagcacaagggacccaaagttgaacgtgatcaggcggccaagcatcgatttagctggatgaaactgctggcccataaggtcggcaggcacctgtctcaggacaccggaagtccttccggtatgaggccatgggaggacctgccatctcaagatacaggatcaccgtcccggatgcgcccatggaaggaccctccatcagacctcctgctgctgaaacagtccaacagctcaaagatcctggtgggtagatggcaccttgcatccgagaaaggtagttatgaaataattcaggatactgacgaagatacagcagtgaataactggctcatatccccacaaaatgcatctcgcgcctggggggaatccacccctctggctaataagccaggcaagcagagcggccatcccaagttcccccgggttaggcataaaagcctgcaggtccgtcaagacggagggaaatcaaggctgaagaagtctcaattcctgatcaaaacccgcaaaaaaaagaaagagaaacatacccaccacgctcctctttcaccacggacgttccacccactccgctcagaagcgtacaatactttcagcgaaaggagattgaaacatagtcttgtgctccataaatccaatgagacgagcctgccgactgatttgaaccagactctgccctccatggattttgggtggatcgcttctctacccgaccataaccagaactcatcaaacgacaccggccaggcctcgtgcccgcctggactgtaccagactgtaccaccagaagagcattatcagacctttcccatccaggatccagaccagatgcactccacaagtgaccctagccacagatcaagtagccccgaattgtcagagatgctcgagtacgaccgcagtcataagagcttcccaacagacatctcacaaatgtccccatcttccgagcacgaggtttggcagacggtgatcagtcccgatttgagtcaggttactttatctccagagctcagccagaccaatctttcccctgacctatctcacaccaccctgagtccagagctcatccagagaaacctgagccccgcattgggtcagatgcccatcagccccgatctgagtcacacaacgttgtcccctgatctgtcacatacgaccctgtctcttgatctgagccagactaatcttagtcccgaattgtcgcaaacgaacttatcccctgcactagggcagatgccactttcacccgacctctcacacacgaccctcagcttagacttcagtcagaccaaccttagtcccgaactctctcacatgacgctaagccctgagctgtcccagactaatctgtctcccgctcttggacagatgcccatctcccccgatttaagccataccacactgtccttggatttttcacagacaaacctgtcaccagaactcagccaaacaaatttgtccccagctctggggcaaatgccgctcagcccagatccgagtcatacgacattatctttggacctcagtcaaacaaatttaagccccgaactgtcacagaccaatctgtctcctgacctttcagagatgcctctgtttgctgatctgagtcagattcccttaacacctgacctcgaccaaatgactctaagtcctgatctgggagagacagatttgtctccgaacttcgggcagatgtccctgtctcccgatctctcccaggtgactctctccccggacatcagtgacaccaccctgctccctgacctctcacagatttcaccacccccagacttggatcagatattctaccccagcgagagcagtcagagcctgcttctgcaggaatttaacgagagctttccatatcccgatttagggcagatgccatctccctctagcccaacactcaacgatactttcctgtccaaagagtttaaccccctggttatcgtgggcctgagcaaagatggcacagactacatagaaatcatacctaaggaagaagttcagagtagtgaagacgattatgccgagatcgattacgtgccatatgatgacccttacaagacagatgtccggaccaacattaacagctcgagggatcccgataacatcgccgcctggtatctcaggagtaacaatggcaatcgacgtaattattatatcgctgccgaggaaataagctgggactacagcgagttcgtccaaagggagacggacattgaggactcggatgatattcctgaggacacaacctacaagaaggttgtgtttcgaaagtacctcgatagcacgttcaccaaaagggatcctagaggagaatatgaggagcacctaggtatccttggcccaatcatcagagccgaggtggatgacgtgattcaggtacggttcaaaaacctggctagccggccctactcccttcacgcccacggtttatcctacgaaaaatcctccgaggggaaaacctacgaggacgattccccagagtggttcaaagaggataatgcggtccagcctaattcctcatacacttatgtttggcacgccaccgaaaggtcaggacctgaatcaccgggttccgcttgccgcgcctgggcatactattccgctgtgaacccagagaaagacatccattccgggctgatcggtcccttgctgatctgtcagaagggtatactccataaagactccaacatgcctatggatatgcgcgagttcgtcctgctgtttatgaccttcgacgagaaaaagtcctggtactacgaaaagaagagccgctcctcatggcgtctgacttcttccgaaatgaaaaagagtcatgaatttcacgctatcaatggaatgatctactcattgcctggactcaaaatgtatgaacaggaatgggtccgtttgcatctactgaacataggaggctcccaggatatccacgtcgttcacttccacggccaaaccctcctggaaaacggcaataagcagcatcaactgggggtctggccattgctgccgggcagctttaagacactggaaatgaaagctagcaaacctggttggtggcttctcaacaccgaagttggagaaaaccagcgcgccggtatgcagacacctttcctcataatggatagagattgccgtatgcctatggggctcagcaccggaatcattagcgatagccagattaaagcctcagagtttctgggatactgggagccaagactggcacggctgaacaatggtggaagttataatgcctggagcgttgagaaactggctgctgagttcgcatcaaagccctggatccaggtggatatgcagaaagaggtgatcatcactggaatacagacgcagggcgccaaacattatctgaagagctgttacacgacggagttttacgtagcatattcaagcaaccaaatcaactggcagattttcaagggcaatagcaccagaaacgtcatgtatttcaacggcaactcagacgccagcactattaaggagaaccagttcgaccctcctattgtggccagatacataaggatcagtccaactcgcgcatacaatcgaccaacactgcgccttgagctgcagggttgcgaggtaaatggttgttccactcccctggggatggagaacggaaaaatcgaaaacaagcagatcacagctagctcgtttaagaaaagttggtggggcgattattgggagccatttcgcgctcggctgaatgctcaggggcgcgtgaacgcctggcaggccaaggccaacaataacaaacagtggctcgagattgacctcctgaaaattaagaagattaccgctattattacccagggctgcaagtcgctgtcctcagagatgtatgtgaagagctatacgatccactattcagagcaaggcgtggaatggaagccttataggctgaagagctccatggtggataagatattcgaaggcaataccaacaccaagggacatgtgaaaaacttttttaatccgcctattataagcaggttcatacgcgttattcctaaaacttggaaccagtcgattgctttacgactcgagctctttgggtgtgacatatac

SEQ ID NO: 9093 - DNA, 6672 bp, Artificial Sequence
  Description of Artificial Sequence: Synthetic coding sequence
atgttcccaggttgccccagactttgggttctggtcgtgctgggtacctcctgggtgggttggggaagccaggggactgaggcagcacaactgcggcagttttatgtggcggcgcagggcatatcgtggtcctaccgtcctgaacccactaattcctcgctcaatctgtcggtgacttcgttcaagaaaatcgtgtatcgagaatatgaaccatactttaagaaggaaaaacctcagtcaaccatctcaggcttgctgggacctaccctttacgcagaggtgggcgatatcattaaagtgcatttcaaaaacaaggcagacaaacctctttccatccacccgcagggcatcagatactcaaagctgtcggagggagcatcttaccttgatcacacctttccagcagaaaagatggacgacgcagtcgccccgggcagagagtacacttacgaatggtcgatatcagaggactccggcccaactcatgatgaccccccttgtctgacccatatctactactctcatgaaaatcttatcgaagatttcaactcgggtttgatcggacctctgttgatttgtaagaaagggaccctgactgaaggtggaactcagaaaactttcgacaagcaaatagtcctcctgtttgccgtgtttgatgaatcgaagtcgtggtcccagtccagctcattgatgtacactgttaatgggtacgttaacggtactatgccagatataaccgtctgtgcacatgaccatatttcatggcatctcctggggatgtcgagtggacccgagctcttttcaattcatttcaatggccaggttctcgaacagaaccatcataaagtgtccgccataactttggtgtcggcgaccagcaccaccgctaacatgactgtcggtccagaaggaaaatggatcatatctagcctgactcccaagcacctccaagcaggtatgcaagcctacatcgacataaagaactgccctaagaaaactaggaacttgaagaagatcactcgtgagcaaaggagacatatgaaacggtgggagtactttattgcagcagaggaagtgatctgggattacgcccctgtaattcctgcaaatatggataagaagtatagatcacaacatctcgataacttctccaatcagattggaaaacattacaaaaaggtgatgtacactcaatacgaagatgaatcatttacgaagcacactgtgaacccaaatatgaaggaagatggaatcttgggtcccattatccgcgcgcaagtccgggataccctgaagatcgtctttaagaacatggcgtcgaggccttactccatttatcctcatggtgttaccttctccccttacgaggacgaggtgaactcgagcttcaccagcggacggaacaatacgatgattagagccgtgcaaccaggtgaaacctacacttacaagtggaatattctggagttcgacgaacctaccgagaatgacgcacagtgtcttacccgcccatactacagcgacgtcgacattatgcgggacattgcaagcggcttgattggactccttctcatctgcaaatcccgcagccttgatagaaggggaattcagagagcggcggatatagagcagcaagcagtctttgcagtgttcgacgagaacaagagctggtaccttgaggacaacatcaataagttttgcgaaaaccccgatgaggtgaagcgcgacgacccgaagttctacgaaagcaacattatgagcaccattaacggttacgtgcccgaatcgattaccactctgggattttgttttgatgataccgtgcagtggcatttctgttcagtgggcacgcagaatgaaatactcaccatccacttcaccggtcattccttcatttacggtaagcgccacgaagatactctgactctgttccctatgcgaggagaatcagtcaccgtgactatggataacgtggggacctggatgctgacttccatgaactcgtcaccaagatcgaagaagttgagacttaagttcagggatgtcaagtgcatccccgatgacgatgaggatagctacgagatctttgaaccccctgagtcaaccgtgatggcaacgcgtaagatgcatgaccgactggaacctgaggatgaggaatcagatgcagactacgattaccaaaaccggctggctgcagcgcttggcattcgatcttttcgcaatagctcgctgaaccaagaggaagaagagtttaaccttactgcactggcactggaaaacggaactgaattcgtctcatctaacactgacattattgtcgggtcaaactattcgtcaccaagcaacatttcgaagtttacggtgaataacttggcagagcctcagaaagcccctagccaccaacaagcaaccaccgcaggaagccccctgcgacacctgattggcaagaacagcgtccttaacagctccaccgccgaacattcaagcccatactcggaggatcccattgaagatccacttcagcctgacgtgacgggtattaggttgctctccctgggtgcaggggaattcaaatcgcaagagcatgcaaagcacaaaggacctaaggtggagagagatcaagccgcaaagcacagattctcgtggatgaagctgctggcgcataaggtgggccggcatctgtcacaggataccggtagcccatccggtatgcgtccttgggaagatctcccttcccaggatactggaagcccatctcgaatgcggccatggaaggacccgccatcggatctgctgcttctgaagcaatcaaacagctcgaagatccttgtcggcaggtggcatcttgcgagcgaaaagggctcatacgagattatccaagataccgatgaggatactgcggtgaacaactggctcataagcccccaaaacgcatcgagagcctggggtgaatcaactcccctggccaacaaacctggcaagcaatcgggccatcctaagtttccaagagtcagacacaagtcactgcaagtgagacaggatgggggaaaaagccgcctgaaaaagtcgcaattcctgattaagactagaaagaaaaagaaggaaaagcacacccaccatgcacccctgtcccctagaacttttcaccctctgagatctgaagcctacaacacttttagcgaaaggagacttaagcattctctggtcctgcacaaatccaacgaaacttcactccctacggatcttaaccaaactctcccgtccatggattttggttggatagcgtcgctgcctgaccacaatcaaaactcgtcaaacgatactggtcaagcctcctgtcccccaggcctttaccagaccgtgcctcctgaagaacattaccaaactttcccgatccaagaccctgaccagatgcattccacctcagatccttcacaccggagctccagcccagagctttcggaaatgctcgaatacgacagatcacacaaatccttcccgacggacattagccaaatgtccccaagctccgaacatgaggtgtggcagaccgttatctcgccagatctcagccaagtcaccctctcgcctgaactctcccaaacgaacctttcacctgatctcagccacaccaccctcagccctgaattgattcaaagaaacctgtcgcccgcacttgggcaaatgcctatttcaccggatctttcacataccacccttagcccggatctttctcacacgacgcttagcttggatctttcccaaactaatctctcccctgaactgtcccagactaatctgagcccggcacttggacagatgccactctcccctgacctgtcgcacacgaccttgtccttggacttctcacaaacgaatctctcaccagagctgtcacatatgaccctcagccccgaactgagtcagacgaacctttcccctgcacttgggcagatgcccatttccccagatctctcgcataccacgttgtcccttgattttagccagaccaatctttcaccagaattgtcccagaccaacctgtcaccagcacttggtcagatgcccctttcgcctgatccttctcatacgacgctttcacttgacttgtctcaaaccaacctctccccagagctcagtcagaccaacttgtccccggaccttagcgagatgcctctgtttgccgacctgagccaaataccgttgacccctgatctggaccagatgactctcagccccgatctgggggaaactgatctgtcacctaatttcgggcaaatgagcctctcccccgacctttcccaggtgacgctctcaccggacatctcggacacgaccctgttgcctgatttgtcgcaaatcagcccgcctccagatctcgatcaaatcttctacccatctgagtcgtcacagtcactcctcttgcaggagtttaatgagtcgtttccctaccctgatctgggtcaaatgcctagcccttcctcaccaacgcttaatgataccttcctgtcgaaagagttcaacccgcttgtgatcgtcggactctccaaggatgggactgattacattgagataattcctaaagaggaagtgcaatcatccgaggatgactacgcggaaatcgattacgtgccgtacgacgatccgtacaagactgatgtcagaactaacattaacagcagccgagatcccgataacatcgcggcatggtacctccggagcaataatgggaatcgtaggaactactatatcgcggctgaagaaatttcgtgggattactccgagtttgtgcagcgcgaaaccgatattgaagattccgatgatatcccagaggatactacgtacaagaaggtcgtgttccggaaatacttggacagcacctttactaaaagagatccccgcggagaatacgaggagcaccttgggattctgggacccattatccgggcagaagtcgatgatgtgattcaggtgcgctttaagaatctcgcttcccgtccatattcactgcatgctcacggtctttcctacgagaagtcgtccgaaggaaagacttacgaggatgattcccctgaatggtttaaggaagataacgcagtgcagcccaattcgtcctacacttacgtctggcatgcaaccgaaagatcaggacccgaatcgccagggtcggcgtgtagggcctgggcgtactactcggctgtgaaccctgaaaaggacattcacagcggactcatcggaccacttctcatatgtcagaagggtatcctgcacaaggattcaaatatgcctatggatatgagggagtttgtccttctgtttatgaccttcgacgaaaagaagtcctggtactacgagaaaaagtcgaggtcgtcatggagacttacttcatccgaaatgaaaaagagccatgagtttcatgcaattaacggtatgatttactcacttcccggactcaaaatgtacgaacaggagtgggtgcgactgcatctgcttaacatcggtggcagccaagatatccatgtggtgcattttcatggccaaaccctgctcgagaacggaaacaagcaacaccagctgggagtgtggccactccttccagggagctttaagactcttgaaatgaaggcatcgaagccaggctggtggctgctgaatactgaagtgggagagaaccaacgtgcaggaatgcaaactccatttctgattatggatagagattgcaggatgcctatgggactgtcaactgggattatcagcgactcacaaatcaaggcaagcgagtttcttggatactgggagcctcgtctcgcgaggctgaacaatggtggttcgtacaatgcgtggagcgtggagaaacttgcggctgaattcgccagcaagccatggatccaagtggacatgcagaaggaggtcatcattaccggtattcaaacccaaggagctaaacattaccttaaaagctgctacaccactgaattctacgtggcatacagcagcaatcagattaactggcagattttcaaaggaaactcgactcgcaacgtgatgtactttaacgggaactccgatgcaagcaccataaaggaaaaccagtttgacccaccgatcgtggcaagatacattcgcatctcacctaccagagcatacaatcggcctacgctccggctcgaacttcagggatgtgaagtgaacggttgctcaaccccgctgggtatggagaacggaaagattgagaataagcagattaccgcatcgtccttcaaaaagtcctggtggggtgattattgggaaccattcagagcgagactgaatgcgcaaggaagagtgaatgcatggcaggctaaggctaataacaataagcagtggctggaaatcgatctgctgaaaatcaaaaagatcaccgctatcatcactcaagggtgtaagtccctgtccagcgaaatgtacgtgaaatcttacaccattcattactccgagcaaggagtggaatggaagccgtatagactgaaatcatcaatggtggacaaaatctttgaaggaaatactaataccaaaggtcacgtgaagaactttttcaacccccctattatctcacgcttcatacgagtcattcctaaaacttggaatcagagcattgccctgaggcttgagctctttggctgtgacatttac

SEQ ID NO: 9094 - DNA, 6672 bp, Artificial Sequence; identical to SEQ ID NO: 9028
  Description of Artificial Sequence: Synthetic coding sequence

SEQ ID NO: 9095 - DNA, 6672 bp, Artificial Sequence
  Description of Artificial Sequence: Synthetic coding sequence
atgtttccgggctgcccacgcctgtgggtgctcgtcgtcctggggacttcttgggtcgggtgggggtcgcagggtaccgaggctgctcagctcaggcagttctatgtcgctgcgcaaggcatctcctggtcgtaccggccagaacctactaattcctccctcaacctctcggtgaccagcttcaagaagatcgtgtacagagaatacgagccgtacttcaagaaggaaaagccgcagagcaccatcagcggactgctgggaccaactctgtacgcagaggtgggagacatcatcaaggtccatttcaagaacaaggccgacaagccattgtcgatccacccgcagggcatcagatactcgaaactctccgagggagcatcctatctcgaccacactttcccggccgagaagatggacgacgcagtggcaccaggacgggagtacacctacgagtggtccatctcggaagattcaggcccgactcatgatgatccaccgtgcctgacccatatctactactcacacgaaaatctcatcgaagacttcaactccggcttgatcgggccactcctcatctgtaagaagggaaccttgaccgagggaggaactcagaagactttcgacaagcagatcgtcctgctgtttgccgtttttgacgagtcaaagtcctggtcgcagtcgtcatcactgatgtatacggtgaacggttacgtgaatgggactatgcctgacattaccgtgtgtgctcatgaccacatcagctggcacctcctcggaatgtcatcggggcctgaacttttcagcatccacttcaacggacaagtgctcgaacagaatcaccacaaagtgtccgctatcacccttgtctcagcaacttcgactaccgcaaacatgactgtgggccctgagggcaaatggattatctcaagcctcacgccaaagcacttgcaggccggaatgcaagcgtacatcgacatcaaaaactgtccgaagaaaactcgcaatttgaagaaaatcaccagagaacagcgccggcacatgaagcggtgggaatactttattgctgccgaagaggtgatctgggactacgcgcctgtcatcccggccaacatggacaagaagtacaggtcgcagcacctcgacaatttctcaaatcaaatcggaaagcactacaaaaaagtgatgtacactcagtacgaagatgagagcttcaccaaacataccgtcaaccctaatatgaaggaagacggcatcctgggcccgattatccgggcccaggtgcgcgacactctgaagattgtcttcaagaatatggcctcccggccatacagcatctacccgcacggcgtgaccttctccccatacgaggacgaggtcaatagctcgttcacctcaggcaggaacaacaccatgatcagggcagtgcaacctggcgaaacgtacacttacaagtggaacatcctcgaattcgacgaaccgaccgaaaatgatgcacaatgcctgacgcgtccgtactacagcgatgtggacatcatgcgggatatcgcttccggcctgatcggtttgcttctgatctgcaaatcgcggtcgctcgaccgcagaggtatccagcgcgccgcggacatcgagcagcaggccgtgttcgcagtgttcgacgagaataaatcctggtatctggaagataatatcaacaagttctgcgagaatccggacgaggtgaaacgcgacgacccgaagttttatgaatcgaacatcatgtcgaccatcaacggctacgtcccagaatcgattaccactctgggcttctgcttcgacgataccgtccagtggcatttctgttcggtgggaactcaaaatgaaattctgaccatccatttcactggacacagcttcatttatgggaagagacacgaggacaccttgactctgttcccgatgagaggagaatcggtgaccgtcaccatggacaatgtgggcacttggatgttgacctcgatgaactcctcgcccagaagcaagaagctgcgtctgaaatttagagacgtgaagtgcatcccagacgacgatgaggacagctacgagatcttcgagccacctgagtccactgtcatggccaccagaaagatgcatgatcggctggaacctgaagatgaggagagcgacgctgattacgactaccagaaccgactggcagcagcacttggtatccgctcgttccgcaattcctccctgaaccaagaggaagaggaatttaacctgactgctttggcactggaaaacggcactgaatttgttagctcgaacactgacatcatcgtgggctcgaattactcctcaccatccaacatatccaagttcaccgtcaataatctggctgagcctcaaaaggctccgagccatcagcaggcaactaccgccggctccccgctccgccatctgatcggaaagaattccgtgctcaacagctcgaccgccgagcatagctccccgtacagcgaagaccctattgaagatcctctgcagccagacgtgactgggatccgactcctctcactgggagcgggtgagtttaaatcgcaggagcatgccaagcataaggggcccaaagtggaacgggatcaagcggccaagcaccggttcagctggatgaagctgctggctcataaggtgggccgccacctgtcacaggacaccgggtccccatccggaatgaggccttgggaagatctgccgagccaggataccgggagcccttcccgtatgaggccgtggaaggatccgccgagcgatctgctgctgttgaaacaatccaactcatccaagatcctggtggggagatggcacctggccagcgagaagggatcctacgaaatcatccaggatacggacgaggacaccgcggtgaacaactggctcattagcccacaaaacgcgagcagggcatggggagagtcaaccccactggcgaataaacccggaaagcagtccggccacccgaagttcccgcgggttcggcataagtcgctccaagtgagacaggacggcgggaagtcacgcctgaagaaatcgcaattcctgattaaaacgcggaagaagaaaaaagagaaacacactcatcacgccccgctctcacctcggaccttccacccacttcgctcggaggcttacaacaccttttcggaacgccgcctgaagcattccctggtcttgcacaagtcaaacgagacttccctgccgactgatctgaaccagaccctgccgtcaatggacttcggatggattgcttctttgccagaccataaccaaaactcgtcaaacgacactggacaagcgtcctgcccacctgggctgtatcaaaccgtgccacctgaagaacactaccagacttttcccatccaggacccggaccaaatgcatagcacttcggatccttcgcaccgctcgtcgagcccggaattgtcagaaatgctcgaatacgacagatcccacaagtcgttcccgaccgatatttcccaaatgtcgccaagctcggagcacgaagtttggcagactgtgatcagcccagatctgtcccaagtcacgctgtcgccggaactctcgcaaaccaacttgtcgccagacctttctcatactaccctctctccggaactcatccagcggaatcttagtccagctcttggccagatgccgatttccccggacctttcccacacgactctgagtccggatctctcccatacgaccctgtcccttgacctcagccagacgaatttgtcgcccgagctgagccaaactaatctcagtcctgcgctcggtcagatgcctctctcacctgatctcagccatactactctctcgctcgacttctcgcagaccaatttgtcgcctgagctctcccacatgaccctgagccctgaactcagccagaccaatctgagccctgccctcggacagatgccgatctcgcccgacctctcgcacactactctgtcgttggatttttcccagactaatctgtccccagagctcagtcagactaacctttcaccggctttgggccagatgcctctttcgccagatccatcccacactaccctgtctctggatttgagccaaaccaacctgtcccccgagctgtcgcagaccaacctgagccccgatctcagcgagatgcctctgtttgcggaccttagccagatccctctgaccccggaccttgaccaaatgaccctctccccggatttgggcgaaaccgacctgtcgccaaattttgggcaaatgtcgctctcaccggacctctcgcaggtgaccctgtcaccggacatttcagacactaccctcctcccggacctgagccaaatctccccgccgccggatttggaccagatcttctacccatcagaatcttcgcaatcgctgctgctgcaggaattcaacgagtcttttccgtacccagacctgggtcaaatgccatcaccctcatccccgaccctgaacgacactttcctctcgaaggaattcaacccattggtcatcgtgggactctcgaaggacggaaccgactacatcgagatcatcccgaaggaagaagtccagtcctcggaagatgactacgcggaaatcgactacgtgccgtacgacgatccgtacaagaccgacgtgcggaccaacatcaatagctcacgcgacccggataacattgcggcctggtacttgagatcgaacaacggaaaccgcaggaactactacatcgccgcggaggaaatctcgtgggattacagcgagttcgtgcaacgcgaaactgacattgaagattcagacgacatcccagaagacaccacttataagaaggttgtcttccggaaatacctggattccacttttaccaagcgggacccacggggagagtacgaggagcacctcggaattctgggaccaatcatcagagcagaggtcgatgatgtcatacaggtgagatttaagaatctggcatcccggccctattcgctgcacgcacacgggctgagctacgagaagtccagcgaaggaaagacctacgaagatgactcccccgaatggttcaaagaagacaatgccgtccagcccaacagctcgtacacttatgtgtggcacgctacggagaggagcggaccagagtcacctggaagtgcctgtcgggcctgggcctactactccgcagtgaatcccgaaaaagacatccactctggactcatcggcccgcttctcatctgccagaaaggcatcctgcataaagacagcaatatgccgatggatatgcgggagttcgtgctcctgtttatgaccttcgacgaaaagaaatcatggtactacgagaaaaagtcgcgcagcagctggcgccttacctcctcggagatgaagaagtcccacgagttccatgctatcaacggaatgatctactcgctgccaggacttaaaatgtacgaacaggaatgggtcagactgcacctgctgaatatcggagggtcccaagacatccacgtggttcacttccacgggcaaacgctgctggaaaacggaaataagcagcaccagctgggggtctggccgctgcttccaggatcgttcaaaaccctcgaaatgaaggcgtcgaagcccgggtggtggctgctgaacaccgaggtgggagagaatcagcgcgcgggcatgcagacccctttcctgatcatggaccgggactgtaggatgccgatgggactgtccaccggcatcatctccgactcccaaatcaaggcttcggagttccttggttactgggaacctcgacttgctagactcaataacggaggatcctacaacgcctggtcggtggaaaagctggcggctgaattcgcctcgaaaccgtggatacaagtggatatgcagaaagaggtgatcatcaccggaatacagacccagggtgcgaagcactacctgaagtcttgttataccaccgagttttatgtcgcgtactcgtcaaaccagattaactggcaaattttcaagggcaactcaactaggaacgtgatgtatttcaatggcaattcagacgcctccactattaaggaaaaccaattcgacccacccatcgtcgctcggtatatcaggattagcccaaccagggcatacaaccgcccgactctccgcctggaactgcagggatgtgaggtcaacggatgctcaacccctctcggcatggaaaatggcaagattgagaataagcaaatcaccgcgtcctccttcaagaaatcgtggtggggggactactgggaaccgttccgagctcggttgaacgcacaggggcgcgttaatgcttggcaagctaaggcgaataacaacaagcagtggctcgaaattgacctcctgaagatcaagaagattaccgccattatcacccagggatgcaaatcactgtcgtcggaaatgtatgtcaagtcttacactatccactactcggaacagggggtggaatggaaaccgtatcggttgaaatcgtcgatggtcgacaagatcttcgaaggcaacactaacacgaagggtcatgtaaagaacttcttcaatccgccgattatctcccgctttatcagagtgatcccgaaaacctggaaccagtcgatcgctctcaggctggaactcttcggttgcgacatctac

SEQ ID NO: 9096 - DNA, 6672 bp, Artificial Sequence
  Description of Artificial Sequence: Synthetic coding sequence
atgttcccggggtgcccaagactctgggtgctggtcgtgctgggaacctcctgggtgggatggggctcccagggaaccgaagccgcgcaacttagacagttctacgtcgccgcgcaaggaatctcctggtcgtatcggccggagcctactaattcaagcctgaacttgagcgtcacctcattcaaaaagatcgtctaccgggagtacgaaccatacttcaaaaaggaaaaacctcaaagcaccatctcaggcttgctcggaccgactctgtacgccgaggtcggagacatcattaaagtccatttcaagaataaggctgacaaacctctgagcatccacccacagggaattcgatactcgaaactctcagagggcgcctcatacctggaccacactttcccagcagaaaagatggacgacgcggtggctccagggagagaatacacgtatgagtggtcgatttcagaagattctggcccgacccacgacgaccccccatgcctcacccacatctactactcccatgaaaaccttatcgaggacttcaactccggactgatcggacccctgttgatctgtaagaagggcaccctgacggaggggggaactcaaaagacttttgacaagcaaatcgtgctcttgttcgccgtttttgatgaatcgaaatcgtggtcacagtccagctccctgatgtacaccgtgaacggatacgtgaatggcaccatgccggatatcaccgtctgcgcgcacgaccatatcagctggcatctgctcggcatgtcgtcgggcccggaactgttcagcatccatttcaacgggcaggtgcttgaacaaaaccatcacaaggtgtctgccatcactctggtgtcagccacctcaactactgcgaacatgaccgtgggaccagaggggaagtggatcatcagctcattgactccaaagcacctgcaggcgggcatgcaggcttacattgacattaagaattgtccaaaaaagactcgcaacctcaagaagatcacccgcgaacagcgacgtcacatgaagagatgggaatacttcatcgccgctgaagaagtgatctgggattacgctccggtgattcccgccaacatggacaagaagtataggtcgcaacaccttgacaacttttcaaatcaaatcggcaagcattacaagaaggtcatgtacacccaatacgaggacgagtcgttcactaagcacaccgtcaacccaaatatgaaggaagatggcatcttgggaccgatcatccgggcccaggtgagggacaccttgaagatcgttttcaagaacatggcgtctaggccatactccatctacccacacggtgtcactttttcgccgtacgaagatgaggtgaactcgagctttacctccgggcggaacaacacgatgatcagagccgttcaacctggtgagacttacacctacaagtggaatatcctcgagttcgacgagcccaccgagaatgacgcacaatgcctgactagaccgtactactccgacgtggacattatgcgggacatcgcctccggactcatcggtctgctgctgatttgtaagtcaagatccctcgacagacgcggcatccagcgcgcagccgacattgagcaacaggcggtttttgctgtgtttgatgagaacaagtcctggtacttggaggataacatcaataagttttgcgaaaaccctgacgaagtgaagcgcgacgatcccaagttttatgaaagcaatatcatgtcgacgatcaacggatacgtcccggaatcgatcactactcttggtttctgctttgacgataccgtccagtggcatttttgctcggtcggaacccagaacgagatcctgactatccattttaccggccacagcttcatctacggaaaacgccacgaggacactcttaccctctttcccatgcggggcgaaagcgtcaccgtcaccatggataacgtgggtacctggatgctgaccagcatgaatagttcgccgcgcagcaaaaagctcaggttgaagttccgggatgtgaagtgtatcccggacgacgacgaggattcctatgagattttcgagccacccgaaagtaccgtaatggcgactaggaagatgcatgatcgcctggaacctgaagatgaagagtcggacgccgattatgattaccaaaaccggctggccgctgcgctggggatccgctccttccgcaattcgagcctgaatcaggaagaagaggagtttaatctgaccgccttggccctcgaaaacggaaccgagtttgtctcctcaaataccgatatcatcgtcggttcgaactactcgagcccgtcgaatatctcaaaattcacggtgaacaacctggccgagccgcagaaagcgccgtcgcatcagcaggccaccaccgccggatccccgctgcgccacctcataggcaagaactcggtgttgaactcgagcacggccgagcactcctcaccctactccgaggatccgatcgaggaccctctccagccggacgtgactggaattaggctcctgagcctgggagccggcgagttcaaatcccaggaacacgcgaagcacaaagggcccaaggtggaacgcgaccaagctgcaaagcatagattctcctggatgaaactcctcgcccacaaggtgggacggcacctctcgcaggatacgggatccccgtcaggaatgcggccctgggaggacctcccaagccaagacaccggaagcccgtcgagaatgcggccgtggaaggacccaccgtcagacctcctgctgcttaaacagagcaacagcagcaagatcctggtgggacggtggcacctggcatcagaaaaagggagctacgaaatcattcaggataccgacgaggacaccgcggtgaacaactggttgatctccccacagaatgcatcgcgcgcgtggggcgaatcgacccccctcgccaacaagcctggcaaacagtccggacaccctaagttcccccgggtgcgccataagtccctccaagtcagacaagatggagggaaatcgcgtcttaagaagtcgcaattcctgatcaagactaggaaaaagaaaaaggaaaagcacactcatcatgcgccgctgtcgcctcgaacctttcacccgctgagatccgaggcttataacactttctcagaacggaggcttaaacacagcctggtgctgcacaagtcgaatgaaacctcacttcccactgacctcaaccaaaccctgccgtctatggacttcggatggatcgcctcgctgccggaccacaaccaaaactcctctaacgataccggacaggcctcatgccccccgggactgtaccagaccgtgccaccggaagagcattaccaaacttttccaatccaagacccagaccagatgcactccacttcggatccgtcacataggtcctcctcgcctgagctgtcagaaatgttggagtacgacagatcgcacaagtccttcccgaccgatatctcgcagatgtccccatccagcgaacacgaggtgtggcaaaccgtgatcagcccggacctgtctcaggtgacccttagcccagagctctcacagaccaatctctctccagacctctcacatactacgctcagcccagaactgatccagagaaacctgtccccagctctcgggcagatgcccatctcgccggacttgtcccacactaccctttctccagacctgtcccacaccacgttgtccctggacctgtcccagaccaatctgtcaccggaactgtcccagactaatctctcgccagccttggggcaaatgcctctctccccggatctgtctcacaccactctgagcctcgattttagtcaaactaacctttcgccggagctctcccacatgactctttcgcctgaactttcacaaactaatctgagtccagctctgggacagatgccgatttctcccgatctctcacataccaccctctctctggatttctcccagacgaacctctcccccgaactgtcccaaaccaacctgtcgccggctctcggacagatgcccctctcacctgacccaagccacacgactctcagcctcgacctttcccagactaacctgtcaccggagctgtcccaaacgaatttgagcccagatctgtcggaaatgccgctgttcgccgatctgtcgcaaatcccactcactccggatctcgatcagatgaccttgtctcctgatctgggagaaacggaccttagcccgaatttcgggcagatgagcctctcgccagacctttcacaagtgaccctctcgcctgacatctctgatacgacgctgctgccggatctgtcgcagatatcgccgcccccggacctggaccagatcttctacccgtccgaaagctcgcagtcgctgctccttcaggaattcaatgagagctttccgtacccggatctcggccagatgccgagcccatcgtccccaacgctgaacgatactttcctgagcaaggagttcaaccctctggtgatcgtgggactttctaaggacggaactgactacattgagatcatcccgaaagaggaagtgcaatcgagcgaggacgattacgctgaaatcgactacgtgccttacgacgatccatacaagaccgacgtgagaaccaatatcaactcctcgcgcgacccggacaatattgcagcatggtaccttaggagcaacaacggaaacaggcggaattactacatcgcagcagaagaaatctcctgggattactcggaattcgtgcaacgggagactgacatcgaggactcggacgacatcccggaggatacgacttacaaaaaggtggtgttccggaagtacctcgactcgacgtttactaaaagagatccgcgcggtgagtacgaagaacatcttggcatcctgggaccaatcattcgtgcagaagtggacgacgtcatccaggtgcgcttcaaaaatctcgccagccgcccatactcccttcacgctcacggtctgtcgtacgaaaagtcctcagaaggaaagacttacgaggatgattcgcccgaatggttcaaggaagataatgcagtacaacctaattcctcttacacttacgtatggcacgccaccgaacgctccggacctgagagcccggggtccgcatgcagagcgtgggcgtactacagtgcagtcaacccggaaaaagatatccatagcggccttatcgggccgttgctgatttgtcagaagggaattctgcataaagacagcaacatgccgatggatatgcgcgagttcgtcttgctcttcatgactttcgacgaaaagaaatcatggtactacgagaaaaagtcgcgttcttcatggcgactgactagctctgaaatgaagaagtcccatgagttccacgccattaatggaatgatttactcacttccgggactgaagatgtatgagcaggaatgggtgagactgcatctgctgaatatcggaggatcccaagatatccacgtggtgcacttccatggacaaactctgctggagaatgggaataagcaacatcagctgggagtctggccactcttgccgggatcgttcaagactctggagatgaaggcttcaaaacctggttggtggctgctgaacaccgaggtgggcgaaaatcagcgcgccggaatgcagactccttttctcattatggatagggactgcagaatgccgatgggcctgtcaaccggcattatctcggactcccagatcaaagcatcggaattcctgggatattgggagcctcgcttggcacgccttaacaacggtggatcatataacgcatggtccgtggaaaagctggccgcggaattcgcgtcgaagccatggattcaggtcgacatgcagaaggaggtgatcattactggtatccagacccagggagctaaacactacctgaaatcctgctacactactgaattctacgtggcgtactcaagcaaccagatcaactggcagatctttaaggggaactccactcgcaatgtgatgtacttcaacgggaactccgatgcgtcgactatcaaagagaaccagttcgatcctcctatcgtggccagatacatccggatctcgcctacccgcgcgtacaaccggccgactctgcgactggaacttcagggttgtgaggtaaatggctgcagtacccccctgggaatggaaaacgggaagattgagaacaagcagattaccgcctcatcgttcaagaagtcatggtggggcgactactgggagcccttcagggcacggctcaacgcgcagggccgggtcaatgcatggcaagcgaaagcgaacaacaataagcaatggctggaaatcgacctgctgaagatcaagaagattaccgccatcatcacccagggttgcaagtcgttgtcgtctgaaatgtacgtgaagagttacaccatccattactcggagcagggcgtggagtggaaaccgtaccgtctgaaatcctcaatggtcgacaaaatcttcgaaggaaataccaacaccaagggccacgtgaaaaactttttcaatcctcccatcatttcccgcttcatccgcgttatcccaaagacgtggaaccagtctatcgccctgaggctggaattgttcggatgcgacatatat

SEQ ID NO: 9097 - DNA, 6672 bp, Artificial Sequence
  Description of Artificial Sequence: Synthetic coding sequence
atgtttccaggctgcccaagactctgggtgcttgtggtgctaggaacatcttgggtgggttggggcagtcaaggcactgaggccgcacagctgcggcagttttacgtggcagctcagggcatctcatggtcctaccggcccgagccaacaaatagctcactcaacctgtcagtgacaagcttcaaaaaaattgtttacagagaatatgaaccctacttcaaaaaagaaaagcctcagtccactatctctggtctgctgggaccaacactgtacgctgaggtgggcgacatcattaaagtgcatttcaaaaacaaggctgacaaacctttgtccattcacccacagggaattcgatactccaagcttagtgagggcgcttcctaccttgaccatacctttccagccgagaaaatggacgacgcagtcgcgcctggcagagagtatacttacgagtggtctatctcagaggattccgggcccacgcacgatgaccctccttgtctgacccacatctactactctcatgaaaacctgattgaagattttaactctggccttattgggcccctactgatttgcaaaaagggtaccctcacagaagggggtacccagaaaacatttgacaagcagattgtcctgctttttgccgtctttgacgaaagcaaaagctggtctcagagctcctctctgatgtacaccgtgaacggttatgtgaatggtaccatgcctgacatcaccgtgtgcgcacacgatcacataagttggcacctgttgggtatgagttcagggcctgagttgttttccattcactttaacggccaagtacttgagcagaaccaccataaggtgtccgctattacactggtgtctgctacaagtactacggcaaacatgactgtagggccagagggaaaatggataatcagctccctgacacccaaacatcttcaagcaggcatgcaggcatatatagatatcaagaattgcccaaaaaagactaggaatttgaagaaaattacgcgggagcaacgacgacatatgaagcgatgggaatatttcattgcagcagaggaagttatatgggactacgctcccgttatccccgcaaacatggacaagaagtacagatcacagcacctggataatttcagcaatcagataggtaagcattacaagaaagtgatgtatactcagtatgaggacgaatccttcaccaagcatactgtcaaccccaatatgaaggaggatgggatcctgggcccgatcatccgggcacaggttcgggacacccttaaaatagttttcaaaaatatggcctcccgaccctattccatctatccacacggtgtaacattttccccctatgaagatgaggttaactcaagcttcacatccggcaggaacaataccatgattcgcgcggtccagccaggtgaaacatatacatataagtggaatatcctggaatttgatgaacccaccgagaatgatgcacagtgcctcacccggccctattattctgatgtagacattatgcgggacatcgcttcaggccttataggactgctcctaatctgcaagtcaaggtccctggaccggagggggatccaaagagcggctgacatcgagcagcaagctgtctttgccgtctttgacgagaataagtcctggtaccttgaagataacatcaataagttctgcgagaatcctgacgaggtcaagcgggacgaccctaagttctatgagagtaatatcatgagcaccatcaatggatacgttccagagtcaataaccactctgggcttctgctttgatgacacagttcagtggcacttttgtagtgtgggcactcaaaatgagattctgaccatccatttcactggtcattcttttatctacgggaagaggcacgaagatactctgaccctgtttccgatgcggggggagagtgtgacagtcaccatggacaatgtgggaacgtggatgctcacttcgatgaatagctcacctaggagcaagaaactgcgattgaagtttcgcgatgtgaaatgtatccccgatgacgacgaggatagctacgaaattttcgagccccccgaatctacagtaatggctacgcggaagatgcatgatcgactggagcccgaagacgaagaatctgatgcggattatgactaccagaatagactggcagccgcactcgggataagatccttccgtaattcatcgctgaaccaggaagaggaggaattcaatctgacagctctagctctagagaatgggaccgagtttgtcagctctaatactgacataattgtcggctccaactatagttcaccaagcaatatctcaaaattcacagtgaataaccttgccgagccacaaaaagctccctctcatcagcaggccacgaccgcagggagtcccctgcgacatttaattggtaaaaatagcgttcttaacagttccacagcggaacattcttcaccttattcagaggatccaatcgaggaccccctgcagcctgatgtcaccggaattagacttctatctctcggggccggcgaatttaaaagccaagagcatgccaaacacaaaggaccaaaggtcgaaagagatcaagctgctaagcaccgcttcagctggatgaagcttctcgctcacaaagtgggacgccacctgagccaggacacaggcagcccatccgggatgagaccatgggaggacctgcccagccaggacacgggctccccttccagaatgaggccttggaaggatcctccttcagacctgctgcttctgaagcagagtaattcttccaaaatccttgtcgggcggtggcacctagctagcgaaaaaggcagctacgaaataattcaggacaccgacgaagacaccgctgtgaacaactggctgataagcccacagaacgcatcccgtgcttggggagagtctactcctttggccaacaagcctggcaaacagtccggacatcccaaattcccccgcgtgcggcataagagcctgcaggtacgccaggacggtggaaaaagtcgtcttaagaagtcacagtttcttatcaaaacgaggaagaagaagaaggagaaacatacccaccacgcgccactgtctccaaggacattccatcccctgagatctgaggcttacaatacattttcagagagaaggctaaagcattctttggtgttgcacaagtcaaacgaaactagcctgcccactgatctgaatcagactctcccctccatggacttcggttggatcgcctctctgccagatcacaaccagaatagtagtaacgataccggccaggcttcatgccctcctggactataccagactgttcctccagaagagcattatcaaaccttcccgatccaggatcctgatcagatgcacagtaccagtgatccaagccacagaagctccagccctgagctttccgagatgctggagtacgaccggtcgcacaaaagctttcccaccgatatctctcaaatgtccccatcaagcgaacatgaagtctggcagactgtgatctcacccgacctgagccaggtgaccttgtcccctgagctgagtcaaacaaatttgagccctgacctctctcacactaccctttctcctgaattaatccagaggaacctgagtccagcactgggacagatgcctattagtcccgacctctcacatacaacgctaagcccagacctgagccacaccactctcagtctggacctaagccagacaaacctgtcacctgagctctctcagactaacctgagtcctgctctgggtcagatgcctctgagtcctgacctgtctcacaccacattgtccttggacttcagccaaacaaacctcagtcctgagctgtcccacatgaccttgtctcctgagctgtctcagaccaatctctcccctgccctcgggcagatgccgatatccccggatctctctcacacaacattgtcgttggattttagccaaacaaacctgtcccccgaactgtcccaaacaaacctgagcccagcattgggtcaaatgcccttatctcctgatccctcgcacaccaccttatccttagatttgagccagaccaatctctcccctgaattgtcgcagacaaacctcagccctgacctgtccgaaatgccactgttcgcggatctctctcagatccccctgaccccggacctggaccagatgaccctctctcctgaccttggcgaaacagacctgagtccaaacttcggacagatgagtctgtccccagatttatcccaggtaactttgagccccgatatctccgataccacgcttttacccgacctgagtcagatttccccacctccagacctggaccagattttctaccctagtgagtcgtcgcaatcactgctcctacaggagtttaatgagtcttttccgtatccggatctgggacagatgccttcaccatctagcccaaccctgaatgatacattcctctcaaaggagtttaacccactcgtgattgtaggcctgtcgaaggacggcactgattatatagaaattattccaaaggaagaggtgcagtcctcagaggacgattatgctgagattgactacgtgccgtatgatgacccctacaagacagatgtcagaaccaacatcaacagctcaagggaccccgataatatagccgcttggtatttgcggtctaataacggaaatcgtcgtaattactacatagctgccgaagagatctcttgggactactctgagtttgtgcagagagaaaccgacatcgaggactcagacgatatcccagaggacaccacatataagaaggtggttttcaggaagtatctcgattcaaccttcactaagcgggaccctagaggggaatacgaggaacacctaggaattctgggcccaataattcgagccgaggtggatgatgtcattcaggtgcgtttcaagaacctggcctcacggccctacagcttgcacgctcacggcctgtcatacgaaaagtcctctgagggcaagacctacgaagatgattctccagaatggtttaaggaagataacgcggttcagcccaacagtagctacacttatgtctggcacgcaacggaacgttcaggaccagagagcccggggagtgcatgtcgcgcttgggcctattatagcgccgtgaaccccgaaaaggacattcattccgggttgatcggccccctgctgatttgtcaaaagggcatcctgcacaaagatagtaatatgcccatggacatgcgggaatttgtgttacttttcatgacctttgacgaaaagaaaagctggtactacgaaaaaaagagccgcagttcttggagactgactagttctgagatgaagaaaagccacgaattccacgcgataaacggcatgatttacagcctacccggtctaaagatgtacgagcaggaatgggttcggctgcatctcctcaatatcgggggctcacaggatatccacgtcgtgcactttcacggccagacacttctggagaatggaaataaacagcatcaacttggggtctggcccttgctgcctggtagtttcaaaaccctggaaatgaaggcctcgaaacctggctggtggctgctgaatacggaagtgggcgagaaccagagagccggaatgcagactccctttttgatcatggaccgggactgtagaatgccaatgggactctccaccggtatcatctctgactctcaaatcaaagcaagcgagttcttaggatattgggaaccccgcctggcgcgcctgaacaacggcggaagttacaatgcatggagtgtggaaaagctcgctgcagaattcgcctcgaaaccatggatccaggtcgatatgcagaaggaagtcatcattacagggatacaaactcaaggagcgaaacactacttaaagtcatgctataccacagagttctacgtggcctactcttctaaccagataaactggcaaatctttaaagggaactccacccgcaatgtaatgtacttcaacggaaacagcgatgcctctacgataaaggagaaccagttcgacccaccgattgtggctagatatatacgcatctcccccacgagagcttacaaccgaccgactctgagactggagctccaggggtgcgaggtgaacgggtgcagtacgcctctcggcatggaaaacgggaagatagagaacaaacaaatcaccgcgtccagttttaagaaatcctggtggggtgactactgggagccgtttagggccaggctaaatgcacaggggcgggtaaatgcctggcaggctaaggctaataataataaacaatggctcgagattgacctgctgaagatcaagaaaattaccgctatcattacccaggggtgcaagtcactctcctctgaaatgtacgtcaaatcgtatacaattcactatagcgaacagggagtcgagtggaaaccctatagactgaagagctccatggtagacaaaatctttgagggcaacacaaacaccaaagggcacgtcaaaaacttttttaatccgccgatcatcagtcgtttcattcgtgtgatacctaaaacgtggaaccagagtatcgcactccggttggagctttttggctgcgacatctac

SEQ ID NO: 9098 - DNA, 6672 bp, Artificial Sequence
  Description of Artificial Sequence: Synthetic coding sequence
atgtttcccggctgtccacgcctgtgggtgctcgtggtcctcggcacttcctgggtgggatggggttcgcaggggaccgaagcagcacagctccgtcagttttacgtggcagcgcagggaatttcctggtcctacaggcctgaacctaccaactcatctctcaacttgtcggtgaccagctttaagaagatcgtataccgcgaatacgagccctactttaagaaggaaaagcctcaatcgaccatctcggggctcctcggacctactctgtacgcagaagtgggagatatcattaaggtgcactttaagaacaaggctgataagcccctttctattcatccgcagggtattaggtactcaaagctctccgaaggggcctcctacctggaccacaccttccccgcagagaaaatggacgatgcagtggcaccaggcagagaatacacgtacgaatggtcgattagcgaggacagcggtcctactcatgacgatccaccttgtctgactcacatctactattcccatgaaaatcttattgaagatttcaattccggactcattgggcctcttcttatctgcaagaaaggtactctgaccgaagggggaactcagaaaactttcgataaacaaattgttcttctcttcgctgtgtttgacgaatcgaaaagctggagccaaagcagctcccttatgtacaccgtgaatggatatgtgaacggtactatgccggacatcaccgtgtgcgcccatgaccatattagctggcacctgctgggtatgagctcgggtcctgaacttttttccatccatttcaacggtcaagtgctggagcaaaaccatcacaaggtgtctgccattactcttgtctccgcaacctcgactaccgctaatatgactgtcggccctgaaggaaagtggattatcagctcccttacgccaaagcatctgcaagccggtatgcaggcatacattgacataaagaattgccccaagaaaactcgcaaccttaagaaaatcactcgcgaacagcggcggcatatgaaacgttgggaatacttcatagcagctgaagaagtgatttgggactatgcaccagtgattcccgcaaatatggataagaagtaccgatcccaacaccttgacaacttttccaaccaaataggcaagcattacaagaaggtgatgtatactcagtacgaggacgaatctttcaccaaacatactgtgaacccaaatatgaaggaagatgggatcctggggccaattatccgcgcacaggtgagagatactctcaaaatcgtgttcaagaacatggcgtcacggccttactccatataccctcatggagtcacctttagcccgtacgaagatgaagtcaactcctcatttacgtccgggaggaacaacaccatgatacgggcagtgcagcccggcgaaacgtacacttacaaatggaacatcctggaatttgacgagcctacggaaaatgacgcgcagtgtcttacgcgcccttactactcagatgtggacatcatgcgtgatattgcatccggactcatcggactgttgctcatttgcaagtcgcgctcacttgaccgtagaggtatccagagagcagcagatatagagcaacaagcggtgtttgccgtgttcgatgagaacaagagttggtacttggaggataacatcaacaaattctgcgaaaatccagatgaggtgaaacgtgatgatccaaagttttacgagtcaaacatcatgtccactattaacggttacgtccctgaaagcatcaccactctcggcttttgctttgacgacaccgtccagtggcacttttgtagcgtcggaacgcagaatgaaatcctgactattcactttacgggtcattcattcatttatggtaagaggcatgaggacactcttactctctttcccatgcggggagaatccgtgactgtgaccatggataacgttggcacctggatgctcacctccatgaacagctctcctcggtcgaagaagctgcggctgaagtttagagacgtgaagtgtattcctgatgacgatgaggattcttacgagatctttgagccacccgaaagcaccgtgatggcaacccggaaaatgcatgatcgcctggagcccgaggacgaggaatcggatgcggattatgactaccaaaacaggcttgcagctgcactggggattcgtagctttagaaattcgagcctcaatcaggaagaagaagaattcaaccttactgccttggcactcgaaaacggaacggagtttgtctcctcgaatactgacataatcgtgggcagcaactactcgtccccaagcaacatttccaaattcaccgtgaataatcttgccgaaccacagaaagcgccctctcatcaacaggcgacgaccgcaggatcccctctgcgtcacctgatcggaaagaatagcgtgctcaattcctcgaccgcggaacattcaagcccatacagcgaagatcctatcgaggatcctcttcaaccggatgtgacgggaatcagactgctctcgctcggggccggtgaattcaaatcacaagaacacgcaaagcacaaaggaccaaaagtggagcgcgaccaagcagcaaaacatagatttagttggatgaagctgctggcccataaggtgggaaggcacctttcgcaagataccggaagtccatcaggaatgaggccgtgggaggatcttccatctcaagataccggtagcccttcacgcatgcgcccatggaaggaccctccaagcgaccttctgcttctgaagcaaagcaactcgagtaagatccttgttggaaggtggcatcttgcctcagagaaaggaagctacgaaatcatccaagacaccgatgaggataccgcagtgaacaactggctgattagccctcaaaatgcgtcccgcgcgtggggcgaatcaactccattggctaataagcctggcaaacagtccggacacccgaaatttccaagggtgcgccataagtccctgcaggtgagacaagatggcgggaagagcagactgaagaagtcccagttcctgattaagacccggaagaaaaagaaagaaaagcatacgcatcatgcacctctttcccctcgcacttttcaccctcttcgcagcgaagcctacaacacgttttcggagcgccgtctgaagcattcgctggttctccacaagtctaacgaaacttcgctgcccactgatcttaaccaaactcttcccagcatggattttggatggattgcatcactgccagatcacaatcagaattcctccaatgacactggccaagcgtcctgtcctccagggctttaccagaccgtgcctccggaagaacattaccaaactttcccaatccaagatccagatcaaatgcactccacgtccgatcctagccatcgatcctcaagccccgaactgagcgagatgctggaatacgatagatcccataagtcttttccgacggacatctcccaaatgtccccttcaagcgagcatgaagtctggcaaaccgtcatttcgccggatctgagtcaagtcaccctttccccagagctcagtcagactaacctttctccagatctttcgcacaccactctgagccctgagttgattcaacggaacctctctcccgccctgggacagatgccaatcagccctgacttgtcgcatactactttgtcacctgacctttcgcacactactctgagcctggatctctcacaaacgaacctgtccccagaactttcgcagactaatctttcccctgcacttggccaaatgccgctgtcaccggatctcagccacactacccttagcttggatttttcacaaaccaatctgagccccgagctgtcgcacatgacgctgagccccgaactttcccagactaacctgagcccggcgctgggccaaatgcccatttcgcctgatctcagtcatactactctttctctggatttctcgcaaaccaacctgtcgccagaactcagccagactaatctctcacccgcactcggtcaaatgccactttcacccgacccttcccacaccaccctgtccctggatcttagccagaccaatctctcgcccgaattgagccagaccaacttgagccctgatctctcggagatgccactttttgcagatctgtcgcagattcctctgactcctgatctggaccaaatgacccttagccctgatcttggtgaaactgatttgagcccgaactttggacagatgtcgctgtcccctgatcttagccaagtcaccctctcgcctgacatttccgacacgaccctgctgcccgatttgtcccagatctcgccgcccccagacttggatcagatcttttacccatccgaatcctcgcaatcgctcctgctccaagaattcaacgagtcgtttccgtaccccgatctgggtcagatgccatccccttcgtctcccaccctcaatgatacttttctttccaaggaattcaaccctcttgtgatcgtgggactgtccaaagacggaactgattacattgagataatacccaaggaggaagttcaatcgtcggaagatgattacgcagaaattgattatgtcccgtacgacgacccttacaagaccgatgtgagaacgaacatcaactcgtcccgcgaccccgacaacatcgccgcatggtacctgaggtcaaataacggtaaccggcggaactactacatcgctgccgaggagatatcctgggactactcggagtttgtccaaagggaaactgacattgaagattccgatgatatccccgaagataccacctacaaaaaagtggtgttcaggaagtacctcgattcgacctttaccaagcgagatccgcggggggaatacgaagaacatctgggaattctgggaccgataattcgcgcagaggtcgacgatgtcatccaggtgaggttcaagaacctggccagccgaccatacagcctgcatgcacatggtcttagctacgaaaagtcatcagaaggaaagacctatgaagatgatagccctgagtggtttaaggaggacaacgccgtccagccgaacagctcatacacttacgtgtggcatgctaccgaaaggtccggcccggaatcaccagggtccgcctgcagagcgtgggcatactacagcgccgtcaatcccgaaaaggatattcattccggtttgataggtcctctcctgatctgtcaaaaggggattctccataaagattccaatatgccaatggatatgcgagaattcgtgctgctctttatgacctttgatgagaagaaaagttggtactacgagaaaaagtcgagatcatcatggagattgacttcgtcggagatgaaaaagtcgcacgagtttcatgcgattaatggcatgatctactcactcccaggacttaagatgtacgaacaggagtgggtgcgacttcatctccttaacataggaggatcacaggacatccacgtggtccactttcatggtcagactctcctggaaaatggtaacaagcaacaccaacttggagtctggcctctgctccctggatcgttcaagactctcgaaatgaaggcatccaaacctgggtggtggctccttaacaccgaagtgggcgagaaccaacgcgccggaatgcaaacccctttcctgataatggatagggactgccgcatgcctatgggactctccactggcataatcagcgattcgcagattaaggcgtcagagttcctcggatattgggagccgagactggcccgattgaataacggaggctcgtacaatgcatggtcggtcgaaaaacttgccgctgagttcgcgtcgaagccgtggattcaagtggacatgcaaaaggaggtgatcattactggaattcagacccaaggggcaaaacattacctcaagtcgtgctacactaccgaattctatgtcgcatactcttccaatcagattaactggcagattttcaaagggaactccacccgtaacgtgatgtacttcaacggtaacagcgacgcatccacgatcaaggagaaccagtttgatccacccatcgttgcaagatatatccggatttcacccacgcgcgcatacaatagaccgaccctgagattggaacttcaagggtgcgaagtgaatggatgtagtaccccactgggcatggagaatgggaaaatcgagaacaagcagattaccgcatcaagttttaagaagtcctggtggggtgattactgggaacccttccgggcacgcctgaatgcccaaggacgtgtgaacgcatggcaggcaaaagccaataacaataaacaatggctggagatagatcttcttaagatcaagaagatcactgcaattatcacccaaggttgtaagagcctttcctcagaaatgtacgtcaagtcgtacaccatccattactccgagcagggtgtcgaatggaagccatatcggttgaaatcgtcgatggtcgacaagatttttgagggaaacaccaacaccaagggtcacgtgaagaacttctttaatccaccaattatctcaaggtttattcgagtgattcccaagacctggaaccaatccatcgccctccgacttgaactgttcggttgtgatatctat

SEQ ID NO: 9099 - DNA, 6672 bp, Artificial Sequence
  Description of Artificial Sequence: Synthetic coding sequence
atgtttccgggatgcccacgactttgggtgctggtggtgctggggacttcctgggttggctggggatcccaggggactgaagcggcccaactgagacagttctatgtagcagcacaggggatttcgtggtcgtatcgtcctgagccaactaattcgtcgctcaacctgtcagttacttccttcaagaagattgtctacagggaatacgagccatactttaagaaggaaaaaccacagagcaccatttcagggcttctcggccctacgctgtacgcagaagtgggagatatcataaaggtccacttcaaaaacaaagctgataaaccactctcgatacatccacagggtattcgatattccaagctctcggaaggcgcatcatatctcgatcatacttttcctgcggaaaagatggacgatgcagtggcacctgggcgagaatacacttatgaatggtcgatctccgaggatagcgggcctacgcatgacgacccaccatgtcttacccacatttactactcacatgagaatctgatagaggatttcaactctggcctcataggaccccttttgatttgtaagaaagggaccctcaccgaaggggggacccaaaaaactttcgataagcagatagtgttgctttttgcagtgttcgatgagtcgaagagctggagtcaatcgtcgtccctgatgtacacggtgaacggctacgtgaacggtactatgcctgatatcaccgtgtgtgcacacgaccacatttcctggcatctgcttggaatgagttcgggaccagagctttttagcattcatttcaacggacaagtcctggagcagaatcaccataaggtgtccgcgattacccttgtaagcgctactagcaccaccgcaaacatgactgtggggcctgaaggtaaatggattatctctagcctcactcccaagcatttgcaggccggtatgcaagcatacattgatatcaagaactgtccgaaaaagaccagaaacctgaaaaagattactcgtgagcaacggaggcacatgaagagatgggagtactttatcgcggccgaagaagtcatttgggactacgcaccagtcattccagccaacatggacaaaaagtaccggagccagcacctggataacttttcgaaccaaataggtaagcactacaagaaggtgatgtatacccagtacgaggatgagagcttcactaagcataccgtcaatccaaatatgaaggaagatggtatccttggaccaattatcagagcccaagtccgcgataccctgaagatcgtgtttaagaacatggcgtcgcggccatattcaatctaccctcatggtgtcactttttcgccttacgaagatgaggtcaattcgtccttcaccagcggaagaaacaatactatgattcgcgccgtgcaaccgggcgaaacttacacctataagtggaacattcttgaatttgacgaacctaccgagaacgacgctcaatgcctgactcgtccttactactctgatgtggacataatgagggatattgcatccggtttgatcggactgctgctcatctgtaaatcgcgcagcctcgatcggcgggggatccaaagagcagcagacattgaacagcaagctgttttcgcagtgtttgacgagaataagtcttggtaccttgaggacaacattaacaagttttgcgaaaacccagatgaagtcaaacgtgatgatcctaagttttacgaatcaaatatcatgtcaaccatcaacggttacgttcccgaatcgataaccaccctcggattctgttttgacgataccgttcaatggcacttttgctcggtcggtacccagaacgaaattcttaccatccatttcactggccattccttcatttatggaaagagacacgaggatactcttactctttttcctatgagaggcgagtcagttactgtgaccatggacaacgtgggcacctggatgcttaccagcatgaactcctctcctcgctcgaagaaacttaggctgaagtttcgggatgtgaaatgtatcccagatgacgacgaagattcatacgaaatctttgaacctcccgaatcaactgtgatggcaactaggaaaatgcatgatcgcctggagcctgaagatgaagaatcagatgcagattacgattaccagaacagacttgcagcggcactgggcattcgctcattccgcaattccagccttaatcaggaagaggaggaattcaaccttaccgccctggcactcgaaaacggtacggaatttgtatctagcaacaccgacattatcgtgggaagcaattactcgagcccatccaatatctctaaattcactgtgaacaacctggcggagcctcaaaaagcgccttcccatcaacaagcaacgactgcagggtcccctctcagacatctcattggtaagaactcggtgcttaatagctccactgccgaacattcgagcccgtactcggaagatccaattgaagatccccttcagccggatgtgactgggatcaggcttctgtctctcggtgcaggggagtttaagtcgcaggagcatgccaagcacaaaggtcccaaagtggaacgcgaccaagccgctaagcacagattttcctggatgaaacttcttgctcacaaggtggggagacatctgtcacaagataccggtagccctagcggaatgcgtccttgggaggatcttccctcccaagataccggatcgccttcccgaatgcgcccctggaaggatcctccgtccgatctgctgctgcttaaacagtcgaattcgtccaaaattctcgtcggaagatggcacttggcctcggaaaaaggatcctacgagattattcaggataccgatgaggatacggcagtcaataactggcttatttcacctcaaaacgcatcgcgtgcgtggggtgaatccacccccctcgccaacaagccaggcaagcagtcgggccaccccaagtttcccagggtcagacacaagagcctccaggtgagacaagacgggggtaagtcacggcttaagaagagccaattccttatcaaaacgagaaagaagaaaaaggaaaagcatactcatcatgccccgctttcccctcggacctttcatcctcttcggtctgaagcatataacaccttttcagagcgacgccttaagcattcgcttgtgctccacaagtcaaatgaaacgtcccttcctaccgatttgaaccagactctgccttcaatggacttcggatggattgcaagcctccctgatcacaaccagaattcgtcgaacgataccggacaagcctcctgtcctcctggcctgtaccagacggtgcccccagaagaacattaccaaacgtttcccatacaggaccccgaccagatgcactcaacttctgatccttcgcacagatcatcctcccccgaattgtccgagatgttggaatacgaccgtagccataaatcatttcctaccgatattagccagatgtccccttcctcagaacacgaagtgtggcagaccgtcatttcaccagacctctcgcaagttactctgagcccagaattgtcgcaaacgaatttgagcccagatctgagccatactacgttgtccccagaacttatccaacgaaacttgagccctgcattgggacagatgcccatatcacccgatcttagccatactactctgtccccggacctttcccataccaccttgtccttggacctcagtcaaaccaatctttcaccagaactctcgcagacgaacctgagtccagcccttggtcaaatgccgctgtctcctgatctgtcccatacgaccctgagccttgacttctcacaaactaacctctcaccagaactttcacatatgactctgagtcccgaacttagccagaccaacctctcgcctgccctgggtcagatgcctatttcgccagatctgtcgcacacgaccctttctctggacttttcacaaaccaatctcagccccgaattgagccaaaccaatctgtcaccggctctggggcaaatgccactctccccggacccgagccatacgactcttagcctggacctgagccagactaatctctcacctgagctttctcagaccaacctgtcccccgacctgtccgaaatgcctctgttcgctgatcttagtcaaattccacttacccccgacctcgatcaaatgactctctcaccagatctcggtgagacggaccttagtcccaactttggacaaatgtcactttcacctgatctctcacaggtcactctgtcccctgatatctccgacacgacgcttctgcctgacctttcacagatttcgcctccccctgacttggatcagatcttttacccgtccgaaagctcacagtcccttcttttgcaagagttcaatgaatcgtttccataccctgaccttggccaaatgccgtcgccatcgtccccgaccctgaacgatacttttttgagcaaagagtttaaccccctggtcatcgtgggtctttccaaagatggtaccgattacatcgagattatcccgaaggaggaagtccaatcgagcgaagatgattacgcagaaattgattacgtgccttacgacgacccatacaagaccgacgtgagaacgaacatcaactcatccagggacccagacaacattgcagcatggtacctgaggtcgaataatggaaataggagaaattactacatcgcagcggaagagataagctgggattacagcgaattcgtgcaacgggaaactgacattgaagattccgatgacatcccagaggacactacttacaagaaagtggtgtttcggaaatacctggattcaacgttcactaagcgcgatccacggggcgagtacgaggagcacttgggaattctgggacctatcatacgcgcagaagtggatgacgtgatacaggtgaggttcaagaacctggccagtagaccttacagcctgcatgcacacggcctctcctacgaaaaatcgtcggaaggcaaaacctacgaggacgactcccctgagtggtttaaggaagataatgcagtgcagcctaacagctcttacacctacgtttggcacgccaccgaaagatccggtccagaatcacccggctcagcctgtcgtgcttgggcatactactcggccgtcaatccagaaaaggacatccatagcggtctgatcggaccactgctgatttgccaaaaaggaattcttcataaggattcgaatatgcctatggatatgcgcgaatttgtgcttcttttcatgacgttcgatgagaagaagtcgtggtactacgagaagaagagcagatcctcgtggagacttaccagctcggagatgaagaagtcccatgaatttcatgcaattaacggaatgatttactcgcttccgggacttaagatgtacgaacaagaatgggtccgcctgcatcttctgaacattggaggctcgcaggacatccatgtggtgcactttcatggacagaccctgttggaaaatggtaataagcaacatcagctgggagtgtggccactgttgcctggatccttcaagaccctcgaaatgaaggcatccaagcccgggtggtggctcctcaacactgaagtgggggaaaaccaacgagcagggatgcagactcccttcctcattatggatcgagattgcagaatgccaatgggtctgtcaaccggtattatctcggactcccaaatcaaagcatcagaatttcttggctattgggagccacgactggcccggctgaataacggtggatcttacaacgcctggtccgtcgaaaagctcgcagcagagtttgcaagcaagccttggatacaagtcgatatgcaaaaagaagtgatcattaccggaattcaaacgcagggagcgaagcattacctgaaatcatgttacactactgagttttacgtggcttactcgagcaaccaaatcaattggcagattttcaagggaaactccacccgcaatgtgatgtacttcaacggtaactcggacgcgtccactatcaaggaaaaccagtttgatcccccaatagtggcccgttacatccgcatatcgccaacgagagcatacaatcgaccgactctgagactcgaactgcaaggttgcgaggtgaacggatgtagtaccccgcttggtatggagaacggtaagattgagaataaacaaataaccgcatcgtccttcaagaaatcttggtggggggattactgggaaccctttcgagctcgtctgaacgcacaagggcgggtgaacgcgtggcaagcaaaggccaacaacaacaagcaatggctcgagattgatctgctgaagatcaagaagattactgcaatcataacccagggttgtaagtcgcttagcagcgaaatgtacgtgaagtcgtacaccatccactactcagagcaaggagtcgagtggaagccatatcgcctgaaatcaagcatggtggataagatttttgaaggaaatacgaacactaagggacatgtcaagaatttctttaatcctcctatcatttcgcggtttattcgcgtgatccctaaaacctggaatcagtccattgctctgagattggagttgttcggttgcgatatctac

SEQ ID NO: 9100 - DNA, 6672 bp, Artificial Sequence
  Description of Artificial Sequence: Synthetic coding sequence
atgttccccggatgtcctcgcctttgggtgctggtggtgctagggaccagctgggtgggatgggggtcgcagggcactgaggcagcccaactgcggcagttttatgtcgccgctcagggcattagctggtcgtataggccagaacctaccaatagcagtctgaacctgtcagtcacatcatttaagaaaatcgtttacagagagtatgagccttacttcaagaaggaaaagccacagtcaaccattagtggccttctgggccctaccctgtacgccgaggtgggagacatcatcaaagtgcacttcaagaataaggcggataagccactgtcaatccacccccagggcattaggtacagtaagctctctgagggcgcttcctatctggatcatacattccctgctgagaagatggatgatgccgtagctccaggacgggagtatacctatgagtggtcaatatctgaggattccggaccaacccacgacgatcccccatgccttacccatatatactatagccacgaaaatttgattgaggacttcaacagtgggctaattgggccccttctgatatgcaagaagggaacgctcacagaaggcggcactcagaagacatttgataaacaaatcgtgctcctgttcgctgtctttgatgaaagtaaatcttggagccagtcctctagcctaatgtacactgtgaatggctatgtgaatggcaccatgcccgacataactgtgtgtgcacatgaccatatctcctggcacctcctggggatgtcctccggccccgagctgttctctatccacttcaacggacaggtgctggaacaaaaccatcataaggttagcgccatcaccttagtgtcagctacaagtactactgccaacatgactgtagggccggaaggaaaatggattattagtagtctgacgcccaagcacctccaggcaggtatgcaagcatacatcgacattaagaactgccccaagaaaacccggaacctgaaaaaaatcacaagagaacagaggcgccacatgaagcgctgggaatattttatcgcggccgaagaggtgatttgggattacgccccagtaatacccgcaaatatggacaaaaagtatcggtcccagcatctcgacaacttcagcaatcagattgggaagcattacaaaaaggtaatgtacacccagtatgaggatgagtcgtttacgaaacataccgtcaaccctaacatgaaggaggacgggattttgggccccatcattcgtgctcaggtgcgggacacactgaaaattgttttcaaaaatatggccagtaggccctattctatctatcctcacggcgttaccttctccccttacgaggatgaggtgaattcgtcttttacttcaggccggaataataccatgatccgtgccgtgcagccgggggaaacttacacatacaagtggaacatactcgaatttgacgaaccaacggaaaacgacgctcagtgtctcacgcggccttactattccgatgtggatattatgcgagacattgccagcggcctgatcgggttactccttatatgcaagagtcgttcattagatagaaggggcatccagcgcgcagccgacatcgaacaacaggccgtcttcgccgtttttgacgaaaataaaagttggtacctggaggataacattaacaaattttgcgagaaccccgacgaggtgaagagggatgatccaaaattttatgagtcaaacattatgtcgaccatcaacggctatgtccccgagtcaatcacgacattagggttttgttttgatgacacagtgcagtggcacttctgttccgttggtacccagaacgagatactgacaattcacttcaccggtcactctttcatctatggcaaacggcacgaggacactctaacactgttccctatgaggggcgagagtgtgaccgtcacaatggacaatgttggcacctggatgctcacatctatgaactcttcccccagaagcaaaaagttgaggctgaaattcagagacgtgaagtgcatccccgatgatgacgaggactcatatgagatctttgaaccgcccgagtccactgttatggccacccggaagatgcatgatcgcctggaaccagaggatgaagaaagcgatgccgactacgactaccagaaccggctggctgccgccctgggcatcagaagtttcagaaactcgtctctgaaccaggaagaagaggagttcaacctgacagccctcgccttggagaacgggacagagttcgtatccagcaacacggatatcatcgtggggagcaactatagttctccctctaacattagtaagttcaccgtgaacaatttagcagaacctcaaaaggcgcccagccaccagcaggctactaccgctggatctcccttgagacatctgattggaaagaactcagtgctgaacagtagtacggccgagcatagcagcccctatagcgaagatcccattgaggacccattgcaacccgacgtaaccggcattcgcctgctgagcctgggggctggggaatttaagagccaggaacatgctaagcacaagggcccgaaagtagaaagggaccaggccgcaaagcatcgcttcagctggatgaagctgctggcacacaaggtgggtcgccacttatctcaggatactggtagtccgtcaggcatgcgcccttgggaggaccttccaagccaggatacaggcagtcccagccggatgagaccgtggaaggaccctcccagcgacctgctcctgctgaagcagagcaattcttcgaagattcttgttggacgctggcacctggcctcggaaaaaggcagctatgaaatcattcaggacacagacgaagataccgcggtgaacaactggctcatatcaccacagaacgccagccgcgcctggggagaatctacccctctagcaaataaacctgggaagcaatcaggacaccctaagttcccacgggtaaggcacaaatctttgcaggtgcgccaggatggggggaagtcacgtcttaaaaagagccagtttttgattaaaacccggaagaagaagaaggagaaacacacacatcacgcgcccttgtcccctcgaaccttccatccgctcaggtctgaagcttacaataccttcagcgaacggaggttgaagcatagcctggtcctgcacaaatccaacgagacatcgctccccaccgacctgaaccaaaccctgccatcaatggactttggatggatcgcaagtctacctgatcataaccagaactcgtctaacgacacagggcaggcctcctgcccccccggcctgtaccaaacggttccccccgaggaacattaccagacctttcccattcaggatccagatcagatgcattccacttccgacccgtctcatcgttcttcctcccccgagctgtctgagatgctggaatacgaccggagtcacaaaagttttccaaccgacatttcacagatgtctccatcctccgaacatgaagtttggcagactgtcatatcccctgacctgtcacaggtgactctatcccctgaactaagccagactaatttgtccccagacctgtctcacacaactctgagcccagaactgattcagaggaacctctctcctgcactgggacaaatgccaatctcaccagacctgtcgcataccacactctccccagacctgtcacacaccactctgtctttggacctgtcacagaccaacctgtcacctgaactgtcacagacaaacctgagtccggctctgggacagatgccactgtctcccgacctgtcacatactaccctcagcctggatttcagtcagacaaacctgagcccagaactgagccacatgaccttgagtcccgaattatctcagacaaatctatcccctgcactgggccagatgcccatctcccctgatctgagtcacacaaccctgtccctggacttctctcaaaccaatctgtctccagagctatcacaaactaatctgtcaccagcactagggcaaatgcccctgagccctgacccatcccacacgacattgtctctggacctcagtcaaaccaatctatcacctgagctgtctcagaccaatctgagccccgatttgagtgaaatgccacttttcgccgacctctctcagatccccctcactcccgatctcgatcagatgaccctttcccccgacctgggagaaaccgacttgagtcctaactttggccagatgtcactgtcacccgacctgtcccaagttactctgtcacctgatattagcgatactacgctgctccctgatcttagccagatctccccccctccggacctggatcagatattctaccctagcgaatcttcccagtcacttctgctgcaagagtttaacgagtcatttccttacccggacttggggcagatgccttcaccctcttctcctaccctgaacgacacctttttaagcaaggagtttaaccccctggtcatcgttggcctgtccaaggacggcacagactacatcgaaatcattccaaaggaagaggttcagtcctcggaagacgactacgccgagatagattacgtcccttacgacgatccatataagacagatgttagaactaatatcaattccagcagagaccctgacaatatcgccgcctggtacttgaggtctaataacggaaatcgccgtaactactacatcgccgctgaggagatctcttgggattacagcgagttcgttcagcgggaaaccgacattgaagacagcgacgacatacctgaagatactacttataaaaaagtggtgtttcgcaaatacctggactcgacctttaccaagcgagacccacggggagagtatgaggagcatctggggattttgggtcctattattagggccgaagttgacgacgtgatacaggtgcgattcaagaatttggctagcaggccctactcattacatgctcacggtttgagttacgagaagtctagtgaaggtaagacttacgaagacgattctccagagtggtttaaggaggataacgctgtacaacccaattctagctatacttacgtgtggcacgcaacagaaagatccggaccagaatctcctggctctgcttgccgagcgtgggcatattattctgccgtgaaccccgagaaggacattcactccggtctgataggccccctccttatttgccagaagggcatcctgcacaaggatagtaatatgccgatggacatgcgagaatttgtgctcttattcatgacatttgatgaaaagaagtcctggtactatgagaagaagtcccgcagctcttggagactcacctctagcgagatgaagaaatcacacgaattccatgcaattaacggtatgatttatagcctcccaggacttaaaatgtacgagcaagaatgggtgagattgcatttactgaacatcgggggctcgcaggacattcacgttgtccactttcatggccaaactttgctggaaaacggtaacaaacagcaccagttgggagtatggcccctcctgcctggaagcttcaagacgctggagatgaaggctagtaagcccgggtggtggctactgaataccgaggtcggtgaaaaccaacgtgctgggatgcagacgccatttctgataatggatcgtgactgtagaatgccaatgggtctctctactggtattatctctgactcccaaatcaaggcctccgaatttctaggatattgggagccccggctggctaggctgaacaatggcggaagctacaatgcgtggtccgtggagaagctggccgccgagttcgcctctaagccttggattcaggtggacatgcagaaggaggtgatcattacaggaattcagacccagggagccaaacactacctcaagtcatgctacacgaccgaattctacgtagcttattcttcaaaccagatcaactggcaaatctttaaaggcaattcaacgcgcaacgtcatgtactttaacggaaactctgacgcctctacaattaaagagaaccagttcgaccctcctatcgtggctcggtacattaggatctctcccaccagggcctacaaccgacctacactcaggctggagcttcaaggttgtgaggtcaacggatgctctactcccttgggcatggagaatggcaaaatcgaaaataaacagatcacggcctcatccttcaagaaaagctggtggggagactactgggaaccatttagagctaggctgaatgctcaggggagggtcaacgcctggcaagccaaggcgaataacaacaaacagtggctcgaaattgacctactcaagatcaaaaaaatcaccgctatcatcactcaagggtgcaagtcgctgtccagcgagatgtacgtaaaatcttacactatacactattcggagcagggcgtagagtggaaaccatatcgactgaaatcgagcatggtggacaagatctttgaaggcaacacaaacacaaaggggcacgtgaagaacttctttaatcctccaataattagcaggtttattagggtcatccctaagacttggaatcagtccatcgcactgcgattagagctgtttggttgtgacatttat

SEQ ID NO: 9101 - DNA, 6672 bp, Artificial Sequence
  Description of Artificial Sequence: Synthetic coding sequence
atgttcccaggctgcccacgcctgtgggtcttagttgtgttgggcacttcatgggtgggctggggctcccagggtacagaggctgcacagctgaggcagttctatgtggcggcacaaggcatttcttggtcctaccgtcctgagccaactaacagctccctgaatctcagcgttaccagtttcaagaagatcgtttatcgcgaatatgagccttactttaagaaggagaagccgcaaagcacgatcagcggcctccttgggccgacgttgtatgcggaggttggtgatatcatcaaggtgcatttcaagaataaagctgacaagcccctcagcatacacccacaaggtattcgttatagcaaactatctgagggggcaagctatctggatcacacgttcccagctgagaagatggatgacgcggttgcgccagggagggaatatacctatgagtggtccatctcggaggattccgggccaacccatgatgatcctccatgcttgacgcacatttactactctcacgagaatctgattgaggacttcaactctggtctgatcgggccgctgctgatctgcaagaagggcacgctgaccgaaggcggcactcagaaaacctttgacaagcagattgtcttgctgtttgcagtgttcgatgaaagtaaatcttggtcccagagctcctctctgatgtacacggttaatggatacgttaacggcaccatgccagacattactgtttgcgcccacgatcacatcagttggcatttactgggtatgtcctccgggccggaactgttttccatccactttaatggtcaagttctggaacagaaccaccacaaggtgagcgcaatcacgcttgtgtctgcgacttccacgactgccaacatgacagttgggcctgaaggtaaatggattatctccagcttgactcctaaacacctacaggccggtatgcaggcgtatatcgacataaagaactgccccaaaaaaactcgcaatctgaaaaagattaccagagagcagcgccgccacatgaaacgttgggagtattttatcgccgccgaggaggtaatttgggactatgcaccggttattccggcaaacatggacaaaaaatatcgtagccagcacctggacaacttcagcaatcagatcgggaaacactataaaaaggttatgtacacccagtacgaggatgagtcttttactaaacatacggtcaaccctaatatgaaggaagatggcatcctgggtccgatcatccgcgcccaggtgcgagacacactgaagattgtgttcaaaaatatggcttcacgcccgtactccatctacccccatggggtgaccttttctccgtatgaggatgaggttaattcctcctttacttcaggccgcaataataccatgattagggcggtgcaaccgggtgagacctatacctacaagtggaatatcctggaatttgacgaacctacggagaacgatgcacagtgtttgacgcgcccatattactcagacgttgatattatgcgcgacatagcgagcggactgattggtctgctgttgatttgcaagagccgtagtctggatcgccgcgggattcagcgcgcagcggatattgagcagcaggccgtgtttgctgtttttgatgagaacaaatcctggtacctcgaggacaacataaataaattctgcgaaaatccagacgaagtgaagcgcgatgaccctaagttctacgagagcaacattatgtctactattaacggctacgttcctgaaagcatcacaactctgggcttctgttttgatgacaccgtccaatggcacttttgctccgttggtactcagaacgaaatcctcaccattcatttcaccggtcatagcttcatttacggtaaacgacacgaagatacgctgactcttttccccatgcgcggagaaagcgttaccgtgaccatggataacgtgggcacgtggatgctcacctctatgaacagctctcctcgttctaagaaattacggctgaaattcagggacgttaaatgcattcccgatgatgacgaggactcttatgaaatttttgaaccccccgaatccactgtgatggcaacgcggaaaatgcacgaccgcctggaacctgaggacgaggagtctgacgctgactatgattaccagaatcgcctcgctgcagcactgggaatacgcagctttcgcaattccagtctgaaccaagaggaggaagagtttaacctgactgcgttggcactggaaaatggcaccgagtttgtgagcagcaacaccgacatcatcgtcggcagcaactatagctcccctagcaatatcagtaagttcactgtgaacaatctggctgagccgcagaaagcgccgtcgcaccagcaggcaactactgcaggaagccctctaaggcatcttataggcaaaaatagcgtgctgaatagcagcaccgcggaacatagcagcccttatagcgaagatcccattgaggaccctctgcagccggatgttaccggaatccgactgctgagcctgggcgctggcgagttcaagagccaggaacacgccaagcataaaggtccaaaggtggaaagggaccaggcggctaaacaccgcttcagctggatgaagctgctggcccataaagtgggtaggcatttgagtcaggacacgggttcgccatcaggcatgcgcccttgggaagacctaccttctcaggataccggcagccctagcaggatgaggccgtggaaggacccgccaagcgacctgctgttgttgaagcagagtaactctagcaagattttggtgggccggtggcacctggcgtcggagaaaggcagctacgagatcatccaggacaccgacgaggataccgccgtgaataactggctcatctctccgcaaaacgcctcccgcgcttggggtgagagcacgccactggcaaataagcctggtaagcagagcggccaccctaagtttcctcgtgtgcggcacaaatccttgcaagtgcgtcaagacggtggtaaaagtcgcttaaagaaaagtcagttcctgattaagacccggaaaaagaagaaggagaagcatacccaccatgcaccattgagcccacgcaccttccaccccctgcgttccgaagcgtacaacacgttttcggagcgccgcctaaagcactctctggtccttcataagtccaatgagacctcgctgccgaccgacctgaatcaaacgctgccgtcgatggatttcggttggattgcctcactgccagaccataaccagaactcctctaacgacaccggtcaggcttcttgtccgcccggtttgtaccagaccgtgccacctgaggagcattaccagaccttcccgatccaagatcctgaccaaatgcactcaaccagcgatccttctcacaggtctagcagtcccgagctaagcgaaatgctagaatacgatcgcagccataaaagctttccgaccgacatttcccagatgagcccttcttctgaacacgaggtctggcagaccgttattagccctgatctctctcaagtgacgctgagcccagagctgagccaaacgaatctctccccggacctgagtcataccacgctgtctcctgaattgattcagcgaaatctgtcacctgcgctgggccagatgccgatcagcccggatctgagccacactaccctatccccggatctgtcacatacgacactgagcttggacttaagccagaccaacctgagcccggagctgtcccaaactaatcttagccctgcactgggacaaatgccactgtctcctgacctgagccacacaactctgagtctggacttctctcaaacgaatctcagccctgagctatctcacatgacgctatccccagagttgtctcaaaccaatctctcaccggccttgggccaaatgcctatttctcctgacctgtcccacactacgttgtctctggacttttctcagactaacctgagccctgagctgagccagaccaatttgtctcctgctctgggtcagatgccccttagccctgatcctagccacactactctgtctctggatttgagccagaccaatcttagcccagagctttcccaaaccaatctgagtcctgacctgtctgaaatgcctctcttcgccgacctgtcgcaaattccactgacgcctgacctggaccaaatgacgctgagcccagaccttggcgagacagacctctccccaaacttcgggcagatgagcttgtcaccggatctgagccaagtgaccttaagtccggatatttcagatacaacattgctgccggatctcagccaaatctcaccaccgccggatctggatcaaatcttttaccctagcgagtctagccagtccttgctgctgcaggaatttaatgagagcttcccctatccggatctgggccagatgccaagcccttcatcacctacactaaacgacacctttctttctaaggagtttaaccctcttgtcatcgtcggcctctccaaagatggtacagactatattgagattatccctaaagaggaagtgcagtctagcgaggatgactacgccgagatcgactacgtgccgtatgacgatccttataagactgacgtccgcactaacattaactcgagccgtgacccagataacatcgctgcgtggtacctcaggagcaataacggaaataggagaaattactatattgcggcggaggagatctcgtgggattatagcgaatttgtacagagggagaccgatattgaggacagcgacgacatccctgaggacactacctacaaaaaggtcgttttcagaaagtacctggactccacgtttactaaaagagacccacgcggtgaatatgaggagcatctgggcatcctgggtcctattattcgcgcagaggtagatgacgttattcaagttaggtttaaaaatctggcgtcacgtccttatagcctgcatgcgcacggcctctcctatgagaaaagcagcgaaggcaaaacctacgaggacgacagccctgaatggtttaaggaggataatgcagtgcagcctaattctagctacacttacgtgtggcacgcaacggaacgctccggacctgaatcccctggatcagcctgcagggcgtgggcgtattattctgcagtgaacccggaaaaagacattcattcgggtcttattggtcccttactgatctgccagaaggggatactgcacaaggactcgaacatgcctatggatatgcgtgaatttgtcttgctgtttatgaccttcgacgagaagaagtcctggtattatgagaagaagtcgcggtcgagctggaggttgacgtccagcgaaatgaagaagtcacacgagtttcacgcaatcaacgggatgatctattccctgcctggtctgaagatgtacgaacaagagtgggtgcgcctgcacctgctgaacataggtggcagccaggacattcacgtagttcacttccacggccagacactcctggagaatggtaataagcagcatcaactgggcgtgtggcccctgctgcctgggtcgtttaagaccctggagatgaaagcaagcaaaccggggtggtggttactgaacaccgaggttggtgaaaatcagcgagcgggcatgcagacgccatttctgataatggacagagattgtcggatgccgatgggcctgagcacaggtatcatatctgatagccagatcaaggcaagcgagtttctgggttactgggaaccgaggctggctcggctgaataatggtgggagctataatgcatggtctgtggaaaagctggctgcggaattcgctagcaaaccatggattcaggttgacatgcaaaaagaagtgattatcaccggaatccagacccagggtgctaaacattacttgaagtcttgctacacgacggaattttacgttgcttacagcagtaatcagatcaattggcagatttttaagggcaactccacgcggaatgttatgtactttaacggcaattccgacgcctctacgatcaaagaaaaccaattcgacccgcctatcgtagcgcgctacattcgaatctccccgacgcgtgcgtataatcggccaacgctgcggctggaattacagggttgcgaagtcaacgggtgcagtactccccttggtatggagaacggcaaaattgagaataaacagatcaccgcgagcagcttcaagaagagctggtggggtgattattgggaacctttccgcgcgcgcttgaatgcccaaggccgggtgaatgcgtggcaagcgaaggcgaataacaacaaacagtggctggagatcgatctgctgaaaattaaaaaaattaccgcgattatcacgcaggggtgtaagagcctgagctctgagatgtatgtcaagtcttacaccattcattatagcgagcagggcgtagagtggaagccgtatcgcttgaagagcagcatggtggataagatttttgaaggtaatacaaacaccaaagggcacgtgaagaacttttttaaccctccaatcattagccggtttatacgcgtgattccaaaaacgtggaatcagtcgattgccttgcgcctggagctgtttggctgcgacatatat

SEQ ID NO: 9102 - DNA, 6672 bp, Artificial Sequence
  Description of Artificial Sequence: Synthetic coding sequence
atgtttccaggatgtccaaggctctgggtgctggtagtactggggacatcttgggttggatggggatcacagggaactgaagctgcccagctgcgccaattctatgtcgccgcccagggaatatcctggtcgtatagacctgaacccacaaacagtagtctaaacttgtccgtgacatctttcaaaaaaatcgtgtatcgggaatacgaaccatacttcaagaaagaaaaacctcagagtactatcagtggacttttagggcccacactgtatgcagaggtgggggatataatcaaagtacacttcaaaaataaagccgataagccactgtctatccatccccagggaattcggtattcaaagctctccgaaggggcttcttatctggatcatacatttcccgccgagaaaatggatgacgcagtggctccaggacgcgaatacacatatgaatggtctatctcagaagattctgggcctacacacgacgaccctccctgtcttactcacatctattattcccatgaaaatttaatagaagattttaactctggattgataggaccccttctgatctgtaagaaaggaactcttactgaaggaggaacacagaaaacatttgacaaacagattgtactattatttgcagtgttcgatgaatctaaaagttggtctcagtcctcctcccttatgtacacagtgaacgggtatgttaatgggacaatgcctgacatcacagtatgcgctcatgatcatatatcttggcacctgctcggaatgtctagtgggcccgaactgttttctatccacttcaatgggcaggtgctcgaacagaatcaccataaagtttctgccataactctcgtaagtgcaacatctacaactgccaatatgactgtaggacccgaggggaaatggatcatatcctctctgactcccaaacaccttcaggctggaatgcaggcctatatcgatatcaaaaattgccccaaaaaaactcgcaatttaaaaaaaatcacaagagaacaacggagacatatgaaaagatgggagtactttattgcagctgaagaagttatttgggactatgctcctgttattccagcgaacatggataaaaaatatcgctctcaacacctcgacaatttttccaaccagattggaaaacattataaaaaagtgatgtatacacagtatgaagatgaatccttcacaaaacatacagtcaacccgaacatgaaagaagatggaattcttggacccattatccgggcacaggtgcgggatacactcaaaatagtgttcaaaaacatggcctctcggccatattctatatatccccacggggttacattcagtccttatgaggacgaagtaaattcttccttcactagtgggcgaaacaatacaatgatcagggcagtacagcctggggaaacatatacatataaatggaacattttagaatttgatgaaccaactgaaaatgatgctcagtgtctgacacggccctactactccgatgtcgatatcatgcgagatatcgcatcaggattgattggactactcctaatatgcaagtctagatctctggataggcgtgggattcagcgcgccgcagacattgaacagcaggctgtattcgcggtgttcgacgaaaacaaaagttggtacctggaagataatattaataaattctgtgagaatcccgatgaagtcaaacgcgatgatcccaaattctatgaatctaatataatgtcaactattaatgggtatgtgcctgaatctattacaactcttggattctgtttcgatgatacagtgcagtggcatttctgctcagtaggaacacagaatgagatactcactatccacttcacaggacactctttcatatatgggaaacgacatgaagatactttaactctatttcccatgagaggggaaagtgtcactgttactatggataatgtagggacatggatgcttacatcaatgaattcatcaccccgaagtaaaaaactgaggctgaaatttagagatgttaaatgtatccccgatgatgatgaagactcctatgagatttttgaaccacctgaatccactgtgatggcaacaaggaaaatgcacgatcggctggaacccgaagatgaagaatctgatgctgattacgattaccagaatcgcctcgctgcagccctgggaatcaggtctttccggaattcatctctaaatcaggaagaagaagaattcaatctcactgcacttgccctggaaaatggaactgagttcgtgtctagtaatactgatatcatagtgggatcaaattatagttccccttctaatatctcaaaatttactgtcaataatttggctgaacctcagaaagccccttcacatcagcaggccacaactgcagggagtcctttaaggcacctgatcggaaaaaattcggtgcttaacagtagtacagctgaacattcctctccctattctgaagatccaattgaagaccccctacagcccgatgtgacaggaatcagactactgtcgctcggagccggagaatttaagtcgcaggaacatgcaaagcacaaaggacccaaggttgagcgggatcaggcggccaagcataggttctcgtggatgaaactactcgcccacaaagtgggaagacacctatcacaggatactgggtctccatctgggatgaggccttgggaagacctaccctcacaggatacagggtccccctccagaatgcgcccttggaaggatcccccatctgacctcctcctcctcaaacaatccaactcctcgaagatactggtaggaagatggcacctagcttcggaaaaaggaagttatgaaattattcaggacactgatgaagacactgcagttaacaattggctgatatctccccagaatgcctccagagcctggggagaatccactcccctggctaataaaccagggaaacagtctgggcatcccaaatttcctcgagtgcggcacaaaagtcttcaggtacggcaggatggaggaaaatctagactcaaaaagtctcagtttctaataaagacacggaagaaaaagaaggagaagcacacacaccacgctccactctcccctagaactttccatccactgcgatctgaagcctacaacactttcagtgaacggaggcttaaacactctcttgtgttacacaaaagtaatgaaacatcactgcctacggatcttaatcagactctaccctccatggatttcgggtggatagcatccttgcccgatcacaaccaaaatagttcaaatgatacagggcaggccagttgtcctcctggactttatcagacagtgcctccagaagaacactatcagacattccctatccaggatcctgatcagatgcactccacttcagatccaagtcataggtcgtcatcgcccgaactgtctgagatgctggaatatgatcggtctcacaagagttttcctacagatatttcacagatgtcacccagttctgaacacgaagtatggcagacagtcatatctcccgatcttagtcaggtgacactgtctcctgaactttcccagacaaatctgtctcccgacctgtcacacactacattgtcacccgaattaatacagcggaatctgtcccccgctctggggcagatgcccatttcccccgacctctctcatacaacacttagtcccgatctctcccatactacactgtccttggatctaagtcagacaaatttatctccagaattgtctcagacaaacctgagtccagcgcttggacaaatgccactatcacccgatctaagtcatacaactttgtctcttgatttctcccaaactaatctatcacctgaactttcccacatgactctatctccagaactgtcacagactaacctctctccagccctagggcagatgccaatttccccagatctctcgcacactactctgtcgctcgatttttctcaaactaatctgtctcctgaactctctcagacaaacctctctccagcacttgggcagatgcccctctctcctgatccttcccacactacactgagtctggatctgtctcagactaatctctctccagaactgtctcagacaaacctctcccccgatctcagtgaaatgcccctgttcgctgacctgtcccagattcccctcactcccgatcttgatcagatgacactaagtcccgatttgggagaaactgacctatcccccaattttgggcagatgtcactcagtcccgatctttctcaggtaactctttcccccgatatctctgatactacactcctacccgatttatctcaaatcagtcctccccccgatctggatcagatattctatccatcagaatcctcacagagtcttctccttcaggaatttaatgagtccttcccctatccagatctaggacagatgccttctccctcttctcccacattgaacgatacgttcttgtcaaaagaattcaatccattggtgatagtcggactcagtaaagatgggactgattatattgagatcatccccaaagaggaagtgcagtcctcagaagatgattatgcggaaatcgactatgttccatacgatgatccctataaaacagatgttcgcacaaatatcaactcatcacgagaccccgacaacatcgctgcttggtatctaagaagtaataacgggaacaggcggaattattatatcgccgcggaagagatctcttgggattatagtgaattcgtgcagcgcgagactgatatcgaagattcagatgatatccccgaagatacaacatataaaaaagtggtgttcaggaaatacctagacagtacatttacaaaaagggatcccaggggagaatatgaagaacatctcgggatcctgggacccatcatcagagccgaagtagatgatgtgatacaggtccggttcaaaaacctggcatctcggccatactctctccatgctcacgggttgtcttatgaaaaatcttcggaagggaagacatatgaagacgattcccctgaatggtttaaagaagataatgccgtccagcccaacagttcttatacatatgtgtggcatgctactgaacgctcaggacccgaatcacctgggagtgcatgtcgggcttgggcctactatagtgccgtgaaccccgaaaaagatatccacagtggactaattgggccactgttgatctgccagaaaggaatactgcataaagattctaatatgcctatggatatgagggaattcgtgttgctgtttatgacatttgatgaaaaaaaatcttggtactatgaaaaaaaatctcggtctagttggaggctgactagttcagaaatgaagaaatcacatgaattccacgccataaacggaatgatctattcgctccccgggcttaagatgtatgaacaggagtgggttcgtcttcatctgctcaacatcggaggatcccaggacatccatgtggttcatttccatgggcagacactgctagaaaacgggaacaaacagcaccagctaggggtgtggcctcttctgcccgggagttttaaaacactcgaaatgaaagcctctaaaccaggatggtggcttctgaacacagaagtaggggaaaatcaaagggccggaatgcagactccattccttataatggatagagattgtcgaatgcctatgggactctccactgggatcatatccgattcacagattaaagcatctgaatttttgggatactgggaaccacgacttgccagactcaataacggagggagttacaatgcttggtcagtggaaaagcttgctgcggaatttgccagtaagccttggatccaggtggatatgcagaaagaagtgatcatcacggggatccagacacagggggccaaacattatctgaagtcttgctatactactgagttctatgtagcttattcatctaaccagatcaactggcagatttttaagggaaattcgactcgaaacgtgatgtatttcaatggaaattcggatgcttccactatcaaagagaaccagttcgatcctccaatcgtggctcgctacatccggatatcacccacaagggcctataatagaccaacactccgattagaactgcaggggtgcgaagtgaacggatgttcaacgccactggggatggaaaacgggaaaatagaaaacaaacagattacagcatccagttttaaaaagtcctggtggggggattattgggaaccatttcgggctcggcttaatgctcaggggagggttaatgcctggcaggcgaaagccaacaacaacaaacagtggctcgaaatagatctcttgaagataaaaaaaattacagcaatcatcacacaggggtgtaaatccctatcttcagaaatgtatgtgaagtcctatacaatccactacagtgaacagggagtggaatggaaaccttaccgattaaaatcttccatggttgataaaatcttcgaaggaaacacaaacacaaagggacacgtaaaaaactttttcaatccacctatcatctcccgctttataagggtgatcccaaaaacttggaatcagtctatcgcactccggctggaactttttggatgtgatatctac

SEQ ID NO: 9103 - DNA, 6672 bp, Artificial Sequence
  Description of Artificial Sequence: Synthetic coding sequence
atgttcccgggttgcccccgcctctgggtgctggtggtgctggggaccagctgggtggggtggggatcccagggaaccgaggctgctcaactgaggcagttttacgtggcggcccaaggaatctcgtggtcctaccggccggagccgactaactcgtcgctcaacttgagcgtgaccagcttcaagaaaatcgtgtatagggaatacgagccgtacttcaagaaagaaaagccgcaaagcaccatctcgggcctcctcgggccaacgctctacgccgaggtgggggatatcatcaaggtgcacttcaagaacaaggctgataagccactttctatccatcctcagggcatccgctactcgaagctctccgagggagcgagctatctggaccacacctttcccgccgaaaagatggacgacgcagtagctccgggacgcgaatacacttacgaatggtcaatctccgaggactcaggtccaacccatgacgaccccccttgtctgactcatatctattacagccacgaaaacctcatcgaggacttcaactcgggtctgatcggcccgctgcttatctgcaagaaaggaactctcactgaaggaggaacccaaaagacctttgacaaacagattgtgctgctgtttgcagtgtttgatgaaagcaagtcgtggtcgcagtcgtcatccctgatgtacactgtgaacggctatgtcaatggcacgatgccagacatcactgtgtgtgcgcacgaccacatttcctggcacctgctgggaatgtcgtcaggcccagaactgttttcgattcacttcaacggtcaggtcctggaacaaaaccatcacaaggtgtccgctatcactctggtgtcggcaacctccaccactgcaaatatgactgtgggtcctgaaggaaagtggatcatcagcagcctcacgccgaagcacctgcaggctggaatgcaggcctacatcgatatcaagaactgtccgaaaaagaccaggaatctcaagaagatcactcgggagcagcggaggcatatgaaacggtgggaatacttcatcgcagccgaagaagtgatctgggactacgcgcctgtgatccctgccaatatggataagaagtaccggagtcagcatctggacaacttctccaaccagatcggaaagcactacaagaaggtgatgtacacccaatacgaggacgaaagtttcaccaagcataccgtgaacccgaacatgaaagaggacggtattctgggtccaatcattcgggcacaggtcagggataccttgaagatcgtgtttaagaacatggcttcccggccatactccatctaccctcacggagtcacgttctcgccgtacgaggacgaggtgaacagctcgtttactagcggacggaataacacgatgatccgcgcggtccaaccgggagaaacctatacctacaagtggaacatcctggaattcgacgaacctactgagaatgacgcgcaatgcctcacgcgcccatactactcggatgtcgatatcatgcgggatattgcctcgggactgataggattgctcttgatttgtaagagcaggagcctcgatcgccgcgggatccagcgcgccgcagatattgagcagcaagccgtgttcgcagtgtttgacgagaacaagagctggtacctggaggataacatcaacaaattctgcgagaatcctgacgaagtgaagcgggacgatccaaagttctacgaatcaaacatcatgagcactatcaacggatacgtgccagagtcgatcacgacgctgggcttctgcttcgatgacactgtgcaatggcacttctgctcggtgggaacccaaaatgagatcctgactatccatttcactggtcatagcttcatctacgggaaaagacacgaagataccctcacccttttccctatgcggggagaatcagtcaccgttaccatggataacgtcggaacttggatgctgacttctatgaactcgtccccacgatccaagaagttgcgcctgaaattccgtgatgtcaagtgcatccctgacgacgatgaagattcctacgaaatcttcgagccgccggaaagcaccgttatggccacccggaaaatgcacgatcgcctggaacccgaggacgaagagtcggacgcagattacgattaccaaaaccggctcgccgcagcactcggaatccgctcatttagaaacagctcgctgaatcaggaagaagaggagtttaacctgaccgcgctggcgcttgagaacggtaccgagttcgtgtcctccaacaccgatatcatcgtcggcagcaattactcgagcccgtccaacatctcgaaattcactgtgaacaacttggcggaaccgcagaaagcgccgagtcatcagcaagccacgaccgctggctcgcccctccgccatctgatcggaaagaattccgttctgaactcgtcaaccgcggaacatagctcaccttattcagaggacccgattgaggacccgctgcagcctgacgtgaccggcatcagactcctgtcactgggggcaggcgaattcaagtcccaggaacacgcaaagcacaagggaccaaaagtggagcgcgaccaagccgcgaagcatagattctcctggatgaaactgctggcgcataaggtcgggcggcacctgtcgcaggatactggatccccatcgggaatgcgcccgtgggaagatttgccttcgcaggacaccggatccccgagccgcatgcgaccgtggaaagatccaccgtccgacttgctgctgctgaagcagtccaactcgtccaagatcctggttgggcgctggcacctggcctccgaaaagggatcctacgagattattcaggacaccgatgaggacactgcagtcaataactggctgatttcaccacagaatgcctctcgggcatggggcgaatccactcctctggccaataagccggggaaacagagcggacacccgaagtttccaagagtgcggcacaagtcgttgcaagtcagacaggacggaggcaagtcgcgcctgaagaaatcgcagttcctgatcaaaacccgaaagaagaaaaaggagaagcatactcaccatgcgcctcttagcccacggaccttccacccgctccggtcagaagcgtacaataccttctccgaacggcgcttgaagcattctctcgtcctgcacaaaagcaacgagacttccctcccgaccgacctgaaccagaccctgccatccatggactttggctggatagcctccttgccggatcacaatcaaaactccagcaacgacactggacaggccagctgccctccaggattgtaccagaccgtgccaccggaggagcactatcagaccttccctatccaggacccggaccagatgcactccacctcggacccctcccaccggtcctcctccccggaactttccgaaatgctggagtacgacaggtcccacaaatcattcccgacggatatctcccagatgtcgccttcatctgagcacgaggtgtggcagaccgtcatctcgcctgacctgtcccaagtgactctgtctcccgagctctcgcagactaatctcagtcctgacttgtcgcatactacgctctcgcccgaattgatccaacgcaacttgagtccggcactgggtcagatgcctatctccccagacctgtctcacaccactctgtcgcccgatctttcgcacaccactttgtcgctggacctgagccaaacgaacttgtcaccggaactctcccagaccaacctttcccccgccctcgggcagatgcccctgtcccctgacctgtcacataccaccctgtcccttgatttctcgcagacgaacctgtccccggaactgtcccatatgactctgtccccagagttgtcccagaccaatctcagcccggccttgggacaaatgcctatctctccggatctcagccataccactctgagcctggacttttctcagactaatctttcccctgagctgagccaaactaatctgtcaccggctctcggccaaatgccactgtcaccagaccccagccatactactctgagccttgatttgtcacaaaccaacttgtccccggagctgtcccaaaccaatctctcaccggatctgagcgaaatgccgctctttgcagatctcagccaaatccctctcacgccggacctggatcagatgaccctgtctccggatttgggtgaaactgacctttcgcctaactttgggcagatgtccctgtcaccggaccttagccaggtgactctcagcccggatatctccgataccactctcctgcccgaccttagtcaaataagcccgccgcccgatctggatcagattttctacccttccgaatcaagtcaatcgctcctgctccaggaattcaatgagagcttcccctacccagatcttggtcagatgccatccccgtccagcccgactctgaacgataccttcctgtcgaaagagttcaacccgctggtgattgtcggactctccaaggacggaactgattacattgagattatcccaaaggaggaagtgcagtcatcagaggatgactacgcggagatcgactacgtgccgtatgacgacccgtacaagaccgacgtgagaaccaatatcaactcatctcgcgatccggacaatatcgcagcttggtacctgcggtccaacaatggtaatcgcagaaactactacattgcggctgaagagatttcgtgggactactctgagtttgtgcagcgcgagactgatatcgaagattcggatgacatccccgaggacaccacttacaagaaagtggtgttcaggaaatacctcgactcgacgttcacgaagagagatccccgcggagaatatgaggagcatctgggcatcctcggacctatcatccgcgccgaagtggacgacgtaatccaagtgcgcttcaagaaccttgcctcccgcccgtactccctccacgcgcacggactctcgtacgaaaagagctcggagggaaagacgtacgaagatgactcccctgaatggttcaaggaggataatgctgtccagccaaattcctcctacacctacgtttggcatgcgaccgaacggtcaggacctgagtcacctggttccgcttgccgcgcatgggcctactactccgcagtcaatccggagaaggatattcacagcggcctgatcggaccactcctgatctgccagaagggaattttgcataaggatagcaacatgccgatggacatgcgggaatttgtactcctgtttatgactttcgacgaaaagaagtcctggtactacgagaagaagtccagatcctcttggcggctgaccagctcagagatgaaaaagtcacacgaattccacgcaatcaacggaatgatctattcgctgccggggttgaagatgtacgagcaggaatgggtgcgcctgcaccttctcaatatcggcggatcccaagacattcatgtggtccactttcacggccagactctcctggaaaacggcaacaagcaacaccagttgggggtctggccgctgcttcctggatcgttcaagactctggagatgaaggccagcaaaccaggctggtggctgctcaacactgaagttggagagaaccaacgcgcagggatgcaaacccctttcctgatcatggaccgcgactgccggatgccgatggggctctcaactggaatcatcagcgacagccagataaaggcctcggaattcctcgggtattgggagccacggctggccagactcaacaatggtggatcgtacaatgcctggtcggtggaaaaactcgcggccgaattcgcgagcaagccatggattcaagttgacatgcagaaagaagtcatcattacgggcatccagactcagggagctaagcattacctcaaaagctgctacaccaccgaattctacgttgcctactctagcaaccaaatcaattggcagatcttcaaaggtaattcgacgaggaacgtcatgtacttcaacgggaattccgatgcctccaccatcaaagagaaccagttcgaccccccgatcgtggcgcggtacattagaatcagccctacccgtgcatacaacaggccgaccctgaggctggagctccaaggatgtgaagtcaacggttgttcgacgccgttgggtatggaaaacggaaaaatcgagaacaaacagatcaccgcttcttcctttaagaaatcctggtggggcgactactgggagccgtttcgggcgagactgaatgcacaaggacgcgtgaacgcctggcaagcaaaagctaataacaacaaacagtggctggagatcgacctgctgaaaatcaaaaagatcactgccattatcacgcaggggtgcaagagcctttcgtcagaaatgtacgtgaagtcctacaccatacactactccgaacagggagtcgaatggaagccgtacaggctgaagtcgtcgatggtcgacaagatcttcgagggcaataccaacacgaaaggccacgtgaagaactttttcaatccacctatcatctcacgtttcatacgcgtgatccccaagacttggaaccagagcatcgcacttcgactggaacttttcggatgcgacatctac

SEQ ID NO: 9104 - DNA, 6672 bp, Artificial Sequence
  Description of Artificial Sequence: Synthetic coding sequence
atgttccccgggtgcccgagactctgggtcctagtggtcttaggcacatcgtgggtggggtgggggagccaggggaccgaggcagcccagctgcggcagttctacgtggcagctcagggaatttcctggagctacaggcccgagccaaccaactcgtcactgaatttgagtgtgacaagttttaaaaagattgtgtaccgagagtacgagccctactttaaaaaagagaaacctcaatccaccataagtggactgcttggtcccactttgtatgcagaggtgggggacattatcaaggtccactttaagaataaggcagacaagcctctctccatacacccccagggtataagatactctaagttatcagagggcgccagttacttggaccacaccttccctgcggaaaagatggatgatgctgtggcccccggccgggaatacacctacgagtggtctattagcgaggacagcgggcctacacacgatgatcctccctgcttgacccacatctattactcccatgagaatctgatcgaagatttcaactccggtctcatcggccctctgttgatttgcaaaaaggggacccttactgaaggcggaacacagaagactttcgataaacagatcgtgctgctgttcgccgtctttgacgagtccaagagctggtcccagagcagttcgctcatgtatactgtcaacgggtacgttaacggtaccatgccagacattaccgtgtgtgctcacgatcatatttcgtggcatctgctcggcatgtccagtggacccgagctcttctcaattcatttcaatggccaggtgcttgagcagaaccatcataaggtgtccgcaattaccttggtaagtgctacgtctacaaccgccaacatgacggtggggccagaaggaaagtggataatcagcagcttaaccccaaaacacctacaagccggcatgcaggcgtacatagacatcaaaaactgccctaagaagactcggaatctgaagaaaattacgcgagaacagaggcgccatatgaagcgttgggaatactttatcgctgccgaggaagtaatctgggactacgcacccgtgattcctgctaatatggacaaaaagtaccggtctcagcatttagacaacttctcaaaccaaattggcaaacattataagaaggtgatgtatacacagtatgaagacgagagcttcacaaagcacactgtaaacccaaatatgaaggaggatggtatcctgggcccgatcatcagagctcaggtccgagacacccttaaaatcgtttttaaaaacatggcctcccgtccatatagtatctatccccatggggtaacatttagcccatacgaagatgaggtgaactcatcttttacttcaggacgcaataacaccatgatacgagccgtgcaacccggcgagacttatacctacaagtggaacattctggaatttgacgaacctacagagaacgacgcccagtgcctcacaaggccgtattacagcgatgtcgatatcatgagagacattgcatctggtttgattggcctcctcctgatctgtaagtctcggagtcttgaccggagaggtatccagcgtgcagcagatatcgaacagcaggccgtgttcgctgtcttcgatgaaaataaatcttggtatctagaggataacataaacaaattctgcgaaaaccccgacgaagtcaagcgtgatgaccccaaattctatgagagcaatatcatgtcaaccattaatgggtatgtaccagagagcatcacaaccctgggcttctgttttgacgatacggttcagtggcacttttgctcagtgggtactcaaaacgagatcctcactatccactttaccggtcacagctttatctatggtaagcgacacgaggatacgctgaccctgtttcctatgcgaggtgagagtgttacagttaccatggacaacgtaggaacgtggatgctgacgagtatgaattctagccccaggagcaagaaacttcggctgaagtttcgcgacgttaagtgcattccagacgatgatgaagactcatacgaaatctttgaaccaccagagagcacggtgatggctactaggaagatgcatgacaggctcgagccagaggacgaagaaagcgatgcagattacgattaccagaaccgcctggcggcggcgttagggatccgctcctttagaaacagtagtctgaatcaggaggaggaggagttcaacctcacagccctcgcactcgaaaatggcaccgagtttgtgagctctaatactgacattatagttggaagcaactacagctctccaagcaatatatctaaattcaccgtgaataacctggccgaaccccagaaagccccatctcaccaacaggcaacgaccgcaggtagccctctacggcacttgataggaaaaaactccgtgttgaatagtagtaccgcggaacactcgagcccctactctgaggaccctattgaagacccacttcaaccagatgttaccgggattaggctgctatcgctcggggcaggcgagtttaagtcccaggaacacgcaaagcataaaggcccaaaggttgaacgggaccaagctgctaaacacagattcagttggatgaagcttctagctcacaaggttgggagacacctgagtcaggacaccggctcaccttctgggatgcgtccttgggaagatctcccatcccaggacaccggatccccctctcgtatgagaccttggaaagatcccccctccgacctccttctactgaagcagagtaattcctccaagattctggtgggccgctggcacctcgctagcgaaaaaggttcgtatgaaatcatccaggatactgacgaggacacagcagtcaataattggctcattagtccacagaatgcatcccgtgcctggggagagtccacaccgttggcaaataagcctggaaaacagtcaggccacccaaaatttccccgagtgaggcacaaatctctgcaggtgcggcaggacggcggcaaatctagattgaaaaagagccagttcctaattaagacaaggaaaaagaaaaaggagaagcacacgcatcacgcgcctctttctccaaggacgttccacccccttcggtcagaggcctataatactttttccgagagacggttgaaacatagcttggtgctacataaatccaacgaaacaagtctgcccactgatttgaaccagacactgccttccatggacttcggctggattgcttctctgccagaccataatcagaatagctcaaacgatacaggacaggcttcttgtccacccggcctgtatcagaccgtcccacccgaggaacattaccagaccttccctattcaggatcccgatcagatgcactctactagtgacccatctcacagaagctcctcacctgagctcagtgaaatgctggagtacgaccgatctcataagagtttcccaacggacattagccaaatgagcccaagcagtgaacatgaggtgtggcaaaccgtcatcagtccggatttgtcgcaggtgaccctgtcccctgagctgtcgcagactaacttgagcccagatctgtctcataccaccttgtccccagaattgattcaacggaatctttcccctgccctcggacagatgccaatctctcccgacctgtcccacaccaccctgtctcctgacctgtcacacacgactctctcgctggacctttctcagacaaatctgtctcctgagctgtctcagaccaatcttagcccagcgttgggtcaaatgccacttagcccagacctgtctcataccacactaagcctcgactttagccagacaaacctatcccccgagctctctcacatgaccctctcccccgaattgagccaaacaaatttatctcccgcacttggccaaatgcccatctctcctgatttgtcgcatactacattgtccctagatttctctcagacaaacctgtccccagagctctcccagacgaacctgagcccagcccttggtcaaatgcctctgtctcccgatccaagccatacaacgctctcactcgacctatcccagaccaatctctctccagagctcagtcagacgaatctgagccctgacctgagcgaaatgcccctcttcgccgatctgtcacagatccccctcactccggatttggatcagatgacactcagtcctgacctgggcgagacagatttgagtcccaattttgggcagatgtctttgagcccagacttgagccaagttaccctgtcacccgatatctcggacactactctgctgccggatctatctcagatcagcccaccaccagatcttgatcagatcttttacccctccgagtcctcccagtccctcttgctgcaagagttcaacgagagctttccataccctgacctgggccagatgccctccccgtcctcgccaaccctcaatgacacctttttgtcgaaggaattcaacccactggtgattgtcgggctttccaaggacggaacagattatatcgagatcatcccaaaggaggaggtgcagtcatccgaggatgattacgccgagatagattacgtgccttatgacgatccctataagacagatgtgagaaccaatatcaactcttccagggatcccgacaacatcgctgcttggtatttgcgctctaataatggtaatagaagaaactattatattgccgcagaagaaatcagctgggattatagcgaattcgtgcagcgggaaaccgacattgaagatagtgacgacattccagaggacacaacatacaaaaaggttgtgttcagaaagtatctggactcaacttttaccaagagagacccccggggtgagtacgaggaacacctgggcatcctcggccccattattcgcgcggaggtggacgatgtgatccaggtgagatttaagaacctggcatctagaccgtattcgctgcacgcacatgggctgtcatacgaaaagtcttccgaaggaaaaacgtacgaagatgacagcccagagtggttcaaggaggacaatgctgtgcaacccaactctagttacacctacgtttggcacgctactgagcggtccggtcccgagtctcctggctctgcatgtagggcatgggcctattattccgctgtaaatccagaaaaagacattcattcaggcctgatcggcccgttactgatctgtcagaaaggaattctccacaaggacagtaacatgccaatggacatgagagaattcgtgttgctcttcatgaccttcgacgagaaaaagtcctggtattacgagaagaagagtcggtccagctggcgtctgacatcttcggaaatgaagaagagccacgagttccacgcaatcaacggtatgatttactccctgcctggtttgaagatgtacgagcaagagtgggtacggcttcacctgttgaacatagggggctctcaggatatacacgtggttcacttccatggacagaccctcttggagaacggtaacaaacagcaccagcttggcgtatggcccctgttgcctgggtcgtttaagacacttgaaatgaaagctagtaagcccggctggtggctgctgaatacggaggtgggggagaatcagcgtgccggaatgcaaacacctttcctaatcatggacagagattgtagaatgcctatggggttgagtacaggtatcatcagcgactcccagattaaagcttccgagttcttgggctactgggaacctagactggcacgactcaataatggaggatcctataacgcatggtcagtggagaaactcgccgctgaattcgcttctaagccgtggatacaagtcgacatgcagaaagaggtgatcatcacagggatacagacccagggcgccaaacattatctcaaatcatgctacacgaccgagttttacgtggcctactcgtcgaatcagataaattggcagatttttaagggcaactctacgcgcaacgtcatgtactttaatggtaattccgacgcgtccaccataaaagagaaccagttcgacccacccattgtcgcaaggtacatccggatctcaccgacacgggcctacaataggcctacactcagactggaattacagggctgcgaggtgaatgggtgtagtacccccctgggaatggagaacggaaaaatagaaaacaagcagattacagcgagctccttcaagaagagctggtggggcgactattgggagccattcagggcacggcttaatgcccaagggagggtgaacgcatggcaggcgaaggccaataataataagcaatggctggaaatcgacctgctgaaaatcaaaaagatcacagctatcatcactcaggggtgcaaatcactgtcgtccgagatgtatgtgaagagttacactatccactacagcgagcaaggagttgaatggaagccttataggctcaaatcatcaatggtcgataagatctttgaagggaacaccaacacaaaaggccatgtgaagaacttctttaacccccctatcatctctcgttttattagggtcatccccaaaacatggaaccagtccatagccctgcgtctggagcttttcggatgtgacatctac

SEQ ID NO: 9105 - DNA, 6672 bp, Artificial Sequence
  Description of Artificial Sequence: Synthetic coding sequence
atgtttcctggctgcccgagactttgggtgctggttgttctgggcacgagctgggtgggctggggatcccaggggacagaagccgcccagctgagacagttttatgtggcagcccaggggataagctggtcttataggccggagcccactaatagttccctcaatctgtctgtgaccagcttcaaaaagatagtataccgagaatacgagccctatttcaagaaggaaaagccccagtccacgatctccgggctattaggacctactctgtacgctgaggtcggcgatatcatcaaagtccacttcaaaaataaggcggacaaacctttgtccattcatccccaagggataagatatagcaagttaagtgagggcgcgagctacctggaccatacctttcccgcggagaagatggatgatgcagtggcgcccggccgagaatatacttacgagtggtctatctccgaagactccgggcccacccacgatgatcccccctgcctgacacacatctattatagccatgaaaatctgatcgaggactttaactccgggctgatcggtcctctcctcatttgtaaaaagggtacacttaccgaagggggcacccagaaaaccttcgacaagcagattgtgttgctattcgccgtcttcgacgagagcaagtcttggtcgcaatcctcatccctgatgtacactgttaacggatacgtgaatggcacaatgccagatattacagtctgtgcacatgaccacatttcctggcacctgctcgggatgtctagtggccctgagctctttagcatccacttcaacggtcaggtgctagagcagaaccaccataaggtgtctgcgataactctagtgagcgcgacaagcaccacggcaaatatgaccgttgggcctgaaggcaagtggataataagttctttgacacctaaacatctgcaagcaggaatgcaggcttatattgatattaagaattgtccaaaaaagacaagaaatttgaaaaagatcacaagagagcagagacgtcatatgaagaggtgggagtattttatagcagcggaagaagtgatctgggattacgccccagtgatccctgctaatatggacaagaaatataggagccagcatctggacaacttctccaatcagatcggaaaacattacaagaaggtgatgtacacgcagtacgaagatgagtcattcactaagcataccgtgaatcccaatatgaaggaggacggaatcttaggtccgataatccgagcccaggtgagggacaccctaaagatcgtcttcaaaaacatggccagcaggccctacagtatttaccctcacggagtcaccttctcaccttacgaggacgaagtgaacagctccttcaccagcggtcgcaacaacaccatgatcagggcagtgcagcctggtgaaacctatacttataagtggaacatcttggagttcgacgaacctacagaaaacgacgcccagtgtctcactaggccatactattctgacgtagatattatgcgggacatcgcctccggcctgattggactcctcttaatctgtaagtcgcgatccctggaccgaagagggatccaacgagccgcagacatagagcagcaagctgtttttgctgtcttcgacgagaacaaaagttggtacctggaggacaacattaataaattctgtgagaaccccgatgaggtgaaaagagatgatccaaagttctacgagagtaacatcatgagcacaattaacggctacgtcccagagagcataactaccctcggattttgcttcgatgacaccgtgcagtggcacttttgttctgtaggcacccagaacgaaattctcacaattcacttcacaggccattcttttatctacggcaaaaggcacgaagataccctcactctgtttcctatgaggggagagagcgtaactgtcactatggataatgtgggaacatggatgctgaccagcatgaatagttcaccccgaagcaaaaagctgagactgaagttccgagatgttaagtgtatacccgatgacgacgaggacagttatgaaatctttgaaccaccagaatctacagtgatggccactaggaaaatgcacgatcggctggagcccgaagatgaggagagtgacgccgactatgattaccagaaccgactagccgccgccctgggtataaggtcgttccgtaacagctcgcttaatcaagaggaggaggaattcaatctcacagcattagcgctagaaaatgggaccgaattcgtctcgagcaatacagatatcatcgtcggtagcaactattcctccccctcaaacatctcaaaatttacggtgaacaatctagccgaacctcaaaaagccccctcacaccagcaagccaccacagcaggtagccctttaagacacctgattgggaagaattcagttctcaatagctcgaccgcagaacatagcagtccttatagtgaagatcccattgaggacccccttcagcctgacgtgacaggaatccgactactgtcccttggggcaggcgaatttaaatctcaggagcacgctaagcataaggggccaaaggtggagagagaccaggctgctaagcatcgattttcctggatgaaacttctagctcataaagtgggaagacacctttcccaggataccgggtccccctcaggtatgcgaccatgggaggatctgccatcccaagatacgggctcaccatccaggatgcgaccctggaaggaccctcccagtgatctgctactgcttaagcagtcaaattccagcaagatccttgtgggccgatggcatttggcctctgagaagggctcctacgaaatcatccaagacaccgatgaagacacagccgtgaacaactggctgataagtccacaaaatgcgagtcgggcctggggcgaatctactccacttgccaataagccaggaaagcagtccggccacccaaaatttccacgcgtgaggcacaagagtttgcaggtcaggcaagatggcgggaagtctcgactgaaaaagtcgcagttcctgattaaaacccgaaagaagaaaaaagaaaagcatactcaccatgcccctctatcaccacgaacgtttcatcctcttaggagtgaagcctacaacaccttctctgaaagacggttgaaacatagcctagtactgcacaagtcgaatgagacatcgctccccaccgatctcaatcagactcttccctcaatggatttcgggtggatcgcctctctgcccgaccacaatcagaacagttccaacgacacagggcaggcttcttgcccgcctgggctgtatcagacagtgcctccggaagaacactatcagacttttcccattcaggaccctgatcaaatgcatagcacgagtgacccatcacatcggtcgagtagtcccgagctatcagagatgctggaatacgatagatcccacaagtccttccccacagacatctctcagatgagtccatccagcgagcacgaggtatggcagaccgtcatctctccggatctgtcacaggtgacccttagccccgagctgtctcagaccaacctcagccctgatctgtcccacacgacactgtcccccgaattgatacagagaaacctaagtccagctctgggacagatgcctataagtcctgacctctctcacaccaccctgtccccagatttgagtcacaccacactgtctttggatttgagccagactaacctgtctcccgaactgtctcagacaaacctgtcgcccgcattggggcaaatgccattgtcccccgacctcagtcacacaacactgtccctggatttcagtcagacaaatctctccccagagctgagccacatgaccctctcacccgaactaagtcagaccaatttgtcccccgcacttggccagatgcctatttcccctgacctaagccacaccacactgtctctggatttttcacagaccaacctttcacccgagctgtcgcagacgaatctgtcacctgctctcggtcagatgccattgagtccggatccttctcacacaaccctgtctctcgatctgtcccaaacaaacttgtccccggagctatcacaaacgaatctgagccctgatttgtctgagatgccgctgttcgcagatctaagccagataccgctgacacctgatttggaccaaatgacgctctcccccgatttaggagaaacagacttgtcacctaattttggccaaatgtccttgagcccagacttgtcccaagtgaccctgagccccgacatcagtgacaccaccctgctgcccgacctgtctcagatttccccacccccagatctcgatcagattttctatcccagtgagagctcccaatctctgttgctgcaggagtttaatgagagtttcccatatcccgacctcgggcaaatgccatcccccagctctcccaccctcaatgacacattcctgtccaaggagtttaaccccctggtaattgtgggcctgtctaaggacggaaccgactatattgagattattccgaaagaagaggtccagagttccgaggacgactatgccgaaatcgattacgtcccatatgatgacccttacaagacagacgtgaggacaaatatcaatagctccagggaccccgataatatcgcggcttggtatctccgttctaacaatggaaacaggcggaattattacatcgccgccgaggagatcagctgggattacagcgagtttgtgcagcgagagactgatatcgaggatagtgatgatattccagaggatacaacgtataaaaaagtcgtattcaggaaatatctggatagcactttcaccaaacgggatcctcgaggggaatatgaggaacacctgggcattttggggcccatcataagggcggaagtagatgatgtgattcaagtccgatttaaaaatttggccagccgtccttattccctgcacgcacatggcctgtcctatgagaagtctagcgagggcaagacatacgaggatgacagccctgagtggtttaaggaggataacgccgtccagcctaattcctcctacacatacgtctggcatgcaacagagcgatcaggaccagagtctccaggtagtgcctgcagggcgtgggcttactattcagcggtgaatcccgagaaagacatccattctggactgattgggccactgcttatctgtcagaaaggtattctgcacaaagactcgaacatgccaatggatatgcgggagtttgtgctcttatttatgacctttgacgaaaaaaagtcttggtactatgagaaaaagtctcggtccagctggaggctgacatcttcagaaatgaagaaaagccacgaattccatgcaatcaacggcatgatatactccttgcctggtctgaagatgtacgagcaggaatgggtgcggcttcacctgcttaatatcggcgggagccaggacatacacgtagtgcattttcatggacagacactactcgaaaacggtaataagcagcaccaattaggggtgtggccactgctaccaggcagcttcaagaccctcgaaatgaaagccagcaagccggggtggtggctgctgaacacagaagtaggggaaaatcagagggccggaatgcagacgccttttcttatcatggatcgagattgccggatgcctatggggctgtccacagggataatttccgacagccagataaaggcctctgagtttctcggctactgggaacctcgtctagccaggctgaataacgggggatcctacaacgcttggagcgtagagaagctggctgccgagttcgccagtaaaccttggatccaggttgatatgcaaaaggaagtgatcatcacagggattcaaacgcagggagccaaacactatcttaaatcttgttacactacggagttttacgtggcgtactctagcaaccaaattaattggcaaatcttcaaagggaactctacccggaacgtgatgtactttaatggcaattccgatgcttctactataaaagagaaccagttcgacccaccgatcgtcgccagatatattaggatcagccccaccagagcctataaccgacccactctccgcctggagctgcagggctgcgaggtcaacggatgttcgacacccttgggcatggaaaacggcaagatcgaaaacaagcagatcaccgcatccagctttaagaagtcctggtggggagactattgggagcccttccgggcacggcttaacgcacagggcagggtcaatgcctggcaggccaaggctaacaacaataagcagtggctggagatagacctattgaagattaagaaaataaccgccatcatcactcaagggtgtaaatctctgagctcggagatgtatgtcaagtcttataccatccattattccgagcagggtgtcgagtggaagccctatcgtctgaaatcctcgatggttgataaaatattcgaagggaacacaaacacgaagggccatgtgaagaattttttcaaccctccgatcattagcaggttcatccgcgtgattcctaaaacctggaatcagagcatagccctcaggttagaactctttgggtgcgacatatac

SEQ ID NO: 9106 - DNA, 6672 bp, Artificial Sequence
  Description of Artificial Sequence: Synthetic coding sequence
atgttcccaggctgccccagactctgggtgctagtggtgctgggcacgtcatgggtcgggtggggctctcagggcaccgaggctgcacagctgcgccagttttacgttgctgctcagggcattagttggagctatcggcccgagcccacaaacagctctctgaacctgagcgttacttctttcaaaaagatcgtgtaccgtgagtatgagccttattttaagaaggaaaagccacaaagtaccattagtgggttgcttggcccgacactatatgccgaagtcggagacattataaaggtgcatttcaaaaacaaggctgataaacccttgagtatccacccccagggcatccggtactcaaagctctctgaaggggccagttacttggaccacacttttcccgctgaaaagatggatgatgccgtagcgccagggagggaatacacatacgagtggagtattagtgaggactcagggccgactcacgatgatcccccctgtctgacacacatttactacagccacgagaatctcattgaagacttcaactctggtttgattggtccattgttgatttgtaagaaaggcaccttgaccgaaggaggaacacaaaagaccttcgacaaacagatcgtcctgctgttcgcagtgtttgatgagtccaaaagttggtcacagtcttctagtctgatgtataccgtcaatggatatgtcaacggaactatgcccgatataactgtgtgtgctcacgaccacatcagctggcaccttctcgggatgtctagtggccctgaactatttagcatccactttaacgggcaggtgctggaacagaatcaccacaaagtaagcgcgatcacactggtctccgctaccagtactacggccaatatgaccgtcgggcccgaggggaagtggataatctcctcactgactcctaagcacctgcaagccgggatgcaggcgtacatagacataaagaactgtcccaaaaagaccaggaacctaaagaagattacccgcgagcagagacgccacatgaagaggtgggaatacttcatcgccgccgaagaggtcatatgggactatgctccggtaattccggctaatatggataaaaagtaccgcagtcaacacttggacaacttttcgaaccagatcgggaaacactacaagaaggtgatgtacacacaatatgaagacgagtcttttactaagcacaccgtgaaccctaacatgaaggaggatggcattcttgggcctataatccgcgcccaggtgcgggacacgttaaagatcgtttttaaaaacatggcgtcaaggccttattccatctatccccatggggtgactttctctccttacgaggatgaggtgaactcatctttcactagcgggcggaacaatacaatgatccgcgctgttcagccaggagagacatacacatataaatggaatattctcgagttcgatgaacccacggaaaacgacgcccagtgcttgaccagaccttactatagcgatgtcgatatcatgcgagatatcgcaagtgggctcataggcctgttattaatctgtaagagcaggagtctggacaggaggggaatccagagagcggcagacatagaacagcaggcagtgtttgccgttttcgacgagaacaaaagttggtacctcgaggacaatatcaacaaattttgcgagaaccctgatgaagtgaagcgtgacgacccaaaattttatgagtcaaacatcatgtcaactatcaatgggtacgtccctgaatcaatcaccactttaggcttctgcttcgacgacacagtgcagtggcacttctgctcagtcggtactcagaacgaaatcttaaccatacattttacaggacattccttcatctacggcaaaaggcacgaagataccctcacccttttcccaatgcgtggggaatcagtgactgtcacaatggacaatgtgggaacttggatgctgacctctatgaactcctctccgcgttcaaagaaacttagactgaaattcagagacgtgaaatgcatccctgatgatgatgaggattcttacgagattttcgagcctccagagtctaccgtgatggccacgcgaaaaatgcacgacagactcgaacccgaggacgaggagagcgacgcagattacgattaccaaaatcgcctagcagcagccctaggcatcagaagcttcaggaacagctcactgaaccaagaagaagaggagtttaatctgaccgccctggcacttgaaaacgggacagagttcgtgtccagtaatacggatatcatcgtgggttcgaactattcctctccttcaaatatctccaagttcaccgtgaataatcttgccgagcctcagaaggccccatcgcaccagcaggccactacggctggatccccactgcgacacctgattggaaagaatagtgtgctcaactcttccaccgctgaacactcctcgccctactccgaagatcccatcgaggatccgttgcaaccagatgtaaccggcatacggctgctgtcactaggagccggggagtttaaaagccaggagcatgcaaagcacaagggcccaaaagtggagcgcgatcaggctgcaaaacaccggttctcatggatgaaattgctcgcacacaaagtaggacgtcatttgtcacaggacacaggatccccttctggaatgcgtccctgggaagatcttccaagccaggatacaggaagcccctctagaatgcggccatggaaagatcccccaagcgatctgctgctgcttaagcaatctaactcctccaaaatcctggttggccggtggcatttggccagtgagaagggatcatatgaaataatccaggacacagacgaggacactgctgtgaacaattggttgatcagtccccaaaacgcgagtagggcctggggagagagcacgccattggcgaataagcccgggaaacagtccggtcatccaaagtttccaagggtgaggcacaagtccctgcaggtccgccaggacgggggaaagagcagattgaagaaaagccagttcctgattaagacccgcaaaaaaaaaaaggagaaacatacccaccacgcacccctgagcccccgcacctttcaccccttaaggtcagaagcctataacactttctcagaacgcagattaaagcactccttagttctgcacaagtccaatgaaacaagcttacctaccgacctgaatcaaactttaccaagcatggattttggctggatcgcatccctgcccgatcacaatcagaattctagtaacgataccgggcaggctagctgcccccccgggctctaccagactgttccccctgaagagcactaccaaacatttccaatccaggaccctgaccagatgcactcaaccagcgacccgtcccatcgcagcagcagccctgaactgtccgagatgttagagtatgatcgttcgcataagtcattccccaccgatataagccagatgtctccaagcagtgaacatgaggtttggcagaccgttatctctccagatctttcccaggtcactctctctccggaattgtcccagaccaacctcagccccgatctctcccataccacactatccccagaactaatccagcgcaatttatcacctgccttgggccagatgcccatcagtccagatctgtcccacaccacattatcgcctgacctgagccacacaaccctgtctctcgatctgtcgcagaccaacctatccccagaactgagccaaactaaccttagccctgcgctcggacagatgcctctgtcccccgacttgtcgcataccactctgtctttagatttcagccagaccaatctgtcccccgagttgtcccatatgacactgagtccggagctgagccagacaaatctctctcctgcgctaggacagatgcctattagtcctgacctgtctcatactacactgagcttggacttcagccagacaaacctctcgcccgaattgtcacagactaatctgagccctgctctggggcaaatgcctctcagtcctgacccatcccacacaacactaagtctggacctgagccagaccaacctgtctcctgaactgagccaaaccaatctgtctcccgacctttcagaaatgcccctctttgcggatctctcacagataccactgacaccagacctggatcaaatgaccctatcccctgacctgggagagaccgatctgtccccaaacttcgggcagatgtctttatctcccgaccttagtcaggtaactctgtcaccggatatttcagacaccaccctgcttccagatctgtcccagatatcaccaccacccgaccttgaccagatcttctacccctcagagagcagccagtccttgctgctgcaggaattcaacgagagctttccttaccccgaccttggacagatgccgtccccgtcttctcccacactcaacgatacttttctctcgaaggaattcaatcccttagttattgtgggattgagcaaagacggtacagattacattgaaatcattcctaaggaggaggtgcagagttccgaagatgattacgcagagatcgactatgtgccctacgatgacccttacaagaccgatgtgagaaccaatatcaacagctctcgggatcctgataacattgccgcctggtacctccgatcgaacaacggcaatcgaaggaactattacatagcagcggaggagattagttgggattattcagaatttgtccagagggagactgacatagaagacagcgatgacatccctgaggatactacctataagaaagtcgtctttcgcaagtacctggactcaacctttaccaagcgggatccaaggggtgaatatgaagaacatctcggtattctagggcctatcatccgagctgaagtcgatgatgtgatccaagttcgtttcaagaacctggcgagcaggccctatagtttgcacgctcacgggttgtcctatgagaagagtagtgaagggaagacttacgaagatgattcacctgaatggtttaaagaggacaatgcagtgcagccaaactcctcctatacctatgtgtggcatgctacagagcgcagcggtcctgagagcccaggctctgcctgcagggcatgggcatattattccgccgtcaaccctgagaaggacattcactctggtctgatcggcccgctgctgatatgccagaagggaatcctccataaggactctaatatgccgatggacatgagggaattcgttctgttattcatgacttttgatgaaaagaagagctggtattacgagaaaaagagtcggtcctcttggaggttaacttcgtcggagatgaaaaaaagccacgagtttcatgccattaatggcatgatctacagcttacctggtctgaaaatgtatgaacaggagtgggtcagactgcatttactcaatatcgggggttctcaggacattcacgtcgttcacttccatggacagactttgcttgaaaatggcaacaaacaacatcagcttggcgtttggcctcttttgcccggttcctttaagacattagaaatgaaggcctcaaagccaggatggtggctgctgaacactgaggtgggagagaatcagagggccggcatgcagacccctttcttaattatggatcgcgactgccgcatgcccatgggtctgtccactggaatcatctctgattcccaaatcaaggcaagtgagttcctcggctattgggaaccaaggttggctcgactcaacaacggtggctcttacaatgcttggtccgtggaaaagctggcagcggaatttgcttcaaaaccctggatacaggtcgatatgcagaaagaggtgataattactggcattcagacccaaggagccaaacactacctgaagagttgttataccacggaattttacgttgcttattcaagtaatcagatcaattggcagatatttaagggcaacagcactcgaaatgtcatgtatttcaacgggaactcagacgctagcaccatcaaagagaatcagttcgaccccccaattgtggctagatacataaggatttcgcctacacgggcctacaacaggcccaccctgagactcgagctgcagggctgtgaggtcaatggctgttccactccgttagggatggagaacgggaagattgaaaataaacagattactgcgtctagttttaaaaaatcctggtggggcgattactgggagccttttcgagcccgactaaacgcccaggggcgtgtgaatgcatggcaggccaaggcaaacaacaataagcaatggctggagatcgacctgctcaagatcaaaaaaattacagctattatcactcaggggtgtaagtccctgtccagcgagatgtacgtgaaatcctatacgatccactattctgaacagggagtggaatggaagccataccgactgaagagctcgatggtggacaaaatttttgaggggaacactaacactaaggggcacgtgaaaaacttttttaatccgcccataatctcccggtttatcagggttatccccaagacctggaaccagtcaattgcgctgaggttggagctcttcggatgcgatatttat

SEQ ID NO: 9107 - DNA, 6672 bp, Artificial Sequence
  Description of Artificial Sequence: Synthetic coding sequence
atgttccccggatgccccagactgtgggtgctggtcgtcctgggcacttcctgggtaggctgggggagccagggaaccgaagccgctcagctgaggcagttttatgtggcagcccaaggcatttcatggtcctaccggcccgaacccaccaattccagcctgaacctgtcagtaacatctttcaagaagatcgtgtacagagaatacgagccatatttcaagaaagagaagccgcaaagtaccattagtggccttcttgggcctactttgtacgctgaggtgggtgatataataaaggtccacttcaagaacaaggccgacaagcccctgagcatccacccccaggggattaggtactctaagctgtccgagggcgcgtcttacctggaccacacattccccgctgaaaagatggatgacgctgtggccccaggcagggagtacacctacgaatggagtatctcagaagactcaggcccaacccatgatgaccccccatgcctgacccacatatactattcccacgagaatctgatagaggatttcaacagcggacttatcggcccactgctcatctgcaaaaagggcacactcaccgagggggggacccagaagaccttcgacaaacagatagttctgctcttcgccgtgtttgacgagtcaaagtcctggagccaaagcagttccctgatgtatacggtcaacggatacgtcaacggcaccatgccggacataacagtttgtgctcacgaccatatctcttggcacctgctcggcatgtcttccgggccggagctgtttagtatccatttcaatgggcaggtgctcgagcagaatcatcacaaggtttcagctataactttggtctctgctactagcacaacggccaacatgaccgtaggtcccgaaggcaagtggatcataagcagcctgaccccgaagcatcttcaagccgggatgcaagcatacatcgacattaagaactgcccgaaaaaaactcgcaacctgaagaagattacccgcgaacaacgacgacatatgaagcgctgggagtacttcatcgctgccgaagaggtgatctgggactatgctcccgtgatacccgctaacatggataagaaatacaggtcccagcatctggacaacttttccaatcagatcggcaagcattataaaaaggttatgtatacccagtacgaggacgaaagcttcaccaagcacacagttaaccctaatatgaaggaagatggaatcttgggccccataatccgcgcccaggtgcgcgacacacttaaaattgtattcaaaaatatggcttctagaccttattctatatacccgcatggagttactttttctccctacgaggacgaggtcaattctagttttacatcaggtcgcaataacactatgatccgggccgtacagccaggcgagacctacacatacaaatggaacatccttgagttcgacgaaccgaccgagaacgacgctcagtgcctgacaaggccatattactctgacgtcgacatcatgcgcgacatcgcatccgggctgattggactcctgctcatatgtaagtcaagaagcctggacagaagaggaatccagcgagccgccgacattgagcaacaggcggttttcgctgtgtttgatgaaaacaagtcctggtacctggaggataacatcaacaagttttgtgagaatcctgacgaggtaaagagggatgatccaaaattttatgagagtaacattatgtcaacaattaatggttatgttccagagtccataaccaccctgggtttctgtttcgacgatacagtccaatggcatttttgcagcgtgggcacccagaacgaaatcctcacaatacactttacgggccactctttcatctacggtaaacgacacgaggatacgctgacactttttccaatgcgcggcgaatctgtgacggtcacaatggacaacgtaggaacgtggatgctgacctccatgaactcctcaccacggtcaaagaagctgagactcaaatttagggacgtgaagtgcatccccgatgacgacgaggattcatacgagatcttcgaacctccggagagtaccgttatggccacccgaaaaatgcacgaccggctcgaacccgaggacgaggaatcagatgccgactatgattaccagaatagacttgctgcggctctgggaatccgatccttccggaactcaagcctgaatcaggaagaggaggaatttaacctgacagctctcgcactggaaaacggcaccgagttcgtgtctagtaatacagacatcatagtaggtagcaactatagttctccctccaacatttcaaaattcactgtaaacaatttggctgagcctcagaaggctccatctcaccaacaagctacaactgccggttccccattgaggcatcttatagggaaaaacagtgtgctgaatagctccaccgctgaacattccagcccttatagtgaggatcctatcgaagatccactccaacccgacgtgacaggcattcgactgctctctctgggtgctggcgagtttaagagccaggaacacgccaagcacaaaggacccaaggtggagagagatcaggccgcaaaacatcggttctcttggatgaaactgctcgcccacaaggtcggcaggcacctctctcaagatacagggagcccatccggtatgaggccatgggaagatctgccctcacaggacactgggtctccctcccggatgcgcccctggaaagacccaccatctgacttgctcctgttgaaacagtccaattcctccaaaattctggtcggaagatggcacctcgcctccgaaaaagggtcctacgaaatcatccaggatacagacgaagatacagcagtgaacaactggcttatctctccacagaatgccagcagggcttggggggagagtacgcctttggccaacaaaccaggcaagcagtccggtcacccaaaattccctcgagtgcggcataagagcctgcaggtgcgccaggacggcggaaaaagcagactgaagaaatcacagttcctgatcaagactcgaaaaaaaaagaaggaaaagcatacccaccatgcacccctgtcaccccgcacttttcatccactgcgctccgaagcctacaatactttttctgaacgaaggctgaaacatagcctggtgctccacaagtcaaatgagactagcctgcctacggacctcaatcagacactgcccagtatggactttggatggattgccagtttgcctgaccacaatcagaacagcagtaatgacacagggcaagcctcctgtcccccaggcctgtaccaaaccgtcccccctgaagagcactaccagacatttccaatccaggatccagaccagatgcattcaacgagtgacccaagccaccgctcttcatcccccgagttgagcgaaatgctggagtatgataggagtcataagtcattccccactgacatcagtcagatgtctccctccagcgagcacgaggtgtggcagaccgttataagtcccgatctcagtcaggtgacactgagtcccgaactcagccagaccaacttgtctcccgacctcagtcacaccaccctgagcccagaattgatccaacgcaatctttcacccgcactgggtcagatgcctatctctcccgatctgagtcacactacactcagccccgatctgtcccataccactctgagtctggaccttagtcaaactaaccttagcccagagctctcccaaacaaacctgtctcccgcccttggccagatgcccctcagccctgatctgtcccacacaactctgagtctggactttagccagacgaacctcagtcccgagctgagccatatgacgttgtctcctgaactcagtcagacaaacctgtctccagctcttggccagatgccaataagccccgatctgagccacactaccttgtcactggacttttcacagacaaacctgagcccagaactgagccaaacaaacctgtcccccgccttgggccagatgcctctcagcccagatccatcccacacgactctttctctcgacctgtcccagacgaacttgagccccgagctctctcagactaatctgagtccggatctgagtgagatgcccctgtttgcggacttgtctcagatcccgttgacccccgacttggaccagatgacgcttagcccggacctgggagagaccgacctgtcaccaaacttcggacagatgtccctgtcccctgacctcagtcaggtcaccttgagcccagatatctccgacaccacactgctgccagatcttagccagatatctcccccccccgatctggatcagatcttctacccttcagagtcctcccagtccctgcttctgcaggaattcaacgaaagcttcccctatccagacctgggtcagatgccatcccccagcagccctacactgaacgatacgttcctgtcaaaagagtttaacccgctggtgatcgtcggcctgagtaaggacggtaccgactacatcgagatcatccctaaggaggaggttcagtcaagcgaggacgactacgcggaaatcgattacgttccctacgatgacccttacaagacagacgtgcgcaccaacatcaacagctccagggatcctgacaatatcgctgcctggtacctgagaagcaacaacggcaatcggcgcaactactatatcgcagccgaggagatcagctgggactacagcgagttcgtccagcgcgagacggatatcgaggatagcgatgatatcccagaagacaccacctataaaaaggtggtattcagaaagtatctggactcaacgttcactaagagagatcctagaggagaatatgaagaacatctcgggatactcggccccatcatcagagccgaggtagacgacgtgattcaggtacgattcaagaacctggccagccgaccctactctctgcatgcacacggcctttcttacgagaagtcttctgagggcaaaacatacgaggacgattctcccgagtggttcaaagaagacaatgcggtccagcccaacagctcctatacatatgtgtggcacgcaacagagaggagtgggccggagtcccctggctcagcctgtagagcgtgggcatactattcagctgtgaatcccgaaaaggatattcattctggcctcatcgggcccttgctcatctgccagaaggggatcctgcacaaggattccaacatgcccatggacatgcgggagttcgtccttctgttcatgacgtttgatgagaagaagtcttggtattacgaaaagaaatctcgctcttcctggcggctgacgagtagcgagatgaagaagagccatgaatttcacgccatcaatggtatgatctactccctgccggggctgaaaatgtatgagcaggagtgggtgcgactgcacctgctgaacatcggtggaagtcaggacattcacgtggttcactttcacggacagactctccttgaaaacgggaacaaacaacaccaactgggcgtgtggccactgctgcctgggagcttcaaaacgctggagatgaaggccagcaagcccggttggtggcttctgaatactgaagtgggcgaaaaccagagggctgggatgcaaacacctttcttgatcatggacagagactgcaggatgcctatgggtctcagcacggggattatcagtgactctcagattaaagcaagcgagtttttggggtattgggaacctcggttggcccgcctgaataacggaggctcttacaatgcctggtctgtggaaaagctggccgccgagtttgcttcaaaaccttggatacaggtggatatgcagaaagaggtaatcatcacggggatccagacacagggcgctaaacattacctcaagagctgctatactaccgaattttacgtggcgtactcatctaaccaaattaactggcagatatttaagggcaattctacaaggaacgtcatgtatttcaatggaaacagcgatgcctctactatcaaggaaaatcagtttgatccccctatcgtcgcacggtatatcaggatttctccgaccagggcttacaaccgcccaaccctgaggctcgaactgcaaggatgcgaagtcaatggctgtagcactcctctcggcatggagaacggcaaaatcgaaaacaagcaaataacagctagtagcttcaagaagagttggtggggtgattattgggaaccctttcgggcgaggctgaacgcccagggcagggtgaacgcttggcaagccaaggctaataataataaacaatggctcgaaattgatcttctgaaaatcaagaaaattactgccatcatcactcagggttgtaagtccttgagttccgagatgtatgtgaagagctatacgatacactacagcgaacagggggtggaatggaaaccatataggctgaaatcttccatggtggacaagattttcgagggcaacacaaatacgaaaggacatgtgaaaaatttcttcaacccccccattattagcagattcatcagggtgattccaaagacctggaaccagtctatagctctgaggctggagttgttcggttgtgacatctac

SEQ ID NO: 9108 - DNA, 6672 bp, Artificial Sequence
  Description of Artificial Sequence: Synthetic coding sequence
atgtttcccggatgcccacgattatgggtactagtggtccttggaactagctgggttgggtggggctcccagggcaccgaggccgcacaacttagacagttctacgttgccgcccagggcatatcatggagttaccgtccagagcctacgaatagttccttaaatctgagcgtcactagcttcaagaagattgtctaccgagaatacgagccttacttcaagaaggaaaagccacaatcaaccatctctgggttgctgggcccaacactgtacgccgaggtgggagacatcataaaggttcatttcaagaacaaagcggataaaccacttagtatccacccgcagggaatcagatacagcaaattgtccgagggggcctcttacctggaccacacctttcccgccgagaaaatggacgacgccgtcgcgcccggacgggaatacacttacgagtggtccataagcgaggattctgggcccacacatgacgatcctccatgtctcacacacatctactactcccacgagaacctgatcgaagacttcaattcaggcctgattgggcccctacttatttgtaagaaaggcactctcaccgaggggggaactcagaagaccttcgacaaacagattgtcttgctgtttgcagtctttgacgaaagcaaaagctggagccaaagttccagtctgatgtataccgtcaacggctatgtcaacggcacaatgcccgatataactgtgtgtgctcacgatcacatcagctggcatttgctgggcatgtctagcggacccgagctgttttccatccactttaatggtcaggtgctggagcagaaccaccataaggtgtcggctatcacactggtgtctgctacctccacaactgcaaatatgaccgtggggcctgaagggaagtggattatctcatcactcactcccaagcatctgcaggctggaatgcaggcctatattgacatcaaaaattgtccaaagaaaactcggaatctaaaaaaaatcaccagagagcaaaggcgccacatgaagagatgggagtattttatcgcggccgaagaagtgatctgggactacgccccggtcatccctgcgaacatggacaagaagtatcgaagtcagcatttagacaatttctccaaccagattggcaagcactacaaaaaagtaatgtatacgcagtacgaagatgaatcattcaccaagcatactgtgaatccaaacatgaaggaagacggaatcttgggacccatcatacgggcacaagtgcgcgatacccttaaaattgtctttaagaatatggcctccagaccatacagcatttacccccatggggtgacctttagcccatacgaagatgaggtaaactcttcattcacctcaggaagaaataacacaatgatccgcgccgtccaaccaggcgagacctacacttataaatggaacatcttagagtttgatgaacctactgagaacgacgcccagtgtctgacgaggccatattatagcgatgtggacatcatgagggatattgcgagtggattgataggactccttctgatttgtaagtctaggtcccttgatagaagaggcattcagcgagctgccgacattgaacagcaggcggtatttgcagtcttcgacgaaaataaaagctggtatcttgaggataacataaataagttttgtgagaatcccgatgaagtaaagcgcgacgaccccaaattttatgagtcaaatataatgagtactatcaacgggtacgtgccggagtcgataacaaccttgggcttctgtttcgacgacacagtgcagtggcacttctgcagcgtaggaacccaaaacgagattctgaccattcacttcaccggacatagcttcatatacggaaagcggcatgaagacaccctgactctttttcccatgagaggtgagagcgtgaccgtcacaatggacaacgtgggaacatggatgctgacatccatgaacagtagccccagaagtaaaaagctgcgacttaagtttcgcgatgtaaagtgtatacctgacgacgatgaagattcatacgagatcttcgagccccccgagtctaccgtcatggccacaagaaagatgcacgacagactagagcccgaggacgaagagtcagatgccgattacgactaccagaaccgcctggccgctgctctggggattcggtccttcagaaattcttcacttaaccaagaggaggaggagttcaaccttaccgcccttgcattagaaaacggaaccgagtttgtgagcagtaataccgatatcatcgtcgggtccaactactcctctccaagcaacatcagtaagttcactgtaaacaacctcgccgagccgcagaaggccccgagccaccagcaggcaaccaccgccggcagcccgcttcgacatctcataggcaaaaactctgtccttaattcaagtactgcagagcattcttccccttattccgaggaccctatcgaggaccctctgcagcccgatgtcacgggcatcaggctgctctccctcggcgcaggcgaattcaaaagccaagaacacgccaagcataaaggacctaaggtggaaagagaccaggccgcaaaacaccgattctcctggatgaagctcctggcccacaaagttggtcgtcacctgtctcaggatacgggaagccccagtgggatgcggccatgggaagacctccccagccaggacacagggagtcctagtcgcatgcggccatggaaggatcccccctctgacctcttgctgcttaaacagtctaatagttcgaaaatcctggtaggtcgatggcatttggcctcggagaaaggaagctatgagatcatccaagatacagatgaagacacagctgttaataactggctcatcagtccccagaatgcttccagagcctggggcgagtcaaccccactggccaacaaacctggtaagcagagcgggcatcccaagtttcccagggtgcgtcataagtctctccaggttcgccaggatggtggcaagagcaggctgaagaagtcccagtttcttatcaagaccaggaaaaaaaagaaggagaagcacacccatcacgcccccctgtctcctagaacattccatcctctccgtagcgaagcttacaacacgttttctgagcggcgcctgaaacacagtttggtcctccacaaatccaatgagaccagtttgccaaccgatttgaatcaaaccctgccctccatggatttcggctggatagctagtctgccggaccacaatcagaatagttcaaacgacacgggccaggcatcttgcccccccggtctgtaccagactgtgcctcccgaagagcattaccaaacctttcctatccaggatcccgatcagatgcactcgaccagcgaccccagccacaggtcctccagtccagaactcagtgagatgctggagtatgaccggagtcacaagagctttcccacagatatttcgcagatgtccccttcttccgaacacgaggtctggcagacggtcatttcacctgatttgagccaggtgaccttgagtccagaactctcccaaaccaacttatccccagacctctcacatacaaccctgtcaccggagcttattcagcggaatttgtcccccgctctgggccagatgcctatttcacctgacctgagccacacgaccctgtccccagacctgtcccacacaacccttagcctggacttgtcacaaacaaacttatctccagagctcagtcagactaatctatccccagccctcggacaaatgccattgagccctgacctctcacacactaccctgtctctggacttctcccagacgaacttatccccggaattgtcgcacatgacattgtcaccagagctgtcgcagacgaacttgagtcccgccctaggacaaatgcccatatcccccgatctgagccataccactttatctctggacttctctcagactaacctgagccccgagctctcacaaacgaacctgagcccagcgctggggcagatgcctcttagcccggaccctagccacaccacactttccctggatctttcacagactaatttgtcgccggagctgtcacagactaacctctcccctgacctgtctgagatgccactgtttgcagacctttctcagatccctctgacccccgatttggaccaaatgactctgtctcccgaccttggtgagaccgacttgtctccaaatttcggccagatgagcctatctcctgatctgtcccaggtcaccctgtccccagacataagcgacacaaccctgttgccagatctgtcccaaataagccccccgccagatctggaccagatcttttatccaagtgagtcttctcagagcctactgcttcaggaattcaacgagagctttccctacccggatcttggccagatgccttcccccagttctccgacattgaacgacaccttcctgagcaaggaattcaacccccttgtgatcgtagggttgtccaaggatggcacagattatatcgagattattcccaaggaggaagtccaatcttccgaagatgactacgccgagattgattacgtcccatatgacgatccatacaagaccgacgtacggactaacattaattcctcacgggatcctgacaatattgctgcctggtatctgcgctctaataacggcaatcgcaggaattattacatcgctgccgaagagatcagctgggattatagtgaatttgtgcaaagggagacagatattgaggactccgacgacattcccgaagacacaacctacaaaaaagtagtatttcgcaaatatctggactccacttttacaaaacgggatcccagaggcgagtacgaagagcacttgggcatcctcggccccatcattcgggcagaagtcgacgacgtaatccaggttcggtttaagaacctggcctccaggccgtactccctgcatgcccacgggctgtcctatgagaagtcgtctgaagggaagacctacgaggacgattcaccagaatggtttaaggaagacaacgccgtccaaccaaacagctcttacacgtatgtgtggcatgccacagagaggagtggtcccgaatcacctggctctgcttgccgtgcctgggcttactacagtgctgtcaatcctgaaaaagacattcacagcggtctgattggtccgctgctcatatgccagaaggggatcctgcacaaggattctaacatgcctatggatatgcgcgaatttgtactcctctttatgacctttgatgagaaaaagtcttggtactacgagaaaaagtccaggagttcttggcgtctgacaagcagtgagatgaagaagtcccatgagttccatgctattaacggtatgatttattcccttcccggcctgaaaatgtacgagcaggaatgggtgcggttacatcttcttaacatcggtggttcccaggatattcacgttgttcactttcacggccagactttgctagagaatggcaacaaacagcatcagctgggtgtatggcccttgttacccggctcattcaaaacattagaaatgaaagccagcaaacctggctggtggctgttaaataccgaggttggcgaaaatcagagagctggcatgcagacaccttttctgataatggatcgtgattgtagaatgccgatgggcttgtccaccggaataattagtgactctcagattaaagccagcgagttcttggggtattgggaacctcggctcgcccgtttgaacaatgggggctcttacaatgcatggagcgtggagaaacttgccgctgaattcgcctccaagccttggattcaggtggatatgcagaaggaggtgattattacgggtatccagacccagggcgctaagcactacctaaaaagttgttatactactgagttttacgtcgcctactctagcaatcagatcaattggcagattttcaaagggaactctacgcgcaatgtgatgtattttaatggtaacagcgacgcttccaccattaaagaaaaccagtttgatccccctattgtcgcccgctacataagaataagccctacgcgtgcgtataaccgccccaccctgcgcctggaattacaggggtgtgaagttaatggatgttctacacccttgggcatggagaatggaaagatcgaaaacaagcagattaccgccagtagtttcaaaaagagctggtggggcgactactgggagcccttccgcgccaggcttaacgcccagggccgggtgaatgcttggcaggcaaaagcaaataacaacaagcagtggctggagatcgatctgctgaaaattaagaaaatcaccgcgattattactcagggatgcaagtctttgtcaagtgagatgtacgttaaatcttacaccatccattactccgaacagggtgttgagtggaagccctataggttaaagagctctatggtggacaaaatctttgagggaaacaccaatacaaaggggcacgtcaagaacttctttaatcctcctattatcagtcggtttatccgggttatcccaaaaacctggaaccagtctatcgccctaagactggagttattcgggtgtgacatctac

SEQ ID NO: 9109 - DNA, 6672 bp, Artificial Sequence
  Description of Artificial Sequence: Synthetic coding sequence
atgtttccgggttgtccaagactttgggttctggtggtcctgggcacctcatgggttggttggggttcacagggaaccgaagcggcccagctccgacagttttacgtggcagcccaaggtatttcctggagctaccgtccagaaccaaccaatagctctttgaacttgagcgtgaccagcttcaagaagattgtctaccgtgaatacgaaccctattttaaaaaagagaagccgcagagcaccatttccggactgctcggtcccacgctctacgcagaggtgggcgacatcataaaagtccacttcaagaacaaagccgacaaacccttgagcattcatccacaaggaatccgctacagcaagctaagcgagggggccagctatctggaccatacgttcccggccgaaaaaatggacgacgctgtggctccaggccgcgaatacacctacgagtggtctatctcagaagattctggtcctacccacgatgacccgccatgcctgactcacatatattatagccatgagaatctgatcgaggatttcaacagcggtctgatcggcccgctgctgatctgcaaaaaaggtacactgacagagggcggcacccagaagacgtttgacaaacagatcgtcctgctgttcgccgtcttcgatgagtctaagagctggtcccagagcagctccctgatgtataccgtgaatggatacgtcaacggaacaatgcccgatatcacggtctgcgctcacgaccacatcagctggcacctcctcgggatgagcagcggccccgaacttttctctatccattttaatggccaggtcctagagcagaatcaccacaaagtgtcagccatcacgctggtgtctgccacttctactactgccaacatgacggtgggtcctgagggtaagtggattatcagctcgctgacgccgaaacatctgcaggcgggaatgcaggcgtacatagacattaagaattgtccaaaaaagacgcgaaatttgaaaaaaattaccagggagcagcgcagacacatgaaacgctgggaatacttcattgcagctgaggaggtgatatgggattatgcccctgtcatccctgctaatatggataagaagtatcggtcccagcacctggataatttctcaaatcagatcggtaaacactacaaaaaggtcatgtatacgcagtatgaagacgaatcctttaccaagcatactgtcaatccgaatatgaaagaggatgggatcctgggtccaatcatccgagcccaggtccgcgacacgttgaagatcgtctttaagaacatggctagccgcccatatagcatctacccgcacggcgtgacattctccccgtacgaggacgaggttaacagctcgttcacttcaggtcgcaataataccatgatcagagcggtgcagccgggcgaaacctacacgtataaatggaacattttggaatttgacgaaccgacagagaacgacgctcagtgtctgacccgcccgtactacagcgatgtcgatatcatgcgcgacatcgctagcggcctcatcggtctgctgcttatctgcaaaagccgcagtctagatcgccgaggcatccaacgggcggctgatatcgagcagcaggcagtgtttgccgttttcgacgaaaacaaatcttggtacctcgaggataacattaacaaattttgcgagaatccggatgaggtcaaaagggatgatccgaagttctatgaaagtaacataatgagcactatcaatggatatgttcctgaaagcattaccacactcgggttctgtttcgacgataccgttcaatggcacttttgcagcgttggtacgcagaatgaaatcctgaccatccactttacgggacacagctttatctacggtaaacggcatgaggatactttgactttgttcccgatgcgtggagagtctgtgactgtaaccatggataacgtcgggacctggatgctgacctcgatgaattcctctccgcgcagcaagaaactgagattgaagttccgcgacgtgaaatgcatcccggacgacgatgaggattcttatgagattttcgagccgccggagagcactgtgatggccacccgtaagatgcatgatcgcctggagccggaggacgaggaatcagatgcggactacgattaccaaaatcggctggctgcggccctgggcatccgcagctttcgcaacagctcgctgaatcaagaggaagaggagttcaacctgaccgcgttggcattggaaaatggcaccgaattcgtttctagcaacacggatatcattgtaggctccaactacagctctccatccaatatcagcaagttcaccgtaaataatctggcggaaccacaaaaggcgccatcccatcagcaggcgaccaccgccggctcgccactgcgacacttgattggcaaaaacagcgtgctgaacagcagcacggccgagcactcttcgccctacagtgaggatcctatcgaagaccctttgcaaccggatgtcaccggcatccgtctgctgagcctgggtgcaggcgagtttaaatcgcaggaacatgcaaaacataaaggtccgaaagtggaacgggatcaggccgccaaacaccgattctcttggatgaaactgctggcccataaggtcggccgccacctctctcaggacacgggctcgccgtccggcatgcgcccttgggaggatttgccttctcaggacaccgggtcacctagccgcatgcgaccgtggaaagaccctccgagcgatctgctactgttgaaacagagcaacagctctaaaatcctggtgggtcgctggcacttggcgagcgagaagggcagctatgaaatcattcaggacacggatgaagacactgctgtcaacaactggctgattagcccgcagaatgcttcaagggcatggggcgagtctacccctctggccaacaaaccaggtaaacaatccgggcatcctaagtttccacgggtgaggcacaagtccctgcaggtgcgccaggacggaggcaagtcccgcttaaaaaagagtcagtttttgatcaagacaagaaagaagaagaaggagaaacatacgcaccatgcacctctgagccctaggactttccacccattgcgcagcgaggcctacaataccttcagcgagcgccgtttgaagcactctctggtactgcataaatcaaacgaaactagcctgccgacggatctgaatcaaacgttgccaagcatggattttgggtggatagcgagtctgcccgatcacaaccagaacagctccaacgacacaggccaggcgtcctgtccgccgggtctgtaccagaccgttccgcccgaggaacactaccagaccttccctatccaagatccggaccagatgcactcgacaagcgacccaagccacaggtctagcagcccagagttgtccgaaatgttagagtatgatcgctcgcacaagagcttcccgaccgacatctctcagatgtctcctagttcagaacatgaggtatggcagactgtgatcagcccagacctctcccaagtgacgctgagtcccgaactgtcccagacaaatctgtccccagacttatcccacaccaccctgagtccggaattaattcaacgcaacctttcgccagcgctgggccagatgccgatcagcccggatctttcccacacaaccctttcgccagatctcagccacacaactctgagtctggatctcagccagacgaatctgagcccagagctctcacagaccaacttgagtccggctttgggtcagatgccactcagccctgatctttctcacaccactctgagcctggattttagtcagacgaatctgagcccagagctttcacatatgacactgagtcctgagctttcacagactaacctgagccccgccctgggacagatgccaatcagtcctgacctgagccacaccaccctgagcctggatttctcgcagactaacctgtcccctgagcttagccagactaatctgtcccctgccttggggcagatgcctctgtccccagacccaagccacaccaccctgagcctggatttgtcccagaccaatttaagccctgaactgagccagaccaacttgtcgccggacttgagtgagatgccgctgttcgctgatctgagccagattccgttgacccctgacttggatcagatgaccttgtccccagatctgggtgagaccgatctgagccctaattttggtcagatgtccctgagcccagatctgtctcaggtgaccttgtccccagacattagtgacaccaccctcctgccggatctgagccagattagtcctcctcctgacctagatcagattttctatccgtccgagagcagtcaaagcctgctgctgcaggaattcaacgagtctttcccatatcctgacttaggtcaaatgcctagcccctccagccctacccttaacgatacctttctgagcaaagaatttaatccgctggtcatcgttgggctgagcaaggatggcaccgattacattgaaatcattcctaaagaagaggttcagagctcagaggacgactacgcagagatcgactacgtcccttacgatgatccgtacaagaccgatgttcgcaccaacatcaatagctcccgagaccctgacaatattgcggcctggtatttgcgcagcaataacgggaatcgcagaaactattatatcgccgctgaagagattagttgggactactcggagttcgtgcagcgtgaaaccgacatcgaagactccgacgacattcccgaggacaccacttacaagaaagtggtctttcgaaaatacctggattctactttcacaaagcgagatccacgaggcgagtatgaagaacacctgggcatcctgggccctatcatccgcgcggaggtggacgacgtgattcaggttcggtttaaaaatctagctagccgaccgtatagcctgcacgctcatggtctgtcatatgagaagtcttctgagggtaagacctacgaggacgacagcccggaatggttcaaggaggataatgccgtacagccgaactctagctatacctacgtctggcacgctaccgaacgcagcggcccggagtctcccgggagtgcatgccgtgcgtgggcctactactctgcggttaaccccgaaaaggacatccattctggcttgattggcccactgctgatctgtcagaagggtattcttcacaaagatagcaatatgcctatggacatgcgcgagtttgttctgttgtttatgacgttcgatgaaaaaaagagctggtactatgaaaagaaatcccgcagctcctggcgattaacttccagcgagatgaaaaaatcccacgagttccacgctattaatgggatgatttattcattaccagggctgaagatgtatgagcaagagtgggttcgcctgcatcttctgaacatcgggggctctcaggatattcatgtggtacacttccacggtcagaccctgttggagaacgggaacaaacagcatcagctgggtgtatggccgctgctgcctggtagcttcaagaccttggagatgaaggcctcgaaaccaggttggtggctgttgaacactgaagtcggcgagaaccagcgtgccggtatgcagacccccttcctgatcatggacagagactgccgcatgccgatgggtctgtccacgggtatcatcagcgacagccaaattaaggccagcgagtttctggggtattgggagccccgcttggcgcgcctgaataatggtggcagctataacgcgtggagcgtggaaaaactcgccgccgaattcgcctctaaaccgtggatccaggtggatatgcagaaagaggttattatcacgggtattcaaactcagggtgccaagcattatcttaaaagctgctacaccactgaattctacgtggcatacagcagcaatcagatcaactggcagatttttaaaggtaactccaccagaaacgtgatgtactttaacggaaactccgatgcgagcaccatcaaagaaaatcagttcgatccccccattgtggcccgctatattcgcatcagcccgaccagggcatacaaccgtccaacgctccgtctggagctgcaggggtgtgaggttaatgggtgctccactccactcggtatggagaacggaaagattgagaacaaacagatcacggcgtcctccttcaagaagagctggtggggcgattattgggagccgtttcgagcgcgcctgaacgctcagggtcgggtgaatgcctggcaagctaaagcgaacaataataaacaatggctggagattgacctgctgaagattaagaagatcacggctataatcacccagggctgcaaaagcctgagctccgagatgtacgtcaaaagctataccatccattacagcgaacaaggcgtcgagtggaaaccatatcggttaaagagcagtatggtggacaagatcttcgaaggtaacaccaacactaaaggccatgtgaaaaacttttttaatcccccaatcatttctagatttatcagagttatcccaaaaacctggaatcagtctatcgctctgcgcctagagctgttcggctgtgatatctac

SEQ ID NO: 9110 - DNA, 6672 bp, Artificial Sequence
  Description of Artificial Sequence: Synthetic coding sequence
atgttcccaggatgtccaagattatgggtcctggttgtgctggggactagttgggtcggctggggctcacagggcaccgaggcagcccagttgaggcaattctacgttgctgcccagggaattagttggtcctaccgccccgagccaacaaactccagcttgaacctatccgtaacatccttcaagaaaatcgtgtaccgcgagtacgagccatacttcaaaaaagaaaagccgcaatctacgatttctggactcctggggcctacgctgtacgctgaagtgggagatattataaaggtgcacttcaagaacaaagcagacaagccattgagcatccatccacaaggtatccggtactccaagctgtcagagggagcttcttatttggatcacactttccctgcagagaaaatggacgatgcagtggcacctggtcgcgaatatacatatgaatggtccatctcagaagattccggtcctacccatgatgaccccccgtgtctcacacacatctactacagccatgagaacctgatcgaggacttcaatagcggtctcatcggaccgctgcttatttgtaaaaaaggaacactcacggaaggaggcacccagaagactttcgacaaacagattgtgctgctctttgccgtcttcgacgagagcaaatcgtggtctcagtctagttccctgatgtacactgtaaacggctatgtgaatggaaccatgccagacataacagtttgtgctcatgaccacatcagttggcacttgttggggatgtccagcggccccgagctgttttccatccacttcaatggccaggtcttggaacagaatcatcacaaggtgagcgcaatcaccctagtgagtgcaacaagtactacggcgaacatgacagtgggcccagaaggtaaatggatcatctcttcccttacgccgaagcatctgcaagctggcatgcaagcctatatcgacataaagaattgccccaagaagacacgaaacctgaagaaaattacaagagaacagcggcgacacatgaagaggtgggaatacttcattgctgccgaagaagtgatctgggactacgcacctgtcataccggcaaacatggacaaaaagtaccggtctcagcaccttgataatttttcaaatcagattggcaagcattacaaaaaggtcatgtacacccagtacgaggatgaatcctttacaaagcacacggttaacccaaatatgaaggaggatgggatattggggcccatcatccgagcccaggtgcgggacaccctaaagattgtattcaagaatatggctagcagaccgtactccatatacccacacggtgtgaccttcagtccatacgaggatgaagtgaattcgtctttcacgtctggacggaacaataccatgatccgcgccgtccagcccggcgagacctacacctacaaatggaacatcctggaattcgatgagcccaccgaaaacgatgcccagtgcctgacacgcccatattattctgatgtcgacatcatgcgcgatattgcctccggcctgatcggactgctcctcatttgtaaatcaaggtcactggacagacgtggcatccagagagccgccgacatcgaacagcaggcggttttcgccgtcttcgacgaaaacaagtcttggtacctggaggataacattaataaattctgcgagaaccccgacgaagtcaaacgggatgaccccaaattctatgagtcaaatattatgagcaccattaatgggtacgtcccagaatccattacaacgctcggtttctgcttcgatgacacagttcagtggcatttctgtagcgtcggaactcaaaacgagattctcactatccacttcacagggcacagcttcatttacggaaagaggcacgaagacacattgacactgtttccaatgcgcggcgagtctgtcaccgtcacaatggataacgtcggaacatggatgctcacctccatgaactcaagccccagaagcaagaagctccggctcaaattccgggacgtgaagtgcatcccagacgatgacgaggattcttatgaaatcttcgagcctcccgagagcactgtgatggctacccgcaaaatgcacgacaggctcgaacccgaagatgaggagtctgacgcggattacgactaccagaaccgactcgctgctgcgctgggcattagatcatttaggaacagtagcctgaaccaggaagaggaggagtttaatctgaccgcactggctctcgaaaatggaactgagtttgtatcatctaatacggacattattgttggcagtaattacagcagcccttccaacatctccaagttcactgtcaacaatcttgccgagccacagaaggctcctagccatcaacaggctacaaccgccggaagtccacttcgccacctcattggaaaaaacagcgtcctaaactcatcaactgcagagcatagtagcccctattcagaggaccccatagaggatcctcttcagccagatgtcactgggatcaggttgctgtcactcggagcaggggaatttaagtcgcaagaacatgccaaacacaaaggtccaaaagtggaaagggaccaggccgctaagcatcggttttcgtggatgaagctcctggcacataaagtgggaaggcacctgagccaagatacaggctcaccctctggaatgcgcccttgggaggatctcccaagccaagatactggatccccttctcgcatgcgtccatggaaggacccaccctctgaccttctgcttcttaaacagtcaaatagtagtaaaatcctggtaggccgatggcatctcgcctcagaaaaggggagctacgagattatccaagacactgacgaggataccgcagttaataactggcttatctccccccaaaacgcctctcgggcctggggcgaatcaaccccactagcaaacaagcccggtaagcagtccggtcaccccaagtttccaagggtgagacacaaatcactgcaggtcaggcaagatgggggtaagagccgattgaagaaatctcagttcctgattaagacgagaaagaaaaaaaaagaaaaacacacgcatcatgcacctctgtccccacgaaccttccatccactcaggtcagaggcttacaacaccttttccgagagacgcctgaaacatagtctggtgctgcacaaatccaacgaaacctccttgcctacggatcttaaccagacactgccctccatggatttcgggtggattgcttccctgcccgaccataatcagaattcctccaatgatactgggcaggctagttgcccccccggcctgtaccagacagtgccccccgaagaacactaccagacctttcccattcaggatcccgaccagatgcactccactagcgacccttcccaccggtcatcttctcccgaactctcagagatgctagagtacgatcggtctcacaaaagctttccaactgacatatctcagatgtcaccaagcagcgaacatgaggtatggcagaccgtgatcagtcccgacctgagccaagtgacactatcgccggagctgtctcaaaccaacctgagccccgatctaagccacaccaccctcagccctgaactcatacagaggaatttaagtcctgcgctgggccagatgcccatctccccagatctgtcgcatacaaccctttcgcccgacttaagccataccacactgagcctggacctctcacaaactaacctttctcctgagctgtcccagaccaaccttagtccggccctgggacagatgccactctcacccgatctgagtcacaccactctgagtctggattttagccaaacgaatttatcaccggagctgagccacatgaccttaagcccagagttatcacagacaaacctttcgccagctctggggcagatgccaatcagtcctgacctatcacacaccacgctcagtctggacttttcccaaactaacctctcaccagaactgagtcaaacaaatctgtcgcctgccttgggtcagatgcctttgtcacctgaccccagtcacacgacactttcgttggatctatcgcagacgaatctgagtcctgagctctctcaaaccaatttatcacccgacctgtccgaaatgccgctgttcgccgatctgagtcagatccctctgacacctgatctggatcaaatgacgctgtcccccgacctaggggaaactgatctgtctcccaatttcgggcagatgtctctgtcccccgacctgagccaagtgactttgtcgcctgacatctcagacaccaccctcctccctgatctgagtcagattagccccccccccgatctggaccagatcttctatccatccgagagcagtcagtcgctgctccttcaagagtttaacgagagcttcccctatcccgatctagggcagatgcccagccccagctcacccaccctcaatgatacgttcctctcaaaggagtttaaccctttggtcattgtaggccttagcaaggatggaaccgactatatcgagatcatccctaaagaagaagtacagagcagcgaggatgactatgctgaaattgattatgtgccgtatgacgacccctataaaaccgatgtgcgcactaatattaatagcagccgggaccctgataacattgccgcatggtacttacgcagcaataacggcaaccggcggaattattacattgctgccgaagaaatctcttgggactactccgaatttgtacagagggaaacagacatcgaggatagcgatgacatcccggaggatacaacctacaaaaaagtcgtctttcggaagtatctggactcaacgtttaccaaaagagatcctcgtggagagtacgaggagcatctcggcatcctgggccctattatacgggctgaagtggatgatgtcatccaagtgaggttcaagaacctagcctcccggccctattccctgcatgctcacggtcttagctatgaaaagtccagcgaggggaagacatatgaagacgatagtccggagtggttcaaagaagacaatgcagtgcagcctaacagttcttacacctacgtgtggcacgctacagaacggtccgggcccgagagccctggctccgcttgccgcgcatgggcctactactccgcagtgaaccccgaaaaagatatccactcaggactgataggccccctactgatctgtcagaaaggtatcctacacaaggattcgaacatgcccatggacatgcgagaattcgttcttttattcatgacttttgacgaaaagaagtcatggtactatgagaaaaagagcaggagctcctggcgactgacctcttctgaaatgaaaaagagccacgagtttcacgcaatcaacggcatgatctattccctccctggactgaaaatgtacgaacaggagtgggtgcggttacacttgttgaatattggcggtagccaggatattcatgtggtgcacttccacggacaaaccctcctagagaacggcaataagcagcatcagctgggggtgtggccactgctgcccggtagtttcaagactctcgagatgaaagcatcaaagcccggctggtggctgctcaacaccgaagtgggtgagaaccaacgcgcaggtatgcagaccccttttttaatcatggaccgggattgtcgtatgcctatgggcttatccaccggcatcatttccgactcacagattaaggcgagcgagtttctgggttactgggagcctcggctggcacgcctcaataatggcgggtcctacaatgcttggtccgtcgagaagctggcggctgaatttgctagcaaaccctggattcaggttgacatgcagaaggaagtcatcataactggaattcaaacccaaggtgctaaacactatctgaaatcgtgttataccacagaattctacgttgcttactctagtaaccagatcaactggcaaatctttaaaggaaatagcacccgtaacgtgatgtattttaacggcaacagtgacgcctcgaccatcaaggaaaatcaattcgatccacccattgtggccaggtacatccgcatctcccccacccgtgcttataaccgaccaactctccgacttgagctccaggggtgtgaagtgaacggctgtagtactcccctggggatggagaatggaaagattgaaaacaaacaaatcaccgccagcagtttcaagaagagctggtggggcgattattgggagccctttcgagccaggcttaacgcccaaggcagagtcaacgcttggcaagctaaggctaataataacaaacaatggctggagatagatttgttaaagatcaagaagattacagccatcatcacccaggggtgcaagagcctctcttcagagatgtatgtcaagagttacaccatccactattctgaacagggggttgaatggaagccctatagactcaaaagcagtatggtggataaaatattcgaggggaacaccaacaccaagggccacgtgaaaaacttctttaatccccccattatcagtagatttatccgtgttatcccaaagacctggaaccagagcattgccctgcgactggagctatttgggtgtgatatctat

SEQ ID NO: 9111 - DNA, 6672 bp, Artificial Sequence
  Description of Artificial Sequence: Synthetic coding sequence
atgttccctggatgtcctaggctctgggtgcttgtagtgcttggcactagctgggtcggctggggctcgcaggggaccgaagcggcccagctccgccagttctatgtagctgcacagggcatatcatggtcttatagaccagaaccaaccaactcctctcttaacctttctgttactagcttcaaaaagatagtgtatcgcgaatatgagccttattttaagaaagaaaagccccagtctaccatcagtggcctgcttggaccaaccctgtacgcagaggtcggcgacatcattaaggttcacttcaaaaataaagctgacaaaccactgagcattcaccctcagggcattcgctattcgaagctgtccgaaggtgccagttacctcgaccacactttccccgcagagaaaatggacgatgctgtggcccctggtagagagtatacctatgaatggtctatcagcgaagacagcgggcctacgcacgacgatccgccctgtcttacccacatatactattctcacgaaaaccttattgaggactttaactccggcctgatcgggcctctgctaatctgtaaaaaaggcaccctgacggagggaggtactcaaaaaacctttgacaagcaaatagtgctactgtttgcggtgtttgatgaatcaaaatcgtggagccagtcgtctagtctaatgtacacagtaaatggctacgtgaatggcacgatgccagacattaccgtgtgcgcacacgatcacatcagttggcatttgctggggatgtccagtggccctgagctgttttccatccactttaacgggcaggtgctcgaacagaaccaccacaaagtgagcgccattacactggtctcagcgactagcaccaccgcaaatatgaccgtcggtccagaaggcaaatggattatttcctctctaactccaaagcacctccaagccggcatgcaagcatacatcgacatcaagaattgtccaaagaagacgcggaacctgaagaagatcactagggaacagcggcggcatatgaaaagatgggagtatttcatcgctgcagaagaagtcatctgggattatgcgcccgtgatacctgcaaacatggataaaaagtacaggagccaacacctggacaacttctcaaatcagataggcaagcattataaaaaggtgatgtacacgcaatacgaagacgagtcattcacaaaacatacagtgaatcccaatatgaaggaagatggtatactgggtccaatcatccgggctcaagtaagagatacattgaagattgtgtttaaaaatatggccagtagaccgtatagcatttaccctcatggggtcacatttagtccttacgaagatgaggtcaattcctcttttaccagcggacgtaacaatactatgatccgagccgtgcaacctggcgagacttacacatataagtggaacattctggaattcgatgaacccacagaaaacgatgcccaatgtcttacccgcccgtattattctgacgtggatatcatgcgggacatagcatcagggctgatcggcctcctgctgatctgtaagtccagaagtctggaccgaagaggaattcagagggccgccgacatcgagcagcaagcagttttcgccgtgtttgatgagaacaaaagttggtatcttgaggacaacattaacaaattttgtgaaaaccccgacgaggtcaagcgtgacgacccgaagttctatgagtcaaacattatgtcgaccatcaatggctatgtacccgaatcgatcacgacactcggtttctgcttcgatgacacagtgcagtggcatttctgctctgtcggcactcagaatgaaatactcaccatccattttaccgggcactcattcatctatggaaaacgccatgaggatactctgaccttgttcccgatgcgcggtgagagcgtcactgtaacgatggataacgtggggacttggatgcttacctctatgaattcgtcaccgagatcgaagaaactgaggcttaaattccgagacgtgaaatgtataccagacgacgacgaggatagttatgaaatttttgaaccccccgagtcgacagtgatggccacccgaaagatgcatgacaggcttgagcccgaggacgaggagtctgacgccgactatgactatcagaatcggctagccgcagccctcgggatccggtcattccgcaatagcagtcttaatcaggaagaggaagaatttaaccttacagcactggcgctcgaaaatggcactgaattcgtgtcttcaaataccgatattattgtgggatcgaactacagctccccatctaacatctccaagtttacagtgaataacctggcagagccccagaaggctccgtcgcaccagcaggctactactgcaggcagcccgcttcgccacctcattggtaagaacagcgtgttgaactcttcgactgccgaacacagcagcccctacagcgaagaccccattgaggatccccttcagcctgatgttacaggcatccgcctactcagcttgggggcaggagagtttaagtcacaggaacacgcaaagcacaaaggacctaaggtggagagggaccaggccgctaagcatcgattctcctggatgaagctcttggcccacaaggtggggcgacacctgtcccaggacacaggatctccttctggaatgcggccatgggaagaccttccctcacaggacacgggcagtccatcccgtatgagaccttggaaagatccgcctagtgaccttctgctccttaaacagagtaactcttcaaagattctggtgggaagatggcacttagcgagcgaaaaagggagttatgagattatccaggacacagatgaggataccgcggttaacaactggctgattagcccacagaacgccagccgcgcctggggcgagtccacacccttagcaaacaagccaggcaagcagtccggccaccccaaattcccaagggtgagacacaagagcctccaggtgagacaggatggggggaagtctcgactcaaaaaatcccaattcctgataaagaccaggaagaaaaagaaagagaaacatacccatcacgcccccttgtcgcctcgcaccttccatcctcttagatccgaggcatacaacacattttcggaacgaagactcaagcattctctggtgctgcataagtccaatgagacctcgctgcccaccgacctaaatcagacattgccaagcatggatttcggctggatcgccagcctaccagaccacaatcagaattcctcaaacgacactggccaggcttcctgcccccccggcctgtaccagactgtgcctcccgaagagcactatcaaactttcccaatccaagaccctgaccagatgcacagcacaagtgacccatctcatcgaagtagctctcccgaactgagtgagatgctcgagtacgacaggagccacaagagctttccaactgacatcagtcagatgagtccctctagcgagcacgaggtgtggcaaaccgtaatttctcctgatctgtcacaggttaccctctcccccgagctctcacagacgaacctgtctcccgatctttcacatacaacactcagccctgaactcattcagcggaatctaagtccagctcttggtcagatgcccatctctcccgatttgagccatacaacactgtctcctgatctgtcccacactacgctttcactcgacctatcccaaactaacttgtcacctgaactcagccagaccaatctgtctcctgcactgggacagatgcccctcagccctgatttgagtcatactactctcagcctagatttctcccagacgaaccttagccctgagctgtcacatatgacactgtctcccgaactgtctcagacaaacctttcaccagctttgggacagatgcctattagccccgacctctcacataccactctgtcacttgatttcagccaaactaacctgagccctgaacttagccagaccaacctgtcacccgcgcttggccagatgccattgtcacctgatcccagtcacactactctctcactggacttgagccagacaaacctaagccctgagcttagccagaccaatctctccccagatctatcagaaatgcccttatttgctgatctgtcacagatcccactaacaccagatctcgaccagatgactctgtcacccgatttgggggaaacagacctctctcctaattttggacaaatgtccttgagtccagacctctcccaggtgactttatcgccggatataagcgatactactctactccctgacctcagccagatatcccctcccccagacttggaccagatattttaccccagcgaaagtagtcagtcactgttgctccaggaattcaatgagagctttccctaccccgacctgggccagatgccctcaccctcttcccccacgctgaacgataccttcctgtcaaaggaatttaacccacttgtaatcgtgggtctctccaaagatgggacagattacatcgagattatccctaaagaagaagtccagtcttccgaggacgactatgcagaaatagactatgtgccctacgatgatccatacaaaacggacgtgcggacaaacattaactcctcccgggacccagataatatagcagcatggtaccttcgctctaacaatggaaacaggcggaactactatatcgccgccgaagagatctcatgggattattccgagttcgtccagagagagacagatatcgaggactcagatgacattcccgaggacacaacttacaagaaggtggtttttcggaagtacctggactccacttttaccaagcgagacccaagaggcgaatacgaggagcacctgggcatcttggggcctattatcagggctgaagtggatgatgttatacaagtacgttttaaaaacctcgcttccagaccttactcgctacatgcccatgggctgagctacgaaaaatccagcgaaggcaagacctacgaggacgatagcccggaatggttcaaagaggacaacgcagtccagcccaattcgtcctatacgtatgtttggcatgccacagagaggtctggtcctgaatcccccgggtcagcttgccgagcctgggcttattacagcgccgttaaccctgagaaggacatccattctggactgataggccccttgctgatttgccagaaaggcatcttacataaagactcaaacatgccaatggatatgcgcgaattcgtgctgttgttcatgacattcgatgagaagaagagttggtactacgaaaagaaatcccggagcagctggcgcttaacaagttcggaaatgaagaaaagtcacgaatttcacgcaatcaacgggatgatttattcactgcctggtttgaaaatgtatgagcaagaatgggtgagactgcacctcctgaatatcggagggtctcaggatattcatgtggtgcactttcacggccagacattgttggagaatggaaataaacaacaccagttaggcgtctggccgctgctgcccggttccttcaagacactggaaatgaaagcgtcgaaacctggatggtggcttctgaacactgaggtgggggaaaatcaaagagcaggcatgcagacccccttccttatcatggatcgagattgccgcatgcccatgggcttatcaaccggcatcataagtgacagtcaaataaaggcatccgagtttttgggttattgggaaccacgactggcacgcctgaataacgggggaagctataacgcctggtccgtggagaaattggcagccgagttcgcttccaagccctggattcaggtggatatgcaaaaagaagtgatcattaccgggatccagacacaaggggcaaagcattatcttaaatcatgctatacaacggagttctatgttgcttactccagcaatcagataaactggcagattttcaaagggaactctacaagaaacgtgatgtactttaatggcaactccgatgcatctaccattaaagagaaccagttcgatcctcctatcgtcgctcggtacattaggatctcccccacgagagcctataacaggccaacactcaggcttgagctgcaaggatgtgaagtgaacgggtgtagtactccacttggcatggaaaatggaaagattgaaaataagcaaatcactgcctcctcctttaagaagagttggtggggagattattgggagcccttccgggccaggctcaacgctcagggccgagtaaacgcgtggcaggccaaggccaacaacaataaacagtggttggagatcgacctcctcaaaattaaaaagattacggccatcataactcagggctgtaaatcactgagttcagagatgtacgtgaagtcgtatacaatacactattccgaacaaggagtggagtggaaaccatatcgcctgaagagctccatggtcgacaaaatcttcgaaggtaataccaacacgaaaggacacgtgaaaaatttttttaatcctccaattattagccggtttattcgcgtcatacccaagacgtggaatcagagtattgctttgagattagagctcttcggctgcgacatctac

SEQ ID NO: 9112 - DNA, 6672 bp, Artificial Sequence
  Description of Artificial Sequence: Synthetic coding sequence
atgtttccaggctgcccgcgcctatgggttctcgttgtacttgggacaagctgggtgggctggggtagtcaagggacagaagccgcccagctaaggcaattctacgttgccgcccagggcatcagttggtcttatcggcctgagcccacaaattctagtctgaacctgtccgttacctctttcaagaaaattgtatatagggagtacgagccgtatttcaaaaaagaaaagccccagtccactatcagtgggctgctagggccaactctatatgctgaagtgggagacattatcaaggtgcatttcaagaataaggccgacaagccactttctatccaccctcaaggcatcaggtatagtaaactgtcggaaggagcctcctacctcgatcacaccttccccgcggaaaagatggatgacgcggtggctccaggacgcgaatatacctatgagtggtccattagtgaggatagcgggcccacccacgacgaccctccttgcctaacccatatttattattctcacgaaaacctgattgaggacttcaattctggcctgatcgggcccctccttatctgtaaaaaaggcacgctcaccgagggggggacgcagaaaaccttcgacaagcagatcgtgctgttgttcgctgtgttcgatgagagcaagtcttggtcacaatctagcagcctgatgtacacagtgaacggctatgtgaacggaactatgccagatatcactgtttgtgctcacgaccacatctcctggcacctcctcgggatgtcttctggacccgaactgttttcgatccattttaatgggcaggtgttggagcagaaccatcacaaggtgtccgccatcactctggtgagcgcaaccagtacaactgccaatatgactgttgggcctgaagggaaatggattataagtagtctaacgcctaaacacctgcaggccgggatgcaagcatatatcgatatcaagaactgcccgaaaaagacaaggaacctcaagaaaatcactagagagcaacgcagacatatgaagagatgggaatacttcattgccgcagaggaggtcatttgggattacgctcctgtgattccagcaaatatggataaaaaataccggagccagcacctggataacttctccaatcaaattggcaaacattacaaaaaggtgatgtacacacagtatgaagacgaatcattcaccaaacacactgtgaaccccaatatgaaagaagatgggatactgggccctattataagggcccaggtgagagataccctaaaaattgtctttaagaacatggcttccaggccctatagtatctatcctcacggggtcacattttctccatatgaggacgaagtgaattcttcttttacaagtggaaggaacaacacgatgatcagagccgttcaaccaggagagacatacacatacaagtggaacatattggaattcgatgagccgaccgaaaatgatgcacaatgccttactcgaccctactattccgatgtggatattatgcgagatatcgccagtgggctgatcggacttctgctgatctgtaaaagcagaagcctcgacagacgaggaatccagcgagccgctgatatcgaacagcaggcagttttcgcagtgttcgatgagaataagtcctggtatcttgaggataatattaacaaattctgtgaaaacccagacgaagtcaagcgtgacgacccaaaattttacgaaagcaacattatgagtaccataaatggttatgtcccagagtcgattactacactgggcttttgcttcgacgataccgtgcagtggcacttctgttccgtcgggacccaaaatgaaatcttgacgatacattttactggacattctttcatatacggcaaaagacacgaggatacgctgaccctctttccgatgcggggtgagtccgtgaccgtgaccatggataacgtaggcacctggatgctcaccagcatgaattctagtccgaggagtaagaagttgcgcctgaaatttcgcgatgtcaaatgcataccggacgacgatgaggattcctacgagatattcgaaccgcctgaatctaccgtcatggcaactcgcaaaatgcacgacagattggaaccggaggatgaagaatcagacgccgattatgattatcagaaccgattggccgcagcactcgggatcagaagtttcagaaactcatctttgaaccaggaagaagaggagttcaatctgaccgctctcgcactcgagaacgggaccgaattcgtatcaagcaatacagacatcattgtgggtagcaattattcctctcccagcaatatatccaaatttactgttaataacctggctgagccgcagaaagctccctctcaccaacaggccaccacagctgggtcaccattacgccatttgataggtaagaacagcgttctgaatagttctacggccgaacactcctccccctactccgaagacccaatcgaggaccctctgcagcccgatgtcaccggtatccgcctgctcagtctgggcgcaggtgagttcaagtctcaagagcatgctaagcataaaggaccaaaagttgagagggaccaggctgccaaacacaggtttagctggatgaaactccttgcacacaaggtcgggaggcatttatctcaggataccgggtcaccttctgggatgaggccctgggaggatctgcccagtcaagacactggatcgccatctaggatgagaccatggaaggatcctccttcagacctgctgctgcttaagcagagtaactcatcaaagattctggtgggtcgctggcatttagctagcgagaaaggctcctacgagattatccaggataccgacgaagatactgctgtgaacaattggcttatatcaccgcagaacgcatctagagcttggggagagtctacacctctggccaataaacccggcaagcagtctggtcaccctaaatttccacgagtgaggcataagtctctgcaggttaggcaggacgggggcaaatcacggttaaaaaaaagccagttccttattaaaacccggaaaaagaagaaggaaaagcatacgcaccacgcccccctcagcccacggaccttccatccgctgagatctgaagcgtacaatactttcagtgagcgtaggctgaagcattcattggtcctacacaagtcgaacgagacgagccttcccacagatctcaaccagaccctgccatccatggatttcggctggatcgccagtttacccgatcacaatcagaacagctcaaatgacactggacaggcatcctgcccgcccgggctttaccagactgtgcctccggaagaacattaccagacctttcccatacaggatcccgatcagatgcactctacttcagacccttcccatagatcaagctcaccggaactcagtgaaatgttggagtacgacagatctcacaagtcattcccgacagatatcagtcagatgtcaccatcatctgagcacgaggtctggcagactgtgatcagtcctgatctttcacaggttacccttagtcctgagcttagccagactaatctgtctcctgacctctctcacaccacgctttcaccggagctcattcaacgcaaccttagccccgcactgggccagatgcccatatcaccagatcttagccacaccactttgagtcctgatctgtcccacacgacattatccctcgacctctcacaaactaacctaagccccgagctgagtcaaaccaacttatcacccgccctgggacagatgcccctaagccccgatctgagccacactactctgagtttggacttttctcagacgaatctaagtcctgaactgtctcacatgacactgtcacccgagctgtcacaaactaacctgagtcccgctctgggccaaatgccaatcagtccagacctctcacatactaccctgagcctggatttttcccaaactaatctaagtcccgagctctcacagactaatctgagtcctgctctgggccagatgccgctgtcgccagatccatcacacacgactttgagtctggatctttcacagacaaatctgagcccagagctgagccaaacaaatttatctccggatttgagtgagatgcctctcttcgccgatttgagtcaaatcccacttactccagatctggaccaaatgacactatctccagacttgggtgagacagatctgtctcccaactttgggcagatgtcactgagcccagacttgagtcaagtcaccctgtctccagacatttctgatacaacactgttaccagatctcagtcagatttctcctccccctgaccttgatcagattttctacccaagtgaaagctctcagtctctgctgttgcaggaattcaatgagtcgtttccgtatcctgacctgggtcagatgccctccccatcatcgcccacattgaatgacacattcctgagtaaagaatttaatcctctcgtcattgtaggcctgtccaaagacgggacggattacatcgagataatcccaaaagaagaggtgcagagcagcgaggacgattacgctgagatcgactatgtgccatacgatgacccctacaagactgacgttagaaccaacatcaattcgagccgggaccccgataacatcgctgcctggtatttacgtagtaataacggtaaccgcaggaactactacatcgcggccgaagaaatcagttgggattactcagagttcgtccagcgagagacagatatagaagactccgatgatatcccggaagatacgacctataaaaaggtggtgttccggaaatacttggattccaccttcaccaaacgcgacccccgcggcgaatatgaggaacacttaggtattctgggccctatcatcagagctgaagtggacgatgtgatacaggtgagatttaagaatttagcttcccgcccgtacagcctccatgctcacggcctctcctacgagaagtcatctgaaggaaaaacctacgaagacgacagccctgagtggttcaaggaagacaacgctgtccagcctaatagcagctacacctacgtatggcatgctacagaaagatccgggccagagtcaccgggcagtgcttgcagggcctgggcgtactattctgctgtgaaccccgaaaaagacatccactcaggactgatcggcccgctgcttatctgccagaaaggcatcctccataaggattctaatatgccaatggacatgcgggaatttgtgcttctattcatgacttttgatgagaaaaaatcctggtactacgagaaaaagtctcgctcttcatggagacttaccagcagcgagatgaaaaagagccatgaattccatgccatcaatgggatgatctattcccttcctggcttgaaaatgtatgaacaggaatgggtgcgtctccacctgttaaatatcggagggtctcaggacatacacgtcgtacatttccacgggcagaccctgctcgaaaatggcaacaagcagcaccaactgggcgtgtggcctctgttgcccggcagcttcaagactctggagatgaaggcctcaaagccggggtggtggttgctgaataccgaagtcggcgaaaaccagagggctggaatgcagacgccttttctgatcatggatcgggattgtcgtatgcccatgggactcagcaccggcataatctccgattcacaaatcaaagctagtgagtttctgggttattgggagcctcggcttgccagactgaacaacggggggagttacaacgcttggagtgtggagaagttggctgccgaatttgcttccaaaccatggatccaggtggatatgcaaaaggaggtgataattacgggcatccaaacccagggcgcaaaacactatctgaagagctgttatacaacggagttttatgtcgcctacagttctaatcaaataaattggcagatctttaagggaaattcgaccagaaacgtaatgtactttaatgggaacagcgacgctagcaccatcaaagaaaaccagttcgacccgccaatagtggcgcgctatattagaatttcccctactagggcctacaacaggcctaccctcaggctggaactgcagggatgtgaggtgaacggatgcagtacccccctgggaatggaaaacggcaaaatcgagaacaagcagattacagcatcctcctttaagaaatcttggtggggcgattactgggagccatttcgcgctcgcctgaatgcccaggggcgggtgaacgcctggcaggctaaggctaataataacaaacagtggttagaaatcgacctcttgaagataaagaagatcaccgccataatcacccaggggtgtaagtctctatcaagcgaaatgtacgtgaaaagctataccattcattattccgagcagggggtagagtggaaaccatacagactgaagagcagcatggtggacaaaatctttgaagggaataccaatacaaaaggccacgtgaaaaattttttcaacccccccatcatttcgagattcattcgagtcatccccaaaacctggaaccagagtattgcccttagactggaactgtttggatgcgatatctac

SEQ ID NO: 9113 - DNA, 6672 bp, Artificial Sequence
  Description of Artificial Sequence: Synthetic coding sequence
atgtttcctggttgcccacgattgtgggtgttggttgttctcggaacaagctgggtgggctgggggtctcagggcacagaagctgcccagctccgccaattctacgttgctgcacaagggatctcatggagttaccgccctgaaccaactaatagtagcctgaatctgtccgtgacatcctttaagaaaatcgtatatagggagtacgagccatacttcaaaaaagagaagccacagtctacgatcagtggcctccttggtccaacactttacgctgaggttggcgacatcatcaaagtccactttaagaataaagccgacaagccgttgtctattcatccgcagggaattagatactctaaattgtccgaaggcgctagctaccttgaccacacctttcccgctgaaaagatggatgatgccgtggcccctgggagggagtacacttatgaatggtctatatctgaggactcaggcccaacccacgacgatccaccgtgcctgactcacatctattactcccatgagaatctgatcgaggacttcaattctgggttgattggaccactgttgatctgtaagaaagggacactgactgagggaggtacacagaagactttcgacaagcaaatcgtgttgctgttcgctgtcttcgatgagtcaaaaagttggtcccaatcttcatccctcatgtatactgtaaacggatacgtgaacgggactatgcctgacatcacagtgtgtgcccatgatcatatctcctggcatctgctcggaatgtcttccgggccagagttgttcagtatacattttaacggacaagtgcttgagcagaaccaccacaaggttagtgccattaccctcgtgtctgctacatcaacaacagccaacatgaccgtggggccagaggggaagtggattatttcctcacttacacccaaacatctccaggccgggatgcaggcatacatcgacattaaaaactgccctaaaaagacccggaatctgaagaagatcactcgggagcagagaagacatatgaaacgctgggagtattttatcgcggcggaggaagttatctgggattacgccccagtcattccggcaaatatggacaagaaatataggtcacagcacctggataacttttccaatcagatcggaaagcactacaagaaagtaatgtacactcaatatgaggacgagtcctttacaaaacacacagttaacccgaacatgaaagaagatggtattctgggcccaataattcgagcacaggtgcgagatactcttaagattgtcttcaagaatatggctagccggccgtatagcatctacccgcacggagtcactttctctccctacgaggacgaggtgaattccagttttaccagcggccggaataacactatgatcagagccgtccagcccggcgagacttacacctacaagtggaacattctcgagtttgacgaacccactgaaaatgacgcacagtgcctgacaagaccttactacagtgacgtcgacatcatgcgagacatcgccagcggtctgataggcctgctgctcatctgtaagtccagatcactggaccggcgaggcattcagcgggcagccgatatcgagcagcaggctgtattcgccgttttcgatgagaataagtcctggtatctggaagataatattaataaattttgtgaaaatcctgatgaggtgaagcgggacgaccctaagttctatgaaagcaatattatgtccactataaatgggtatgtccccgaatcaataactaccctgggtttttgttttgacgacacggtgcaatggcatttttgctcagtggggacccaaaatgagatcctgacaattcattttactggccacagtttcatctatggaaagcgacacgaggacactcttaccttgttccccatgcggggcgagtccgttacggtgacaatggacaacgttggcacatggatgctcacatctatgaattccagcccccgctctaagaaacttcgactcaagttcagggatgttaaatgtattccggacgatgatgaggatagttacgagatctttgaaccccccgagtctaccgtgatggccacccgcaaaatgcacgatcggctggaaccagaggatgaggagtccgacgccgattatgactatcaaaatcgcctggctgccgccttgggtatacggagctttagaaatagctctttgaatcaggaagaggaggagttcaatctgactgctctggcgcttgagaatggcaccgaatttgtctctagtaatacggacattatcgttggcagcaactactcttctccaagcaatatcagcaagtttaccgtgaacaacctggctgagccacagaaggccccgagccatcagcaggcgacgaccgccggcagccctctcaggcatctgataggcaagaactccgtcctcaacagcagcacggcagagcattcaagtccctattccgaagaccccatcgaggaccctctgcaacctgacgtgaccggaatcagacttctctcccttggcgccggagagttcaagtcacaggagcatgccaaacacaaggggccgaaggttgagcgcgatcaggccgccaagcacagattcagctggatgaagctgctggcgcacaaggtgggccgccacctgtcccaagacactgggtcccccagtggaatgcggccctgggaagacctgccaagtcaagacacaggatcccccagcagaatgagaccttggaaggatccacccagcgaccttctgctcttgaagcagagtaacagttccaagatcctggtcggacggtggcacctggcttctgagaaaggcagctacgaaattattcaggacaccgatgaggacaccgccgttaacaattggctcatttcaccccaaaatgcatccagagcttggggggaatccactcccctcgctaataagcccgggaaacagagcggccaccccaagtttccaagggtgaggcacaaatctctgcaggttaggcaggacgggggcaaatcccggctcaaaaagagccagtttctgataaaaactcggaaaaagaagaaagagaaacatactcatcatgcaccattgagtcccagaacctttcacccactgcgctccgaggcttataataccttttctgagcgacggctgaaacactcactggtcctccacaagtccaatgagacatcactccctaccgatctgaatcagacattgcccagcatggactttggatggatcgctagtcttccagatcacaatcagaattcaagtaacgacacaggacaggctagttgtccacctgggctttaccagaccgtgccgccagaggagcactaccagacttttccaattcaggatcccgaccaaatgcatagcacttccgatccctctcaccgaagctcctctcctgagctcagcgaaatgctcgagtacgatcggagccacaaatcctttcccacggatattagtcaaatgagccccagctccgagcacgaggtctggcagaccgtgatttcccccgacctgtcacaggtgactctctctcccgaactctctcagaccaacctgtctccagacctttcacacaccactctttctcccgagttgatccagagaaacctcagtcccgctcttggacagatgccaatcagcccagacctgagccacacgactcttagcccagatttgtcacacaccactctgtccctcgacctgtctcagaccaatcttagcccagagctgtctcaaactaacctcagtcccgccctcgggcaaatgccactcagccccgacctgtcccacactaccctgagcctggactttagccaaacaaatctgagcccagagttgtcccatatgactctcagcccagaattgtcccagactaatctgagccccgcccttggccaaatgcccatatccccagacctgagccatactaccctgagcctggacttttctcagaccaatctgtcccctgaactgtcacaaaccaacctgagccctgctctgggccagatgccgctgtcaccggatccgagtcatactacactctctctggatttgagtcagactaacctttctcctgagttgtctcagacaaatttgtcacctgacttgagtgagatgcctctgttcgctgacctgtctcaaattcctctcacccccgatctggatcagatgacgctttcccctgatctgggcgagaccgacctttcccctaactttggccaaatgtccctgagtccagacctgagtcaggtgaccctgtcccctgatatatctgataccacgcttctgcccgacctgagccagatcagccctcctccagatctcgatcagatcttttatcccagtgagtcctcacagagtctgcttctgcaggaattcaatgagtcattcccctatcccgaccttggccagatgcctagtccaagcagtcccactctgaacgatacattcctgtccaaagagtttaatcctctcgttatcgttggcctgagcaaggatggcactgactatatcgaaattattcccaaggaggaagtgcagtcaagtgaagatgactatgctgagatcgactatgtgccctacgacgacccctataagaccgatgtgaggaccaatataaactcttctagggatcccgataacatagcagcgtggtacctccggtctaataacggcaacagacgcaattactatatcgcggctgaggagatcagctgggactattccgaatttgtacagcgggagacagatattgaagactcagacgatatccctgaggacacaacatataagaaagttgtttttcggaagtatctcgatagcacctttaccaagcgcgaccccaggggcgaatatgaagaacatttgggtatccttggtccaattatcagggccgaggtggatgatgttatacaggtgagattcaagaaccttgccagtcggccatatagtctccacgcgcatgggctgagctatgaaaagtctagtgaggggaaaacctacgaggacgactcacccgaatggtttaaagaagataatgctgtccagccaaactctagctacacttatgtgtggcatgcaacagagaggtccgggccagagtctccgggaagcgcttgcagggcctgggcctattatagcgccgtgaatcctgagaaagacatacactctggactgattgggccactcttgatctgtcagaaaggcatcctgcacaaagattcaaacatgcccatggacatgagggagttcgtactgctgttcatgacattcgacgagaagaagtcctggtactatgaaaagaaatcacggagcagctggaggctgactagctctgagatgaagaagagccacgagttccatgccataaacggaatgatttactcacttcccggactgaagatgtacgagcaggaatgggtccgacttcacttgctgaatatcggtggcagccaggatatccacgtggtacacttccatggacaaaccctgttggagaacgggaacaagcagcaccaacttggtgtgtggccattgttgccaggatcctttaagaccctcgaaatgaaggcctccaagcccggatggtggctgctgaatacagaggtgggagagaatcaaagagccggcatgcagactccctttctcattatggaccgggattgccgcatgccaatgggcttgagtacgggtattatatcagactcacaaatcaaggcctctgagtttctcgggtattgggaaccgagactcgcccgactgaataacggaggcagttacaacgcgtggtccgtcgaaaagctggcggccgagttcgcaagcaaaccctggattcaagtcgatatgcagaaggaagtaattatcactgggatccagacgcagggtgctaaacactacctgaagtcatgttataccacagagttctacgtggcctactccagcaatcagataaactggcaaatctttaaaggtaacagtacaaggaacgtgatgtacttcaatggaaactctgacgcgtccactattaaggaaaaccaattcgatccccccattgtggctcgctacataagaatctcccctacccgcgcttacaatagaccaacactccggctggagcttcaaggttgtgaggtgaatgggtgttccacaccgctgggtatggagaatgggaaaatcgagaacaagcagatcactgcatcctcatttaagaagtcatggtggggggattactgggagccattcagagccaggctcaacgctcaaggacgcgtgaacgcatggcaggctaaggcgaacaataacaaacagtggttggagatcgacctgctgaagataaaaaagattaccgcaatcatcacacaggggtgcaagtcattgagtagcgagatgtacgtgaaaagctacacaatacactactcagaacagggcgttgagtggaaaccatataggctgaaatcctctatggttgacaagatcttcgagggaaacaccaacacaaaggggcatgtgaaaaacttttttaatcctcccattatcagccggtttatccgcgtcatccccaagacatggaatcagagcatagccctccgcttggaactgtttgggtgcgacatatat

SEQ ID NO: 9114 - DNA, 6672 bp, Artificial Sequence
  Description of Artificial Sequence: Synthetic coding sequence
atgttccctggatgcccaagattatgggtgttggtggtgttgggaacttcatgggtagggtggggatctcagggaactgaagcggcccagctgaggcagttctacgtggcggctcagggaatatcttggagttatagacccgaacccacaaattcttccctaaatctctcagttacatcttttaaaaaaatagtttatcgcgaatacgaaccatattttaaaaaagaaaaaccacagtctacaatctctggacttctcggacccacactttacgctgaagttggagatataattaaagtacattttaaaaataaagccgataagcctctatctatacatcctcagggaatccggtatagtaaactctctgaaggagcatcatatcttgatcatacattccctgccgaaaaaatggatgatgccgtggctcctggaagggagtatacatatgaatggagtatctcggaagattctggaccaacacacgatgatccaccttgcttaacacatatctattattctcacgaaaatctaattgaagatttcaacagtggactcatagggcctcttctaatttgtaaaaagggaacactaactgaaggagggactcagaaaacttttgataagcagatcgtattgctcttcgccgtgtttgatgaatctaaatcatggtctcagagttcaagtcttatgtatacagtgaatggatatgtgaatggaactatgccagacatcactgtctgcgcgcacgaccatatttcatggcatctgctgggaatgtcatctggacccgaattattttcgattcatttcaatgggcaggtgcttgagcagaaccaccacaaggtctcagcaatcacactcgtgtctgcaacatccactacagcaaatatgacagtagggcccgaaggaaaatggataatctcatccctcacaccaaaacatttacaggcagggatgcaggcatatatcgacatcaagaactgtcccaagaaaacaagaaatcttaaaaaaataactcgcgagcagaggaggcatatgaaacggtgggaatacttcatagcggccgaagaggtgatttgggactatgctccagtgatacctgcaaacatggataaaaagtatcgatctcagcatctggataatttctccaatcagataggaaaacactataaaaaagtcatgtatactcagtacgaggatgagtccttcacaaaacatacagtgaaccccaatatgaaggaagatgggatcctcgggcccatcattagagctcaggtaagagatacattaaaaatcgtctttaaaaatatggcctctcggccttattcgatctatcctcacggagtaacattttctccctacgaagatgaagtgaacagttcctttacatcgggaaggaataacactatgatacgcgccgtacagccaggagaaacatatacatataaatggaacatattagaattcgatgaacccacagaaaatgatgcacagtgcctaactagaccctattactccgatgtggatatcatgcgggatatagcctccggactcatagggctattgctgatatgtaaaagtcgctcactcgatcggcggggaattcagagagcggctgatattgaacagcaggccgtgtttgcagtgttcgacgaaaacaaatcatggtatctggaagacaacattaacaaattctgtgaaaatcccgatgaagtcaaacgcgacgatcctaaattttatgagtctaacatcatgtcaactatcaacgggtatgtgcctgaatccatcactacactgggattttgtttcgacgatacagtgcagtggcacttctgcagtgtcgggacacagaacgaaattttaacaatccactttactgggcattctttcatctatgggaaaaggcacgaagacactctcacattattcccaatgcgaggggaatccgttactgttacaatggataatgttgggacttggatgcttactagtatgaattctagtcctaggtccaaaaaactgcggctgaagtttagggatgtcaaatgtatcccagatgatgatgaagattcttatgaaatctttgaaccccccgagtccactgtgatggcgacaaggaaaatgcatgatagacttgaaccagaagacgaggaatctgatgcagattatgattatcagaaccgcctcgccgccgctcttgggatccgctcctttaggaactccagtctcaaccaggaagaggaggaattcaacctcactgctctagccctagaaaatggaacagaattcgtctcttccaatacagacatcatagtggggtctaattattctagtccctccaatatctctaaattcacagttaataatctcgccgaacctcagaaagccccctcacaccaacaggccacaacagccgggtcacccctgcgccacctcatcgggaaaaattcggttctcaactcctcgactgctgagcattctagtccttattctgaagatccaattgaggatcctctacagcccgatgtgactggaatccgcctcttaagtttgggagccggggaatttaaatctcaagaacacgcaaaacacaaaggacccaaagtggaacgggaccaggcagcaaaacataggttttcctggatgaagcttctcgcgcataaagttggaaggcacctctcccaggatactgggtccccctctggaatgaggccatgggaggatttaccatctcaagatactgggtcaccttctaggatgaggccttggaaggatcccccatctgatctcctgttactaaaacagagtaactcatctaaaatactagttggacggtggcacctggcctccgaaaaaggatcgtatgaaatcatacaggatacagatgaagatactgcggtaaataattggctgatctccccccagaatgcctccagggcttggggagagtctacacctctggctaataaacctgggaaacagtcaggacaccctaaatttcccagggtgagacacaaatctctacaggtaaggcaggatggaggaaagagtagactcaaaaaatcacagttcttaataaaaacaagaaaaaaaaagaaagagaaacatacacatcatgcccccctgagtcctagaacgttccaccctctaaggtcagaagcatataacacattctcagagcgacggctgaaacattctctggtgctacataaatcgaatgaaacatccctcccaacggatctgaatcagacactcccatcaatggacttcggatggatcgcatccttgccagatcataaccagaactcttcaaatgacacgggacaggcaagttgcccacccggactctatcagactgtgccacctgaggagcactatcagactttccctattcaggatcctgatcagatgcactctacatctgatccctctcatcgatcttcctcacccgaactgagtgaaatgctcgagtacgacaggtcccataaatcttttcctacagatatctcacaaatgtctccatcctctgagcacgaagtctggcagacagtaatatcaccagatctgtctcaggtaactctctcccccgagctctcccagactaatctatctcccgatctctctcacactactctatcacccgagctcatacagcggaatctgtcgcctgcgctcggacagatgcccataagtcctgacctttcgcatacaactttatctcccgatctgtcacatacaactctgtctctggatctgtcacagactaacctgagtccagaactgtctcaaacaaatctttcccccgcactggggcagatgcctctttctccagatctgtcccacacaactctgtctctagatttctctcagactaacctatcacccgaactgtctcacatgactctctcgcccgagctgtctcagactaacctttcccccgcactcggacagatgcccatctcccctgacctgtctcatacaactctctctctcgatttctcacagacaaacctctctcctgaactaagtcagacaaacctgtcacccgcattaggacagatgccactctctcccgacccatcccatacaactctctccttagatcttagtcagactaatcttagtccagaactcagtcagacaaacctatctccagatctgtctgaaatgcccctgttcgcagacctatcacagataccacttacacccgatctggatcagatgactctttctcccgacctgggagaaacagatctgtcgcctaactttgggcaaatgtctctcagtccagatctttcccaggtcacactctcacctgatatatccgatacaactctcttgcctgatctctcacaaatcagtccccctccagacctggatcagattttttatccttctgaatcatctcagtctttgctcctgcaggaatttaatgaatccttcccctatcctgatctcgggcagatgccctccccttctagtcccacacttaacgacactttcttatcaaaggagttcaacccactcgtcatcgttgggctgtccaaagacgggactgattatatcgaaattatccctaaagaagaagtgcagtcaagtgaggatgattatgcagagatagattatgtgccttatgatgatccttataaaacagatgtgcgcactaatatcaattcatctagagatcctgataacatcgctgcctggtacttaaggtctaacaacgggaacaggcgaaactattatatcgccgctgaagagatttcctgggattacagtgaattcgttcagcgcgaaacagacatagaagattcagacgatattcccgaagatacaacatataaaaaagtggtgttcagaaaatatctagattctacattcactaaacgcgatccacggggggaatacgaagaacacctcgggattctaggaccaataattcgcgcggaggtagatgatgtgatccaggtgagattcaaaaacttggcctcccggccctattcactacatgctcatgggctcagttatgaaaaatcttccgaagggaaaacttatgaagatgattccccagaatggttcaaagaagataacgctgtgcagccaaactcatcctatacatatgtatggcacgccacagaacgctcagggccagaaagtccaggatctgcctgtcgcgcgtgggcttactactccgccgtaaacccagagaaagatattcacagtggactgatagggcccctgctgatatgccagaaaggaatactgcacaaagactctaacatgcctatggacatgagggaattcgtactcctctttatgacatttgatgagaaaaaatcatggtactatgaaaaaaagagtcgatctagttggcgactgacttcgagtgaaatgaagaaaagtcacgaattccacgcaataaatggaatgatttactccctgcccgggctcaaaatgtatgaacaggaatgggtacggcttcatctactcaacataggggggtctcaggatattcacgtggttcatttccatgggcagactttactcgaaaatggaaacaaacagcatcagctcggagtatggcctctgttaccaggatcttttaaaactctagaaatgaaagcatcgaaacctgggtggtggctcctaaacacagaagtaggggaaaatcagagagccgggatgcagacgccatttctaatcatggatagagattgtcggatgcccatgggactctcaactgggattatctcagactcgcagatcaaagcgagtgaattcctgggatactgggaacctaggctcgcacgactgaataatggaggatcatataatgcttggtcagtggagaaattagccgccgagtttgcctccaaaccatggattcaggtggatatgcagaaagaagtaattataactgggatacagacacagggagccaaacactatcttaaatcgtgctatacaactgaattctacgtggcttattctagtaaccagataaattggcagattttcaaaggaaattctactcggaatgtaatgtacttcaacgggaattctgatgcttctacaattaaggaaaatcagttcgacccccccatcgtggcacgttatatcagaatttctccaacacgagcctacaataggcccacattgcggctcgaactccaagggtgcgaagtgaacggatgttctacaccactcgggatggaaaatgggaaaattgaaaataagcagataactgcttcttcctttaaaaaatcctggtggggggattattgggaaccattccgggcccggctaaatgcccagggaagagttaatgcttggcaggctaaagccaacaataataaacagtggctggaaatagatctcctcaagataaaaaaaatcactgccataatcacacagggatgtaagtcactctcttcagaaatgtacgtaaagtcatacacaatccattattctgaacagggagtggaatggaaaccctaccggcttaaatcatccatggtggataaaatttttgaagggaatacaaacactaaagggcacgtaaaaaactttttcaaccctccaattatcagtcgcttcataagagtgatccctaaaacatggaaccagagtatcgctcttcggctagaactatttggatgtgatatctat

SEQ ID NO: 9115 - DNA, 6672 bp, Artificial Sequence
  Description of Artificial Sequence: Synthetic coding sequence
atgtttccaggatgtcctaggctatgggtgctggtggtgttgggcacctcctgggtgggatggggtagtcaagggacggaagccgctcagctgcggcagttttacgttgccgctcaggggatttcatggtcttaccgtcctgagccaacaaacagcagcctgaatctctctgtcacgagcttcaaaaaaatcgtgtatagggagtacgagccctatttcaagaaggaaaagcctcagtcaaccatcagcggactgttggggcctacactctatgctgaagtcggcgacatcatcaaggtgcacttcaaaaataaggccgataagcctctgtcaattcacccacagggcattcggtattccaaactcagcgagggggcttcctatttggatcacaccttccccgcggaaaaaatggacgacgcggtggctccaggaagagaatatacctacgagtggtcaattagcgaggactctggtccgacacatgacgacccaccttgcctgacacatatctattattctcatgaaaacctgattgaggacttcaatagtggtctgatcggtccccttctcatttgcaagaaaggaactctgaccgagggaggaacccagaagaccttcgataagcaaattgtgctgttatttgccgtttttgacgaatctaagtcctggtcacagtcctcttctctcatgtatactgtgaacggctatgtgaacggcacaatgcctgatattaccgtatgcgcacatgatcatatcagttggcacctgctggggatgtcctccgggcctgagctctttagcatccactttaatggccaggttctcgaacagaaccaccataaagtatccgctattactttagtatccgctacttcgactacagccaatatgactgttggacctgagggaaaatggatcattagcagcctgacccccaagcacttgcaggcaggaatgcaggcctatattgacataaaaaattgtcctaagaagacaagaaaccttaaaaagatcacgagggagcagaggcgccacatgaagcggtgggagtactttattgccgccgaagaagtgatatgggattatgcccctgttattcccgcgaacatggacaaaaaatacagaagccagcaccttgacaatttctccaaccagattggaaaacattacaagaaggtcatgtacacccaatacgaggacgagtcattcacaaaacacactgttaatcctaacatgaaggaagatggtatccttgggcctattatcagggcccaggtcagggacacactaaaaatcgtctttaaaaacatggcttccaggccatactcgatttatccccatggagttacattcagcccatatgaggatgaggtcaatagctcttttaccagtggtaggaataacactatgattcgagccgtgcaacctggagaaacttatacgtataaatggaacatactggagttcgacgaaccaaccgagaatgatgcgcagtgcctcactagaccctactacagtgatgtagatattatgcgggacattgcttcaggtctaatcggactattgctgatttgcaagtccagatctttggatcgacgaggcatacagagagcagcggatattgagcagcaggccgtcttcgctgtatttgacgagaacaagtcatggtatctcgaggacaacattaataagttctgcgaaaaccctgacgaggtaaagcgagatgatcccaagttctatgagagcaatattatgtccaccatcaatggttacgtgccggagtccattacaactcttggcttctgcttcgatgacactgtccaatggcacttttgttcggttggaacacaaaatgaaattctgaccatacatttcaccggtcatagctttatttacggcaaacgtcacgaggatacactgaccctgttccccatgagaggggaatccgttacggttacgatggataacgtcggcacctggatgttaacgtccatgaatagctcccctagatccaaaaaactgcgcctgaagtttcgggacgttaagtgcattccagacgacgatgaagatagttatgagatcttcgagccacctgaatccaccgtgatggccactcgcaagatgcacgacagacttgagcctgaagacgaagagagcgacgcagactatgattatcagaatcgtctggccgccgccctggggatcaggtcgtttaggaattcctcgctgaaccaagaagaggaggagttcaatctaaccgccctagctcttgagaacggaaccgaattcgtctccagtaacaccgatattatcgtcggaagcaattacagctcgcctagcaacatcagcaagttcaccgtgaataatctcgccgaaccgcagaaggctcctagtcatcaacaggcgacaactgccggatcccctctccgtcatctcatcggcaaaaatagcgtgctcaattcgtccactgccgagcacagtagcccctatagcgaggaccccatcgaggatcccctccagccagatgtgaccggaatccgcctactgtccttaggagccggagaattcaaatcccaggagcacgcaaagcacaaaggtccgaaggtggaaagggaccaagctgcgaaacaccgcttttcctggatgaagctgctggcccataaggtggggcgccatttgagccaggacaccggctcccccagtggcatgagaccttgggaagatctgcctagccaggacaccggcagtcccagtagaatgcgcccatggaaagaccctccgtccgatctgctcctactaaagcagtccaactcatcaaaaatccttgtcggccggtggcacctggcatcagaaaaagggtcttatgagattatccaggacacagacgaggacacagcagtgaataattggctgatctctccacagaacgcttcccgcgcctggggcgagtcaacgcctctagccaataaaccgggcaaacagtctgggcacccaaaatttccgcgagtcagacataagagcctacaggtccgccaggacggggggaagtcgcgccttaaaaaatctcaattcctcatcaaaacaagaaaaaaaaagaaggaaaagcatacccatcacgctccactgtcaccccggacctttcaccctctgcggtcggaagcttataacacttttagcgagaggaggcttaaacattccctcgttctgcacaagtctaatgaaactagcttgcccaccgaccttaaccagaccttaccatccatggactttggatggatcgcttcacttccagaccacaatcagaatagttccaacgataccggtcaagcctcatgccctccaggcctttatcagacggttccccccgaagagcattaccagaccttccccatacaggatcccgatcagatgcatagcactagcgatcctagtcacagatccagcagccccgagctttccgagatgctggagtatgatcgttctcataagagctttcccaccgatatttcccagatgtcacccagctctgagcacgaagtctggcagaccgtaatcagtccagacctctctcaagtcactctctcaccggagttgagccagacaaacttgtcccccgacctaagtcacaccacactctcccctgagctaatccagaggaacttgtccccggctctgggccagatgcccattagtcctgatctctcacacacgaccctctcccccgatctgagtcacaccaccctgagtttggacctgagccagacaaatttgagtcctgaactgagccagaccaacctgtcaccagccctagggcagatgccgctcagcccagacctgtctcacacaaccctctcactggatttttcacagaccaatttgagcccggagctgtcacacatgactctgagcccagagctgagccagaccaacctgagcccagctctcgggcagatgcccatatcccctgacctctctcacactactctgtcacttgacttttctcagacaaatctcagtcctgagctgtcacaaaccaatctgtcgccagccctgggacaaatgcctctgtcccctgatcccagccatactacattgtccttggacctaagccagacaaatctgtccccagaattgtcacagaccaacttaagcccagacttgtccgagatgcctctgtttgcagacctgtcccagatccccctgactcccgatctggatcagatgactctgtcaccagacctcggagaaacggacctgtcccccaacttcggacagatgagcctctcacccgacctaagtcaagtaacactgtcgcccgatatctcagatacaaccctgctgcccgatctctcacagatctcccctccaccagacctggaccagattttttatccatcagaatcttcccaaagccttttgctacaggaattcaatgaatccttcccttatccagatcttggccagatgcctagcccctctagtccaacgttaaatgatacatttctctccaaggaatttaatcctctagtcatagtgggactgtctaaggacggtactgactacatcgaaatcatccctaaagaggaggtccagtcaagcgaagatgattatgccgaaatagactacgtgccatacgatgacccgtacaagaccgatgtgagaaccaacattaacagctctcgtgatccggacaacatcgccgcttggtatctcaggtccaacaatggaaataggcgcaattattatatcgccgctgaggagatctcttgggattacagcgagtttgttcagagagagacggatatcgaggactcagacgacattccagaagatacaacctataagaaggtggtatttagaaagtaccttgactctactttcacgaagcgggaccctaggggagagtacgaagagcacctgggcattcttggaccaattattcgcgcagaagtggacgatgtcattcaggtgcgattcaagaatctcgctagcaggccttattccctgcatgcacatggtttgtcctatgagaaatcatcggaggggaagacttacgaggacgactccccagaatggtttaaggaggataatgccgtccaaccaaattcctcatatacctatgtgtggcatgcgactgagcgctcagggcctgaatcccccgggtccgcttgtagagcttgggcctattatagcgcagtgaaccccgaaaaagatatacactctggacttataggacccctgcttatctgccagaagggcatactgcacaaagacagcaacatgcccatggacatgcgggaatttgtcctactattcatgacgtttgacgaaaagaagtcttggtactacgaaaagaaaagccgcagctcgtggcgcttgacatcatctgaaatgaagaaatctcacgagtttcacgccataaatggcatgatctactctctgccaggactgaagatgtacgaacaggagtgggttagacttcatctcctcaacatcgggggctctcaagatatccatgtcgtccatttccacggccagaccctgctcgaaaatgggaataagcagcaccagctaggggtctggccgctacttccaggctccttcaagacgctggagatgaaagctagtaagccaggatggtggttgcttaacaccgaagtgggcgaaaaccagcgggcaggcatgcaaacccctttcctgatcatggatcgcgactgtaggatgcccatggggttgtcaacgggcattataagcgattcacaaattaaggcgagcgagtttctgggctactgggagccgcgcctagccagactgaataatggtgggtcatacaacgcctggtccgtggagaaactcgccgccgaatttgcgtctaaaccatggatccaggtcgacatgcagaaggaagtcatcatcaccggaatccagacccagggggccaagcactatctgaaatcgtgttataccaccgagttctacgttgcgtactcatcgaatcagataaattggcaaatctttaaggggaattccacgagaaacgtgatgtacttcaatggaaactctgatgcctctaccataaaggaaaatcagttcgatcccccaatagttgctagatacatcagaatctcccctaccagggcgtacaatagacctacgctacgactggagcttcaagggtgcgaagtgaacggatgctccacccctctgggcatggaaaatggaaagatagagaataagcagataactgccagtagcttcaaaaagtcctggtggggggactactgggagcctttccgggctcgtctcaacgcccagggtagagtgaatgcctggcaggctaaggccaacaacaacaaacagtggctagagattgacctcctaaaaattaagaagattactgccataatcacccagggctgcaaatcgctgtcctcagaaatgtacgtcaagtcgtacaccatacattattctgaacagggcgtcgaatggaaaccctatcggctgaagagctctatggtagacaagatcttcgagggtaatacaaacactaagggccatgtcaagaattttttcaatcctcctatcataagccggttcatccgcgttataccaaagacatggaatcagtctattgccttgaggctggaactgtttggatgcgatatttac

SEQ ID NO: 9116 - DNA, 6672 bp, Artificial Sequence
  Description of Artificial Sequence: Synthetic coding sequence
atgtttccgggctgtcctagattatgggtactggttgttttgggaacatcatgggtgggctggggctctcagggtacggaagcagctcaattgagacaattttacgtcgccgcgcaggggatctcttggagttatcgaccagagccgacaaacagctctctcaatctgtccgtaacaagcttcaagaaaattgtttatcgcgaatacgagccttatttcaaaaaagaaaaaccacaatcaacaatatcaggcctattagggccaacattatacgcggaagtgggcgacatcatcaaagtacactttaaaaacaaagcggacaagcccttatccatccatcctcaaggcattcgctattctaagctttcggagggagcttcatatctggatcacacattcccggcagaaaaaatggatgacgcggttgcacccggtagagaatatacttacgaatggtcaatttctgaagacagtggcccaacacacgatgatcccccctgcctcacacatatttattattcgcatgaaaatttgattgaggactttaattccggcctcatcggcccgctgttaatctgcaaaaagggcactctgactgagggtggcacccagaagacattcgataaacagatcgtgttgcttttcgctgttttcgatgaatctaaatcttggtctcagtcgagctccttgatgtatacggtgaatggctatgtaaacgggacaatgccagacatcacagtttgtgctcatgatcatatctcctggcatttgttaggcatgagctctggcccagaattgtttagcattcatttcaacggccaagtcctcgaacagaatcatcataaagtaagtgccattacacttgtatctgcaacgtccacaacggcaaacatgacagtaggccctgaaggcaaatggattatctctagccttacgccaaaacatctgcaggcgggcatgcaagcttacatcgacatcaaaaactgcccgaaaaaaacacggaatcttaaaaaaattactcgggagcagcgccgccatatgaaaagatgggaatatttcattgcagctgaagaagtgatctgggattatgcaccggtcattccagcaaatatggataaaaaatatcggagccagcacttagataacttctctaatcaaataggaaaacattataaaaaagtcatgtatactcaatatgaggatgaatcttttactaaacatacagtgaatcccaacatgaaagaagatgggattttaggaccgattattagagcacaggttcgtgatacattaaaaattgttttcaaaaatatggcgtctaggccatattccatctatccgcatggggtaactttcagcccgtatgaagacgaggtcaactcatcctttacatcagggcgaaacaacacgatgatccgtgctgtccaacctggggaaacctatacctataaatggaatattcttgagtttgacgagcctacagaaaatgatgcacagtgccttaccagaccttactattcggacgttgacattatgcgtgacattgcaagtggattgattggactgttacttatctgtaaatctagatctttggatcgtaggggtattcagagagcagccgatatcgagcagcaggcagtgtttgctgtgttcgacgaaaataaatcttggtatttggaagataacattaataaattctgtgaaaacccagatgaagtcaagcgcgatgaccctaaattttatgaaagcaatataatgtccacgattaacggctatgtgcctgaatccattacaacactgggcttttgttttgacgacacagtccaatggcatttctgtagtgtgggaactcagaatgagatcctgactattcatttcaccggacactctttcatttatggaaaacgccatgaggatacactaacactgtttccgatgcgtggtgaatctgtcacggttaccatggataatgttggcacgtggatgctcacgtcaatgaattcatctcctaggtctaaaaaacttagacttaagtttagggatgtaaagtgtatccccgatgacgatgaagattcttatgaaatctttgaaccgccagagtccacagttatggccacacggaaaatgcacgatcgtctggaaccggaagatgaagaaagcgacgcagattacgattatcaaaaccgcttggcggcagctttaggcattagatctttccgcaattcttccttaaaccaagaagaagaggaatttaacctgaccgcactggcactagagaacgggacggaatttgtgtcctctaatacggacattatcgttggttctaattattcgagcccatctaatattagcaagtttaccgttaataacttagctgaacctcagaaggcgccgtctcaccagcaagctacgacagctggttcaccgcttaggcatctgatcggaaaaaatagcgtattgaattcgagcactgccgagcattcttctccgtattctgaggaccctatcgaagatccactgcagccagatgtcacaggcatcagattactgagtctgggcgcaggagaatttaagtcgcaggaacatgccaaacataaaggacctaaggtagagcgcgaccaagccgcaaagcatagattttcttggatgaaactacttgcacataaggttggcagacacttaagccaggatacagggtctccttcgggcatgcgtccatgggaagacttgccgtcacaggataccggaagcccgtcgagaatgcggccatggaaagacccgccatccgacctactgttgcttaaacaatctaattcttccaaaatccttgtcggtagatggcatctggcctccgagaaaggcagctacgaaattatacaggatacggatgaagataccgccgtgaataattggctgatctcaccacaaaatgccagtcgcgcatggggtgaatccacaccgcttgcaaacaagccgggtaaacaaagcggccatcctaagtttccgagggtacgacataaaagtcttcaggttcggcaagatggtggaaaatcacgcctcaaaaaatcccaattcttaattaaaacgagaaagaaaaaaaaagagaagcacacccatcatgcgccgctctctccaagaacgttccacccgttacgtagcgaagcgtacaacacctttagcgaacgccgtttgaaacacagcttagtgttgcataaatcaaacgaaacaagcctaccaacagatctgaatcagacccttccgagtatggattttggttggatagcatcactgccggatcataatcagaattcgtccaatgacaccggacaggcttcatgtccgccgggcttatatcagaccgtgccgccagaagaacattatcaaacgtttccgattcaggacccagatcaaatgcacagcacatctgacccatcacatagatcttcatcaccggagctctcagaaatgcttgagtatgaccgttcccacaagtcctttcccacggacattagtcaaatgagcccgagcagcgagcatgaagtttggcaaacggtcatcagcccggacttgagccaagtaacactgtcacctgaactgagtcaaacaaatttgtctccggatctctctcatacgaccctttcccccgaattaattcaacgtaacttgagcccagcgttgggacagatgcctatttctccagatctctcccatacaaccttgtctccagatcttagccatacaacattatcactcgatctttcccaaacgaatctgagtccggaattatcgcaaacaaacctgagtccggccttagggcagatgcccttatcaccggatctaagccatacgacgttatcgttagatttttctcaaacaaatctttctccggaactgtcccacatgacactgtctccggaattgtctcaaaccaatctgtctcctgccttaggccaaatgcctatctcaccggatctttctcatacaacccttagcttagactttagccagacgaacttatcacctgaactttcacagactaacttatcccctgccttaggccaaatgccgttgtccccggaccctagccatacaacactttctctggacttaagtcaaacgaatcttagtcctgagctctcccaaacaaatctttctcccgaccttagcgaaatgccgctatttgcagatttatcccagatacccctcacgccggaccttgatcaaatgacattgtcacctgatttaggcgaaacagacctttctcctaattttggacagatgtccctgtcgcctgatttatctcaagtcacgctgtctcccgacatcagcgacacgacactgttacctgatttgtcacaaatttcaccgccacccgatttggatcagatcttctatcctagcgaaagcagtcaatcactcctccttcaggaatttaatgaaagctttccatatcccgatctgggtcaaatgccatcgccttcatcccctactttaaacgatacgtttttaagcaaagaatttaaccccttggttattgtaggactgagcaaggatggtacagattatattgaaatcatcccgaaagaggaagtacaatcaagcgaagatgactatgcagaaattgattacgtcccatatgatgatccctataagacggatgtgagaacgaatattaactcatctcgcgatcctgacaatatagctgcatggtacctcagatcaaacaatggcaaccgccgtaactattacattgctgcagaagaaatttcctgggactattctgagttcgtacagcgtgaaactgatattgaagatagtgacgatatcccggaggataccacctacaaaaaagtagtttttcgcaaatatctggacagtacgtttacaaagcgcgaccctagaggagagtatgaagaacatttgggaattcttggaccgattattagagcggaagtagacgacgtaatacaggtgagattcaagaacttggcttcccgcccgtattccttacatgcacatggcctttcgtatgaaaaaagctctgaaggcaaaacatatgaggacgattccccagaatggttcaaagaggataatgcggtacagccaaacagttcttatacgtacgtgtggcatgctacggaacggtctggaccggaatcaccaggcagcgcttgtcgtgcatgggcttattattcagcagtgaacccggaaaaagatattcacagcgggttaataggcccgctcctcatctgtcagaaggggattcttcataaagatagcaacatgccgatggatatgcgggaattcgttttattatttatgaccttcgacgagaaaaaatcttggtattatgaaaaaaaaagtagatcatcgtggcgccttacgtcatccgaaatgaaaaaatcccatgagtttcatgcaatcaatggaatgatctattctctacctggcttaaaaatgtatgaacaggaatgggttcgtttacatcttcttaatatcggcgggtcgcaagatatacatgtcgttcactttcatgggcagacgctgctggagaacggaaataaacagcatcagcttggcgtgtggccgttgcttccggggtcattcaagactcttgaaatgaaagcgtctaagccaggctggtggcttcttaacacagaggtcggtgaaaaccagcgggctggtatgcaaacgccgtttctgataatggaccgagattgcagaatgcctatggggttaagtaccggtatcattagcgacagccaaatcaaagcctctgaatttttaggttactgggagcctcgtctggcccgtctgaataacggtggaagttataacgcctggagcgtcgaaaagctagctgccgaattcgcatcaaaaccgtggatccaggttgatatgcaaaaagaggttatcattaccggcattcaaacacaaggggccaaacattatttgaaatcatgctatactacggaattttatgtcgcttatagctcaaatcaaatcaattggcaaatttttaagggaaactcaacgcgtaatgtgatgtattttaacggaaacagcgatgcttctactattaaggaaaatcaattcgatccgccgatagtggcccggtatattcgcatttctccgacgagagcttacaatagaccgacattacgtctggaattacagggatgtgaggtgaacggctgcagtacgcctcttggtatggaaaacggtaagattgaaaataaacagattacggcaagttcatttaaaaaatcttggtggggagattattgggaaccttttcgcgcacggctcaacgctcaaggaagagtgaatgcgtggcaagctaaagcaaacaataataagcagtggctcgagatcgaccttctcaagattaaaaaaattactgcgattattacacaaggatgtaagtcattgtcatccgaaatgtatgtcaaatcatatacaattcactatagcgaacaaggagtggaatggaaaccatatagattaaagtcaagcatggtcgataaaatcttcgaaggcaacactaataccaaaggacatgttaaaaacttctttaatccgccgattatttcgcgcttcatccgagtaataccaaaaacctggaaccagtccatagctctgagattagaactgtttggctgtgatatttat

SEQ ID NO: 9117 - DNA, 6672 bp, Artificial Sequence
  Description of Artificial Sequence: Synthetic coding sequence
atgttccccggctgcccaaggctgtgggtgctagtggttctaggcacatcttgggtgggctggggcagtcagggcacagaggctgcgcaactgcgccaattttatgtcgccgcgcagggaatatcatggtcctataggccagagcctaccaactcctcattgaacctatccgtcacatcctttaagaagatcgtataccgcgagtatgaaccatactttaagaaggagaaaccgcagagtactatcagtgggttgctgggccctactctgtatgccgaagtgggcgacattattaaggtgcattttaagaataaggcagataaacctctgtccatacacccccaggggattaggtacagtaaactctctgaaggagcctcttacctggaccatacattcccagccgagaagatggacgacgctgtcgctcccggtagagagtatacatatgaatggtctatcagtgaagatagtgggcctacgcacgacgatcccccctgtcttacacatatatattattcccatgagaatctgatagaggacttcaacagcgggctgattggaccgctgctgatctgcaagaaaggcaccttgacagagggcggtacccagaaaacgttcgacaaacagattgtcctgctgtttgcggtgtttgatgagtcgaaaagttggtcgcagtcctcaagccttatgtacaccgtcaatggttacgtcaatgggacaatgcccgacattacggtatgtgcccatgaccacatctcatggcacctcttaggtatgtcctccgggccagagctgtttagtatccacttcaacggacaggtgctcgagcagaaccatcacaaagtctctgctataaccctggtttcagcaacttcgactactgccaacatgacagtgggccccgagggtaagtggatcattagctccctgacaccgaaacatctgcaagctgggatgcaagcctatatagatattaagaattgccccaaaaagactagaaatctcaaaaagattactagggaacagagacggcatatgaagagatgggagtattttatcgctgcagaggaagtcatttgggattatgcaccagtcattcctgccaacatggacaaaaagtataggagccagcatctcgataatttttctaaccagatcggcaaacactataagaaggtcatgtatactcagtatgaggacgagagttttaccaaacacacagtaaatcccaatatgaaggaggacggtatcttaggacctattattcgcgcccaggtgcgcgataccctgaagatcgtattcaaaaatatggcatcccgtccgtactccatttacccgcacggagttacattctcaccatatgaagatgaggtgaactcttcatttacctccggcagaaataacaccatgatccgcgcagtccagcccggtgagacctatacctataagtggaatattttggagtttgatgaacccactgagaacgacgcacagtgcctcactcggccgtactattcagacgttgacataatgagggacatcgccagtggactcatcgggctgctgctgatttgcaaatcacggagtctggacaggaggggcatacagcgggccgcagacattgagcaacaggccgtgtttgcggtctttgacgagaacaaatcgtggtaccttgaagataatatcaacaagttttgcgagaacccggatgaggtcaaacgagacgatccgaaattttatgaaagtaatattatgtctaccataaatggttacgtcccagaatccattacaacactcgggttctgctttgacgatactgtgcagtggcatttttgttccgtgggaacccagaatgaaattctcacgattcattttaccggccattcgttcatctacggaaagcggcacgaggatacactcactctgttcccgatgaggggcgagagcgtcacggttactatggacaacgtcggaacatggatgctgacatctatgaacagcagtcctcgcagcaaaaagctcaggctgaagttccgcgatgttaagtgtatcccggacgatgatgaggactcatatgaaatctttgaaccgcccgagagtactgttatggccacacgaaaaatgcacgaccggttagagccagaggatgaggagtcagacgctgactatgactaccagaatcggctggcagccgcactggggatcagatccttccgcaatagcagcctgaatcaggaagaggaagagtttaaccttacagctttagccttggagaacgggaccgagttcgtatcgtctaatacagacattatcgtgggcagtaactactcttccccaagcaacatctctaaatttaccgtcaacaacctcgcggaacctcagaaagcaccttcacatcagcaagcaactacagctgggagccctctgagacacctgattggtaaaaactctgtccttaacagcagcactgctgagcacagttccccatactccgaggatccgatagaagaccctttgcagccagacgtcacgggtatccggctactgtctctgggggcaggagaatttaagtctcaggagcacgcaaagcataaggggcctaaggttgagagagatcaagcagcaaagcacaggttcagttggatgaagcttctcgcacataaagtggggcggcacctcagccaggatacaggatccccctctggcatgaggccctgggaagatctgcctagccaggacaccgggtcgccgtcacgtatgaggccttggaaagatcctccctctgacctgctgctgttgaagcagtcaaattcaagcaagatactggtaggcaggtggcatctggcctctgagaagggcagctatgaaattatccaggacaccgacgaagacaccgctgtgaataattggctcatctctccgcagaatgcctccagggcttggggagagtctacccccctcgcgaacaagccgggcaaacagtccggtcaccctaagtttccgcgcgttaggcataagtcactgcaggtcagacaggatggaggaaaatcacggctgaaaaagtcacagttcctgatcaaaacccggaagaagaagaaagaaaaacatacgcaccacgccccactcagtccgcgaacgtttcaccccctgaggtccgaggcctacaacactttctctgaaaggcggcttaagcacagtcttgtcctccacaaatcaaatgaaacaagcctcccgacagacctgaatcagacgctaccatccatggactttggctggatcgcgtcccttcctgatcacaatcagaattctagcaatgatactggccaggcctcttgcccacccggcctctaccaaaccgtacccccagaagaacactaccagacattcccaattcaggatcctgatcagatgcattctacttcagatccgtcacatcgatcgtcaagtccagagctctccgaaatgctggaatatgatagatctcacaagtccttcccaaccgacatcagccagatgtcgccaagcagtgagcacgaagtttggcaaactgtcatatcccctgatctgagccaggtcacactctctccagagttgagtcaaaccaacctcagccccgacctctcccataccacattgagccccgaactcatccagaggaatctgtcaccagccctcggccaaatgccaatctctcccgatctctcgcataccaccctaagtcccgacttgagccacacaaccttgagtctagaccttagccagactaacctgtcacccgaactctcacagaccaacctctctcccgcactgggacagatgcccctctcacccgacctttcccatactactctgagcctcgacttttcccagacgaatctctctccagagctgagccacatgacgcttagccctgaactgtcccagacaaatctgtctcccgctctggggcagatgcccatcagccctgatctgagccacacaacactctctctcgacttcagccaaacaaacctcagtcctgagctgagccagaccaaccttagtcccgcactggggcagatgccattaagccccgacccgtcccacacaacattaagcttggatctgagccaaaccaacctcagccctgagctcagtcagactaaccttagccccgacctctcagaaatgcctcttttcgcggacctctctcaaatacctctgaccccagatctggatcagatgaccctgtctccggacctaggtgaaacagacttgtcccccaattttggtcaaatgagtttaagccctgatctctcacaggttaccctgtcacctgacatctctgacactactctattacccgacttgtcccaaattagcccgccgcctgatctggaccaaatcttttatccttctgagagctcacagtctctgcttctccaggagtttaacgaatcattcccctaccccgaccttggccagatgccgtcaccatcctcacccaccctgaatgacaccttcctgtcaaaagaattcaaccccctggtgattgtggggctctctaaagacgggactgattacatcgaaattatccccaaggaggaggtgcagtcgtcagaggatgattatgcggagatcgactatgtcccttatgacgacccttataaaacggatgtccgtacaaacatcaactcttccagggatcctgacaatatcgctgcgtggtacctccggtctaataacggtaacagacgtaattactatattgccgcggaagagatttcttgggattacagcgagttcgtccaaagagagaccgatatcgaggacagtgatgatattcccgaggacaccacatataaaaaagtggtcttccgcaagtacctagactctacatttacaaagcgagaccccagaggggagtatgaagagcaccttggcatattaggcccaataatacgagctgaagtggatgacgtcatccaggtgagattcaagaacctggcatctaggccatattctttgcatgctcatggcttatcttacgaaaagagcagcgagggtaaaacctatgaagacgacagccctgaatggtttaaagaggacaatgccgtgcagcctaactcctcgtatacatacgtctggcacgctaccgagcggtcaggccccgaatcccccgggagtgcatgtcgcgcttgggcttactactccgctgtgaaccctgagaaggatattcatagtgggctgatcgggcctctccttatctgtcagaaaggcatcctccacaaggacagtaatatgcccatggatatgagagaattcgtcctactgtttatgacattcgacgagaagaagtcatggtactacgaaaagaaatctcggtccagctggagactgacttctagtgagatgaagaaaagccacgagtttcatgcaattaacgggatgatttactctctacccggcctaaaaatgtacgagcaggagtgggtgcgcctgcacctgctgaatattgggggctctcaggacattcatgtagtccacttccacgggcagactttgttagagaacggtaacaagcagcatcagctaggtgtctggcctctattgcccggctcatttaagactctcgagatgaaagcttcaaagcctgggtggtggctcctgaacactgaagtcggagagaaccagcgcgccgggatgcaaacgccctttctaataatggacagggactgtcggatgccaatggggctgtccaccggtattatttcggattcccagattaaggctagtgagtttctcggttattgggagcctcggcttgctagactgaacaacgggggcagctataatgcctggagtgtcgagaagctggctgctgaattcgcatccaagccatggattcaggtcgatatgcaaaaggaggtaattataactggaatacagactcagggagccaaacactacttgaaatcatgctacaccacggagttctacgtggcatactctagcaatcagatcaattggcagatctttaaagggaatagcaccaggaacgtgatgtacttcaacggcaactctgatgcgagcaccattaaggaaaatcaattcgatccccccatcgttgccaggtatatcagaatcagcccgacacgggcttataatcggcctaccttaagattggaactacagggctgcgaagtcaatggttgttctacgcccctcggtatggagaacggcaaaatcgagaataagcagatcacagcaagcagtttcaaaaaaagctggtggggtgactattgggaacccttcagagcgcgactgaacgcccagggtcgggtcaacgcatggcaggcaaaagccaataataataaacagtggctggagatagatctactaaaaataaagaaaataactgctattatcacccagggatgtaaatcactcagctccgagatgtacgtgaagtcatataccatacattactctgagcagggagttgagtggaagccgtataggcttaaatcctccatggtggacaaaatatttgagggaaatacgaacacgaagggacatgtgaaaaacttctttaacccgcccatcatctcccggttcatacgggtgattcccaaaacctggaaccagtctattgcccttcgcctagaattgttcggctgtgatatttac

SEQ ID NO: 9118 - DNA, 6672 bp, Artificial Sequence
  Description of Artificial Sequence: Synthetic coding sequence
atgtttccaggctgccctcggctctgggtgcttgtcgtgttaggtacctcgtgggttgggtggggatcccaaggcaccgaggccgcgcagctccggcagttttacgtggcggcacaaggaatttcctggagctaccgaccagagccgacaaacagtagcctgaatctatcagtaacatcttttaaaaaaattgtttaccgcgaatatgagccatattttaaaaaggaaaagcctcagagtaccatcagtgggctcctcggaccaactctttacgccgaggtcggcgatataataaaagtgcacttcaaaaacaaagcagacaagcccctgagtatccaccctcagggcatccgctattccaagctgtctgaaggagcctcataccttgaccacacatttcccgcagagaagatggacgatgcagttgcgcccgggagagagtacacctatgagtggagcatttctgaggactccgggcctactcatgacgaccccccctgtctcacacacatttattacagtcacgagaacctaattgaggacttcaacagtgggctgattggaccccttctgatttgcaagaaggggacactgacagagggaggaacacagaaaaccttcgataaacagattgtgctgctgtttgcagtgttcgatgagtccaagagttggagtcagtcatcaagtctgatgtacacagttaacgggtatgtaaacggcacaatgccagatattaccgtgtgtgcgcatgatcatattagttggcatctgcttggcatgtcgagtgggccagagctgttctctatccacttcaacgggcaggttcttgagcagaatcaccataaggttagcgctatcactcttgtctctgctaccagcacgactgccaacatgacagtgggccccgagggcaaatggattatcagcagtctcacccccaagcacctgcaggccggaatgcaagcctacattgacataaagaactgtcctaagaagactcgcaatctcaagaaaatcactcgggaacagcgccgccacatgaaaaggtgggaatatttcatagctgccgaggaagtgatttgggactatgcccccgtaattcccgcgaacatggacaaaaagtacaggtcacagcacttagataactttagtaaccagatcggtaagcactataaaaaggtgatgtacacacagtatgaggatgaatctttcaccaaacataccgtgaacccaaacatgaaggaagatggaattctcgggccgattataagggcccaggttcgggacaccctgaagattgtgttcaaaaatatggctagtcgcccatatagcatttaccctcacggggtgacattttcaccgtacgaggatgaagtaaactcaagtttcaccagcggcagaaacaacaccatgattcgggccgtccaacccggcgaaacctacacgtataagtggaatatccttgagtttgacgaaccaaccgagaatgacgcacagtgtttgacccgaccatattacagcgatgtggatattatgcgcgacatcgccagcggcttaattggccttttgttgatttgtaaatccagaagtctggatagacgtgggatacagagagccgccgatatagagcagcaagccgtgtttgccgtttttgatgagaataagtcctggtacctggaggacaacataaataagttttgtgagaacccagatgaggtaaaaagggacgatccaaaattctacgagtcaaatataatgtctactatcaatgggtacgtaccagagagcatcaccactcttggcttttgttttgatgacactgtgcaatggcacttctgctccgttggaactcaaaatgagatactcaccattcacttcaccggacactccttcatctacggcaagcggcacgaagatactctaactctgtttcctatgagaggagagagtgtcaccgtcacgatggataacgttgggacctggatgttgacttctatgaattccagtcctaggtcgaagaagttacggttgaagtttcgggatgtgaagtgtatccccgatgatgatgaggacagttatgaaattttcgagccccctgaaagcacagtgatggccactaggaagatgcacgatagactagagccagaggacgaagaaagcgatgcagactacgactatcaaaaccgactcgctgccgccttaggtatccgcagcttcaggaacagttcactcaatcaggaggaggaagagtttaacctcaccgccctcgcccttgagaatggaaccgagtttgtgtcctccaacacagatatcattgtcggcagcaattatagctctcccagtaacatcagcaagtttaccgttaataatttggcagagccacagaaagccccttcacatcaacaagctaccacagccggttctcctctcaggcatctcattggtaaaaacagcgtgttaaactcttctaccgccgagcacagctccccatattctgaggatccaatcgaagacccattacagccagatgtaacaggcatacggctgctgtcattgggcgcaggggaattcaagagccaagaacacgctaagcacaaggggcctaaagtcgagagagatcaggcagccaagcatagattcagctggatgaagctgttggctcataaagtgggcaggcacttatcccaggacacgggcagtccttctggaatgcgcccatgggaagaccttccttcccaggatactggctctccgtcccgaatgcgcccatggaaagatcctcccagcgatttgcttctgctgaaacaatccaattcgtccaagattctggttggacgctggcatctggcttccgagaaaggaagttatgagataatacaggatacagacgaagacacagcggtaaacaactggcttatcagcccgcagaatgcctctcgcgcgtggggcgagtcaacacctctggcgaataagcccggaaaacaatctggtcatccaaagtttcccagggtgagacataaaagtctgcaggtgcggcaagacggaggaaagagccgtctgaaaaaatcgcagtttttaatcaaaactaggaaaaaaaaaaaggagaaacatacgcatcatgcacctctttcccctaggaccttccatccgcttaggtctgaggcctataacacattttccgagagacggctgaagcactccttagtcctacacaagtcgaacgagacgtccctgccaacggatcttaaccagacgctccctagtatggacttcggatggatcgcgtctctgcccgaccacaatcaaaattcctcaaatgatacaggccaggcttcctgccctccgggtctttatcagaccgtaccccccgaagaacattatcagactttccccatccaggatcccgaccagatgcactcaacttcagatccctcacacaggtcatcgagcccggagctctctgagatgttagagtatgataggagtcacaagagttttcccaccgacatctctcaaatgtctccttccagtgaacatgaggtttggcagaccgtcattagccctgacttaagccaggtgaccctctcaccggagctcagccagacaaacctgtctcccgacctctcgcacacaacactatcacctgagctgatacaacggaacctgtcaccagctctgggccaaatgcccatcagtcccgacctctcacataccacactctcccctgacttaagccacaccacattgtctttggacctctctcaaactaatttgagtcctgaactctctcagacgaatctttccccggctttaggccagatgcccttatcaccagacctgtcccacacaacactcagtctggacttttctcagacaaatctgtccccggagttgtcccatatgactctgtctcccgaactaagccagacaaatctgtcgcctgccttgggacagatgcccatatcaccagatctatctcacactacactatcattggacttctctcagaccaacctgtcccccgagctttctcagacgaacctgagtccagcgctgggacagatgcctctgtcaccagacccatcacacacaacgttgagccttgacttgtcacagaccaatctgtctcccgaactaagtcaaactaatctctcacccgacttgtctgagatgcctctatttgcagacctgtctcagattcctctcacaccagatctggaccaaatgacattgtcacctgatttaggagaaacggaccttagcccaaactttgggcagatgtccttatccccggacctcagccaggtcaccttgtccccagacatatctgacaccacgctgttgccagacctgagtcaaatcagtccccctcccgacttagatcagatcttttaccccagtgaaagctcacagagcctgctcctccaggagtttaatgagagtttcccctacccagatctcggacagatgccatcccccagctcacctacacttaacgacacatttctgtccaaggagttcaatcctcttgtgatagtggggctatcaaaggatggcactgattacattgaaatcattcctaaggaagaggttcagagttcagaggacgactatgctgagattgactacgtgccctatgacgatccttacaaaacagacgtccgcacgaacattaactccagcagagacccagacaacatcgcagcctggtaccttagatccaacaatgggaaccgtaggaactactatattgcagccgaggaaattagctgggactattccgagtttgttcagagggagacagatatagaagattccgacgatattccagaggacacaacctacaaaaaggtggtcttccgtaagtacctcgactctacctttacaaaacgtgacccacggggtgagtacgaagaacacctgggaatcctgggcccaatcattcgcgcagaagtggacgacgtcatacaagttagattcaagaatttggcctcaaggccttattcgctgcatgctcatggactttcctatgagaagagcagcgaggggaaaacatatgaagacgattcacccgagtggtttaaggaggacaacgccgttcagcctaattccagttatacatatgtgtggcacgccaccgaacggagcggaccggagtcccccggctccgcatgccgagcgtgggcatattattcggcagtcaaccccgagaaggacatacattccgggctcattggcccacttctgatctgccaaaagggcatattacataaggactctaatatgcccatggacatgagagagttcgtcctactgtttatgacttttgacgagaagaagtcttggtattacgaaaagaaaagtagaagctcctggcgcttgacatcgtccgagatgaaaaagtctcatgaatttcacgcgatcaacggcatgatctactctctgccggggctgaaaatgtatgagcaggagtgggtccgccttcacctgctgaatataggcgggtcccaagatatacacgtcgttcatttccatggacagaccctgctggaaaacgggaataagcaacaccagctcggggtttggccgttgttgcctggctccttcaagactctggaaatgaaggcaagcaagcccggctggtggctcctgaacactgaagtgggcgaaaatcaacgcgcagggatgcagacaccatttctcatcatggacagggattgtcgaatgcctatggggctgagcactggcattatctctgattcccaaatcaaagcctccgagttccttgggtactgggaaccacgcctggccaggcttaacaacgggggatcctacaacgcatggtctgtggagaagctggccgccgagttcgcctctaaaccgtggatacaagtggatatgcagaaagaggtgattatcacagggatccagactcaaggtgccaagcattacctgaaaagctgctatacaaccgagttctatgtcgcctattcgagcaaccagatcaactggcagatatttaaaggtaattccactaggaacgtgatgtacttcaacggtaactctgacgcttctacaataaaagaaaaccagtttgatcctcctattgttgcccggtacatccggatctcccccaccagggcctacaatcggccgactctgcggctcgagctgcagggatgcgaagtgaacggatgctccacacctttaggcatggagaacggaaagattgagaacaagcaaatcactgctagcagtttcaagaaatcgtggtggggggactattgggagccttttcgcgcccggctcaacgcccagggaagagtgaatgcatggcaggcaaaggcaaacaataacaagcagtggctggagatcgacctcttgaagataaagaagattactgcgataattactcagggctgtaaatctctctctagtgaaatgtatgttaaaagctatacaatccactacagtgaacagggtgtggagtggaaaccctaccgattgaagagctctatggttgacaaaatttttgagggcaacaccaacactaaaggacatgtgaaaaattttttcaacccccccatcatcagtaggtttattagggtaatccccaagacctggaatcaatctatagcacttcgactggaactctttggctgcgacatctac

SEQ ID NO: 9119 - DNA, 6672 bp, Artificial Sequence
  Description of Artificial Sequence: Synthetic coding sequence
atgtttccagggtgtccccgcctgtgggtccttgtcgttttagggacttcctgggtcggttggggctctcaggggaccgaagctgcccagcttagacagttctatgtcgccgctcagggcatctcttggagctaccgcccagagccaacaaatagctcactgaatctgtcagtaacaagtttcaaaaagatcgtttacagagagtatgaaccttactttaaaaaggagaaaccacagtccactatctcagggctgctaggccctaccctgtacgccgaggtgggagatatcattaaggtgcattttaagaataaagccgacaaacctcttagtatccatccacaaggaattagatatagtaagctaagtgaaggcgctagctacctggatcatacctttccggctgaaaaaatggacgacgccgtggcaccaggaagagagtacacatatgagtggagcatcagtgaggacagcggacccactcatgacgacccgccatgcctaacacacatttactattcacacgagaatctgatcgaggacttcaacagtggactgatagggccactcttgatctgcaagaaggggaccttaaccgagggcggcacgcagaagacgtttgacaagcagattgtgcttctgttcgcagtctttgacgagtcgaagagttggtcacagagtagtagtctgatgtatacagtgaacggctatgtgaatggcactatgcctgatatcacagtttgcgctcacgaccatatcagttggcacctactcggtatgagctcaggacctgagttgttcagtattcacttcaacggacaggtcctagagcaaaaccaccacaaggtgagtgcaatcaccctcgtgtccgcaaccagtacaaccgctaacatgacggtagggcccgaaggtaaatggattatcagtagcctgactcccaagcacctccaagccggtatgcaggcctacatagatatcaagaattgtcccaagaaaacccggaacctcaagaagatcacccgggaacagcggcgacacatgaagagatgggagtatttcatcgccgccgaggaggtcatttgggattatgccccagtaatccccgctaacatggacaaaaaatacagatctcagcatctggacaacttttctaaccagatcggcaagcactataagaaggttatgtacacccagtatgaagatgagagtttcaccaagcacacagtcaaccctaacatgaaggaggatggcattctggggcccatcatacgggcacaggtgcgggacaccctgaaaattgtcttcaaaaacatggccagtcgcccgtatagtatttacccacacggggtaactttcagcccatacgaagacgaggtgaacagctctttcacttcaggccgtaacaacacgatgatccgtgctgtgcagcccggcgagacttacacatacaagtggaatattctggagttcgatgaacccaccgaaaacgacgcgcagtgcttgactaggccctattattcggatgtggatatcatgagagatatcgcttcagggctcatcggcttgctcctcatatgtaagtcccgctcgctagatcggcgagggatacagcgggcagccgatatcgaacagcaggctgtgtttgctgtattcgatgaaaataagtcttggtatcttgaagataacattaacaaattttgtgagaaccccgatgaggtcaagcgggacgacccaaaattttacgagtctaatatcatgagcacgattaatgggtacgtgccggagtctatcacgactcttgggttctgttttgacgacacagtccaatggcacttttgtagtgtggggacccagaatgaaatcctgaccatccattttaccggacattccttcatctacgggaaacgccacgaggacacccttaccttgttcccaatgcggggcgagtccgtaaccgtgacgatggataatgtcggcacctggatgttgacaagcatgaactcatctcctagatccaaaaagctgagactaaagttcagagacgtgaaatgtatccctgacgatgatgaagactcttacgagatctttgaaccacccgaatctactgtgatggctactcggaagatgcacgataggttggaaccggaggatgaggaatccgacgccgactatgactaccaaaatagactggccgctgccctgggcataagatccttcaggaactcatctctgaatcaggaagaagaagagtttaatctgaccgcactggctctcgagaacggcaccgagttcgtttcttcgaatacagacattattgttggctctaactactcatccccttcaaatatcagcaagtttactgtgaataatctcgccgagcctcagaaggcgcctagccatcagcaggcgactaccgccggatctccactccgtcacctcatcggtaagaacagcgtcctcaacagctctaccgccgagcacagctccccttacagcgaagaccctatcgaagatccattgcagcccgatgtgactgggattcggctactgtctcttggcgccggcgagtttaaatctcaggagcacgccaaacacaaaggccctaaggtggagcgggatcaggccgccaagcataggttttcctggatgaagctcttagcccataaggtggggcggcacttatcccaggacaccgggtccccgtcggggatgcggccttgggaggacctcccatcacaggacacaggcagtccttcacggatgcgaccttggaaagatcccccctcagatttgctgctgttgaaacagtctaattcctcaaagatccttgttggacgttggcacctcgcaagcgaaaagggttcatatgagattatacaggacacggatgaggacacagctgtcaataattggctgatatccccccagaacgcatctagagcatggggggaatcaacaccgctggccaataagccgggcaagcagtcaggccatccaaaatttcccagggtgcgacataaatctctgcaagtcagacaggacggagggaaatccagactgaagaaatcccagtttctgattaagactaggaaaaagaagaaagagaagcacacccatcacgcgccactgagtccacgaaccttccatcccctccgctcagaggcttataataccttttccgagaggcgactgaagcacagccttgttctgcacaaaagcaacgaaacatcactgcctaccgacctgaatcaaacgctccctagcatggattttggttggatcgccagtttgccggatcataaccagaacagcagcaatgatacgggccaggcatcatgcccccctggattgtatcagaccgtgccccctgaggagcactaccagacctttcccatccaggaccccgaccagatgcattcaacttccgatccttcacacagaagttccagcccggagttgagcgaaatgcttgagtacgacagatctcataaaagctttcctactgacattagccagatgtctccctcgtccgaacatgaggtttggcagactgtaatcagtcctgacctttcccaggtaaccttgtctcctgaactgtcccagacgaacctgtccccagacctgtcacataccacattgagcccagagctgattcagcgaaatctgtcgccggctctagggcagatgccaatttcgccagatctgagtcataccacattatcccccgatcttagccacaccaccctaagcctcgatctctcccagactaacctatcccccgagctcagtcagaccaacttatcgcctgcacttgggcagatgcctctgagccctgatctcagccacaccactctgtcactcgacttctctcaaaccaatctgagtcctgagctgtctcatatgaccttatcccctgagctgtcccaaacaaatctgtctcctgccctggggcaaatgccgatatcacctgacttgagccacaccactctgagtcttgacttttcccagactaatctgtctcccgagctctcccaaaccaatctctcccccgctctcgggcagatgccactcagccctgatccctctcatactaccttgagtctggatctctcccagacaaatttgagcccagagctatcgcagaccaacctctcacctgacctgtcagaaatgcccttgtttgcggacctcagccagatccccttaacacccgacctcgatcagatgacactttcccccgatctgggagaaaccgacctgtctcccaactttggccagatgagcctgtcccccgatctctcgcaagtaaccctctcacccgacatatctgatactaccctcctgccagatttatctcagatttcacccccacccgacctggatcagattttttacccctctgagtcatcccagtctttgctgctacaggaattcaatgagtcctttccgtacccagacttggggcagatgccaagtccttctagcccgacactgaatgataccttcctgtcgaaagaattcaaccctctcgttatagtaggtttgtctaaagacggcacagactacatcgagattatcccaaaggaagaggtccaatcttctgaggacgattatgcagagatcgactatgtcccttacgacgacccctacaagaccgatgtgagaacaaacattaactctagtcgtgaccctgacaacattgctgcatggtacctcaggtccaacaatgggaatcggagaaattactatattgcggcagaagagatctcctgggactatagtgagttcgtgcagcgggaaacagacatcgaagactccgacgacatccccgaagacactacatacaagaaagtcgtgttcagaaagtatctggatagtactttcactaagagggaccctaggggagagtacgaggaacacctcggaatcctgggcccaatcatccgggctgaggtggatgatgtgatccaagttcggttcaagaacctcgcatcccgaccgtactcacttcatgctcacggtttgtcatatgaaaaatccagtgaaggaaaaacctatgaagacgacagcccagagtggtttaaggaagataacgccgtgcagcccaattccagctatacctacgtctggcacgcgactgagcgaagtggccctgagtcaccgggatccgcctgccgtgcatgggcatactactcagcagtgaatcccgaaaaggacattcactcgggcttgataggacctctccttatctgtcagaaagggatcctgcataaggattctaatatgcctatggatatgcgagaatttgttctgctgtttatgacatttgatgaaaagaagagttggtactatgagaaaaaaagcagatcttcctggaggctcacctcaagcgagatgaagaaatctcatgagttccatgcaattaatggtatgatctacagtcttcctggcttgaagatgtacgaacaggagtgggtgagactccatctgctgaacatcggtggatcccaggatatccacgtagtgcacttccacgggcagacccttctggagaatggcaataaacagcaccagctgggcgtgtggccccttttaccgggcagttttaagactcttgagatgaaggcaagcaaaccgggctggtggctgctgaacaccgaggttggagaaaatcagcgagcaggaatgcaaacaccatttctgattatggatcgcgactgccggatgccgatggggctctccacagggataatcagcgactcacagattaaagccagcgaatttctgggctattgggagcctaggctggcccggttgaacaatggcggaagttataatgcttggtcagtggagaagctcgcagccgagtttgcctcaaaaccatggatccaggtcgatatgcaaaaagaggtgataatcactggcatccagacccaaggtgccaaacactacctcaagagctgttatacaaccgagttttacgttgcatattctagcaatcagatcaattggcagatctttaagggaaactctaccagaaacgtgatgtacttcaacggcaattccgacgccagtacgatcaaggagaaccagttcgacccccctatcgtggcccgctatatcaggatctcacctactcgagcgtataaccgtcctaccctgaggctcgagctgcaggggtgtgaggtcaatgggtgcagtacccctttaggcatggagaacggcaagattgagaacaaacagatcactgccagtagcttcaaaaagtcctggtggggagattattgggagcccttccgggcacgactgaatgcacaggggcgggtaaacgcctggcaggccaaagccaacaataataagcaatggctggagattgacttactgaagataaagaaaattacggcgattatcacccaaggatgcaagagcctgtcaagcgagatgtatgtgaagtcctacacaattcattatagcgagcagggcgtcgagtggaaaccctatcgtctcaagagctcgatggtagataagatattcgagggcaacacgaacactaagggccacgtgaagaatttctttaacccaccaatcataagtagattcataagggtcattcctaagacttggaaccagtcgatcgcattgcgcctcgaattgtttggctgtgacatctac

SEQ ID NO: 9120 - DNA, 6672 bp, Artificial Sequence
  Description of Artificial Sequence: Synthetic coding sequence
atgttcccaggttgtccacggttgtgggtgttggtcgttcttggcacatcctgggtagggtggggtagccaggggacagaggctgctcagcttagacagttctatgtcgccgctcagggcatctcttggagttaccgcccagagccaaccaattcttctctgaatctgtcagtgacgtcttttaagaagattgtctacagggaatacgagccctattttaagaaggagaagccacaaagcacaatcagtgggctccttgggcccactctttacgcagaagttggcgatatcatcaaagtgcactttaagaataaggcagacaagccattaagcatacatccgcagggcattcggtactccaaactgtctgagggagcaagttacctagatcacacctttcctgctgaaaaaatggacgatgccgttgctcccggacgggagtatacctacgagtggagcatttcagaagattcagggccaacccatgacgaccccccttgccttacccatatatactacagccatgagaatcttatcgaggattttaatagcgggctgatcggacctctgctgatatgtaagaaaggcaccctgacagaaggcggaacccagaaaacttttgataaacagatcgtgctgttgtttgccgttttcgacgagtccaaatcttggtcccagagctcatctttaatgtatacggtgaatggatacgtcaacggtactatgcccgatattaccgtttgcgcgcatgaccacatttcatggcacttgctgggaatgagcagtgggcccgagctattttctatccacttcaacggccaggttctggaacagaaccaccacaaggtcagcgcgatcacactggtctctgccacgagcactactgctaacatgactgtcggccccgaagggaaatggatcattagcagtctgacacctaaacacctgcaggcaggaatgcaggcttatatcgacattaagaattgccctaagaagactagaaatctcaagaagattactcgtgagcagaggagacatatgaaaaggtgggaatactttattgcagccgaagaggtgatctgggactacgcgcctgtgattcccgccaacatggataagaagtatcggtcacagcacctagataacttttccaaccaaatcggaaaacattataagaaggttatgtacacccagtatgaggacgaatcattcactaagcacaccgtcaatccaaacatgaaagaggatggaatacttggaccgatcattcgcgcccaggtccgtgatactctgaaaatcgtttttaaaaatatggcgtcacggccttacagcatctacccccacggcgtgacattttccccctatgaggacgaggtgaatagctccttcaccagcggtcgcaacaacaccatgatccgggcggtgcagcctggcgagacatatacatataagtggaatatactggagtttgatgagcctaccgagaacgatgcccaatgccttactcggccttactactctgacgtggacatcatgcgcgacatagcctcgggcttaattggcctgttgctcatatgtaagagccgctctctggatcgccgcggtatccagcgggcggccgacatcgagcagcaggctgtttttgctgtctttgatgagaacaagtcatggtacctcgaagacaacattaacaagttctgtgagaaccccgacgaagtcaagagggatgatccaaagttttacgagtctaacatcatgtcaacaattaacggctatgtgcctgaatccataacaacgctgggtttctgtttcgacgatactgtgcagtggcacttttgcagcgttgggactcagaacgagattctgacaattcatttcaccgggcacagcttcatttatggtaaacgccatgaggatactctaactcttttcccaatgcgaggagagagtgtaacagtgactatggataacgtggggacctggatgctcacttctatgaacagtagtccccgaagcaagaaactgcggttgaagttccgggacgtgaagtgtatccctgacgacgatgaagatagctacgagatattcgaaccacctgagtcgaccgtgatggctaccagaaagatgcatgaccggctggagcccgaagacgaggaatccgatgctgattatgactatcagaaccggcttgcggccgcactgggtatccgcagtttcagaaactcttcacttaaccaggaagaagaggagttcaacctgacggctttggccctagagaacggcacagagttcgtatctagcaatacggacataatcgttggatccaactactcatcaccctccaacattagcaagtttactgtcaataacttggcagaaccacaaaaagccccctctcaccagcaggccactacagccgggtccccgctccgtcatctcatcggcaagaactctgtgctgaactccagcaccgccgagcacagcagtccttattcagaggatcccatcgaggacccactccaacctgatgtcacagggattaggttactgagcctaggcgctggggagttcaagtcgcaagagcacgccaaacacaagggccctaaagtggagcgagaccaggcggctaaacatcggtttagttggatgaaacttttagcccataaagttggcagacaccttagccaggatacagggtctccttctggcatgcgtccatgggaagacttgccatcccaggacacggggtccccatcgcggatgaggccatggaaggaccccccctcggatctcctgctgctcaagcagtctaactccagcaagattttggtgggcaggtggcatctggcctccgaaaagggttcatacgagatcatacaggacactgatgaggatacggccgtgaataactggctcatttcaccacaaaatgcaagcagggcatggggcgagagtacaccactcgcaaacaaacctggtaagcagagcggccatcccaagttccccagggtgcggcacaagtccctccaggttaggcaggacggaggaaagagtcgacttaaaaagtcccagttcttgataaagactcgtaaaaagaaaaaggaaaaacacacccatcatgcacccctgtctcctaggaccttccaccccctgagatcagaagcctataataccttttccgagagacggttgaagcatagccttgtcctgcacaagtcaaacgaaacatctcttcccacagatctaaaccagaccctgccaagtatggattttggatggatcgcttctctacccgatcataaccaaaactcctcgaatgatacgggtcaggcttcctgtcctccaggactgtatcagacggtcccaccagaggagcattaccaaacctttccaatacaggacccagaccagatgcacagcaccagcgacccttcacatcgtagcagttcaccggagctttcggaaatgctcgaatatgatcggtctcacaagtcattcccaactgacatctctcagatgtccccctcttcagagcacgaggtgtggcagaccgtgatctcaccagacctgtcccaggttacgctgagtccagagctgtcgcagactaatctatcaccagacctttctcataccactttgagccccgagctcatccagaggaacttatcaccagctttgggccagatgcctatcagtcctgacctttcgcacacaactctgtcaccagatctctctcacactactctgagccttgacctttcccagaccaatttaagccctgagttgtcccagaccaacctgagtcctgcgcttggtcaaatgccactgagccctgatttgagccatacaactctgtcactggacttctcacagaccaacctcagccctgaactctcacatatgaccttgagcccagagttgtcccaaacaaacctctcacccgccctcggccagatgccaatctcccctgatctgtcacacaccactctgtcactagactttagtcaaacaaatctttcacctgagctatcccagaccaatctgtccccagcactggggcaaatgcctttatcgcccgatccttcccatacaaccttgtcccttgatctgagccagaccaatctgtctccagagttatcacagactaatttgagtccagacctatccgagatgcccctattcgcggatttgtcccagatcccccttactcccgatttggatcagatgactctgagtcctgacctgggcgagaccgatctgtctcccaacttcgggcagatgtctctgtcaccggaccttagtcaggttactctgagccccgatatctcagatacaacactattgcccgacctaagccagatcagcccccccccagacttggatcaaatcttttacccatctgagtcctcccagagcctcttgctccaggaatttaatgagagctttccgtatcctgatttaggccagatgccttcgccctcaagcccgaccctgaacgacactttcctgagcaaggagttcaatcccctcgtgattgtgggactttcgaaggacggcacagattacattgaaatcattcccaaggaagaagtacagtcatctgaagatgactacgcagaaattgactacgtgccatacgacgacccgtataaaacagatgtgcgcaccaatatcaacagtagtcgtgatcctgacaatattgccgcctggtacctgagaagcaataacggtaaccgccgcaattactacatcgcggctgaagaaatctcttgggattattcggagtttgtgcagagagagactgacattgaggatagtgatgacattcccgaagacacaacctataagaaagtagtgtttcgaaaatacctagattcgaccttcacgaaacgagaccctagaggcgagtacgaggagcatttgggaatcctcggccctatcatcagggctgaggtggatgacgtaatccaggtacggtttaaaaacctggccagccggccgtacagcctgcacgcccacggactgtcctatgaaaagagttccgaaggaaaaacttacgaggacgacagtccagagtggttcaaagaagacaacgctgttcagcctaactcctcttatacctacgtttggcacgctacagagcggtccggccccgagtctccagggtcagcctgtcgggcctgggcatattactctgccgtaaatccagaaaaagacatacatagcggcctgatcggcccactgttgatctgtcagaagggcatcctccataaagattccaatatgcctatggacatgcgcgagtttgtgctcctgttcatgacctttgacgaaaaaaagtcttggtattatgagaaaaaatctcggtcctcatggagacttacctcaagcgagatgaagaagagccatgaattccatgccattaacgggatgatctatagccttcctggtctgaagatgtatgagcaagaatgggtccggctgcacctgcttaatatcggtgggagccaagacattcacgtggtccatttccacggacagactctcctggagaacggcaacaagcagcatcagttgggggtctggccgttgttaccggggtcttttaagactctagaaatgaaggcctcgaagcctggctggtggctgctgaacactgaggtgggtgagaaccaacgcgccggcatgcaaacgcctttcctgatcatggatcgcgactgccggatgcctatgggcctctcgacaggaattatcagtgattcacaaatcaaggccagtgagtttttggggtattgggagccccgtctggcccggttgaacaacggcgggagctacaatgcatggtctgttgaaaaactggccgccgagttcgccagcaagccatggatccaagtggatatgcagaaagaagtgattattacaggaattcaaacccagggcgcaaagcactaccttaagtcctgttacacaacagagttctacgtcgcctactcatccaaccagataaactggcagatcttcaagggtaactctacgcgtaatgtaatgtattttaatgggaatagtgacgctagcaccatcaaagagaatcagtttgatccaccaattgttgcccgatacatacgcatcagcccaaccagggcatacaatagacccacactgaggttagaacttcagggctgtgaggtgaacggctgctcaactcctcttgggatggaaaacgggaagatcgagaacaagcagattacagcgagcagctttaaaaagtcatggtggggagattactgggaaccattcagagcgcggctcaatgcccagggaagggtaaacgcatggcaagcaaaagctaataacaataagcagtggctcgagatcgacctgttgaagattaagaagatcacggctatcataacacagggttgtaaatcactcagcagtgaaatgtacgttaaatcatacacgatccactattccgaacagggagtggaatggaagccttaccgccttaagagtagcatggtagataagatcttcgagggcaatacgaacaccaaaggccatgtgaaaaacttttttaaccccccaatcatatcacggttcatcagagtgattcctaaaacatggaaccaatccattgccctccggttggagttattcggctgcgatatctac

SEQ ID NO: 9121 - DNA, 6672 bp, Artificial Sequence
  Description of Artificial Sequence: Synthetic coding sequence
atgtttcctggatgtcctcgcctgtgggttcttgtcgtactaggcacttcatgggtgggttggggatctcagggtacagaagccgctcagctgcggcagttttacgtggccgcacaaggaataagctggtcctaccggcctgaaccgacaaacagctctttgaacctgagcgtgacctcattcaagaagattgtgtatcgtgaatacgaaccctacttcaagaaggagaagcctcagtccacaatttccggcctgctaggcccaactctttatgccgaagtgggcgacataattaaggtccattttaagaacaaagccgataaacctttgtcgattcatcctcaggggattagatatagtaaactatctgagggcgcttcttatctcgatcatacatttcccgctgaaaagatggacgacgccgtcgcccccggcagagagtatacttacgaatggagtatcagcgaggattctgggccaacacacgacgatccgccatgtctgactcatatttattatagtcatgagaatctgatagaagactttaatagcggccttattggacctttgttaatctgtaagaagggcacactgaccgagggcggaacgcagaaaacctttgataaacagattgtgttgctgtttgccgtctttgacgagagtaaatcctggtcccagtcaagcagcttaatgtacaccgtcaacggctatgtgaatgggacgatgcccgacatcaccgtgtgcgcccatgatcatatctcgtggcacttattgggcatgtcctccggacctgaactgttttcaatccactttaatgggcaggtgctagagcagaatcatcacaaggtatcagccatcacgttggtgtcggccacctctaccactgctaacatgacagtgggccccgaggggaagtggataatatccagcttaacgcccaaacatcttcaagccggcatgcaggcctacatcgacatcaagaactgcccaaagaaaacgcggaatctgaaaaaaatcaccagagagcagcgacgccacatgaagaggtgggagtatttcatcgccgcagaggaagttatttgggattatgccccagtgattcccgccaatatggataagaagtatcggtcacaacacctcgataacttctccaaccagattggcaaacattacaaaaaggttatgtacacacagtatgaagacgagtctttcactaagcacacggtgaaccccaacatgaaggaggatggcatcctggggccaatcatcagagcccaagtgcgggatacattaaaaatagtgtttaagaatatggcctctagaccatattcgatttacccccacggcgtgaccttctccccctacgaggacgaagtaaattcctcttttactagtgggcgcaacaatacaatgattagggctgtgcagcccggtgagacatatacatacaagtggaacatcctggagtttgacgaacctaccgagaacgatgcccagtgcctgactagaccttactactctgatgtggatatcatgcgggatattgcctccggactgattggactgctactcatttgcaagtcccggtcactggaccggaggggtatccagcgagccgccgatattgaacaacaggccgtttttgctgtctttgacgaaaataagagctggtatttggaagataacatcaataagttttgtgagaacccagatgaagtaaagcgggacgaccccaagttctatgagtccaacatcatgtcaaccattaatggatacgtgccagaaagcatcacaaccttaggtttctgcttcgatgacactgtgcagtggcatttctgctcagttggtactcaaaatgaaatcctgaccattcattttactggtcactccttcatctatgggaaaagacatgaagatacattgaccctctttcctatgcgcggcgagtccgtgactgtgacaatggacaatgtagggacgtggatgctgaccagcatgaattcaagcccacgaagtaaaaagctgaggctcaaatttagagacgtcaaatgcatccccgatgacgatgaggacagttatgaaatttttgaaccgcccgaatccaccgtgatggcaacacggaagatgcacgataggcttgagccagaagacgaggaatccgatgcagattacgattaccagaatcggctcgcagccgccctcggaatccgaagcttcaggaactcctcactgaatcaagaggaggaggaatttaatctaacggccttggcacttgaaaatggcacagagtttgtatcctccaatacagacatcatcgtcggaagcaactacagctctccatcgaacattagtaagttcacggtaaacaacctggcagagccacagaaggcacctagtcaccagcaggccactacagccggctcacccctgaggcacctgatcggaaaaaactcagtgctgaattctagtaccgctgaacacagttcaccatactccgaagaccccatcgaggatcccctacagcccgacgtcacaggaatccgcctgttaagcctgggggctggggaatttaagagtcaggagcacgctaagcataaaggacctaaagtggagcgcgatcaagccgcaaaacaccggttctcttggatgaagctactggcccacaaagttggccgacacctgtcccaggacaccggcagcccaagtggcatgcgtccatgggaagatcttccgtctcaagataccggttccccatcgcggatgcgtccctggaaagacccaccttctgacttgctgctgctaaaacaaagtaactcctcaaagatactggtgggacgttggcacttagcctctgaaaaaggatcatacgagataattcaggacactgatgaggataccgcggttaacaactggcttatatcccctcagaacgctagcagagcatggggcgagagtaccccgctggccaacaagcccggaaagcagtcaggccatcccaaattccccagggttagacacaaatctctgcaggtaagacaggacgggggaaagtctcggctgaaaaagtcccagtttcttattaagacacgcaagaaaaagaaagagaaacatacacaccacgcacctctgtcccccagaacctttcacccgctccggtccgaagcgtataacaccttcagcgagcggcgcctaaaacacagcctcgtcctccacaagtctaatgagactagtctgcctacggatttgaaccaaactctgccctctatggacttcggctggatcgccagcctgcctgatcataaccagaatagcagcaatgacactggacaagccagctgtcctccaggcttatatcagacagtgcctccggaagagcattatcagaccttcccaatccaggaccctgatcagatgcactctacttcggacccgtcacatcgtagctcaagtcctgagctctctgagatgctggaatacgatcgatcgcataagtcatttcccacagacatttcgcaaatgtctccctcctctgagcacgaggtttggcagacagtaatatcgcccgacctgagccaagtgaccctctctcccgaattatctcagacaaacctcagccccgacttatctcacactactttgtcaccagagctgattcagaggaacttgtctcctgcactcggccagatgcccatatccccagatctgagtcacacaacactgtcacccgatctgtctcacactaccctcagcttggatttgagccaaaccaacttgagtcccgagctaagtcagacgaatctatctcctgccctcgggcagatgccactgtcacccgacctttcccatactacgctgtctctggacttttcacagacaaacctgtcacccgagctcagccacatgactctgtcccctgagctgagtcagacaaatctgtcccctgcccttggccagatgccgatctctcctgatctctcacataccactttgagcctggacttcagccaaactaatctgagccctgagttgagtcagaccaacctgtcccccgccctcggacagatgcccctatcgcccgatcccagccacactaccctgagcctggatctcagtcagactaatctgtccccagagttaagtcagacgaacctttcaccggatctgtcagagatgccactgtttgctgatctctcccagatacccctgacacctgatctggatcaaatgaccctaagccccgacctaggggaaactgacctctcacccaactttggtcaaatgtctctgtctcctgacctgtctcaggtgacactttcccccgatatctctgatacgacactgctccctgacctcagtcagatttcccccccacccgatctagatcagatcttctacccaagtgagtcttcccaatccctgctattacaagaattcaacgaaagcttcccctatccggacctcggccagatgccctcacccagttctccaacactgaatgacacctttcttagcaaggaatttaatcctctggtgatcgtaggcctctcaaaggatggaacagattacatcgaaattatccccaaagaggaggtccagagcagcgaagacgactacgcagagattgactacgtaccatacgatgacccctataaaactgacgtgcggaccaacatcaattccagcagagatcccgacaacattgcggcctggtacctgagaagcaacaacgggaatagacgcaactattacattgccgcagaggagatcagttgggattactctgagttcgtgcagcgggagacggatatagaggactcagatgatatcccagaagacaccacatataaaaaagtcgtatttcgaaaatacctcgacagcacattcacaaagcgggacccccggggggaatatgaagagcacctagggatcctcggccctatcattcgtgcggaggtggacgatgtgattcaggtccgattcaaaaacctggcatcccgcccatattcactgcacgcccatggtctcagttacgagaagagctcagaaggcaagacttacgaagatgacagcccagagtggtttaaggaggacaacgctgtgcagcctaattcgagttatacttatgtttggcatgcgaccgagcgatctggaccagagtcacctggaagcgcgtgtagagcctgggcatattactccgcagtcaatccagaaaaggacatccactctggattaattggaccgttgctgatttgtcagaaaggaatactgcataaagactctaacatgcccatggacatgagagaattcgtgctcttatttatgaccttcgatgagaaaaaaagttggtattacgagaaaaagtccagaagctcctggcgcctgaccagcagtgagatgaaaaaatcccatgagtttcatgcaattaatggcatgatctacagtctgccggggcttaaaatgtacgaacaggagtgggtccgtctgcatcttttaaatatcggaggcagccaggatatccacgtcgtgcattttcacggacagactctcttggagaatggtaacaagcaacatcagctgggcgtgtggcccctgctgccaggctctttcaaaaccctcgaaatgaaagcaagtaagcctggctggtggctgctcaacactgaggtgggggagaaccagcgagctggaatgcagacacccttcctgattatggatcgggactgtcgcatgcccatgggtctgagcacaggtattatatcggactcccagataaaggccagtgagtttctggggtattgggagcccaggctggcccgactgaataacggcggatcctataatgcctggagtgttgagaagttggcggcggagttcgcaagtaaaccttggattcaggttgacatgcaaaaggaagtgatcatcaccggaattcagacccagggcgccaagcactatttgaaatcttgctacactacagagttctacgtcgcctattctagcaatcagatcaattggcagatctttaaaggaaacagcactcgaaatgtaatgtattttaacggcaatagtgatgccagtacaataaaggagaatcagtttgatcctcccatcgtggcgagatacatacgtatctcaccaacaagggcttacaaccgacctacactgcgcctggaactgcagggctgtgaagtgaatggatgcagcacccccctgggcatggagaacggaaagattgaaaacaaacagattactgcctctagttttaaaaaatcctggtggggcgactattgggaacctttcagagcaaggctgaacgcgcagggacgggtaaatgcctggcaggctaaggcaaacaacaataaacagtggctggaaattgacttattgaagatcaagaagatcacagccattatcacccaaggctgcaagagtctctcgtctgagatgtatgtgaagtcttatacaattcactattccgagcagggggtcgaatggaagccctatcggcttaaatcatcgatggttgacaaaatattcgaagggaacaccaatactaaagggcatgtcaagaatttcttcaatccacccataatcagccggttcataagagttatcccaaagacttggaaccaaagtatcgcactgcggctagagctcttcgggtgtgatatttac

SEQ ID NO: 9122 - DNA, 6672 bp, Artificial Sequence
  Description of Artificial Sequence: Synthetic coding sequence
atgtttccgggatgtccccgactctgggtgctagttgtactgggtaccagttgggttggttggggcagccagggcaccgaggccgctcaattgcgtcagttttacgttgcagcccaaggcataagctggtcgtacagacccgaaccaactaattccagcttgaatctgtcggtcacttcttttaaaaaaatcgtctatagagagtacgagccgtacttcaagaaggagaagccccagtctaccatatccggcctgctgggtccaacgttgtacgcggaggtgggcgacattataaaggtgcatttcaaaaataaggcagacaagccgctatccattcatccccagggcatccgatatagtaagctttccgagggggcgtcctacctggatcatacttttcccgctgagaaaatggatgatgccgttgcgccaggacgagagtatacctatgagtggtcgatatcagaggactcaggcccgacccacgatgacccgccatgcctgacccatatttactacagtcatgagaatttgattgaggattttaattcgggtcttatcggcccgctactaatctgtaagaagggtaccctaacggagggtggaacccaaaagacgttcgataagcagatcgtactgctgtttgccgtgttcgacgagtccaagtcttggagccagtctagctccttaatgtacacggtgaatggctatgttaacggtacaatgcccgacatcactgtgtgcgcgcatgaccacatcagctggcacttgctgggcatgtcatcaggcccggaattgttctctatccactttaatgggcaggtactagagcaaaatcaccacaaagtaagcgccatcaccctggttagtgcaacgtccaccactgccaacatgaccgtaggcccagaaggtaagtggataatctcgtcactgacgccgaagcacctacaggcagggatgcaagcctatatcgatattaagaattgtcccaagaagacaaggaacctaaaaaagatcacacgtgagcagcggcgacacatgaagcgctgggaatacttcatcgccgccgaggaggtgatctgggattacgccccggttataccagcaaacatggacaaaaagtatcgcagtcagcatctagacaatttttccaaccaaatcgggaagcattacaagaaggttatgtacacgcagtatgaagatgaatcctttactaagcacaccgtcaatccgaacatgaaggaagacggcattttgggtcccatcatcagggctcaagtgcgtgatacactcaagatcgttttcaaaaacatggcatcccgtccgtactccatctaccctcacggagtcacattcagtccgtatgaggacgaggtgaactcctctttcacgtcgggacgaaataatacaatgattcgggccgtgcaaccaggggagacatacacgtataagtggaacatcctggagtttgatgagcccacggagaatgatgcccagtgtcttacgcgaccttattattctgacgtcgatataatgcgtgatatcgcttccggtttgattggacttttgttgatctgcaaaagccgatccctggaccgtcggggaatccaacgcgccgctgatatcgaacagcaggctgtattcgcagtgttcgatgagaataagtcctggtatttggaggacaacattaataagttctgcgaaaaccccgacgaggtgaagcgcgatgacccgaagttttatgagtcaaatatcatgtctacgatcaacggctacgtacccgagagcattactacactgggattttgcttcgatgacacggtgcagtggcacttctgctcagtcggtacgcaaaatgagattttgactattcattttacgggccacagctttatttacgggaaacggcacgaagacaccctgacgcttttccccatgcggggcgagtcggtgacagtgactatggataacgtgggcacatggatgcttacgtccatgaacagttccccccgttccaaaaagctgcgcctaaagtttcgcgatgtcaaatgtatcccagatgatgatgaggatagttacgagatctttgagccaccagagtccaccgttatggccacccgaaagatgcatgatcgtctggagccggaggatgaggaaagtgatgccgattacgattatcagaaccgtctagcagcggccttgggaattcgttcgttccgtaactcatcactgaaccaagaggaagaagagttcaacttgacagcactcgctctagaaaacggcactgaattcgtatcttccaacactgacatcattgtgggttcgaactactcaagcccctcaaatattagtaagttcacggtgaataatctggcagagccgcaaaaggccccctcgcaccagcaggccactacagccggctcgccacttcgtcacctgataggaaaaaactcggtactaaactcgtcgacggccgagcactcctccccatattctgaagatcctatcgaagacccactgcaaccggatgttacgggcataaggctcctgtccctgggagctggtgagttcaagagccaagagcatgccaagcacaagggaccaaaagtggagcgggatcaagctgctaagcaccggtttagctggatgaagctcttggcccacaaagtgggaaggcacctgtcacaggacacgggctccccgagtggcatgcgtccatgggaggacttgccatcccaagataccggatcgccgtcgcggatgcgcccctggaaggatccacccagcgatttgttgttgctgaagcagagcaacagctcgaagattcttgtgggcaggtggcatttggcctctgagaagggctcctacgaaatcatccaggacacagatgaagacaccgctgttaacaactggctgatatctccgcagaatgcctcccgagcctggggtgagagcacccccttggccaacaagccaggaaagcaatccggccaccctaagtttccgcgtgtcaggcacaagtccctacaggtgcgtcaggatggagggaaatcccgcctcaagaagagtcaattcctcataaaaacacgcaagaagaaaaaggagaagcacacacatcacgccccgctgagtccccgcacttttcacccactaaggagtgaagcctacaataccttctctgagcgccgcttgaagcacagtttggtcctgcacaaatctaacgagacgtctctacccacggatctgaaccagaccttgccaagcatggacttcggctggattgcatccctgccggatcacaaccagaacagctccaacgatacgggacaagcctcatgtccccccgggctctaccagactgtgcccccggaagaacactatcagacgttccctatccaggatcccgatcaaatgcactcgacctcagatccctctcaccggtcgagctcccctgaattatctgagatgctggagtacgatcgctcacacaaaagcttcccaaccgacatcagccaaatgtccccaagcagcgagcacgaggtttggcaaacggtgatcagtcccgacctatcgcaggtgacactgagcccggagctgtcccaaaccaatttgtcaccagacctgagccacacaacactatcgcctgagctaatccagcgcaacttgtcccccgcactgggtcagatgcccatttcaccggacttgagccatacgacgctgtcccccgatttgtctcacacgactctgtcactggatctgagccagaccaatctatcgcccgaactgagccagaccaacctctccccagccctagggcagatgcctctgtcccccgatctgtcacataccacgctctccctcgatttttcccaaaccaacctatccccggaactgtcccacatgacgctgtcccccgaactcagtcagactaacctgtcccccgccctcggtcagatgcccatcagcccggatttaagtcataccacgctctctctggattttagccagacgaatctgagtccggaactcagccagacaaacctgtccccggctctcggtcagatgccgctgtcgcctgaccccagccacacgacactgtcgttggatttatcgcagaccaacctgtcgccggagctatcccagacgaacctgtcgcccgatctttccgagatgccgctgtttgctgacctgagccagatcccgttaaccccggaccttgaccagatgacgctgtcgcccgatctgggagagacggatctgagcccaaatttcggtcaaatgtcactcagtcccgatctgagccaagttaccctttcccccgatatcagcgacaccacgctgttgccggatctcagtcagatatccccgccaccggatctggaccaaatcttctacccgtccgaaagtagtcagagcttgttactgcaagagttcaacgagagctttccatatccagatctcggacagatgccatccccaagcagtccgaccttgaacgacacgttcctgtcaaaggagttcaatccgctcgtaatcgtgggtctgagcaaggatggcacagactacatcgagattatccccaaggaggaggtgcagtcctccgaggacgactatgccgagattgattacgtgccttacgacgatccctacaaaaccgatgtcaggacgaacataaactccagcagagaccccgacaatattgctgcctggtatttgcgctccaacaacggcaaccggcgaaactactatattgcagccgaggagatttcatgggattactccgaatttgtccaaagggagaccgacatcgaggactccgacgacattcccgaagatacgacctataagaaggtcgtgtttcggaagtatctggactcaacgttcaccaagcgggatcctcgtggagagtatgaggagcatcttggcatactgggaccgatcatccgggccgaggtcgacgatgtgatacaagttcgctttaaaaacctggcctcccgaccttactctctccacgcgcatggactgagttacgagaagtcctccgaaggtaagacgtacgaggatgattcccccgagtggttcaaagaggataatgctgtgcagccaaattcgagctatacctacgtgtggcacgcgacggagcgtagcggtcctgagagtcccggcagcgcttgccgagcgtgggcgtactactccgcagtgaacccggaaaaggatattcacagtggcttaattggcccgctccttatctgccaaaaaggtattctgcacaaggactccaacatgcctatggatatgcgtgagttcgttttgctttttatgaccttcgacgagaagaagtcttggtactacgagaaaaagtcccgctctagctggcgtctgacttctagtgaaatgaagaagtcccatgaattccacgccataaacggcatgatctatagccttcccggtttgaagatgtacgaacaggaatgggtgagactccatctgttgaacattggtggttcgcaggatatccatgtggttcacttccacggacaaacgctccttgaaaatggaaataagcagcaccaacttggagtgtggcccttgttgccaggctcgttcaagacccttgagatgaaagcgtcaaagcccggctggtggttactaaacacggaagtgggtgagaaccagcgcgccgggatgcagactcccttcctcatcatggatcgagactgccggatgcccatgggtctgtccaccggcattatctccgattctcaaattaaagcatccgaatttttgggttactgggagccccgcctggcccgactcaataatggaggatcatataacgcctggtcggtcgaaaagctggccgccgagttcgcctcaaaaccctggatacaggtggacatgcaaaaggaggtcataataaccggcatacagacgcagggcgccaagcattatctgaagagctgctacactactgagttttatgtcgcctactccagtaaccaaatcaactggcaaatattcaaaggcaattcgacccgcaatgtaatgtattttaacggtaactcggacgcctccacgatcaaggagaaccagtttgacccccccatagtggcccgctatattcgcatctcacccacccgggcgtacaataggccgactctgcgcctcgagctgcagggctgcgaggtgaatggttgcagtacaccgttaggcatggagaacggcaagatagagaataaacaaataactgccagtagtttcaagaagtcgtggtggggtgattattgggagccgttccgcgcccgactgaacgctcagggccgggtgaacgcgtggcaggccaaagccaataataacaaacagtggctggagatcgatctgctcaagattaagaagataactgccatcatcacccagggatgcaagtcgctttcaagcgagatgtacgtgaaaagctacacgatccactattcggaacaaggtgtggagtggaaaccctacaggcttaagtccagtatggtggacaaaatctttgagggcaacacgaacacgaagggtcacgtcaagaattttttcaatccgccgattatctcccgcttcatccgagtcattccaaagacatggaaccagagcattgcgctacggctggagttgttcggttgcgatatttac

SEQ ID NO: 9123 - DNA, 6672 bp, Artificial Sequence
  Description of Artificial Sequence: Synthetic coding sequence
atgttccccggatgtccacgactttgggtgctggttgtcctgggaaccagttgggtgggatggggctcacagggtacagaggccgcacagctcagacagttttatgtcgccgcccaggggatatcatggtcatacagaccagagccaaccaatagctcattgaacctgagcgtcacctcattcaagaagattgtgtatagggaatacgagccttactttaagaaagagaaacctcaatctaccatctcgggcttgctaggacccacgttgtatgcagaggtcggcgacatcataaaagtccatttcaaaaacaaggctgataagccgctgtcgatccatccacagggcattcgatatagtaagctgtcagagggcgcatcatatttggaccatacttttcccgcggagaaaatggatgacgcagtggcccctggacgggaatacacctacgaatggtctatctccgaagactctggccccacacacgacgaccccccatgcttaacccacatctactactcccacgaaaacctaatcgaggattttaactcaggcctcatcgggcctctcctgatttgtaaaaaggggacactgaccgaaggcgggactcagaagacttttgacaagcagatcgttctgctattcgccgtttttgacgagtccaagtcttggagccagagcagttcattgatgtatacagtgaacgggtacgttaacggcacaatgccggatatcactgtgtgcgcgcacgaccacatttcctggcatctgctcgggatgtccagcggtcccgagctttttagcatccacttcaatggacaggttcttgaacaaaaccaccacaaggtctcagccattaccctggtgtccgctacatcaaccactgcaaatatgacagtggggcccgaaggaaagtggatcatttcctcactaacaccgaagcatttacaagctgggatgcaggcctatatcgacataaagaactgtcccaaaaagaccaggaatctgaagaaaattactagggaacagagacggcacatgaaacgttgggagtatttcatcgccgcagaggaggttatctgggactacgctccagtgattcctgccaatatggataaaaaatacaggagccagcacctggataatttcagtaaccagattggcaagcattacaaaaaggtcatgtacacacaatatgaggacgagtctttcactaagcacaccgtgaatcccaatatgaaggaggatggaatcctgggacccatcatccgggcccaggtgcgcgacactttgaagattgtgtttaaaaacatggcgtccagaccgtacagcatttacccccacggcgtgacattctctccctacgaagacgaagtcaattctagctttaccagcggccgaaataataccatgattcgggctgtccagccaggcgaaacctacacatacaagtggaacattctcgaattcgatgaaccaactgagaacgatgcacaatgtctgactcgtccgtactactctgacgtggacatcatgcgggacatcgcctcaggcttgatcggattgctcctcatttgcaagtctagatcgctcgaccgacggggtattcagcgagctgccgacatcgagcagcaggccgtcttcgcggtctttgatgaaaataagagctggtatctcgaagataatattaacaaattttgtgagaatccggacgaggtgaaacgtgacgatccaaaattctatgagtccaatataatgagtaccatcaatggctacgtgccagagtctattaccactctgggcttttgttttgacgacactgtccaatggcacttctgcagcgtgggtactcagaacgagatactcaccatacacttcactggtcactcttttatctacggtaagagacacgaagacactctgaccttattccctatgaggggcgagtccgtaactgtcactatggataatgtcggaacatggatgctgacctccatgaattcgtccccaagaagtaagaagctacgtctgaaattccgagatgttaaatgcatcccagatgacgacgaggactcctacgagattttcgagccacctgaaagcaccgtcatggctacccgaaaaatgcacgataggctggagccagaagatgaagagagtgatgcggactacgattaccagaatagactggcggccgctctggggatccggagtttcagaaattcctctttaaaccaagaggaggaagagttcaacttgactgctctggcgctcgagaacggtactgagttcgtgtcaagtaacactgacataatcgttgggtcaaattactctagcccatcaaatatatctaaatttacagtcaataacttggcagaaccacagaaggccccttctcaccaacaggctacaactgcaggaagccctctccgccacttgattgggaaaaactcagtgctaaactccagtactgccgagcatagttcgccctactctgaggatccaatcgaggacccgttgcagccagacgtaacgggaatccgcctactcagcttgggtgctggcgagtttaagagtcaggagcacgccaaacacaagggcccaaaagtggaacgggatcaggcggcaaagcaccggttttcttggatgaaattactcgcccataaggtagggcggcacctgtcacaagatacaggctcccctagcggcatgagaccctgggaagatctgccatcccaagatacagggtccccatccaggatgcggccttggaaggatcccccttccgacttgttgttattgaagcagagtaacagctcaaaaatcttggttgggagatggcacctggcatctgagaagggaagttacgagatcatacaggataccgatgaggacaccgctgttaacaattggctcatctccccccaaaacgcctcacgggcctggggagagtctacaccactggctaataagcccggcaagcagagtggccatcctaagtttccgcgagtgcgtcacaagtctcttcaggtgcgacaggacggcgggaagtctcgccttaaaaaatcccagttcctgattaagacccggaagaaaaagaaagagaaacacacgcatcatgcacctctcagcccccggacttttcaccccctcaggagtgaggcctacaatacattcagtgagcgaaggctaaagcactcattagtgttacacaaatccaatgagaccagcctgccaactgatttgaatcagacacttccatccatggactttgggtggatcgcgagtctccctgaccataaccagaatagtagtaacgacacggggcaagcctcctgtcctccaggattgtaccagaccgttccacctgaggagcactatcaaacttttccaattcaggaccccgatcaaatgcattcaacctccgaccccagccataggagcagctctcctgaattgtcggagatgctagaatatgataggtcacacaagtccttccctacagatatctctcaaatgtccccctcatccgagcatgaggtatggcagactgtgatctcccctgacctcagccaggtgactctgagccctgagctctcgcaaaccaatctgtctcccgacttatcgcatacaacactgagcccagagctgattcagcgaaacttatcccctgcactgggccagatgccaatcagcccggatctgtcacataccacgctgagccccgatctatcacatacaacactttcactggatttgagccaaactaacttgagcccagagctatcccagacgaacctgtcacccgccctgggccagatgccactgagtcccgacctgagccacactacattatcgttagacttttcccagacgaacctgagccccgagctgtcacacatgactttgtcccctgaactgtcccaaacgaatctgagcccagcactgggtcagatgcctatctcgccagacttgtcacacaccacactttcactggacttctcacagacaaacctgtcacctgaactgtcgcaaaccaatctatcgcctgcacttggacagatgccgctttcaccagacccatcacacactactctgtcgcttgatctgtctcagaccaatctgagccctgaattaagccagacaaatctgagccctgacctgtcggaaatgccactatttgctgatttatcccagatccccctcacaccagacctggaccagatgacgctgtcacctgaccttggcgaaacagacctctcccctaactttggacagatgagcctgtcaccagacctttctcaagtcacactctcccccgatatatctgatactactctacttcccgacctatcccagatatcccctccaccggatctggaccagatattttacccctccgagagttctcagagtctgctgttgcaggagtttaatgagtcattcccctacccagatctcggacagatgccttctcccagcagccctacattgaacgacaccttcctgagtaaagagtttaatcctctagtaatcgtaggcctgtcaaaagatgggaccgactacatcgagattattccaaaggaggaggtgcagtcttcggaggacgactatgccgagattgactatgtgccctatgatgatccatataagacagatgtgcgtactaacataaatagcagtagagacccggataacattgccgcctggtacctcaggtctaataacgggaataggcgaaactactacatcgccgcagaagaaattagttgggattatagtgaattcgttcagcgtgaaaccgatatcgaggattctgacgatattccggaagacaccacctacaagaaggtggtgtttagaaagtacctggatagcactttcaccaagagagaccctagaggtgagtacgaggagcatctgggcatccttggacccatcatccgtgcggaagtggatgacgttatacaggtgaggttcaagaatctcgcatctagaccatactccctccatgctcatggcctctcttacgaaaagagtagcgaaggcaaaacctatgaggacgactcacctgagtggttcaaggaggataacgcggtgcagccgaacagctcatacacatacgtgtggcacgctacagaacggtctgggcccgagtcccccggctccgcctgtagagcatgggcttattactcggctgtgaatcccgaaaaggatatccacagcggactcataggcccgctgctaatttgtcagaaggggattctgcacaaggattccaatatgcctatggacatgagagagttcgtgttattatttatgacctttgacgaaaagaagagctggtactatgagaaaaagtcaagatctagctggcgcctgacgagcagcgaaatgaaaaaatcccacgagtttcatgctattaacgggatgatatatagcctcccaggtttaaaaatgtatgagcaggaatgggtgcgcctgcacctcttaaacattggtggctcacaagacattcacgtggttcactttcacgggcagacgctgttggagaatgggaacaaacagcaccaactcggagtgtggccccttctgccgggttcctttaaaactcttgagatgaaggccagcaaaccggggtggtggctcttgaacacggaagttggtgagaatcaacgagccggaatgcagactccattcctgatcatggatagggattgtcggatgcctatgggactctcgaccggtattatttccgatagccagatcaaagcttctgagttcctcggatactgggagcctcgactggctcgtctcaataacggagggtcatacaacgcgtggagcgtggagaagctagcagccgagtttgcctctaagccctggattcaggtggatatgcagaaagaggtgatcatcaccgggattcaaacgcagggggctaagcattatctgaaatcctgttataccaccgagttttacgttgcgtactccagtaatcaaattaattggcaaatcttcaagggcaactccacccggaacgtgatgtacttcaatggaaactctgatgcttcgactatcaaggagaaccagtttgaccccccaattgtggcaagatacatccgcatctcccccacgcgagcctataatcgtccaactttacgcttagagctgcagggctgtgaggtaaacggttgcagtacaccactggggatggaaaacggcaaaatcgagaacaagcagattactgctagcagttttaaaaaatcttggtggggcgattattgggagccctttcgggctaggctgaacgcacaggggcgggttaacgcatggcaggctaaggcaaataacaacaagcagtggttagagattgacttgttaaagataaaaaaaatcacggcgatcattacacaggggtgcaaaagtctttctagtgagatgtatgtaaaatcttataccatacattacagcgagcaaggggttgagtggaagccctatcggctgaaaagttccatggtcgataagatttttgaggggaacacgaacactaagggccacgttaagaatttctttaatccaccaatcatctccagattcataagagtcatccccaagacttggaatcagagcatagccctgaggctggaattgttcggatgtgatatttat

SEQ ID NO: 9124 - DNA, 6672 bp, Artificial Sequence
  Description of Artificial Sequence: Synthetic coding sequence
atgttccctggctgtcccagactttgggtgcttgtcgtgctcggaaccagctgggtgggctgggggtcccaggggacggaggccgcccaactgcgccagttctatgttgccgcacagggaatcagctggtcatatcgccctgagcccactaactcctccctgaatttaagcgtgacttctttcaagaagattgtttatcgagagtacgagccttacttcaaaaaggagaagccacaatctaccatttctggcctcttgggccccactctctacgctgaagttggagatataatcaaggtccactttaaaaacaaggccgacaagccactaagcatccacccgcagggcattcggtactctaagctcagcgagggagcctcatacctcgatcacactttccccgctgagaagatggacgatgccgttgccccgggtagggaatatacctacgaatggtccataagcgaggactctggacccacacatgatgaccctccatgcctgacgcacatttattactcccacgaaaatttaatcgaagatttcaatagcgggctcatcgggccgctgcttatttgtaagaaagggacactcaccgaaggcgggacacagaagacttttgacaaacaaattgtgctgttatttgcagtgtttgacgaaagcaaaagttggtcacagagtagctctttaatgtatacagtgaacgggtacgttaacggaaccatgcctgacataactgtctgtgcccacgaccacatctcttggcatctgctgggcatgtccagcgggcctgagctcttctcaatccatttcaacggacaggtgctggaacagaaccatcacaaggtaagcgctatcaccctggtgagcgcgacttccactaccgctaacatgacagtcggacccgaaggcaagtggattatctcctcgctgacgcctaaacatttgcaggctggcatgcaggcatacatcgatatcaaaaattgtcctaaaaagactagaaacctgaagaaaatcacacgcgagcaacgtcgacatatgaagcggtgggaatactttattgcggcagaggaagtcatatgggattatgcgcctgtgatccccgccaatatggataagaagtaccgctcacagcatctcgataactttagtaatcagatcggcaagcattacaagaaagtgatgtacacccagtatgaggacgaaagcttcacaaaacacaccgtcaacccaaatatgaaggaagatggtattttaggcccgattattcgggctcaggtccgagatacactaaagatagtgttcaaaaacatggcctctcgcccctatagtatctacccacatggagtgacattctcaccttacgaagatgaagtgaactcgagcttcactagcgggaggaataatactatgatcagggcggtgcagccaggcgaaacatatacctataagtggaacattctagagttcgatgaacctaccgagaatgatgcccaatgcctgaccaggccctactacagcgacgtggatatcatgagagacatcgctagtggcctcatcgggttattgctgatttgtaaatcgaggagcctcgacaggcgggggatccagcgggcggcggatattgagcaacaagccgtgtttgcagtatttgacgagaataaatcttggtacctcgaggataacattaataagttctgtgagaatcctgatgaagtaaaaagggatgacccaaaattttacgaatcgaacatcatgtcgacaattaacggctacgtcccagaaagcataactactttagggttttgcttcgacgacacagtgcagtggcacttctgctcagtcggaacccagaacgagatcctgacgattcacttcaccggccattcttttatctacggcaagcggcatgaagacacactgactctatttcctatgagaggtgagtctgtgacggtcaccatggacaatgtgggaacgtggatgcttactagtatgaactccagtccgaggagtaagaagctcaggcttaagtttagggatgttaaatgcattcccgacgacgatgaggatagctacgagatctttgaacccccggaaagcacagtaatggctacacgaaaaatgcacgaccgcctggaaccggaggacgaggaatcagacgctgattacgactaccagaaccgattggccgccgctctgggtatccgatcctttcgtaatagctctcttaatcaggaagaagaggagtttaatctaacagctcttgctctcgagaacggaacagagttcgtctcaagtaataccgatatcatcgtgggatcaaactactcatctccatctaatatttcaaagtttacagtgaacaatctggccgaacctcagaaagccccaagccaccaacaggccaccaccgcgggaagtcctttaagacacctgattggtaaaaatagcgtcctgaattctagtaccgcagaacatagctcgccatactccgaagaccccatcgaggacccactgcaacccgacgtaaccggcatccgtctgctttccctgggcgccggggagtttaaaagtcaggagcacgccaagcataaaggacccaaagttgagcgtgatcaagctgctaaacatcggttctcttggatgaaattactggcccacaaggttggtagacacctgtcacaggacaccggatccccaagtggcatgagaccatgggaagatctgcctagtcaggacaccgggtcccctagcagaatgcgaccttggaaggacccacctagcgatctgcttctgctcaagcagagtaattcctccaaaattctggtcggtagatggcatctcgcctcagagaagggctcctacgagataatccaggatacagatgaagatactgcggttaataactggctgatcagtccccagaacgcctctcgcgcatggggcgaatccacccccctggcaaataaacccggcaagcagagtggccatcctaagttccctcgcgtgcgccataagtcccttcaggtaagacaggacggaggtaagtccaggctgaaaaaatcccagtttctaatcaagacgcgtaagaagaaaaaggaaaaacacactcaccacgcgccccttagtccacgaaccttccatccgctgagatcagaggcttataataccttctccgagcgcagactcaagcacagcctggtgctgcataaaagtaatgagacctcattgcccacagacctcaaccagacactccccagcatggatttcgggtggatcgcatctttacctgatcataatcaaaattcctcgaacgacacgggacaagcatcatgccctccaggactgtaccagactgtgccacccgaagaacactaccagacgtttccaattcaggatcctgatcaaatgcatagcactagtgatcccagccaccgatcatccagtcccgagctatcagagatgctggaatacgaccggtcccataagagctttcccactgatatttcacagatgagcccttcatctgagcatgaggtgtggcagacagtgatctctcctgatttatcacaggtgacactgagccctgaacttagtcagacgaacctgtctcccgacctgagccacaccaccctgtcgccagaactcatccaacggaacttgagtccagcgctggggcagatgcctatatctccagacctgtcccacacaaccctatcgcctgatctcagccacacaacattgtccttagatctgagtcagaccaatctatcccctgaactcagtcaaacgaatctatcacctgctctcggacagatgcccctgagtcctgacctctcacataccaccctctctctggattttagccagacgaatctgtcccctgagctgtctcatatgacgctcagtcccgagctgtcccagaccaacttatcgcctgccctggggcagatgcctatcagtcccgacctgtcacacactaccctttcactggatttcagccaaaccaacctgagccctgaactttcccagacaaaccttagccctgctctcggacagatgcccctgtccccagaccctagtcatactactctgagcctcgatttgtcacagacgaatctgtcgccggaattaagccaaacaaatctgtctccagacctgtcagagatgccgctgttcgcagacctgagtcagatccctcttacacccgacctggatcagatgaccctgtcccccgacctcggagagaccgatctctcacccaacttcgggcagatgtcactgtcacccgacctgagccaggtcaccttaagccccgacatctcggacactaccctcctgccagacctaagtcaaataagtcccccacccgacctcgaccagattttttatccctccgagtcatcacaaagcctcttgcttcaggaattcaatgagagtttcccttatcccgaccttgggcagatgccctcccccagctcacccaccttgaatgacaccttcctctccaaagagtttaaccctctggtgattgtgggtctctctaaagatggcaccgattatattgagattatcccaaaggaggaggttcagagcagcgaagacgattacgcagagatcgactacgttccctacgacgacccttataagactgacgtgaggacaaatataaatagttcccgagacccggataatatcgctgcgtggtacctccggtctaataatgggaatcgcagaaactattatatagccgctgaagagataagttgggactactccgaatttgttcagagggaaactgacatcgaagacagcgatgatataccagaggacactacttataagaaggttgtttttcggaaatacttggactcaacatttaccaaaagagacccaagaggtgagtacgaagagcacctgggaattctgggaccgattatcagggccgaagtcgacgatgtaatccaggtgcgcttcaaaaatctggcctctcgcccatacagtctacacgcccacggtctctcgtacgagaaatcatcagaagggaaaacctatgaggatgacagtccggagtggttcaaagaggataacgcagtgcagcccaatagttcctatacttacgtttggcatgccacagagaggagcggccctgagtctccaggaagtgcatgccgcgcctgggcttattactctgcagttaatccagagaaggatatccacagcggtctgattggacctttgttaatctgtcaaaagggcatcttgcacaaggactctaatatgcctatggacatgagagagtttgtgttgctctttatgacctttgatgaaaaaaaaagttggtactacgaaaaaaagtcaagatccagctggaggctcacgtcaagcgaaatgaaaaaaagccacgagtttcatgcgatcaatggaatgatctactccctcccaggactgaaaatgtatgaacaggagtgggtccgactccacctgctcaacatcggcggctcccaggacattcacgtggtccactttcacggccagacattgttagagaatgggaataagcaacaccagctgggcgtctggccactcttgccgggatcattcaagaccttggagatgaaggctagtaagccaggctggtggctgttgaatacagaagttggcgagaatcagcgggcgggaatgcagacacccttcctgatcatggaccgggattgcaggatgcctatgggacttagcacgggtatcattagtgattctcagatcaaggcctcagaatttctgggctattgggagccgcgcttggctcgactaaataatggggggagctataacgcttggagtgtagagaaacttgccgccgaattcgcttccaaaccctggatccaggtagacatgcaaaaggaggtgataatcacagggatccaaacccagggggcaaagcactacctcaaatcttgctacaccacagaattttatgtggcttatagtagtaaccagatcaattggcagatcttcaaagggaacagcacacgcaatgtgatgtatttcaatggtaatagtgacgctagcaccattaaggagaatcagttcgatcccccaattgtcgccagatacataagaatatctcccacccgggcctataaccggccaactttgcgtctggagctgcagggatgtgaagtgaacggttgctccactccattggggatggagaatgggaagatcgaaaataaacagattactgcatcctctttcaaaaagtcatggtggggagattactgggaacccttcagggccaggctgaacgcgcagggacgcgtcaacgcctggcaggcgaaagctaacaacaacaaacagtggctggaaatcgatcttcttaagattaagaaaattaccgccatcattacccagggctgcaagtcgttatcaagtgaaatgtatgtgaaaagctataccattcactactctgaacaaggcgttgaatggaagccgtatcggctgaaaagctcaatggtagacaaaattttcgaaggaaatactaacacgaagggccacgtcaagaatttcttcaatccccccattatttctcggtttatacgtgttatcccgaaaacctggaaccagagcattgccctgaggctggagttgttcggctgtgacatttat

SEQ ID NO: 9125 - DNA, 6672 bp, Artificial Sequence
  Description of Artificial Sequence: Synthetic coding sequence
atgttccctggttgccctcgtttgtgggtgctggtcgtgctcggtacctcttgggtgggctggggctcccagggaacagaggctgcacagcttcgtcagttctacgtggctgctcaaggaatttcatggtcttatagacctgagcctaccaactcctctctgaatttgagcgtcacatcatttaagaagatcgtgtacagggaatacgagccctacttcaagaaggagaagccccaatccacaatcagcggattgcttggacccacactctacgcagaggtaggagacattattaaggtgcattttaagaacaaggcagataagcccctgtcaatccatccacaaggaatccgctactctaaactgagtgagggagcaagttacttggatcacacatttcctgccgagaaaatggatgatgccgtagcccctggcagggaatacacctacgaatggtctattagtgaggattctggacccacccatgatgacccaccttgcctgacccacatttactattcacacgaaaacctcatcgaggattttaatagcggcctcatcggccccttgctgatctgcaagaagggcacacttactgaaggcggtacacagaagacttttgataagcagatcgttcttcttttcgccgtgtttgatgaatctaaatcatggtctcagagcagtagtctcatgtacacagttaacggatatgtcaacggtaccatgcctgacatcaccgtttgtgctcacgatcacatctcctggcacttgctcggtatgtcctctggacccgagcttttttctatccatttcaacggccaggtcctggagcagaatcaccacaaagtgtccgctatcaccctcgtctcagctacctctactactgccaatatgacagttggcccagaaggaaagtggataattagttcccttactcctaagcacttgcaggccggaatgcaagcttacatcgatattaagaactgtcctaagaagactcgcaaccttaaaaagattacacgtgaacagcgccgtcacatgaagcgttgggagtactttatagctgccgaagaggtcatttgggactatgcacccgttatccctgcaaacatggacaagaagtataggtcccagcacctggacaatttttccaatcagatcggtaaacattacaagaaggtcatgtacacccagtatgaggacgagtcctttaccaagcacacagtaaatcccaatatgaaagaggacggcatcctgggccctattatcagggcccaggtgcgtgacacactcaaaatcgtgtttaaaaacatggcctctcgcccctattccatatatcctcacggcgtgaccttctcaccctacgaagatgaagtcaacagctcatttactagtggaaggaataacacaatgattagggccgtacagcccggcgaaacctacacatataaatggaatattttggagtttgatgagcctactgagaatgacgcccaatgcctcacacgtccctactatagtgatgtcgatatcatgcgcgatatcgcttcaggtctgatcggtctgctccttatctgtaaatcaaggagtctggaccgccgcggaatacagcgtgcagccgacatcgagcagcaggctgtcttcgccgtgttcgacgaaaataaaagctggtacctggaggacaacattaataaattctgtgagaatcctgatgaggtaaagcgtgatgatcctaaattctatgagtcaaacataatgagcactatcaacggctacgtcccagaatctatcaccaccctcggattctgtttcgatgacaccgtacagtggcacttctgttccgtgggtacccaaaacgaaatcctgaccattcactttactggccacagttttatctacggcaagcgccacgaggacaccctgacactgttcccaatgaggggagagagtgttaccgtgaccatggataacgtcggaacttggatgctcactagtatgaactcaagtccaaggtccaagaaactgagactcaagttccgtgacgtgaagtgtataccagacgacgacgaggatagctatgaaattttcgagccacccgagtccaccgtcatggccactcgtaaaatgcacgacaggctcgaacctgaagatgaggaatctgacgctgactacgactaccaaaaccgtctggccgcagctctgggtataaggtcctttcgtaatagcagtctgaatcaggaagaggaggaatttaatctgaccgcacttgccttggagaacggcaccgaatttgtctcctccaataccgatatcatcgtgggaagtaattacagctcaccatccaatatctccaagttcactgttaataacttggctgagcctcagaaggccccatctcaccaacaagccactacagccggcagcccactccgccacctgatcggaaaaaactccgtgctgaacagttctaccgccgaacacagttcaccatactctgaagaccctattgaagacccattgcaacccgatgtcactggaatcaggctgttgagtctgggcgcaggcgaattcaagtcacaggaacacgctaaacataagggcccaaaagtggaaagagaccaggccgctaagcatcgtttctcttggatgaagttgttggctcacaaagtgggacgccatcttagccaggacaccggaagcccaagcggaatgaggccctgggaggatcttccttcccaggatactggatccccttcacgcatgcgcccatggaaggatcctcctagcgacctcctccttctgaaacaatctaactcctctaagatcttggtaggccgttggcatctggcctccgagaagggctcctatgaaatcattcaggacactgatgaagacacagctgtgaataactggctgataagtcctcagaacgcttcaagagcctggggcgaatccactcctctcgccaataagcctggaaagcagtccggccaccccaagttccccagagtaaggcacaagtccctgcaggtcaggcaagatggtggtaagtcacgcctgaaaaagtctcaattccttattaagacccgcaaaaagaagaaggaaaaacacacccaccacgctccactctcaccacgtaccttccatccactcagaagcgaggcttacaacaccttctctgagcgccgtcttaagcactctcttgtgttgcataagtcaaatgagacctctctccccaccgaccttaaccaaacactgcccagtatggatttcggttggatcgcctcacttccagaccataatcagaattcctccaatgacaccggacaagcctcctgtcctcctggactgtaccagactgtccctcctgaggaacactatcagacattccccatacaggatcctgaccagatgcactctacctcagatccttcacaccgttcttctagtcccgagctctctgagatgttggagtacgatagatctcacaagagtttccctaccgacatcagtcaaatgagccctagcagtgagcatgaggtctggcagaccgttattagcccagatctctcacaggtaaccctctctcctgagctctctcagaccaacttgagccccgacctcagtcatactacattgagtcccgagctcatccaaaggaatctttcccccgccctgggtcagatgcctatctccccagacctctctcacacaacattgagccctgatctctcccacacaaccctgtcactggatttgtcccagacaaatctgagccctgaattgtcacaaaccaacctcagtcccgctcttggtcagatgccccttagcccagacctgagtcacacaaccctgtccctggacttcagccagacaaatctgtcacccgagcttagccacatgaccctgtccccagagctgagccagaccaatctctcccccgctctcggtcagatgcctatctcccccgatctgtcccacaccacactctctctcgacttttcccaaaccaacctttctccagagctctcccagacaaatctgtcccctgctctcggacagatgcccctgtctcccgaccctagtcatactacactcagcctcgacctgagtcagacaaatctttctcccgagctgtctcaaactaatctgagccctgacctttccgagatgccactgtttgctgacctgtctcaaattcccctcaccccagatctcgaccagatgacattgtcccccgacctgggagaaactgatctgtcccctaacttcggccaaatgtccttgtccccagacctttcccaagtaacactgagccccgatatctcagatacaacccttttgccagatctttcacagataagcccaccacccgatctcgatcagatattctacccttctgagtcaagccaaagcctccttctgcaggagttcaacgagtccttcccctaccctgacctcggacaaatgccttccccctcctcaccaactcttaatgatacatttctgagcaaggagttcaatcctctggtcatcgtgggtctgtctaaggacggtaccgactatatcgagataatcccaaaggaagaggttcagagcagcgaagacgattacgccgaaattgactacgtgccttacgatgatccatacaagacagacgtaaggaccaatataaactcttcaagggacccagataatatcgccgcttggtacctccgtagcaataacggcaatcgccgcaattactatatcgccgccgaggaaatttcttgggactacagcgaattcgtccagagggagactgacattgaggattccgatgacatcccagaggacacaacctacaaaaaggtcgtgtttcgtaaatatttggactctaccttcactaagcgtgatccaaggggtgaatatgaggaacacctgggtatactcggtcctatcattagggctgaggtggatgatgtgatacaggtccgtttcaaaaaccttgcttctagaccctactccctgcatgcccacggtctctcatatgagaaatctagtgagggcaagacctacgaggacgactcacctgaatggttcaaggaagacaacgcagtacagcctaacagctcctatacttatgtctggcatgcaaccgagagaagcggtcctgagagtcccggtagcgcctgcagggcatgggcttactacagtgctgtcaacccagagaaggacatccactctggtctgatcggtcctttgctcatctgccagaaaggcattctccacaaagactccaatatgcctatggacatgcgcgaatttgtactcctctttatgacattcgatgagaagaaatcatggtattacgagaaaaaatctcgttcttcttggcgtctgaccagttcagaaatgaagaagtcacatgagttccacgctatcaatggaatgatatacagtttgcctggtctcaagatgtacgagcaggaatgggtgaggctgcacctgctgaacatcggcggttctcaggacattcacgtggtgcacttccacggccaaacactgctggagaatggtaataagcagcaccagctcggtgtctggcctcttttgcccggaagttttaaaaccctggagatgaaggcctctaagcccggttggtggcttcttaacaccgaagtcggagaaaaccagcgcgctggcatgcagactccatttcttatcatggaccgcgattgcaggatgccaatgggactgtctactggaattatttccgacagccagattaaggcatctgagttcctgggttactgggagccacgcctggcccgcctgaacaatggcggaagctacaatgcttggagcgttgaaaagttggccgctgagttcgcctctaagccatggatccaagtagacatgcaaaaagaggtgatcataacaggtatccagacacagggtgccaagcactacctgaaaagctgttacaccacagaattttacgtcgcttacagcagcaaccagatcaactggcagatctttaagggaaactcaacccgcaatgtgatgtactttaatggcaactccgacgcatccaccatcaaagaaaaccagttcgaccctccaatcgtggcaagatatatccgcatttcccccacccgcgcatacaacaggcctactttgaggttggagctccagggatgcgaagtgaacggttgttctacacctctcggcatggaaaacggtaagattgagaacaaacaaattaccgcctcctcatttaagaaatcctggtggggtgactattgggaaccattcagagctcgccttaacgcacagggacgcgtcaatgcttggcaggcaaaggctaacaacaataaacagtggctcgaaattgacttgctcaagatcaagaaaataacagccatcatcacacagggctgcaagtccctctcatctgaaatgtacgttaagtcatataccattcactatagcgaacagggagtggagtggaagccatacaggctcaagagcagcatggtggataaaatttttgagggtaatacaaacaccaagggacacgtgaagaattttttcaatccacccatcatctctcgttttatacgcgtcatacctaagacctggaatcagtcaatcgctctgaggcttgagcttttcggatgcgatatatac

SEQ ID NO: 9126 - DNA, 6672 bp, Artificial Sequence
  Description of Artificial Sequence: Synthetic coding sequence
atgtttccgggttgtccgcgattatgggttttagtagttctaggtacgtcgtgggtaggttggggttcgcaaggtacggaagcggcgcaactacgtcaattttatgttgcggcgcaaggtatatcgtggtcgtatcgaccggaaccgacgaattcgtcgctaaatttatcggttacgtcgtttaaaaaaatagtttatcgtgaatatgaaccgtattttaaaaaagaaaaaccgcaatcgacgatatcgggtctactaggtccgacgttatatgcggaagtaggtgatataataaaagttcattttaaaaataaagcggataaaccgctatcgatacatccgcaaggtatacgatattcgaaactatcggaaggtgcgtcgtatttagatcatacgtttccggcggaaaaaatggatgatgcggtagcgccgggtcgtgaatatacgtatgaatggtcgatatcggaagattcgggtccgacgcatgatgatccgccgtgtctaacgcatatatattattcgcatgaaaatctaatagaagattttaattcgggtctaataggtccgttactaatatgtaaaaaaggtacgttaacggaaggtggtacgcaaaaaacgtttgataaacaaatagtattactatttgcggtatttgatgaatcgaaatcgtggtcgcaatcgtcgtcgttaatgtatacggttaatggttatgtaaatggtacgatgccggatataacggtatgtgcgcatgatcatatatcgtggcatttattaggtatgtcgtcgggtccggaattattttcgatacattttaatggtcaagtattagaacaaaatcatcataaagtatcggcgataacgctagtatcggcgacgtcgacgacggcgaatatgacggtaggtccggaaggtaaatggataatatcgtcgttaacgccgaaacatttacaagcgggtatgcaagcgtatatagatataaaaaattgtccgaaaaaaacgcgaaatttaaaaaaaataacgcgtgaacaacgtcgtcatatgaaacgttgggaatattttatagcggcggaagaagttatatgggattatgcgccggtaataccggcgaatatggataaaaaatatcgttcgcaacatttagataatttttcgaatcaaataggtaaacattataaaaaagttatgtatacgcaatatgaagatgaatcgtttacgaaacatacggttaatccgaatatgaaagaagatggtatactaggtccgataatacgagcgcaagtacgagatacgctaaaaatagtttttaaaaatatggcgtcgcgaccgtattcgatatatccgcatggtgtaacgttttcgccgtatgaagatgaagttaattcgtcgtttacgtcgggtcgaaataatacgatgatacgagcggtacaaccgggtgaaacgtatacgtataaatggaatatattagaatttgatgaaccgacggaaaatgatgcgcaatgtttaacgcgaccgtattattcggatgttgatataatgcgtgatatagcgtcgggtttaataggtctactactaatatgtaaatcgcgttcgctagatcgacgtggtatacaacgtgcggcggatatagaacaacaagcggtatttgcggtatttgatgaaaataaatcgtggtatctagaagataatataaataaattttgtgaaaatccggatgaagttaaacgagatgatccgaaattttatgaatcgaatataatgtcgacgataaatggttatgtaccggaatcgataacgacgttaggtttttgttttgatgatacggtacaatggcatttttgttcggtaggtacgcaaaatgaaatactaacgatacattttacgggtcattcgtttatatatggtaaacgtcatgaagatacgctaacgttatttccgatgcgtggtgaatcggtaacggtaacgatggataatgtaggtacgtggatgctaacgtcgatgaattcgtcgccgcgttcgaaaaaattacgactaaaatttcgagatgttaaatgtataccggatgatgatgaagattcgtatgaaatatttgaaccgccggaatcgacggttatggcgacgcgtaaaatgcatgatcgtctagaaccggaagatgaagaatcggatgcggattatgattatcaaaatcgtctagcggcggcgttaggtatacgatcgtttcgaaattcgtcgctaaatcaagaagaagaagaatttaatctaacggcgctagcgctagaaaatggtacggaatttgtttcgtcgaatacggatataatagtaggttcgaattattcgtcgccgtcgaatatatcgaaatttacggttaataatttagcggaaccgcaaaaagcgccgtcgcatcaacaagcgacgacggcgggttcgccgttacgacatctaataggtaaaaattcggtactaaattcgtcgacggcggaacattcgtcgccgtattcggaagatccgatagaagatccgctacaaccggatgtaacgggtatacgactactatcgttaggtgcgggtgaatttaaatcgcaagaacatgcgaaacataaaggtccgaaagtagaacgagatcaagcggcgaaacatcgattttcgtggatgaaactactagcgcataaagtaggtcgtcatctatcgcaagatacgggttcgccgtcgggtatgcgaccgtgggaagatctaccgtcgcaagatacgggttcgccgtcgcgtatgcgaccgtggaaagatccgccgtcggatctattattattaaaacaatcgaattcgtcgaaaatattagttggtcgatggcatttagcgtcggaaaaaggttcgtatgaaataatacaagatacggatgaagatacggcggttaataattggttaatatcgccgcaaaatgcgtcgcgagcgtggggtgaatcgacgccgctagcgaataaaccgggtaaacaatcgggtcatccgaaatttccgcgtgttcgtcataaatcgttacaagttcgacaagatggtggtaaatcgcgtctaaaaaaatcgcaatttctaataaaaacgcgtaaaaaaaaaaaagaaaaacatacgcatcatgcgccgttatcgccgcgaacgtttcatccgttacgttcggaagcgtataatacgttttcggaacgtcgtctaaaacattcgttagtattacataaatcgaatgaaacgtcgctaccgacggatctaaatcaaacgttaccgtcgatggattttggttggatagcgtcgttaccggatcataatcaaaattcgtcgaatgatacgggtcaagcgtcgtgtccgccgggtttatatcaaacggtaccgccggaagaacattatcaaacgtttccgatacaagatccggatcaaatgcattcgacgtcggatccgtcgcatcgatcgtcgtcgccggaattatcggaaatgttagaatatgatcgttcgcataaatcgtttccgacggatatatcgcaaatgtcgccgtcgtcggaacatgaagtatggcaaacggtaatatcgccggatttatcgcaagtaacgttatcgccggaactatcgcaaacgaatctatcgccggatttatcgcatacgacgctatcgccggaactaatacaacgaaatttatcgccggcgttaggtcaaatgccgatatcgccggatctatcgcatacgacgctatcgccggatttatcgcatacgacgctatcgttagatctatcgcaaacgaatttatcgccggaactatcgcaaacgaatctatcgccggcgttaggtcaaatgccgctatcgccggatttatcgcatacgacgttatcgttagatttttcgcaaacgaatttatcgccggaattatcgcatatgacgctatcgccggaattatcgcaaacgaatttatcgccggcgttaggtcaaatgccgatatcgccggatctatcgcatacgacgttatcgctagatttttcgcaaacgaatttatcgccggaactatcgcaaacgaatctatcgccggcgctaggtcaaatgccgctatcgccggatccgtcgcatacgacgttatcgttagatctatcgcaaacgaatttatcgccggaactatcgcaaacgaatttatcgccggatctatcggaaatgccgctatttgcggatctatcgcaaataccgctaacgccggatttagatcaaatgacgctatcgccggatttaggtgaaacggatttatcgccgaattttggtcaaatgtcgttatcgccggatttatcgcaagtaacgctatcgccggatatatcggatacgacgctattaccggatttatcgcaaatatcgccgccgccggatttagatcaaatattttatccgtcggaatcgtcgcaatcgttactattacaagaatttaatgaatcgtttccgtatccggatttaggtcaaatgccgtcgccgtcgtcgccgacgttaaatgatacgtttctatcgaaagaatttaatccgctagtaatagttggtttatcgaaagatggtacggattatatagaaataataccgaaagaagaagtacaatcgtcggaagatgattatgcggaaatagattatgttccgtatgatgatccgtataaaacggatgttcgaacgaatataaattcgtcgcgagatccggataatatagcggcgtggtatttacgatcgaataatggtaatcgtcgaaattattatatagcggcggaagaaatatcgtgggattattcggaatttgtacaacgtgaaacggatatagaagattcggatgatataccggaagatacgacgtataaaaaagttgtatttcgtaaatatttagattcgacgtttacgaaacgagatccgcgaggtgaatatgaagaacatttaggtatactaggtccgataatacgtgcggaagtagatgatgtaatacaagtacgatttaaaaatctagcgtcgcgtccgtattcgctacatgcgcatggtttatcgtatgaaaaatcgtcggaaggtaaaacgtatgaagatgattcgccggaatggtttaaagaagataatgcggttcaaccgaattcgtcgtatacgtatgtatggcatgcgacggaacgttcgggtccggaatcgccgggttcggcgtgtcgtgcgtgggcgtattattcggcggttaatccggaaaaagatatacattcgggtttaataggtccgctattaatatgtcaaaaaggtatattacataaagattcgaatatgccgatggatatgcgagaatttgttctattatttatgacgtttgatgaaaaaaaatcgtggtattatgaaaaaaaatcgcgatcgtcgtggcgtctaacgtcgtcggaaatgaaaaaatcgcatgaatttcatgcgataaatggtatgatatattcgttaccgggtctaaaaatgtatgaacaagaatgggttcgtttacatctattaaatataggtggttcgcaagatatacatgtagtacattttcatggtcaaacgttattagaaaatggtaataaacaacatcaattaggtgtttggccgctattaccgggttcgtttaaaacgctagaaatgaaagcgtcgaaaccgggttggtggctactaaatacggaagtaggtgaaaatcaacgtgcgggtatgcaaacgccgtttttaataatggatcgtgattgtcgaatgccgatgggtctatcgacgggtataatatcggattcgcaaataaaagcgtcggaatttttaggttattgggaaccgcgtttagcgcgtctaaataatggtggttcgtataatgcgtggtcggtagaaaaattagcggcggaatttgcgtcgaaaccgtggatacaagtagatatgcaaaaagaagtaataataacgggtatacaaacgcaaggtgcgaaacattatctaaaatcgtgttatacgacggaattttatgtagcgtattcgtcgaatcaaataaattggcaaatatttaaaggtaattcgacgcgtaatgtaatgtattttaatggtaattcggatgcgtcgacgataaaagaaaatcaatttgatccgccgatagtagcgcgttatatacgaatatcgccgacgcgtgcgtataatcgaccgacgttacgtttagaattacaaggttgtgaagttaatggttgttcgacgccgctaggtatggaaaatggtaaaatagaaaataaacaaataacggcgtcgtcgtttaaaaaatcgtggtggggtgattattgggaaccgtttcgagcgcgactaaatgcgcaaggtcgagtaaatgcgtggcaagcgaaagcgaataataataaacaatggttagaaatagatttactaaaaataaaaaaaataacggcgataataacgcaaggttgtaaatcgctatcgtcggaaatgtatgtaaaatcgtatacgatacattattcggaacaaggtgtagaatggaaaccgtatcgtctaaaatcgtcgatggttgataaaatatttgaaggtaatacgaatacgaaaggtcatgtaaaaaatttttttaatccgccgataatatcgcgatttatacgagttataccgaaaacgtggaatcaatcgatagcgttacgtttagaactatttggttgtgatatatat

SEQ ID NO: 9127 - DNA, 6672 bp, Artificial Sequence
  Description of Artificial Sequence: Synthetic coding sequence
atgttccctggatgccctaggctctgggtcttggtcgttctggggacatcttgggtagggtgggggtcgcagggtaccgaggccgctcagctccgtcagttctacgtcgccgcgcaggggattagttggagctataggccggaacctaccaactcatcgctgaacttgtccgttacatcttttaaaaagatagtataccgtgaatacgaaccttacttcaagaaggaaaagcctcaaagcacaatctccggtctcttggggcctactttgtacgcggaagtcggcgatatcataaaggtgcacttcaagaacaaggcggataagcccctctctatccatcctcagggtataaggtattcaaagctatccgagggggcatcttatttggatcatacatttcctgccgaaaaaatggacgatgccgtggctcccggtcgagagtatacttatgagtggtctatcagtgaagattccggaccaactcatgatgaccccccttgcctaacccatatttattattctcacgagaacctaattgaagacttcaactccgggctgatcgggcctctcctgatctgcaaaaagggtaccctgactgaagggggcacccaaaaaactttcgataagcaaatagtgttgctctttgctgtattcgatgagtcaaagagctggagtcagtccagcagcttaatgtacaccgtgaatggctacgtgaacgggacaatgcctgatatcacagtatgtgcacatgaccatatcagctggcatttgctcggcatgagctctggccctgaactgttttccattcactttaatggacaggtactggagcagaatcatcataaagtttctgccatcacattggtgtctgccacatccaccacagcaaacatgacggtgggtccggaagggaagtggattattagcagtctgacccctaaacacctgcaggccgggatgcaggcttatatcgatattaagaactgcccaaaaaaaacgaggaacttgaaaaagattacccgcgaacagagacgtcatatgaagagatgggagtatttcattgcagcagaggaagtcatctgggattatgcacccgtaattccagcaaatatggacaaaaaatataggtctcagcatctggacaactttagtaatcaaatcgggaaacactacaagaaggttatgtatactcagtatgaggacgaatcctttacgaaacacactgttaaccctaacatgaaagaggacggaatccttgggcccattatcagggcacaggttcgggacacattgaagatcgtgttcaaaaatatggcttcccgaccttactctatatacccccacggtgtgacctttagcccctatgaggatgaggtcaatagttctttcacaagcggaaggaataatacaatgatccgcgccgtgcaacccggggagacatacacctacaagtggaatattctggagttcgacgagcctacggagaatgacgcccaatgcctcaccagaccttattattcggatgttgatattatgagagatatagcatccggcctaattggccttctgctcatttgcaagagcaggagtctggatcgcaggggtatccagcgtgccgccgacatagagcaacaggccgtgttcgccgtgttcgacgaaaataaatcttggtaccttgaggataacattaataagttttgcgaaaaccccgatgaagtgaagcgggatgatcccaagttctacgaaagcaatataatgagtacaattaacgggtacgttcctgaaagcatcactacccttgggttttgcttcgacgataccgtccagtggcatttctgttccgtaggtacacagaacgagatcctcaccatccattttactggccactccttcatatatggtaaacggcatgaggacacattgacactgtttcccatgaggggggagtctgtgaccgtaaccatggataacgtcggcacatggatgctgacgagcatgaactcctccccacgtagcaagaagttgaggttgaagtttcgagacgtgaaatgcatccccgacgatgatgaggattcctatgagatttttgagccccccgaatccacggtgatggctacccggaaaatgcacgataggctggaacctgaggacgaggagtccgacgccgactacgactatcagaacagattggcagcggccctgggaatcaggagcttcaggaattcctcacttaaccaagaagaagaggagttcaaccttacagcactcgccctcgaaaacgggactgaattcgtttcatccaatactgacatcatcgtaggatccaattattccagtccgagtaatatatctaaatttaccgttaataatctcgccgaaccgcagaaggccccgagtcaccagcaggcaaccaccgccgggagtccattacgccaccttattggaaaaaactccgtcctgaatagctctacagcggagcacagcagcccatatagtgaagaccccatcgaagatccactacagcctgacgtgaccggcataagactcctgtcccttggcgccggcgaatttaagagccaggaacatgcgaagcataaaggacccaaagtggagagagaccaggccgctaagcacagattctcatggatgaaactgctggcacataaagtgggcagacatttaagtcaggacacaggctccccaagtggtatgcgaccctgggaagatttgccctcacaggacaccggcagcccaagtcgcatgcgtccttggaaggacccccccagtgatctgctgctactgaaacagtcaaactcttcaaagatcctggttggtcgatggcatcttgcttccgaaaaaggaagttatgaaatcattcaggatacagacgaggataccgccgtaaataactggttgataagcccacagaatgcgtccagggcctggggggaaagtaccccgctggccaacaagcccgggaaacaatctggccaccccaagttcccgcgggtcaggcataagtcgctacaggtgcgacaggatggcggaaaaagtcggctcaagaaatctcaatttctcatcaaaactaggaagaagaaaaaggagaagcatacacatcatgcgccactaagccctcgaaccttccatcccctgaggtctgaggcttacaatacgttcagcgagaggagactgaagcactccctcgtgttgcataagtccaatgaaacgagcctgccaactgatcttaaccagaccctgccctccatggacttcggatggatcgctagcctgccggatcacaatcagaattcatctaacgatactgggcaggcctcctgtccgccgggcctctaccaaacggtccctcccgaagagcactatcaaactttccccatccaggatcccgatcagatgcactccacaagcgacccgtcacacagaagtagttctccggaactcagcgagatgttggaatacgatcggagccataaatcgttccctaccgatatctcccagatgagcccctccagcgaacatgaggtctggcagaccgtgattagcccggatttatctcaagtcacgctgtctcctgagctgtctcaaaccaacctgagccccgacctcagtcatacaacactttcaccagaactgattcaacggaatctaagtcctgccctgggacagatgccgatctctcctgacctttcacacactacgctgtcccctgacctatcccacacgactcttagcctggatttgagccaaaccaatctctcccccgagctgagccagactaacctttcacctgctttaggccagatgcccctctcacccgacttgagtcatacaacattgtcactcgacttttcacagactaacctttctcccgagttgtcacatatgactctgtcgcccgagttgagtcaaactaatctgagtcccgccctgggacagatgcctatttcgcctgacctgtctcacacaaccctaagtctggacttttctcagaccaatttgagtcccgagctgagtcaaacaaatctgtcaccggctcttggacaaatgcctctctccccagatccatctcacaccactctctctcttgatctctcgcagaccaacttatctccagagctgtctcagaccaacctgtccccagatctttctgagatgccgttgtttgcggacctgagccagattcccctcactcctgacctggatcaaatgacactcagtcccgacctgggcgagaccgatctttctccaaactttggacagatgtctttgtccccagacttgagccaggtgacgctgtctccggacatatctgacactacgttgctacccgatctgtcacaaatatcacctcccccggacttagatcagatattttaccctagcgagagtagtcagtctctcctacttcaggaattcaacgaatcctttccttatccggatctggggcagatgccctccccctcgagcccaactttgaatgacacattcctgagcaaagagttcaatccattagttatagttggactctctaaggacggaacagactatatcgaaatcatacccaaagaagaagtgcagtcttctgaagatgattacgcggagattgactacgttccatatgatgacccctacaaaacagacgtccgaacgaacataaattcctcccgggacccagataatattgccgcatggtaccttcgctccaataacggaaatagacggaattactatattgccgccgaggagatttcttgggactattccgagttcgtgcaaagggagaccgacattgaggatagtgacgatattcccgaggacaccacttacaagaaagttgttttcagaaaatacctcgactccacttttactaaacgcgacccccggggtgaatacgaagagcacttgggcattttaggtcccatcataagagctgaagtcgacgacgtgatacaagttcggtttaaaaacctggcttccaggccatatagcctccatgcacacggccttagttatgaaaagagtagcgagggcaagacctatgaggatgacagcccagaatggttcaaggaagataacgccgtgcagccaaatagcagttatacttacgtttggcatgctacagagagatccggaccagagagccccggcagcgcctgtcgcgcctgggcctactattctgcggtcaatccagaaaaggacatccattctggtctcataggtcctctgctgatctgtcagaagggtattctgcacaaggactcgaacatgccaatggacatgagagagttcgttttgctcttcatgacctttgacgagaagaagagttggtattacgagaaaaaaagcagatccagctggaggcttacatcttcggaaatgaaaaaaagccacgagtttcatgcgattaatggcatgatttattccctccccgggctgaagatgtacgagcaagagtgggtgcgactgcatttgctcaacattggtggttcccaggacattcacgttgtccatttccacgggcagacacttctcgagaacgggaacaagcagcatcagctgggcgtgtggccgcttctgcccggatctttcaagacacttgaaatgaaggcgtctaaacccggctggtggctgctgaacacggaggtgggggagaaccagcgggctggtatgcaaacccccttcctcataatggatagagactgccgcatgccaatgggtctcagtacgggcatcatttctgacagccagattaaagcgtccgaattcctcggatattgggaacctagactagctcggttgaacaatggcggaagctacaacgcttggtcagtggagaagctagcagctgaatttgcgagtaagccttggattcaggtcgacatgcagaaagaggtcatcataactggcattcagacccagggagccaagcactatctgaagtcctgttacactacggaattttatgtagcctacagctccaatcagattaattggcagatcttcaaagggaatagtacaagaaacgtgatgtatttcaacggaaacagcgacgcgagcactatcaaagagaaccagtttgatccgcctattgtagctaggtacattaggatctcacctacgcgggcttacaacaggcctacactgaggttggagctgcagggctgtgaggttaacgggtgtagtaccccacttggaatggaaaacgggaagatagaaaataaacagatcacggcgtcctcatttaaaaaaagctggtggggcgactattgggaaccgtttagggctcgtctgaacgcacagggcagagtgaatgcatggcaggcaaaagcaaataataataagcagtggcttgaaattgatctccttaaaatcaagaagattaccgccatcatcactcagggatgtaaaagtctttcttcagaaatgtatgtgaagagttacactattcactacagcgaacagggcgttgaatggaaaccttaccgcctgaagagttccatggttgataaaatttttgaaggtaacaccaataccaagggccatgtaaagaacttttttaatccccctatcatcagtcgatttatccgcgttattccgaagacctggaaccagtcaattgctcttcggctggagctttttgggtgtgacatatac

SEQ ID NO: 9128 - DNA, 6672 bp, Artificial Sequence
  Description of Artificial Sequence: Synthetic coding sequence
atgttcccagggtgcccaagactttgggtcttagtcgtcctgggaacatcttgggtaggatggggatcgcaagggacagaagctgcccagctaaggcagttctacgttgctgctcaggggatcagttggtcatatcgtccagaaccaaccaactcttccctgaacttaagcgtaacttcctttaagaagatagtgtaccgagagtatgagccatactttaaaaaggagaaaccccagtccaccatttcaggcctgctgggacctacgctttacgccgaagtgggagacatcattaaggtgcacttcaaaaacaaggctgataagcccctttcaattcacccacaaggaattcggtattccaaattatccgagggcgcctcttatttggatcacacctttccagccgagaagatggatgacgccgtggccccgggcagagagtacacgtacgaatggtccatcagcgaggacagtggccctacacacgatgatccgccttgcctcactcacatatactactctcacgaaaatctcatcgaagactttaactcgggtttaattggaccacttttaatctgcaagaaaggtaccttaactgagggtggcacccagaaaacgttcgacaagcagatcgtgctgctcttcgccgtgtttgatgaatccaaaagctggtctcagtcttccagtttgatgtacactgttaacgggtacgtgaacgggaccatgcccgacattaccgtctgtgcccatgaccacatttcatggcaccttcttggcatgagctcaggcccagaacttttctctattcacttcaacgggcaggtgctggagcagaatcatcacaaggtctcagctatcactttagtgtccgcaacttccaccaccgctaatatgaccgttggacccgaagggaaatggataatttccagcctgactcctaaacacctccaggccggaatgcaggcctacatcgatatcaaaaactgtccaaaaaagactaggaacctgaaaaaaattacgcgagagcaacggcggcacatgaagaggtgggagtattttatcgcggctgaagaggtaatttgggactacgctccggtcattcctgccaatatggacaaaaagtaccgctcccaacatctggacaacttctctaaccaaatcggaaagcactacaagaaggtaatgtatacgcagtatgaggacgaaagcttcactaagcataccgtaaaccccaacatgaaagaagatggcatcctcgggccaatcatcagagctcaggtgcgtgatacgcttaagattgtgttcaagaacatggcctcaagaccttacagcatttacccacatggggtgacattttccccctatgaagatgaagtgaacagttcatttacctccgggagaaacaacactatgatcagggctgtacagcccggagaaacctacacatacaagtggaatattctagaatttgatgagcctaccgaaaacgatgcgcaatgtctcacacgaccatactattcagatgtggatattatgagggacatcgctagtggcctgattgggttgctgttgatctgtaagtccaggagcctcgaccgccgagggatccagagagctgccgacatcgagcaacaggcagtattcgccgtgtttgacgagaacaaaagctggtatttggaggacaacatcaacaagttctgtgagaatcctgacgaagtcaaacgagacgatcccaagttttacgaatccaacatcatgtcaactattaatggttacgttcccgagtccatcacaactctgggattttgcttcgatgataccgtccagtggcacttttgttctgtggggacccagaatgagatcctcaccattcattttacaggacattcgtttatctacggaaaaagacacgaggacaccttgacgctgttccctatgcgtggagagtctgtcactgtgaccatggacaacgtgggaacgtggatgctgacgtccatgaattcttctcctaggtcaaagaagctaagactgaaatttagagatgttaagtgtataccagacgatgacgaagattcctatgaaatctttgaacctccggagagcaccgtcatggctacccggaaaatgcacgacaggctcgaacctgaagacgaggagtccgacgcagactacgactatcaaaaccgactggcagctgctttgggcatacggtctttcaggaactcatccctaaatcaagaggaagaggagtttaatctcactgccctggctctcgagaacgggactgagttcgtctcctccaacaccgacataatcgtgggcagtaattacagtagcccatctaacattagcaaattcacagtaaacaacctggccgagccacagaaagcaccatctcaccagcaggcaacgacggctggctctccactgagacacctgatcgggaagaacagcgtgttgaattcttcgactgcggaacacagtagtccctactctgaagatcctattgaggacccactgcagcctgacgtcactggcattaggttactctcactcggtgccggggaatttaagtcccaagaacacgctaagcataagggccccaaagtggaacgcgaccaggccgccaagcatagattcagttggatgaagctgctggcccacaaagtcggcagacatctaagtcaagacacgggtagcccttctggaatgcgaccttgggaggacctgcctagtcaggatactggtagtccgagtcgtatgaggccctggaaggacccaccatcagatttgttactgttgaaacagtcaaattcctctaagatcctggtgggccgctggcacctggcttctgaaaagggatcttatgaaatcattcaagatacagacgaagatactgccgtgaacaactggctcattagccctcagaatgcctccagagcgtggggggagagcactccacttgccaacaaacctgggaagcagtccggccaccctaagttccctcgggtacgacataagtcattgcaggtgaggcaggacggcgggaaatctcgccttaagaaatcccagtttttaattaaaaccaggaaaaaaaagaaagaaaagcacacacaccatgcgcctttgtccccaagaacatttcacccactcaggtctgaagcttataatacattctctgagcgtagattaaagcactccctcgttctccataagtccaacgaaacctctttgcctactgacctgaatcaaaccttaccttccatggactttggttggatcgcaagtctcccagaccacaaccagaattcctctaatgatacgggtcaagcgtcatgtcccccaggattgtatcagacagtcccacctgaggaacattatcaaaccttccctatccaagatcctgatcaaatgcatagcacgagtgatccttctcaccgctcttcatccccagaacttagcgaaatgctcgaatatgaccgatctcacaagtcgttcccgacagatattagtcagatgagcccatcaagtgagcatgaggtttggcagacagtgatatcccccgacctgtcacaggttacactgagccctgaactgtctcagacaaatctgtcgccggatttatcacacactacactctcacctgaattaatacagaggaatcttagccctgctctgggtcagatgcccatttcccctgacctgagtcacaccactctttcccctgatctgtcccatacgactctgtccctggatctttctcaaacaaacctgtctcccgagttgtcacagaccaacctgtcccctgcgttgggtcagatgcccctctcccctgatctttcccacacaacattgagcctggatttctcacagactaacttatcaccagaattgagtcacatgacactgtccccggagctgagtcagaccaatctctcccccgccctgggacagatgccaatttccccagacctctcgcataccacactttccctcgatttctcccagacaaacctttcaccggagttgtctcagactaacctctcccccgcgctcggacagatgcctctgtctcccgaccccagtcatactaccttgagcctggacttaagtcagaccaacctttctcccgagctgtcgcagacaaatctaagccctgacctgtcagagatgccacttttcgcagatctttcccaaattccccttactccagacctggaccagatgacattgtctccagatttgggtgaaactgatctgagtcccaactttgggcaaatgtcgctctcccccgatctgtctcaggtgaccctctctcccgatatatctgacacaactctgctcccagacctgtcacagatatcccctccacctgacctggatcaaatcttttatccatccgagagttcccaaagcctgctgctccaggagttcaacgaatccttcccctatccggatttaggtcagatgccctctccttccagccccaccttaaacgatacttttctgagcaaagagttcaaccctttggttatcgtgggcctaagtaaagatggaacagactacatagagatcatccccaaggaggaagttcagtcttccgaggacgactacgccgaaatcgattacgtgccgtatgatgacccgtacaaaaccgatgtacgaaccaacatcaacagttcacgagatcctgacaacatcgccgcttggtacttacgctccaataacggcaatcgcaggaattactacattgccgccgaagagatctcttgggactacagcgaatttgtgcaaagagaaacagacatcgaggattccgacgacataccagaggacaccacttataagaaggtggtttttaggaagtacctggatagcacattcaccaagagagacccgcgcggcgaatacgaggagcacttgggcattttgggaccaattatccgcgcggaagtagatgacgtgatccaggttagatttaagaacctggcttctaggccttattccttgcacgcccatggtttgagttacgagaaatctagcgagggcaaaacatacgaagacgattcccctgaatggtttaaagaggataatgccgtccagccaaactccagttacacctacgtgtggcacgcaactgaaagaagcggtcctgagtcgcctggttcagcatgcagagcatgggcgtactattcggcagttaacccggagaaggacattcattctggcctaatcggtcctctgctcatatgccagaaaggtattcttcacaaggactctaatatgcccatggacatgagagaatttgtgcttctctttatgacatttgacgaaaagaagtcttggtattatgagaagaaaagcagatcgtcctggcgactcacctctagcgaaatgaagaaaagccatgagtttcacgctattaacggcatgatctactcactgcctggactgaagatgtacgaacaagaatgggtccgactacatcttctgaatatcggcggaagccaagatattcatgtggtgcattttcatgggcagacactgctggaaaatgggaataaacaacaccagctcggcgtgtggcccttgttgccaggatccttcaaaacgttagaaatgaaagcctccaaacccggatggtggcttctgaacacagaggtgggggagaaccagcgtgcaggtatgcagacaccctttttgatcatggatcgcgattgccggatgccaatggggctgtcaaccggcatcatttcagacagccagattaaggcatctgaattcctgggctactgggagcctcgacttgccagattaaataacgggggatcctacaacgcatggtcagtggagaagttagccgccgaattcgcttccaagccctggattcaggtcgacatgcagaaagaagtgataattaccgggatacagactcagggcgccaagcactatctgaagagctgttataccaccgaattttacgtggcttatagttctaatcagatcaactggcagatttttaagggaaattctacgcgaaatgtcatgtactttaacggaaatagcgacgcctccaccatcaaagaaaatcagttcgaccctcctattgtggctcgttacataagaatttcgcctaccagagcatataatagaccaacgctacgactcgaactgcagggatgtgaggtgaacggctgtagtactcccctggggatggaaaacggaaaaatcgaaaataaacaaattactgcttccagcttcaagaaaagctggtggggcgattactgggaaccctttagagcacggctgaatgcccagggccgagtcaatgcctggcaagccaaagctaacaacaataagcagtggctggaaatcgacctgctgaagatcaaaaagataaccgctataatcacccaaggctgtaagtccctctcttcagagatgtatgttaaaagttatacaatccactacagcgagcaaggcgtcgaatggaagccatatcggctcaagtcctctatggtagacaagatcttcgaggggaatacgaacacaaagggccacgtcaaaaatttcttcaacccacctataatcagtcgatttatccgagttattccgaaaacctggaatcaatctatcgctctccgactggaactgtttgggtgtgatatatac

SEQ ID NO: 9129 - DNA, 6672 bp, Artificial Sequence
  Description of Artificial Sequence: Synthetic coding sequence
atgttccctgggtgccccaggctgtgggtgctggttgtcttgggaacctcttgggtcgggtgggggtctcaggggactgaggctgcccaactgaggcagttttatgttgccgcccaaggaattagttggtcttatcgacctgagcctacgaactcaagtctgaatctgtcagttactagctttaaaaaaatcgtttatcgcgagtatgagccctattttaaaaaagaaaagccacagtcaactatttctggtctgctcgggcctaccctctacgccgaagtgggtgatatcatcaaggtgcacttcaaaaacaaggccgacaagccactgagtattcatccgcagggcatcaggtattccaagcttagtgagggcgcgagttatcttgatcacacgttccccgccgaaaagatggatgatgccgttgccccggggcgtgaatacacatatgagtggagcattagtgaggactctgggccaacgcatgacgacccgccttgtctgacccacatctattactcacatgagaacctgattgaggacttcaatagtggattgatcggcccgttactcatctgcaagaaggggaccttaactgagggcgggactcagaagactttcgataagcagatcgtcctgctgttcgctgtcttcgatgagtctaagagttggtcccagagttcaagcctgatgtacaccgtaaatggttacgtgaatgggaccatgccagacatcacagtgtgcgcccacgatcatatatcatggcacctgctgggcatgtctagcggtcccgagcttttctctattcacttcaacggtcaagtgctcgaacagaaccatcacaaagtcagcgcgatcacccttgtctctgccacctccacaacagcgaacatgactgtgggacctgagggaaagtggattatttccagtctgacacccaaacatctacaggcaggcatgcaagcctatatcgacattaaaaattgccccaagaagacacggaatctgaaaaagatcaccagagaacaacgacgacacatgaagcgttgggagtactttatagcagctgaggaggtcatttgggattatgcacccgtgattcccgccaatatggacaaaaaataccgatctcagcatttagacaacttctctaatcagattgggaaacactacaagaaggttatgtacacacaatacgaggacgaaagcttcactaagcacacagtcaaccccaacatgaaggaagatgggatcctgggtcctataattcgggcacaggtccgcgacaccttaaaaatagtatttaaaaacatggcctctaggccctacagtatttatccacatggcgtaacattttctccttacgaagatgaggtcaacagctctttcaccagtggcagaaacaacaccatgattcgagcagttcagcccggagagacctatacatataagtggaatatattagagttcgacgaacctacggagaatgacgcgcaatgtcttacccgtccatactacagcgatgtggacatcatgcgagacatcgctagcggacttatcggcctgcttcttatctgtaagagtcggtctctcgataggaggggcatccagcgtgcagctgatattgaacagcaggctgttttcgctgtgtttgatgaaaacaaatcgtggtacctggaagataacattaataagttctgtgagaacccggacgaggtgaagcgcgatgatcctaagttctacgaatctaatataatgagcaccattaatggctacgttccagaatcaatcaccactttgggcttttgctttgacgatacagtccaatggcacttttgcagtgtgggtacacagaacgagattcttactattcactttacaggacatagcttcatctacggaaagcggcacgaggacaccctcactctgtttcccatgagaggggaatccgtcaccgtgactatggacaatgtaggcacttggatgctcacaagcatgaacagttctccacgctccaagaagctgcgccttaagtttagggacgtgaaatgcatccctgatgacgatgaggattcctacgagatcttcgaaccccctgaatctactgtgatggccacaagaaagatgcatgatcgcttggagccggaggacgaagagtccgacgctgactatgattaccaaaatcgcctggctgcagcgctgggtatccgatcttttcgcaactcctccctgaatcaggaagaagaggaattcaacttgaccgcattggccctggaaaacgggactgagtttgtcagctccaacacagatataatcgtcggtagtaattacagttccccctcaaacatctccaagtttactgtgaacaatctcgccgagccccaaaaggcaccttctcaccagcaggcaacaactgctggcagccctcttaggcatctcattgggaagaacagtgtcctcaactcgtccactgccgagcattcctctccctactcagaggacccgatagaggacccattacagccggatgtgaccggaatcagattgctgtcactaggcgccggggaatttaagtcacaggaacacgccaaacacaaaggcccaaaggtggaacgcgatcaagccgctaaacaccggtttagctggatgaagctgctcgcgcacaaagttggacgtcatttgtctcaggacaccgggagcccttctggtatgcgtccctgggaagaccttccctcccaagacaccggttccccatccaggatgagaccgtggaaggatccaccaagcgatctcctgctgctgaaacagagtaactctagcaaaatcctggtgggtcgttggcatcttgcatcagaaaaggggtcttacgaaattatccaggatacagacgaggacaccgctgtgaacaattggctcatctcaccgcagaacgcgtcccgtgcctggggcgagagcacgcccctggcaaataagccagggaagcagtctggccatcctaaatttccacgggttcgccacaagtctctgcaggttcggcaggatgggggtaagtcgcgcctgaaaaagtcacagttcctcatcaagacgcgtaagaaaaaaaaagagaaacacacccaccacgctccactgtctccccggacgtttcacccgcttaggagcgaggcgtacaacacctttagtgaacggcggctgaagcactccctcgtgttacataagtcaaacgaaactagtctcccaaccgatcttaatcagactctaccatctatggacttcggctggatcgcctcactccctgaccacaaccaaaattcctctaatgacacaggccaggctagctgtccgcctggcctataccaaaccgtccccccagaagaacactaccagacgttcccaatccaggatccggaccagatgcatagcacctctgaccccagccacagatcatcttctcccgagttatccgagatgctggaatacgacagatcccataagtcctttcccaccgatatctctcagatgtctccttcgtccgagcatgaggtttggcagaccgtgatctctcctgacttgagccaagtaactctctcacctgagctgtcacaaactaatctctccccagatctctcccacactaccctcagtccggagctaatccagcgtaatctgtcacccgctctgggccagatgcccatttccccggatctgtctcatacaacactgtctcctgacctgtctcacaccactctttcactggatctcagtcagaccaacctcagccccgagctgagtcagacaaatctctcacccgcgctgggtcagatgccactctctcctgacctaagtcataccactttgtctctggacttctctcagaccaacctctcacctgagctgagccatatgacgctgagcccagaactgtctcaaaccaacctgtctcctgccttggggcagatgccaatctcacctgacctatcccatacgacgctgtccctggacttttcccagacaaatcttagccccgaacttagccaaacaaacctcagtccagcactgggacagatgcccctgagtcctgatccttctcatactacactgtccctggatttgtcacagactaatctgagccctgagctgtctcagacaaatctttcaccagatctgagcgagatgccccttttcgctgacttgtctcagatccctttgacgcctgatcttgatcagatgacgctcagccccgatctcggagagacagacctatctcccaacttcggccaaatgagcctctcccccgacctgagccaagtgaccctgtcacccgacattagtgataccactctgctcccagatctgtcacagatttcacccccacccgacctagatcagattttctacccctctgaatccagtcagtccctattgcttcaagaatttaatgaatctttcccttatcccgatctggggcaaatgccctccccaagcagccccacactgaatgatacctttctgagtaaagagtttaacccactggtcattgtgggcctgagtaaggacgggactgattatatcgaaatcatcccgaaagaagaagtccagtctagtgaggatgactacgctgaaatagactacgtgccttacgatgatccgtataagaccgacgtgaggacaaacataaattccagcagggacccagacaatatcgcagcctggtaccttcggagcaacaatgggaaccggcgtaattactacatcgccgccgaagagatctcatgggattactctgagttcgtccagagggagaccgatatcgaggactccgacgatatcccggaagatactacctacaagaaagtcgttttccgaaagtacctcgattccaccttcaccaaaagggaccctcgaggtgaatacgaagagcacctgggcatcttgggtccgattattagggctgaagtcgatgacgtaattcaagtgcgttttaagaacttggcgtctaggccatacagtctccatgctcatggtttaagctatgagaagtcctccgagggcaagacctatgaagacgatagtcctgaatggttcaaggaagacaacgcagttcagcccaattcttcctacacatatgtttggcatgcgactgagaggtctggccctgagtctcccggttctgcttgtagggcatgggcctattatagtgccgtgaatccggagaaggatattcactctggccttatcggtcctctgctgatctgtcaaaaaggcattctgcacaaagactccaacatgcccatggatatgagggagttcgtgctgctgtttatgacatttgacgagaagaaaagctggtattacgaaaaaaaaagcagatcctcgtggcggctgactagtagcgaaatgaagaagagtcacgagtttcatgccatcaatgggatgatctacagcttgcccggtctgaaaatgtatgaacaggagtgggtgcggttacacctgctgaatataggcggaagccaggatatccacgtggtccacttccacgggcaaaccctgctggaaaatggaaacaaacagcaccaactgggggtatggcctctgttgcctggaagttttaagaccctggaaatgaaagcgtccaagcccggctggtggctgctaaacacagaagtgggggaaaaccaacgggcaggaatgcaaacgcccttcctgattatggatcgagactgtcggatgcctatggggttgtctacagggatcatctccgactcacaaattaaagcgagtgaatttctgggctattgggagccaaggttggcaagattgaacaatggcggtagctacaatgcctggagcgttgagaagctagcagccgagttcgctagcaagccatggatccaagttgacatgcagaaggaagtaatcatcacgggcatccaaacacagggagcgaaacactacttgaagtcatgttacaccaccgaattttatgttgcctactcgtccaatcaaatcaattggcaaatttttaagggcaattcaactcgaaacgtgatgtattttaacggcaactcggacgctagcactatcaaggaaaatcagtttgatcctcccatagtggctaggtacattcgtatctcccctacccgggcatacaacaggccaactctgagactagagttgcagggatgcgaggtgaatggctgcagcaccccgctgggaatggagaacggaaagatagaaaataagcagatcaccgcatcaagcttcaagaagtcctggtggggagactattgggagcccttccgtgcacgtcttaatgcgcagggacgcgttaatgcctggcaagcgaaggccaacaataataagcaatggctagagatcgatctgctgaagatcaagaaaataactgccataatcactcagggctgtaagtctctttccagcgagatgtacgtcaagtcttacactatacactattccgagcaaggcgttgagtggaagccatacaggctaaaatcctcaatggtcgataagatcttcgaaggcaataccaatacgaagggccacgtgaagaacttcttcaacccaccgatcatcagtagattcatccgtgtaatccctaagacgtggaaccagtctatcgccttacggcttgagctgttcgggtgcgacatctac

SEQ ID NO: 9130 - DNA, 6672 bp, Artificial Sequence
  Description of Artificial Sequence: Synthetic coding sequence
atgttcccaggctgtccaaggctctgggtcctcgtcgtgctgggtaccagttgggtgggttggggtagtcagggaacagaggctgctcagctcagacagttctatgtggcggcacagggcatttcttggtcatatagaccggagcctactaattccagccttaacttgtctgtgacctcttttaagaagattgtttacagagaatacgaaccatacttcaaaaaggagaaacctcagtcaacaatctcaggtctccttggccctactttgtacgctgaggtgggcgacattattaaggtgcactttaaaaataaggctgataagcctctctcaatacaccctcagggaattaggtattccaaactttccgagggtgccagttacctcgatcacacgttcccagctgaaaaaatggatgacgctgttgcgcccggtcgcgaatacacctacgaatggtccatctcagaggattccggccctacccatgatgaccctccctgtttgacgcatatctattattcccacgagaatttgatcgaggacttcaacagcggactgatcggtccgcttctgatctgcaagaaaggcacgctgaccgagggaggaactcaaaagacatttgataaacagattgtccttcttttcgccgttttcgacgaatcaaagagttggtcacaaagctcttctctcatgtataccgtgaacggttatgtgaacggaaccatgccagatattaccgtgtgcgctcacgatcatatctcatggcatttgctgggtatgtcctcaggaccggagttgttctccatccactttaatggtcaggtcttggagcaaaaccaccacaaagtgtccgcgatcacactggtgtccgctacaagtaccactgccaacatgacggtaggacctgagggcaagtggattatctcaagcctgacccctaaacacttgcaagccggaatgcaagcttacatcgacatcaaaaattgtcctaaaaaaacgagaaacctgaaaaagataacaagagaacaacgcagacatatgaaacgctgggagtattttatagcggcagaagaagtgatttgggactatgcccctgtgatacctgccaacatggataagaagtacagaagtcaacacctcgacaacttcagcaatcagatcggtaaacattacaagaaagtaatgtatacacagtacgaagacgagtccttcaccaagcatactgtgaatcccaatatgaaggaggacggaattttgggccctatcataagggcccaggtaagagacacactgaaaatcgtgtttaagaatatggcatccagaccctatagcatttatcctcacggagtgactttctccccctacgaggacgaggtgaatagttcctttacatctggtagaaataacactatgatcagagcggtccaacccggtgaaacctacacatacaagtggaacatcctcgaattcgacgagcctaccgagaacgacgcccagtgccttactagaccgtattattctgacgtagacatcatgagggatatagcatccggcttgataggtctgcttctgatttgcaagtccaggtcattggacaggcgcggcattcagagagcagctgacattgaacaacaggctgtgtttgccgtttttgacgagaacaagtcatggtacctggaggataatataaacaagttctgcgaaaatcctgacgaggtgaagagagacgacccaaagttttacgaaagtaatattatgagcactattaatggatatgtcccggaatctattacaacgctgggattctgctttgatgataccgtgcagtggcacttctgttccgtgggtacgcagaatgagatcctgaccatccacttcactggtcattccttcatctacggaaaacgccatgaagatacacttacgctctttccaatgaggggtgaatctgtaacggtcaccatggataatgttggcacgtggatgctcacgagtatgaactcttccccacgctctaagaagctccgccttaagtttcgcgatgtgaagtgcatacccgacgacgatgaggattcttacgaaattttcgaaccgccagagtcaaccgtaatggcgaccagaaagatgcacgacaggctcgagcctgaggacgaagagagtgacgcagattacgactaccagaacaggctcgccgctgccctcggaatccgctccttcaggaactcttcactcaaccaggaggaggaggagttcaacctcacagcgttggccctggagaacggtacggaattcgtttcaagtaatactgacattattgttggaagcaattactctagcccgtcaaacatcagtaagttcacggtcaacaatttggctgagccacagaaggccccctctcatcagcaagcgaccacagcgggatctcccctgagacacctgatcggtaaaaattccgtattgaattcatccactgccgagcactcctccccttactctgaagatcccattgaagaccctttgcagcctgacgtgaccggtattcgccttctctccctgggcgcgggcgagttcaagtcccaggagcacgctaaacacaaaggaccaaaggtagagagagaccaggctgccaagcatagattcagttggatgaagttgctggctcacaaagtgggaagacatctgagtcaggacactggatcaccttcaggaatgagaccttgggaagaccttccatctcaggacacgggaagcccaagtaggatgcgcccatggaaggacccacctagcgacctgctgctcttgaaacaaagtaacagttcaaagatcctggtcggacgctggcatctcgccagtgaaaaaggttcttatgagataatccaggatactgatgaagacacagccgttaacaactggctcatcagcccccagaatgcaagcagggcttggggcgagtctacgcccctggctaataaaccaggcaagcagtctggtcatcctaagtttccaagggtcagacacaaatccctgcaggtcaggcaagatggcggtaagtcccgcctcaagaagagtcaattccttatcaaaacacgcaagaaaaaaaaagagaagcacacccaccatgcccctctgtctcctaggacttttcatccattgagaagtgaggcatacaacacctttagcgaaaggagactgaagcattctttggttttgcacaagtccaacgagacttctctgccaactgatctcaaccagacgctgccaagcatggactttggttggatcgccagtctgcccgaccataatcaaaactcatccaacgatacgggacaggcctcatgccccccaggcctttaccagaccgtccccccagaggagcactaccagacctttccaatccaagaccctgaccaaatgcactctacttctgatccatcccataggagtagctcacctgaactctctgagatgctggagtacgacagatcccataagtccttcccgaccgacatctctcaaatgtctccatcaagcgaacacgaagtatggcagactgtaatctcaccggacttgtcccaggtgacgctgagtcccgagcttagccaaaccaacctcagccccgatttgtcacacactactttgagccccgaattgatccagcgcaatctgtctcccgccctcggacagatgccaatctcccccgacctctcccatacaactctcagtccagatctctcccacacaactctttctttggacctgagccaaaccaacctttcacccgagcttagccagaccaacctgtctccggcattgggccagatgcctctgtccccagatctcagccacaccaccttgagcctggattttagccagacgaacctgagtccggagctttctcacatgactctgagtcccgagctttcccaaaccaatctttctccagccctgggtcagatgccaatctcacctgaccttagtcataccaccctttcactggatttttcccagaccaatttgagtccagagctgagccagactaacctttcacctgcacttggtcagatgcccctctctccagatccatcacacactaccttgtcattggatctgtcacaaaccaacctgtcacctgagctctcccaaacaaacttgtctcccgatctgtcagagatgccgttgtttgctgatttgtctcagattcctctgactccggaccttgaccagatgacactcagccctgaccttggagagacggatcttagtcctaatttcggccagatgtccctgagccccgatctgagccaagtgacattgtccccggatatctcagacacaaccctcttgcctgatctgagccagatctccccgcccccagatctggaccagatcttttacccttccgagagcagtcagtcactgctgctgcaggaatttaacgaatccttcccttatccggacctgggacagatgcctagcccgagcagccctaccctgaatgacactttcctgtccaaagagtttaaccctctggtgatcgtgggtttgtccaaggatggcacggactacattgagattatccctaaagaggaagtgcaatcatccgaggatgactacgccgaaattgactacgtcccatacgacgacccttacaagaccgatgtacgcacaaacattaacagtagtcgcgacccggataatatagctgcctggtatttgaggagcaataatggtaatcgcagaaactactatatcgccgcagaagagatcagctgggattactccgaatttgttcaaagggagacagatatcgaggactctgacgacatcccggaagacaccacttacaagaaagtcgtctttagaaagtatcttgactctaccttcaccaagagagatcctagaggcgagtacgaagaacacctcggaattctgggaccaataattcgcgctgaggtggacgacgttatccaggtcaggttcaagaatctcgcctcccgcccctactctttgcacgctcacggtctgtcttacgaaaagtcctctgagggcaagacttacgaggacgatagtcctgagtggttcaaggaggacaatgccgtccaacctaactcatcctatacatatgtctggcacgcgacagagagatctggacccgagtcccccggcagcgcatgtcgcgcatgggcatattacagtgcagtgaatccagaaaaagatatccacagcggcctgatcggtccattgcttatttgccagaaaggcattctgcacaaggattctaacatgccaatggatatgagagagttcgtgctgctgttcatgacgttcgacgaaaagaagtcctggtactacgaaaagaaatcccgctcatcctggcgccttactagtagcgagatgaagaaaagtcacgagtttcacgctatcaatggcatgatttactctttgccaggtttgaaaatgtacgaacaggaatgggttaggctgcatcttctgaacatcggaggatcccaggacattcatgtggtgcattttcacggtcagacactgttggagaatggaaataagcagcaccaactgggagtttggcctctcttgcccggttctttcaagaccctcgaaatgaaggcaagtaagcccggttggtggttgttgaataccgaggtcggcgaaaatcagcgcgcaggaatgcagaccccattccttattatggacagagattgcaggatgcccatgggcctgtctacaggcataatatccgattctcaaattaaagcctcagagtttctgggatactgggaaccacgcctcgcccgccttaacaacggaggttcatacaacgcatggagcgtcgagaagttggccgctgagttcgcaagcaaaccatggatccaggttgacatgcagaaggaagttattatcacaggcatccagactcagggagcaaaacactacttgaaatcttgctacacaaccgagttttacgtagcatactctagtaaccagatcaactggcaaatcttcaaaggcaattctacacgcaatgtgatgtacttcaacggcaattccgacgcttcaaccatcaaagaaaaccaattcgatccaccgattgtagctcgctacatacgcatcagtcctacgagagcatataaccgccctacgctgcgcctcgagctgcagggctgcgaggtaaacggttgctcaacaccactgggcatggagaatggaaagattgaaaataaacaaatcacagcttcatcctttaaaaagagttggtggggtgattactgggagcctttcagagccagactcaacgcccagggcagggtaaacgcttggcaggctaaagcaaataacaacaagcagtggttggagatcgacttgctgaagatcaaaaaaattactgcaatcatcacccagggatgcaaatccctgtctagtgagatgtacgtgaagtcctacacaatccattattcagaacagggcgtggaatggaaaccgtacaggctgaagagttccatggtagataagatctttgaaggtaacactaacactaaaggccatgtgaagaatttttttaatccccctatcatttccaggttcatccgcgtgatccctaagacctggaatcagagcatcgcccttaggctcgaactttttggttgcgacatctat

SEQ ID NO: 9131 - DNA, 6672 bp, Artificial Sequence
  Description of Artificial Sequence: Synthetic coding sequence
atgtttccaggctgtcccagactgtgggtgcttgtggtacttgggacatcgtgggttggatggggatcacaggggactgaggctgcccagctgaggcagttctacgtcgcggcacaggggattagctggagctatcgacctgaaccaaccaatagctcactcaacctatctgttacttcctttaagaaaatcgtatatcgtgagtacgaaccttattttaaaaaggaaaagccccaatctacaatctccgggctgctgggcccaaccttgtacgccgaggtgggggatatcattaaggtgcatttcaagaacaaagcggacaagccactttctattcatcctcagggaatcagatactctaaactgagcgaaggcgccagctatctggatcacacattcccggcagagaaaatggatgacgccgtggcacctggacgcgaatatacgtacgagtggagcatctccgaggatagcggccccacacatgacgatcctccttgcctcacacatatctattacagtcacgagaacctcatcgaagattttaactccggcctgattggcccccttctcatctgtaaaaaagggaccctcacggaaggcggtactcagaaaaccttcgacaaacagattgtgctgctcttcgccgttttcgatgaatctaagtcttggtcccagtccagttcccttatgtacacagtgaatggttatgtaaacggaacgatgcccgatatcactgtatgtgcccatgatcacatctcatggcaccttctggggatgagtagcggtcccgaattgttctccatacactttaacggccaggtcctggaacagaatcaccataaggtcagcgctatcactctggtcagtgctaccagcactaccgctaatatgacggtgggaccagagggcaagtggatcatctcttcattgacgcccaagcatctgcaggccgggatgcaggcatatattgatatcaaaaactgcccaaagaaaacaaggaacctgaaaaagattacgagggagcagagacgacatatgaaaagatgggagtatttcatcgcggccgaagaagttatttgggactatgcccccgtgatcccagccaacatggacaaaaaatatagatctcagcacctggacaactttagtaaccagatcgggaaacactacaagaaggtgatgtacacacaatacgaggatgaaagcttcacaaagcacacggtcaacccaaacatgaaggaagacggcatcctcggtcctatcataagggcgcaggtgcgtgatacactcaagatcgtgttcaaaaatatggctagcaggccttactcaatttacccccatggtgtcacattcagtccatacgaagatgaggtcaactcctcatttaccagtgggcgtaataatacaatgattagggcagtacagccaggtgagacatacacgtataagtggaacattctcgagttcgatgaacccaccgagaatgatgcccaatgcctcacaagaccatattattccgatgtagatatcatgagagatatcgcatctggcctcattggcctcctgctcatctgcaaatcccgaagtctcgatcgaagggggatccagcgcgcagccgatattgaacagcaggcagtctttgccgtttttgatgagaataagagctggtatctcgaggataacattaataaattctgtgaaaatccagacgaagtaaaacgcgacgatccaaagttctacgaatctaacattatgtctacgattaatgggtacgttccagagagtatcaccacactgggcttctgctttgacgatactgtacaatggcatttctgttccgtcggcactcagaacgaaatcctgacaatccacttcaccggccattcatttatctacggtaagagacatgaagatacgctcaccctgttcccgatgcggggcgagtccgtcacggtgaccatggataatgtgggaacttggatgctcaccagcatgaatagctctccacgcagcaagaagctgcgattaaagtttcgggacgtgaagtgcatcccggacgacgatgaagatagttacgaaatttttgaacctccagagagcactgtgatggcgacacgaaagatgcacgatcggctcgaaccagaggacgaagagtccgatgcagattacgactaccagaatcgcctggctgcagcactgggtatacgctcatttcgcaattcctcccttaaccaagaggaagaggaattcaatctgacagctctggcgctggaaaatggtactgagttcgtgtcatcaaacaccgatatcatagtggggagcaactatagtagccctagcaacataagcaaattcacggttaataatcttgctgagcctcagaaagctccatcccaccagcaggccacaaccgcgggctctcccctgcgccatctgatcgggaaaaacagcgtcctcaacagcagcaccgccgaacactcaagcccttactctgaagaccctatagaagaccccctgcagccagacgtgaccggcataaggcttctcagtttgggggccggagaatttaaatcccaggagcacgcgaaacacaaaggaccaaaagtggagagagaccaggccgccaagcacagatttagctggatgaaactcctcgcccataaggtggggagacatctgtcccaagataccggaagtccgtctgggatgcgcccctgggaagatctcccttcccaggatactgggtccccatctaggatgaggccttggaaagatcctcctagtgatctgctcctcttaaaacagagcaattcatcaaagatcctcgtgggcagatggcatttggcttctgagaaagggtcctacgagatcatccaggacactgatgaagatactgcagtgaataactggctcatctccccccaaaacgcatcacgtgcatggggggaatcaacgccattggcaaataagccagggaagcagtcggggcatcccaagtttcccagggtgcgacacaaatccttacaggtgcgccaggatggtgggaaaagccgcctgaaaaaaagtcagttcctgattaaaacccggaaaaagaaaaaagagaagcacacgcatcatgctcccctgagcccacggaccttccaccccctgcgcagtgaagcatataacactttcagcgagagacgcctgaagcacagcctggtgttgcataaaagcaatgagacttcgctcccaaccgatctcaatcagacgcttccttcaatggatttcgggtggatcgcttctctcccggatcacaaccagaactcctcaaatgacactgggcaggccagttgcccgccggggttatatcagacagtaccgcccgaggaacactatcaaaccttccccatccaggacccggatcagatgcattcaacatccgatccatcccaccggagctcttcgccggaactgagcgagatgctcgagtacgacaggtcccacaagagcttccccacagacataagccaaatgtctccctcatcagagcacgaggtttggcagactgtcattagtcccgatctctctcaggtgacgctttcaccggagctgtcccagaccaatctgtctccggacttgtctcacacgacattgagccccgaactaatccaaagaaacttgtctcctgcgctaggacagatgccgatttctccagacctgtctcacaccacgctgtccccggacctctcacatacgacgctgtcattggatctctcccagaccaacctgtcgcctgaactgtcacaaactaatctctcccccgcgctgggccagatgccacttagccctgaccttagtcacacgacactatctcttgacttctcccagaccaacctttcccccgaacttagccacatgaccttgtctcccgagctgtctcaaaccaacctgagccccgccctcggccaaatgccgatatcacctgacctgagccatacaacattgtcactggacttctctcaaacgaatctgtccccagagctgagccagacaaacctcagcccggccctcgggcagatgccgctctcccccgatccgtcccatacaacactctcactggatctttcccagacaaatttgagccctgagttgtctcaaaccaatctgtctccagacctgtccgagatgcctctattcgctgacctgagccagatcccccttacgcctgacctggatcagatgaccctttcgcccgatctgggcgaaaccgatctaagtccaaatttcggccaaatgagcctttcccccgatctctcccaagttacgttgtccccagatatctccgacacaactctgttacctgatctgtcccagatctcgccacctccggacctagaccagattttttacccctcagagtctagtcagtcgctgctgctacaggagtttaatgagtctttcccatacccagatttaggccagatgccatccccgtcctcaccaactttgaacgataccttcctttctaaagaatttaatccactggtaatcgtggggttgagcaaagacggcacagattacatcgagattatcccaaaagaagaggttcagagtagtgaggacgactacgcggagatagactacgtaccatacgacgacccctataagacggatgtgaggactaacatcaactcatctcgggaccccgacaacatagccgcttggtatcttaggagtaataacgggaatagaaggaattattacattgcagctgaagaaataagctgggactattccgaattcgtgcaaagggaaactgacattgaagattctgacgacattccggaagacacaacatacaaaaaagtggtgttccggaaatacctggacagtacatttaccaagcgggacccacgcggggagtacgaggaacacctgggcatcctcggtccgattattcgagccgaggtggatgacgttattcaggttcgtttcaagaacctggccagcagaccctatagcctgcacgctcacgggctctcttacgagaaaagctccgaagggaaaacgtacgaagatgattctccggaatggtttaaagaagacaacgcggtacagcccaacagttcatacacttatgtttggcacgctaccgagcgctccggacctgagtcgcccggctcagcatgtagggcttgggcctactactcagccgtgaaccccgaaaaggatattcactccggattgattggccctctccttatatgtcagaagggtattctacataaggattccaacatgcctatggacatgcgcgaattcgtattgctgtttatgacatttgacgaaaaaaaaagctggtactatgagaagaaatcccgaagctcatggcggctgacttcctctgaaatgaagaaatcccacgagtttcatgccataaatggcatgatttacagcctgccagggttgaaaatgtacgaacaggaatgggtcaggttgcatttgctcaacatcggggggagccaagatatacacgttgtgcacttccatgggcagacactcctagaaaatggcaacaagcagcatcagctcggagtatggccactcttaccaggtagctttaagaccctcgagatgaaagctagcaaaccaggctggtggttgctgaacaccgaggtaggtgagaaccaacgggctgggatgcaaaccccattcttaataatggatcgggattgtcggatgccaatgggcctctccacgggcatcataagtgattcccaaataaaggcatccgagttcctgggatactgggagcctagattagcacgcctgaataatggagggtcttataacgcttggtcggttgagaaactggccgccgagtttgccagcaagccctggatccaggtcgatatgcaaaaagaagtgattattaccggaatccaaacacaaggagctaagcactatctgaagtcttgttacaccactgaattttatgtggcatactccagcaaccaaataaattggcagattttcaagggcaactccactagaaatgtaatgtacttcaatggcaatagcgacgcctcaacaataaaggagaatcagttcgatccccctattgtcgctcgctatatcaggattagcccaactagggcgtacaaccgacccacattacgtctggagttgcaaggctgcgaagtcaatggctgctctacccctttaggcatggaaaatggcaaaatagagaacaagcagatcaccgcctctagttttaaaaaatcctggtggggagactactgggaaccgttccgagcccgcctgaatgcgcaggggcgcgtcaatgcttggcaagcaaaagccaacaataataagcaatggctggaaattgacctcttgaagataaagaaaattaccgctattattacccagggctgtaagtcactcagcagcgagatgtacgtcaagtcttatacaattcattatagtgagcagggagtagaatggaagccatatagattaaagagctcaatggtggacaagattttcgagggcaatactaataccaaggggcatgttaaaaatttttttaatcctcctattatctctcgattcatacgggtgatacccaagacttggaatcagagtatcgccttgcgcctcgaactcttcggttgcgacatttac

SEQ ID NO: 9132 - DNA, 6672 bp, Artificial Sequence
  Description of Artificial Sequence: Synthetic coding sequence
atgttcccaggatgtccacggctttgggtactagtagtgctaggtaccagctgggtgggctgggggagtcagggcacagaggccgcccagctgcgccaattctacgtagctgcgcagggtatctcttggagttacaggccagagccgactaactcttctctgaacctgtcagtgacttcgtttaagaagatcgtctatagggagtacgaaccctattttaagaaggagaaaccgcagtcaacaattagcggactgctcggaccaaccctctacgccgaggtgggcgatatcatcaaagtacacttcaagaacaaggcggacaagcccttatctatacatccccagggtatccgctatagcaagctctctgagggggcctcctaccttgaccacaccttccccgccgaaaagatggatgacgctgttgcgcctggtcgagagtatacctatgagtggagtatcagtgaggactctggaccaacacacgatgaccctccctgtcttacccacatctattactcccatgagaatctgattgaggacttcaactcaggtcttatagggcctttgctcatctgcaaaaagggtaccctgacagaaggcggaacgcagaagacatttgataaacaaattgtgcttctctttgcagtgttcgacgaatcgaaaagctggagccaatcaagctctctgatgtacacagtgaacggttatgttaatggcacaatgcccgatataactgtgtgcgctcatgaccacatcagttggcacttgctcggaatgtcgagcgggcctgaattgttcagcattcatttcaatgggcaggtgctagagcaaaaccaccacaaggtatccgctattactctggtatcagctaccagcaccactgcaaacatgacagtggggccagaagggaagtggataatcagctctttaacacccaagcacctgcaggcaggaatgcaggcatacatagacatcaaaaattgcccaaagaagacaagaaatttgaagaagattacacgagaacaaaggagacatatgaagcggtgggagtattttatagcagcggaggaagtcatttgggattacgcccccgtgattcctgcaaacatggataagaaatacaggagccagcatctcgataacttttcgaaccaaattgggaaacactataaaaaagtcatgtacactcagtatgaagatgagagcttcacaaagcacactgttaatcctaacatgaaagaagacggcatcttaggtccgatcatccgcgcccaagtgcgggacactctgaagatcgtattcaaaaatatggcgtctagaccttactccatataccctcatggcgttactttctcaccatatgaagacgaagtaaacagcagcttcacgtctggtaggaacaacacaatgatccgcgctgtacagcccggggagacttatacatataagtggaacatcctagagttcgacgaacctaccgagaacgacgctcagtgtctcactagaccatactatagcgacgtggatataatgcgcgacatcgcttctggactgatcggccttctgcttatttgcaagtccaggtcgctcgatagacggggaatccagcgagccgccgacatagaacagcaggcagtgtttgctgtcttcgacgagaacaagtcctggtatctcgaagataacattaacaagttttgcgaaaatccagatgaggtgaagagggatgatccaaagttttacgagtccaacatcatgtccacgattaacgggtatgtacccgagtccataacaactctcggattctgttttgacgataccgtccagtggcacttttgctcagtgggaacccagaatgaaatcctcactattcatttcacgggacactccttcatttacggaaaacggcatgaggatacactgaccttgtttcccatgcgcggcgaaagtgttactgttacaatggataacgtgggtacgtggatgttgacaagcatgaattccagcccacgcagcaaaaaattgaggcttaaattccgagacgtgaagtgcatcccagacgatgatgaggactcctacgagattttcgaaccgcctgagtccacggtcatggcgactcgtaagatgcacgatcgattagagccagaggacgaggagagtgatgccgactatgattaccaaaacaggctggccgcagcccttggaataagatcttttaggaattcctctttaaaccaggaggaggaagaatttaacctgaccgccctggccttggagaatgggactgaatttgtctctagtaacaccgatataatcgttggaagtaactattcaagtcctagcaacatatccaagttcacggtgaacaaccttgccgagcctcaaaaggcaccttctcaccaacaggcaactaccgcaggctctcctctgcggcacctcatcgggaaaaacagcgttctgaacagcagtactgccgagcactcaagcccctacagcgaggaccccattgaggacccccttcaaccagatgtgactggcattaggctactctctcttggagccggcgagttcaagtctcaggaacacgcaaagcataagggcccaaaggtcgaacgcgatcaagcagctaagcacagattcagttggatgaagctcctcgctcacaaggtgggccgccacctgagccaggacacgggctcaccttccggaatgagaccctgggaggacctgccaagccaggacaccgggtcgccatccaggatgcgtccatggaaggacccccctagtgatttgctgttgctgaagcaatctaactcctccaagatcctggttggcaggtggcatttggccagtgaaaaggggagttatgaaatcattcaggataccgacgaagatactgctgtgaataactggctgatcagcccccagaacgcttcgcgtgcttggggcgaatcaacccctctagccaataaacctgggaagcagagcggacacccaaaattccctcgcgtgagacacaagagtttgcaggtgaggcaggatggcggtaagtcacgcctcaaaaagtctcagttcctaatcaagacacgaaagaagaagaaggagaagcatacccaccatgccccgttaagccccagaacctttcacccactgagatctgaggcctataacaccttcagtgaacggcgcttaaagcattctctggtgcttcataaatctaacgagacctcactcccgaccgaccttaatcagacactgcctagtatggattttggctggatcgcatccctccctgaccacaaccaaaattcttccaatgatactggtcaggcctcctgccccccgggcctgtaccaaacggttccgcccgaggaacactaccagacgttccccattcaggaccccgaccagatgcactcaacaagcgatccctcccataggagttcttctccggagctgtctgaaatgctggagtacgacagaagccataaatccttcccgaccgacataagtcaaatgtcgcctagctctgagcacgaagtctggcagacagtgattagtcccgatctttctcaggtgaccctgtctccagaactgtcccagacgaacctctcacctgacctctcccacaccacgctgtcccccgaactgattcagaggaacttgtcccccgccctgggtcagatgcccatttcacctgacttaagtcacaccactctaagccccgatttgagtcatactacactgtccctcgatctgtcacagaccaatctgagtcccgagctgagccagaccaatctgagtccagcgcttggccagatgcccctatctcccgacctgagccacaccaccctttccctggatttctcacagaccaatctctcgcctgagctgtcacatatgacgctgtcgccagagctgtctcagacgaacttatctcccgccttagggcaaatgcccatcagccctgacctgtcccacacaacactaagtcttgacttctcccagacgaatctgtcccccgagctctcacagactaatctatcccccgcgctggggcagatgcccctgtcgcctgaccctagccatacaaccctcagcctcgacctatcccagactaatctgagtcccgaactaagccagactaatctttcccccgacctctccgagatgcccctgttcgctgatctgtcacaaatacctctgactcctgaccttgaccagatgaccctatcccccgatctaggggaaactgaccttagccccaacttcggacaaatgtccttatctcctgatctcagccaggtgacactctcacccgatatcagcgacacgacactgctgcccgatctgtcgcagatatccccgccaccagacctcgatcagatcttttatccaagtgaatcatcccagtctcttctactccaagagttcaatgagtccttcccctaccctgatctgggccaaatgccttccccctcttctcccacactaaatgataccttcctttcaaaagagtttaatcccctcgtgatagttggtctgagcaaagatggaacagactacatcgaaataataccgaaggaggaggtgcagtcctcggaagatgactacgctgagatcgactacgtgccttacgatgatccctataaaacagacgtgcgtaccaatatcaacagctctagggacccagacaatatcgcagcgtggtatttacgcagcaataacggcaaccgtcgcaactactatatcgccgcggaagagatatcatgggattattcagagttcgtgcaacgcgaaaccgatatagaggattccgacgacatacctgaggacacaacatataagaaggttgtatttcggaagtacctggactccactttcaccaaaagagacccacggggagagtatgaagaacacttgggtattctgggccctattatccgagccgaggttgacgatgtgatccaggtgcggttcaagaacctggccagtcgcccttacagcctccacgcgcatgggttgtcctacgagaagagcagcgagggtaaaacatatgaggacgatagtccagaatggttcaaagaggacaatgctgtgcagcccaattcaagctacacatatgtatggcacgcaacggagcgttccggccccgaatcccccggatctgcatgtagagcctgggcctactatagtgccgtcaaccctgagaaagatatccacagtgggctgattggcccactgctgatttgtcagaaagggatcttgcataaggacagtaacatgccaatggacatgagggagttcgtgcttttgtttatgaccttcgatgaaaagaagagttggtactatgaaaaaaagagccggtcgtcatggagactcactagttcagagatgaagaagtcgcacgaattccacgcgatcaatgggatgatctacagtctcccagggctgaagatgtacgaacaggagtgggtccggttgcatctcctgaatatcgggggctctcaggacatccatgtcgttcattttcacggccaaactctactggagaatgggaacaagcagcaccagttgggcgtctggccactgttgcctggtagctttaagaccctggagatgaaagcttctaaacccggttggtggctcctgaatacagaggttggcgagaatcagagagccggcatgcagacgccctttctgatcatggaccgggattgccggatgccgatgggactgagtacagggatcatttcggatagccagattaaggcctccgaatttcttggatactgggagcctcggcttgctagattgaacaatggaggaagctacaacgcctggtccgtggagaagttagctgcagagtttgcaagtaaaccctggatccaggtagatatgcagaaggaggttattataaccggaattcagacgcaaggcgccaagcactacttgaagtcttgctacacaaccgagttctatgtggcctactccagtaaccagattaactggcaaatttttaaggggaatagtactcgcaacgttatgtactttaacggaaacagcgatgcatctacaatcaaggagaatcagttcgatcccccaatcgtcgctcgatatatccgtatctccccaacgcgtgcttataatcgaccgacactgcgactggaactgcagggatgcgaagtgaatggctgttctacccccctgggtatggagaacggaaaaatcgaaaacaaacaaatcactgccagtagttttaagaagagctggtggggggattactgggaaccgtttcgagcgcgcctgaacgcacagggacgagtaaacgcctggcaagcaaaagcaaacaacaacaaacagtggctggagatcgacctcctcaagatcaaaaagataacggcaattattactcaaggatgcaaatcactcagtagcgagatgtacgtgaagtcttataccatacactacagcgagcaaggtgtagagtggaagccctaccgcctcaaaagcagcatggttgataagatttttgaaggcaacacaaacacaaaagggcacgtcaagaacttctttaatcccccaataattagcagattcatccgtgtgatacccaagacctggaatcagagcattgccctccggctcgaactttttggctgtgacatatat

SEQ ID NO: 9133 - DNA, 6672 bp, Artificial Sequence
  Description of Artificial Sequence: Synthetic coding sequence
atgtttccaggctgcccgcgactttgggtcttagtggttcttggtacgagttgggttggttggggttcccaggggacagaggccgcccagctccggcaattttacgtcgcagcacagggtatctcttggtcgtaccgccccgaacccacaaattcatcactcaatctttctgtcacgagcttcaagaagattgtctaccgcgagtatgagccatacttcaagaaagagaagcctcagtccacgatatctggccttttggggcctactttatacgcggaggtcggtgatatcattaaggtccatttcaagaacaaggcggataaaccgctctccatccacccacagggtattcggtactccaagctctccgaaggggcctcctacctggatcacacatttcccgcggagaaaatggacgatgcagtcgccccggggcgggagtacacgtacgagtggtcgatctctgaagactcgggacctactcatgatgatcctccttgtctgactcatatctattatagtcacgagaatcttatcgaagatttcaattccggtctcatcggaccacttctcatatgtaagaagggcacgctgacggagggcggtacacagaagacatttgacaagcagatagtgctgctttttgcagtctttgatgagtctaagtcctggagtcagagctcgtcgcttatgtataccgtcaatggctacgttaacgggactatgcctgacataaccgtttgtgcgcacgatcatatctcatggcacctgttagggatgtcgtccggtcctgaacttttctccatacattttaatggtcaggtgcttgagcaaaatcatcataaggtatctgcgattacccttgtcagcgctaccagcaccacggccaatatgaccgtcggccctgagggtaagtggatcatttcgtcactcactccaaagcatctacaagcggggatgcaggcctatatcgacatcaaaaattgcccaaagaagactcgtaatctgaaaaagattaccagggaacaaaggagacacatgaagcgatgggagtactttatcgccgcagaagaagttatctgggattacgcacccgtgatccctgctaacatggacaaaaagtatcgctcacagcacctggacaatttctcaaatcagattggtaagcattataaaaaagtgatgtacacgcagtatgaggatgaaagctttactaagcatactgttaatcctaacatgaaggaagatggtatcttgggtcccattatccgtgctcaagtccgcgatactctaaagatcgttttcaagaatatggcaagccggccttactctatatatccgcacggcgtgacgttttccccatacgaggatgaagtcaattcatctttcacgtccggtcgcaacaacactatgattcgcgcggtacagcctggagaaacctacacctacaaatggaatatcttggagtttgatgagcctaccgaaaatgatgcccaatgccttactcgtccgtactatagtgacgtcgatataatgcgtgacattgcgagcggactcattggcttgctcctcatatgcaaaagccgctcgctggatcgacggggtatccaacgagctgctgatatagagcagcaagcagttttcgctgttttcgacgagaacaaatcatggtacctggaggataatataaacaaattctgtgagaaccccgacgaggtcaagcgtgatgatccaaaattctatgagagcaacatcatgagtacgataaacggctacgtccctgagagcatcaccaccttgggcttttgcttcgacgataccgttcagtggcatttctgtagtgtaggtacacagaacgaaatcctcacgattcattttacggggcattcttttatttacggcaagcgacacgaggatacactaacactgttccctatgcgtggcgagtcagtaaccgttacaatggataatgtgggcacgtggatgctgaccagcatgaactcttctccacgctcgaaaaagttgaggcttaaattccgtgatgttaagtgcattccagacgatgatgaggattcatacgaaatttttgagccgcctgagagcaccgtcatggcgacacgcaagatgcatgacaggctggagcctgaggatgaggaatccgatgccgattacgactatcagaacagattggcggctgctttgggcataaggtcgttcaggaattcttcgttgaatcaggaagaagaagagttcaatttgactgccttggcactggaaaacggtactgaattcgtctcgtcaaacacagacattatcgtaggcagtaattattctagccccagtaacattagtaagtttacggtgaacaatctcgccgagccccagaaagctccgtcgcatcagcaggcaaccaccgccggctcccctctgcgtcacttgattggcaagaattctgttctaaattcatccaccgccgagcactcttccccctatagtgaggatcctatagaagatccactgcaaccagacgtaacggggatacgtctgctatctctcggtgcaggggaattcaaatcccaggagcacgcgaagcataaagggcctaaggttgaacgagatcaggcagccaagcaccgtttctcatggatgaagttgcttgcacataaagtcgggcgacatctctcgcaagacaccgggtcgccctctggcatgcgaccgtgggaggatttgccatcccaggataccggctctccttcacgtatgcgcccttggaaagaccctccatcggatcttctgcttctaaagcagtcgaacagtagcaaaatcttagtcgggcggtggcatttggcttctgaaaagggaagttatgaaatcatccaggatacagatgaagatacagccgtgaacaactggcttatctcccctcagaacgcctcaagagcttggggtgagtccacgcctctcgctaacaaaccaggtaagcagtcaggccatccgaaattcccacgagttagacacaagtctctgcaagtcagacaagatggcggaaaaagtcggttgaagaagtctcaattcctgatcaaaacacgtaagaagaaaaaggagaagcacacccaccacgcacctttgagtccgcgaactttccaccctcttcgttctgaagcctataacactttttctgagcgccgcttgaagcattccctagtcctccataagtccaatgagacctccttgcccactgatcttaatcaaaccctcccctccatggattttggttggattgcaagtctgccggatcacaaccaaaattcatcgaacgacacgggtcaggcaagttgcccccctggattgtaccaaactgttccgccggaggagcattatcagaccttccccatacaggatcccgatcagatgcatagtacttcggaccctagccacaggtcgtcctcgccggaactttccgaaatgctcgaatatgatcggtctcataagtcgttcccaactgacatatcccaaatgagtccctcaagtgagcatgaagtatggcagacagtgatcagcccagatctctcgcaggtgaccttgtcgccagagttatcgcaaacgaatctttccccggatcttagtcatactactctctctcccgagttgatccaacggaaccttagccccgcgctgggccagatgcccatctctccggacctgtcacataccacactctccccggatttgtcacacaccaccctgtctctcgacttgtcgcagacgaacctgagccctgagttgtctcaaaccaatctttcgccagccctcggtcagatgccgcttagtcccgacttgtcccacactacactgtccttggattttagtcaaactaacctcagtccagaactcagccatatgacactctctccagagcttagtcagactaacttgtcccctgcgttggggcaaatgccgatctccccggatcttagccacaccaccctgtcactggacttttctcagaccaaccttagcccggagctgtcccaaaccaatctctctccggcactgggacagatgccactctccccagacccatctcacacaaccctctctctcgacctttcgcaaactaatctatcgcctgaactatcccaaaccaatttgtcgcctgacctgtccgaaatgccattgttcgcagacttgtcacaaatcccactgacccctgatctcgaccaaatgaccctttcccctgacctgggcgagacagaccttagtcctaatttcggacagatgtctttgtcacccgatctctcgcaagtaacactcagcccagacatctccgacactaccctcctgcccgacctcagccagatctcgcccccgcctgatctggatcagatattttacccatcggagtctagccagtccttgctgcttcaagaattcaatgagagtttcccttaccccgatctgggccaaatgccctcgccctcctcaccgaccttaaatgataccttcctgtcaaaggagttcaatccccttgtgattgttggactctctaaggacggtactgattacatcgaaatcattcccaaggaagaagtgcagagctccgaggacgattacgctgaaattgattacgttccttatgacgatccttacaagactgacgtcaggacgaacatcaattcatctcgagacccagataatatcgcagcctggtatctgcgatcgaataacggtaacagacgcaattattacatagctgctgaggagatttcttgggactatagtgagtttgtccaaagagagacagatattgaggatagtgatgatatccccgaagatacaacatacaagaaggtggtgtttagaaaatatctcgattcgacttttacgaaacgtgatcctcggggagaatatgaagagcatctgggaatcctcggccccattatccgggcggaagtggacgatgtaattcaggtcaggttcaaaaatctcgcgtctcgtccctactcactgcatgctcatggtctttcatatgaaaaatcgtctgagggcaagacatacgaggatgattcccccgaatggtttaaagaagacaatgctgtccagcctaatagttcatacacatatgtctggcacgccactgagcgttcgggtccagaatcgccggggagcgcttgtcgtgcgtgggcctactactcggccgtgaacccggagaaggacatacatagtgggctcattggtcccctactgatatgtcagaaaggaatcctccataaagactctaacatgccgatggatatgcgggaatttgtattattgttcatgacctttgacgagaagaagtcctggtattacgagaagaaaagcaggtcgtcgtggcgtctcacatcctcggagatgaagaaaagtcacgaattccatgctataaacggaatgatttactcgcttcctggacttaagatgtacgaacaggaatgggtaagattacaccttctcaatattggcgggagccaggacattcacgtcgtgcatttccacggccagaccttactcgaaaatggaaataagcagcaccagctgggtgtatggccgctgttgcctggttcattcaagacgcttgagatgaaagcgagcaaaccaggatggtggctcctaaataccgaggtcggtgaaaaccagcgcgcgggcatgcaaactcctttcctgattatggatcgcgactgccgcatgcccatgggcctttcaactgggattatttccgatagtcagataaaagcaagcgaattcttggggtactgggagccacggctcgccagattgaacaatggaggttcttataatgcctggagcgttgaaaaattggcagccgagttcgcgtccaagccctggattcaggttgacatgcaaaaagaggttatcattacgggcatccagacacagggtgccaaacattatttgaaaagctgctataccacagagttttacgtcgcgtattcatctaaccagatcaactggcagatctttaaagggaactctacacgaaatgtgatgtacttcaacggcaactcagatgcctcgactatcaaagagaaccagtttgatccaccgattgtggcacgttacattcgcatatctccgactcgtgcttataaccggcctactctgcgcctggagcttcaaggctgtgaagtgaacggctgctcgacaccattaggaatggaaaatggtaaaatcgaaaataagcagattaccgccagttccttcaagaagagttggtggggagactactgggaacccttccgggcgcgtctcaatgcacagggacgagtcaacgcctggcaggctaaagcgaacaacaacaaacaatggttagaaatagacctcttgaagatcaagaaaatcaccgcaatcatcactcaaggctgtaagagtttgagtagcgaaatgtatgtgaaatcttatactattcattacagcgagcaaggagtggagtggaagccttataggctgaaatcgtctatggtagataagatcttcgagggcaacactaatactaagggccacgtcaagaacttctttaacccgcccattatctcgcgattcatacgagtaattcctaaaacgtggaatcagtcaattgcattacgccttgagctttttggctgcgatatctat

SEQ ID NO: 9134 - DNA, 6672 bp, Artificial Sequence
  Description of Artificial Sequence: Synthetic coding sequence
atgtttcctgggtgcccacgactttgggttcttgttgtgttgggcacgtcttgggttggctggggcagccagggaactgaggcagcccagctccgtcaattttacgtagccgcccaggggatttcttggtcctacagacccgagcctactaattcatctctgaacctgtctgttactagttttaagaagatagtgtatcgcgagtacgaaccttactttaagaaggagaaaccacagtccaccatttctgggttgctgggcccaactttgtatgcggaggttggagatataattaaggttcacttcaagaataaggcagacaagcctttgagtatacatccccaagggatacgttactcgaagctgagcgaaggtgcaagctatctagaccacactttcccagcagagaagatggatgatgctgttgcccctgggcgggagtacacttatgaatggtctatctcagaggacagcggacctacccatgacgatccgccatgccttactcatatctattactctcacgagaatctgatcgaggacttcaacagtggcctgattgggcccttgctgatctgtaaaaagggaactctgacagaaggcggcactcagaagacttttgacaaacaaattgtgctattgttcgcagtgttcgacgagtcaaaaagctggagccaatcgtcttctttgatgtatactgtcaacggctacgtgaatggcacaatgcccgacattactgtctgcgctcacgatcacatttcctggcacctcctcggaatgtctagtggtcctgaactgttttccatacacttcaacgggcaagtcctcgaacagaaccaccacaaggtatcagcgatcactctggtttctgcaacgagtaccacagctaatatgacagtcgggcctgagggcaagtggatcatcagctccttaacccccaagcacttacaagcggggatgcaggcttacatcgacattaaaaattgcccaaagaaaacacgcaacttgaagaagatcacaagggagcaaaggcgacacatgaagcggtgggagtacttcatcgccgctgaagaggtgatatgggactacgccccagtgatccctgcaaacatggacaaaaaatacagatctcagcacttagataacttttccaaccagattggcaagcactataaaaaggtgatgtatacccagtacgaggatgaatcgttcaccaagcatactgtgaatcctaatatgaaagaggatggtattctcggaccaatcattagggcccaggtgcgagacacgctgaaaatcgtgtttaagaatatggcatctcgcccatactccatctatcctcacggagtcacattttcgccctacgaggacgaggtgaatagctcatttacctccggacgcaataataccatgatccgtgctgtgcagcctggtgagacctacacctacaagtggaatatactggagtttgacgaacctactgagaatgatgcccagtgtttgacccggccctactattctgatgttgacatcatgagagacatcgctagcggcctcataggcttgttacttatctgcaaatctcgcagtcttgacagaaggggcatacagcgcgccgccgacattgagcagcaagctgtctttgccgtcttcgatgaaaacaaaagctggtatctggaggataacataaataaattctgcgagaatccagacgaagtgaagagggatgaccctaagttctacgagagcaacattatgtccactattaatgggtacgttccagaaagcatcactaccctcggtttctgcttcgatgataccgtgcaatggcacttctgcagcgttggcacacaaaacgagatcttaacgatacattttaccgggcatagtttcatctatggcaagcgtcatgaagacacactcacactgttccccatgagaggcgagtcagttacggtcacgatggacaatgttgggacttggatgctgacctcaatgaattctagtcctaggtccaaaaagcttcgtctcaagttcagggacgtgaaatgcatcccagacgatgacgaagactcttacgaaatatttgagcctcctgagtcaacagttatggctacccgcaaaatgcatgacagactggaaccagaggacgaggaatccgatgcagattacgattaccaaaaccgtttagctgctgcgttaggcattcggtcgtttcggaattcttctctgaaccaagaggaagaagagttcaatttgaccgcactagccctggaaaacgggaccgagttcgtgagcagcaacaccgacattatagtgggaagcaactattccagtccaagcaatatctctaagttcacagtgaacaacctcgccgagccacagaaggctcccagccaccagcaagctaccacagctgggagcccactgagacatttgattggcaagaacagtgtgctaaattcatccactgctgaacactcctcaccttactctgaggaccccatcgaagaccccctgcagccagacgtaacgggaatcaggctcctgtccctgggagccggggagtttaagtcacaggagcacgccaaacacaaggggccaaaagtcgagcgcgatcaggccgctaaacataggttcagttggatgaaattgctcgctcacaaggtcggtcgtcacttgtcccaggatacgggcagcccaagcggcatgagaccgtgggaagatctgccgtcacaagataccggctctccaagtcgcatgcgcccctggaaggaccctccttctgacctgctgttgttgaaacaaagcaattcctccaagatcctcgtgggtcgctggcatctggctagtgagaaagggtcctatgagatcatccaggacacagacgaagatacagccgtgaataactggttgattagcccacagaacgcttctcgtgcctggggagagtctaccccactcgcaaacaagcctggtaagcagagtgggcatcctaaatttcccagagttagacataagtccctccaggtccgccaggacgggggcaagtctaggctgaagaagagccagtttctgattaaaacccgcaagaagaaaaaagagaagcatacacaccacgcacctttgagtccgagaacattccatcccctccggagcgaagcctataacaccttttctgaacgaagactcaagcacagcttagtcctgcataaatcgaatgagacctccctgccaactgatctgaatcaaacgctcccctctatggattttggatggattgcttcgctaccagaccacaaccagaattcctcaaacgatacaggccaggcatcgtgccccccaggcctctaccaaacggtaccgcctgaggaacattaccagacattccccatacaggatcctgatcagatgcacagcacaagtgacccatcgcatcggagctccagccccgaactctcagaaatgttagagtatgacaggagccacaaatcgttccctacagacatcagccagatgagtccgtcatccgaacacgaagtatggcagaccgtcatctctccggatctctcccaggtgacccttagcccagaactttcccagacaaatctgagtcccgatctttcccacaccacgctcagcccggagcttatacagaggaacctgtcaccggctctgggccagatgccaattagtccggatttgtcccacaccaccctgagtccagaccttagtcatacaacgctttcactggaccttagtcagacaaacctctctcccgagctgagccagacgaacctctcacccgccctgggtcagatgcccttgagtcctgatctgtctcacactactctttcacttgacttctctcagaccaatctcagtcctgagcttagtcatatgaccctctcaccagaattatcgcagacaaatttgtctccagccttggggcaaatgccgatatcacccgacctctctcatactacgttgagtctggattttagccaaactaacttgagtcccgaactgtcgcagacgaacttgagtccagcccttggacagatgcccttgtcccccgacccttctcacacgaccctgagcttggatctgtcccagactaacctaagccccgaactgtctcagaccaatttgtcccctgacctgtccgagatgccgttattcgccgacctgtcacagatcccgctcacacccgatttggaccagatgacactttccccagatcttggagagacagatctgtcccccaattttggccagatgagcttgtcgccagacctgtcccaggtgaccctctcccccgacatcagcgacaccaccctgttaccagacctttcccaaatctcacctccacctgatctagaccagattttttatccatccgagtcatcacaaagccttttgctgcaagagttcaatgaatcatttccctacccagacttagggcaaatgccctcacccagttcccccaccctgaatgacacctttctttctaaggagtttaatccattggtcattgtcggactgtccaaggatggaacggactatattgagattatacctaaagaagaggtgcaatcatctgaagacgactatgcagaaatcgattacgtcccttatgatgacccttacaagactgacgtgcgaacaaacattaattcctcgagggatcctgacaacattgcggcctggtacctgagatcaaacaacgggaatcggcggaactactacattgctgctgaagagatctcatgggactatagcgaattcgtgcagcgagaaacggatatcgaggactctgatgacatcccagaagatacgacctataaaaaagtagtctttcgaaagtacctggattccaccttcacaaaacgagacccacgcggcgaatacgaggagcatcttggaattctggggccgattatcagagccgaggtggatgacgtgatccaggtgcgattcaaaaatttggcaagcaggccttacagtttacacgctcacggcctgtcatatgaaaaaagcagtgaggggaaaacatatgaggacgacagtccagaatggtttaaggaggacaacgccgttcaaccaaacagtagttacacctatgtgtggcacgcaaccgagcgcagcggccccgaaagcccaggcagtgcatgccgggcatgggcatattattcagcggtcaacccagagaaggacattcatagtggcctgattggtcctctccttatatgtcagaagggaatcctccacaaagactccaatatgccaatggatatgagagagtttgtgctcctgttcatgactttcgacgagaaaaaatcctggtattacgagaaaaagagtaggtccagttggcgactgacttcgtccgaaatgaagaagagtcatgagtttcatgcaattaacggcatgatttacagtctgccaggactcaaaatgtatgagcaggagtgggtgagactgcatctgctgaacatcggaggctcccaagacatacacgtggtgcactttcacgggcagaccttactggaaaatgggaacaagcaacatcaactgggagtatggccactgctgcctggttcctttaagacacttgagatgaaagcctccaagccaggttggtggttactcaacaccgaggtcggcgaaaaccagagggctggcatgcagacacctttcttgattatggaccgcgactgccggatgcctatgggcctgtctaccggaattatttccgattctcagataaaagcttcagaatttctggggtattgggaaccccgactggctaggctaaataacggcgggagttataacgcctggagcgttgaaaagctggccgctgaatttgccagtaaaccctggatccaagtagacatgcagaaagaggtgataatcactgggatccagactcaaggtgcaaaacattacctcaaaagttgttataccactgagttttacgtggcctattctagcaatcagattaattggcagatcttcaagggcaacagcaccaggaatgttatgtattttaacggcaacagcgacgctagcaccatcaaagagaatcagttcgacccacccattgttgctagatatatccggatttctcccactcgtgcatacaacaggcccacactacgactggagttgcagggatgcgaagtgaacggctgtagcactcctctgggaatggaaaacggcaagatcgaaaacaagcagattaccgcttcctccttcaaaaagtcgtggtggggcgactattgggagcccttccgagctcggctcaatgctcaggggcgggttaatgcatggcaggcgaaagccaataataacaagcagtggctggagattgatctgctaaaaatcaaaaagatcactgcaattataacccaggggtgcaagagtctcagctctgaaatgtacgtgaaaagttacactatccattacagcgagcagggagttgaatggaaaccataccgtctcaaatccagtatggtggataagatatttgagggtaacacgaatacaaagggtcatgttaagaatttttttaaccctcctattatatcccgatttatcagggtgatccccaaaacttggaaccagtccattgcattaaggctcgaattatttggctgcgacatttac

SEQ ID NO: 9135 - DNA, 6672 bp, Artificial Sequence
  Description of Artificial Sequence: Synthetic coding sequence
atgttcccaggttgccctagactatgggtcctggtcgtgctcggtacctcttgggtagggtgggggagtcaggggaccgaagccgctcagctcagacagttctacgtggcagcccagggcatttcttggtcttatcgtccagagcccacaaactcatccctgaacctgtctgtgacttccttcaaaaaaattgtgtatagagagtatgaaccctattttaagaaggagaaaccacagtcaaccattagcggcctcctagggcctaccctgtacgcagaagtgggagacattatcaaagtccatttcaagaacaaggccgacaaacccttgtctatccaccctcagggcattaggtattccaagctgtcagaaggcgcaagctacttagaccatacattccccgcagagaagatggacgacgcagtcgcccctggacgagagtatacttacgagtggtccatcagcgaagactccggaccgacgcacgatgacccaccatgtcttacccatatttactattctcacgaaaacttgatagaggatttcaactcaggactgataggaccacttctgatttgtaagaaaggcacactgactgagggaggcactcagaagacctttgataaacagattgtgttgttatttgccgtgttcgacgaatccaagtcctggtcgcagagttccagcctgatgtacaccgtcaacggctacgtgaacggtactatgccggacattactgtctgcgctcacgatcacatcagctggcatctgttagggatgtcaagcgggcccgagctcttctctatacatttcaacggacaggtgctggagcaaaaccatcataaagtctctgccatcactctggtatccgccacttcgaccacggccaacatgacggtgggcccggagggcaaatggatcatcagcagcctgacacccaagcatctgcaggccggaatgcaagcctatattgacatcaagaactgccctaaaaagacacggaatctcaaaaagatcacccgggaacagcggcgacatatgaagcgatgggagtatttcatcgctgctgaggaagtgatatgggactatgcccctgtaatccccgcgaacatggacaagaagtatcgctcacagcatctcgataacttctccaatcagatagggaagcattacaagaaagtgatgtacactcagtatgaggacgaatccttcaccaaacacaccgtcaaccccaatatgaaggaagacggaatcctgggtccaattattcgcgcacaagtccgcgataccctgaagatagtatttaagaacatggcatctaggccctatagcatatatccacatggcgtgactttctcgccttacgaagacgaagtaaacagttctttcacctctggccgcaacaacacaatgatccgcgccgtgcagccaggtgaaacctatacatacaagtggaatattcttgaattcgacgagcccacggaaaatgatgctcaatgcttgactcgaccctattattctgacgtggatatcatgagagatatagcctccggactgatagggctactactgatctgcaagagccgcagtttggacaggcgtgggatacagcgagccgccgacattgagcagcaagcggtgttcgcagtgttcgacgaaaataagagctggtatctggaggataacattaacaaattttgtgagaaccccgatgaggtgaagcgcgacgatccgaagttctatgaatcgaacatcatgagcacaatcaacgggtacgtaccagagagtatcacaacactcggattctgtttcgatgatacagtccaatggcacttctgcagtgtggggacgcagaacgaaatcctgactatacatttcaccggccactcattcatttatgggaagcggcacgaagacaccttaacgctgttccccatgcgcggggaatccgtgacagtaaccatggacaacgtaggcacgtggatgctcacttcaatgaactcctcaccacgcagcaaaaaactccgcctcaagtttagagacgtgaaatgtatcccggatgatgacgaggacagctatgaaatctttgaaccccctgaatccaccgtgatggccacacgcaaaatgcacgatcggctcgagccagaggacgaggagtctgatgcagactatgactaccagaacaggctggcagccgctctagggatccgaagctttagaaactcgagcctgaatcaggaggaggaagagttcaacctgacggcccttgccctcgaaaatggaaccgagttcgtgtcctctaacaccgatatcatcgtgggaagcaattattcatcgcccagtaatatatccaaattcactgtcaataatctcgctgagcctcagaaagccccctctcatcagcaggctacaaccgccggcagccccctcagacacttgattgggaagaactccgtgctgaactcaagcacagcggagcactcttccccctactctgaggatccaattgaggatcctctgcagcccgatgtcaccgggattcgtctgctgtcactgggagccggcgaattcaaatcccaggaacacgccaagcataaaggtcctaaagtggagcgagaccaggccgccaaacacagattctcttggatgaagctcttggcacacaaggtaggcaggcacctttctcaggacaccggatctccttccgggatgcgcccttgggaagacctgccatcccaggataccggctccccctctcgcatgcgtccatggaaggatccgcccagtgacctgctgttgctcaaacagtcgaacagttccaagatcttagtcggtagatggcacttggcctccgagaaggggtcctatgaaatcatccaagacacagacgaggacaccgccgtaaacaattggctaatttccccccagaacgcctcaagagcctggggcgaatctaccccactcgctaataagccagggaaacagtctggacacccaaagttcccacgggtccgtcataagtctctgcaggttcggcaggacggtgggaaaagcaggctgaagaagtcccagttcctcattaagacgcgcaagaagaaaaaggaaaagcacacacatcatgcacctctgtcgcccaggacattccaccctctgcggtctgaagcgtacaataccttttctgaacgcaggctgaagcactccctggtgctgcacaagagcaatgagacatccctgccaaccgaccttaaccaaacactgcctagtatggacttcgggtggatcgccagcctgcccgatcacaatcagaattcctctaatgataccggccaggctagctgccccccggggctgtaccagacagtgccacctgaggagcattatcagacattccctattcaggaccctgatcagatgcactccacgagtgacccgagtcaccggagctcgtctccggagctttccgaaatgctggaatatgacagatctcataagagcttccctacagatataagccagatgagtccttctagcgagcatgaggtctggcagacggtgatctcaccggacctgagtcaagtgaccctctccccagaattgagccagacgaacctaagtccagatctgtcacatactaccctgagcccagaactcattcagcggaaccttagccctgcgctgggtcagatgcccatcagtcctgatctgagtcacaccaccctaagcccagatctgtcacacacgactctgagcttggatctgagccaaactaatctgagcccggagctgtcccagacaaacctgagccccgcactggggcaaatgcctctgtcgccagacttatcccacacgactttgtccctggattttagtcaaactaacctctccccagaattgtctcatatgaccctgtcacccgagctgtctcagaccaacctttccccggccctgggacagatgccaatttcacccgacctttctcacacaacactgtcactagacttctctcagactaatctgtcacctgaattgagccagacgaacctgagtccggcgcttggtcagatgcccctcagccccgacccctctcacactaccctaagcctggacctctcccagactaacctgagccctgagctgagccagacaaacctgtcccccgacctcagcgaaatgcctttgttcgcggacttgtctcagattccgctgacgcctgatctagaccagatgacgctgtcccccgacttgggcgagaccgacttgtcccccaattttggacagatgagtctgagccctgacctgtcccaggtcactctgtcccccgacatcagcgatactaccctgctgcccgacctgtcccaaatctcccccccacctgatctggaccagattttttaccccagtgaatcttctcagagcctgctgctgcaggaatttaacgagagcttcccttatcccgacctgggccagatgccgagccctagcagtcctacgctcaatgacacttttctgagcaaggaatttaatcctctcgtgatagttggcctgtctaaagatggcacagactatatagaaatcatccccaaggaggaagtgcagagctcagaggacgattacgccgagatcgactacgtcccgtacgacgacccctacaagaccgacgttaggacaaacatcaattcaagcagggatcctgataacatcgccgcctggtatctgaggtccaacaacgggaatagacgaaactattatattgctgccgaggagatcagttgggactactctgagtttgtgcaacgggaaacggatattgaggactccgacgacattcctgaagataccacttacaagaaagtggtgttccgtaagtatctcgactcgacattcaccaagcgggatccaaggggagaatacgaagaacatttgggcatcctgggaccaattattcgcgccgaggtggacgacgtcatacaggtccgcttcaagaatttggcgtcgcgcccatactcactccatgcccacggactgtcatacgagaagagttccgaaggtaaaacctatgaggacgactcccccgagtggtttaaagaagacaacgccgtacagccgaacagttcctacacatatgtatggcacgcaaccgaacgaagtggacccgaatcaccggggagcgcatgtagagcgtgggcctactatagcgcagtaaatccagagaaagacatacactctggacttataggacctctgctcatctgtcagaaggggatcctacacaaggactccaacatgcccatggacatgagggaatttgtgctcctttttatgacctttgatgaaaaaaagtcatggtattacgagaagaagtctaggtcctcttggcgactgacaagcagtgagatgaagaagagccacgagttccatgccattaacggcatgatctactcactccctggcctcaaaatgtatgaacaagagtgggtacgcttgcatctgttaaatatcgggggcagccaggatatccacgttgtccacttccatgggcagactctacttgagaatggaaacaagcagcaccagctcggcgtttggccattgctgcctggaagctttaaaactttggaaatgaaggcctctaagcctggttggtggctactgaacaccgaagtgggggagaaccagagagccggcatgcagaccccattcctgataatggatagggactgcaggatgcctatgggactgagtactggtataataagcgactcacagattaaagcatcagagtttctggggtattgggagccacggttagcccgactgaacaacggagggtcttacaatgcgtggagcgttgagaaattggccgccgaattcgcctccaaaccctggattcaggtggacatgcaaaaggaagtgattattaccggaatccagacccagggagccaaacattacttaaaatcctgttacaccactgagttctacgtggcctacagctcgaaccagataaactggcagatcttcaaaggtaatagcaccaggaacgtgatgtactttaatggcaactcagatgcatccacgattaaggagaatcagttcgatccacccattgtggctcgctacatacgtatcagtccaacccgcgcctacaataggcctactctgcggttggagctgcaggggtgcgaagtcaatggctgcagcactccgctggggatggagaatggcaaaatcgagaacaaacagatcacagcaagttcctttaagaaatcgtggtggggtgactattgggagccttttagggccaggctgaatgctcagggccgcgtcaatgcctggcaggccaaggctaacaacaataagcagtggctagaaatcgacctcctgaagatcaaaaaaatcaccgccataatcactcaggggtgtaagagcctatcgagcgagatgtacgtgaagtcctacaccattcactatagtgaacagggcgttgaatggaaaccatacagactgaaatcttccatggtcgataaaatatttgaggggaacactaataccaaggggcacgtgaagaacttcttcaatccccctatcatctccagatttatcagagtgatcccaaaaacttggaaccaaagcattgctctgcggctcgaacttttcggctgtgacatttat

SEQ ID NO: 9136 - DNA, 6672 bp, Artificial Sequence
  Description of Artificial Sequence: Synthetic coding sequence
atgttccccggatgtccgaggctctgggtcttagttgtactgggcacttcctgggtggggtggggctcacagggcaccgaggctgcccagctgcggcagttctacgtcgctgcacagggtatcagctggtcatataggcctgagcccacaaactcttcactgaacttatccgtgacgagtttcaagaaaatagtctacagagaatacgaaccatattttaaaaaagaaaaacctcagagcacaatctctggactgttgggacctaccctatatgcagaggtaggtgacatcattaaggtccattttaagaataaggccgacaaacccctgtcaatccacccacagggcatcagatattccaagctgtcagagggggcaagttacctggaccacaccttcccagctgagaaaatggacgatgccgttgctcccggtcgggaatatacatacgagtggtcaatctccgaagactccgggcctacacacgacgaccctccttgcctgactcacatctactattctcatgaaaaccttatcgaagatttcaactcaggactgatcggcccactcctaatttgtaagaagggaacgttgaccgaaggcggaacccagaaaacctttgataaacagatagtgctgttattcgctgtctttgacgagagcaagagctggtcacagagttctagtctcatgtacactgtcaacggctatgttaacgggaccatgccggacatcaccgtgtgcgcacatgaccatatttcctggcatctgttgggaatgtcaagtggaccagagctgtttagcatccacttcaatgggcaggtcctcgaacagaatcatcacaaagtgagtgcgataacactggtaagcgcgacctcaacgactgccaatatgacggtgggccccgaggggaagtggattattagctcgctgactcctaagcaccttcaggccgggatgcaagcgtatattgacattaaaaactgccctaagaagacacggaacttaaagaaaatcaccagggagcagagacgtcatatgaaacgctgggagtacttcatcgccgcagaggaggtcatctgggactatgcaccggtcattcccgctaacatggacaaaaagtatcgttcccagcacctggacaatttctcaaatcagataggtaaacactacaaaaaggtgatgtacacacagtatgaggatgagtcgttcaccaagcataccgtcaatcctaatatgaaggaagatggtattctgggtccgataatacgggcgcaggtccgggatacacttaagattgtttttaagaatatggcgtctaggccttactcaatttaccctcacggtgtaacttttagcccatacgaggacgaggtaaactcaagcttcacaagtggcaggaacaacacaatgattcgcgccgtgcagccaggggagacatacacttataagtggaatattctcgaatttgatgagccgactgagaatgacgctcagtgtcttacccgcccctattactccgacgtcgacattatgcgcgatattgcatctgggcttattgggttgctactcatctgcaagagtaggagtctggatagaaggggcattcagcgagccgccgatatcgaacaacaagcggtgtttgcagtatttgacgagaataaatcctggtacctggaagataacattaacaaattctgtgagaaccccgacgaggtaaagcgggacgaccccaaattctacgaatctaatatcatgagtactattaatggatacgttccagaaagcataacaaccctgggattctgctttgacgatactgtccaatggcacttttgtagtgtggggacccaaaacgagatccttaccatccactttaccggtcactcttttatatatggcaagaggcacgaggacacactgacactcttccctatgagaggcgagagtgtaacggtgaccatggacaatgtcgggacttggatgttaacttctatgaattcatctccaaggtcgaagaagcttcgccttaagttcagggacgtgaagtgcatacctgatgacgatgaggattcctatgagattttcgaaccccctgagtctactgttatggcaaccagaaagatgcatgacagacttgaacccgaagacgaagagtcagacgctgactacgattatcaaaacaggttggctgctgcgctgggcattaggtcattcaggaattccagcctgaaccaggaggaagaagagtttaatctcacggctttggcacttgaaaatggaacagagtttgtgtcgagcaataccgacatcatcgtcgggtccaactatagttctcctagcaatatctcaaaatttaccgtcaataatctggcggaaccacagaaggctccaagccaccaacaggccacaactgctgggtctccacttcgtcatctaattggcaagaattccgtccttaatagcagcacggcggagcattccagtccatactccgaggatcccatcgaagatcctctgcaaccggatgttacagggatccggttactatcattgggggccggtgaattcaagagccaggagcacgccaagcataaagggcctaaggttgagagggatcaggccgctaagcatcgattttcatggatgaagctccttgcccacaaggtcggcaggcatttgtcccaggataccgggtccccgtcagggatgaggccatgggaagacctgccttcccaggataccggcagtccgtccaggatgcggccgtggaaggatccacccagtgacctcttacttctgaagcagtccaattcttctaagatcctggtgggccggtggcacctcgcatcggagaaagggtcctatgagatcattcaggacacagatgaagatacagccgttaataattggctcatcagcccgcaaaatgcctccagagcttggggtgagagcactccccttgcgaacaaaccaggtaaacagtccgggcatccgaagttcccgagggtgcgccacaaatctttgcaggtccgccaggatggcgggaaatcaaggctgaagaaatcacaattcttgatcaagaccaggaagaagaaaaaggaaaaacacacgcatcatgcaccattgagtcctcgaacttttcacccccttcggagtgaggcgtataataccttttcagaacggcgacttaagcacagcctcgtgctgcacaagtcaaacgagacctcgcttcccacagatctgaatcagactttaccctcgatggatttcggatggatcgcctccctgcctgaccataatcagaactcttccaacgatacaggacaagcatcctgtccacccggactctatcagactgtccccccggaagagcactatcagacatttcctatccaggaccccgaccaaatgcactctactagtgacccctcccataggtcaagctctccggaactctccgagatgctcgagtacgaccgctcacacaaatcctttcctactgatatcagccagatgagcccttcatccgagcatgaggtgtggcagaccgtgatctctccggacttgtcccaggtgacgttgtcacccgagttatctcagaccaacctgtcccctgacctctctcatactacgctgagccctgagctgattcagcggaacctgtctcccgcacttggacagatgcccatctctccagatctttcccacacaaccttgagccctgacctgtcacacacaaccctctcgctcgacctgagccagacgaacctgagccctgagctgtctcagacgaatttgagcccggcactggggcaaatgccactaagtcccgacttgagccatactacattgtcactagacttcagtcagaccaacctgtctcccgaacttagccatatgaccctgagccccgaactgagccagaccaacctttctccggcgctcggtcaaatgcctatatctccagacctgtcccacacaaccctgtctctggatttcagtcagaccaatctctcgccagagctcagccaaaccaatttgtccccagcattgggccagatgccacttagtcctgaccccagccacacgactttgagtttggacctgtctcaaactaatctatctcctgaacttagccagacaaacctgagtcccgacttgagcgaaatgcccctttttgccgacctgtctcagatacctttgactccagacctggaccagatgaccctcagtcccgacctgggggaaacagacctgtctcccaacttcggacagatgagtctatcccctgacctcagccaggttactctgagcccggacatttcagacaccacactgctgcctgacctgagccagatttctcctccaccagatctggaccagatcttctacccgtccgaaagttcacagagcctcttgctccaggagttcaatgaatctttcccctatcctgacctgggacagatgcccagcccaagctcaccgaccctcaacgacaccttcctgtcaaaggaattcaatccccttgtgatcgttgggttgtccaaggacgggacagattacatagagattatccccaaggaagaggttcaaagttctgaagatgattacgccgaaatcgattatgtcccctacgatgatccgtacaaaaccgacgtccgcaccaacattaacagctcccgcgatccagataacatcgcggcctggtatctgcgaagcaataatgggaaccggcggaattactatatcgctgcagaggaaattagctgggattactcagagtttgttcagagagaaacggacattgaggatagtgacgacattcctgaggataccacttataagaaggtggtgttcagaaagtacctggactcaacgttcacaaagcgggacccaagaggggagtacgaggaacacctcgggatattgggccccatcatccgcgcagaagtggacgatgtcattcaagtgcggttcaagaacctcgcttcccggccttactccctgcatgcacacggactctcgtatgagaagtctagcgaagggaaaacttatgaggatgactcaccagagtggttcaaggaagacaacgcggtgcagcccaattcgtcatacacttacgtgtggcacgccactgagcgcagcggccccgaatctcccggttcagcatgtagggcatgggcatactacagtgctgtgaacccggaaaaggatatccacagcggactgatcgggcccctcctgatttgtcagaaggggatcctccataaggattctaacatgcctatggacatgcgggagttcgtgttgctgtttatgacatttgacgagaaaaaatcttggtactacgaaaagaagtcacgaagtagttggaggctcacctcaagcgagatgaagaagagccacgaattccacgcaattaatgggatgatatactctcttccggggctgaagatgtacgagcaggaatgggttagattgcacctgcttaatatcggcggatctcaggatatccacgtggtgcatttccatggccaaactctactggagaatggcaacaagcagcaccagttgggggtgtggccactactgcccggctcctttaaaaccctcgagatgaaagcctcaaagcccgggtggtggttgctaaatacggaggtcggtgaaaatcagagagctggaatgcagacgcctttccttattatggatagggactgccgcatgcctatgggactgagcacgggtatcatttctgactcgcagataaaagccagcgaattcctgggatactgggagcccagactcgcacgactaaacaatggcggatcctataacgcgtggagtgttgaaaagcttgctgctgaattcgccagcaaaccttggattcaggtcgatatgcagaaggaagttatcataactggtatccagacacagggcgctaagcactatctcaagtcttgctatactaccgaattctacgtggcctacagctctaaccaaatcaactggcaaattttcaagggtaacagtacccgaaacgtgatgtacttcaatggaaacagtgatgcatcaacaatcaaagaaaatcaattcgacccccccattgttgctcggtacataaggatcagccccactcgggcgtacaacaggcctacattacgactcgagctgcaaggatgtgaggtgaatggttgttctacgcccctggggatggagaacgggaaaatcgaaaacaagcagatcacggcgtctagctttaaaaagtcatggtggggcgactactgggaacctttcagggcacgccttaatgcacagggccgggttaacgcctggcaggctaaggcaaacaataacaaacaatggctggagatcgatctactgaagattaagaagattacggccatcattacccaggggtgcaaatccttgtcctccgagatgtacgtgaagagctacacaatccattattcagaacaaggagtggagtggaagccgtatcgtctaaaatcctccatggtggataagatcttcgagggtaataccaacactaaaggccacgtaaagaatttctttaaccctcccattatttctcggtttattagggtcattccaaaaacttggaatcagagtatcgccttacgcctggagttattcgggtgtgacatatac

SEQ ID NO: 9137 - DNA, 6672 bp, Artificial Sequence
  Description of Artificial Sequence: Synthetic coding sequence
atgtttcccggatgtccaaggctttgggtcttggtagtactagggacaagttgggttgggtgggggtcacaggggacagaagctgcacagctgcgccagttttatgtggctgctcaggggatctcttggtcctacagacctgaacccactaactcttcactgaacctatcagtgacatcctttaaaaaaatagtgtatcgagaatatgaaccttactttaaaaaggaaaaacctcaatcaacaatctcaggattactaggaccaacactatatgccgaagtgggggatataattaaagtacactttaagaacaaagccgataaacctctttccatacacccccaggggatcaggtattcgaaactgtctgagggggcttcctatctcgatcacactttcccagctgaaaaaatggatgatgccgtcgcaccaggacgtgaatatacttacgaatggtcaatctccgaagattctggaccaacgcatgatgatcccccatgtctgacacatatctattattcgcatgaaaacctaatagaggacttcaacagtgggctgattgggcccctactgatttgcaaaaaagggactttaactgaagggggaacacagaaaacatttgataaacagatcgtgcttttattcgctgtcttcgatgagtctaaatcttggagtcagtcctccagtttgatgtacacagtcaacgggtacgtgaatggaactatgcccgacatcacagtgtgcgctcatgatcatataagttggcatctcctggggatgagtagtggacctgaattgttctctatccactttaatggacaggtccttgaacagaatcatcataaagtctccgcaattactctagtctccgccacttcaacaacagctaatatgacagtcgggcctgaaggaaagtggataatctcctcgttaactcctaaacatctccaagcggggatgcaggcttatatcgatataaaaaattgccctaaaaaaactcgcaaccttaaaaagatcacacgggaacagcggcgacacatgaaaaggtgggaatattttatcgccgccgaagaagtgatatgggattacgcccccgtaatccccgctaacatggataaaaaatatcgatctcagcacctcgataatttttcgaaccagattgggaagcattataaaaaggtcatgtatacacagtacgaagacgaatcttttactaaacatacagtgaaccctaacatgaaagaggatggaatcctggggccaataatccgtgcccaggttcgcgatacactcaaaatcgtgttcaaaaacatggcgtctaggccatattctatctatcctcacggggttacatttagtccctatgaagatgaagtaaacagttcttttactagtggaaggaacaatactatgatacgcgccgtgcagcccggggaaacttacacttataaatggaatatcctggaatttgatgaacctacagaaaatgatgcacagtgtctgactaggccctattactccgatgtggatattatgcgggatattgcctccgggctgatcgggctactactcatttgtaaatccaggtccttggataggagagggatccagagggcagccgatatagaacaacaggccgtcttcgcagtattcgatgaaaacaagagttggtacctggaagacaatattaataaattttgtgaaaaccccgatgaggtgaaaagagacgatcccaagttttatgagtctaacatcatgtcaactattaatggatacgtacctgagtctatcacaactttaggattctgttttgatgatacagtgcagtggcacttttgttccgtagggacgcagaatgagattctcacaatacatttcactgggcattcattcatctatggaaaacgccacgaagatacattgactcttttccccatgaggggagaatctgtgacagtaactatggacaatgttggaacttggatgctaacatctatgaatagtagtcctcggtctaaaaaactccggttgaaattcagagatgttaaatgcattcctgatgatgatgaggattcttacgaaatattcgagccacccgaatcaactgtgatggctacacggaagatgcatgatagactagaacctgaggatgaggagtccgacgccgattatgattatcagaacaggctagccgctgccttagggatacggtcttttcgaaactctagtctgaatcaggaagaagaagaatttaatcttacagcattagctctggagaatgggacggaattcgtgtcctctaatactgatatcatagtgggatcaaactattcaagtccttcaaatatctccaaatttacagtgaataaccttgctgaacctcagaaagcccccagtcatcagcaggccacaacagcagggtctcctttacggcatctcatagggaaaaattctgtacttaactcctcaacagccgaacactcctccccctatagtgaagatccaatagaagatccactgcagcctgatgtgactgggataagattgctctcactaggagcaggagaattcaaatctcaggagcacgctaaacacaaagggcccaaagtcgagcgagaccaggcagccaagcatagattctcttggatgaaattacttgcccacaaggtgggacggcacttatcccaggatacagggtccccttcagggatgaggccatgggaagacttacctagtcaggatactggatctccctcccggatgcgaccatggaaagatcctccaagtgacctccttctactgaaacagtccaattcttcaaaaatactcgtcggaaggtggcaccttgcctcagaaaaggggagttatgaaattatccaggatacagatgaggatacagctgtgaataattggctcatcagtccccagaacgcctcccgagcctggggggaatcgactccccttgctaacaaacctggaaaacagtcagggcaccccaaattcccacgggtcaggcataaaagtctccaggtaagacaggacgggggaaaatcacgccttaaaaaatcccagttcttaatcaaaacaaggaagaaaaaaaaagaaaaacatacacaccatgctcccctgtctccccggacattccaccctctgaggtccgaagcttataacactttctccgagcgacggctgaaacactccctcgtgctgcacaagagtaatgagacgagtcttcctacagatttgaaccaaacactgccttcaatggacttcggatggatcgcgtcactcccagaccataatcagaacagttctaacgatacagggcaggcttcgtgtccaccaggactctatcagactgtcccccccgaggaacattatcaaacgttcccaatccaggatcctgatcaaatgcatagtacttcagatccctctcacagatcttcttctcctgaactttccgaaatgctagaatatgatcggtcccacaaatccttcccaactgatatcagtcagatgtctccttcttccgagcacgaagtctggcagactgtgatctctccagatctctctcaggttacacttagtcctgagctgtctcaaacaaatttgagtcccgatctgtctcacactacgctgtctccagaactcatacagaggaatctcagtcccgctttggggcagatgcccatctcccctgatctctctcatactactctcagtccagacctttcccatacaacactctccctcgatctctcccagacaaacctgtcccctgaactctctcagacaaatctgtccccagcacttggacaaatgcctctctcaccagatttgtcgcatacaacgctgtctctcgatttttctcagactaacctttcgccagaactgagtcatatgacgctctcccccgaattaagtcagactaatctgtcccctgcgctcggacaaatgcccatatcaccagatctaagtcacactacgttatctctcgattttagtcagacaaatctctctcctgagctctctcagacgaatctgtcaccagccctcgggcagatgccactatcccctgatcctagtcacactacattatcactagatctcagtcagacgaacttgtcaccagaactttcccagacaaatctttcccctgacctcagtgaaatgccactattcgccgatttatcccaaattccactgacacctgatttagatcagatgacactctccccagacctcggggagactgatttatcccctaactttggacagatgtccctgtcccccgatttgtcacaggtgacactttcaccagatatatccgatactacactcttgcctgatctgtcccagatatcacccccgccggatctagatcagatcttctacccaagtgaatcatctcagtcactcttacttcaggaatttaatgagtcctttccttaccctgacttgggacagatgccttctcccagttccccaactcttaatgatacatttctaagtaaggaattcaaccctctggtaatagtgggattatctaaagatgggactgactatatagagatcatccccaaagaggaagtgcaatcatctgaggatgattatgcagaaatcgattatgttccatatgatgatccctataaaactgatgtgcgaacaaacataaactcatcacgagacccagataatatcgcagcttggtatcttcgctcaaacaatggaaacaggcgaaattattatatagccgccgaggaaatatcatgggattattcagaatttgtacagcgagaaacagatattgaagattccgatgatattcccgaagatacaacatacaaaaaagtggtgttcaggaagtatcttgattccactttcactaaaagggatccccggggggaatatgaagaacatctaggaatacttgggcccataatacgagccgaagtagatgatgtaatacaggtgcgctttaagaatctagcgtcaaggccttactccctgcatgctcatggactgagttacgagaaatcttctgaagggaaaacttatgaagatgattccccagaatggtttaaagaagataatgcggttcaaccaaatagttcatacacatatgtatggcatgcaacagaacggtctggacccgaatctcccgggtccgcttgcagggcctgggcttattatagtgcggtgaatcctgagaaagatatccactccgggctgattggacctctgctcatttgtcagaaggggatcctccataaggattcaaacatgccaatggatatgcgagaattcgttctcctattcatgacattcgatgaaaaaaaatcttggtattatgagaagaaatcgcgatcatcctggcgattaacatctagtgaaatgaaaaaaagtcacgaattccatgcaatcaatgggatgatctatagtcttcctggactgaagatgtatgagcaggaatgggtaagactccatctcctgaatataggggggtctcaagatatacatgtggtccatttccacggacagactcttctcgaaaacggaaacaagcagcaccagttgggggtgtggcccctacttcctggatccttcaaaacacttgaaatgaaagctagtaaaccagggtggtggctactgaacacagaagtaggagagaatcagcgcgcaggaatgcagactccttttctcataatggaccgggactgtagaatgccaatgggactgagtactgggataatcagtgattctcagataaaagccagtgaatttctcggatattgggaacctcgactcgcccggcttaataacggagggtcatacaacgcttggtctgtcgaaaaactcgctgccgaatttgcctctaaaccttggatccaggtggatatgcaaaaggaagtgataatcacaggaatccagactcagggggccaaacactatctgaaatcttgttatacaactgaattctatgtggcctactcctccaatcagataaactggcagatcttcaagggaaatagtacacgtaacgtgatgtattttaacggaaattcagatgcatccactataaaagaaaatcagttcgatcctcccatagtggcccggtatatcagaatttcccctactcgggcgtataatcggcccactctccgcttggagttacaggggtgtgaagttaacgggtgttcaactcctcttggaatggagaacgggaaaattgaaaacaaacagatcacagccagttctttcaaaaagagttggtggggagattattgggagccattccgagcacgccttaacgcacaggggcgagtaaacgcctggcaggctaaagccaataacaataagcagtggctcgaaatagatctgctgaaaattaaaaaaattactgcgatcatcacacaggggtgcaaaagtcttagtagtgaaatgtatgtgaaatcatacactatacattactcggaacagggagtggaatggaaaccctataggcttaaatcttctatggttgataaaatattcgaagggaacacaaacacaaaagggcatgtaaaaaatttttttaatcctcccattatatctcgattcatccgagtcattccaaaaacttggaatcagtcaatcgccttaagactcgaactatttgggtgtgatatctat

SEQ ID NO: 9138 - DNA, 6672 bp, Artificial Sequence
  Description of Artificial Sequence: Synthetic coding sequence
atgtttccaggatgtccaagactatgggttttagttgttttaggaacaagctgggttgggtggggaagtcaaggtacagaagcagctcaattaagacagttttatgtagcagctcaagggataagttggtcatatagaccagaaccaacaaattcttcattaaatttatcagttactagttttaaaaaaattgtatatagagaatatgagccttacttcaagaaggaaaagccacaatctactatttcaggacttttaggaccaactttatatgcagaagttggagatataattaaagttcatttcaaaaataaagcagacaaacctttatccatacatcctcaaggaattagatactcaaaattatcagaaggagcaagttatcttgatcatacttttccagcagaaaaaatggatgatgcagtagctccaggtcgtgagtatacttacgaatggagtatttcagaagactcaggtcctactcacgatgatccaccatgtttaacacatatttattatagtcatgaaaatttaattgaagattttaactctggattaattggtcctttacttatttgtaaaaagggaactcttacggagggtggaacacaaaaaacatttgataaacaaattgtgcttttatttgcagtattcgatgaatcaaaatcatggtcccaatcaagttcacttatgtatactgtaaatggatatgttaatggaactatgccagatattacagtttgtgctcatgatcatatatcttggcatttacttggaatgtcttctggaccagaacttttttctatacattttaatggtcaagttcttgaacaaaatcatcataaagtatcagctattactttagtttcagcaacatcaactactgctaacatgacagtgggaccagaaggaaaatggattatttcttcattaactccaaaacacttacaagctggtatgcaagcatacattgatattaaaaattgtcctaaaaaaacaaggaatttaaaaaaaattactagagaacaacgtagacatatgaagagatgggaatactttattgcagctgaggaggtcatttgggattatgcaccagttataccagcaaatatggataaaaaatatagatcacaacatttggacaatttttctaatcaaattggtaaacattataaaaaagttatgtatactcaatatgaagatgaatcatttactaaacataccgttaatccaaatatgaaagaagatggtatattaggtccaattattagagctcaagttagagatactcttaaaattgtttttaaaaacatggctagtagaccatattctatttatccacatggagtaactttctctccatatgaagacgaagttaatagtagttttacatctggacgaaataatacaatgataagagctgttcaaccaggagaaacatatacttacaaatggaacattttagaatttgatgaaccaactgaaaatgatgcacaatgtttaacgagaccatattatagtgatgtcgatataatgagagacattgcaagtggtttaattggtttacttttaatctgtaaatcaagatctttagacagaagaggaattcaaagagcagctgatattgaacaacaagctgttttcgctgtatttgatgaaaataagagttggtatttagaagataatattaataaattttgtgaaaatcctgatgaagttaaaagagacgaccctaaattctatgaatctaatattatgtctacaattaatggatatgttcctgaaagtataacaactttgggattttgttttgacgatactgtacaatggcatttctgtagtgttggaacacaaaatgaaatcttgacaatacattttacgggtcatagttttatttatggaaaaagacatgaagatacacttactttatttccaatgagaggtgaatctgtaacagtaacaatggataatgttggaacttggatgttaacatcaatgaacagttctcctaggagtaaaaaattaagacttaaattcagagatgttaaatgtattccagatgatgatgaggattcttatgaaatcttcgaaccaccagaatcaactgttatggctacaagaaaaatgcatgatagattagaaccagaagatgaggaaagtgatgctgattatgattatcaaaatagattagcagcagcattgggtattagatcatttagaaattcttctcttaatcaagaagaagaagaatttaatttaacagcattagcattagaaaatggtactgaatttgtatcttctaatacagatattattgttggatctaattattcatcaccaagtaatattagtaaatttacagtaaataatttagcagaacctcagaaagctccatctcatcaacaagctacaacagcaggaagtccacttcgtcatttaattggaaaaaattctgtattaaattcatctaccgcagaacatagctctccatattcagaagatcctatagaagatccattacaaccagatgttactggaattagacttctttcacttggagcaggagaatttaaatctcaagaacatgcaaaacataaaggaccaaaggttgaaagagatcaagctgctaaacaccgtttctcttggatgaaattattagctcataaagtaggtagacatcttagtcaagatacaggatctccaagcggaatgagaccatgggaagatttaccatcacaagatactggaagtccatcacgtatgagaccatggaaagatccaccatctgatttgctattattaaagcaaagtaattcatctaaaattctagttggtagatggcatttagcaagtgaaaaaggatcatatgagattatccaagacacagatgaagatacagctgttaataattggcttatttcaccacaaaatgctagtagagcttggggagaatcgactccacttgcaaacaaacctggaaaacaaagtggacatccaaaattcccaagagttagacataaatctcttcaagttcgtcaagatggaggaaaatctaggttaaaaaaatcgcaatttttaatcaaaactaggaaaaaaaaaaaagaaaaacatactcatcatgctccattatcaccacgaacatttcatcctttaagaagtgaggcttataatacattttcagaacgaagattaaaacatagtcttgttcttcacaaatcaaatgaaacttctctccctacagatcttaatcaaacactaccatctatggattttggatggattgcatcattaccagatcataatcaaaattcatctaatgatactggtcaagcttcttgtccaccagggttatatcaaactgttccaccagaagaacattatcaaactttcccaattcaagatccagatcaaatgcatagtacttcagatccttcacatcgaagtagtagtccagagctaagtgaaatgttagaatatgaccgtagtcataagtcattccctacagatatttctcaaatgagtccttcaagtgaacatgaggtttggcaaacagtcattagtccagatttatcacaagttactttatctccagaattatcacaaactaatctatcaccagatttatctcatacaactttgagtccagaacttattcaaagaaatttatctcctgccttaggtcaaatgccaattagtccagatttaagtcatactacgctttcaccagatttatcacatactactttgtcattagatctttcacaaactaatttaagtcctgaattatcacaaacaaatttaagtccagcacttggacaaatgccattaagtcctgatttatcacatactacactatccttagacttctcacaaacaaacttgtcaccagaattatctcatatgacactttcaccagaactatcacaaactaatctttcaccagctttaggacaaatgccaatttctccagatctttcacatacgactcttagtttagacttttctcaaaccaatttatcaccagaactttcacaaactaatttgtcacctgcattaggacaaatgccattatcaccagatccttcacataccactctttcacttgatttatcacaaactaatttatcaccagaattaagtcaaacaaatctttcaccagatctttcagaaatgccattattcgcagatttatctcaaattcctttaactccagatttagatcaaatgacacttagtccagatttaggagaaactgatttatctccaaatttcggacaaatgtcactttctccagacctttcacaagttacattgtctccagatatatctgatacaacattattacctgatttgtctcaaatttctcctccaccagatttagatcaaattttttatccatcagaatcttctcaatcattacttttacaagaatttaatgaaagtttcccatatccagatttaggacaaatgccatctccaagtagtccaactcttaatgatacctttttatctaaggaattcaatcctttagttatcgtaggattatcaaaagatggaactgattatattgaaattatcccaaaagaagaggttcaatcatcggaagatgattacgcagaaattgattatgtaccatatgatgatccatacaaaactgatgttagaactaacattaattcatcaagagatccagataatattgctgcatggtatttaagatcaaataatggaaatagaagaaattactacattgctgctgaagaaattagttgggactatagtgaatttgttcaaagagaaacagatatagaagattcagacgatattcctgaagatactacatataaaaaagtagtttttagaaaatatcttgattcgacattcacgaaaagagatcctagaggagaatatgaagaacatcttggaattttaggtccaattattagagcagaagttgatgatgttattcaagttagatttaaaaatttagcttcaaggccatatagtttacatgctcatggactttcatatgaaaaatcatctgaaggaaaaacatacgaagatgattctccagaatggtttaaagaagacaatgctgttcagccaaattcaagttatacttatgtttggcatgcaactgaaagaagtggaccagaatctccaggaagtgcttgtagagcttgggcatattacagtgcagtcaatccagaaaaagatattcattcaggattgatcggaccacttcttatatgtcaaaagggaattttacataaagattcaaatatgccaatggatatgagagaatttgttttactttttatgacttttgatgaaaagaaaagttggtattatgaaaaaaagagcagatctagttggagattaacatcaagtgaaatgaaaaaatctcacgaattccatgctattaatggaatgatttattctttaccaggtcttaaaatgtatgaacaagaatgggttagattacacttgttaaatataggaggaagtcaagatattcatgtagttcattttcatggacaaactttattagaaaacggtaataaacaacatcaattaggagtctggccacttcttccaggatcttttaaaacattagaaatgaaagctagtaaaccaggatggtggctattaaatacggaagttggagaaaatcaaagggcaggtatgcaaactccattccttattatggatagagattgtagaatgcctatgggactttctacaggtattatttcagattctcaaattaaagcttcagaatttttaggttattgggaaccaagattagctagattaaataatgggggatcttataatgcatggtcagttgagaaattggctgcagaattcgcttctaaaccatggatacaagtcgatatgcaaaaagaagttataataactggaattcaaacacaaggagctaaacattatcttaaaagttgttatactacagaattctatgttgcttattcttcaaatcaaattaattggcaaatttttaaaggaaactctacaagaaatgttatgtattttaatggaaattcagacgcaagtacaattaaagaaaatcaatttgatccaccaatcgtagctaggtacattagaatctctccaacaagagcttataatcgtccaacattaagattagaacttcaaggatgtgaagttaacggatgttcaaccccattaggaatggaaaatggtaaaattgaaaataaacaaattacagcatcatcttttaaaaaatcatggtggggagattattgggagccattccgtgctaggttaaatgcacaaggaagggtaaatgcttggcaagctaaagcaaataataacaaacaatggcttgaaattgatttacttaaaattaaaaaaattactgcaataattacacaaggttgcaagtcactttcatctgaaatgtatgttaaatcttatactatacattatagtgagcaaggtgttgaatggaaaccatatagacttaaatcttctatggtcgataaaatattcgaaggaaatacaaatactaaaggtcatgttaaaaatttctttaatcctccaattatttcacgattcattcgagttattccaaaaacatggaatcaatcaattgctcttagattagagttatttgggtgtgatatttat

SEQ ID NO: 9139 - DNA, 6672 bp, Artificial Sequence
  Description of Artificial Sequence: Synthetic coding sequence
atgtttcccggatgtccccgactgtgggtgctcgtcgttttaggcacgagttgggttggctggggcagccagggtacggaggctgcacagttgcggcagttttacgttgcagcgcaggggatcagctggtcatatcgacctgagccaacaaattctagcctgaatcttagtgtgacatcatttaaaaaaatcgtgtaccgagaatacgagccttactttaagaaggaaaaaccccagagcaccatcagtggtctcctgggacctactctgtatgctgaggtaggtgacatcataaaagtacattttaaaaataaggctgacaagcccctcagtatccatccccaggggattcgctatagcaaactgtccgagggggcctcttatttggatcataccttcccagctgaaaaaatggatgacgcagtcgctcctggccgagagtacacatacgagtggtccataagcgaggattcaggccctactcatgatgatcctccgtgtctgacccacatatactacagtcacgaaaatctgatcgaagactttaatagcggactcattggaccactcctgatctgtaaaaagggtacacttactgagggcggaacccagaagacgttcgataagcagatcgtgctgcttttcgccgtgtttgatgagtctaagtcttggtcccagagttcaagtctgatgtacactgtcaatggatacgtaaatgggaccatgcctgacatcacagtgtgtgcacacgaccacattagttggcatctcctaggaatgtcttccggcccagagctgttttcaattcacttcaatggacaggtcctggaacagaaccaccacaaggtgtccgctattactctggtatccgctacttccacaacggcaaatatgacggtgggacccgagggcaagtggatcatctcttcactgacgcctaaacacttacaagcaggcatgcaggcttatatcgacatcaagaactgtcctaaaaaaacccggaacctgaaaaagatcacccgagagcagagaaggcatatgaagagatgggagtactttatcgctgccgaagaggtcatttgggattatgccccagtcatccccgcaaacatggataagaaatatcgatcccagcacctggacaacttctcgaatcagattgggaaacattataagaaagtgatgtacacccaatacgaggatgagagcttcaccaaacatacagttaatccaaatatgaaagaggacggcatcctcggtccaattattagagcccaagtgagggataccctcaaaatagttttcaaaaacatggcttcccgtccttattccatttacccccacggcgtaaccttttccccctacgaggatgaagtcaactctagttttacctccggacggaacaacaccatgatcagggctgtccaacccggcgagacatacacgtacaaatggaacatattggagtttgacgaacccacagaaaatgatgctcagtgcctaacccgaccatactattctgacgtggacattatgcgagatattgcctccggcctgattggcctgttgcttatctgcaagtccaggagccttgacaggcgaggcatacagcgcgccgccgacatagagcagcaggcggtgttcgctgtttttgatgaaaacaagagctggtatctggaagataatattaacaaattctgcgagaaccctgatgaagtaaaaagagacgaccccaaattttatgagtctaacatcatgtccactattaacgggtacgtgcccgaatcgataaccacactggggttttgttttgatgacactgtacagtggcacttttgctctgtgggaacacagaatgaaatcttaactatacacttcactggacattcatttatctacggaaaacgccacgaagatacgttgacgctttttcccatgcgcggcgaatcagtcactgtgaccatggacaacgtgggcacctggatgttaacgagcatgaattctagccctaggagtaaaaaacttcggctaaagtttcgcgacgttaagtgtattccagacgatgatgaagattcttatgaaatatttgagccacctgagtctacagttatggccacgagaaaaatgcacgacaggctggagccggaagatgaagaaagcgatgcagattacgattaccaaaatcggctagccgcggccctgggcatcaggagctttcgaaattctagcctgaatcaggaggaggaagaatttaacttgacagcactggctctggaaaatggcacagaattcgtctccagcaatactgatatcattgtgggctcaaactattcctctcctagcaatatctccaaatttaccgtaaataatctagcggagccgcagaaggcaccttctcatcagcaggccacaacagccggttcacctctccgccatctcattgggaagaatagtgttctcaactcctctactgccgagcactcctccccctactctgaggacccgatcgaggatcccctgcagcctgatgtaactggtataagattgctctctctaggggccggagagttcaaaagccaggaacatgccaagcacaagggccctaaggtggagcgtgatcaggcagctaagcaccgattcagctggatgaagcttctggcccacaaggttggcaggcatctgtcacaggataccgggtccccctctggaatgcgtccctgggaggatctcccatcacaagacaccggtagccccagcagaatgagaccatggaaggatccgccctcggacctgttattacttaaacagagcaactcaagcaagatactggtggggagatggcatctggcgtcagagaagggctcatatgaaatcatacaggacacagatgaagacactgctgtgaataactggctgattagtccccagaacgcgtcccgggcctggggcgagagcacgccactggcgaataagcctggaaaacagtctgggcaccctaaattccctagggtgcgccacaagagcctccaagtgcggcaggacggtgggaagagtcgcttgaaaaagtcccagttcctgattaagacgcgaaaaaaaaagaaagagaaacatacacaccatgccccactgagcccacgcacgttccatccgctccgctctgaggcatacaatacattttccgagaggaggcttaagcatagtctggtgctgcacaaatccaacgagacttcactccctacagacctaaaccagaccctgcccagtatggacttcggatggatcgcctccctccctgaccacaaccagaactcatccaacgacactggacaggcctcctgtccaccaggattataccagactgttcctccagaagagcactaccagacctttccaatccaggatccagaccagatgcattccacaagtgacccctcacatcgaagctcctcccctgaacttagcgaaatgttggagtatgacaggtctcacaagagctttcctaccgatatttcccagatgtccccttcctccgagcatgaggtgtggcaaacagtgatcagtccggacctgtcccaagtcacgctgtcgcccgagcttagccaaactaatctgagtcccgatttgtctcacacaaccctgagccctgagctcatccagcgaaatctgtctccggctttggggcagatgcctatatctcccgacctttctcatacgacgttaagtcctgacctatcacatacaacccttagcctggatctcagtcagactaatctctctcctgagctgagtcaaactaatctgtcacctgccctggggcagatgcccctatccccagatctgtcacataccacactgtctcttgacttctctcagacaaatttatcccctgaattatcccatatgaccctctcgcccgagcttagtcagactaacctttcccccgccctgggccaaatgcccatttcaccggatctgagtcacaccactctgtccctcgatttctctcagaccaacctctctcctgaactttcccagacaaatttgtcccccgctcttggtcagatgccactcagccccgatccgagccacacgactttgtcattggatctgtctcagacaaacctgtccccagaattgagccagacaaatctgagtcctgatctgtctgagatgcccctctttgccgatctctcacagatccctctgactccagatctagatcagatgaccctgtctccagatctcggagagacagacctttcgccaaactttggccagatgagcctctccccggacctgagtcaggttactctgtctccggatatttccgacacaactctcctccctgacctatcccagatctcccccccacccgacctggatcagatcttttaccctagcgaatcttctcaatccctccttctgcaggagtttaatgaaagcttcccttaccccgacctcggccagatgccatccccgtcatctccaacactgaacgacacgtttctttccaaggagttcaaccctcttgtcatcgtgggactaagcaaggacggaacggattacatcgaaatcatccctaaagaggaggttcagtcttcagaggacgattacgccgagatcgactacgtgccctatgacgacccttacaagacagatgtaagaacaaacatcaattcctccagggatcctgacaatatcgctgcctggtacttgagatcaaacaacggcaatcgcaggaattactacattgctgccgaggaaatttcttgggactactcagagttcgtgcagcgagagaccgacatcgaagacagtgatgacatcccggaagatacaacttataagaaagtagtgttcaggaaatatctggactcaacctttactaaacgcgacccccgaggggagtatgaagagcatctcggcattctcgggcctatcattcgcgctgaagttgatgatgtgatccaggtacgttttaagaacctggctagccggccttactcgttgcatgcccacggactttcttatgaaaagtcctctgaggggaagacatatgaagatgacagcccagagtggtttaaagaagacaacgctgtgcagcctaatagctcctatacctacgtgtggcacgctacagagcgaagtggcccggagtctcctggatcagcgtgtcgcgcatgggcatattactcagccgtgaaccccgagaaagacatacattctggcttgatcggtcccctgctcatttgccagaagggcatcctgcacaaagattcaaacatgccaatggacatgagggagtttgtcctgcttttcatgacattcgatgagaaaaaaagctggtattatgagaagaagtcccggtcctcttggcgacttactagcagcgaaatgaagaagtcccatgagtttcacgcaatcaacggaatgatttactctttgccgggtcttaaaatgtatgaacaggagtgggtcagactgcatctgctcaatattggaggatctcaggacattcacgtggtccacttccatggtcagactcttctggagaacggcaacaagcagcatcagctcggcgtgtggcccctgctgccaggctcattcaaaacactggagatgaaagcaagcaaacccgggtggtggctgttgaataccgaggtgggggagaaccaacgggcgggaatgcaaacaccctttctgatcatggacagagactgtagaatgccaatgggtctctccaccggaatcattagcgatagccagatcaaagcctctgagttcctcggttactgggagcctagactcgcaaggcttaacaatggcggctcctacaacgcatggagcgtggagaaactggcagctgaattcgcctccaaaccatggatccaagtggatatgcagaaagaggtgatcatcaccggtattcagacccagggggcgaaacattacctcaagagctgctatactaccgaattctacgtggcctattcgagtaaccagataaactggcagatctttaagggaaacagcacgcgaaacgtgatgtactttaatggcaattcagatgcttctaccattaaagagaaccagttcgatcctcctattgtcgcaagatacattcgtattagtcccactcgcgcgtacaataggcccacgctacgcctcgagttgcagggttgcgaggtcaatgggtgcagtactccacttgggatggagaacgggaagatcgaaaacaagcaaataacagcaagcagtttcaagaagtcttggtggggtgattattgggagccattcagggcaagactgaacgcccagggtagggttaacgcctggcaggcgaaagccaacaataacaagcagtggctcgagatagatctgttgaaaatcaagaaaatcacagccattattacacagggatgtaagtccctatctagtgaaatgtacgtaaaatcttatacgatacactactccgagcagggcgttgagtggaagccttatcgcttgaagtcttctatggtggacaaaatcttcgaggggaacactaacaccaaaggacatgtgaagaacttcttcaacccaccaatcatctctcgcttcattcgcgttattcctaagacttggaatcagtcaattgctttgagactggagctcttcggctgcgacatttac

SEQ ID NO: 9140 - DNA, 6672 bp, Artificial Sequence
  Description of Artificial Sequence: Synthetic coding sequence
atgtttccaggatgtcccaggctatgggtgctcgtggtgctgggtaccagttgggtggggtggggttcacagggcacggaggccgcccagctgcgacagttctacgtcgctgcccagggcatctcgtggagctacaggcctgaaccaaccaattcaagccttaatttatctgtgacctccttcaagaagattgtgtatcgggaatatgagccttactttaagaaggagaagcctcaaagcacaatctccggcctgctgggccccacactgtatgccgaagtcggcgacattattaaggtgcattttaaaaataaggcggacaagcccctgtctattcacccacaggggattcgttattctaagctgtcagagggagcctcatacctggaccatacgtttccagccgagaaaatggacgatgcagtcgccccagggcgtgagtacacctatgaatggagcatctcggaggattcagggcctacgcatgatgatcccccctgcctgacccatatttactattctcatgagaacctgatcgaggattttaatagtgggctaattggtcctcttctcatctgcaagaaaggcaccttgactgagggagggacacagaagactttcgataagcaaatcgtccttttgtttgccgtctttgatgagagtaaatcatggagccagtccagtagcctgatgtatacggtcaatggatacgtgaacggcaccatgccagatatcaccgtgtgcgctcacgaccatatatcttggcatctgctgggcatgtcctcagggcctgagcttttttcaatccactttaatggccaagtgctggaacagaaccaccataaagtttctgcaataaccctcgtcagcgccacctctaccaccgctaatatgacagtgggccccgaaggcaagtggataatctccagtctgactcctaagcatctgcaagccggaatgcaggcctacattgacataaagaattgtccaaaaaaaacccggaacctgaagaagattacacgagaacaaaggaggcatatgaagaggtgggagtattttattgcagcagaggaggttatctgggattatgccccagtcataccagctaacatggacaagaagtaccgctcgcagcaccttgataactttagtaaccaaattggcaaacactacaagaaggttatgtatacacagtacgaggatgagagtttcacaaagcacacggtcaaccctaacatgaaggaggacggcatactcgggccaatcatccgggcacaggtgcgggataccctgaagatcgtattcaagaacatggcctctagaccttactctatctatccgcacggcgtaacattctctccgtacgaagatgaagtcaatagttctttcactagcggacgtaacaacaccatgatcagggctgttcagccaggagaaacatatacctataaatggaacatcctggaattcgacgaaccaactgagaacgacgcacagtgcctgacccggccctactacagcgatgtggacattatgcgagacattgcctccggcctgattggtttgttgctgatctgcaaaagccggagtctggaccgccgcggtatccaacgggctgctgatatagaacaacaggcagtatttgcagtgttcgatgagaacaaatcctggtaccttgaagataatattaacaaattctgcgaaaatcctgatgaggtcaagcgggatgatcccaaattctatgaatccaatatcatgtccacaatcaacggctacgtgcctgagtccataaccacactcggattctgtttcgacgatactgttcagtggcacttctgctcagtgggcacccaaaatgaaattcttacaatccattttactggccattcatttatctacggcaagcggcatgaggacacacttactctgtttcccatgaggggcgaatcagtaacagtcacgatggacaacgtaggcacctggatgttgacctctatgaattcatcccctcgaagcaagaagctgcgcctgaagtttcgcgacgttaagtgtattcctgatgacgacgaagattcgtacgagattttcgaaccccctgagtcgaccgtaatggctactcgaaagatgcacgaccggctagaaccagaggacgaggaaagtgacgccgattacgattatcagaatcgcctagcggcagctctaggaattcggtccttccgtaacagtagcctgaatcaggaagaggaggagtttaacctaacagccctggctctcgaaaatgggaccgagtttgtgtccagtaatactgatatcattgtcggcagtaattactcctcacctagtaacatttcaaaatttaccgtcaataacttggctgagcctcaaaaagccccatctcaccagcaggccaccactgccggcagtcctctacgccaccttatcgggaagaactccgtgttgaactcgtctacggcggaacactcttccccctatagcgaagaccctattgaagatcctttacaacctgacgttaccggcattcggctcctgagcctcggcgcgggcgagtttaaatctcaggaacacgccaagcataaaggacccaaagtcgaaagagaccaggctgcgaagcatcgctttagttggatgaagctcctggcccacaaagtgggccggcatcttagccaggacacaggaagcccctctgggatgcggccatgggaggatctgccctctcaggacacaggctccccatccaggatgcggccatggaaagatcccccaagcgatctgctcctactgaaacaaagtaatagcagtaagatactcgttggtagatggcacctggcctcagaaaaaggttcctatgagattatccaggataccgacgaagatacagcagtgaataactggctgatttctcctcagaacgcgtcccgagcctggggagagagtactcctttagccaataaaccagggaaacagagtggacatcccaagttccccagagtccggcacaaatccctacaggtacggcaggacggtggaaagagtagattgaaaaagagccagttcctgattaagacacggaagaagaagaaagagaagcacacacaccatgccccgttgtcaccccgaactttccatcctcttagatctgaagcttacaacacattctctgagcgcaggctgaagcacagcttagtgctgcataagagtaatgagacttccctgccaactgatttgaatcagaccctaccatctatggactttggctggatcgcaagcctcccagaccacaatcaaaattcctctaatgacaccgggcaggcgagctgtccgccaggcctgtatcagactgtaccgccggaagaacactatcagacctttccgatacaggacccagaccaaatgcattctacaagcgatcccagtcaccgaagcagtagccccgaactgtctgagatgttggagtacgaccggagccacaagtctttccccaccgatattagccaaatgtctccatcatcagaacatgaagtctggcagactgtgatttccccagacctatcccaagtgacattgagcccggagctttcacagactaatctttctcctgacctgagccacacgaccctaagccctgaactgatacagaggaacctaagccctgctctcggacaaatgccaatttcccctgaccttagccacacgactctgtcccccgacctctcgcataccactctgtctttagatctgagtcagacaaacctgtcaccagagttatcacagaccaacctttcaccagcactcggccagatgcccttatcacctgacctgagtcacaccactctaagcttagatttctcccaaacgaatctgtcgcccgaactcagccacatgactttgtctccagaattaagccaaactaatcttagccctgcactcggccaaatgcccatctcccctgacctttcccatacaactttgagtctggatttttcccagaccaacctgtctccagagctatcccagaccaacttgtcgcccgcgcttgggcaaatgcccctaagccctgatccctcccacacaaccctctccctggacctctctcagactaaccttagcccagagctcagccaaaccaatctcagtcccgacctttcggagatgcccctcttcgcagatctctcccagattcccctcactcccgaccttgaccagatgaccctgtcaccggacttgggtgagactgacctctctccaaactttgggcagatgtctctgtcccccgatctgtctcaggttactctgtcccccgacatctccgacacaacactgctgccggatctgtcacagatttcgcctcccccagatctcgatcaaattttctaccctagcgagtctagccagtctctgctgctgcaggagtttaatgagagtttcccataccctgacctgggacagatgccctccccttcgtctcccacactgaacgatacatttctctctaaggaatttaacccgctcgtgatagtaggtctgtctaaggatggtacggattacatagagattatcccaaaagaggaggtccagagtagcgaagatgactatgccgagattgattatgtgccttatgacgacccttataagacagacgtgcggacgaacataaacagtagccgggatcctgacaatattgccgcctggtatctccggtccaataatggaaaccgacgcaactattatatcgccgcagaggaaatcagttgggactatagcgagtttgtacagcgcgagacggatattgaagattcggatgacatcccggaggataccacctataagaaggtagtctttcgtaaatacctcgactctacttttactaaacgggatcccagaggcgagtacgaagaacacctgggcatactggggccaatcattcgagccgaagtagacgacgtgattcaagtgaggtttaaaaacctggcctctcgaccatactccctgcatgcacatggtctgagctacgaaaagtcctccgagggaaagacctatgaagatgactcaccagaatggtttaaggaagacaacgccgtgcagccaaattctagctatacctatgtatggcatgccacggaacgctccgggcccgagagccccggctctgcttgccgtgcttgggcgtattacagcgctgtgaacccagaaaaggatatccactcaggcctgattggaccccttctgatttgccagaagggaatcctgcacaaggacagcaacatgcccatggacatgcgcgaatttgttctactctttatgacgtttgacgagaagaaaagctggtattacgagaagaagtcccgctcttcatggagactcacatcatcagagatgaaaaaatcccacgagtttcacgctattaatggtatgatttatagccttcctggcctcaagatgtacgaacaagagtgggtacgtctgcatctccttaacatcggcggcagccaggatatacacgtggttcactttcatgggcagacgctcctggaaaatgggaataagcagcatcagctgggcgtttggccactgctgcccggcagttttaagaccttggaaatgaaagcttctaaaccgggctggtggttgctgaacacagaggtgggagaaaatcagcgagctggcatgcagactccttttttaattatggatagagattgtcggatgcccatggggctgagtacgggaattataagcgatagccaaattaaggcctcagagttcctcggatactgggaaccgaggctggcccggctaaataatgggggttcctacaatgcctggtcagtggaaaagctggccgcagagtttgctagcaagccctggatccaagtggatatgcagaaggaagtaattattacaggaatacagacccagggagcaaagcattatctcaagtcatgctacacaacggagttttatgtcgcctatagctctaatcaaatcaattggcagatcttcaagggcaactctacccgcaacgtcatgtactttaatggaaacagcgacgcctcaactatcaaggagaaccagttcgatccacccatcgtggcccggtatatccgtatcagccccacgcgggcctataaccgacctactctacgactggagctgcagggttgtgaggtgaacggatgcagcacaccattggggatggagaatggaaagatcgaaaataagcaaataacagcaagctcctttaagaaaagttggtggggcgattattgggagcccttcagggcacggttgaacgcgcaaggcagggttaacgcttggcaggcaaaagcgaataacaacaagcaatggttagagatagatcttctaaaaatcaagaagattactgccataataacgcaggggtgcaagagtctgagtagtgaaatgtacgtgaaatcctatactatccactatagtgagcagggagttgaatggaagccataccgcttaaagtcatcgatggtggacaaaattttcgagggaaacactaataccaagggacatgttaaaaacttctttaaccccccgattatttcgagattcatccgcgtgattccaaaaacttggaaccagtctatcgcgctgagactggaactgtttggctgcgacatctat

SEQ ID NO: 9141 - DNA, 6672 bp, Artificial Sequence
  Description of Artificial Sequence: Synthetic coding sequence
atgtttcccggttgtccacgcctgtgggttctcgtagttctgggcaccagctgggtcgggtggggaagccagggtaccgaggccgcacagttaagacagttctatgtggcagcacagggcattagttggtcctatcgcccagagccaaccaattccagtctgaacctctccgttacatcttttaaaaaaatagtttacagggaatacgagccctacttcaagaaagagaagccacaatcaactataagcggcctgttaggacccacactatacgccgaggtaggcgacatcataaaagtccactttaagaataaggctgacaaaccactaagcattcatcctcaagggatacgatattcaaagctcagcgagggcgcctcttaccttgatcacacatttcccgcagagaaaatggatgatgccgtggcacccggcagggaatacacctatgaatggagtatcagcgaagatagtggcccaacccatgacgatcccccatgcctgacccacatctattactctcatgaaaacctaattgaagatttcaattctggcctgattggacctctgctgatttgtaagaaaggcactctcactgaaggaggcacccagaaaacctttgataagcagattgtgttactgtttgccgtgttcgacgagtcaaagagctggtcacagagctcatcattaatgtacacagtgaatggctatgtgaacgggaccatgcctgacatcacagtctgtgcacatgatcatatatcttggcatctgctgggcatgtcctcaggccccgagctgttcagcatccacttcaatggccaggtcctagaacagaatcaccataaggtaagcgcaataactctagtttctgctacaagtactacagccaacatgaccgtcggtcccgaggggaagtggatcatctccagtctgacccctaagcatctgcaggccggaatgcaggcatatattgacataaagaattgtccaaaaaaaaccaggaatttaaagaagatcacacgtgaacaacggcggcatatgaagcggtgggagtatttcatcgcagccgaagaagtgatctgggactatgcacctgtgatcccagccaacatggacaaaaagtatagaagccagcaccttgataactttagcaatcagataggcaaacactacaagaaggtgatgtatactcagtacgaagacgagagttttactaagcacactgtgaatcccaatatgaaggaggatggaatcctgggacctataatccgggcccaggttcgggataccttgaaaatagtgtttaagaatatggcctcccgcccctattctatctatcctcacggcgtgacattctccccttacgaggatgaggtgaatagcagtttcacttctgggcgaaataacacaatgataagagccgtgcagcctggtgagacatacacatataagtggaacattttagagttcgacgagcccaccgaaaacgatgcccaatgtttaaccaggccttattattcagacgtcgatattatgagagatatcgctagcggcctgatcggactcctgcttatttgtaaaagtcgctctctggatcggcgtgggatccagcgggctgctgatattgagcagcaagccgtttttgctgtttttgacgaaaacaaatcctggtacctggaggacaacattaataaattctgtgagaacccagatgaagtaaagcgagacgaccccaagttttacgagagtaatataatgagcacaataaacggctatgtgccagaaagcattacaacactcggcttttgtttcgatgacacagtccagtggcatttttgcagtgttgggacccagaatgagattctcacaattcactttacaggccacagcttcatatacgggaaaagacatgaggacaccctcaccctcttccctatgaggggggagagcgttaccgtaactatggataacgtaggcacctggatgttaacaagcatgaacagctccccacggagcaagaagctgagattaaagttcagggacgttaagtgcattcccgatgacgacgaggattcttacgaaatttttgaaccccctgaatcaaccgttatggcaacacgcaagatgcatgatcgccttgagcctgaggacgaggagtctgatgccgattacgattatcagaatcgactggctgccgccctgggcatcagatcttttaggaactcttccttaaatcaggaggaagaagagtttaacctgaccgcactggccctcgaaaatggcaccgagttcgtgtctagtaataccgacataattgttggatccaattattcctctcccagtaacatctctaagttcacagttaacaatctggccgagccccaaaaggccccaagccaccagcaggcaactaccgcaggtagtcctctgaggcatctcattggcaaaaatagtgtgttaaattcctccactgccgagcattccagtccttactccgaagaccctatagaggatccactgcaacctgatgttacaggtataaggttactgagcctaggcgctggcgagttcaaaagccaagagcacgcaaaacacaaaggccctaaggtcgagagagaccaagcagccaaacatagattctcctggatgaagctgctggcccacaaagtggggaggcatctaagtcaggacacaggctcccctagcggtatgcggccatgggaggatctccccagccaggacaccgggagcccttcaagaatgcggccctggaaggacccaccctccgacctactattgctaaagcagagtaacagcagcaagatactggtgggcaggtggcacctcgccagtgaaaagggcagctacgagataattcaggatacagacgaggacaccgccgtgaacaattggctgattagccctcagaatgcctcccgcgcttggggggaaagtactcctctcgccaacaaaccaggaaaacagtccggacacccaaagttccccagggtgcgacataagtccctgcaggttcgacaggatggcggtaagtctcgtctgaagaagagccaattcttgatcaagacaagaaaaaagaagaaggagaaacatacacaccatgcccccctttcaccacgaacattccaccccctacgctccgaagcctataacacctttagcgagcggcgcctgaagcattccctcgtcctccacaagtccaacgagacatccctccctactgatctcaaccagaccctaccgtctatggacttcgggtggatcgcctccttacctgaccacaaccagaattctagcaacgacaccggccaagcctcttgcccaccaggtctgtaccagactgtgccccctgaagaacattatcagaccttccctatccaagaccctgaccagatgcactctacatcagatcccagccaccggagctcttccccagagctatccgaaatgctggagtatgatcgatctcataaatcatttcccaccgatatcagccagatgtcaccctctagcgaacacgaggtctggcagaccgtgattagtcctgatctgagtcaggttaccttgtcccccgagctgagtcagacaaatctgtcccccgatctgtcccacaccaccctctcccctgaattgatccaaaggaacctgtcccctgccctgggacagatgcctataagcccggacctcagtcacacaaccctgagtcctgatctgtctcataccactctgtctctggatctctcccaaaccaatctgagcccagagctcagccaaaccaacctgtctcctgcactaggccagatgccactgagtccagacctttcccacaccaccctatccctggatttttcacagactaacctgtcacccgaactgagtcatatgaccctatctcccgaactctctcaaacaaacctcagccccgccctcggacaaatgcctataagcccagatctctcccataccacactgagtctggacttcagccagacaaatctctctccagaactgagtcagacaaatctatcacctgcactaggacaaatgcctctgagcccagatccatcacatactactctgtctctggacctctctcaaacaaacctgagccctgagttaagtcaaactaatctgagtcctgacctcagtgaaatgcccctgttcgcagacttaagccaaatccctctgacacccgacctggaccagatgacactgtctccagatctaggcgaaactgacctgtcccccaactttggccaaatgagtctgtctccagacctgagtcaagtgacattatccccagacatctctgatacaactcttctcccagatctgtcccaaattagcccccctcccgacctcgaccagatattttaccctagcgagtcctcccagtctttactattacaggaattcaacgagtcatttccttatcccgacctcgggcagatgccttctccatcctccccaaccctcaatgatacattcctgtccaaggaattcaaccctttggtaattgtgggtctgagcaaggacggtaccgactacattgagatcataccaaaggaggaagtacagagttctgaggacgactatgccgagattgactatgttccctatgacgacccatacaaaaccgacgtacgcacaaacattaattcctcccgcgaccccgacaatatcgccgcctggtatttgaggagtaataatggaaaccggaggaattactacatcgccgctgaggagatttcctgggactacagtgagttcgtgcaacgcgagactgatatcgaggacagcgacgacatcccagaggatacaacatacaaaaaagtggtctttcgaaagtatctggacagtacatttacaaaacgcgatcctcgaggggaatatgaagaacacctgggcatactgggcccaataatccgggctgaagtggacgacgttatccaggttcgattcaagaacctggcatcacggccctacagtctgcatgcacatggtctgagctatgaaaaaagttctgaaggaaagacttacgaggacgatagcccagagtggtttaaagaagataatgccgtgcaacctaactcttcttatacctatgtgtggcatgccactgaacgttcaggacctgagagtcccggctcagcatgccgcgcatgggcatactattccgccgtgaatccagaaaaggacatacacagtgggctaatcggccctttactaatatgccagaaagggatcctgcataaagattctaacatgcctatggacatgcgagagttcgtgttactctttatgaccttcgacgagaagaagagttggtactacgagaaaaagagtaggtcatcttggcgactgaccagctccgaaatgaaaaagtctcatgagtttcatgccataaatggcatgatctattctctgcctggtctaaaaatgtatgagcaggaatgggtgcggctgcatctcctgaacatcgggggtagtcaggatatacatgtggtgcactttcacgggcagactttactggagaacggcaacaagcagcaccagctgggagtgtggccactcctaccaggatccttcaaaacactggagatgaaggcatcaaagccagggtggtggcttctgaacaccgaagtcggcgagaatcagagggctggtatgcagacccctttcttaatcatggaccgcgactgtagaatgccaatgggtttatcaaccggtattatctccgatagccagataaaggcaagtgaatttctgggctactgggaaccacgactagcaagactaaacaatggagggtcatacaacgcatggtccgtcgagaaactagctgctgaattcgcctctaaaccttggattcaggtggacatgcaaaaggaggtgattatcactggcatacagactcagggggctaaacattacctgaagagttgttataccacagaattctacgtggcctactccagtaaccaaattaactggcagatctttaagggcaacagcactagaaatgtcatgtacttcaacggcaacagtgatgcatcaacaatcaaggaaaaccaattcgaccccccaatcgtcgctagatacatacggatttccccaaccagagcttacaacagaccaaccttaaggctagaactgcagggatgcgaagttaatgggtgctcaactcccctgggcatggaaaacggcaaaattgagaacaaacaaatcaccgctagctcattcaagaagtcttggtggggagactattgggagccttttcgtgcccggctaaatgcacagggcagagtgaacgcttggcaggctaaggccaataataataagcagtggctggagattgatctgctgaaaataaagaaaatcaccgccatcataactcaagggtgtaaaagcctgagtagcgagatgtatgtcaagagttataccatacactactccgaacagggcgtggagtggaagccttaccgtctaaaaagttctatggttgataaaatttttgaaggtaatacaaatacaaaaggccatgtgaaaaatttcttcaaccctcctataatctctcgatttattcgagtgatccccaaaacctggaaccaaagtatagcactacgcctcgaactgtttggctgcgatatttat

SEQ ID NO: 9142 - DNA, 6672 bp, Artificial Sequence
  Description of Artificial Sequence: Synthetic coding sequence
atgttcccaggatgcccacgtctgtgggtgctcgtagtgctggggaccagctgggtggggtggggatctcagggcacggaagcagcccagctccgtcagttttacgttgcggcccaggggatatcttggtcatatcgtcccgagcccacaaactctagccttaacctgtcagtgaccagcttcaagaagatcgtgtatcgggagtacgaaccatacttcaaaaaagagaagccacagtccaccatcagcggattgcttggacccacgttgtacgctgaggtgggcgatattatcaaagtgcattttaagaacaaagctgataagcctctgtctatccacccccagggcatccgctacagtaagttatccgaaggagcctcgtatttagaccatacctttccagccgagaagatggatgacgcagttgcgccaggacgcgagtacacatacgagtggtctatttcagaggatagcggcccaacccacgacgaccccccctgtcttactcacatctactactcccatgaaaacttgatagaagattttaattcgggcctcattggtccacttctgatctgtaagaagggcactttaactgagggcgggacccagaagacatttgacaagcaaatagttctactattcgctgtattcgatgagagtaaatcttggagccagagctcctcgctcatgtatacagtgaacggctatgtcaatgggacaatgccggatatcactgtttgtgctcacgaccacatctcatggcatttgctgggaatgagctctggcccagaactgttttctattcactttaacgggcaggtgctggagcagaatcaccataaggtgagcgcaatcacgcttgtcagtgctacctccactaccgctaacatgacagtggggcccgagggcaaatggattattagctcccttaccccaaagcatctgcaggctggtatgcaagcatatatagatataaaaaactgcccaaagaagactcgtaacttaaagaagattaccagagagcagcgacggcatatgaagcgctgggagtactttatcgccgccgaagaggtcatctgggactatgctccagtgatccccgctaatatggacaaaaagtatcgttcacagcatctggataatttcagtaatcagatcggcaagcactataagaaagtgatgtatactcagtacgaggacgaatctttcacaaaacacacagtcaaccctaatatgaaagaagacggaatactgggaccaattatccgagcacaggtgagggacaccctcaaaatagtgttcaagaatatggcatccaggccctactctatctacccccatggtgtcacattttccccctatgaagacgaggtcaactccagtttcaccagcggccgaaacaatacaatgattcgggccgtccagccgggcgagacttacacctataagtggaacattctcgagttcgatgagcccaccgagaacgatgctcagtgccttacgcgaccttactactctgacgtggatataatgagggacatcgcctccggcttgattggcctgctcctcatctgcaaaagcaggagtctggatcgccgggggatacagcgcgcagcagatatcgagcaacaggccgtctttgccgtctttgacgagaataaatcctggtacctggaagacaacattaacaaattttgtgagaatcctgatgaagttaaacgtgacgatcctaagttctatgagtcaaatatcatgtccacgattaacggatatgttccggaatctattaccactctggggttctgcttcgatgatacagtgcagtggcatttctgttcggtagggacccagaacgaaatcctcacaatccactttaccgggcactccttcatttacggcaagcggcacgaggacacccttacattatttccgatgcgcggcgagagcgtgactgtgactatggacaatgtgggcacttggatgctgacgagcatgaactcttcccctcgatccaagaagttaagactgaagtttcgagatgttaaatgcatacctgacgatgatgaggactcctatgagattttcgaacccccggagagcaccgtgatggcaacgcgtaagatgcacgatcgcttggaaccagaggacgaggaatccgatgctgactatgattaccagaatcggctcgctgcagccctcggaatacgaagtttccggaactcatcattgaatcaggaggaggaagaatttaacctgaccgccctggcactggaaaacggcaccgagtttgtcagctctaataccgacatcatcgtgggatcgaattactcaagcccatcaaacattagtaagtttaccgtcaataacctcgccgagccgcagaaggctccgtcacatcagcaagccacaacagcgggcagccccctgaggcacctgatcggcaagaactcagtgctcaattctagcacagctgaacatagttctccatactccgaggatccaatcgaggacccactgcaaccggatgttacaggcatcaggctgctgtccctgggcgccggcgagtttaaaagccaggagcacgccaagcacaaagggccaaaggttgaaagggaccaggccgccaaacaccgcttctcatggatgaagctccttgctcataaagtgggacggcatctctctcaggacaccggcagcccaagtgggatgagaccatgggaagatttaccgagccaggatacgggcagtcccagtcgtatgcggccgtggaaagaccctcctagcgaccttttgctgcttaaacagtcaaacagcagcaagattctggtcggtcgctggcacttagcttctgaaaagggaagctacgaaattattcaggacaccgacgaggacaccgcagttaacaattggctaattagtccacagaacgccagcagggcctggggcgaaagcacccccctggcaaataagcctgggaaacagtccggtcatcctaagttccccagagtgaggcacaaatccctgcaggttcgccaagacggcggcaagagcaggctcaagaagagccagttcctgatcaagactcgaaagaagaagaaggagaagcacacccatcacgctccactgtccccgaggaccttccatcctcttaggtccgaagcatataatacctttagcgagaggcggctcaaacactccctggttctacacaagtcgaacgaaacaagcctcccaaccgacttaaatcagacccttccatctatggacttcggatggattgctagcttgcctgatcacaaccagaacagttccaatgacacgggccaggccagttgcccccctggcctttaccagacagtgccccccgaagaacattaccaaactttcccgatacaagacccggaccagatgcactccacgtctgacccctctcacaggtcatccagcccagagcttagcgagatgctagagtacgatagatcacacaagtccttcccgaccgatatttcacagatgtctcctagctccgagcacgaagtctggcagacagtcatctcaccagacttatcccaagtaacactaagccccgaactgagtcagacaaatcttagtcctgatctcagtcatacgaccctgagtccagagctgatccagcgaaacctatcacccgccctgggccagatgcctattagtcccgatttgtctcacaccacactgtctccagacttgtctcacacaactctctccctggacctaagtcaaaccaatctatcacctgaactttctcagacaaatctgtcgccagctctggggcagatgcccttatcacctgatttgagtcataccacattgagtttagattttagccagaccaacctgagtccagagctgagccacatgactctgtctcccgagcttagccagaccaatctgtcaccagccctgggccagatgcccatcagtcccgacttaagccacacaaccctgtcacttgatttctcacaaaccaacctttcccctgagctgagccagacaaatctctcgccagccctgggtcaaatgcccctcagccccgacccgtcacataccactctgagcctcgacctctctcaaaccaatctctctccagagctctcccagaccaatctgagtcccgacctgagcgagatgcccctgttcgcagacctatctcagattccacttaccccggacctggaccagatgactctctctccagacttgggagaaacggatctgagccctaatttcggccagatgtctctctcccccgatctctcccaggtaacactatcgccggacatcagcgacaccaccttgttaccagatcttagtcagatatctcctccacctgacctggatcagatcttctaccccagcgaaagttctcagagcctcctgttgcaggagttcaatgagtccttcccttacccagacctagggcagatgccatccccgagctcccctaccctgaatgatacgttcctcagcaaagagttcaatcctttggtaattgtggggctctcaaaggatggcacagactatattgagataattcccaaggaggaagttcagtcgagcgaggacgattatgcagaaatcgattacgttccatatgatgacccgtacaagacggatgtccggaccaatattaactccagccgggacccagataatatcgctgcctggtacctccggtccaacaacggaaaccggcgcaactactatatagccgccgaagagattagctgggattatagtgagttcgtccagcgggaaacagacattgaggacagcgatgacatccccgaggatacaacctacaagaaggttgtttttcgcaagtaccttgactctacgttcaccaaacgcgaccccagaggcgagtatgaagagcacctgggcatcttggggcctatcatcagggctgaggttgatgacgttatacaggtgcggttcaaaaatctcgcctcccgaccgtactccctccacgcccacggactgtcttacgaaaaaagctctgaaggaaaaacctacgaggatgacagtccagagtggttcaaagaagataatgccgtccagcctaactcaagctacacctacgtatggcacgcaaccgagcgcagtggaccagagtcaccaggatcagcatgccgagcttgggcgtattatagcgctgtgaatccggagaaagatatccactctgggttgatcgggccactgctgatctgccagaaagggatactacataaggattctaatatgcccatggacatgcgcgaatttgttctcctctttatgacattcgacgagaagaagtcttggtactacgagaaaaaaagtcgcagttcatggagacttacatcttctgaaatgaagaaatctcacgaatttcacgctatcaacggtatgatatatagtttgcctggcctaaagatgtacgaacaggagtgggtccggttgcaccttttgaacatcgggggaagccaggacatacacgtggtccactttcacggacagaccttattagagaatggaaacaaacagcaccagctgggggtgtggcctctgctcccgggttcctttaagacgttggagatgaaagcatcaaagcccgggtggtggctactaaacaccgaagtcggggagaaccagagagccggcatgcagacaccttttttaattatggaccgcgattgcaggatgccgatggggctgagcactggaataataagtgactcccagattaaggcttctgaatttcttggatattgggaaccccgactcgcgcgcctgaacaatggcggcagctacaacgcgtggtcagtcgagaagctggccgccgagtttgctagcaaaccctggattcaggttgacatgcaaaaggaggttatcatcacagggattcaaacccagggtgctaagcattaccttaagtcatgttatactacagagttctacgtggcttatagtagcaaccagatcaactggcagatctttaagggtaactcaactcgcaacgtgatgtactttaacggcaacagcgatgcctcaactattaaagaaaatcagtttgacccccctatcgtcgcaaggtacattagaatctcgcctacgagggcatataatcggccaactctgaggcttgagctgcagggctgtgaggtaaatgggtgttctactccgctgggcatggaaaacggtaaaatagagaacaagcagatcacagcttcatccttcaagaagagttggtggggagactattgggagccatttcgggctcgccttaacgcacaagggagggtcaatgcctggcaagctaaggctaataataacaagcaatggcttgagattgacctgctcaagatcaagaagatcacagcaattatcacccaagggtgtaagagcctgtcatcagagatgtatgtcaaaagctataccatacattactctgagcagggggtagaatggaagccttacaggttgaaatcttctatggtcgacaagatctttgagggcaacacgaatacaaaggggcacgtgaaaaattttttcaatcctcctatcatttcaagatttatccgggtgattcccaaaacctggaaccagagcatcgccctgcgtttagaactgtttggatgcgatatttat

SEQ ID NO: 9143 - DNA, 6672 bp, Artificial Sequence
  Description of Artificial Sequence: Synthetic coding sequence
atgttccctggatgtcctcggctctgggtattggtggttcttggaaccagctgggtaggttggggctcccagggtactgaggccgcccaactgcgccagttttacgtagccgcacagggaatttcatggtcataccgaccagagccaaccaattcgtccctcaatctcagcgtcacctctttcaaaaagattgtctatcgggaatatgagccgtactttaagaaggaaaaaccacagtccacaatttcaggactgctgggtccaacgctttacgcggaggttggtgacattattaaggtccattttaagaacaaagccgataaaccactttctattcacccgcaaggtattagatatagcaaacttagcgaaggagcttcttatttggatcatacgttccccgccgaaaagatggatgatgcagtagctcctggaagagagtacacatatgaatggtccatcagtgaagattcgggaccgacccatgatgatccaccatgccttacacacatatattacagtcatgagaatctcattgaggattttaactctggtcttatcgggcctctcctcatttgtaagaaaggaactttgacagaaggaggaactcaaaagacgtttgataaacaaatcgttcttctattcgctgtttttgatgagtcgaaatcttggagtcaaagttcctcgctaatgtacacagtgaacggatacgtaaatggtaccatgccagatattaccgtatgtgcccacgatcatatttcttggcatctcctaggtatgagctccggaccagaacttttcagcatccactttaatggacaagtactggaacagaaccatcataaggtatcagcaatcactctcgtgagtgctacctctacgacagctaatatgactgtcggaccagaaggaaaatggataatttcatctcttaccccaaagcatttgcaggctgggatgcaggcttatattgatataaaaaactgtccaaaaaaaacaagaaacctaaaaaagattacaagagagcaacgcagacatatgaaaagatgggaatattttatcgcagctgaggaagttatttgggattatgcgccagttattcctgctaatatggataagaaatatagaagtcaacatttagataacttttcgaatcagataggaaaacattataaaaaggtgatgtatacacagtacgaagacgaatcgtttacaaaacacacagtcaatcctaatatgaaggaagatggaatcctcggacccatcattagggcccaagtaagagacacactgaaaattgtttttaagaatatggcatctagaccgtatagtatttatccacatggggtcactttctcaccttacgaggatgaggtaaattcgtcctttacatctggacgaaacaacacaatgattagggcggtccaaccgggagaaacctatacatataagtggaatatattggaatttgatgaaccgactgagaatgatgcacagtgcttgacaagaccttattattctgacgtggacattatgagagacatagccagtgggctaataggtcttcttttgatttgtaaatctcgttcacttgatagaagaggcattcaacgggccgccgatatagaacaacaggccgtattcgcagtttttgatgaaaacaaatcatggtaccttgaggataacatcaacaaattttgtgaaaatccggatgaagtcaaacgcgatgatcctaagttttatgaatcaaatataatgtccactatcaacggatatgttccagaatcaataacaaccttgggattttgttttgatgatacggttcaatggcacttttgttcagtaggcacgcaaaatgaaattctaaccatccatttcacaggacatagcttcatatatggaaaacggcacgaggacactttgactttgtttccgatgcgaggggaatctgttaccgtcacaatggataatgtaggaacctggatgttgactagtatgaatagctccccgaggtcaaaaaagctacgcttgaagtttcgtgatgtgaagtgcattccggatgacgatgaagatagttatgaaattttcgaacctccagaatcgacagttatggcaactcgaaaaatgcacgatagacttgagccagaagatgaagaatcagatgcggattatgattatcaaaatcggcttgccgctgcactcggaatccgatctttcaggaactcttctctcaatcaagaagaagaagaattcaatttgactgctttggcgttggaaaatggaactgaatttgtcagttccaacacggatattatcgttgggtcgaactattcctcgccgagtaacatatccaaatttacggttaacaacttggcagaaccccaaaaggcaccatcacaccaacaagctacgaccgcaggctcaccgctacgacatctgatcggaaagaatagtgtgctaaattcttccaccgccgagcattcgtctccctattccgaagaccctatagaggacccactgcaaccagatgtgacaggaatccgtctgctatcattgggagcaggtgagtttaaatctcaggagcatgctaagcataaaggacccaaggtcgaacgtgaccaggctgccaaacatagattttcatggatgaagcttcttgcccacaaagtaggacgacatctgagtcaggatactggcagcccgtccggtatgcgcccatgggaagacctcccaagtcaagatacaggatctccgtcacggatgaggccatggaaagacccaccttcagaccttctgttgctaaaacaatctaacagctccaaaatattggtcggaaggtggcatcttgcgagcgaaaaaggctcctacgaaattatccaagacactgacgaggacactgctgtcaacaattggctgatctcaccacaaaatgcgtcccgcgcatggggagagagcacaccattagcaaataaaccaggaaaacagtctggacatccaaaatttccgcgtgtgcgacacaagtcacttcaagttagacaagacggaggcaagtcgagactcaaaaaatcgcaattcttgattaaaacccgtaagaaaaaaaaagagaaacacacacatcatgctccgctctctccaagaacctttcatccattgagaagtgaggcctataatactttcagcgaacgacgactcaagcattctttggtgttgcataagagcaatgaaacttcgctgccaacggatcttaatcaaactctgccttcgatggattttggatggattgcatctcttcctgatcacaatcagaattcatctaacgacaccggccaagcatcctgcccacccggtttgtatcagactgtgccaccagaggagcattaccaaaccttccctatccaagaccctgatcaaatgcactcaacatcagatccttctcatcgtagttctagcccagagttgtcagaaatgctggaatatgacagatctcacaagagctttccgaccgatattagtcaaatgtcgccatcttccgagcatgaagtatggcaaactgtgatctcgccagaccttagtcaggtgacattgagtcctgaattgtctcagacaaatttgtcccctgatctttcacacacaactttgagtccagagttgatacagcgaaatctgtcaccagcacttggacagatgccgatatcaccagatctcagtcatacaacgctctcaccagacttatctcacactactctttcactcgacctgtcacaaacaaacctatcacctgagttaagtcaaactaatctctcgcctgcattaggacagatgccactgtctccagatttgtcccatacaacactctccttggacttctcacaaacaaacctctctcccgagctgtcacacatgactcttagcccagagctttcccagactaatcttagcccagcgctgggacaaatgccaatttctcccgatctatcgcacactacactttccctggatttttcacagacaaatctaagtccggagctgtcgcagacaaacctaagtccggcccttggacaaatgccgttatcccccgacccatctcatacaacattgtcgcttgatttaagtcagacaaatttgtcgccggagctctcccagacaaatctgagtcccgatttgtcggaaatgccactgttcgcagatttgtcacaaattcctttaactccagacctcgatcaaatgaccttatcaccagatcttggagaaacagatctctctccgaattttggacagatgtccttatcacctgacctttcccaagtgacacttagtccagatatatccgacactactctattgccagatctatcccaaatttcaccacctcctgatttagatcaaattttctacccctctgagtcatcacaaagtttgttacttcaagaattcaatgaatcgttcccatatccagatctcggacagatgccatcaccatcgtcgccaaccttgaacgatacttttctgtctaaagagtttaatccattggtgatcgtcggactgtcaaaagatggaaccgactacatagagattattccaaaggaggaagtgcaaagtagtgaagatgattacgctgagatcgactacgtaccatatgacgatccctataagacggacgtacgaacgaacataaattcaagtagagatcccgataatattgcggcttggtatcttagatcgaataatggtaatcgcagaaactactacattgctgcggaggagatctcctgggattatagcgaattcgtgcaaagggaaactgacatagaggattctgatgatattccagaagatactacttataaaaaagttgtatttcgtaagtatttagactctactttcaccaaacgtgatccacgtggagagtatgaagaacatctcggaatacttggtccaatcattagagcagaagtagatgatgttattcaggtgcgttttaagaatcttgcaagcagaccgtactcgctccatgctcatggtttgtcttatgaaaagtcttcggaaggaaaaacttatgaagatgactctccagagtggtttaaggaggataatgctgttcaaccaaattctagttacacgtatgtttggcatgccaccgagagatcaggaccggagtctccaggaagtgcctgtcgggcttgggcttactattccgctgtaaacccagaaaaggacatccatagtggactcatcggtccgttgcttatatgccaaaaagggattcttcacaaggattccaatatgccaatggacatgagagagttcgtactcctatttatgacgttcgatgaaaaaaagtcgtggtattatgagaagaaatccagatcatcttggcgactaacatcgtccgaaatgaaaaagagccatgaattccacgctatcaacggtatgatatattcacttccaggattgaaaatgtacgaacaagaatgggtacgactacatttactgaacattggtggaagccaagatattcacgttgtccatttccacggtcaaacgttgttggaaaacggtaacaagcaacatcaacttggagtctggccgcttctccctggatcatttaaaacactcgagatgaaagcttctaagccgggctggtggttgttgaatactgaagtgggagaaaaccaacgagcgggtatgcagactccgtttttaataatggatagagattgtcgtatgccaatgggactttcgactggaatcatatccgacagtcaaattaaggcctccgaatttctcggatactgggagccgcggttggcacgtcttaataacggaggatcgtacaatgcatggtcagtcgagaaactcgcggcagaatttgcatcaaaaccatggatacaggtggatatgcaaaaggaagtaattattaccggaattcaaactcaaggagctaagcactatctcaaatcttgctacacaactgagttctacgttgcatatagctctaaccaaatcaactggcaaattttcaagggaaatagcacaagaaacgtcatgtatttcaacggcaactcggatgctagtacaattaaggaaaatcagttcgatccacccatcgtagcacgctatattcgtatctcaccaactcgcgcttacaaccgaccgacgctgcgtttggaattgcaaggatgtgaagttaacgggtgttcaacgcctttgggaatggagaatggtaagattgaaaataaacaaattaccgcctcatcttttaagaagtcgtggtggggagattactgggaacctttcagggcccgtttgaacgcacaaggtcgagtaaatgcttggcaagctaaagctaataacaacaagcaatggcttgaaattgatttgctcaagattaaaaagattactgctatcatcactcaaggatgcaaaagtttgagttctgagatgtacgtgaaatcatacactattcattattctgaacaaggggttgagtggaagccttaccgtcttaaaagttcaatggtcgataaaatatttgaaggaaataccaatacaaagggacatgtcaaaaatttttttaaccccccaattatctcgcgatttattagagtaattccaaagacatggaatcaatcaattgccttgcgacttgaactttttggatgtgacatctat

SEQ ID NO: 9144 - DNA, 6672 bp, Artificial Sequence
  Description of Artificial Sequence: Synthetic coding sequence
atgttcccagggtgccctaggctctgggtgctcgtcgttctgggtacaagttgggtcgggtggggctcacagggaacggaggccgcacaattgcgccagttttatgtcgcggcccagggaatcagctggagttacagacctgagcccaccaattccagtttgaatctttctgttaccagttttaagaagattgtgtatagggagtacgagccttactttaagaaggagaagcctcagagcactatctctggcctcttaggacctactctctatgccgaagttggcgacattataaaggtgcacttcaagaacaaggcagataagcctttaagcatccatccacagggcataagatacagcaagcttagcgaaggcgcatcctatctcgatcacaccttccctgcagaaaaaatggacgacgcagttgcaccggggagagagtacacctacgaatggagtatcagcgaggattctggccctacacacgatgacccaccttgtttgactcacatttattactcacatgagaacctgatagaggacttcaatagtggcctgataggtcctctgttgatttgcaagaaaggcaccctgactgaggggggaacccagaagacattcgacaaacagattgtgctgctttttgccgtgttcgacgaatctaagtcctggtcccagagttcgtcactaatgtataccgttaatggatatgtaaatggcactatgcccgatattacagtgtgtgcccacgatcatatctcctggcacctgctgggcatgtcatctgggccagaattgttctcaattcacttcaatgggcaggtgctcgaacagaatcatcataaggttagtgccataaccctggtctccgctacctcaactacagccaatatgactgttggtcctgagggaaagtggatcatctcttctttgaccccaaaacatctgcaggctgggatgcaagcttacatagatatcaagaattgcccgaaaaagacccgcaacctaaaaaaaattacgcgcgaacagcgcaggcacatgaagcggtgggagtactttatcgccgcagaagaagtgatctgggattatgctcccgtaattcccgcaaacatggacaagaaataccgctcgcagcacctggacaacttttccaatcaaataggcaaacattacaagaaggtgatgtatactcagtacgaggacgagtcgttcacaaaacacaccgtcaacccaaatatgaaggaggatggaatcctagggcccattattcgcgctcaggtcagagatacactgaaaatcgtgtttaagaatatggcgagtaggccatatagtatatacccccacggtgtgactttcagcccatacgaggatgaagtaaacagctcctttacaagcggtcggaataacaccatgattcgcgccgtgcagcccggcgagacgtacacctacaagtggaacatactggaatttgatgaacctacagagaacgacgctcaatgcctgaccagaccctactactccgatgtggacattatgagggatatcgccagcggcctgatcgggttgcttctgatctgtaagagccggagtctcgataggcgcggcattcagcgagccgcggacattgagcagcaggctgtattcgccgttttcgatgagaacaagtcatggtatctggaagacaatatcaataaattctgcgagaaccccgacgaggttaagagggacgatccgaagttctatgagtccaatatcatgagtacaataaatggatacgtcccagagtcaattacaactttgggattctgtttcgatgacaccgttcagtggcatttttgcagcgttggtactcagaacgaaattctcacaatccacttcacaggccactcctttatttacgggaaaagacacgaagatactctcaccctgtttccaatgcggggcgagtcagtgaccgtaacaatggacaatgtaggaacatggatgctcacttctatgaacagcagcccaagatcgaaaaagcttcggttgaaattccgcgatgtgaaatgcatccccgacgacgacgaagattcttacgaaatctttgaacctcccgagtctacagttatggcaacacggaaaatgcatgacagactggaaccggaggacgaagagtccgacgctgattatgattatcagaacagactggcggcagccctggggattagaagcttccgcaatagctcgttgaaccaggaggaagaggaattcaacctcactgcattagctctcgagaacggaaccgaatttgtgagcagcaacaccgatattattgtcgggtctaactacagctcaccctccaacatttcaaagtttaccgtcaataatcttgccgaaccacagaaggccccctcccaccagcaggcaaccacggctgggtcacccctccgccatcttattggtaaaaacagtgtactaaattcctctacggcggagcattcatccccctacagtgaagaccctatcgaagatcccttacagcccgatgtcacagggattcggctgctgtctctgggagctggagaattcaagagtcaagagcacgccaagcataagggccctaaggttgagcgggaccaagccgcaaagcacagatttagttggatgaagcttctggcccacaaggtgggccgccacctcagccaggacaccggaagccccagcggtatgaggccctgggaagatctaccttcacaggacaccggaagcccaagccgcatgcggccctggaaggatcccccatctgatctgctgctgttaaagcagagcaacagttccaaaatattggtgggaagatggcatctcgcctctgaaaagggaagttacgaaatcatccaggacacggacgaagatacggcagtaaataactggctgatcagcccacagaacgcatctcgagcttggggcgagagcacccctctggctaacaagccagggaagcagtctggacaccctaaatttccacgggtccggcataaatcactccaggtacgccaggacggagggaagtcaaggcttaaaaagagccagtttctgatcaagacccggaagaagaagaaggagaaacacacccatcacgctcccctatcccctaggacttttcatccactgcggtcagaggcatacaacacattttctgagagaaggctgaaacatagcttagtgctccacaaatccaatgagacatctctgcccactgatctaaaccagactctcccgagtatggattttggttggattgcctctcttcccgaccacaaccaaaactcatctaacgacaccgggcaggccagctgtcctcctggcctttaccagactgtccctcccgaagaacactaccaaacgttccccatccaagaccctgatcagatgcattctacctcagaccccagtcaccgctcctccagcccggagctctccgagatgcttgaatatgatcgctcccacaaatccttcccaaccgacatcagtcagatgtctccgagttccgaacatgaggtatggcagactgttatcagtccagacctgtcccaagtaaccctgtcaccggaactctcacaaactaacctgtccccagacctgagccacaccaccctgtcgcccgaactgattcagcgcaatttaagccccgcattgggccagatgccgattagcccggacctctcacacacaaccttgtccccagacctgagccacactaccctttcgctggatctttcgcagaccaacttgtctccggagctgtctcaaacaaatctgtcccccgctctggggcagatgccactgagtccggacctgagtcacactactctgagcctggatttttcgcaaaccaatctgtcccccgagctttcacatatgacccttagcccagagctaagccagactaacctttctcctgctttggggcagatgccgatctctcccgacctcagccacaccactctgtcccttgacttcagccagacgaatctctcacctgaacttagtcagaccaatctgagtccagcactgggacagatgccgctgagccctgacccctctcacactactctgagcctggatcttagccagacaaatctgtcccccgagttgtctcagactaatctgagtcctgatctgtccgaaatgcccctattcgctgacctgtcccaaataccactcacaccggatttagaccagatgaccctaagtcctgatctgggagaaaccgacctgagccctaatttcggccagatgtctttatcgcccgacctctctcaagtgaccctgtcaccagacattagtgacactacactcttaccagatctgagccaaataagccctcctcccgatctagatcagattttctatcctagtgaatcttcccagtccctcttgctgcaggaatttaacgagagcttcccataccccgacctcggacagatgcctagcccttcctctccgacactaaacgatacatttctcagtaaggagttcaatcctctggtcatcgttggactctcaaaagatggaactgattatattgagatcatccctaaggaggaagtccagtcatccgaggatgattacgctgaaattgactacgtcccttatgacgatccgtataagacggacgtgaggaccaatataaacagctccagggacccagataatatcgctgcatggtatctgcggtcgaacaacgggaatcgaagaaattattatatcgccgcggaggaaatatcatgggactacagtgaattcgtgcagcgcgagaccgatatcgaagattccgacgatatcccagaggatactacttataaaaaagtcgttttcaggaaatacctggattctacttttactaaaagagaccctcgcggtgaatatgaggaacacctgggcatcctcggccctatcatcagagctgaggtggatgacgttatccaggtgcgattcaagaatttagcctctagaccatacagcctgcatgcacacggtctctcctacgagaagtctagcgagggtaagacgtacgaagatgatagtccagaatggtttaaagaagacaacgctgttcagcccaattctagctatacctatgtatggcacgcgaccgaacgctctggccccgagtcaccgggaagcgcttgccgagcctgggcctattattcggcagttaatccagagaaggatatacattccgggctgataggtcctctgttgatctgtcaaaaaggcatcctgcacaaggatagcaatatgccaatggacatgcgggaattcgtgctgttattcatgacatttgatgagaagaagtcttggtactacgaaaaaaagtcccgctctagctggcggttgaccagtagcgaaatgaagaaatcccatgaatttcatgccatcaacggcatgatttacagtttacctggcctgaaaatgtacgaacaggagtgggtgagactgcatctgctgaatattggggggtcacaagacattcatgtagtacactttcacggacagacacttttggagaatgggaacaaacagcatcagctgggcgtgtggcccctgttgcccggcagcttcaaaactcttgagatgaaggcgtcaaagccggggtggtggctcctgaacaccgaggtaggggagaatcaaagagcggggatgcaaacacctttcttaatcatggatcgcgactgtaggatgcctatgggactcagcactggcatcatctccgattcccagatcaaagcgagtgagttcctggggtactgggagcccagattggcgaggctcaataacgggggatcctataatgcttggtctgtcgaaaagttggcagcagagttcgccagtaagccttggattcaggtggatatgcagaaagaggttattataacaggcatccagacacagggcgccaaacattatctcaagagctgctacacaactgagttttacgtggcgtattcatcaaaccagattaattggcagatctttaaaggcaatagtacacggaacgtgatgtacttcaacggcaactctgatgcaagcaccataaaagaaaaccagttcgatcctccaatcgttgctaggtacattcgcatcagtcctactcgggcttacaatagaccaacacttcgactggagcttcaagggtgcgaggtgaacggctgcagtactcctctgggcatggagaacggcaaaatcgagaacaaacagattactgcctcaagctttaaaaaatcctggtggggcgattactgggaacctttccgcgcacgactcaatgcacaaggccgcgtcaatgcatggcaggctaaggcgaataataataagcagtggctagaaattgacctgctaaaaattaagaaaatcacagctattataacgcagggatgtaaatcccttagcagtgagatgtacgtgaagagctacacgatacattatagtgaacagggggtcgaatggaaaccttacaggctgaagtcttccatggttgacaagatatttgaaggaaacacaaacactaagggacacgtgaagaactttttcaacccacctattatctcacgcttcatccgcgtcatcccaaagacatggaaccagagcatcgccttgaggcttgaactgttcggctgcgatatctac

SEQ ID NO: 9145 - DNA, 6672 bp, Artificial Sequence
  Description of Artificial Sequence: Synthetic coding sequence
atgttccctggctgcccgaggctgtgggtgctggtggtcctgggaacctcgtgggtcggttgggggtcccaaggcaccgaggctgcacaactgcggcagttctatgtggcagcccaaggtatctcatggtcgtaccgcccggagccgaccaactcgtcgctcaatctgtcggtgacctcatttaaaaagatcgtttacagagaatacgagccgtacttcaagaaagaaaagcctcaatcaactatctccggattgctgggaccgactctgtacgccgaagtgggcgacatcatcaaggtgcattttaagaacaaggctgacaaaccgctgtcgatacacccgcagggcatccgatacagcaaactctcagagggtgcgtcatacttggatcacaccttcccggccgaaaagatggacgatgctgtggcgccgggcagggagtacacgtacgagtggtcgatcagcgaggactcgggcccaactcatgacgacccaccttgcctgactcacatctactacagccatgagaatctcattgaagatttcaatagcggcttgatcgggcccctgttgatctgcaagaaggggaccctgaccgagggaggaacccaaaagacctttgacaagcagattgtgttgctgttcgcagtgtttgacgaatccaaatcatggtcccagtcgtcgagcctcatgtatacggtcaatgggtacgtcaatggaaccatgccagacatcactgtctgcgcccacgaccacatcagctggcatttgctgggtatgtcgtccgggcccgaattgttctcgatccacttcaacggtcaggtgctggaacagaaccaccacaaagtctcggcgatcactctggtgagcgccacctcgaccactgctaatatgaccgtgggaccggaaggaaaatggatcatttccagcctgactcctaagcacctccaggcaggaatgcaggcctacatcgacatcaagaactgcccgaagaaaactcggaacctgaagaaaatcacccgcgaacagcgccgacacatgaagcgttgggaatacttcattgcagcagaggaagttatttgggactacgcaccggtcatcccggctaacatggacaagaagtacagatcccaacatctggacaacttcagcaaccagatcggtaagcattacaagaaggtgatgtacacccaatacgaagatgaatcattcaccaagcacactgtgaacccgaacatgaaggaggacggaatcctggggccaatcatcagggcacaggtgcgcgacaccctgaaaatcgtgttcaaaaacatggcttcacggccatactcgatctacccacacggggtcaccttctccccttatgaggacgaagtcaactcttcgttcacctcgggccgcaataatactatgattcgggccgtgcagcccggagaaacctatacgtacaaatggaatatcctggagttcgatgagccaactgaaaacgatgcacaatgcctcactagaccttactacagcgacgtcgacatcatgagagacatcgcctccggcctgatcgggttgctcctgatctgtaaatcgcgctccctggaccggcggggaatccagagggccgcggacattgaacagcaggccgtctttgccgtgttcgacgagaacaagtcatggtacctggaggacaatatcaacaagttctgtgagaaccccgatgaagttaagcgcgacgaccctaagttctacgagagcaatattatgtctacgatcaacggttacgtcccagaatcgataaccaccctgggattttgcttcgacgacactgtgcagtggcatttctgcagcgtgggaacccagaacgagatcctgactattcatttcaccggtcactcgttcatttacggaaagaggcatgaggataccctcactctcttccccatgagaggagaatcagtgaccgtgactatggacaatgtgggcacttggatgctgaccagcatgaatagcagcccacggtccaaaaagttgcggctgaaattccgggatgtgaaatgtatcccggacgatgacgaagattcgtacgagattttcgagcctccagaaagcactgtgatggcgactcggaagatgcatgaccggcttgaaccggaagatgaggaatcggacgccgactacgattaccaaaaccgccttgccgccgcgctcggaatccggtcgttccgcaactcctcactcaaccaggaagaagaagaattcaacctcacggcactggctcttgagaacggaactgaattcgtgtcctcaaataccgatatcatcgtcggctcgaactactcgtcgccatcgaacattagcaagttcaccgtgaacaacctggcagagccacagaaggccccctcgcaccagcaagcaaccaccgcgggatcaccactgagacatctgatcggaaagaatagcgtgctcaactcctcgaccgcggaacattcctccccgtactcagaagatccgatcgaagatccgctgcagccggatgttactggcatcagactgctgtcgctgggcgccggggaatttaagagccaggaacacgccaagcacaagggcccgaaggtggaacgcgaccaagcggcgaagcatcgcttctcatggatgaagctcctggcgcataaagtggggagacacctgtcacaggataccggatccccgtccggaatgcgtccttgggaggacctcccaagtcaggacactggatcgccctcgcgcatgcgaccgtggaaggacccaccctccgacctgctccttctgaagcagtccaattcatcgaaaatcctcgtgggaaggtggcacctggcttcagaaaaaggatcgtacgaaatcatccaggacacggacgaggacaccgccgtcaataattggctgatctccccacagaacgcctccagagcctggggtgagagcaccccgctcgcgaacaagcctggaaagcagtccggccacccaaaatttccgcgggtgagacacaagagcctgcaagtccggcaggatggcggcaaatctcgcctcaagaagtcacagttcctgattaagacccggaaaaagaagaaggagaagcacacccaccatgcccctctttcaccgcgaacttttcacccgctgcggagcgaggcctacaacactttctcggagagacggctgaaacactccctggtcttgcataaatccaacgaaaccagcctgcctaccgacctgaatcagaccttgccaagtatggactttgggtggatcgcttccctgcctgatcacaatcagaactcatcaaatgacactggccaagcctcctgcccgccaggcctttaccagaccgtccctccggaagagcactaccagaccttcccaatccaggacccggaccagatgcattccacttcggacccgtcacaccgcagctcgtccccagaactgagcgagatgctggaatacgaccgtagccataagtccttcccgacggacatctcacagatgtcaccgtccagcgaacacgaagtgtggcagaccgtcatctcgccagacctcagccaggtgactctttcccctgaactttcgcaaaccaacctctcgcccgatttgagccacacgactctcagccccgaactcatccaacgcaatctgtccccggctcttggacaaatgcctatctcaccagatctgtcgcacactactttgtccccggacctgtcccataccaccctctcgctggacctgtcgcaaactaatctcagccctgagctctcacagacgaacctgagccccgctctcgggcagatgcctctgtcacctgatctgagccatacgaccctttccctggatttcagtcagactaacctttctccggagctcagccatatgaccctcagtccagaactttcccagaccaatctcagtccggcgctgggccagatgccaatatcccccgatttgtcgcatactaccctctcccttgacttttctcaaacgaatctgtcaccagagctctcccagactaatctgagccctgctctgggacagatgcccttgagcccggatccttcacacactactctctcgttggatctgagtcagaccaacctttcaccggaactcagtcaaactaacctgtcccccgacctctctgagatgccactgttcgctgacctctcgcaaatccctctgactccagaccttgaccagatgaccttgtcaccggacctgggtgagactgacctgagtccaaactttggccagatgtccctttcgccggatctttcacaggtcaccctgtcgcctgacatcagcgatactactctgctgccagatttgtcacagatctccccgcctcctgacctggaccaaatcttctacccctccgaaagctcgcagagcctgctcctgcaagagtttaacgaatcgtttccgtacccggatctgggccaaatgccttcgccgagcagcccgaccctcaacgacactttcctgtcaaaggagtttaacccattggtcatcgtaggactctccaaggatggtaccgactacatcgagatcatccccaaagaggaagtgcaaagcagcgaagatgactacgcggagatagactacgtgccgtacgacgacccgtacaagacggatgtccgcaccaacatcaactcgagccgggatccggataatatcgcggcttggtacctgagatcaaacaacggcaaccgacgtaactattacatcgcagcggaggaaatcagctgggactattcggaattcgtgcagcgggagacggatattgaggattcggatgatatcccagaggataccacttataagaaggtcgtgttccgcaagtacctcgattcaactttcaccaagagggatccccgcggagagtacgaagaacacctgggaatccttggaccgattatccgggccgaggtggacgatgtcattcaagtgcgcttcaaaaacctcgcgtcgcggccgtactctcttcacgcccacggactcagttacgaaaagtcctccgaaggaaaaacgtacgaggacgactcgccggagtggtttaaggaagataacgccgtacagcctaattccagctacacctacgtgtggcacgccaccgaaaggtcggggccagaaagcccagggtcggcgtgccgcgcctgggcatactattccgctgttaatccggaaaaggacattcacagcggactcatcggccctctcttgatctgtcaaaagggaatcctccataaggactccaacatgccgatggatatgcgcgaattcgtcctcctgttcatgacctttgatgaaaagaaatcctggtactacgaaaagaagtcccgctcaagctggcgcctgacgtcgtcggaaatgaagaaatcccatgagttccacgcgatcaatggaatgatctactcgctcccaggacttaagatgtacgaacaagaatgggtgcgcctccacctgctgaacatcggaggaagccaagatatccatgtggtgcacttccacggacagaccctcctggagaatggtaataagcagcaccagttgggtgtgtggccgctcctcccgggcagcttcaagactctggagatgaaggcatccaaaccaggatggtggctgttgaatacggaggtgggagaaaaccagcgggccggaatgcaaactccgtttctgatcatggacagagactgcagaatgccaatgggactttcaactgggattatcagcgactcacaaatcaaagcatcagaattcctgggctactgggagccgagactggccaggctgaacaatggaggctcctataacgcctggtccgtcgagaagctcgctgctgagttcgcgtctaagccgtggatccaggtggatatgcaaaaagaggtgatcattaccggaattcaaactcagggagccaaacactacctgaaatcctgctacactactgagttctacgttgcctactcttcaaaccaaatcaattggcagatcttcaagggaaactcgactcgcaatgtgatgtattttaacggaaactccgatgcttccacgatcaaggagaaccaatttgatccgccgatcgtggccagatacatccgcatttcccccactcgggcctacaatcggcccaccctgcggctcgagctgcagggctgtgaggtcaacgggtgttctacccccctgggaatggaaaacggaaagatcgaaaataaacaaattactgcgagctcgttcaaaaaatcgtggtggggggactactgggaaccgttccgcgcacggctgaatgcccagggacgcgtgaacgcatggcaagccaaagcaaataacaacaagcagtggctcgaaatagatctcctgaagattaagaagatcactgcgatcatcacccaagggtgcaagtccctttcttccgaaatgtacgtcaagagctacaccatccattactcggaacaaggagtggagtggaagccgtacagactgaagtcgtctatggtggacaaaatcttcgaaggtaacactaacaccaagggccatgtgaagaactttttcaaccctccaatcatctcaaggttcatccgcgtgatcccaaagacttggaatcagtcgatcgcgctgagactggaactgtttggttgcgatatctac

SEQ ID NO: 9146 - DNA, 6672 bp, Artificial Sequence
  Description of Artificial Sequence: Synthetic coding sequence
atgtttcctggatgtccgcgactttgggttctcgtggttttaggaacttcttgggtcggctgggggtcccagggaacagaagccgcccaactgcggcagttctatgttgccgcacagggaatatcctggagctatcgccctgagcctacgaattctagtctcaacctcagcgtgacctcctttaaaaaaatcgtgtaccgagagtatgagccctattttaagaaagaaaagccacaatcaacaattagcggtctcctgggccccacattatacgctgaggtcggggatattataaaagtgcattttaagaataaagcagacaagcccctctcaatccatcctcagggtattagatacagcaagctttcggagggcgcctcatatcttgaccatacgttccctgcagagaagatggatgacgccgttgcacctggaagggagtacacatatgaatggtcgatatctgaagacagcggtcccacacacgacgaccccccttgccttacccacatctactatagtcatgagaacctcatagaagacttcaacagtggccttatcgggcctttactgatttgtaaaaaaggcaccctcacagagggcgggactcagaagacttttgataaacagatcgttctgttattcgcagttttcgacgagtccaagagttggagtcagagtagtagtctgatgtatacagtcaacggctacgtgaacggcaccatgcccgacattacggtatgcgcacatgatcacatttcgtggcatctattgggtatgagtagcggccccgagcttttcagcattcacttcaatggacaggtcctggagcagaaccaccacaaggtttccgcaatcactctggttagtgccacctccaccacagcaaatatgacagtcggccctgaagggaagtggatcataagcagcttgacccctaaacacctgcaggccggtatgcaggcatacatcgacattaagaattgcccaaaaaaaacgcgcaacttgaagaaaattaccagggaacagaggcgacacatgaagcgatgggagtacttcatagccgccgaagaggtgatttgggactacgctcctgtgattccggccaacatggataaaaagtacaggtcccaacacttggacaactttagtaatcagattggaaagcactataagaaggtcatgtacacgcagtacgaagacgagtccttcacaaaacatactgtcaacccaaacatgaaggaagacggaattcttggtccaatcatcagagctcaggtgcgcgatacgctgaagattgtgtttaagaacatggcatcccgcccttacagtatctaccctcacggagtgaccttttctccttatgaggacgaggtgaattcctctttcacttcaggtagaaacaatactatgattcgcgcagtccaacccggcgaaacatacacctacaagtggaacatccttgaattcgatgagcctactgagaacgatgcccaatgcctgaccaggccttattatagtgatgtagacatcatgcgtgacatcgcttctggcttgattggactcttgcttatctgtaagagtagatcccttgacaggcgcggaatccagcgggctgccgatatagagcagcaagctgttttcgctgtttttgacgagaacaaatcgtggtatctggaggacaacatcaataagttctgtgagaaccccgatgaggtgaaacgcgatgaccccaagttctatgagagcaatatcatgtccactatcaatggctatgtgcctgagtcgataacgacattgggattttgtttcgatgacacagttcagtggcatttttgctctgtcggaacccaaaatgaaatccttacgattcacttcactggccattcattcatctacggcaagcggcacgaagacaccctaacactcttccccatgcgaggggaaagtgtaaccgtgacaatggataatgtaggtacctggatgttaacttccatgaatagctcacctcgtagcaagaagttacgcctgaagttcagagatgttaaatgcattcctgacgacgacgaggactcttatgaaatatttgagcctcccgagtctaccgtgatggccactagaaaaatgcatgatcgcctcgagcccgaggacgaagaatctgatgctgattatgattaccaaaaccgtttggccgccgcactcggtatccgctccttcagaaacagttctcttaaccaagaggaagaggaattcaatctaactgctctggcacttgaaaacggaaccgagtttgtgtcaagcaacaccgatatcatcgtaggaagcaattatagctccccgagcaatatatctaaattcacggtgaacaacctggcggagccacaaaaggctccatcccatcagcaagcaactacagcgggatcaccccttcggcacctgatcgggaaaaacagcgtgttaaactcatctacagccgagcatagcagtccatattctgaagacccaatcgaagatccgcttcagcccgatgtgaccggtatacgcctgcttagcctgggagcgggcgaattcaagtctcaggagcacgctaagcataaagggcccaaggtggaaagagaccaagctgccaaacaccgtttctcgtggatgaaacttttggcccacaaggtaggacggcacctaagccaagacaccggtagcccaagcgggatgaggccctgggaggatctcccttctcaggacaccgggtctccttctcggatgagaccctggaaggaccccccaagtgatctcctgttgttgaagcagtcaaactcctccaagatcctggtaggacggtggcaccttgccagtgagaaagggtcctatgaaattatccaggataccgatgaagacactgccgtgaacaactggctgatatccccacagaacgcctcaagagcctggggagaatctacccctctggcgaataagcccggcaagcagtccggtcaccctaagttcccgcgcgtgcgtcataaatccctgcaagttcgacaggacggggggaaaagtagactcaagaaatcacagttcctcatcaagacaagaaagaaaaagaaggagaaacatacccaccacgcgcctctgagcccacggacatttcatccgctgcggagcgaagcgtataacacattcagtgaacgccgcttgaagcatagtctagtgctgcacaagtccaacgagacttctctacctacagatcttaaccagacactacctagtatggattttggctggatcgcttcactcccagatcataatcagaacagctccaatgacactggccaggcctcctgtccacccggcctatatcagactgtcccacctgaagagcactatcagacattcccaatacaagaccctgaccagatgcattcaacttccgatccaagtcataggagttcctcccctgaattgtccgaaatgctggaatatgacagatcccacaaatccttccctacagacatttcccagatgagtccttcaagcgagcacgaggtgtggcagactgtgatctccccggacctctctcaagttacgctctcaccagagctgtctcaaactaacttgagcccagacctcagtcataccactctctcgcccgaattaatccaaaggaatctatcccctgcccttggtcagatgccgatttcccctgatctgagtcatacaacgctttctccagatctctcccacacaactttgagccttgatttgtctcagacaaacctctccccggagctttcacagactaatctatccccagctctgggccagatgcccctttccccggatctgagccacacgactctgtcactggattttagtcagacaaatctttcccctgagctgagccatatgactctgtcccccgaattgtctcagacgaacctctcccctgccctgggccagatgccaatcagtcccgaccttagtcacaccacactgtctctggatttctcacaaacaaatctgtcgccggagctctcccagactaacctgtcccccgcattagggcagatgcccttgtctcccgacccaagtcataccaccctctcccttgacttgagccaaaccaatttgagtccagaactgtcacaaacgaacctgagtcctgatctttcagaaatgcccctattcgccgacctgtctcagatccccctgacacccgacctcgatcaaatgaccttgtcccccgacctaggcgagaccgaccttagcccgaattttggtcagatgtccctgagtccggacttgtcacaagtcaccctctctcccgatatctcggacaccacactgcttcctgacctgagccagatctcccctccccctgacctggatcagatattctacccaagtgaatcttcccaatcactgctgctgcaggagtttaacgaaagcttcccctaccctgatcttggtcaaatgccaagtccgagctctccgaccctcaacgatacttttttaagcaaggaatttaacccgcttgtgattgttggcctgtctaaagatgggacagattatatcgagatcatccccaaagaggaagtgcaaagtagcgaagacgactacgcagagatcgactacgtgccatatgacgatccatacaaaacggacgtacggaccaacattaattcctccagagatcctgataacattgcagcatggtaccttaggagcaataatgggaataggcgaaattactacatcgcagccgaagaaattagctgggactattctgaatttgttcaacgtgagaccgacatcgaggactctgatgatattccagaggatacaacatacaagaaagtggtgttccgtaaatatctagactcaaccttcacgaagcgcgatccccgtggggagtacgaggagcatctcggtatcctggggccgatcataagggcagaggtggatgatgtgatccaggtccggttcaagaatctggcgagtcggccttattctcttcatgctcacggtttgagctatgagaaatcatctgaggggaagacctacgaagacgactccccagaatggtttaaggaggataatgccgtgcagcccaacagttcgtatacctacgtatggcatgccaccgaaagatctggcccggagagtccagggtctgcatgccgcgcctgggcttattactccgcagtcaatcccgaaaaggacatccactccgggctcattggaccactgcttatctgccagaaaggaatactgcataaggatagcaacatgcccatggacatgcgcgaattcgtacttctctttatgacttttgatgaaaagaagtcttggtattatgagaagaaaagccgtagcagttggagactgacaagctcggagatgaaaaaatcccacgagttccacgctattaacgggatgatttattctctgccgggactgaaaatgtatgaacaggagtgggtgagactacatctgctcaatatcggaggcagccaggacatccacgtggtgcattttcatggccaaactctgctcgagaacggcaataagcaacaccagctgggcgtctggcctctgttgccaggctcctttaagactctggagatgaaggcaagtaaaccgggctggtggcttcttaacaccgaggtcggcgagaaccagagggcagggatgcagacaccttttctgatcatggatagggactgcagaatgcctatgggcctctcgaccgggatcatcagcgacagtcagataaaagccagcgaatttcttgggtactgggaaccccggctggctaggctgaataacggaggcagttataacgcatggagcgtggaaaagttagctgcagagttcgcctccaagccctggatccaagttgacatgcaaaaagaggtgatcatcaccggaatccaaacacagggggccaagcactacctgaagtcatgctacactactgagttttatgtggcatacagtagcaatcagattaactggcagatattcaaaggaaatagcactcggaatgtgatgtactttaatggcaacagtgatgcgtccacaataaaggagaatcaattcgatccccctatcgtggcacgttacatcaggatctcccccaccagggcctacaatcgacctaccctgcgcttagaactccagggctgcgaggtgaacggctgctctaccccactaggaatggagaacgggaaaattgagaataaacagattaccgcttctagctttaagaagagctggtggggggactattgggagccattcagggccaggcttaacgcccagggtcgtgtcaatgcatggcaggccaaagctaataacaacaagcagtggttggagatcgacctgcttaagattaagaagataactgctattatcacacagggttgcaaaagcttgtccagcgagatgtatgttaagtcctacacaatccactactccgagcagggtgttgagtggaaaccttacaggctaaagagcagcatggtggataagatttttgaggggaacacaaatacaaagggacacgtcaagaactttttcaacccaccaattatctccagatttatacgcgtgatcccgaagacttggaatcagtcaattgcccttcgattggagctttttggatgtgacatctac

SEQ ID NO: 9147 - DNA, 6672 bp, Artificial Sequence
  Description of Artificial Sequence: Synthetic coding sequence
atgtttccgggctgtccccgtttgtgggtgctagtcgttttgggcacctcatgggtggggtggggatcccaggggaccgaagctgcgcagcttcggcagttctacgtggctgctcaaggtatctcttggtcatatcgtcccgaacccactaactcctcactgaatctgtcagtgacttcgtttaaaaagatagtgtacagagagtacgaaccttactttaaaaaagagaagccacagtcgacaatttctggcctgctagggcccaccttgtatgcagaggtcggcgatattatcaaagtgcattttaaaaacaaggctgataaacccttgtccatccacccccaggggatacgctactcaaagttaagtgaaggagccagttatctggatcacaccttcccagccgagaaaatggacgatgccgtggcccctggccgggagtacacatacgagtggagtatttcggaagatagcggaccaacgcacgacgacccaccctgtcttacccacatttattattcgcacgaaaacctcattgaagacttcaattcaggattgatagggcctctgcttatatgtaaaaaagggacccttacagagggcgggacgcagaaaacttttgataaacaaatcgtgttactcttcgccgtcttcgacgaaagtaaatcctggtcacagtcctcctcactgatgtataccgttaacggctacgtaaacggaaccatgcccgacataaccgtctgtgcccacgatcatattagttggcacttactggggatgagttccggacccgagctgttttccatccatttcaatggacaagtgctggagcaaaaccaccataaagtttccgctatcactctcgtttccgctacctccaccactgctaatatgacggtgggccccgaggggaaatggatcatctcatctttaaccccgaaacatctgcaggctgggatgcaggcttacatcgatatcaaaaactgccccaagaagacccggaatttaaaaaaaataacgcgcgaacaacgtcgccacatgaaacggtgggagtacttcattgctgcagaggaagtgatctgggactacgcacctgtaattcctgccaatatggataagaagtataggagtcagcacctcgacaacttctccaaccaaattggcaagcactacaagaaggtcatgtacacacaatatgaagatgagagcttcacgaagcacaccgtgaaccccaatatgaaggaggatgggatcttagggcctataattcgagcccaggtccgtgacaccctgaaaattgtgttcaaaaacatggcctcccgaccctactcaatctacccacacggggtaaccttctccccttacgaagatgaagtgaactcgtcatttaccagtggaagaaataatactatgatcagagcggtacaaccaggcgagacctatacatataagtggaacattcttgagttcgatgagccgaccgagaacgacgcgcaatgtctcacccgcccatactactctgatgtcgatatcatgagagatatcgcttctggcctgatagggctgctattgatttgtaaaagccgctctctggacaggaggggcatccagcgtgcggccgacattgagcaacaggcagtctttgccgtgtttgacgagaacaagtcctggtatcttgaggataatatcaataagttctgtgagaatcccgacgaagtgaaaagggatgaccctaagttttatgaatcaaatatcatgtccacaatcaatggatacgtgcccgagtctatcactacactgggattctgttttgatgacactgttcaatggcacttctgctccgtggggacccagaatgagattttgacaatccactttaccggccatagtttcatctacggtaaacgccatgaggataccctgaccctatttccaatgcgcggagaatccgttaccgtcactatggacaacgtggggacttggatgcttacctcgatgaactctagtcctcggagtaagaaattaagactgaagttcagggacgtgaagtgtatcccagatgatgacgaagattcctacgaaattttcgagccgccagaatcaaccgttatggctactcgcaaaatgcatgataggttagaacccgaggacgaggaatcagatgctgactatgactatcagaaccggctcgctgcggctcttgggatacggtcatttaggaactcaagtctcaatcaagaagaggaagagttcaaccttacagctctggcgttggaaaacggcaccgagttcgtcagctctaacaccgacattatcgtgggatcaaattactcctctccttcgaatatttccaaattcaccgtgaataatttagctgagccccagaaggcaccatcccaccaacaggcgaccactgcaggaagccctctgcggcatttaatcgggaaaaatagcgttttgaacagctcaacagctgagcactcaagcccctacagcgaggaccctatagaggatccattacaacccgatgtgaccggcattaggctactttctctcggtgcgggtgaattcaaatcccaagagcatgccaagcataagggacctaaagtagaacgagaccaggccgctaaacatcggttctcatggatgaagctcctggctcacaaggtcggcagacacctctcccaggacaccggctctccgagtggcatgcggccctgggaggacctgcccagtcaagatactgggtcaccctcgaggatgaggccttggaaagaccccccatctgatctactcttactgaaacagtccaactcatccaagattctcgtgggccgctggcaccttgcctccgaaaaaggcagttacgagataatacaagacaccgatgaggataccgctgtcaataattggttgattagtccgcagaatgccagtcgtgcatggggcgagtccacgcctctggctaacaagcccgggaaacagagtggccacccaaagttccctcgcgtgcgacacaaaagcctccaggttaggcaggatggagggaaaagcagattaaaaaagtctcagttcctgattaagacccgcaaaaagaagaaggagaagcacacccaccacgctccacttagtccccgaacctttcaccccctgagaagtgaagcctataacaccttttcagagcggcggctcaaacactccctggtactccataaaagcaacgagacatctctgcccacagatttgaatcagacccttccctccatggatttcgggtggatagcatccctcccagatcataaccagaacagcagcaatgatactggccaggcctcgtgcccacctggtctttatcagactgtgccacccgaggaacactatcagacatttccgatccaggatccggatcagatgcattcaacctccgatccatcccacagaagttccagccccgaactgtccgagatgcttgagtacgatcgatcgcacaaaagtttccccacagacattagccagatgagtccgagcagcgagcacgaggtctggcagaccgtcatctccccagatctctcacaggttaccttatctccagaactcagccagacaaatttgagcccggatctctcacacactaccctgtctcctgagctgatccagcgcaacctctcaccggctctcggccaaatgcccatatcacctgatctgtctcacaccacactcagcccggatctgtctcatacaactctgtccttggatctgtcacaaaccaacctgagtcctgagctgtcccagactaatctgagccccgctcttggccaaatgcccctgtctcctgatcttagtcacacaactctttcacttgatttcagtcagactaatttgtcaccagaactttcacatatgactctgagccctgaactctcacagactaacttgagtccagcactcgggcagatgccaattagccccgacttatcacacacaacccttagtctggacttctcgcagactaacctgtcgcccgaactgagtcaaacgaatctgagtccggccctcgggcagatgcctttgagccctgatccttcccacacaaccctgagccttgacctgtcccagaccaatctgtcccccgagctgtctcagactaacctgagtccggaccttagcgaaatgcccctgttcgctgatttgtcccaaattcctctcacccctgatcttgatcagatgacgttaagtcccgacctgggggagaccgacctaagtccaaatttcggacagatgtccctttcacctgatttgtcacaggtgacactttcccccgatatctctgacactacgctgcttccagacctctctcagatcagtcctcccccagatcttgatcaaatattttacccctctgaatctagccagtccctactgcttcaagagtttaatgagagcttcccataccccgatttggggcagatgccttcccccagctctccaacactcaacgacacttttctttctaaggagttcaatccccttgtcattgtgggcctgagcaaagacggaaccgactatatagagatcatccctaaagaagaagtgcagagtagtgaagacgactatgccgagatcgattacgtaccttacgatgacccgtacaagactgatgtccgtaccaacataaatagctctagggatcccgacaacattgccgcctggtatctgcgtagcaacaatggaaatcgaagaaactattatatagccgctgaagagatatcttgggactactcggaatttgtgcagcgcgagaccgacattgaggactctgacgacatccctgaggacacgacctacaagaaggtcgtgttccgtaaatatcttgatagtaccttcactaaacgcgacccccgtggcgaatacgaggaacacctggggatcctggggccaatcataagggccgaggtggatgatgtgattcaagtgcgatttaagaacctggcgtcacggccatactctctgcacgctcatggactgtcttacgaaaagtcaagcgaaggcaagacttacgaagacgatagccccgaatggttcaaggaggataatgccgtgcaaccaaattccagctacacctacgtatggcacgccactgagaggtctggccccgaaagtccaggtagcgcatgtcgagcctgggcttactattcggcagtcaaccctgaaaaagatattcattccggactaatcggacctctactaatctgccaaaagggcatcttgcacaaggatagcaacatgcccatggatatgcgggagtttgttctcttgtttatgacgttcgatgagaagaagtcgtggtattatgagaaaaagtctcgctctagctggagactgacaagctctgaaatgaagaagtcccacgaatttcacgctatcaatggcatgatctacagtctgcccggtctaaagatgtacgagcaggagtgggtgaggctgcatctactcaatatcggcggttcccaggatatacacgtggtgcactttcatgggcagacactgttagaaaatggcaacaagcaacaccagttgggtgtatggcctcttctccctggcagcttcaaaactctggagatgaaggccagtaagcccggatggtggctgcttaacactgaggtgggcgagaatcagagggcaggcatgcagactccattcttgataatggatcgggactgccggatgcctatgggtctgtccacgggcataatcagcgactctcaaataaaggcgagcgagttcctcggttactgggaaccgcggttggcccggctaaacaatgggggaagctacaatgcatggtctgtcgagaagctggccgcagaatttgcttccaagccgtggattcaagtggatatgcagaaagaagtgataattactggcattcagactcagggcgcaaagcactacctgaagtcatgctacacaaccgagttttatgtcgcctattcctcaaatcagatcaattggcaaattttcaaaggtaactcaacccgcaacgtcatgtattttaacggcaatagcgacgcctccacgataaaagagaaccagttcgaccccccgatcgtcgccaggtacattaggatcagcccaactcgggcctacaaccggccaacccttagattagaacttcagggctgtgaggtcaacggttgtagcaccccccttggcatggagaacggaaagatcgagaataagcaaatcactgcaagtagctttaagaaatcttggtggggagactactgggagcccttccgggctaggctgaacgctcagggccgggtgaatgcgtggcaggcaaaagcgaacaacaacaaacagtggctggagatcgatctgcttaagattaagaaaatcaccgccattataacacagggttgtaagtctttatcctcagagatgtatgtaaaatcctataccattcattactcggaacaaggtgtcgagtggaagccatatcgactgaagtcgtccatggtggataagattttcgaagggaacacaaacactaaggggcacgtgaagaattttttcaatcctccgatcatctcccgctttattcgtgttatccctaagacttggaatcaaagcattgctctgcgattagagttgttcgggtgcgatatctac

SEQ ID NO: 9148 - DNA, 6672 bp, Artificial Sequence
  Description of Artificial Sequence: Synthetic coding sequence
atgtttcccggatgccccaggctttgggtcctggttgtgcttggcaccagctgggtgggctggggctcacaaggaaccgaggcagctcaacttcgtcagttctacgtcgcagctcaggggatctcttggtcatacaggccagagcctacgaactcaagcctgaacctctcggtcacttcatttaaaaagatcgtatacagggaatacgaaccttattttaaaaaagaaaagccacagagcacgatcagtggcttattgggccctactctctacgcagaagtgggagacatcatcaaggtccacttcaagaacaaagctgacaaacctctcagcatccatccacagggcattagatactctaaactgagtgaaggagcttcatacctcgaccacaccttcccagccgagaaaatggacgatgctgtcgcaccaggccgtgaatatacttacgagtggtctatcagcgaggacagtggtcccacccatgatgaccctccttgtctgacccacatctactattctcatgaaaatcttatcgaggatttcaattcaggcctcatcggtcctctgctgatatgtaaaaagggcaccttaaccgaagggggtacacaaaagacattcgacaaacaaatagttctgcttttcgctgtctttgacgaatctaagtcctggagtcagagctcatctctgatgtacaccgtgaatggatatgtcaatggtacaatgccagacatcactgtgtgcgcccacgatcatatcagttggcatttgctgggcatgagctctggaccagaactcttttctattcatttcaatggccaggtgcttgaacagaatcatcataaggtgtcagcaattaccctggtgagcgcaacttctacaaccgctaatatgactgtaggacccgaagggaaatggattattagctctttgaccccaaaacacctccaagctgggatgcaagcctacatcgatattaagaattgtcctaaaaagacacgtaacttgaagaagatcacaagagagcaacgacggcacatgaagcgctgggaatattttatcgcagccgaggaagtgatttgggactatgctcccgtcatccccgccaacatggataagaagtaccgcagtcagcacttagacaatttcagcaaccaaattggaaaacattataaaaaggtcatgtacacccagtatgaagacgaaagttttaccaaacacactgtgaacccgaacatgaaagaggatggcatactcggcccaatcatccgggctcaagtaagggatacactgaaaatcgtgttcaaaaacatggcaagccgaccttacagcatttatcctcacggcgtgacatttagcccatatgaagacgaggtgaacagttccttcacatcaggtcggaataatacaatgatccgggccgtccagccgggcgagacatacacatacaaatggaacatcctcgaatttgatgaaccgacagagaacgacgctcagtgcttaactcgcccatattatagtgacgtagacattatgagggatattgcttctggcctgataggactgctgctgatctgtaaatcccgcagtttggataggaggggcatccagagggccgcagacatcgagcagcaggcagttttcgctgtatttgatgaaaataaatcatggtacttagaggacaacattaataagttctgcgaaaacccagatgaagttaaacgggatgatcctaaattttacgagtctaacatcatgagcaccataaacggatacgtccctgagagcatcaccactctgggtttttgttttgatgatacagtgcaatggcacttctgcagcgttggcacgcagaacgaaatcctcactatccacttcacaggacactcattcatctacggcaagaggcacgaggacactctcacgctttttcccatgcggggagagtccgtcactgtgacaatggataatgtcgggacttggatgctgacctcaatgaacagctctcctcgcagcaagaaattgaggctgaaattcagagatgtgaaatgcatcccggacgatgacgaagatagctatgaaatctttgagcctcctgaaagcacagtcatggccaccagaaagatgcatgacagactagaaccagaggatgaggagagcgacgcagactacgattaccagaaccgcttagctgcagctctgggcattagaagtttcaggaactcaagtcttaaccaagaggaggaggagtttaaccttacggccctcgctctggagaacggaacagagttcgtgagctcaaataccgacatcatcgtgggctccaattactcttcaccttctaatatctcaaaatttaccgtgaacaatctggctgagccccagaaggctccctctcatcagcaagccactactgcggggagtccactgagacacctgatagggaaaaacagcgtgttgaatagcagcaccgccgagcactcaagcccatacagcgaagatcctatcgaggacccgctgcagcctgatgtaaccgggatcagattactttctctgggtgctggcgagttcaaaagtcaagaacacgctaagcacaaagggcctaaagtagagagggaccaggcagctaagcacaggttcagctggatgaagttgcttgctcataaggttgggaggcaccttagtcaggacaccggatcaccatccgggatgcgtccttgggaggaccttcctagtcaggacactgggtcaccatcaaggatgaggccctggaaagatcctcctagtgacctgctgctgcttaaacagagcaactcttccaagatacttgtggggagatggcacctcgcaagcgagaaaggatcgtacgagatcatccaagatacagatgaagatactgcggtcaataattggctaatatcgccgcaaaacgctagccgcgcatggggagaaagcacccctcttgcaaataagcccgggaaacagagtggacatcctaaattccctcgcgtgaggcacaaaagcctgcaggtcaggcaggacggcggaaagtctcgcctcaaaaaaagccaattcctgatcaaaactagaaaaaagaagaaagagaaacacacacatcatgctcccctaagccctcggacctttcacccactaaggtccgaagcttataacactttctccgagaggcggcttaagcacagcttggttctgcacaaatcaaacgagaccagcctgcctacagacctgaatcaaactcttccaagtatggacttcgggtggattgctagtctgcccgatcataaccaaaattccagcaacgatactggccaagcatcatgccccccaggactgtatcaaacggttcctcccgaagagcattatcagacctttccgattcaggatccagaccagatgcatagcacctccgacccttcccatcggtctagctctcccgagctgtcggaaatgctggaatacgatcgtagtcataagagtttccctactgatatatcgcaaatgtcacccagttcagaacacgaagtctggcagacagttattagccctgatctgtcccaggtcactctcagcccagaacttagccagacaaacctgagccccgacctgtcacacacaaccctcagcccagaattgattcagcgaaaccttagccccgcattgggccaaatgccgatttcaccagatctttcgcacaccacactgtcgccagacctgagccacacaaccttaagtcttgatctgagtcaaaccaaccttagcccagaactgagccagacaaatctgagccccgctctgggacagatgccgttgtccccagaccttagccacaccaccctgtctctcgactttagtcaaaccaacctgtcaccagagctcagtcacatgaccctgagccctgagctgagtcagacgaacttgtctcccgcactgggccagatgcccatctcgcccgacttgtcacataccactttgagtctggattttagtcaaacaaacctgtcacctgagctgtcgcagaccaacctgtccccagcactgggccagatgcctctgtctccagatcctagtcacactaccctgagtttggaccttagccagacaaacctctctccagagctcagccaaacgaacctgagtcctgatctgagcgagatgcccctattcgccgatctgagccagatcccccttacacccgacttggaccaaatgacacttagtcccgatcttggtgagaccgacctgagccccaattttgggcagatgtccctgtctcccgacctgagtcaggttactctatcacctgatatcagcgacacaaccctgctgccggacttgagccaaataagtccaccccccgacctggaccaaatcttttaccccagcgaaagctctcagagcctcctgttgcaagaatttaatgagagttttccttaccctgacctggggcaaatgccttcaccttcttctcctaccttgaacgatactttcctgagcaaagagttcaacccactagtgatcgtcgggctgagcaaagatggcaccgactacattgagattatccccaaggaagaagtccagtcttccgaagatgactacgccgaaatcgattacgtgccgtatgacgacccatataaaacagatgtgaggacaaatataaacagcagtagggaccccgacaacatagcagcctggtacttgagatccaacaacgggaacagaaggaactattacatcgccgctgaggagatttcctgggactactctgagttcgttcagagagagaccgacatcgaagattcagacgatatcccagaagacaccacatacaaaaaggtcgtgttccgtaaataccttgatagcactttcactaagcgcgatccaagaggagagtacgaggaacatttggggatcctcgggccaatcattagagccgaagtcgatgatgtaatccaggtgaggttcaaaaacctggcttctagaccgtactccctgcacgcgcacggcctgtcttacgaaaaatcgagcgaaggcaaaacatacgaggatgatagcccagaatggttcaaagaagataacgctgtgcagccgaacagctcttacacatacgtgtggcacgctaccgagagaagcggccccgagagtccaggaagcgcgtgcagggcttgggcatactactccgctgtgaaccctgaaaaagacattcacagtggactcattgggccgctgctcatctgccagaagggcatacttcataaggactcaaacatgcctatggatatgcgggagttcgtactcctttttatgacctttgatgaaaaaaaatcatggtactacgagaagaaatctcgctctagctggcgcctgacatcaagcgagatgaagaaaagccacgaattccacgctatcaacggcatgatctactctctccccgggctgaaaatgtacgagcaagagtgggtaagactccacctgcttaacataggaggcagccaagacattcatgtcgtacatttccatgggcaaactctcttagaaaacggcaacaagcagcaccagctgggcgtgtggcctctccttccaggatccttcaaaactttggagatgaaagcttcgaagcctggctggtggctcctcaacaccgaagttggagaaaaccagcgtgctggtatgcagacccccttcctgattatggatcgggactgccgtatgcctatgggcctgtctacgggaattatcagcgacagccaaattaaagctagcgaattcctgggttactgggagcctagacttgctcgcctcaacaacggcgggagttacaacgcctggagcgtagaaaaactggcagcagaattcgcttctaaaccatggatacaggtcgatatgcaaaaggaggttattatcactggaatccagacccagggcgcaaaacactatctgaagtcttgttacacaaccgaattctatgtagcatattcatctaaccagatcaactggcagatctttaaaggaaactcgactagaaatgtcatgtactttaacggaaatagtgatgcgtccaccatcaaagagaatcaatttgatcctcccattgtcgcccgctacatcaggattagccccactagggcctacaacagaccaactctccgcctggaactccaaggctgcgaggtaaatggctgcagcaccccgcttgggatggaaaatggtaagatcgagaataagcagatcacagcttcaagctttaagaaaagctggtggggcgactactgggagccgtttcgggcacggctcaacgcccagggaagagttaatgcctggcaggcaaaagctaacaataacaagcaatggctggagatcgatttgctcaaaatcaaaaaaattaccgcgattatcacacagggctgtaaaagcctgtcgagcgagatgtacgtcaagtcctacaccattcactactcagagcagggcgtggaatggaaaccttacaggctgaaatccagcatggtggacaaaattttcgagggcaacactaacaccaaaggccatgtgaagaacttcttcaacccccccatcattagccggttcatcagagtgatccctaaaacgtggaatcaatcaatagctctgaggctcgagctgtttgggtgcgatatctat

SEQ ID NO: 9149 - DNA, 6672 bp, Artificial Sequence
  Description of Artificial Sequence: Synthetic coding sequence
atgttccccgggtgtccccggttgtgggtgctagtcgttctgggcacgtcatgggtggggtggggttctcagggcactgaagccgctcaattgcgtcaattttacgtcgccgcccagggtatatcctggtcgtatcgaccggaaccaacaaactcatctctcaatctcagcgtgacctcatttaaaaagattgtgtaccgcgagtatgagccctattttaaaaaggaaaaaccacaaagtactatcagtgggctgttgggccctaccctgtatgccgaggtgggtgatatcatcaaggtccactttaaaaacaaagctgataaacctctatccatccatcctcaggggatccgttactcaaagctaagtgaaggcgcttcttatttggaccacacctttccagccgagaagatggatgatgctgtcgctcccggacgcgagtacacgtatgagtggtctatttccgaagactctggtcccactcacgatgatcccccctgcctgacccacatatattattcacacgagaatctcatcgaagattttaactccggattgatcggccctttgctaatttgcaagaaaggcacactgactgaagggggtacacagaagacattcgataaacagattgtgctgctctttgctgtcttcgacgaatctaaatcgtggtctcaaagctcaagcttgatgtacacggtgaacggctatgtcaatggcaccatgccagatatcacagtgtgcgcgcacgaccatatcagttggcacctcttgggtatgtcttctggacccgagttattctcaatccacttcaatggccaggtgttggagcaaaatcaccacaaagtttccgctatcacactagtttcggcgacctcaactaccgcgaatatgacggtggggccagaaggcaagtggataatctcttccctaacccccaagcacctgcaagccgggatgcaggcctacatcgatataaagaactgtcccaaaaaaacacgcaatctgaagaagatcacccgagagcagcgccgacacatgaaaagatgggagtactttatcgctgccgaagaagtcatttgggactatgcgcctgtcataccggctaatatggacaagaagtaccgctcacaacatttggataatttctccaatcagatcggaaaacattacaagaaagtcatgtacactcagtatgaggacgagtctttcacgaagcacaccgtgaatcccaacatgaaagaggatgggattttggggcccatcatccgcgctcaggtgagggataccctgaagatcgtgtttaagaatatggcttcccgtccttattcaatctacccccacggtgttactttctcaccctatgaggatgaggtgaatagcagctttacctccgggagaaataataccatgatcagagctgtgcagccgggagagacctacacgtacaagtggaatatactcgaatttgacgaacccactgagaatgatgcgcagtgtttgacacggccatactactctgacgtggacatcatgagggacatcgcctccggcctcattggccttctgctgatctgcaagtctaggtcccttgaccggcgaggaatccagcgagctgcggatattgagcagcaagctgtcttcgcagtgtttgacgaaaacaagagttggtatctggaggataacatcaacaagttctgcgagaaccccgacgaggtaaagcgggatgacccgaaattttacgagtccaacattatgtctactattaacggatatgtgcctgaatctataacgacacttggtttttgctttgatgacaccgtccagtggcatttctgctctgtgggaacccagaacgagattttaacaatccacttcactggacattccttcatttatggaaagagacacgaggacaccctgacactatttccaatgagaggcgagagcgtcacagtgactatggataacgtgggcacatggatgctgacctccatgaatagctccccccggagtaagaaactgcgcctgaagttccgggatgtgaagtgcattcccgatgatgatgaggactcgtatgagatatttgaacccccagagagcactgtcatggccacacgtaaaatgcatgacaggctcgagcccgaggatgaggaaagtgatgcggactatgattatcagaatcgactggccgctgccctcggaattcggtcgtttcgcaatagtagcttgaatcaggaggaggaagaatttaatcttacagctcttgccctggaaaatgggaccgagtttgtgtcctcgaatacagatatcatcgttggcagtaattacagcagtccgtctaacattagcaaattcaccgttaataatcttgctgaaccccagaaggcaccgtcccatcagcaggcaaccaccgcagggtcaccactacggcatctcataggaaaaaattctgttctgaactctagcactgccgagcactcctctccatattctgaggatcctatagaggatccacttcaacctgacgtcactggcattcgtttactcagcctgggcgcaggggaattcaagagtcaagagcatgccaagcacaaagggccgaaggtggagcgtgaccaggccgccaaacaccggtttagctggatgaaactgcttgcccacaaagtcggtagacatctctcccaagatactggcagtccttccggcatgaggccttgggaggatctgcctagtcaggacacaggctctccctcccgcatgaggccctggaaagaccctccttcagatttgctcttgctgaagcaatccaactcaagtaagattctggtcggaaggtggcacctggccagcgagaaggggtcatatgaaatcatacaggatacagacgaggataccgcagtgaataactggttgataagtccacaaaacgcatcacgcgcctggggagagtccacgccccttgccaacaagccgggaaaacagtctggccatcctaagttccctcgggtaaggcataaatctctacaggtcagacaggatggcgggaagtcccgactgaaaaagtcgcagttcttgataaaaacgcggaaaaagaagaaggaaaagcacacacaccacgcacctttgtctccccgcacctttcacccactgcgaagtgaggcctataatacattctcggagcgtagactgaagcattctctagttctgcataaatctaacgaaacctctctccccaccgatctgaatcagaccttaccatcaatggattttgggtggatagcgagcctgcccgaccacaaccagaattcaagtaatgataccggtcaagcgagctgcccccctggcctgtaccagactgtgccgccagaggagcattatcaaacctttcccatacaagacccagaccagatgcacagtaccagtgatcctagccataggagttcttcaccagagcttagcgaaatgctggaatatgaccggtcccacaaatcatttccaacagacatcagccagatgtcaccttctagcgagcacgaggtgtggcagaccgtgatcagccccgacctgtcgcaggtgacactctcaccagaactatcccagacgaatctttctcccgacttgtctcacacaaccctgtcaccagagctgatccagaggaacttatcgcccgcactgggacagatgccgattagtcccgatttgagccataccaccctgagccccgatctttcccacaccactttgagccttgacctcagccagaccaatctgagcccggagctctctcagacaaacctgagccccgcactgggccagatgcctctgtcccctgacttgtcacataccacacttagtctcgatttctctcagactaacctctccccagaactgtcccatatgacactgtcaccagaactgagccagaccaacttatctcccgctctgggccagatgcctatctctcctgatctgagtcacacgacattgtccctggattttagtcaaacaaatcttagccccgagctgtctcaaactaatctgtcacctgctctggggcaaatgcccctgtctcccgacccaagccatactactttatcgttggacctgtctcagacaaatttaagtccagagctgtcccagaccaacctttctcccgatctgtcagagatgcccctctttgctgacctttctcagatcccactgactcccgatctggatcagatgaccctgtccccagacttgggcgagactgacctgtcccccaattttggccagatgtccttatcgccggatctgtcacaggtgactctgagtccagacataagcgacactacattgcttccggacctttcgcaaatatcacccccaccagatctcgaccaaatcttttatcccagtgagtctagtcagagtctgctattgcaagaatttaatgagagcttcccctatccagatttaggccagatgcccagcccctcatccccaacgttgaacgataccttcttgagtaaggagtttaatcccctggtgatcgtaggacttagtaaagatggcacagactacatagaaattatccccaaagaggaagtccagtcctcggaagatgattacgccgaaatcgactacgttccatacgacgatccatataagacggatgtgaggacgaacatcaactcaagccgtgacccagataacatcgcggcatggtacctgaggtctaataacggcaatagaagaaattattacatcgctgcagaagaaatttcttgggactactccgagtttgtacagcgagagactgacattgaggattccgatgacatccccgaggacacaacttacaagaaagtggtgttcagaaaatatttagactccaccttcaccaaaagggatccaagaggggaatacgaggagcacctggggattttgggcccaataatccgcgcagaggtggacgacgtgatccaggtgcgtttcaagaacctcgcaagccgcccctactccctgcacgcacacgggctgagttatgagaaaagctcagagggaaagacatatgaagatgattctcctgaatggttcaaagaagacaatgccgtgcagccaaatagtagctacacttatgtctggcacgcgaccgaacgctcagggcctgaaagtcctggaagcgcctgcagggcctgggcatactatagtgccgtaaacccagaaaaggatattcacagcgggttgataggccctttattgatctgtcagaagggcatcctacataaggactcaaacatgccgatggacatgcgtgaatttgtcctactattcatgaccttcgatgaaaaaaaatcatggtattatgagaaaaagtcacgtagttcctggcgcttaacgagttcagagatgaaaaagtcccacgagttccatgcaatcaacggcatgatctactcgctcccagggctgaagatgtatgagcaggagtgggtccgcctgcatctgctgaatatcggagggtctcaggacatacacgtagttcactttcatggacagactctgctcgagaatggtaacaaacagcaccagcttggagtgtggcccttgctaccagggagcttcaaaactctggaaatgaaggctagtaagcctggatggtggctcctcaataccgaggtgggggagaaccaaagggcaggcatgcagacccctttcctcatcatggaccgggattgccggatgccgatgggactctctactggtatcatcagcgatagtcagatcaaggcttccgaattcttggggtattgggagccgcggttagctcgtctcaacaatggtgggtcatacaatgcctggtcggtggagaagctggccgcagagttcgcaagcaagccctggatccaggttgacatgcaaaaagaggtcataattacgggaatccagactcagggagctaaacattatttgaagtcttgctatactactgagttctacgtcgcttattcaagtaaccagattaattggcagatattcaagggcaactccaccagaaatgtgatgtatttcaatggcaacagcgatgcaagcaccatcaaagagaaccagtttgaccctccgattgtcgcccggtacatccggatctctcccacacgcgcctacaaccggcccaccctgaggctcgagctgcaaggatgtgaggtgaatggctgtagcactccactggggatggagaacggtaagatcgagaataagcagattaccgccagtagttttaagaagtcttggtggggcgactattgggaacccttcagagcccgccttaatgcgcagggacgagttaatgcatggcaggcaaaggctaataacaacaagcagtggctggagattgacctcctgaagatcaaaaagatcacagccattataactcaagggtgtaaatccctgtcgtccgagatgtacgttaagtcgtatactatccactacagcgagcagggggtggaatggaagccctatagattaaagagtagtatggtggacaagattttcgagggtaatactaacacaaagggacatgtgaagaatttctttaatcctcccataatctctcgtttcatacgagttatcccaaagacatggaatcagtctattgcactccgtctggagctctttggttgcgacatctac

SEQ ID NO: 9150 - DNA, 6672 bp, Artificial Sequence
  Description of Artificial Sequence: Synthetic coding sequence
atgttccccggttgcccaagactgtgggtactggtggtgttagggaccagttgggtaggctggggatcacagggcactgaagctgcccagctgcgacagttttacgttgccgctcagggcatcagctggtcctacaggccggaacccacaaactcatcccttaacctaagtgtcacctccttcaagaaaatcgtataccgcgaatacgagccatacttcaagaaagagaaaccacaatcgaccatttctggcctgctgggccccacgctgtatgcagaggtcggcgacattatcaaagtccacttcaagaataaggccgataaacccctcagtatccatccacaggggattcgttattccaagctcagtgagggggcaagctacctggaccacaccttcccagccgaaaaaatggatgatgccgtggcacccggaagagaatacacctacgaatggagcatatctgaggactctggccccactcacgatgaccctccttgtctaacccatatttactatagccacgaaaatcttattgaagactttaacagcggcctgatcggtccccttctcatctgcaagaaggggaccttgactgagggtgggacccagaaaaccttcgataagcagattgtactcctcttcgccgtgttcgacgagagtaagtcctggtcacagtcttctagccttatgtacaccgtgaacggctacgtgaatgggaccatgcccgacattacggtgtgcgcccatgaccacatctcctggcatctgctaggaatgtctagcggaccggaattgttcagtatacacttcaacggacaggtgctagaacagaaccatcacaaagtctccgcgatcacactggtcagtgccacctctaccaccgccaacatgacggtcggcccagaggggaaatggattattagctcattgactccgaaacaccttcaagcaggaatgcaggcatacatcgatatcaagaattgccccaagaaaactcggaacttgaaaaagatcacccgggaacagcggagacacatgaaaagatgggaatatttcatcgccgccgaagaggtgatttgggactacgcccctgtcattcctgccaacatggataaaaagtaccgatcccagcacctggataacttttcaaaccagattgggaagcactacaagaaagttatgtacacgcaatatgaggatgagtcctttacaaagcacacagtgaaccccaacatgaaggaagacggtatcctggggcctatcattagagcccaggtcagggacactctgaagattgtgttcaagaatatggccagccggccttatagcatctacccgcatggcgttaccttctcaccttatgaggatgaggttaactcttcctttacttccgggcgcaacaatactatgatccgcgcggttcaacccggcgagacgtatacttataagtggaacatcctggagtttgatgagccaaccgagaacgacgcccagtgccttacccggccgtactacagtgacgtggacatcatgagggacatcgccagcggacttatcggcctgcttctgatctgtaagtctcggtccctggacagaagaggaatacagcgggcagccgacatcgagcagcaggcagtcttcgcagtgttcgatgagaataagtcctggtacttggaagataacatcaacaagttctgtgagaatccagacgaggtaaagagagacgacccaaagttttatgaatcaaacataatgtcaaccattaacggctacgtgcctgaatccattactaccctggggttctgtttcgacgacactgttcagtggcacttttgtagcgtgggtacccagaacgagatcttaaccatccacttcacggggcacagttttatctacggcaaaaggcatgaggacacgctgacactgttccccatgcgcggtgaatcagtgacggtgaccatggataacgtggggacttggatgctcacaagtatgaatagttcaccacggtcaaaaaaactgagactcaaattcagggatgttaaatgtatccccgacgacgacgaagattcctacgagatcttcgagccaccagaaagcactgtcatggctaccaggaaaatgcacgatcggcttgagcctgaggacgaagaatccgacgcagactatgactaccagaatagactagctgccgcccttggcatacgatcattccggaattccagtttaaatcaagaagaggaggaattcaatctcacagcgctggctctcgagaacggaaccgagttcgtctcctcaaacacggacatcattgtcgggtcaaactactctagtccctcaaacatttctaaattcaccgtgaataacctggcggagccccagaaggccccatcccatcagcaagctaccacggcggggtctccacttcgccatctgatcggtaagaattcggtgctcaatagttctactgccgaacactcatcgccgtactcagaagacccgattgaggacccgttacagccagatgtgaccggtattcggttgctcagtctcggagccggggagttcaagagccaggagcatgctaaacacaaggggcctaaggtggaacgcgaccaggccgccaaacacagattcagttggatgaagctgttagcccacaaggtggggagacacttgtcccaggacactgggagccccagcgggatgcgaccttgggaggacctcccttcccaggataccggatctccctctcgcatgcggccttggaaagatcctcctagtgatctgctgctcttgaagcaatctaattcctcaaaaatccttgtgggacgttggcacttggctagcgagaaagggagctatgaaatcatccaggatacagatgaggatacggccgtgaataattggttgatcagtccgcagaacgctagccgggcatggggggaaagcacccccctggccaacaaaccaggcaagcagagtgggcaccccaaatttcctagagtgcgtcacaaaagtctgcaggtgcggcaggacggcggtaaatctcgtctgaagaagtcccagtttttgatcaagactaggaaaaagaaaaaagaaaagcatacacaccacgctcccctgtcaccccggacgtttcatccacttcggagcgaagcctacaatacattctccgaaagacgcctgaagcactccctcgtgctccacaaatctaacgagactagcctgcccaccgatctgaatcaaacgctgccgtctatggatttcggctggatcgcatccttgcccgaccataaccaaaatagtagtaatgacacaggtcaggcgagttgccctcccggattgtaccagactgtgcccccagaggagcattatcagacttttcccatccaggaccccgaccagatgcatagtacatcagatccctcgcacagatcctccagccctgagctctccgagatgctggagtatgaccggtcacacaagtccttccccactgacatctcgcagatgagtccatcaagcgagcatgaggtgtggcagaccgtgataagtcccgacctgagccaggtgactctgtctcccgaactaagccaaactaatctgagtcccgatctgtcccacaccaccttgtctccagagcttatacagagaaatttaagccccgctcttgggcagatgcccatctcccctgacctgtcccacactaccctgagccctgacttgtcccacaccacattatcactcgacctatctcagacaaacctttctccggaactgtctcaaaccaacctgagccccgccttggggcagatgcctctgagtccggacctctcccacaccaccctgtcactggacttttcacagactaatctttctccagagttaagccacatgactttatcgcctgagctctcgcagaccaatctgtccccagcgctcggtcaaatgcctatctctcccgatttaagccacaccactctttctctggatttctcacaaactaaccttagccccgaattgagtcagaccaatctgtcccccgccctgggccaaatgccattgtcaccagacccttctcacacaactctgtcgcttgacctgtctcaaaccaatctgagtccagagctttcccagactaacctcagtcctgatctctctgagatgcccctctttgcagacctctcacaaataccgctgactccagacctggatcagatgacactgtcccctgatctgggcgaaactgaccttagcccaaacttcggccagatgtccctctcccccgatctttcccaggttactctgtctcctgacatctccgacactacgcttctccccgaccttagtcagatctcccccccacctgacctcgaccagatcttctatccatccgaatcatctcagtctctcttgttgcaggaatttaacgaatctttcccgtatcccgatctggggcaaatgccttctcctagctcaccgacgctcaacgatacctttctgagtaaagagttcaacccactggtcatcgtagggttatccaaggacggaactgactacattgaaatcatccctaaggaggaggtgcagagttcagaggatgattatgccgagatcgattacgtgccgtacgacgacccatacaagactgacgtgcgcaccaatatcaactcctcccgtgacccggacaacattgctgcctggtacctgaggagcaataatggcaaccgtaggaattactatatcgcggcagaggagatatcctgggattactcagagtttgtgcagagggagacagacattgaggacagcgatgacatccctgaagacaccacctataagaaggtggtgtttaggaagtacctggacagtacttttacgaagcgcgaccctagaggcgagtacgaggaacacctaggaattctgggacccatcatccgggctgaggtcgacgacgttattcaggtgaggtttaaaaacctcgcgtcccgaccatatagcctgcacgcccatggactgagctatgaaaagtcttcagagggaaaaacatacgaggacgacagtcctgagtggttcaaggaggacaatgcagtacagcctaacagctcctacacctacgtgtggcatgccactgagcgaagcggcccagaatcaccgggttccgcctgcagagcgtgggcttactactcagccgtgaatcctgaaaaggacatccactcagggctgattggacccctgcttatctgccaaaaggggatattacacaaggattccaacatgcctatggacatgcgggagtttgtgctattatttatgacattcgacgaaaaaaagtcttggtactatgagaagaagtcgcgaagctcttggcgccttacaagcagcgagatgaaaaagtcacatgaattccacgctatcaatgggatgatctacagcttaccaggtctaaaaatgtacgaacaagagtgggtgcgactgcacctgctcaacattggcggatcacaggacattcacgtggtccattttcacggccagaccctattggaaaacggcaataagcagcaccagctcggtgtgtggcctctgctgcctgggagcttcaagacccttgagatgaaggccagcaagcctgggtggtggttgctgaacacggaagtcggtgaaaaccagcgtgctgggatgcaaacgccatttctcataatggacagggattgccggatgccaatgggtctcagtaccggtattatttccgacagccaaatcaaagccagcgagttcctgggttactgggagcctcgcttggctcgcctgaacaatggcggaagttacaatgcttggagtgttgaaaagctggctgcagaattcgccagtaaaccatggatccaagtggatatgcagaaagaagtgatcatcactgggatccagactcagggcgccaaacactacctgaaatcctgttacacgaccgaattttacgtggcctactcttcgaatcagatcaattggcagatattcaagggaaactctacccgcaacgttatgtacttcaacggaaactccgatgcgtccaccataaaggagaaccagttcgacccgccaattgtggcgagatatataaggatctctcccactcgggcatacaacagacctacgttgcggctggaactccaggggtgcgaggtcaacgggtgctctacgcctctcgggatggagaacggaaagatcgaaaataagcagattaccgccagttccttcaaaaagtcttggtggggggactattgggagcctttccgagccaggctgaatgcacagggcagggtcaatgcctggcaagctaaggccaacaacaacaagcaatggcttgagatcgatctgctgaaaataaagaagataaccgcgatcattacgcaaggctgcaaatccctctccagtgagatgtatgtgaaatcctacaccatccactattccgagcagggagttgaatggaagccttaccgattgaagtcaagcatggtagataagatttttgagggcaacacaaatactaagggccacgtcaagaacttcttcaaccctccgatcatttcaagattcatacgagtaattcccaagacgtggaatcagtcaatagcactgaggctggagttgtttggatgtgatatctac

SEQ ID NO: 9151 - DNA, 6672 bp, Artificial Sequence
  Description of Artificial Sequence: Synthetic coding sequence
atgttccccggttgtcccaggctctgggtgctcgtcgttcttggaaccagctgggttggatggggtagccagggcaccgaggcagcccagctgagacagttctacgtcgccgcgcaggggatcagctggagctaccgccctgagcccacgaactcatcccttaacctttcagtgacctccttcaagaagatcgtttaccgtgagtatgagccctactttaagaaggagaagcctcagtccaccatcagcggtctcctaggcccgaccctgtacgctgaggtgggcgacatcatcaaggtccactttaagaacaaggccgacaaaccccttagcattcatccccaaggcatccgttacagcaagctttcggagggtgcctcgtacctcgatcacaccttcccggccgaaaagatggacgacgccgttgcacccggcagggaatatacctacgagtggagtatcagcgaagactcaggccccacacatgatgacccgccctgcctcacccacatctattactcgcacgagaacctgatcgaagactttaattcgggcctgatcgggccactgcttatctgtaagaagggcacgttgaccgagggcgggactcagaagaccttcgacaagcaaatagtgctcctttttgccgttttcgacgagtcgaagtcgtggtcccaatcctcttccctcatgtacaccgttaacggttacgtaaacggcactatgccggacatcacagtttgcgcacacgatcacattagctggcacctcctcggaatgtcgtcgggccccgagctgttttcgattcatttcaacggccaagttctggagcagaaccaccacaaggtcagcgctatcactctggtctctgcgacatccaccaccgctaacatgactgtcggccccgagggtaagtggattatctcttccctgacccctaagcaccttcaggcaggaatgcaagcttacatagacatcaagaactgtcctaagaagacccgcaacctcaagaagattacccgcgagcagcggcgccacatgaagcgctgggagtatttcatcgccgcggaagaggtcatctgggactacgctcctgttatccccgccaatatggacaagaagtacagatcgcagcatctcgacaacttctccaatcagatcggcaagcactacaagaaggtcatgtacacccagtacgaggatgagtcgttcaccaagcacaccgtgaatcccaacatgaaggaggacggcattttgggccccatcattcgtgcgcaggtccgggacactttaaagatcgtcttcaagaacatggcctccaggccatatagtatctatccccacggcgttacattctccccctacgaggacgaagtgaacagtagcttcaccagcggccgcaacaacaccatgatcagggcggtgcagcctggcgagacctatacatacaaatggaacatccttgagttcgatgagcctactgagaacgatgcgcaatgcctcacgaggccttactactccgatgttgacattatgcgtgacatcgcgagtggactgatcggcctcctcttgatttgcaagtcccgttccctcgatcgccgcggcattcagcgtgcagcagatatcgaacagcaggcagtgttcgctgtctttgacgagaataagagttggtatctcgaggataacatcaacaagttctgcgagaaccccgatgaggtaaaaagggatgaccccaagttctacgaatccaacatcatgagcaccattaacggctacgtcccggaatccattaccacactcggcttttgctttgacgataccgtgcagtggcatttctgctccgtaggaactcagaacgaaatcttgactatccactttacaggccactccttcatctacggtaagcgtcacgaagataccttgaccctgttcccgatgagaggcgagtctgtcaccgtgactatggacaatgtcggcacatggatgcttaccagcatgaactcttctcctcgttctaaaaagctcaggcttaagttccgtgacgtgaaatgcattcccgatgatgacgaggattcttacgagatctttgaacctcccgagtccaccgtcatggctactcggaaaatgcacgaccgcttagagccggaggacgaggaatcggatgcggattacgactaccagaatcggctggccgccgcactcggtattcgttcttttcgcaacagcagtctgaaccaggaggaggaggaattcaacctgaccgccttggcactggagaacggtactgagttcgtctcaagcaacactgacattatcgtaggttctaactactcctcgccatccaacatttcgaagttcaccgtcaacaacctggctgagcctcagaaagcacctagccaccagcaggccaccaccgccgggtctccgctcaggcatctcatcggaaagaactccgttctaaactcctccaccgcggagcactcctcgccctattcggaggatcccatcgaggaccccctgcagccggatgtaactggtatccgcctccttagtctgggtgcaggagagttcaagagccaggagcacgccaagcacaagggacctaaggtcgagagggatcaagccgccaagcaccgcttcagctggatgaaacttctggcccacaaggtgggtcgtcatctgtcccaagataccggatctccgtcgggtatgagaccatgggaagatttgccgtctcaggacaccggatccccgtcccgtatgcggccgtggaaggacccgccttccgacctcctccttttgaagcaatcgaactcctccaagatcttggtgggccgttggcacttagcaagtgaaaagggctcgtacgagataatccaggataccgacgaagacacggccgtaaacaactggctcatttccccccagaacgcgtcccgcgcttggggtgagagcacccccctcgcaaataagcccggaaaacagtccggccatccgaagttccctcgggtccgtcataagtctctgcaggtccgccaggatggaggtaagagcaggcttaagaagagccagttcctcatcaagacccgtaagaagaagaaggagaagcatacacaccacgcccctctttcgccaaggaccttccatcccctccgctcagaggcgtacaacaccttttcggaaagacgtttgaagcatagtctcgttctgcacaaatccaacgaaacttcgttaccgaccgatctcaatcagaccttgccgtcgatggacttcggctggatcgcaagccttccggaccacaaccagaactccagcaacgacaccggccaggcgagctgtccgcccgggctctaccagactgtccctcccgaagaacactaccagacgttccccatccaggacccggatcagatgcactccacgtcagatccatcgcatcgtagttcttctcccgagctcagtgagatgctcgaatacgatcgatcacacaagtctttcccaacagatatctcccagatgtcaccgtcctccgaacacgaagtctggcagaccgttatcagtcctgacttatcgcaggtgacgttatcccctgagctgtcgcagacaaatttgtctcccgatctctcacataccactctgagtccggagctgattcagcgcaacttgagccctgcactcggtcaaatgcccatcagcccggatttgtcccatacgaccttgtctcccgatctctcccacaccacattgtctctggacctttcccagaccaacctcagtcccgagctgtctcagacgaacctttcccccgctctcggtcagatgcccttgtcacctgacctgtcgcacaccactctttctctcgatttttcccagaccaacctgtccccggagctgtcccatatgaccttgagtcccgagcttagccagacgaacctcagtccggcgctcggccagatgcccatctcccccgacctcagccataccaccttgagcctcgatttcagccagactaatctctctcccgagctgtctcagaccaacctctcccctgctctgggacagatgccactgagcccagatcccagccatacaacgcttagcctcgaccttagccaaaccaacttgtctccagagttgtcacagaccaacctcagccccgacttgtccgagatgccgctcttcgccgacctgtcccagatccctttgactcccgacctcgaccagatgacattgtcccccgaccttggagagaccgacctttccccgaactttggacagatgtcgttgagccccgacctctcccaagtcacactctcaccggacatctccgacacgacactcctccctgatctgagccagatcagtcccccgcccgacctggatcagatattctacccttccgagtcgtctcagtcgttgctgttgcaagagttcaacgagtcttttccgtaccccgatctcggccagatgcctagcccctccagtcctactctcaacgatactttcctttccaaggagttcaatcctctcgtcattgtcggccttagcaaggacggtacggactacattgagattattcctaaggaggaagtccaaagtagcgaggacgactacgctgaaatcgactatgtcccgtacgatgacccctacaagaccgacgtcagaaccaacataaattcctcccgtgaccccgacaacattgccgcgtggtatttgcgctcgaacaatggtaaccgccgtaactattatatcgccgctgaagagatctcctgggactactccgagtttgtgcagcgcgaaacggacatcgaggacagtgatgacatccctgaggatacaacctataagaaggtcgtcttccgcaagtaccttgattccaccttcaccaagcgcgacccgcggggtgagtacgaggagcacctcggcatactcgggcccattattcgcgccgaggtggacgatgttatccaggtccgctttaagaatttagcgtctcgtccttacagtctccacgcgcatggcttgtcctacgagaaatcttctgaggggaagacttatgaggatgactctcccgaatggttcaaagaggataatgctgtccagccaaattcctcctacacctacgtgtggcacgccaccgagcgttcaggcccggagtccccgggctcggcgtgccgtgcttgggcctattactctgctgttaaccccgagaaggatattcattctggactcatcggcccccttctcatctgccagaagggaattctccacaaagattccaacatgcccatggacatgcgtgaattcgtcctgttgttcatgaccttcgacgaaaagaagtcctggtactacgaaaaaaaatcgcgttcctcttggcggctgacatcttcagaaatgaagaagtctcacgaattccatgccatcaacggtatgatctactccctgcctggactcaagatgtacgaacaggaatgggtccggctccacctgctgaacataggtggatctcaagatatacacgtcgttcacttccacggccagacactcctagagaatggtaacaagcagcatcagctgggcgtgtggccgctcttgcctggttccttcaagactctcgagatgaaggcatccaagcctggatggtggctgctaaacactgaggtcggcgagaatcagcgtgccggcatgcaaacaccttttttgattatggaccgtgactgtcgcatgcccatgggcctttccacaggcattatttcagattcccagattaaggcaagcgaattcctgggatactgggaaccccggctggctcgtctcaacaacggcggttcctacaacgcgtggtcggtagaaaagctggccgccgaattcgcttcgaagccctggattcaagtcgatatgcagaaggaggtcatcatcactggaatccagacccagggagctaagcactatctcaagtcgtgctacaccactgagttctatgtcgcctattcctctaaccagattaactggcagatattcaagggcaactccactcgtaacgtcatgtacttcaacggtaactctgacgcctcaactattaaggaaaaccagtttgacccccctatcgtcgctcgttatatccgcatctctcccacccgcgcctacaacaggccaactcttcgcctcgagctacagggctgtgaagtgaacggttgctccacccccctaggcatggagaatggaaaaatcgagaacaaacagattaccgcaagctccttcaagaagagttggtggggcgactattgggagccattccgtgccaggctcaacgcccaagggcgtgtgaacgcttggcaagctaaagccaacaacaacaagcaatggctcgagatcgatttgcttaagatcaagaaaattaccgccatcattacgcaggggtgcaagtctttgtcgtccgagatgtacgtcaagtcctacacgattcactactctgagcagggggtcgagtggaagccgtatcgacttaagtcttccatggttgataagatcttcgagggcaatactaataccaagggtcatgtcaagaacttctttaatcctccgatcattagtagattcatccgggttattcctaagacttggaatcagtccatcgccttgcgtctggagctgtttggatgcgatatttac

SEQ ID NO: 9152 - DNA, 6672 bp, Artificial Sequence
  Description of Artificial Sequence: Synthetic coding sequence
atgttccctggttgtccgcgcctttgggtgctcgtcgtgcttgggactagctgggtaggatggggttcacagggtaccgaagccgcccaactgaggcagttttacgtggccgcacagggtatctcttggagctataggcctgagcccacgaattcttccctgaacctgtctgtgacgagctttaagaaaatcgtgtatagagaatacgaaccctatttcaagaaggaaaaaccacagtctaccatcagtgggttgctggggcctaccctctacgccgaagttggagacataatcaaggtccatttcaaaaacaaggctgataaacctcttagtattcacccacagggaatacgatacagtaaactgagtgagggggcttcctatctcgatcacacctttccagctgaaaaaatggacgacgcagttgccccagggagggagtacacctacgagtggagcatctccgaggacagtggtcctacccacgatgaccctccctgcttgacccatatttactatagtcatgagaatctcattgaggattttaatagcggactgataggaccacttttgatctgtaagaagggcactctcactgaaggcggcacccagaagacgtttgacaagcagatcgtcctgctttttgcagtgttcgatgagagcaagtcatggtcccaaagttcctccctgatgtacacggtgaatggttacgtgaatgggaccatgccagatatcacggtatgtgcccatgatcacatctcttggcatctcctcgggatgtcatccgggcctgagctgttttccatccactttaacggtcaggtactcgaacagaatcaccataaagtttctgccatcaccctggtgagcgctacctctaccaccgctaacatgactgtgggacctgaaggtaagtggatcatctcctctctgaccccaaaacatctgcaggccggcatgcaggcatatatagatatcaaaaactgtcctaagaaaacgaggaatctcaagaagattacccgagagcaacggagacacatgaagcgctgggagtatttcatcgcggcggaagaggtgatctgggattatgccccagtgatccccgccaatatggataaaaagtacaggtctcagcatcttgataatttctccaatcaaatcggtaagcactacaaaaaagtgatgtacacccagtacgaggatgaatcctttaccaagcacacggttaacccaaatatgaaggaagacggaatcctgggccctatcatacgggcccaagtgcgcgatacactcaagattgtatttaagaacatggccagtcgaccatactccatctacccccatggcgtgacattttccccttatgaggatgaagtgaattcctcttttacatctggccggaataatacaatgatccgagctgtccagcccggagaaacgtacacttataagtggaacattctggaatttgacgaaccaaccgagaacgatgctcaatgtctgacgagaccatattatagcgacgttgatataatgcgggacatcgcctcaggcctgatcgggctgttgctcatatgcaagagtcgctccttggatcgcaggggaattcagcgggcagccgacatcgagcagcaggcagtctttgccgtgttcgatgaaaataagagctggtacctcgaggacaacatcaacaagttttgtgagaatcccgatgaagtaaagcgggacgacccaaagttctacgagtcaaatattatgtccacaatcaacggatacgtccctgaatctatcaccacgctgggcttctgtttcgacgacaccgtgcagtggcacttctgctctgttggaacccaaaacgagattctcacgatccactttactggccatagtttcatctatggcaagcggcatgaagacacactgaccctgttccctatgcgcggggagtctgtgaccgtgacaatggacaacgtcggcacgtggatgctgaccagtatgaattcttcacccaggagtaaaaagcttcgcttgaagtttcgcgacgtcaagtgcatccctgatgacgacgaagactcctatgagatctttgagccacctgaatccaccgtcatggccactagaaagatgcacgacaggctcgagcccgaagacgaggaatcagatgctgactacgattaccagaacaggttggcagccgctttgggaatcagaagctttaggaatagttcactgaatcaggaggaggaagaattcaatcttactgcactggcactcgaaaacggcacagagttcgtaagctccaacacagatattatagtggggtctaactattctagtcccagtaacatctctaaatttaccgtaaataacctggcggagccccagaaggcaccttcccaccagcaagccaccacagcagggtcaccattgcggcaccttattggcaagaatagcgtgctgaattcttccacggccgagcactcctctccctactccgaggacccaattgaagaccccctgcagccagacgtcactggcatacggctcttgtctctgggtgcaggagagtttaagagccaggagcatgccaaacacaaaggacctaaggtcgagagggaccaggcagccaaacataggttcagctggatgaagcttctggcccataaagtggggcggcacctgtcccaggatactggtagcccatcagggatgcgcccctgggaggaccttcctagtcaggacaccgggagccctagcaggatgagaccatggaaagacccgccaagcgatctgttgcttctcaaacagagcaactcctctaaaatcctggtgggacgctggcatctcgccagtgagaaagggagttacgagatcattcaggacacagatgaggatacagctgtgaacaactggctgatctcaccccagaacgcttcaagggcttggggtgagtcaacacctctggctaacaaaccgggtaagcagagcggacaccccaagttcccccgcgtgcggcataagtccctgcaggtgagacaagacggggggaaaagtcggctgaaaaagagtcaattcctgatcaagacaaggaaaaagaaaaaagagaagcacacccaccatgccccacttagtcctagaacgtttcacccactgcgcagcgaggcatacaacaccttctccgaaagaagactgaaacatagcctggtcctgcacaagagcaacgagacctcattgcccactgaccttaatcaaactttgccaagcatggactttggatggattgcctcccttcctgatcacaatcaaaatagctccaacgacacaggccaggcgtcctgcccgcccggcttgtaccagaccgttcctcccgaagaacactaccagactttcccaatccaggaccctgaccagatgcatagcacctctgatccaagccaccgatcctctagccctgagttgagtgagatgctcgagtacgatagatcccacaagtcatttcccactgatatttcccagatgagcccatcttctgagcatgaggtgtggcagactgtgatttccccagacttgtcacaggtgaccctgagccctgaactgtcccagaccaatctgtcccctgaccttagccatactacgctgagcccggaactcatccaacgcaatctgagtcctgccctggggcagatgcccatctctccagaccttagtcacaccaccctgtctcctgatctttcccacactaccctgagtctcgacctgtcacagaccaatctgagtcctgaactctcccagaccaacctgtcacccgcgctcggacagatgccactgtctccggacctgtcccacaccacattgtcactggacttttcacaaaccaatttgagccccgagttgagccacatgaccctgagcccagaactctctcaaaccaacctctcccccgctctgggtcagatgcccatctcccccgacctgagccatacgacactgtctctggacttcagccagacaaacctgagtccagaattgtcccagaccaacctgtcaccagccctgggacagatgccactgagccctgacccgtcccataccacactgtctcttgatctgtctcagacaaacctgagccccgagctgtcccagactaatctgtcaccagatctgtccgagatgcccctcttcgctgatctgtcacagatccccctcacacccgacttggatcagatgaccctcagtcctgacctcggcgagactgatctttcacccaatttcgggcagatgagtctgtccccggacctgagccaagtgacactgtcacctgatatctccgacaccaccctgctcccagacctctcccagatatcacccccgcccgacctggaccaaatcttttatccctctgagagttcccagagtctgctgctgcaagaatttaatgaaagtttcccctacccagatctggggcagatgccatcacccagttcccccacgcttaacgatacattcctcagcaaagaatttaaccccctggtgatagttggactgagcaaagacggaacagattatatagaaatcattcccaaggaggaggtgcagtcatccgaggacgattacgcggagattgattacgtgccctatgacgacccgtataaaacagacgtccggacgaatatcaactcatctagagatcccgataacatcgctgcttggtaccttaggagcaataacggaaataggcggaactactatattgcagcagaggagatcagctgggactattctgagttcgttcagagagaaacagacatcgaggattctgatgatatcccagaagacactacttataagaaggtggtcttccggaagtacttggatagcacttttaccaagcgagatccccgcggagagtatgaagaacacctcggcatcctggggcctattatcagggctgaggtcgatgacgtcatccaggttaggtttaaaaacctggcttcacgcccatatagtcttcatgctcatggcctctcctacgagaagtcttctgaaggaaagacttacgaagatgacagccccgagtggttcaaagaggataacgccgtgcagcccaatagctcttacacctatgtgtggcacgcgacagaaaggtcaggaccagagtcccccggaagcgcttgcagggcttgggcgtattactcagccgtgaacccagaaaaggacatccatagtggactgatcggacctctgctcatttgccagaaggggatccttcataaggacagtaatatgccaatggatatgcgcgagtttgtgttgctcttcatgacctttgacgaaaagaaatcctggtactacgaaaaaaagagccgcagttcctggcggctgacgtcatctgaaatgaagaagagccatgaattccacgccatcaacggtatgatttacagcctgccggggctcaagatgtatgagcaggagtgggtgagattgcacttgcttaacattggagggagtcaggacatccacgttgtacacttccatggacagacactgctggaaaatggcaataagcagcatcaactgggtgtttggcctctgctgcctggtagcttcaagacgttggaaatgaaggcttccaagccagggtggtggctgctcaacaccgaggtaggcgagaaccagagagctggtatgcagactccttttctgattatggacagggactgccgaatgcccatgggactcagtactggaattatcagtgattcacagatcaaggcttccgagtttctcggctactgggaaccccgcctggcacggctcaataatggaggctcatataacgcctggtcagtggagaagctcgctgctgaatttgccagcaagccatggatccaggttgacatgcagaaggaggtgatcattacgggtattcagactcaaggggcaaagcattatctgaagtcatgctatacgactgagttctatgttgcgtactcaagcaatcagatcaattggcagatcttcaaaggcaactctacaaggaacgttatgtatttcaatggaaatagcgatgccagtaccatcaaagaaaaccagttcgaccctcctattgtagcacgctacatccggatatcacccactcgggcgtacaaccggccaactttgcgccttgagctgcagggctgcgaagtaaacggctgcagcactccactcggcatggagaacgggaagatagagaataagcagattaccgctagttcttttaaaaaaagttggtggggcgattactgggagcccttccgcgctagactgaatgcccaaggcagggtcaacgcgtggcaggcaaaagctaataataacaagcagtggctggaaattgacttgctgaaaatcaagaagattaccgctattataacacaaggatgcaaatcactgtcatccgagatgtacgtgaaatcttacactattcattatagcgaacaaggggtagagtggaagccatacaggctgaaatcatccatggttgataagatcttcgaaggaaacacgaatacaaaggggcacgtcaagaatttcttcaaccctccaatcatcagtagatttatcagggttatcccaaagacctggaatcaaagcatcgcactccgacttgagctcttcggctgcgacatctac

SEQ ID NO: 9153 - DNA, 6672 bp, Artificial Sequence; identical to SEQ ID NO: 9106
  Description of Artificial Sequence: Synthetic coding sequence

SEQ ID NO: 9154 - DNA, 6672 bp, Artificial Sequence
  Description of Artificial Sequence: Synthetic coding sequence
atgtttcctgggtgtcctaggttgtgggttcttgttgttttgggaacttcatgggtcggttggggctcacaaggtacagaggctgctcagcttcgtcaattctatgtggctgcacagggaatttcttggtcatatagaccggaacccacaaatagttcattgaatttgtccgtcactagttttaaaaagatcgtatatagggaatacgaaccatacttcaaaaaggaaaagccgcagagtaccatcagtggtctcctcgggcctacactgtatgctgaagtgggtgatattattaaagttcatttcaagaataaggcggataaaccgcttagcatccatccgcaagggatcaggtacagtaaactttccgaaggcgcttcctatctggatcatacttttccagctgaaaagatggacgatgcagttgctccaggtagggagtacacttacgaatggtctatatcggaggactctggacctactcacgatgacccaccatgtcttacccatatatattactctcacgaaaaccttatcgaagattttaactctgggcttattgggccactactaatttgcaagaagggtaccttaacagaagggggtactcagaaaacattcgataagcagatagttctgttattcgctgtctttgatgaatccaagtcatggtctcaatcttcctcattgatgtacacagtcaatggatacgtgaacgggacaatgccagacatcacagtgtgtgctcacgatcatatttcttggcacctcttaggtatgagcagtggcccagagcttttctccattcactttaatggacaagtattagagcagaaccatcataaggtttcagcaattactttggtcagtgccacttctactaccgctaatatgaccgtcggtccagaggggaaatggataatctctagtttaacacccaaacatctgcaggctggaatgcaggcatacatcgatatcaaaaactgccctaaaaagactagaaatcttaagaaaataactagggaacagagacgtcacatgaagcgttgggaatatttcatcgcagctgaggaagtcatctgggactatgctcctgttatccctgcgaatatggataaaaaatacagatctcaacacctagataatttttcaaatcagatcggaaaacattacaagaaagtgatgtatacccaatatgaggatgaatcttttacaaagcatactgtgaatccaaatatgaaggaagacggaatcttgggaccaatcatacgagcacaggtccgggatacacttaaaattgttttcaagaatatggccagccgtccttactcgatttacccgcacggtgtcactttctcgccttacgaagacgaggtcaactcttccttcacttcaggacgaaacaacactatgattcgcgctgtccaacccggcgaaacatacacttacaagtggaacatactcgagtttgatgagccaacagagaatgacgcccaatgcttgactaggccttactacagtgatgttgacattatgcgtgatattgcttctggcctcattggactattgttgatctgtaagagccgttccctagacagaagggggatacagagggctgcagatattgaacaacaagcagtttttgctgttttcgatgaaaataaatcttggtacttagaggataacattaacaagttttgcgaaaatcctgacgaagttaagcgggacgatccgaaattctatgaatctaatatcatgtcaactataaatgggtatgtcccagagtcaattaccaccttgggattttgttttgatgacacagttcagtggcatttttgtagtgttggtacacaaaatgagatcttgacaattcattttaccggtcactcctttatttatgggaagaggcatgaggatactttgacactttttccaatgagaggtgagtccgtaacagttactatggacaacgtggggacttggatgctgacaagtatgaatagcagcccccgaagtaagaaactgcggcttaaatttagagacgtaaagtgcatccctgatgatgacgaggactcctacgaaatattcgaaccgcctgaatctactgttatggctactcgtaagatgcacgatcgtttggagcccgaagatgaggaatctgatgcggattatgattatcagaacaggttggcagcggctcttggtatcaggtcatttaggaatagtagtctcaatcaagaggaagaagaattcaatttgactgctcttgccctggagaatggaactgagttcgtgtcttcgaatactgatatcattgtgggcagtaactatagttccccgagcaatatttctaagtttactgtgaataacctcgctgagccacaaaaagctcccagtcaccaacaagctacaacggccgggtcgcctcttaggcatctgatcggtaagaattctgttctgaattcctccacagcagagcatagctcaccttacagtgaagatcctatcgaggatccactacagcctgatgttactggcattagactgctaagcttgggagctggagaatttaaaagtcaggaacatgcaaagcacaagggcccaaaggtggaacgtgatcaggccgccaagcatcgattttcctggatgaaattacttgctcacaaggtagggagacatctctcacaggacacaggaagtccaagtggtatgcgtccatgggaagacttgccctcacaagatactggaagtccatctaggatgaggccttggaaggatcctccctctgatcttctgcttcttaagcaatcaaatagtagcaaaatccttgttggcagatggcatttggcctcggagaaggggtcttatgagattatacaagatacggatgaagatactgccgtcaataactggttaatcagtccccagaatgcctcgcgcgcctggggagaaagtacacctctggctaataagcctggtaagcaatccggtcaccctaaattccctcgggtcaggcataagagtctccaagtcagacaggatggaggtaagtcgcggcttaagaaatcacaattcctgattaagactcgcaagaagaagaaggagaagcacactcaccatgctcctcttagtccgaggacttttcaccctctccgatcagaggcatacaatactttctcagaaaggcgattgaaacattccttggtccttcacaaaagtaatgagactagtctgcccactgatttgaaccaaactttaccatccatggattttggatggatagcttctcttcccgatcataaccagaattctagtaatgacactggccaggcttcatgccctccagggctctatcaaactgtccctcccgaggaacattaccaaacatttcctatccaagaccctgaccagatgcattccacatctgatcctagccatagaagtagttcgcctgaacttagtgaaatgcttgaatatgatcgttctcacaaatcatttcccacagatatctctcagatgagcccttcatccgaacatgaagtgtggcagactgtaatatcccccgatttgagccaggttactttgtctcctgagttatcccaaaccaaccttagtccagatctcagtcacactacactaagtcccgaacttattcagagaaacctgagtcctgcattgggtcaaatgccgatatcaccagatttgtcgcatactaccttgagcccagatctgtcccatactacgctttccctagatctatcacaaaccaacctttccccagaactcagtcaaacgaatctctctccagcactggggcagatgcctctctctccggatttgtcccatactactctgtcattggatttcagccaaacaaatcttagtcctgaactgtcccatatgaccttaagtcccgaattatcccaaacaaaccttagccccgcacttggccagatgccaatttctccggatctttcgcatacaacactatcattggatttctcgcagacgaatttaagcccagagctgtcacagacaaatcttagtccagctctaggtcaaatgccactctctcctgatccttcacataccacattatctctcgacctgtcccagaccaatctgtcgcctgaattatcacaaacaaatctcagccctgatctctctgagatgccactgtttgccgacttgtcacagatacctctcactcctgatttggatcagatgacactttctccagatctgggcgaaaccgacttaagtccaaacttcggtcagatgagcttatctccagatttgagccaagtaacgctcagccctgatatatccgatacgaccctcctacctgatctttcccaaatttctccaccgcccgatctcgaccagatcttctatcctagcgagtcctcccaaagtttgctcttgcaggaatttaatgagtcattcccctatcctgaccttggacagatgccctcaccttctagccctactcttaatgatacatttttgtcaaaggaatttaatcctttagtgatcgtcgggctgtcaaaagacgggactgattatattgaaatcatccctaaagaggaagtgcagagctctgaagacgattacgctgagattgattatgtcccgtatgatgatccatataaaacagacgtcaggactaatatcaactcctcgcgcgatcccgacaatatcgccgcctggtacctgcgatctaacaatggaaaccgacgtaattattatatagcagcggaagaaatttcttgggattactcagagtttgtgcaaagggagactgatatcgaagattcggatgatatcccggaagataccacgtataagaaggtggtgttcaggaaatacctagactctacctttacgaagcgtgatcccagaggagaatatgaggagcatttgggtatcttgggacctattattagagcggaggttgatgatgtgatccaagttagatttaagaatcttgccagcaggccttatagtctgcatgcccatggattgagttatgagaaaagcagcgaaggtaaaacttacgaggatgacagccctgaatggtttaaggaggataatgctgtccagcctaactcatcttacacttatgtttggcatgctacggaaagatctgggcccgagtcacctggtagcgcttgtcgagcttgggcgtattactcagccgtgaatcctgaaaaagacatacattctggtttgatcggaccgcttctaatttgtcagaagggtatcttgcataaagactctaacatgccgatggatatgcgagagttcgttcttctgttcatgacttttgacgagaaaaaaagctggtactacgaaaaaaagtctagatcttcgtggaggcttacgagctcagagatgaaaaagagtcacgagtttcatgctataaatgggatgatttattctttgccagggttgaaaatgtacgaacaggaatgggttagactccatctgttgaatattggaggctcccaagatatacacgtcgttcacttccacggacaaaccttgctggagaacggaaataagcagcaccagcttggtgtttggcctttgttgcctggttcattcaagacccttgagatgaaggcttcaaagccgggttggtggttgctgaataccgaggtgggtgagaatcaaagggctggtatgcagaccccgtttctgatcatggacagggactgtaggatgccaatgggacttagcactgggattattagtgattctcaaataaaagcttccgaatttctcggatattgggagccaaggttagcaaggttaaataacggaggctcatataatgcctggtcagttgaaaaactcgcagctgaattcgcatcaaagccctggattcaagtagacatgcaaaaggaggttattattaccgggatccaaactcagggagctaaacactacttgaagagctgttacaccacagaattctacgttgcttattcgtctaatcaaataaattggcagatattcaaggggaatagtactcgtaacgttatgtatttcaatggaaattcagatgcgagcactataaaggaaaaccagtttgaccctcctatagttgctcgttatattaggatttcccctactcgagcctataataggccaactctaaggcttgagttgcaaggctgcgaagtgaacggctgtagtacaccactaggcatggagaacgggaaaattgaaaataagcagattactgcatctagtttcaaaaagtcatggtggggagattactgggagcccttccgcgccaggctcaatgcacaaggccgcgtgaacgcttggcaagcaaaagccaacaacaacaagcagtggctggaaatagacttgcttaaaattaagaagattactgctataataacccaaggctgtaaaagcctttcctctgaaatgtatgtgaaatcttatacgatacattattctgaacaaggagttgagtggaagccatataggctcaaatcgagtatggtggacaaaatatttgagggtaataccaataccaagggccacgttaaaaatttctttaaccctccaatcatttcaagattcatcagagtcattcccaagacttggaaccagtctattgcgcttaggcttgaactgttcggttgcgacatctac

SEQ ID NO: 9155 - DNA, 6672 bp, Artificial Sequence
  Description of Artificial Sequence: Synthetic coding sequence
atgtttcctggttgtcctcggctgtgggtcctcgtggttctggggacttcctgggttggttggggctctcaaggaaccgaggctgcacagctgcgtcaattctacgtagctgcacaggggatctcctggtcttataggcccgaaccaaccaactcatcccttaacctctcagtaacttcctttaaaaaaattgtgtatagggagtacgaaccttacttcaagaaagaaaagccacagtctacaatatctgggctgctgggccctaccctatacgcggaagtgggagatattataaaagtccattttaagaataaagctgataagcccctcagtatacacccgcagggcattcgctactccaagctgtccgagggagcaagctacctggaccacactttccccgcagagaagatggacgatgcagtggccccaggtagagaatacacatacgagtggtccatcagcgaggattccggcccgacacacgacgaccccccttgtctgacccatatctattacagccacgaaaacctcatcgaggactttaacagcggcttgattgggcccctgctgatctgtaagaagggcaccctgaccgaggggggaacccaaaagacatttgataagcagattgtcttgttgtttgctgtctttgatgaatctaagagttggagtcagtccagttcactgatgtatacagtgaacggatacgtcaacggaaccatgcccgatataacagtttgcgcccacgatcatatttcttggcatcttctggggatgtctagtggcccagagttgttcagtatccatttcaacggtcaggtgctcgagcagaaccatcacaaagtgagcgcaatcacccttgtttcagctacctctaccactgcaaatatgactgtcggacccgaggggaagtggatcatctcctccctgacaccaaaacacttacaggcaggcatgcaagcttatattgacattaaaaactgccctaaaaaaacaagaaaccttaaaaagatcacaagagagcagaggcgccatatgaagcgctgggaatacttcatcgctgcggaagaagttatctgggactatgctccggtgatccctgcgaacatggataagaaataccgaagccagcacctcgataattttagcaaccaaatcgggaaacattacaagaaagttatgtatacccaatatgaagatgagtcatttaccaagcatacagtcaatcccaacatgaaggaggatggaatcttgggcccaattattagggcccaggttagggatacgcttaaaattgtgtttaagaatatggccagtaggccatactcaatttacccgcatggagtgacattctccccgtacgaggatgaagtcaacagcagcttcacctccggtcgcaataacacaatgattagggccgtccagcccggagagacgtacacctacaaatggaatatcctggaattcgatgaacccactgaaaatgatgcccaatgtcttaccagaccatattactccgacgtcgacattatgagggacattgcttcagggctgatcggattactgctgatctgcaaatctcgctctttggacagaaggggaattcaaagagcagcagatatcgaacaacaagccgtctttgctgtctttgatgaaaataaaagctggtatcttgaagacaatatcaataaattttgcgaaaacccagacgaggtcaaaagggatgacccgaagttctatgaaagtaatatcatgtccaccatcaacggatacgttcctgaaagcattaccaccctcggattctgctttgacgataccgtccaatggcacttttgctctgtcggcacccaaaacgagattctgactatacacttcaccggtcactcattcatctacggaaaaaggcatgaggacacactgactctgtttcctatgcgaggagagtcagtgaccgtgacaatggataacgtgggaacttggatgctcacaagtatgaatagcagccctcgcagcaaaaaattgagactcaaattccgcgacgtgaaatgcatcccagatgatgacgaggactcatatgagatctttgaacctcctgaaagcaccgtgatggcaaccagaaagatgcacgatcgccttgaacccgaggatgaggaaagtgacgcagattacgactaccaaaataggttggctgctgcccttggcattcgatcgtttaggaacagtagcctgaaccaggaagaagaggaatttaaccttacagcacttgccctggagaacggcactgaatttgttagttctaacactgacatcattgtggggagtaactatagctcacctagcaatattagcaagtttaccgtgaataatctggcagaaccccagaaggcgcctagccatcagcaggccactacagctggctcccccctccggcacctgatcggaaagaacagtgttctgaactcctcgactgccgagcacagcagcccatatagtgaggaccccatagaggatccactgcaacccgacgtcacaggaataagattgttgagccttggcgccggagaatttaagtcacaagaacacgctaagcataaaggaccaaaagttgaaagagatcaggcagccaaacaccgcttcagctggatgaaacttcttgcacacaaggttggaagacatctgtctcaagacaccggtagccccagcggcatgaggccttgggaggatcttcctagccaggataccggttctccttcaaggatgaggccttggaaagaccccccctcggacttgctcttgctgaaacagagtaacagttcgaagatccttgttggccgctggcaccttgcctccgaaaaaggaagttatgaaatcatccaagatacagacgaagacaccgccgtcaacaattggctgattagccctcagaacgccagccgagcttggggggagagcacacctttggccaataaacccggcaaacagtctgggcatcctaaatttccccgcgtgagacacaagtcgctgcaggttagacaggacggaggcaagtcccggctgaagaagtcacaatttctcatcaagacacgtaaaaagaaaaaagagaaacatacacaccatgcccctctttctccaagaaccttccacccgctcaggagcgaagcatacaacaccttctctgaaagacgactgaaacacagccttgtactgcataagtccaacgagacctcactgccaacggatctgaaccagaccctcccttcaatggacttcggatggatcgcctcactgccggaccacaaccaaaacagttctaatgatactggccaagctagctgccctcctggtctgtatcagacagtgccaccggaagagcactaccaaactttcccaatccaggatcccgaccaaatgcactcaacctccgacccctcccaccgctcctcaagcccagagctctctgaaatgctggagtacgataggtctcataaatccttccctactgatatttcccagatgagcccgagcagcgagcacgaagtttggcaaactgtcatatcccctgatttgagtcaagtcactttgagccccgagctcagccagaccaacctgtctccagatttgagccacacgactctctctccggagctgatccaacgtaatctttccccggccctcggccagatgcctatcagccctgatctctctcacacaactttgagccccgatttgtcccacaccaccttgagccttgacctgagtcaaaccaatctttcaccagagctgtcccagacaaacctgtctcctgccttgggtcaaatgcccctgagccccgatctgtcgcacacaaccctgagccttgattttagccagaccaacctctcaccagaactgagccacatgaccctctcacccgaactgagtcaaacaaatctttctcctgccctggggcaaatgcctatctctccagatctctctcatacaacactttctctggactttagtcaaaccaatctgagtcctgagctgagccaaactaacctcagtcctgctctcgggcagatgccactgtctcccgatcccagtcatacaaccctgtcactcgatctgtcccagactaacctgagcccagaacttagtcagaccaacctctcacccgatcttagtgaaatgccactctttgcagacctttcccagatccctttgacccctgatttggaccagatgacactgtctcctgatttaggcgaaacagacctgagtccaaatttcgggcagatgtcactgagtcccgatctgagccaagtgacactgagcccagacatctccgacacaaccttactccctgacctctctcagatttctccgcctcctgacctggatcagatattttaccctagcgaatcatcccaaagcctgctgttgcaagaattcaatgagtccttcccttaccctgacctgggacagatgccgagcccatcttctcccactctgaacgatacttttctatcaaaggaatttaatcctctggtaatagtcggtctgagtaaggatgggaccgactacatcgagatcataccgaaagaggaagttcagagtagcgaagatgactatgccgagattgactacgtcccttacgacgatccttataaaacagatgtgcggaccaacataaactcttctagggatcctgacaatatcgccgcctggtaccttcgcagcaataacggaaacaggcgcaactactacatcgccgccgaagaaatttcctgggactacagtgaattcgtacagcgtgaaaccgatattgaagactccgacgatatccctgaggatacaacctataaaaaagttgttttcagaaagtacttggattccacctttaccaaacgagatccacggggagagtatgaagaacacttgggcatcctgggtcccattatccgggccgaagtggatgacgtgatccaggtgagatttaagaatctcgcatcaaggccgtattctttgcacgcgcatggcctgtcttacgaaaagagcagcgaaggcaaaacttatgaggacgattcgcctgaatggttcaaagaggacaatgcagtgcagcccaactccagctatacctacgtatggcatgcaacagagaggagcggcccagaatcaccaggctcagcttgcagggcctgggcatactattctgccgtgaaccctgagaaggacatccactctggtctgattgggccgcttctcatctgccagaagggtatcctgcacaaagatagtaacatgcctatggacatgagagaattcgtcctcctgtttatgaccttcgacgagaaaaagagctggtactatgaaaagaagtcacgatcctcctggaggcttacatctagtgaaatgaaaaaatcacatgagtttcacgctattaacggcatgatttattccctgcccggacttaaaatgtacgagcaagagtgggtgagactgcatttgctcaacattggtggaagccaagacatccatgtcgtgcacttccacgggcagacccttctcgaaaacggcaacaagcaacaccaattgggcgtgtggcccctcctgccgggatcctttaaaacattagaaatgaaagctagcaaacccggatggtggttgctcaacaccgaagtcggagagaaccagagggcagggatgcagactcccttccttattatggatagggactgtagaatgcctatgggcctgagcacggggattatctctgattcacagatcaaagcttccgaatttctgggttattgggagcccaggttggccagactgaacaatggcgggtcctacaacgcttggagcgtggagaagcttgccgccgagtttgccagcaagccctggattcaggtcgatatgcagaaggaggtgataatcaccggaatacagacacaaggggcaaagcattatttgaaaagctgttacactactgagttctatgtggcttatagcagcaaccagatcaattggcaaatctttaaaggtaactctacaaggaacgtcatgtatttcaatggcaacagcgacgctagcaccatcaaagagaaccagttcgacccccctattgttgctcggtatatccgtatcagccccactagagcttacaacagacccacgctgcggctggagctgcagggatgcgaagtgaacggttgctccactccactgggcatggagaacggcaagatcgaaaataagcagataaccgccagcagcttcaagaagtcatggtggggagattactgggaaccgttccgcgctaggttaaacgctcaggggcgcgtcaacgcatggcaggctaaggccaacaacaacaaacagtggctggagattgatctgctgaaaataaaaaagatcacagccatcattacacagggatgcaagtctctctcaagcgagatgtatgttaaatcatacacaattcattacagcgaacaaggcgtggagtggaaaccatataggctgaagagctctatggtcgataaaatctttgagggaaatacaaacaccaaaggacacgttaagaacttctttaaccccccgatcatcagccgctttatcagagttattcctaaaacctggaatcagtctattgcactgcggttagaactgttcggatgcgatatatac

SEQ ID NO: 9156 - DNA, 1398 bp, Artificial Sequence
  Description of Artificial Sequence: Synthetic coding sequence
atggtgagccaggctctgcggctgctgtgccttctgctgggcctgcaagggtgcctcgcagctggaggagtggccaaagccagcggcggggagactcgggacatgccgtggaaaccggggccgcaccgcgttttcgtgacccaggaggaggcacacggcgtcctgcaccgccggcggcgcgcgaacgcgtttctggaagaactgaggccaggatcactcgagcgagaatgtaaggaagaacagtgctcgtttgaagaagcccgcgagatcttcaaggacgccgagcgcaccaagctcttctggatttcctactccgacggcgatcagtgcgcctcgagcccgtgccaaaacggaggatcatgcaaggaccagctccagtcatacatctgcttctgtctgccagcattcgagggccgcaactgcgaaacccacaaggatgaccagctgatctgcgtcaatgagaacggggggtgtgaacaatactgctcagaccataccggcactaaaaggtcatgccgctgccacgaggggtactcgctgctggcggatggcgtgtcctgtacgccgactgtcgaatacccgtgtggaaaaatccccatcctggagaaaagaaatgcctcgaagccgcaaggtcgcatcgtgggcggaaaggtgtgtcctaaaggagaatgcccctggcaggtgctgttgctcgttaacggagcccagttgtgcggcggcaccctgatcaacactatctgggtcgtgtccgcagcccactgctttgataagatcaagaattggcggaacttgatcgctgtgctgggggagcatgatctctcagagcatgacggagatgaacagtcacgcagagtggcacaggtcatcatcccgagcacttacgtgccgggaactactaaccatgatatcgccctgttgcggctgcatcagccggtggtgcttactgaccatgtggttccgctctgcctcccagaacggaccttttcggagcgaactctcgcatttgtccgcttctcactcgtgtccggatggggccagctgcttgaccgcggagccaccgctctcgaactgatggtcctcaatgtgcctagactgatgactcaggactgcctgcaacagtcgagaaaggtgggagactcgccgaatatcactgaatacatgttttgcgcaggatactcggacggctctaaagactcctgcaaaggtgattcaggcggcccccacgctacccactaccgcggaacctggtacctgaccggaatcgtgtcgtgggggcaggggtgcgctactgtcggtcactttggtgtatatactcgggtgtcgcagtacatcgagtggctccagaaattgatgcgcagcgaaccgcggccaggagtgctcctccgcgctccattcccg

SEQ ID NO: 9157 - DNA, 1398 bp, Artificial Sequence
  Description of Artificial Sequence: Synthetic coding sequence
atggtcagtcaggctctgagactgctttgtttgttgctgggcctacaggggtgcctcgccgccggcggcgtggctaaagcgagtggcggggaaaccagagacatgccatggaaacccggcccacatagagtgttcgttacgcaggaggaagctcacggcgtgctccatagacgtaggagagccaatgccttcttagaagaacttcgtccaggctctctggagagggagtgcaaggaggaacagtgctccttcgaagaggctcgcgagatctttaaggacgccgaaaggacgaaactgttttggatatcttatagcgacggagaccagtgtgctagctctccctgccagaacggcggttcatgcaaagatcagttacagtcctacatttgtttttgcctgcccgccttcgagggcaggaactgtgagacacacaaggacgatcagttgatttgcgtgaacgagaatggtgggtgcgaacagtattgcagtgaccacaccggcacgaagcggtcttgccggtgccatgaaggctactctctgctggctgatggggtttcctgcacccctaccgtagagtatccatgcggcaagattcccattctcgaaaagagaaacgcatccaaaccccaggggcgtatcgtcggtggaaaagtctgtcctaagggagaatgtccctggcaggtgctgcttctggtgaatggcgcacagctttgcggtggaaccctcatcaacactatctgggtggtgagcgcagcccactgcttcgacaagataaaaaattggcgtaacctcattgccgtgctgggcgaacacgatctcagcgaacatgatggcgatgaacagtcccgccgcgtcgctcaagtgattataccctctacatatgttcccggtactacaaaccatgacatcgccttacttaggctccaccagcccgtggtcctgaccgatcacgtggtcccattgtgcttgcccgagcgcaccttcagcgagagaaccctggcctttgttcgattcagcctggtgtccggttggggtcagctgctcgaccggggcgccaccgcactggagctcatggtcctgaatgtacccagactgatgacacaggactgcctccaacagtcccggaaagtcggtgactcccctaatatcaccgagtatatgttttgcgcggggtacagtgatggttcgaaggactcctgcaaaggcgactccggagggccgcacgccacgcattaccgggggacctggtatctgaccggcatagtatcttgggggcaggggtgcgctaccgtcggccactttggagtgtacacacgcgtgtctcagtatattgagtggctccagaagcttatgcggtctgaacctagacctggggtgctgttgagagcgcctttccca

SEQ ID NO: 9158 - DNA, 1398 bp, Artificial Sequence
  Description of Artificial Sequence: Synthetic coding sequence
atggtgtcccaggccctcagactcctgtgcctgctcctgggattgcagggatgtctcgcagccgggggagttgctaaagcgagcgggggcgaaaccagagatatgccctggaaaccaggtccacatcgggtgtttgttactcaggaggaagctcatggggtactccacagaagaaggagagccaatgcttttctcgaagagctgcggcccggttccttggagagggaatgtaaagaagagcaatgctcctttgaggaggcccgagagatttttaaagacgctgaacggacaaagctgttctggattagctactccgacggagatcagtgtgctagctctccctgccaaaacggcggcagttgcaaagatcaactgcagtcttacatatgtttctgtttgccagccttcgaaggccgaaactgtgagacacataaggacgatcaactgatctgcgtgaacgagaacggaggttgcgagcagtactgttcagatcacaccggcaccaaaaggagttgtcgatgccacgaagggtactcactcctcgcggatggagtgtcttgtacgcccaccgtcgagtatccatgcgggaagattcccatactcgagaaacgcaacgcgtccaagcctcagggccggatcgtgggcggcaaggtttgcccgaagggagagtgcccctggcaggtgctgctgttggtgaacggggcgcagctgtgcggaggtaccctgattaacaccatatgggttgtcagtgcagcacactgttttgataagatcaagaactggagaaatctcattgccgttctgggggaacacgatcttagcgagcacgacggagacgagcagtctaggagggtggcccaggtgattataccgtctacctacgtgcctggcacgacaaaccacgacatcgctctgctccgattgcaccagccagttgtgctcacagaccacgttgtgcccctgtgcctccctgaacggacattctccgaaaggacgctggcgttcgtcaggttcagtctggtgtccggttgggggcaactgctcgatcgcggagccacagccctggagctcatggtgttgaacgtgccaagactgatgacccaagactgtctgcagcaaagtagaaaagtcggggactcccccaacattaccgagtacatgttctgcgcaggatattcagacggttccaaagactcctgtaaaggagactctggtggtccgcacgcaacccattacaggggtacttggtatttgaccgggattgtgagttgggggcagggctgcgccaccgttggccactttggagtgtatacgcgagtcagccagtatatcgaatggctgcagaagctgatgaggtcagagccgcggcccggggttctgctgagggctcccttcccg

SEQ ID NO: 9159 - DNA, 1398 bp, Artificial Sequence
  Description of Artificial Sequence: Synthetic coding sequence
atggtgtctcaggccctccgtttgctttgccttctgctgggcctgcaaggctgcttggcggccggaggagttgcaaaggcttctggaggcgaaaccagggacatgccatggaaaccaggcccacaccgcgtatttgtcactcaggaagaagctcacggcgtgcttcatcgcaggagaagagctaatgcatttctggaggaactgaggcccggctctctggagagggagtgtaaagaggaacagtgctcgttcgaggaggcccgagaaatctttaaggacgctgagcgaactaagttattttggatctcttatagtgatggggaccagtgcgctagcagcccttgtcagaatggcggttcgtgcaaggatcaactgcagtcatacatctgtttctgcctgcccgctttcgagggcagaaattgtgagacgcataaggacgatcaactgatctgcgtcaatgaaaatggaggttgtgagcaatactgctccgatcacactggtactaagcgcagctgtcggtgccacgagggatactccctattggctgatggagtgagctgtactccaactgtggaatatccatgtggtaaaataccgattctggagaaacgcaatgcatccaaaccccaggggcgcatcgtggggggaaaggtgtgccctaaaggggaatgcccgtggcaggtcctgctgctcgtgaacggtgcccagctatgtggggggacactcatcaatactatttgggtggtgagcgcagcgcattgtttcgataagatcaaaaactggcgcaacttaatcgctgtgctgggagagcacgacttaagtgagcatgacggcgacgagcagtcgcggcgcgtggcccaggtaataattccctccacgtatgtgcccggcacaacaaaccatgatatagcgctgttgagactgcaccaaccagttgtgctgactgatcacgtggtacctctatgccttccagagcgcaccttctccgagcgcacgttagccttcgtgaggttttcgctggtttccggatggggacaactgttagaccgaggtgccactgctctcgaactgatggttttaaacgtccctcggctgatgacacaggactgcctccagcagtcacggaaggtgggggattccccaaacattaccgaatatatgttctgcgccggctattctgatggatccaaagattcttgcaaaggcgacagcggcggtcctcacgctactcattatagagggacttggtatttgacgggaatcgtatcctggggacagggctgcgccacagtaggccatttcggcgtgtataccagagtttcccaatatatcgaatggctgcagaaattgatgcgtagcgagccgcgtccaggtgtgctactccgtgccccattccct

SEQ ID NO: 9160 - DNA, 1398 bp, Artificial Sequence
  Description of Artificial Sequence: Synthetic coding sequence
atggtgtcccaggccctccggctcctgtgccttttgctggggttgcagggatgcctggccgcgggaggagtcgccaaagcctcgggcggagaaaccagagacatgccgtggaagcctggcccgcatcgggtgttcgtgacccaagaagaagcccatggagtgctgcaccgccgtagaagagcaaatgcgtttctggaggagctgcgccctggatcattggaacgcgagtgcaaggaagaacagtgttcgtttgaagaagcaagggagattttcaaggacgcagaaaggaccaaattgttctggatctcctactctgatggcgatcaatgcgcatctagcccatgtcagaacggaggatcgtgcaaagaccagctccagtcatatatctgtttctgcctgcctgctttcgaaggccgcaactgcgagactcacaaagacgaccagctcatttgtgtcaacgaaaatggagggtgcgagcaatactgctccgaccataccggcactaagaggtcgtgtcggtgccacgaaggctactcactgctcgccgacggagtgtcctgcacgccgactgtggaatacccatgcggcaagataccgatcctggagaaacggaacgcctcaaagccgcagggccggatcgtcggtggaaaggtgtgtcccaagggagagtgcccgtggcaggtactgctgctggtgaatggcgcccaactgtgtggtggaaccctgatcaacactatttgggtcgtgtccgcagcgcactgtttcgacaagatcaagaactggcggaatttgatcgctgtcctcggggagcacgacctgtcagagcacgacggcgatgagcagagccgtcgggtggcgcaggtgatcatcccatccacttacgttcccggtactactaatcacgacatcgcactcctgcggctgcatcagcctgtggtcttgacggatcacgtggtcccgctctgcctgccggaacggaccttttccgagcgcaccctcgcttttgtccgcttcagcctcgtgagcgggtgggggcaattgctggatcgcggcgccacggcgttggagcttatggttctgaacgtgccgcgactgatgacccaagactgtctccagcaatcaaggaaggtgggagattcccctaacatcacggaatacatgttctgcgccggatactcagacggatcgaaggatagctgcaaaggtgatagcggaggtccacatgcgacccactaccggggcacttggtacctgaccggaatcgtgtcctggggacagggctgcgctaccgtgggacatttcggagtatatactagagtgtcccaatacattgaatggcttcaaaaacttatgagaagcgaaccaaggccaggggtactgttgcgagcgcccttccca

SEQ ID NO: 9161 - DNA, 1398 bp, Artificial Sequence
  Description of Artificial Sequence: Synthetic coding sequence
atggtgtcacaagctctccgattactctgtctcctcctgggcctgcaggggtgtctagctgcaggaggcgttgcaaaggcctctggaggtgagacacgtgacatgccttggaaaccggggccccatagagttttcgtcactcaggaagaggcccatggcgtcctccatcggcgccgccgcgcgaatgctttcctggaagagctgcgccccggttccctggagcgggaatgcaaagaagagcaatgtagctttgaagaggcccgggagatttttaaggacgccgagcgaactaaactgttctggattagttacagcgacggcgatcaatgtgcctcgtcaccatgccagaacggtggcagctgcaaagaccagttacagtcctacatatgtttctgcctccccgcttttgaaggccggaactgtgaaacccataaagatgatcaactcatttgtgtgaacgaaaatgggggatgtgagcaatactgcagtgatcatacaggtaccaagcgttcatgccgctgccatgagggttatagtctactagcagatggtgtaagctgcacccccacggtagagtacccttgcggcaaaattcccatcttagaaaaacgaaatgcaagcaaaccacagggtcgcattgtcggcggcaaggtctgtccgaagggagaatgtccctggcaggtcttattgctcgtaaatggcgcacagctgtgtgggggaaccctcatcaacactatttgggtagtctctgcagcacactgttttgacaagattaaaaactggcgcaatttgatcgctgtgttgggtgagcatgatctgtcagagcacgatggcgatgagcagtcacggagagtcgctcaggtgatcatcccgagtacctacgttccaggaacaacaaaccatgacatcgcgttgctaaggctacaccagcctgtcgttctgactgatcatgtggtcccgttgtgcctcccggagcgcacattcagcgagaggaccctggcgttcgttcgtttcagcctcgtctctgggtggggacagctactagatagaggggccaccgctttggagttaatggtacttaatgtcccgaggctgatgactcaagattgtttacagcagtccagaaaagttggggattcacccaatatcaccgagtatatgttctgtgcggggtactcagatggtagcaaggacagttgtaagggtgattcaggtggcccccacgctacccattacagaggtacctggtatcttactgggatcgtgtcgtggggacaggggtgtgccactgtcggacactttggagtatacacccgcgtgagccaatacattgaatggcttcaaaagctaatgcgttccgagccgagacctggagtattgctccgtgctccctttcct

SEQ ID NO: 9162 - DNA, 1398 bp, Artificial Sequence
  Description of Artificial Sequence: Synthetic coding sequence
atggtgtctcaggcactcagactgctgtgtctgttgctaggactccagggctgtctggctgctggaggagtcgctaaagcttccggaggagaaacccgggacatgccctggaagccgggaccacacagagttttcgtaacacaagaggaagcacacggcgtgctgcaccggcgcagaagagcaaacgctttcctcgaagaactcaggcccggatcactggagagggagtgtaaagaggagcagtgctcctttgaggaagcaagggaaatcttcaaggacgcagagagaaccaagctcttttggataagctactcagacggcgatcagtgcgcttcttcgccctgtcagaacggcggctcatgcaaggaccaactacagagttatatttgtttttgtctgccagcctttgaaggtagaaattgcgagacccataaagatgatcagttgatttgcgtgaatgagaacggggggtgcgagcagtattgctctgaccatactggaaccaaacggtcttgccggtgccacgagggctacagccttttagcagacggcgtgagttgcacgcctactgtggagtacccgtgcggcaagatccccattctggaaaaaaggaacgcttcaaagccccaagggcgcatcgtgggtggcaaggtgtgccccaagggcgagtgcccttggcaagtgctgctcttagtgaatggggctcaactctgtggcgggacactaatcaacacaatctgggtggttagtgcggcccattgtttcgacaaaatcaaaaattggagaaatctcatcgcagtgcttggagaacacgacttatctgagcacgatggggacgagcagagtaggagagtagctcaggtgatcatcccatccacttacgttcccggcacaaccaaccatgacatcgccctgctgagattgcatcagccagtggtgctgactgaccatgtagtccccctctgcttgccagaacggacattttccgaaagaacactagcattcgtgcggttttcacttgtgtccggatggggccagctacttgatcgcggagccaccgccctcgaactgatggtcctcaatgtgcctcggctgatgacccaggattgcctccagcagtctcgcaaagtgggggattcacctaacatcaccgagtacatgttctgcgctggctatagcgacggaagcaaagactcctgtaaaggcgactctggaggacctcacgccacacactatcgggggacttggtacttaacaggcatagtgagttggggccagggctgcgctacagtgggtcatttcggagtttacacaagagtctcacagtacatagaatggttacagaagctcatgcggtctgagcctcgtccaggagttctgctgagggcccctttcccc

SEQ ID NO: 9163 - DNA, 1398 bp, Artificial Sequence
  Description of Artificial Sequence: Synthetic coding sequence
atggtctcacaagctctgcgtttgctctgcctgctcctggggctgcagggttgtcttgccgctggcggagtggccaaggcgagcggaggggagactagagacatgccctggaagcctggacctcatcgggtgttcgtgacacaggaagaggcccacggagtgctgcatcgcaggcgtcgggcgaacgctttcctggaagagctgaggcccgggtcccttgaaagggagtgcaaggaggagcagtgtagttttgaagaagctcgggaaatttttaaggacgcggagcgcacgaagctcttttggataagctactctgatggcgaccagtgtgctagctcaccctgtcaaaatggaggctcctgcaaggaccagctacagtcatacatatgcttttgtttgcccgcgttcgagggcaggaattgtgaaacccacaaggacgatcagctgatatgcgtcaacgagaatggtgggtgcgagcagtactgctcagatcacaccgggacaaaacgttcttgccggtgccacgaaggctattccctgttggcggacggagtaagctgtaccccgacagtggagtatccgtgcggaaaaatacccatactggaaaagagaaacgcaagcaagcctcaggggcgcatcgtagggggtaaggtgtgtcctaagggtgaatgtccgtggcaggtcttgttgctggtaaacggagcacagttgtgcggaggtacgctcataaacaccatttgggtcgtgagtgccgctcattgcttcgataagattaaaaactggaggaacttgattgccgttctcggggagcatgatttatcagaacacgatggggacgagcagagtcggcgggtggctcaggtcattatacccagcacatacgtgccaggtactacaaatcacgatatcgctctgcttaggttgcaccagcccgtagtcctaactgatcatgtggtacctctgtgtctacctgaacggacgtttagcgagcggacactggccttcgtccggttcagtctggtgtccgggtggggccaattactggacagaggtgctactgcacttgagttgatggtgctgaatgtgcctcgcctcatgactcaggactgcctgcaacagtcccgcaaagtcggggactctcccaatatcacagagtacatgttttgcgccggctatagcgacggctccaaggattcttgcaagggcgattcaggcggaccccatgccacccactacagggggacatggtatttgactggcatagtctcatggggccagggatgtgcaacagtcgggcattttggcgtctatacaagagtgagtcagtacatcgagtggttacaaaagttaatgcgcagcgaacctcggccgggggttctgctgagggcgccgttccct

SEQ ID NO: 9164 - DNA, 1398 bp, Artificial Sequence
  Description of Artificial Sequence: Synthetic coding sequence
atggtgtctcaggccttgcggctcttgtgtttgctgctgggactgcaagggtgcctcgcggcaggaggcgtggcaaaggccagcggaggagaaacgcgcgacatgccatggaagcctggaccgcaccgcgtctttgtcacccaagaagaggcacacggagttctgcatcgcaggagacgggcgaacgcattcttggaagagctgcggccggggagcctcgaacgcgaatgcaaggaagaacaatgctcgttcgaggaggcaagagagatcttcaaggacgctgaacggactaagctgttctggatctcctacagcgacggggaccagtgcgcatcctccccatgccaaaatggtggctcctgcaaagaccagttgcagtcctacatatgtttttgcctcccagctttcgaaggaaggaactgcgaaacccacaaggatgatcaactgatctgtgtgaacgagaatggcggatgtgagcaatactgttccgaccatactggcaccaaaaggtcttgcagatgccatgagggatattcgctcctggccgacggagtgagctgcacgcctactgtggaatacccctgtggaaagattccaatcctggaaaagcggaacgccagtaagccccaaggccgcatcgtgggtggcaaggtgtgcccgaaaggagagtgcccgtggcaggtactgctgctggtcaatggagcgcagctttgtggaggaactcttatcaacaccatttgggtcgtttccgcggcgcactgcttcgataagatcaaaaactggagaaatctcattgcggtcctgggtgaacacgatctcagcgaacatgacggagacgagcagtcacggcgcgtggcacaggtgatcatcccgtcgacttacgtgccaggaaccaccaaccacgacatcgcgctgctgcggcttcatcaacccgtcgtgctgactgatcatgtggtgccgctttgcctgccggagagaaccttctcggaacggaccctggccttcgttcgcttttcactcgtgagcggctggggacaactgctggatcggggtgcgacggcgctcgagctgatggtgctcaatgtgcctcggctgatgactcaagactgcctgcaacagagcagaaaggtgggagactcgccgaacattactgaatacatgttttgtgcggggtatagtgacggatcaaaagattcgtgtaaaggagactcgggtggacctcatgcaacgcactacaggggaacctggtacctgacgggtatcgtgtcctggggtcagggctgcgcaaccgtgggacacttcggtgtctacacgcgggtgtcacagtacatagaatggctgcagaagctgatgcgctcagagccacggcccggagtgctgttgagggccccattcccg

SEQ ID NO: 9165 - DNA, 1398 bp, Artificial Sequence; identical to SEQ ID NO: 9159
  Description of Artificial Sequence: Synthetic coding sequence

SEQ ID NO: 9166 - DNA, 1398 bp, Artificial Sequence
  Description of Artificial Sequence: Synthetic coding sequence
atggtatcacaggccctgaggctgttatgtctgctcttggggctgcaggggtgccttgctgcaggcggtgtagccaaagccagcggaggggaaactcgggatatgccttggaaaccaggaccacatagagtgttcgtcacccaggaggaggctcacggggtcctgcatcggcgcagacgggctaacgcctttctggaggaattgcgacccggtagcctcgagcgcgaatgcaaagaggagcagtgcagctttgaagaggctagagaaatctttaaagatgctgagagaaccaagctcttctggatttcctactccgatggcgaccagtgcgccagcagcccgtgtcagaacggtggatcctgcaaggaccagctgcagtcttacatttgcttctgtctcccggcattcgagggaagaaactgtgaaacccacaaagatgaccagttgatctgcgtaaatgaaaacggagggtgtgagcagtactgctcggatcataccggaaccaagcgctcctgtagatgccacgagggttactcactattggcagatggcgttagttgcacaccgacagtggaatatccctgcggcaagatccctatcctggagaagcgaaacgcctcgaagccacagggccgtattgtgggcggcaaggtgtgtcctaagggagaatgcccttggcaggtcctcctgctcgtaaacggcgcacagctgtgcgggggaacactgatcaacacaatctgggtggtgagtgcggcccactgcttcgataagatcaaaaattggaggaacctgatcgcagtgcttggggagcacgacctgtctgaacacgacggtgatgagcagagcaggcgtgtggctcaggtaataatccctagcacttacgttccaggaacaactaatcatgatatagcactgcttaggctgcatcagccggtagtgttaaccgaccacgtagttccgttgtgtctgcccgaaagaaccttcagtgagagaacacttgcatttgttcgtttcagcctggtcagcggctggggtcagctcctcgacaggggcgccacagctctggaactgatggtactcaatgtccctaggcttatgactcaggactgtctgcaacagagtagaaaggttggagatagtcctaatatcacagagtacatgttctgtgccggctactcagatggtagcaaagattcttgcaaaggcgacagtgggggcccacatgccacacactacaggggtacctggtacttaaccgggatcgtttcatgggggcagggatgcgcgactgtgggccacttcggggtctacacacgcgtttcgcagtacattgagtggcttcagaaactgatgcgcagcgagccaagacccggtgtgctgttgagggctcccttccca

SEQ ID NO: 9167 - DNA, 1398 bp, Artificial Sequence
  Description of Artificial Sequence: Synthetic coding sequence
atggttagccaggctttgcgcctcctgtgtttactcttggggttgcaggggtgcttggcggccgggggcgtggctaaagctagtggcggagagacaagagatatgccctggaagcccgggccacaccgcgtattcgttactcaggaggaggcccacggagttctacaccgccggaggcgagccaatgccttcctggaagagctccggccggggtctttggagagagagtgcaaggaggagcagtgtagcttcgaagaagcaagagagatcttcaaggacgcagaacggacaaaactcttttggattagttactctgatggagaccagtgcgcctcgtccccctgtcaaaatggcggctcatgcaaggatcagctacagtcctacatttgcttctgtttgccagctttcgagggacggaattgtgaaacccacaaagacgaccagctgatttgtgttaatgagaacggaggctgcgaacagtactgcagcgaccacaccggcaccaaaaggtcttgtcggtgccacgagggatactccctgctcgccgacggagtctcctgtacccctactgtggagtatccttgcggtaagatccccattttggagaaacgtaacgcatcaaaaccacagggccgcattgtgggagggaaggtctgcccaaagggagagtgcccatggcaggtcttgttgctcgtgaatggagcacagctgtgtggagggacgctcatcaacacaatctgggtggtatctgccgcccactgttttgacaaaattaagaattggaggaatttgattgcggtgttaggtgagcacgacctttctgagcatgatggtgatgagcagtcacggcgcgtagcccaggtaattatcccctccacctacgtgccgggaaccaccaaccacgacatagcgctgttgaggctacaccagccggtggtcctcacggatcacgttgtgcctctgtgcttgccagagaggactttttcggagcggaccttggcctttgtgcggttctcacttgtttcgggctgggggcagcttctggataggggggctacggctctggagctgatggtgctgaacgttccaaggctcatgactcaggactgcctccagcagtccaggaaagtgggtgacagcccaaacattacagagtacatgttttgcgcagggtatagcgacggctcaaaagactcctgcaagggggactctggggggcctcatgcaacacattaccggggaacctggtacctaacaggtattgtctcttggggccaaggttgtgcaaccgtgggtcacttcggagtgtacacccgggtctcccagtatattgagtggttgcaaaaacttatgagatctgagccacgcccaggagtgctgctgcgcgctccatttccc

SEQ ID NO: 9168 - DNA, 1398 bp, Artificial Sequence
  Description of Artificial Sequence: Synthetic coding sequence
atggtgtcccaagcgctgagactgctgtgcctcctccttggactgcaagggtgtctggccgcgggtggggttgcgaaggcctccgggggcgaaaccagagatatgccatggaagcccggcccccatcgcgtgttcgtgacccaggaagaagcacatggagtcctgcatagacgacgccgagcaaacgcgtttctggaggagcttcgaccaggctcccttgagagggagtgtaaggaggagcaatgttcctttgaggaagcgcgggaaatcttcaaagatgcagagcgcactaagctgttttggattagctactcagacggagatcagtgcgcttcgagcccatgtcaaaacggaggatcttgtaaagaccagcttcagtcgtacatttgtttttgtttgcctgcgttcgaagggagaaactgtgaaactcacaaggatgatcagctgatttgcgtcaatgaaaacggaggttgtgaacaatactgtagcgatcacaccggaaccaagaggtcatgtcgctgtcatgaaggctactcgttgcttgcagatggggtgagctgtacccctacggtggaatacccttgtgggaagattccaatcctggaaaagcgtaatgctagcaagccacaaggaagaattgttggaggaaaggtgtgtcccaagggggaatgtccctggcaagttttgctgctcgtcaacggcgcccaactgtgtggtggcactctgataaacaccatctgggtggtttcggcagcacattgctttgataagatcaaaaactggcgcaaccttattgctgtgctgggggagcatgatcttagcgaacatgacggtgatgagcaatcacgacgcgtggcacaggtcattatcccttcgacttacgtgcccggtacgaccaaccacgacattgcacttctccgcctgcatcaacctgtcgtgctgaccgatcatgtggtgccactttgccttccggaaagaacttttagcgaacgtaccctggcgtttgtgcggttttcgctcgtgtccgggtggggacagttgcttgatcggggtgcaaccgcactggaactgatggtgctcaacgtgcctcgtctgatgacccaggactgcctgcaacagtcaagaaaggtgggagactcacccaacattaccgagtatatgttctgtgcaggatactccgatggttcgaaagattcctgcaagggagactccggaggtccacacgcgacccactaccgaggtacctggtaccttactgggatcgttagctggggtcaagggtgcgcaacggtgggacattttggagtgtacaccagagtgtcacagtacatagaatggcttcaaaagctgatgagatctgaaccacggcctggtgtgctgcttcgggcaccatttccc

SEQ ID NO: 9169 - DNA, 1398 bp, Artificial Sequence
  Description of Artificial Sequence: Synthetic coding sequence
atggtgtcacaggccttacgtctcctgtgcttgctcctggggcttcaggggtgcttggctgccggcggagttgccaaggcttccggtggagagactagggatatgccttggaagccggggcctcatcgagtttttgttacccaggaggaagcccatggagtcttgcaccgacggcgcagagccaatgccttcctggaggagctgaggccaggatcactggaacgggaatgtaaggaagaacaatgcagctttgaagaagccagagagattttcaaggatgctgagaggacgaaactcttttggatcagttattctgatggcgaccaatgcgcgtcttccccgtgccagaatggagggtcctgtaaggatcagcttcagagttacatttgcttctgtcttccggcatttgagggcagaaactgtgagacccacaaggatgatcagctgatctgcgttaatgaaaacgggggttgtgagcagtactgttctgaccatactggaacgaagcggtcgtgtcgctgtcacgaggggtactcccttctggctgatggagtgagttgtacccctacggttgagtacccctgtggaaagatccccattctggagaagcgcaatgcttctaaaccccaggggcgaatcgttggtggaaaagtttgccccaaaggcgagtgcccctggcaggttttgcttcttgtaaatggcgcccaactgtgcgggggcaccctgataaacacgatttgggtagtttcagccgcccactgtttcgataaaatcaaaaactggcgcaatttgatagccgtgctcggggaacatgacttatctgagcacgatggagatgaacagagcagacgcgtggcacaggttatcattccttccacctacgtgccaggaacaaccaaccatgatatagcgctgctgcgacttcatcagcccgttgtgctcactgatcacgttgtacccctgtgcctgccagaacgtacgttctctgaacgaacacttgctttcgtgcggtttagcctggtgagtggctgggggcagctgctcgaccgcggcgcaactgcattggagctgatggttctcaacgtacccaggctgatgacgcaggattgccttcagcagtctcgaaaggttggcgactccccaaatatcacggagtacatgttctgcgccggatactcagatgggagcaaggatagctgtaagggggactctgggggaccccacgctactcactatagaggtacatggtatttgactggtattgtttcttggggacagggttgcgcaacagtggggcatttcggcgtgtatactcgggtgtcgcagtatattgagtggctgcagaagctgatgcgcagcgagcctcgacctggtgtgctactccgcgcaccttttccg

SEQ ID NO: 9170 - DNA, 1398 bp, Artificial Sequence
  Description of Artificial Sequence: Synthetic coding sequence
atggtgtctcaagccctccggctcctctgccttctgctcggactgcagggctgtctcgccgcaggaggcgtggccaaagcctcgggaggagaaactagggacatgccgtggaagccgggaccgcacagagtgttcgtgacgcaggaggaagcacacggtgtcctgcataggagacgtcgcgccaatgcttttctggaagagctgcgcccaggttcgcttgagcgcgaatgtaaggaggaacagtgctcgttcgaggaagcgcgcgaaatcttcaaagacgcggagcggactaagttgttctggatcagctactcggacggagatcagtgcgcgtcatcaccctgccagaacggaggttcgtgtaaggaccagctgcaatcgtacatctgtttttgcctcccagctttcgagggtcgcaactgcgagacgcataaggacgaccaacttatttgcgtgaacgaaaatggaggatgtgaacagtactgctccgaccacaccgggactaaacggagctgtcggtgccacgaaggctactcgctgctggcagatggagtttcctgcactcctactgtggaatacccgtgtggaaaaatccccatcctggagaagcgaaacgcgagtaagcctcagggcagaattgtcggaggcaaggtctgcccgaaaggcgaatgcccttggcaagtgctgctcctcgtgaatggagctcaattgtgcggggggaccttgatcaataccatctgggtggtgagcgccgctcactgcttcgacaagatcaagaactggcgcaatctcattgccgtcctcggagaacatgaccttagcgagcacgatggagatgaacaatcccgcagagtcgcccaagtgatcatcccatcaacctatgtgcccgggaccaccaaccacgacatcgccctgctgcgcctgcatcagccggtcgtactcactgaccatgtggtcccgctgtgcctgccagagaggactttcagcgagaggactctggcttttgtccggttctcactcgtgagcgggtggggtcagctgcttgatagaggcgcaaccgcgctggagctgatggtgctgaacgtcccgagactcatgactcaggactgcttgcaacagtcgcggaaagtgggagatagcccgaacatcaccgaatacatgttctgcgccggctactcagatggatccaaggattcctgcaagggagactcaggaggtccacacgccacccactaccgggggacgtggtacttgaccggaattgtgtcctggggccagggctgcgcaaccgtgggccattttggggtgtacactcgggtgtcccaatacatcgaatggctgcagaagctgatgcgctccgagccacgccctggagttctgctgcgggcgcctttcccg

SEQ ID NO: 9171 - DNA, 1398 bp, Artificial Sequence
  Description of Artificial Sequence: Synthetic coding sequence
atggtcagtcaagcccttcgtctgctttgtttacttctcggacttcaaggatgccttgccgcaggaggagtcgcaaaggcctcgggaggagagactagagatatgccatggaaacctgggcctcatcgagttttcgtaactcaggaggaggcacatggagttctgcaccgtcgccgtcgggctaatgcctttttggaagagcttcgccctggatctctcgagcgtgaatgtaaagaagaacaatgctctttcgaagaggcccgagaaattttcaaagacgctgagcgtactaaacttttttggatatcatactcggatggtgatcaatgcgcatcctccccatgtcagaatggaggatcatgtaaagaccaacttcagtcctatatatgtttttgtttgcctgcttttgaaggaagaaattgtgaaacgcataaggatgatcaacttatttgtgtaaatgaaaatggaggatgcgaacagtattgctcggatcatacaggaacaaaacgaagttgccgatgccatgagggatactctctactggcagatggagtctcgtgtactcctactgtggagtacccatgcggaaaaattccaattcttgaaaaaaggaatgctagtaagccacagggacgtatagtgggaggtaaggtttgtccaaaaggagagtgtccatggcaggtgctccttctggtgaatggagctcaattgtgcggagggacgttgattaatactatatgggttgtttcagctgcacattgtttcgataagatcaaaaattggcgaaatctcattgcggtcttgggagaacatgacctgtctgaacatgatggggatgaacaaagccgacgagtggctcaagtgattattcccagcacatacgttccaggcacaactaaccacgacattgctcttcttcgtttgcaccagcctgtggttttaacagatcacgtagttccactgtgtctcccagagcgaacattcagtgagcgtaccctcgcatttgtgagattctctttagtctctggatggggacaacttcttgacagaggagcaaccgcgctagaacttatggttctgaatgtacctcgtttaatgacacaagattgcctacagcaatctaggaaggtaggtgattcaccgaatatcacagagtacatgttctgtgccggctattccgatggatctaaagatagctgtaagggcgactccggaggacctcatgcaactcattatcgcggaacatggtacctcacgggaattgtctcttggggtcagggatgtgccacagttggacattttggagtttacacacgtgtctcacaatacattgaatggttgcaaaagctaatgcggtcggaaccacgccctggggtccttttgcgggctccattccca

SEQ ID NO: 9172 - DNA, 1398 bp, Artificial Sequence
  Description of Artificial Sequence: Synthetic coding sequence
atggtcagtcaggcgctcagacttctctgcctcctgctggggttgcaaggatgtctggccgccggaggcgttgctaaggcctctggaggggaaacccgcgacatgccgtggaagccgggccctcaccgagtgttcgtgactcaagaggaagcccacggagtgctgcaccggcgcaggcgggcaaatgccttcctcgaggagcttcgccccggttcactcgagcgcgaatgcaaggaagaacagtgcagcttcgaggaagcccgcgagatcttcaaggacgcggaacggacgaaattgttttggattagctactcagatggagatcaatgcgcatcctcaccttgccagaatggaggctcgtgtaaggaccagctgcaatcgtacatctgcttttgtctgcctgcatttgaggggaggaactgcgagactcacaaggacgaccagctgatctgcgtcaacgaaaatggaggatgcgaacagtattgctccgatcacaccggcactaaacgatcgtgccgctgccatgagggttactcactcctggcggatggagtcagctgcaccccgactgtggagtacccatgcggaaagatccccatcttggagaaacgcaatgcgtcgaaacctcaaggacgaatcgtgggaggaaaggtgtgcccgaagggagaatgtccatggcaagtactgttgcttgtcaacggcgcccagctctgtggtggtaccctcattaacactatctgggtggtatcggcagcacactgcttcgacaaaatcaaaaactggcggaacctgatcgctgtgctcggagagcacgacctgagcgaacatgacggagatgagcagtccagacgcgtcgcgcaagtcatcattccatcaacctacgtcccgggaacgaccaaccacgacatcgccctgcttcggcttcatcagccagttgttctcactgaccatgtggtgcctttgtgtttgccggaacgcaccttctcagaacggactctggctttcgtgcgcttttcactcgtgtcaggatggggtcagctgctggaccgcggagcgaccgccctcgaactgatggtgcttaacgtgccgcgcctcatgacccaggattgcctgcagcagtcgcgcaaagtgggcgattccccgaacattaccgaatacatgttctgcgccgggtattcagacgggtccaaggactcgtgcaagggtgactccggaggtccgcacgcgacccattaccgcggaacttggtacctcactggaatcgtgtcgtgggggcagggctgtgccactgtgggacacttcggcgtctacaccagagtcagccagtacatcgagtggctgcagaaacttatgcgctcggaaccgcgccctggtgtcctgcttagagccccgtttcct

SEQ ID NO: 9173 - DNA, 1398 bp, Artificial Sequence
  Description of Artificial Sequence: Synthetic coding sequence
atggtgagccaggcactgaggctgctgtgtctccttctcggactgcagggatgtcttgcagccggtggagtcgcaaaagcgagcggcggcgaaacccgcgacatgccgtggaagccaggccctcatagagtgtttgttactcaggaagaggcgcacggcgttctgcataggaggaggcgtgcaaatgccttccttgaagaacttcgccctggttcgctggagagggaatgtaaggaggagcagtgcagctttgaggaagcgcgggagatattcaaggatgccgaaaggaccaaacttttttggatttcctactctgatggtgaccaatgtgccagctcaccatgtcaaaacggaggatcatgcaaggatcaattgcagtcctacatttgcttctgtctgccggcatttgagggcaggaactgcgaaacccataaggatgatcaactgatatgcgtcaacgaaaacggaggttgtgaacagtattgttcggatcataccggtactaaacgctcgtgccggtgccacgagggttactctctgctggcggatggagtgtcctgtactccaactgtggaatacccatgcgggaaaatccctattctcgaaaagcgtaacgcctccaagccacagggtcgcattgtcggcggtaaggtgtgtcctaagggtgaatgtccttggcaggtccttttgcttgtgaacggcgcacaactttgtggaggtacgctgatcaacactatctgggtggtcagcgcagctcattgcttcgataagatcaaaaactggaggaacctgattgcggtgcttggagaacacgacctttcggaacatgatggagacgaacaatcgagacgggtggcacaagtcattatcccgtccacctacgtgccagggacgactaatcacgatatcgcactccttcgacttcaccaaccggtggttctgactgatcatgttgtgcctctttgtctgcccgaaagaaccttttccgaaagaactctcgcgtttgtgcggttttcactcgtgtcagggtggggtcagctgctggacagaggggcaaccgcactggagttgatggtccttaatgtgcctagacttatgacgcaagactgcctgcaacaatcgcggaaggtgggagactcccctaatatcaccgagtatatgttctgtgctgggtactcggatggttctaaggattcatgtaaaggggactccggtgggccacacgcgacccattaccggggaacctggtacttgactggtattgtgtcgtggggccaagggtgtgcaactgtcggacatttcggagtgtacacgcgggtgtcgcaatacatcgagtggctccagaaacttatgcggagcgaacctcgacccggggtccttctgagagcgcctttccct

SEQ ID NO: 9174 - DNA, 1398 bp, Artificial Sequence
  Description of Artificial Sequence: Synthetic coding sequence
atggtcagccaggcgctacgattgctgtgcctcctgttgggactgcagggctgccttgccgcgggaggcgttgccaaggctagtgggggggagaccagagatatgccgtggaagcctggcccacaccgggtctttgtgacacaagaagaagcccacggggtgctgcatcggcgtcggagggcgaacgcctttttggaggagctacggcctgggtcgctagaacgcgagtgtaaagaagagcaatgttctttcgaagaggcgcgcgagatcttcaaagacgctgagcgcaccaagttgttttggatcagttatagcgacggcgaccagtgcgctagcagtccctgccaaaatgggggaagctgtaaagatcagctgcagtcttacatctgcttttgcctccctgcctttgaaggtagaaactgtgagacgcataaggatgaccaactgatctgtgtgaatgagaatggcgggtgcgagcagtactgttctgatcacactggcacgaagagatcctgtcgctgccatgagggatacagtctgctggccgacggagtgagttgcactcccactgttgagtacccttgcgggaagattccgatcctggagaaaaggaacgcttcaaaaccacagggtcggattgtaggaggtaaggtctgccctaaaggcgagtgcccttggcaggtcttattattggtgaatggtgcccaactctgcggcggcacgctgattaacactatctgggtggtgtcggcagctcactgttttgacaaaatcaagaactggaggaatttaatcgccgtcctcggcgaacacgacctgtctgagcacgatggtgacgagcagtctcgcagggtcgcacaggtgattatcccctcaacgtatgtgcctggcaccacaaaccacgatatagcgttgctcagattacaccagccagtcgtgctgacagatcacgtggtcccactctgtctgcccgaacgaaccttttctgaaaggacactcgcatttgtgcggttctccctggtgtccgggtggggacaactgctggataggggagcaactgccctggaactgatggtcctgaatgtcccccggctgatgacacaggactgcttgcagcagtctcgaaaggtcggcgacagtccaaacatcacagaatatatgttttgcgctggatattctgacggaagcaaagacagttgcaaaggcgacagtggagggcctcatgcaacacattaccgagggacttggtatttgacggggatagttagctggggacagggttgtgccaccgtaggccatttcggagtatacacccgcgtgagccagtacatcgaatggttgcagaaacttatgcgatctgaaccacggcccggggtgctgctcagagctccattcccg

SEQ ID NO: 9175 - DNA, 1398 bp, Artificial Sequence
  Description of Artificial Sequence: Synthetic coding sequence
atggtcagccaagcccttcgcttgctgtgtctgcttttgggtctgcagggttgcctcgcggctggaggggttgcgaaagccagcggaggcgaaacgagggacatgccttggaaaccaggcccacacagagtgttcgtgactcaagaagaagctcatggcgtgcttcaccgccgccgtcgggccaacgcattcctggaggagctccgcccgggtagcctcgaacgggaatgcaaggaggaacagtgctccttcgaggaagcccgggaaatcttcaaggacgcagaaaggaccaagctcttctggatttcgtactccgacggtgatcagtgcgcgtcctcaccgtgtcagaatggcggatcctgcaaagaccaactgcagtcctacatctgcttttgtctcccggcattcgagggacggaattgcgagactcataaggacgaccaactgatctgtgtgaacgaaaacggcggatgtgaacagtattgctcggaccacaccggaaccaaaagatcatgcaggtgccatgagggatacagcctgctcgcggacggagtgtcatgcacccctacggtcgaatacccttgcggcaagatcccgatcctggagaagcgcaacgcgtcaaagccgcagggacgcatcgtgggagggaaggtgtgtccgaagggggaatgcccatggcaggtgctccttctcgtcaatggagcccaattgtgtggaggcaccctgatcaacaccatctgggtggtgtccgccgctcattgcttcgataagatcaaaaactggcgcaacctcatcgcggtcctgggggaacacgacctgtccgagcacgacggagatgaacaaagccgcagagtggcccaggtgatcatcccctccacctacgtccctggaacgaccaatcatgatatcgcgctgctgaggctgcaccagccggtcgtattgactgaccacgtggtgccgctgtgcctcccggagagaactttttccgagcggactctggcattcgtgcgcttcagcctggtgtcgggctggggacagctgctcgaccgcggcgccactgcacttgaactgatggtgctgaacgtgcctcgcctcatgacccaggactgccttcaacagtcccggaaagttggcgactcaccaaacatcactgagtatatgttctgcgcgggatattcggatggatccaaggactcgtgcaaaggggactcgggaggaccccatgcgacccattacaggggaacctggtatcttaccggaatcgtgtcttggggacaaggatgcgcaactgtgggtcatttcggagtgtacacccgggtttcgcagtacattgagtggctccaaaagctcatgagatccgagccgcggccgggcgtgctgctccgggcccctttccct

SEQ ID NO: 9176 - DNA, 1398 bp, Artificial Sequence
  Description of Artificial Sequence: Synthetic coding sequence
atggtgtcacaggcgttgagactcctgtgcttgttgctcggacttcagggctgcttggcggcaggaggagtggcaaaggccagcggtggcgagactcgtgatatgccttggaagcctggtcctcatcgtgtctttgtgacccaagaagaggcgcatggagtgcttcatagacgacgccgcgcgaatgcctttcttgaggaacttaggccgggaagtctggaacgcgaatgcaaggaagagcaatgctcgtttgaggaagccagagaaatctttaaggacgcagagcggaccaagttgttttggatctcttactcagatggtgaccaatgtgcatcgtccccatgccagaacggaggttcgtgtaaggatcaactgcaaagttatatctgtttttgtctgcccgcctttgaaggccgaaattgtgaaactcacaaggatgaccagctcatatgtgtcaatgagaacgggggttgcgaacaatactgctcggatcatactgggactaagagatcatgtcgctgtcatgaaggctactcgctgctggcagatggagtctcgtgtactcccactgtggaatacccttgtggtaagattcctatacttgagaaacggaatgcttccaaaccacaaggtcggattgtggggggcaaagtctgcccaaagggagaatgtccgtggcaggtgcttttgctggtaaacggagcacagttgtgtggtggaactctgataaacaccatttgggtggtgtcggctgcgcattgtttcgataagatcaaaaactggagaaacctgattgcagtgcttggcgaacacgacctgtcggaacacgacggcgacgaacaatcacggcgcgtggcgcaggtcatcattcccagcacctacgtgccgggaactaccaaccacgacatagcactgctcaggctgcaccaacctgtggtcctcactgaccatgtggttcctctgtgcctgcccgaaagaactttctcagaaaggacccttgcctttgtacgcttctccctggtttccgggtggggccagcttcttgacagaggagcaacggcactggagcttatggtgctgaacgtgccccgtcttatgacccaggattgcctgcaacagtccaggaaggtgggcgattcgccgaatatcactgagtacatgttctgcgccgggtactcggatggttcgaaggattcgtgtaaaggagatagcggaggtccacatgcaacccattatcggggtacgtggtaccttaccggcatcgtcagctggggacaaggctgtgccacggtgggtcattttggtgtctacactcgtgtgagccagtacatcgagtggctgcagaagctcatgcgttccgagcctcggcccggggtcctgctgagagcacccttccct

SEQ ID NO: 9177 - DNA, 1398 bp, Artificial Sequence
  Description of Artificial Sequence: Synthetic coding sequence
atggtgagtcaagcattgcgattactgtgcctgctgctaggactgcagggatgcctcgcagccgggggcgtggcaaaagcctcgggaggcgagacgcgggatatgccttggaaacccgggcctcaccgagtgttcgttacacaggaggaagctcacggggtccttcatcgacgtcggcgcgcaaatgccttcctggaggaactgcggcccggatcgctagagagggaatgtaaggaggagcagtgctcattcgaggaagcgcgcgagatatttaaggatgccgagcgcacaaaattattctggataagttactctgatggggatcaatgtgcatcaagtccctgccagaacgggggctcctgtaaggaccagctgcaaagctacatatgcttctgtttgcctgccttcgagggacgcaattgtgagacacataaggacgaccagctgatttgtgtgaatgagaatggtgggtgcgaacagtactgctcggatcacactgggacaaaacgatcatgccggtgtcacgagggttactcactgttggccgacggagtcagttgtactccaacggtcgaatatccgtgtgggaagatacccatcctggaaaaacgcaatgcatccaagcctcagggacgtattgtgggtggtaaggtgtgccctaaaggcgagtgtccctggcaggtcttactcctggtcaatggcgctcagttatgtggaggtactctcattaacactatatgggtagtgtctgctgctcattgcttcgacaagattaagaattggcgcaatcttatcgccgttctgggagaacatgacctcagcgagcacgacggcgacgaacagagtcgccgggtcgcccaagtgattattccctccacctacgtgccagggactacgaaccatgatattgcccttctccgtctgcaccaacctgtggttctcaccgatcacgtggtgcccctctgtcttcccgagcgaaccttcagtgagaggacattggcctttgttcgatttagcctggtgtcaggatggggacagctgcttgaccggggtgcaacagccttggaactcatggtattgaacgtcccccgtctcatgactcaggattgtctgcagcagagtcgcaaagtgggagactctcctaacatcaccgagtacatgttttgcgctgggtactcagatggttccaaggactcatgcaaaggggacagcggaggccctcatgctacccactacagagggacttggtacctgactgggattgtttcctggggacaggggtgcgccaccgtaggacacttcggagtgtacaccagggtgtcgcagtacattgagtggttacaaaaactgatgcggagcgaaccaagacctggagtcttgctgcgggcccccttccca

SEQ ID NO: 9178 - DNA, 1398 bp, Artificial Sequence
  Description of Artificial Sequence: Synthetic coding sequence
atggtttcacaggccctacgcctgctctgtttgcttctgggacttcagggatgcttagctgccggtggggttgccaaagcctcgggcggcgaaacaagggatatgccatggaaacccggccctcatcgggtgtttgttacacaggaggaggctcatggtgtactgcacaggaggagacgtgccaatgcgttcctggaggagttgcgacctggcagtttggaacgagagtgtaaggaagaacagtgttcttttgaggaagcacgggagatcttcaaagacgctgagagaacaaagctgttttggatcagctactcggatggagatcagtgcgcttctagcccttgtcagaatgggggatcgtgtaaggatcagctgcaatcctatatttgtttttgcctacctgcattcgagggacgtaattgtgaaacccataaggatgatcaactgatctgtgtgaatgaaaacggcgggtgtgaacagtactgctccgatcatactggtacgaagcgctcttgccgctgccatgagggatatagcctgttggccgatggagtatcctgtactccgacagttgagtatccatgcggcaaaatcccaatcttagaaaagcgcaacgcaagcaaacctcaaggccgcatcgttggcggcaaagtctgtcccaaaggggaatgtccgtggcaggtactgctactagtgaatggtgcccagctgtgtggaggcacactgatcaataccatctgggtcgtttctgcggcacactgttttgacaagatcaagaattggcggaacttaattgccgttcttggcgagcacgacctgtctgagcatgacggagatgagcagtctaggagggttgctcaagtcatcattccctcgacatacgtacccggcacaactaaccatgatattgccttactgaggttgcaccagccagtggtgttgactgaccatgtcgtccctctgtgcctgcctgagaggacgttttctgagcgcaccttggctttcgtacgattctcactggtatctggatggggtcagctcttggaccggggtgcaacagcattggaactgatggtgctgaatgttcctcggctgatgactcaggattgcctgcagcagagtagaaaagtcggggattctccaaacatcacagagtacatgttttgcgcgggctactcagacgggtctaaggattcgtgtaaaggagacagtggcggtccccatgccacccactatcggggcacttggtatcttacggggatcgtttcgtggggtcaaggatgcgctactgtcggacactttggggtgtacacccgtgtgtctcagtacattgaatggctgcagaaactgatgcgttctgagcctcgaccaggtgtgctgttgcgcgcccccttccca

SEQ ID NO: 9179 - DNA, 1398 bp, Artificial Sequence
  Description of Artificial Sequence: Synthetic coding sequence
atggtcagccaggcactgcgcctgctgtgtttacttctgggtttgcagggatgcctggctgcggggggggtggcgaaagcctcaggaggcgagactagggacatgccttggaagcccggtcctcaccgcgtgttcgtcacccaggaggaggctcacggcgtcctccacaggcggaggcgagcaaatgcgttcctggaggagctgcgcccaggttctctggagagagagtgtaaggaggaacagtgttcattcgaggaggcaagagaaatttttaaggatgccgagcggaccaagttattttggatttcatatagtgacggggaccagtgtgcttcatcaccatgccagaacggcggaagctgtaaagaccaactacagtcatacatttgcttttgtcttccggcgttcgagggaaggaactgcgagacccacaaagacgaccagctgatctgcgtcaatgaaaatggcggatgcgaacagtattgctccgaccacaccggcacgaaacggtcctgccggtgccacgagggctatagcttgctggcggacggtgtcagctgtacccccaccgtggagtatccgtgcgggaagatccccatcctggagaaacgaaacgcgtccaaaccccagggacgtatagtgggcgggaaggtgtgtccaaagggcgagtgcccatggcaggtgctcctgctagtgaatggcgctcaactttgcggggggacccttatcaataccatctgggtagtcagcgccgctcactgtttcgacaaaatcaagaattggcgaaaccttattgcagtgttaggcgagcatgacttatccgaacacgatggcgacgaacaatccaggcgggtggctcaggtgataatccccagcacatacgtcccggggacaaccaaccacgacatagccctcctgcgccttcaccagcccgtagtgctgacggaccacgtcgtgccactctgcctcccggagcggacattttccgaacggactttggcctttgtgaggtttagcctggtttccggttggggacagctactggatcgtggagcaaccgccttagagctgatggtattgaatgtgccccggctgatgacacaggattgcctacagcagtccagaaaagtaggggactcacctaacataacagagtatatgttttgcgcggggtacagcgatgggtccaaagactcctgtaaaggcgactcgggcggcccccacgctacacattatcgggggacctggtacttgaccggcattgtgtcatggggacagggatgtgctacagttgggcattttggcgtgtacacaagagttagccagtacatcgaatggttgcagaagctcatgaggtcagagcccaggcctggcgtgctgttaagggcccctttccca

SEQ ID NO: 9180 - DNA, 1398 bp, Artificial Sequence
  Description of Artificial Sequence: Synthetic coding sequence
atggtgtcgcaggctctgcgcttgctgtgcctgctgctggggctccaggggtgtctcgctgcgggaggagtcgctaaggcctccgggggagaaactcgcgacatgccgtggaaaccgggaccccatcgggtgttcgtcacccaagaagaagcccatggagtgctccaccggcgccgccgggcaaatgcattcctggaagaactgcggccggggtccctcgaacgcgaatgtaaggaggagcagtgcagcttcgaggaggcacgagaaatcttcaaggacgcggaacgcactaagttgttctggattagttatagcgacggcgaccagtgcgcttcgtcgccttgccagaatggcggaagctgcaaagatcagctgcagtcctacatctgcttctgcctgccggcattcgagggccgaaattgtgagactcacaaagatgaccaactgatttgcgtgaacgagaatggaggatgcgagcaatactgttccgaccatactggaactaaacgctcgtgcagatgccacgaaggttactcgctccttgcggacggagtgtcgtgtactccgactgttgagtacccgtgtgggaaaattccgatccttgaaaagcgcaacgcctcgaagcctcaaggccgcatcgttggaggaaaagtgtgccccaaaggcgagtgcccctggcaggtgctcctgctggtgaacggcgcccaactctgcgggggcaccctgatcaataccatctgggtggtgtctgccgcacactgcttcgataagatcaaaaactggcggaacttgatcgcggtgctgggagagcacgatctctcagagcacgacggagatgagcaatcacggcgggtggcgcaggtgatcatcccttcgacctacgtccccggaacgaccaatcacgacatcgctctgctgagactgcatcaaccagtcgtgttgactgatcatgtggtgccgctctgtctccctgaacggaccttttcagaaagaaccctggccttcgttcggttctctctggtgtccggttggggccagctgctggaccggggcgccactgctcttgaactgatggtgctgaacgtgccacgcctgatgacgcaggattgcctccagcagagccgcaaagtcggagattccccaaatatcactgagtacatgttttgcgcaggctactccgatggatcgaaggattcgtgcaagggagactccgggggcccccacgccacgcattaccgcggaacctggtacctgaccggaattgtgagctggggacagggatgtgccactgtgggacacttcggcgtgtacactcgggtgagccaatacatcgaatggctgcagaagctgatgcggtcggaacctaggccgggagtgctgctgagggccccgttccca

SEQ ID NO: 9181 - DNA, 1398 bp, Artificial Sequence
  Description of Artificial Sequence: Synthetic coding sequence
atggtgagccaggcgctgcgcctgctgtgcctgctgttgggactgcagggctgcctggccgctgggggtgtggcgaaggcatctggtggtgaaacccgcgacatgccatggaagcctggtcctcacagagtctttgttactcaggaggaagcccacggtgtgctgcatcgacgacgcagggcgaacgccttcctggaagagctgcgcccggggtcactggagcgcgagtgcaaggaagagcagtgttccttcgaagaggcgcgcgaaatttttaaagacgcggagagaactaagttattctggatcagctattccgatggcgaccagtgcgcatcatctccgtgtcaaaacggtggtagctgcaaggaccagttgcagagctatatctgcttctgcctgcctgcgtttgaaggtcgcaactgcgagacgcataaagacgaccaacttatttgtgtcaacgagaatgggggctgcgagcagtattgcagcgatcatactggtaccaagcgaagctgtcgttgtcacgaaggctacagcctcctggcggacggcgtcagctgcactccaacagttgaatacccctgcggcaaaatcccgattctggaaaaacgcaacgcgtccaaaccgcaagggcgaattgtcggtggtaaggtatgccctaagggcgagtgcccttggcaggtcctgctgctggtgaatggtgcgcagctgtgtggcggaacgctaataaatactatctgggtagtcagtgcggcgcactgctttgataagatcaaaaactggagaaacttaattgcagtgctgggtgaacacgacctcagcgagcacgacggtgatgagcagtcccgcagggttgctcaggttattatcccaagcacctacgttcccggcacgaccaatcacgatatcgcactgctgcgcctgcatcagcccgttgttctgaccgaccacgtggtcccactgtgcctgccggagcgcacctttagcgaacgcaccctcgcgtttgtgcgcttttctcttgttagcggttggggtcaactactggacaggggcgccacggctctagaactgatggtgctgaacgtgccaagactgatgactcaagattgtttgcagcagtctcgcaaggtcggcgactccccaaatattaccgagtacatgttttgtgccggttacagcgacggctccaaagactcttgcaaaggtgatagcggcggcccgcacgcgacccactatcgtggtacttggtacctgactggtatcgtgagctggggccagggttgcgccaccgtgggccatttcggcgtttacacgcgagtgtcccagtacatagaatggttacaaaaactgatgcggtccgaacctcgtcctggtgtactacttcgcgctccattccca

SEQ ID NO: 9182 - DNA, 1398 bp, Artificial Sequence
  Description of Artificial Sequence: Synthetic coding sequence
atggtttcacaggcacttcgacttttgtgtctgctgttggggcttcagggctgccttgctgctgggggagtggcaaaggcatcgggaggagagactcgtgatatgccttggaagcccggacctcaccgcgtgttcgtcactcaagaagaagcacatggagtccttcaccgtagaaggcgcgcgaacgcatttctggaagagctgcgaccaggtagtctcgagagagaatgcaaagaggaacagtgctcgttcgaagaggcccgggagattttcaaagacgccgaaagaaccaagctgttttggataagctattcggacggggatcaatgtgcctcctcgccatgccagaacggtggatcgtgtaaagatcagcttcaaagctacatctgcttttgtttgcctgcatttgaaggaagaaactgtgaaactcataaagatgatcaactcatatgtgtgaatgaaaacggagggtgtgaacaatactgttcggaccacaccggtaccaagcgctcctgccgctgtcacgaaggttactccctgctcgcggatggcgtgtcttgcactcctactgtcgagtacccttgcggtaagattccaattctggagaaaaggaacgcatccaagcctcaaggtcgcattgtggggggtaaggtgtgtcctaagggagaatgtccgtggcaggtgcttctgcttgttaacggagcccagctctgtggtggaactcttatcaatactatctgggttgtgtctgcagcacattgctttgacaaaatcaagaattggagaaatcttatcgcagtgcttggtgagcatgatctttccgaacacgatggagatgagcaatcgaggcgcgtggctcaagtcataatcccatccacctacgtgcctggtaccactaaccacgacattgcccttctgagactgcatcagcctgtcgtgcttaccgatcatgtggttccactttgtctgcctgagcggaccttctcggagcgaactctcgcttttgtgcgattttcacttgtttctgggtggggtcaactgctggatcggggtgcaaccgcactcgagctgatggtccttaacgtcccccggcttatgacccaagattgtctccagcagagcagaaaggtcggtgactccccaaatatcacggaatacatgttttgtgcaggatactctgacggttcaaaggactcgtgcaagggagattcaggtgggccgcatgctacccattataggggcacctggtacttgactgggattgtgagctggggtcaaggttgtgcaactgtgggccacttcggagtctacacgagggtgtcccaatacattgagtggctgcaaaagttgatgcgttcagaaccacggcccggtgttctccttcgcgctccatttcca

SEQ ID NO: 9183 - DNA, 1398 bp, Artificial Sequence
  Description of Artificial Sequence: Synthetic coding sequence
atggtcagccaagctttacggctactttgtctgctccttggtcttcagggatgtctcgccgcaggtggagttgccaaggcaagcggcggtgagactcgagatatgccgtggaaacctggaccacatagagtctttgtgactcaagaagaggctcacggcgtgctacatagacggcgtcgagcaaatgccttccttgaggagctcagacctggttctcttgagagagagtgtaaggaagaacaatgttcgtttgaagaggccagagaaatcttcaaggatgcagaaagaactaagcttttctggattagttattctgatggtgatcaatgtgcgagctcaccttgccaaaatggtggaagctgtaaggatcagctgcaaagttacatttgtttttgtcttccagcgtttgagggaagaaattgcgaaactcataaggatgaccagttaatatgcgttaacgaaaacggaggttgcgagcagtactgctccgatcataccggtactaagcgttcttgcagatgccacgaagggtactctcttcttgctgatggtgtgtcatgtactcctacagtcgaatatccatgtggtaagattccgatcctcgagaagcgtaatgcatccaagccacaaggcaggattgttggaggaaaagtctgtccgaagggtgaatgtccttggcaggttcttctccttgttaatggagcacagctatgcggcgggacacttatcaatacaatctgggttgtgtcagcagcacattgtttcgataaaatcaagaattggcgtaaccttattgccgtgcttggcgaacacgatctcagtgaacatgatggtgatgaacagagccgccgggttgctcaggtcatcataccatcaacttatgttccaggcactaccaaccacgatatcgcacttcttagacttcatcagcccgtggtgctcaccgatcatgtggttccattgtgcttgcctgaacgcacgttttcagagcggaccttagccttcgtgaggttttctctcgtctcaggatggggccaactgttggaccgtggcgcaactgctctagagcttatggtgctcaacgtaccacgtcttatgacccaagattgtttgcaacagagcaggaaagttggagattcaccgaatataactgagtacatgttttgcgcaggctattccgatggttcaaaggactcatgtaagggcgactctggggggcctcatgctacacattatagaggaacatggtatcttacagggatcgtgtcttggggacaaggatgcgctactgttgggcatttcggagtttatacaagggtctcacaatacatagagtggttgcagaagctcatgcgtagcgaacccaggcctggtgttcttttgcgcgctccatttcca

SEQ ID NO: 9184 - DNA, 1398 bp, Artificial Sequence
  Description of Artificial Sequence: Synthetic coding sequence
atggtatcgcaagcgctgcggctcctgtgcctgctgcttggcctgcagggatgcctggccgccggaggagtcgccaaggcctccggaggagagactcgggatatgccgtggaaaccgggacctcaccgggtgtttgtgacccaggaggaggcacacggagtgctgcatcgccggagacgggccaacgcattcttggaggaactcaggccgggcagccttgagcgcgagtgtaaagaggagcaatgttcattcgaggaagcaagggaaatcttcaaggatgccgaaaggactaagctgttctggatctcctactccgatggagatcaatgtgcttcgtcgccctgccagaacggaggctcctgcaaagaccagctccaaagctacatctgcttctgtttgccggctttcgaagggagaaactgcgagactcacaaggacgaccaattgatttgcgtgaacgaaaacggaggttgcgagcagtactgtagcgatcacacgggaaccaagcggtcgtgcaggtgccacgaggggtattcgctgctggcggacggagtctcgtgtactccaactgttgagtacccatgtggaaagatacccatcctcgagaagcgcaatgcttccaaaccgcagggacggatcgtcggcggaaaggtgtgccccaaaggcgaatgcccgtggcaggtcctgctccttgtgaacggcgcccagttgtgtggcggaaccctgatcaatacgatctgggtcgtgtctgcggcccattgtttcgacaagatcaagaattggaggaatctgattgccgtcctgggcgaacacgacctgtcagagcacgacggagacgaacagtcacggagggtggcccaggtcatcatacctagcacctacgtgccgggaacgaccaaccacgacattgcacttcttagactgcatcagcctgtcgtgttgactgatcacgtggtgccgctgtgtctgcctgagcgtaccttctcggaacgcactctggctttcgtgaggttcagcttggtgtcgggttggggacagctcctggacagaggagcgaccgcgcttgaactcatggtgctcaatgtgccacgcctgatgacccaggactgcctccagcagtcacgtaaggtgggagactcgccgaacatcaccgagtacatgttctgcgccggctattccgacggatccaaggattcgtgtaagggagattccggcggaccgcacgccactcactaccgcggcacctggtatctgaccggaatcgtttcatgggggcaaggctgcgcgactgtgggccattttggcgtctacacccgcgtcagccagtacatcgaatggctccagaagctgatgcggtcagagcctcgcccaggggtcctgctgcgggcgccatttccg

SEQ ID NO: 9185 - DNA, 1398 bp, Artificial Sequence
  Description of Artificial Sequence: Synthetic coding sequence
atggtgagccaggcacttcgacttctgtgcctcttgttgggactgcaggggtgtctggctgctggaggagtcgctaaggcaagcgggggcgaaaccagagacatgccctggaagcctgggccccatcgggtgtttgtgacacaggaggaggcccacggagtgttgcatcggcgacgacgcgccaatgcgttccttgaggagctgcggcctgggtctcttgagagggagtgtaaagaggagcagtgttcattcgaggaagctcgcgaaattttcaaggacgcggagcggactaagttgttttggatctcttattcagatggagatcagtgcgccagctcaccctgtcaaaacggtggaagttgcaaagaccagcttcagagttacatctgtttttgtcttccagcctttgaaggtcggaactgtgagacccacaaggacgatcagttgatttgcgtgaacgagaacggcgggtgtgaacagtattgctcagaccacactgggactaagagatcttgccggtgtcacgaggggtattcactgcttgcagatggagtgagttgcactcccaccgtggaatatccttgtggcaagatacctattcttgagaagaggaacgcctccaagccacagggaaggatcgtgggggggaaagtctgccctaagggtgaatgtccgtggcaggtcctcctgctggtgaacggcgcgcagctttgcggcggaaccctcatcaataccatctgggtggtcagtgctgcacattgctttgataagatcaagaactggcggaacctgatcgctgtgctgggtgaacacgatctctctgaacatgacggggatgagcagtcacggagagtcgctcaagtgattataccgagtacctatgtacccggtaccacaaaccacgatattgccctgttgaggcttcaccagcccgtcgtcttgaccgaccatgttgtgccattgtgtctgcccgaacgaacctttagtgaaaggactctggcatttgtgaggtttagcctggtctcaggctggggacagctcctggaccgaggagccactgctctggagcttatggtgcttaatgtccctcggctgatgactcaggactgtctccagcagtcacgaaaggtgggggacagtccaaacattaccgaatacatgttctgtgccgggtactccgatggctccaaagattcatgtaagggagattccggcgggccacacgcgacccattacaggggcacctggtacctgactggaatcgtatcctggggccagggctgcgctacggtgggccactttggcgtgtacacccgagtgtctcagtacattgagtggctgcagaaactgatgcggtccgaacctcgccctggcgtcctgcttcgcgctcctttccca

SEQ ID NO: 9186 - DNA, 1398 bp, Artificial Sequence
  Description of Artificial Sequence: Synthetic coding sequence
atggtcagccaagcgcttagactcctttgtctgctgcttggactccagggatgccttgccgcaggaggcgtggccaaggcatccggcggtgagactcgcgatatgccttggaagcccggaccccatagggtattcgtcacccaagaggaagcccatggggtccttcataggcgtagacgggctaacgccttcctggaagaactgcgacctgggagccttgaacgcgaatgcaaagaagaacagtgctcctttgaagaggcacgtgagattttcaaggatgcggaaaggaccaagctgttctggatctcgtactccgatggagatcaatgtgcctcaagcccttgtcagaatggaggttcgtgtaaggatcaactgcagagctacatctgtttttgccttcccgcatttgagggacgcaattgtgaaacgcacaaagatgatcaactgatttgtgtgaatgaaaatggaggttgcgaacaatactgttcagatcatacgggaaccaagcggtcgtgtaggtgccacgagggttactcccttcttgcagatggcgtgtcatgcactcccaccgtggaatacccttgtggcaaaatacccattcttgaaaagcgaaacgcaagcaaacctcaaggacgcattgtgggaggaaaggtgtgtccgaaaggggaatgtccgtggcaggtgttgctcctggtgaacggggcacaactgtgtggtggaactctcatcaatactatctgggtggtgtctgccgcacactgctttgataagattaagaactggaggaatctgatcgccgtgctgggtgaacacgacctcagcgagcatgatggtgacgaacaaagccggcgggtcgcacaggtgattattccatcgacctacgtgcctggaaccacgaatcatgatatcgcactccttagactgcatcagcctgtggtgctgacggatcacgtggtgcctctttgcctgcctgaaagaaccttttccgaacggaccctggcgtttgtcagattttcccttgtgtcaggctggggacaacttctcgaccgaggcgcgaccgcactcgagctgatggttcttaacgtacctcgtctcatgacccaggattgtctgcagcagtcgcgcaaagtgggtgattcccctaacatcactgagtacatgttctgtgcaggatactcggacgggtcgaaagactcatgcaagggagatagcggaggaccacatgcaactcactatcggggaacttggtacctgactggaattgtgtcctggggtcagggatgtgcaaccgtgggacacttcggagtctacaccagagtgtcgcaatacattgaatggcttcaaaaactgatgcgatctgaacccagacccggggtgctcctgagggccccttttcct

SEQ ID NO: 9187 - DNA, 1398 bp, Artificial Sequence
  Description of Artificial Sequence: Synthetic coding sequence
atggtgtcgcaggcattgaggctgctctgcctgctgctgggacttcaaggatgtctggcagcaggaggtgtcgctaaggcttcagggggtgaaacgagagatatgccttggaagcctggaccacatagggtgttcgtgacccaggaggaagcacacggggtactgcatagacggcggagggccaacgcctttcttgaggaacttcggcctggctcactggagagggaatgcaaggaagaacaatgttcattcgaagaggcccgggaaatcttcaaagacgccgagcgaactaagctgttttggatctcgtactccgacggagatcagtgcgcatcctcaccatgtcagaatggaggatcgtgtaaggatcaacttcagtcctacatttgcttttgtttgcctgcgttcgaaggaaggaactgtgaaacgcacaaggacgatcaacttatttgtgtgaatgaaaacggtgggtgtgaacagtactgctcggatcataccggaaccaaacggtcgtgccgatgtcatgaggggtactccctcttggcagatggagtctcctgcacgcctactgtggagtacccatgtggaaagattcctattttggagaagagaaatgcaagtaaaccacaaggaagaattgtgggcggaaaggtctgcccgaagggagaatgtccttggcaagtgctgctgctggttaatggagcacaactctgcggtggtaccctgattaacaccatctgggtcgtgtctgcggcacattgttttgacaaaatcaaaaactggagaaaccttattgctgtgctcggagagcacgatctgtcggagcacgatggtgacgaacagagcagacgcgtcgcacaagttatcatccctagcacttacgtacccggaaccacgaaccatgatattgcacttctcagacttcatcaaccggtggtgttgactgatcacgtggttcccctttgtctcccagagagaaccttttcagaacggaccctggcatttgtgcgctttagtctggtgagcggctggggtcagcttctggatcgtggagcaactgccctggaacttatggttctgaatgtgcctcgactgatgactcaggattgcctccaacagagccgaaaggtcggcgatagcccgaatatcactgaatacatgttttgtgcagggtactctgatggaagcaaagacagctgcaaaggtgactcaggaggaccccacgcaacccattacagaggcacttggtatctgaccggcattgtctcctggggtcaaggctgtgcgactgtgggacatttcggggtatatactcgcgtgagccaatacattgaatggcttcagaagttgatgcggtccgaacctcgccctggcgtcctgcttcgcgccccttttcca

SEQ ID NO: 9188 - DNA, 1398 bp, Artificial Sequence
  Description of Artificial Sequence: Synthetic coding sequence
atggtgtcccaggcgctgaggctcctgtgtctccttttgggactgcaaggatgcctggcagcaggcggagtcgctaaggcctcgggaggtgaaactcgcgacatgccttggaaaccgggaccccacagagtgttcgttactcaagaggaagcgcatggagtcctccaccggcggcggcgcgctaacgcttttcttgaggaactgcgcccggggtcgctcgagagagaatgtaaagaagaacaatgcagcttcgaggaagctcgggaaatctttaaggatgctgaaaggaccaagctgttctggattagctacagcgatggggaccagtgcgcgtcatccccttgtcagaacgggggaagctgcaaagaccaactccaatcctacatctgcttttgcctgccggcctttgagggcagaaattgcgaaactcacaaagatgatcagcttatctgcgtcaacgaaaatggaggatgtgaacaatactgttccgaccatactggaactaagcgcagctgcagatgtcacgaaggatactcgctcctggccgacggggtgtcctgcactccaactgtcgagtatccgtgtggcaagatcccgatccttgagaagcgcaacgcctcaaagccgcaagggcggatagtcgggggaaaggtctgcccaaagggagagtgcccgtggcaggtgctcctgctggtgaacggcgcccaattgtgcggaggcacgctgatcaacactatctgggtggtgtcagcggcacactgcttcgacaagatcaaaaactggcggaatcttattgccgtgctcggtgagcatgacctgtccgaacacgatggggacgagcagtcgcggcgcgtggcccaagtcatcatcccttctacctacgtgcctggcaccacgaatcatgacatcgcactgttgcggctgcaccagccggtcgtgctgactgatcacgtggtgccgctttgcctcccagaacgcactttctcggagcgcaccctcgctttcgtgcgcttctccctggtttcaggatggggccagttgctcgatcggggtgccaccgccctggagctcatggtgctcaatgtgccgaggcttatgacccaggactgcctgcagcagtcacggaaagtgggcgattcgccaaacattaccgagtacatgttttgcgcaggatactcggatggatcgaaggacagctgcaagggggactctgggggacctcacgcgacccattatcggggaacgtggtacctgaccggtatagtctcttggggtcagggctgtgccaccgtggggcatttcggtgtgtatactcgcgtctcgcagtacatcgaatggctgcagaagctgatgcggtcagagccgcggccaggggtcctgttgagagcgcccttcccg

SEQ ID NO: 9189 - DNA, 1398 bp, Artificial Sequence
  Description of Artificial Sequence: Synthetic coding sequence
atggtctctcaggccttgcgccttctgtgtcttctgctgggtcttcaggggtgcttggccgcaggcggggtcgcaaaagcgtcgggtggtgaaaccagggacatgccttggaagcccggtcctcatcgcgtgttcgtcactcaggaggaggcgcacggcgtcctgcaccgtaggcggcgcgccaatgccttcttggaggagttacgcccgggctccttggagagagaatgtaaggaggaacagtgtagtttcgaagaggcccgtgagatctttaaggatgctgagcggactaagctgttctggatttcctacagcgatggggaccagtgcgcttcgagtccctgccagaacggtggtagctgcaaggaccagctccagagttacatctgcttctgcctcccagccttcgagggccgtaactgcgaaacacataaggacgaccagttaatctgcgtgaacgagaatggtggctgtgagcagtactgttccgatcacaccggcaccaagcggtcctgccgctgccacgagggatactcattgctggcagatggcgttagctgtactcctaccgtcgagtacccctgtggcaagatccctatacttgaaaagcgcaacgccagtaagccccagggacgcatcgtgggagggaaggtgtgtccgaagggggaatgtccctggcaggtgctgctgctcgtgaatggggcccaactgtgcggtggtacactgatcaacacgatctgggtcgtctctgcagcgcactgtttcgacaagatcaagaactggcggaacctgattgcggttctgggcgagcatgatctgtctgaacatgacggcgatgagcagtcgagaagggtcgcgcaagttatcatcccgtcaacgtacgtccccggcacgactaatcacgacattgcgttgttgcgccttcaccagccggtcgttcttacggatcacgttgtaccactctgtttgccggagcgaaccttctctgagcgcaccttggccttcgtgcgtttttctctggtctcgggttggggacagcttctggaccgtggcgctaccgccttagagctcatggtgctcaacgtcccaagactgatgacgcaggattgcctgcagcagagccggaaggtcggcgactcccccaacataaccgagtacatgttctgcgccggttactccgacggcagcaaggatagctgcaagggtgactctggcgggccacacgcaacccactaccgcgggacctggtatttgactggcatcgtgtcgtggggacaaggttgcgccaccgtgggtcactttggggtttacacccgtgtctcccagtacatcgagtggctacagaagctgatgaggagcgagccacgcccgggtgtgcttctgcgcgccccgttcccg

SEQ ID NO: 9190 - DNA, 1398 bp, Artificial Sequence
  Description of Artificial Sequence: Synthetic coding sequence
atggtgtcacaggcactgaggcttctttgtctgcttcttggtttgcaaggttgtctggcagcaggaggggtggctaaggcgtcgggcggtgaaactagagatatgccttggaagcccggaccccatagagtttttgtcacccaggaagaggcgcatggagtcctgcaccgccgtcgtagagctaatgcatttctcgaggaactcagacccgggagtcttgagagagagtgcaaggaagagcagtgttcctttgaggaagcaagagagatattcaaggatgctgaacgcaccaagctgttttggattagctatagcgacggagatcagtgcgcttcatcgccttgtcagaacggtggatcatgcaaggaccaacttcagagctacatctgtttctgtttgcctgcatttgagggacgtaattgtgaaacccataaggatgaccaacttatttgtgtcaacgaaaacggaggatgtgaacaatactgtagcgatcataccggcaccaaaaggagctgtaggtgccacgagggatacagcctgcttgcagatggcgtgtcctgtactcctacggtcgaatacccgtgcggtaagattccaattctggagaaacgcaacgcttcaaaacctcaaggacgcattgttggaggcaaggtttgcccgaagggcgagtgtccatggcaggtgctcctgttggtgaatggagcccaactgtgtggtggtaccctgattaacaccatttgggtcgtctccgctgcacactgctttgataagattaagaactggcgaaatcttatagcagtgcttggagaacacgacctttctgagcacgatggtgatgaacaatcgcgacgtgtcgcacaggtgatcattccgtcgacctacgtgcctgggactaccaaccatgacatagcgctgttgcgattgcatcaacccgtggtgctgaccgatcatgtcgtgccactgtgtctccccgaacgcactttttcagaaagaacgcttgcattcgtccgctttagcctggtgtcgggctgggggcaacttctggaccgcggagcgaccgctcttgaacttatggtgctcaacgtaccaagacttatgactcaggattgcctgcaacagtcacgcaaagtgggcgactcccccaatatcactgagtacatgttttgcgcgggatactcagacggatccaaggattcgtgcaaaggtgactcgggtggacctcatgcaacccactatcgtggcacgtggtaccttaccggcatcgtttcgtggggacaagggtgtgccactgtgggtcatttcggagtctacacccgcgtctcgcaatacatcgagtggcttcaaaaacttatgcgtagcgaaccacgcccaggagtgcttctccgggccccattccct

SEQ ID NO: 9191 - DNA, 1398 bp, Artificial Sequence
  Description of Artificial Sequence: Synthetic coding sequence
atggtgagccaggcactgcggcttctgtgcttgctgctcggactgcaggggtgtctcgctgcaggaggggtggcgaaggcatcaggaggagaaacccgcgatatgccttggaagccaggcccccacagagtgttcgtgacccaagaagaagcacacggggtgctgcatagacggcggcgcgccaacgccttcctggaagaactcagaccaggatcgctggagcgcgaatgtaaggaagagcagtgctcgttcgaagaagctagagagattttcaaggacgcggaacgcaccaaactgttctggatttcctactccgacggggaccaatgcgcctcctcaccttgtcaaaatggaggtagctgcaaggatcaactccaaagctacatctgcttctgtttgcctgcgttcgagggacggaactgcgagactcacaaggatgaccagctgatctgcgttaacgagaacggcggatgtgaacaatactgctccgatcatactggcactaagcgttcgtgcagatgtcacgaaggttactccttgctcgctgatggggtcagctgcaccccgaccgtggaatacccctgtgggaagatcccgatcctcgagaagcgcaacgcctccaagccgcagggccggatcgtcggcggtaaggtctgcccgaaaggagaatgtccatggcaggtgctcctgttggtcaatggagctcaactgtgtggaggtactcttatcaataccatctgggtggtgtccgctgcccactgcttcgataagatcaaaaactggcggaacctgatcgcagtgttgggagagcatgacctgtcggaacatgatggagacgaacagtcacggcgcgtggcgcaagtcatcatcccgtcaacgtacgtgcccggtaccactaaccacgatattgcgctgctgcggctgcatcaacccgtcgtgcttaccgaccacgtcgtgccgctgtgtctgccggagcggactttctcagaaagaactctggccttcgtgcgcttttcgctcgtgagcggatggggacagctgctggaccggggcgcgaccgccctggaactcatggtgctcaacgtccctcggctcatgactcaggattgcctgcaacaatcaaggaaggtgggagattcccctaacatcactgagtacatgttctgcgcgggatatagcgacgggtcaaaggacagctgcaagggagactccggaggaccgcatgctacgcactacagaggaacttggtacctgactggaatcgtgtcctggggacagggatgcgcgaccgtgggtcatttcggagtatatacgcgggtcagccaatacattgagtggctccagaagttgatgcggtcggagcctagaccgggggtgctgctgagagctccgttccca

SEQ ID NO: 9192 - DNA, 1398 bp, Artificial Sequence
  Description of Artificial Sequence: Synthetic coding sequence
atggtgagccaggcattgaggcttctctgtctgctgctgggtctgcaaggctgtcttgcagcaggaggagtggctaaggcctcaggcggtgaaacccgagacatgccttggaagcccggtccgcatagagtgtttgtcacgcaagaagaagcccacggagtgctccaccgtagacgacgagcaaacgccttcctggaagagctcaggcccggttcgctcgaacgcgagtgtaaggaagaacagtgtagctttgaagaagctcgagaaatctttaaggacgcggaaagaactaagctgttctggatttcctacagcgacggagatcagtgcgcatcatcaccctgccaaaatggtggatcatgcaaggatcagctccagtcgtacatatgtttttgtctgccagcattcgaaggtcgcaattgtgaaacccacaaggatgatcagcttatttgtgtcaacgagaatggaggttgtgagcagtattgtagcgatcatactggaacgaagcggagctgtcggtgtcacgaaggatactccctgcttgcagatggcgtgagctgcactccgaccgtggagtacccctgtgggaaaatccctatcctggaaaagcggaacgcctctaaaccgcagggtcgaatcgtcggcggaaaagtgtgccctaagggtgaatgcccttggcaagtgcttctgctggtgaatggtgctcaattgtgcggcggaactttgattaacactatatgggtggtgtcggcggcacattgctttgacaagatcaaaaactggaggaaccttatagcggtcctgggggagcacgatctttcagaacacgatggcgatgaacagagccgccgggtggcccaggtcataatcccatccacctacgtgccagggactactaaccacgatattgccctcctcagattgcatcaacctgttgtgctgaccgaccatgtcgtcccactctgcctgcccgagagaaccttttcggaacggacccttgcatttgtgaggtttagccttgtgtcaggctggggacaactgttggaccggggagcgactgccctggaacttatggtcctcaacgtgccacgactcatgactcaggattgccttcagcagagccgcaaggtcggtgattcgccaaatatcaccgaatacatgttttgcgcaggctactcggatggaagcaaggatagctgcaagggtgattccggaggacctcacgcaactcattacagaggcacttggtacctcaccggaattgtgtcgtggggtcagggctgtgcgaccgttggccattttggtgtgtacacccgcgtcagccagtacattgaatggcttcaaaaactcatgcgctcagagccacgccccggagtcctgcttcgggcaccttttccc

SEQ ID NO: 9193 - DNA, 1398 bp, Artificial Sequence
  Description of Artificial Sequence: Synthetic coding sequence
atggtgtcgcaggcgctgaggctcctctgcctgcttctgggactgcaagggtgtctggccgcaggaggcgtggcgaaggctagcggaggcgaaacgagagatatgccttggaagccaggtccgcaccgggtgttcgtgactcaggaggaagcccatggcgtgctgcaccggcgcagaagggccaatgcttttctggaagaactgaggccgggatccttggagcgcgagtgtaaagaggagcagtgttccttcgaagaagcccgcgagatctttaaggacgccgagcggactaagctcttctggatctcctactcggatggagatcaatgcgcttcgagcccctgccaaaatggagggtcctgcaaggatcagctgcagtcctacatttgcttctgcctgccggcatttgagggacgtaactgcgaaacgcacaaggacgaccaactcatctgcgtgaacgagaacggaggatgcgaacaatactgctcggatcataccggcactaagcggtcatgtcggtgccacgaaggatactcactgttggctgacggggtgtcgtgcactcccaccgttgaatatccgtgcggaaagattccaattctggagaagagaaacgcatctaagccgcagggacggatcgtcggaggaaaagtctgccctaagggagaatgtccatggcaagtgctcctgctcgttaacggagcccaactctgtggaggtaccttgatcaacaccatttgggtggtcagcgccgcgcactgcttcgataagattaagaattggagaaacttgattgccgtgctgggagagcatgacctgtcagagcatgacggagacgaacagtcccggcgcgtggctcaggtgatcatcccgagtacttacgtgccgggcaccaccaaccatgacattgcactgctgagattgcaccaacccgtcgtcctgactgaccacgtcgtgcctctctgtctcccggaacgcacctttagcgaacgcactttggcgttcgtcagattctccttggtgtcgggatggggccagcttctggacagaggcgcaaccgccctggagctgatggtgctcaacgtaccacggctgatgacccaggactgtctgcaacagagcaggaaagttggagattcaccgaacattacggaatacatgttctgtgcgggatattccgacggaagcaaagattcgtgcaaaggagactcaggcggacctcacgcaacgcactatcgggggacttggtaccttacggggatagtctcctggggccaggggtgcgccactgtggggcatttcggcgtctacaccagggtgtcacagtacattgagtggctccagaaattgatgcgctcagaacctagacctggggtcctcttgcgcgcaccattccct

SEQ ID NO: 9194 - DNA, 1398 bp, Artificial Sequence
  Description of Artificial Sequence: Synthetic coding sequence
atggtaagccaagcacttcgtttgctgtgcttgcttcttggcttgcaagggtgtctggccgcaggaggagtggctaaggcgagcggaggcgaaacccgggatatgccttggaagcctggaccccatagggtgtttgtcactcaggaagaggctcacggagtcctgcataggcggcgccgggcgaatgcatttctggaggagttgaggccaggttcactcgaacgcgaatgcaaggaagaacaatgctcatttgaagaagcacgagagatcttcaaggatgcagagagaaccaaactgttttggattagctactccgacggtgaccagtgcgcttcgtcaccttgtcagaacggtggctcttgtaaggatcagcttcagtcatacatatgcttctgccttcccgcatttgaagggcgaaactgcgagactcataaagacgaccagttgatttgtgtgaacgaaaacggtggttgcgaacaatactgtagcgaccatactgggacgaagaggagctgtcgctgccacgagggctactctctgctggcagatggtgtgtcctgtactcccaccgtcgaatacccgtgtggtaagattccaatactggagaaaagaaacgcgtcgaagccgcaaggcagaatcgtcggaggcaaggtgtgcccaaaaggagaatgtccttggcaagtgcttctgcttgtgaatggggcacaactttgtggcggcaccttgattaacactatctgggtagtttccgccgcacactgttttgacaagatcaaaaactggaggaacctcattgctgtgctgggagaacatgatctgagcgaacatgatggggatgagcaatcaaggcgtgtggcgcaggtgattatcccgagcacttacgtccctggcacgaccaatcacgatattgcacttcttcggctgcatcagcccgtggtgctgaccgatcacgtggtcccactgtgtctccccgagcggacgttctccgaaagaacgctggcatttgtgcggttttcccttgtgtcaggctgggggcaacttcttgatcgcggcgcaaccgccctcgaattgatggtgctcaatgtcccacgactgatgacccaggattgtctgcaacagtcccggaaagtgggcgactcgcctaatatcaccgagtatatgttttgtgcaggatactcagacggatccaaggattcctgtaaaggtgatagcgggggccctcatgcaactcattatagaggtacttggtacctgaccggtattgtgagttggggacaaggatgtgccaccgttggccacttcggggtctacaccagagtgtcgcagtacatagaatggctccaaaagctgatgagatccgagcctagacctggggtgctgcttcgcgcacccttcccc

SEQ ID NO: 9195 - DNA, 1398 bp, Artificial Sequence
  Description of Artificial Sequence: Synthetic coding sequence
atggtcagccaggccctgcggcttctttgtctccttctggggctccaggggtgcctcgcagcaggaggagtggcaaaggcttctggcggagaaacccgggatatgccatggaaaccaggtcctcacagggtctttgttacccaagaagaagcccacggggtgctgcatcgacggagacgggccaatgcctttctggaagagctcagaccagggtcactggagcgcgaatgtaaggaagaacagtgttccttcgaagaggcaagagaaatcttcaaggacgccgaaagaacgaagttgttttggatcagctactccgacggggaccaatgtgcaagctcgccatgccaaaacggcgggtcgtgtaaggatcagcttcaaagctacatctgcttttgtctgcccgcctttgaaggccgtaactgcgaaacccataaagatgaccagcttatttgcgtcaacgagaatggaggatgtgagcagtactgttctgatcatacgggtaccaagaggtcgtgccggtgtcatgaaggttactccctcctggcagatggggtgagctgtaccccaactgtggaatatccttgcggaaagattcccatccttgaaaagcgtaacgcaagcaagcctcaaggtcgcatcgtggggggaaaggtgtgtcctaagggagaatgtccatggcaggtgcttcttcttgtgaacggagcacaactgtgtggaggcaccctcatcaacactatctgggtggtgtccgcagcacattgcttcgacaaaatcaagaattggcgcaacctcatcgcagtgcttggagaacatgacctgtcggaacacgatggagacgagcagtcacgccgtgtggcccaggtcataattccctccacctacgtgcctggcactaccaaccatgatatcgcactgctccgcctccaccagcccgtggtgcttactgatcatgtagtgccactgtgtctccccgagaggacgtttagcgagaggacgcttgcgttcgttcggttctcacttgtgtcggggtggggtcagcttctggatcgaggagcaaccgcactcgagcttatggtgctcaatgtgcctagactgatgacccaggattgtctgcagcaatctaggaaggtgggtgattcgcctaacattactgaatacatgttttgtgccggctacagcgatgggtccaaagatagctgcaagggagattcgggaggaccacacgccacccattaccggggtacctggtacctgactggtattgtgtcctggggtcaaggctgtgcaaccgtcggacactttggggtgtatacccgggtcagccagtacattgagtggctccaaaagctcatgcgctccgagccccgcccgggcgtccttctccgggcgcctttccca

SEQ ID NO: 9196 - DNA, 1398 bp, Artificial Sequence
  Description of Artificial Sequence: Synthetic coding sequence
atggtaagccaggcccttagactgctgtgcctcctcttggggctccagggctgtttggccgccggaggcgttgcgaaggcgtctgggggcgagacaagggacatgccttggaaacccggtccccaccgcgtgtttgtgacgcaggaagaggcacacggtgttctgcaccggcgcaggcgagcaaatgcttttcttgaagaactcagaccagggtctcttgaacgggaatgtaaagaagaacagtgctctttcgaagaggctcgtgaaattttcaaggatgctgagagaaccaaactgttttggatttcctacagtgacggcgaccaatgcgcatcttctccatgccagaacgggggatcctgcaaagaccagctgcaatcttatatttgtttctgccttcccgcattcgagggccggaactgtgagacacacaaggacgaccagctgatctgcgtcaacgagaacggaggctgtgagcagtactgctccgaccacactggaacaaagcgcagttgcagatgtcacgaaggatactctttgctagcagatggagtgtcctgtacacccaccgtggagtacccatgcgggaagattcccatccttgagaagaggaacgcgtctaaaccacagggccggatagtgggagggaaggtttgccctaaaggagagtgtccctggcaggtcctgctgctggtcaacggcgcgcagctgtgcggtggaacgctgatcaatacaatttgggttgtgtcagcggctcattgcttcgacaaaataaagaattggagaaacttgatcgcagtcctcggggagcatgacttatcagaacatgacggcgatgaacaaagtaggcgtgtcgcccaggtcattatccctagcacatatgtgcctggtaccacaaaccacgatatcgcgctattgagactgcatcagccagtggttttaaccgaccacgtcgtccctttgtgtctgccggagaggaccttctcagagcgcaccctagcattcgttcggttcagcctggtttccggatggggacaattgttggacagaggcgcgaccgccctggaacttatggtgctaaacgtccccagattgatgactcaggactgtcttcagcagtccagaaaagttggggatagtcccaacattacagagtacatgttctgcgctggttacagcgatggctcaaaggatagctgcaaaggggacagtggcggcccacacgccacacattatagagggacttggtatctgacggggatcgtctcctggggacagggttgcgccaccgtgggccatttcggggtttacacacgggtgagtcagtacattgaatggctacagaagctgatgcggtcagagccgcgccctggcgtccttcttagagcgccgttccca

SEQ ID NO: 9197 - DNA, 1398 bp, Artificial Sequence
  Description of Artificial Sequence: Synthetic coding sequence
atggttagtcaagcattgcgtctgctttgtctcctgctaggccttcaggggtgtctcgcggccggaggcgtcgctaaggcatccggcggggaaactcgggatatgccgtggaaacccgggccccatagagtgtttgtcacccaagaggaagcccacggcgtgctgcaccgaaggcgaagggccaatgccttcctggaagaattacgccctggatctcttgaacgcgagtgtaaagaggaacagtgttccttcgaggaggccagagagatatttaaagacgccgagaggactaagctgttctggatcagctatagtgatggcgatcagtgtgcaagctcaccctgtcaaaatggaggctcatgcaaggaccagctgcagtcctacatttgcttctgtcttcctgcattcgagggccgtaattgtgagacccataaggacgaccagcttatatgcgtcaatgagaacgggggctgcgagcagtactgttcagatcacaccggcaccaagcgatcttgtcgctgccatgaagggtactctctgctggccgacggagtaagttgtacaccaactgtggagtacccatgtggcaaaatcccaattttagaaaagaggaacgcatcgaagcctcagggacgcattgtgggtgggaaggtttgtcctaagggcgagtgcccctggcaggtattattattagtgaacggggcccaactgtgtggggggacccttataaacacgatatgggttgtttcagctgcgcattgcttcgacaagataaaaaactggaggaatttgatcgcggtgcttggtgagcacgacctctcagaacacgatggggatgagcagagtcgccgggtagcgcaggttatcatcccttcaacctatgtgcccggaactaccaaccacgacatcgccttgctgaggcttcatcagccggtcgtgctgactgatcacgtggtccccttgtgtctgccagagaggacattctccgaacgcactctcgcgtttgtgagattcagcctcgtttctgggtgggggcagctgcttgaccggggcgccacagcattagaattaatggtgctgaatgtccctagactcatgactcaggactgcctacagcagtcccggaaagtgggcgactcaccaaacattaccgagtacatgttttgtgccggttatagcgatgggtctaaagattcatgcaagggggattccggggggcctcacgctactcattataggggcacatggtacttgaccgggatcgtatcttggggacaagggtgcgctacagtcggccacttcggcgtgtatacacgggttagccagtatattgagtggctccagaagctgatgagaagcgagccaaggcccggggtgctgctcagggccccatttcct

SEQ ID NO: 9198 - DNA, 1398 bp, Artificial Sequence
  Description of Artificial Sequence: Synthetic coding sequence
atggtgtcccaagccttgaggcttctgtgtctgctccttggactgcagggatgccttgcggccggaggagtggcgaaagccagcgggggagaaacccgagatatgccgtggaagccaggaccgcatagagtgttcgtgactcaagaagaggcccatggagtcctgcaccgacgtaggcgcgcaaacgctttcctcgaggagcttcgcccaggatcactggaacgggaatgtaaggaggagcagtgttcgtttgaagaggcccgggaaatctttaaggacgcagagcggactaagctgttctggatctcatactccgacggggaccaatgcgcgtcatccccatgccagaatggaggatcgtgcaaagaccagctccagtcgtacatctgtttctgcctgccggcttttgagggaagaaattgtgaaactcacaaggatgaccagctcatctgcgtgaatgagaacggaggctgcgagcaatactgctcggaccataccggaaccaagcggagctgcaggtgccatgaggggtacagcctgctggcagatggagtgtcatgcacccctacggtcgagtacccttgcggcaagatccccatcctggaaaagcgcaacgccagcaagcctcagggccgcatcgtcggcggcaaagtctgccctaaaggagagtgcccgtggcaagtgctccttcttgtgaatggggcccaactctgtggaggcactctgatcaatactatctgggtcgtgtcggccgcccactgcttcgataagataaagaattggaggaacctcatcgcagtgcttggggaacatgatctttcggagcacgatggagacgagcaatctcgccgggtggcccaggtcattatcccctccacttacgtcccgggaaccactaatcacgacatcgcattgctgcggctccatcagccagtggtgctgactgaccacgttgtgccgctgtgcctgccagagagaaccttttccgaacggaccctcgccttcgtgcggttcagcctcgtctcaggatggggacagctgctggaccgcggcgccaccgcgctcgaactgatggtgctgaacgtgccgagactcatgactcaagattgcctccagcaatcgagaaaggtgggagactccccgaacatcactgagtacatgttctgtgccggatactccgatggatccaaagacagctgcaagggagactccggaggcccgcacgccacccactacagagggacctggtacctgaccggaatcgtcagctggggacaaggatgtgcaaccgtcggccacttcggggtctacacgcgggtttcgcagtacattgaatggctccagaaactcatgcggagtgaaccaagacccggagtgttgctgcgggccccttttcca

SEQ ID NO: 9199 - DNA, 1398 bp, Artificial Sequence
  Description of Artificial Sequence: Synthetic coding sequence
atggtgtctcaagccctgcgccttctgtgtctgctcctcggtctgcagggctgcctggctgcagggggtgtcgccaaggcaagtgggggggagacacgggacatgccctggaaaccaggaccgcaccgagtgtttgtgacccaggaggaggcgcatggggtgctgcatcgaagacgacgggctaacgcgttcctcgaagagctgcggccaggtagtcttgagcgtgaatgcaaggaagaacagtgttcatttgaagaagcgcgggagatttttaaagatgccgagagaacaaaacttttttggatcagttattctgatggcgatcagtgcgcctcctcaccctgccagaacgggggctcttgcaaagatcagctacagagctatatatgtttctgtctcccggccttcgaagggagaaactgcgagacgcacaaagacgaccagctgatatgtgtcaacgagaatgggggctgtgagcagtactgttccgatcacaccggcaccaagcgctcctgccgctgccacgagggctattcgctgcttgcggacggtgtatcgtgcacgccgacagtggagtacccttgtggcaagattcctattttggaaaagcgcaatgcatccaagccccaaggacgcattgttgggggaaaagtttgccctaaaggagagtgcccatggcaagtgctcttgctcgtcaatggggcccagctctgcggaggaacgcttatcaatacaatctgggtagtttccgccgcacactgtttcgataaaattaagaattggagaaacctaatcgctgttttgggggaacacgacctgtcggaacacgatggggatgagcaaagtagaagagtggctcaagtgatcatcccttcgacatacgtcccaggtacaacgaatcacgatatcgctttgctgagactgcaccaaccagtggtgctcacagatcatgtcgttccgctttgcctcccagaaagaacatttagtgaaaggacactagcttttgtgcgcttcagcctcgtctctggctgggggcagttgctggaccgaggagcaactgcattggagctcatggttcttaacgtgcctcgtctaatgacacaggactgtctgcagcaatcccgaaaagtgggggacagtccgaatattaccgaatatatgttctgcgccggatatagcgatgggagcaaagactcgtgtaagggcgactccggcggaccccacgccacccattacaggggaacgtggtatctcaccgggattgtgagctggggccagggatgcgctaccgtaggtcactttggcgtctacacaagggtctcccagtacatcgaatggctccagaaactaatgagaagcgaacctagaccaggagtcttactccgggctccgttcccg

SEQ ID NO: 9200 - DNA, 1398 bp, Artificial Sequence
  Description of Artificial Sequence: Synthetic coding sequence
atggtgagtcaggctctgaggctcctgtgcttgctcctgggccttcagggttgtctcgcagcaggtggagttgccaaagcatcaggcggggagacacgggatatgccttggaaaccgggcccccacagggtattcgtcactcaggaagaggcccacggggtgctccatcgccgtcgtcgcgccaacgcttttctggaagagctgaggcctggctctcttgaaagagagtgtaaggaggagcagtgcagcttcgaggaggccagggaaatctttaaggacgccgagcgtaccaaattgttttggatttcctattcggacggcgatcagtgtgccagttctccatgtcaaaatggagggagttgcaaagatcaactccagtcctatatttgtttctgcctgccagcatttgaagggcgtaattgcgagacgcacaaggacgaccagctgatctgcgttaacgaaaatgggggctgtgagcagtactgttccgatcatacagggacgaagcgctcttgccggtgccacgaagggtacagtctcctggccgatggcgtgtcttgtacacctaccgttgaatacccttgtgggaagattccaatcctcgagaaaaggaacgcaagcaaaccacaaggacgaatcgttggtggaaaagtgtgtccaaaaggcgagtgcccttggcaggttttattgctggtcaatggtgcacaactgtgtggaggcactttgatcaacaccatttgggtggtgtcagcagcacattgtttcgataagattaagaactggagaaacctaatagctgttttgggggagcatgacctgagtgagcatgacggcgatgagcagagtcgtcgcgtggcccaggtgatcatcccctcgacctacgttcccggtaccacaaaccacgacattgccctgcttaggctccaccagcctgtggtgctgacagatcatgtagtgcctctttgcctccccgagcgcacattctcggaaagaaccctggcctttgtgagattctccttggtttcgggctgggggcagctactagatcgcggagcaacagcactggagctcatggtgctcaatgtacccaggctcatgactcaagactgcctccaacagtcccggaaggtgggagacagccccaatataacggagtacatgttttgtgccggttacagcgatggatctaaggattcttgtaaaggtgatagcggcgggcctcatgctactcactaccggggaacctggtaccttaccggcatcgtcagttggggacagggatgcgctacggtggggcacttcggagtttatacgagagtgtcacagtatatagaatggctccaaaagctcatgcggagtgaaccgcgaccaggtgtgctgttgagagccccctttcca

SEQ ID NO: 9201 - DNA, 1398 bp, Artificial Sequence
  Description of Artificial Sequence: Synthetic coding sequence
atggtgtctcaggccctcagattgttgtgtctcctactcggcctccaggggtgtctggcagccgggggggttgcaaaggcttctggtggagaaacaagggacatgccatggaagcctggcccgcatcgagtgttcgtcacgcaagaggaggctcacggggtgttacacagacggcgccgtgctaacgcctttctcgaagagcttaggcctggaagtctcgaacgggaatgcaaggaggaacaatgctcctttgaggaagctcgtgaaatcttcaaagacgctgagagaacaaagctgttctggatcagctacagcgacggcgaccagtgcgcgtcatctccatgccagaatggcggtagttgtaaagaccaactacagtcatacatctgtttctgcctgcccgccttcgaggggaggaactgcgagactcacaaagatgatcagctcatctgtgtcaacgagaatggagggtgcgaacaatactgttctgatcacacaggaaccaaacggagttgccgatgtcacgagggatactcacttttagctgatggagtttcctgcactcccacagtggagtacccctgtggcaagatccctatactggaaaagaggaatgcaagtaagcctcagggaagaattgtgggaggcaaagtgtgtcccaaaggcgagtgtccttggcaggtcctgctgctggtgaacggggcacagttatgtggaggcacactcattaacactatttgggtagtgagcgcagcacattgcttcgataagatcaagaattggcgcaacctaattgccgtactgggggaacacgatttgagcgaacacgacggtgacgagcagtctcgtcgcgtggctcaggttatcattccttccacgtatgtccccggaacaacgaatcacgacattgctctcctccgactgcatcagcccgtggtgctgacggaccacgtcgtccctctctgcctgcctgagcgaaccttttcagagcgcaccctcgcattcgtgagattttccctggtctctggctggggccagctcttggatcgaggggctacggcacttgaactaatggtgttgaacgtgcctagattaatgacccaggattgtctgcaacagtcacgtaaggttggcgattctcctaatatcactgagtatatgttctgtgctggatatagtgatgggtctaaagactcttgcaagggggattcaggcggtcctcacgccacccattaccggggcacttggtacctaacgggcattgtgagctggggccaagggtgcgccacggtgggacacttcggcgtgtacaccagagtgtctcagtatatcgagtggttgcagaagctgatgagatccgagccaagacctggcgtccttctgagggcacccttcccc

SEQ ID NO: 9202 - DNA, 1398 bp, Artificial Sequence
  Description of Artificial Sequence: Synthetic coding sequence
atggtctctcaggctcttcgcctgctgtgcctcctgctgggccttcagggatgtcttgcagccggcggagtggctaaagccagcggcggtgagactagagacatgccatggaaacccggcccccatcgcgtttttgttacacaggaagaagctcatggcgtccttcatcggcgcagaagggcaaacgcattcttggaggaactgcggcctggaagtttagaacgcgagtgtaaggaggaacagtgcagctttgaagaagctcgggaaatattcaaggatgctgaacgtaccaagctgttttggatttcctactcagacggtgaccaatgtgccagctccccatgtcagaacggtggcagttgcaaagaccagttgcaaagttacatctgcttctgtcttccagccttcgaggggaggaactgcgaaacgcacaaagacgatcagctgatctgcgtcaacgaaaatggagggtgcgagcagtattgtagcgatcacacaggcactaagcgatcatgcaggtgtcacgaaggttacagtcttcttgctgatggggtgtcctgtaccccaactgtggagtatccgtgcggaaaaataccaatattggagaaaagaaatgcttcgaagccacagggcaggatcgtaggcggcaaggtttgtccgaagggagaatgcccatggcaagtgctgttgttggtcaatggtgcccagctgtgcggaggaactctcatcaacaccatttgggtggtatccgcagcacactgctttgacaagattaagaattggcggaacttgatcgcggttctaggggagcacgacctatccgaacacgacggcgatgaacagtctagacgcgtcgctcaggtgattatcccctccacctacgtgccaggcaccaccaatcacgatattgccttgttacgcctacatcagcccgtagtgctgactgaccatgttgtgccgctttgcctgcccgaaagaacttttagcgagagaacgctggcgttcgtccggttttcactggtgagcggttggggccaactgctggatcgtggagctacagctctggagctcatggtgctgaacgtccccagactaatgactcaggactgcctacagcaatctcgaaaagtcggagattcgcccaacatcaccgaatacatgttctgtgccggatattcagacggtagcaaagatagctgcaagggggactccgggggaccacatgctacacattaccggggcacatggtacctgactggcatcgttagttggggccaagggtgcgccacagttggacactttggtgtatatacccgtgtttctcagtatattgagtggttgcagaagctgatgcgcagtgaacccaggcccggggtgctcctgcgggccccattccca

SEQ ID NO: 9203 - DNA, 1398 bp, Artificial Sequence
  Description of Artificial Sequence: Synthetic coding sequence
atggtttcacaggccctgagactgctctgtctgctgctgggcctgcagggctgtctggctgcgggcggagttgcgaaggcttctggcggtgagacccgcgatatgccttggaagcccggcccccaccgcgtttttgtgacacaggaagaagctcacggtgtccttcatcgcaggagaagagccaatgcttttctggaggagcttaggcctggaagtctggaacgcgaatgtaaggaagagcagtgttccttcgaggaggcaagagagatcttcaaagatgccgaaaggacaaaattgttctggatctcttacagtgacggcgatcagtgtgcaagcagtccgtgccagaatggaggcagctgcaaagatcagctgcagtcatacatctgcttctgcctgccagccttcgaaggcaggaattgcgaaacccataaagacgaccaattgatctgcgtcaatgagaatggtggctgtgagcagtattgctcagatcacaccggaactaaaagatcatgtcgctgtcatgagggctattccctgctcgctgatggcgtttcctgtaccccaaccgttgagtacccgtgcggtaaaataccaatcttggagaagagaaacgcctcaaagccacaaggcaggatcgtaggcggcaaagtttgtcccaaaggtgagtgcccctggcaagttctgctgctggtcaatggtgctcagttgtgtggcggcactctgattaacacaatttgggttgtaagtgccgcccactgctttgataaaatcaaaaattggaggaacttgatcgctgtgctgggcgagcacgacctgagcgagcacgacggtgatgaacaatccagaagggtcgcacaggtcattatcccttctacatatgtgccaggcacaacgaaccacgatatcgctcttctgagattgcaccagcctgtcgtccttaccgaccacgtcgtgccgctctgtttgcccgagcgcaccttttcagaaaggacactcgccttcgtgagattcagtttggtgtccggttggggtcagctgcttgatcgcggtgccacagccctggagctcatggtgctcaacgtccccaggttgatgactcaggactgcctgcagcaaagcaggaaggtgggcgacagccccaacatcacggagtatatgttctgtgcgggttacagcgacggttccaaggactcctgcaagggagatagtggtggtccccacgccacccattacagaggcacatggtacctgactggcatcgtctcctggggccagggctgcgccactgtgggtcattttggtgtatacactagggtgtcccaatacattgaatggctgcagaagttgatgaggagcgagcctagacctggagttttgctgcgcgctcctttccct

SEQ ID NO: 9204 - DNA, 1398 bp, Artificial Sequence
  Description of Artificial Sequence: Synthetic coding sequence
atggtgtcccaggccctgcgtcttctctgtctgttgttaggtttgcaaggctgtcttgctgcaggaggagtggctaaggctagtggaggcgagactagggacatgccatggaaaccgggaccacatagggtgtttgtgactcaggaagaggcacatggggtactgcatagacgccggcgggccaatgctttcctggaggaattgcgacctgggtctctagagagagagtgcaaagaggagcagtgcagttttgaagaagcacgcgagattttcaaggatgctgaacgcaccaaactgttctggatctcctacagtgatggtgatcaatgtgcatcctccccctgccagaatggcggctcgtgtaaggatcagttgcagagctacatttgtttctgtttgcccgccttcgaggggcggaattgcgaaacccataaggacgatcaattgatctgcgtcaacgaaaacggtggttgcgagcaatattgctccgaccacactgggaccaaacgttcttgccgctgccatgagggatattcgctgctggcagacggagtttcctgtactcctaccgtggaatacccttgcggaaaaattcccattctcgagaagcggaacgcctcaaaaccccagggtcgcattgtcgggggcaaagtgtgcccgaagggcgaatgcccatggcaggttctcctgttagtgaacggcgcacaactgtgcgggggtaccctcataaacactatctgggtggtttccgcagcccactgtttcgataaaatcaaaaactggcgcaatttgatcgctgtgcttggcgaacacgatctctccgaacacgacggcgatgagcaaagccgacgggtggcccaggtgattattccgagtacttacgtgccagggactactaatcatgatatcgccctactcagattgcaccagccagtggtcctcacagaccatgtcgtaccactgtgcctgccagaacgaaccttctccgagcggacactagccttcgtccgcttctctttggtatctggatggggtcagctgttggaccgcggagctacagccctagaactgatggtgctaaatgttccacgactcatgactcaggattgccttcaacagagcagaaaagtaggggattcaccaaacataacagagtacatgttttgcgccggttactccgacgggtcaaaggattcatgcaaaggagatagcggcggaccccacgcgacccattaccgaggtacatggtatctgacaggaatcgtgagctggggacagggttgcgctaccgttggacatttcggggtgtacactcgagtctcccagtatatcgaatggctgcaaaaattgatgaggagtgagccacgaccaggcgtgctgctcagagccccatttccg

SEQ ID NO: 9205 - DNA, 1398 bp, Artificial Sequence
  Description of Artificial Sequence: Synthetic coding sequence
atggtgtctcaagcactccgtctgctgtgcttgcttctggggttgcagggatgtctggcggctggaggagtagccaaagccagcgggggcgaaacacgagacatgccgtggaaaccgggtccgcatagagtgtttgtgactcaggaagaggcccacggggtgttgcatcgccgccgtcgcgccaatgctttcctcgaggagttaaggccagggagtctggagagggaatgcaaggaagagcagtgcagctttgaggaggcacgagaaatctttaaggatgccgagcgaacgaaactgttttggatctcgtacagtgacggtgatcagtgtgccagcagtccctgtcaaaacggaggatcttgtaaagatcagctccagtcatacatttgtttctgtctgcccgcttttgagggcagaaactgtgaaacccataaagacgatcagctgatttgcgtcaacgaaaatgggggctgtgagcagtactgttccgatcacactggaaccaagcggagctgtcggtgccacgagggatactctcttcttgccgatggtgtgtcttgcacccctactgtcgagtatccttgcggcaagatacccatcctggagaaacggaacgccagtaagccccaggggcgaatcgttggcgggaaagtatgcccaaaaggagaatgcccctggcaggtgctactactggtcaacggggcccaactgtgcggcggtaccctaattaataccatttgggtggtcagcgcagcccattgctttgataagatcaagaattggcgcaacctgatcgctgtgctaggcgaacacgatctgtcagaacacgacggagacgagcagtcacggagggttgcccaggtgattatcccttccacttacgtacctggtactaccaatcatgatattgcactgctgagacttcatcaacctgttgtgctgaccgatcacgttgtcccactctgtttacccgagcggacattcagtgaaagaacactcgcatttgtgcgatttagtctggtgtcagggtggggccagctgttggaccgcggagccaccgcccttgagttaatggtcctgaacgtgccccgactaatgactcaggactgtttacagcagtcccgcaaggtgggtgattccccaaacattactgaatatatgttctgcgctggatactctgacggctctaaggactcgtgcaagggcgattccggtgggccgcatgccacgcactatagggggacgtggtatctcacagggatagtgtcatgggggcagggctgcgcaactgtgggtcacttcggggtgtatacacgtgtctctcaatacattgagtggctccagaaactaatgcgctcagagccgcggccgggggtattgctgagggctccgttccca

SEQ ID NO: 9206 - DNA, 1398 bp, Artificial Sequence
  Description of Artificial Sequence: Synthetic coding sequence
atggtgtcacaggccttgcgcctcctctgtctgctcttgggcctgcaggggtgcctggcagccggaggtgtggcaaaggccagcggtggagaaacccgcgacatgccgtggaagccgggaccgcatcgtgtgttcgtgacccaggaggaagcacacggagtcctgcacagacggaggagagccaacgctttcctggaagagctgcgcccgggtagcttggaacgggagtgcaaagaagaacagtgttcatttgaggaggccagagagatcttcaaggatgcagagaggactaaactgttctggatctcctactccgacggtgatcaatgtgcgtcatccccatgtcagaatggaggatcctgcaaggaccagctccagtcgtacatctgcttctgcttgccggcgtttgaaggaagaaactgcgaaactcataaggatgaccagttgatctgtgtgaacgaaaatggaggctgcgagcaatactgctcagaccacactgggacgaaacggtcctgccgatgccacgagggctattccctccttgctgacggagtgtcatgtaccccaactgtggagtacccgtgcggtaagatcccgatccttgagaaaagaaatgcgtccaagccacagggacgcattgtgggcggaaaagtgtgcccaaagggggaatgtccgtggcaggtgctgctcttggtcaatggcgcgcagctctgtggaggaaccctgataaacaccatctgggtggtcagtgcagcgcattgtttcgataagatcaaaaactggcgcaacctgatcgcggtcctcggagaacatgacctgtcggagcacgacggtgatgaacagtcgcgccgggttgctcaagtgattatcccgtccacttacgtcccgggaactaccaatcacgatattgccctgttgcgcctgcaccaacccgtggtcctgaccgatcacgtggtgccgctctgccttccagaaaggactttctcggagcgcaccttggcctttgtccgcttctccctggtttcggggtggggacaactgttggacaggggggcgaccgcgcttgagctgatggtccttaacgtgcctcgcctcatgactcaggactgcctgcagcagagccggaaggtgggagattcgcctaatatcactgaatacatgttctgcgcaggatacagcgacggtagcaaggactcttgcaaaggtgactcgggagggccgcacgcgactcactaccgcggaacttggtaccttaccggcatcgttagctggggacaaggctgcgctaccgtcggccacttcggcgtttacacccgggtttcccagtacatcgaatggctccaaaagctgatgcgtagcgagccgcgcccgggtgtgctcctcagagcccctttcccc

SEQ ID NO: 9207 - DNA, 1398 bp, Artificial Sequence
  Description of Artificial Sequence: Synthetic coding sequence
atggtgtcgcaggccctgagactgttatgtctgctcttgggtctgcagggatgcttggccgctgggggcgtggccaaagcctccggcggcgagactagagatatgccctggaaacctggaccccatcgggtgttcgtcactcaagaagaggcccacggggtactgcaccggcgccgtcgggctaatgcttttctggaggagctacggccaggttcgttggagcgcgaatgtaaagaagaacagtgctccttcgaagaggcaagagaaattttcaaggacgccgaacgcacaaaattgttctggatatcatacagtgatggtgaccagtgtgcaagttccccttgtcaaaacggtggcagttgcaaagatcagctgcagtcctatatttgtttctgtctgccagcctttgagggcaggaattgcgagacccacaaagatgaccagcttatctgcgtgaatgaaaatggcggctgcgaacaatattgtagcgaccacaccggaaccaagcgcagttgtcgctgtcatgaaggatattcactcctggcagacggcgtgagctgcaccccaactgttgaatacccatgcgggaaaattcccattctggagaaacgaaatgctagcaagcctcaaggtaggatcgtcgggggcaaagtgtgccccaagggcgagtgcccgtggcaggtgcttctgcttgtcaatggagcccagttatgcggggggacattgataaatacaatctgggtcgtttcggcagcccactgttttgacaagatcaagaattggcgcaacttgatcgccgtactgggagagcatgatctaagcgagcatgatggagacgaacagagcaggcgtgtcgcccaggtaataatccctagtacatatgtgccaggcaccaccaaccatgatattgccctgttgcgtttgcatcagcctgttgttcttacggaccatgtggttccactgtgcctccccgaaagaaccttttctgaaagaaccctcgcattcgtgcggttctccctggtgtccggttggggtcagctgctagaccgtggagccacggctctggaattgatggtcctgaacgtgccacgcctcatgactcaggactgcctgcagcagagcaggaaagtgggcgacagccctaacatcaccgagtacatgttttgcgccgggtacagcgatggcagcaaggactcctgtaagggcgactccgggggacctcacgcaactcattacaggggtacatggtacctgactggtattgtctcgtggggacagggatgcgctaccgtcggacactttggtgtgtataccagagtctcacaatacattgaatggctacaaaaactaatgcgtagcgagccaagaccaggcgtgctgctcagagccccgtttccc

SEQ ID NO: 9208 - DNA, 1398 bp, Artificial Sequence
  Description of Artificial Sequence: Synthetic coding sequence
atggtgagccaggcactgcgcctactgtgtctcctgctgggattgcaggggtgcctggcagctggtggcgtggccaaggcaagcggaggcgagacacgagatatgccttggaagcccgggccacatcgggtgttcgtcacccaggaggaagcacacggtgtgcttcaccggcgaagaagagccaatgcatttctggaggagctccgccccggatccctggaacgggagtgcaaagaagaacagtgtagctttgaggaggcccgcgagatctttaaagacgctgaaagaaccaaactgttctggatttcatattcagatggggaccagtgcgcctcatccccatgccagaacggagggtcctgcaaggatcagctgcagagttacatttgtttctgcctgccagcattcgagggcagaaactgcgagacccacaaagacgaccaactcatttgcgtgaatgaaaatggtggttgtgaacagtactgctctgaccacaccggtacaaaacgaagctgcaggtgtcacgaaggttatagtctgctggccgatggcgtgtcttgtactccaactgtggaatacccttgtgggaagatcccaatactggaaaaacggaatgcctccaagccacagggccgaatagtgggaggaaaggtttgtcctaagggcgagtgcccttggcaagtgctgctgctcgtgaacggagctcagttgtgcggcgggaccttaataaataccatatgggtggtaagcgcagcccactgcttcgacaaaatcaaaaattggagaaatttaatcgccgtgctaggagagcacgatctatctgagcacgacggtgatgagcagtcccggcgcgtggctcaagttatcattccaagtacatacgtgcccggaacaaccaaccacgatatagccctgcttcgattacaccagccagtggtactaactgatcatgtggtacctttatgcctgcccgaacggactttttctgagcgaacattggcattcgtgcggtttagcctcgtgagcggatgggggcagctgctggacagaggtgctactgccctggagctgatggtcctcaatgtgcctcgtctcatgacacaggactgcctgcaacagagccggaaagtgggcgattcaccaaatataactgagtacatgttttgcgccggatatagcgatggttccaaggatagttgtaagggagattccggaggacctcacgctacacattatcgcggcacttggtacttaacaggcattgtcagttggggccaggggtgcgccaccgtgggacatttcggcgtgtatactagggtaagtcagtatatagagtggttgcagaagctgatgcggagtgagcctagaccgggcgttttgctgcgagctcccttcccc

SEQ ID NO: 9209 - DNA, 1398 bp, Artificial Sequence
  Description of Artificial Sequence: Synthetic coding sequence
atggtgtcacaagccctgagactcttgtgcctgctgctgggactccaaggatgcctcgcagcaggaggcgtggccaaggctagcggcggagaaacccgggacatgccatggaaacctggcccgcaccgggttttcgtgacccaggaagaggcccatggagtgctgcaccggcgcaggagagccaacgcattcctggaagaactccggccaggctcattggaaagagagtgcaaggaggaacagtgttcatttgaggaagcccgggaaatctttaaagacgcagaacgcaccaagctgttctggatttcatattccgatggtgaccagtgcgcctcgtccccgtgccagaacggaggatcgtgcaaagatcagctgcaatcgtacatctgtttctgcctgccggcgtttgaaggacggaactgtgagactcacaaagacgatcaactgatctgcgtgaacgagaacggagggtgcgagcagtactgttcggatcacaccggcaccaagcgcagctgtaggtgtcacgagggttactcccttttggccgacggagtctcatgtacgccgactgtcgagtacccgtgtggaaagatcccgatcttggaaaagcggaatgcttccaaaccgcagggtcgcatcgtcggcggaaaggtgtgcccgaagggcgaatgcccatggcaagttcttctcttggtgaacggcgcccagctctgcggcggtacgctgataaacaccatttgggtggtatcggccgctcactgtttcgataagattaagaactggagaaacctgatcgccgtgctgggagagcatgatctgtccgaacacgatggagatgaacagagcaggcgcgtggcacaggtcatcatcccttccacctacgtccccggaaccaccaatcacgatattgcactgctcagactccatcagccagtggtgctgaccgatcatgttgtgccgctctgcttgcctgaacggacgttctctgaaagaaccctggccttcgtgcgattctcgctggtgtcgggctggggacagctccttgaccgtggagcgacggcactcgaactgatggtcctcaacgtgccacggctcatgactcaggactgcctccaacagtcgcggaaggtgggagactcgccgaacattactgaatacatgttctgcgccggatactccgatggatcgaaggactcatgcaagggagactccggtggcccccatgcgacccactatcgtgggacctggtaccttacgggaatcgtctcgtggggccagggttgcgccacggtcggacatttcggagtgtacactagagtgagccaatacattgagtggctgcaaaagctgatgagatcggaaccgcggccaggagtcctgctgagagctccgtttccc

SEQ ID NO: 9210 - DNA, 1398 bp, Artificial Sequence
  Description of Artificial Sequence: Synthetic coding sequence
atggtcagccaagcgctgcggcttctctgccttctgcttggactgcaaggttgtctggctgccggaggagtcgcaaaggcatcagggggcgagactcgagacatgccttggaagcctggaccacacagagtctttgtcacccaagaagaagcacacggggtcctgcatcgcaggagacgggcgaacgcctttctcgaggagctgaggcccggcagcctggaacgtgaatgtaaagaagaacaatgttccttcgaagaagcacgcgagatctttaaggatgcggagagaacgaaattgttctggataagctattccgacggtgatcaatgtgcaagctcgccgtgccaaaacgggggatcgtgcaaagatcaactgcagagctacatttgcttttgcctgccagcctttgaaggccgaaactgcgagactcacaaagacgaccagcttatttgtgtgaatgagaatggtggctgtgaacaatactgttcggaccatactgggaccaagcggtcgtgcaggtgtcatgagggatactccttgctcgccgatggtgtgtcctgtactcctaccgtggagtacccttgcgggaagatcccaattctcgaaaagagaaacgcatcaaagccgcaaggcagaattgtgggcggaaaggtgtgtcctaaaggagaatgtccctggcaggtgctgcttctggtgaatggtgctcagctgtgtggtggtaccctgattaacactatttgggtcgtttcggcagcgcattgcttcgacaaaatcaagaattggcgtaaccttatagcagtgctgggagagcatgatctttcggagcacgatggcgatgagcagagcaggagagtggcacaggtcattatccctagcacctatgttcctgggaccacgaaccatgacatcgcgcttctgaggctgcatcaaccagtcgtccttactgaccatgtggtgccactttgtctcccggaaagaactttttccgaaagaacccttgcattcgttcgcttttcccttgtgtcaggttgggggcagctcctggacaggggcgccaccgcacttgagctcatggttctgaacgtgccccggcttatgacgcaagactgcttgcagcaatcgagaaaagtgggtgactcgccaaacatcactgaatacatgttctgtgcaggatactcagatggatcaaaggattcatgcaagggtgatagcggggggcctcacgcaacgcattacaggggaacgtggtacctcacgggcatcgtctcgtggggacagggatgtgcgaccgtgggtcactttggagtttacaccagagtgagccagtacatcgaatggctccaaaagctgatgcgttccgaaccccgtccaggtgtgctgctgagagcaccgtttcca

SEQ ID NO: 9211 - DNA, 1398 bp, Artificial Sequence
  Description of Artificial Sequence: Synthetic coding sequence
atggtcagccaggctctccgcttactctgcctgctcctgggactgcaaggatgtctggcggcgggcggtgtggccaaggcctctgggggcgaaacacgagacatgccttggaagccaggtccccacagggttttcgttacccaggaagaggcacatggtgtcctccatagacgccggcgcgcgaacgcgttcctggaggagctgagacctggatcgctagagcgtgagtgcaaagaggagcagtgctccttcgaggaagcgcgtgaaatcttcaaggacgccgaacgaacgaaacttttctggattagctattcggatggagaccagtgtgcttcttccccgtgccagaatggcggttcctgtaaggaccaactgcagtcgtacatctgcttctgcctcccggcctttgagggcaggaactgcgagactcacaaggacgaccagttgatctgtgtgaacgagaacggcggctgcgagcagtattgttccgaccatacgggcactaagcggtcttgccgctgtcatgagggatattccctcctggccgacggtgtgtcatgcactcccacggttgagtacccctgtggtaagattcccatattggagaagcgaaatgcttccaagccacagggccggatcgtgggtggcaaggtgtgtccaaagggtgaatgcccatggcaagtcctgttactggtcaacggcgcgcagctgtgcggtggaaccctgattaataccatctgggttgtttccgccgctcactgctttgataaaattaaaaattggcgtaatttgatcgctgtacttggcgaacacgacttgagcgaacacgatggagatgaacagtctcgcagggtggcgcaggtgatcatcccatctacttacgtgcccggaaccaccaaccatgatatagctttgttgcggttacaccagccagtcgttctcaccgatcacgtggtgccgctgtgccttccggaacgaacgttttccgaacgtacgctcgctttcgtgcgcttctcgttggtgagcgggtggggccagctgttagaccgcggtgccacggctcttgagctaatggtcctgaacgtgccaaggttgatgacccaagactgtctgcagcaaagtcggaaggtcggcgactccccgaacattaccgagtatatgttctgcgccggctactctgatggctccaaggattcctgcaagggagattccggaggaccacacgcaacacattacaggggtacctggtacctaacgggcatcgtatcgtggggccagggctgcgccaccgtcggtcacttcggagtttacactcgggtgagccagtacatagagtggctgcagaagctaatgaggtctgaaccgcgcccgggtgtcttgttgcgtgctccatttccc

SEQ ID NO: 9212 - DNA, 1398 bp, Artificial Sequence
  Description of Artificial Sequence: Synthetic coding sequence
atggtcagtcaagcacttaggctgctctgtcttctgcttggtttgcagggatgccttgctgcaggtggtgttgctaaagcttctggcggagagactcgtgacatgccctggaaaccaggtccccatcgcgtgttcgtcacacaggaagaagcccatggtgttctgcatcgcagacgccgtgctaacgcctttttggaagagctgagacccggttcactggaaagagaatgcaaagaggaacagtgctccttcgaagaggcaagagaaattttcaaagatgctgagagaacaaagttgttttggatcagttactctgacggcgatcaatgcgccagctctccttgccaaaatggaggttcttgtaaggatcagctccaatcttatatctgcttctgcctcccagcctttgagggcaggaactgtgagacacacaaggacgatcaactcatctgtgttaacgagaacggcggctgcgagcagtactgtagcgatcatactggcaccaagaggagttgccgctgtcacgagggttattcacttctggccgatggtgtctcctgtacccctactgtggagtatccttgcggtaagatccccattctggagaagcgcaatgccagtaagccccagggtagaatcgtcggcggcaaagtctgtccaaagggagagtgcccctggcaggtactcttgctggtgaacggtgcccagttgtgcggcggcactctgattaacaccatctgggtggtaagtgcagctcactgctttgacaaaatcaaaaactggcgcaatctgattgctgtcctgggagagcacgacctgtctgaacatgacggcgacgaacagtcacgccgtgtcgctcaagtgattattccttccacctacgtgccaggaacaactaaccatgacatagccctgctgcgcttgcatcagcccgtggtcctcactgatcacgtcgtcccactgtgtcttcctgagaggactttctcagagaggacactggcttttgtcagatttagcttggtctccggctggggccaattgctggacaggggagctaccgcccttgaacttatggtgttgaatgtaccacgtttgatgactcaggattgtctgcaacagtcccgcaaggttggagattcccctaatatcaccgaatacatgttctgtgccggctacagtgatggttctaaggactcttgcaagggcgactcaggaggccctcacgcaactcattacaggggcacatggtaccttaccggaattgtgtcttggggtcagggctgcgccactgtgggtcacttcggcgtttacaccagggttagtcagtacatcgagtggctgcagaaactgatgaggtctgaacctaggcctggtgtgctgctcagagcaccattccca

SEQ ID NO: 9213 - DNA, 1398 bp, Artificial Sequence
  Description of Artificial Sequence: Synthetic coding sequence
atggtgtcacaagcgctgcggctgctgtgtttgcttctcgggttgcaggggtgtctcgcagcaggtggagtcgcgaaagccagcggcggagaaactcgggatatgccttggaagccaggtcctcacagagtgtttgttactcaggaagaagcgcacggagtgcttcataggaggcgtcgcgcaaacgcgtttcttgaagaacttagacctggatcgctggaaagagagtgcaaggaggaacaatgttcttttgaggaagcgcgtgagatcttcaaggatgcagaaagaaccaagctcttctggatttcgtactcagatggagatcaatgcgcatccagcccatgtcaaaatggaggatcgtgtaaagaccaacttcaatcgtacatatgcttttgccttcccgcatttgaaggtcggaattgtgaaactcataaggatgaccaacttatttgcgtcaacgaaaacggtggttgtgagcaatactgtagcgatcacaccggtaccaagcgctcctgtaggtgtcatgagggttactcactgctggccgatggggtgtcatgcacccctacggtggagtacccttgcgggaaaatccctatcctcgagaagagaaacgcatccaagccccaaggacgcatagtggggggaaaggtctgtccaaagggagaatgtccctggcaagtccttctgttggtcaatggggcacagttgtgcgggggcactctgataaacaccatctgggttgtctcggcagcacattgctttgacaaaatcaaaaactggcggaatctgattgcagttcttggagaacacgatctgtctgagcatgacggggatgagcagtcgcgacgggtggcccaggtcattattccttctacttacgtgcctggaactactaaccatgatattgcccttttgcgcttgcaccagcccgtggtgcttaccgaccatgttgtgccgctttgtctgccagaacgcaccttctcggaaagaacgctggcatttgtaagattctcgcttgtatcgggatggggccaacttcttgaccgcggtgcaactgcgctggaactgatggtgctcaacgtgccccgtctgatgactcaggattgtctgcaacagtcccgaaaggtcggtgattcgcctaacattaccgagtacatgttctgtgccggttattccgacgggagtaaggacagctgtaagggcgattcgggcgggccacacgctacgcattacagggggacctggtaccttacgggaatcgtgtcctgggggcaaggatgcgccaccgtgggacattttggagtgtacaccagagtctcccagtacattgagtggcttcagaaattgatgcgatccgaaccgcgccccggggtgctgttgcgggcaccttttcca

SEQ ID NO: 9214 - DNA, 1398 bp, Artificial Sequence
  Description of Artificial Sequence: Synthetic coding sequence
atggtctcacaagctcttaggttactctgccttttgctgggacttcaaggctgcctcgcggcagggggtgtcgctaaagcttcgggtggcgagaccagagatatgccttggaaaccaggaccgcatagagtattcgtcacacaggaagaagcccatggcgttctgcatcggcggcgccgagcgaacgcatttctggaagaactgagaccggggtcattggaacgcgagtgcaaagaagaacaatgctcttttgaggaagcgagggaaattttcaaagatgctgaacgtactaaactcttctggataagttactcagacggcgatcaatgcgcatcatctccttgtcaaaatggcgggagctgcaaagaccaattacagagttatatctgcttttgcctaccggcgttcgagggaagaaattgcgagactcataaagatgaccagctgatttgtgttaatgaaaacggtgggtgcgagcaatattgttctgatcacacgggtacgaaacggtcttgccgctgtcatgaaggctactctttactggctgacggcgtaagctgtacgccaacagttgagtatccgtgtgggaagatcccaattttggaaaaacgcaacgcttcgaaaccccaggggagaatcgtcggcggaaaagtgtgccctaaaggcgaatgcccgtggcaagtcttgcttctggtcaatggggctcagctgtgcggtgggaccctaattaatacaatatgggtcgtttccgcggcgcattgttttgataaaatcaaaaattggagaaatctgattgctgtactgggagaacatgacttatcagaacatgacggcgatgagcagtcgagacgagttgctcaggtgatcatcccgtctacgtatgtaccgggtacgactaatcatgatattgctctcctgcgcctccatcaaccggtagtgctcacggaccacgtagtaccgttgtgtcttcccgaacgcacgttttcagaacgtacccttgccttcgttagattttctcttgtgtcaggttggggacagctgctggatcgaggggccacagcccttgagcttatggtccttaatgtcccgcgtttgatgacacaagactgcctgcaacagtctaggaaagttggggactcgcctaacattacggagtatatgttttgtgcgggctattcagatgggtccaaagattcatgcaaaggcgacagcggcggaccgcacgccactcattaccgcggtacgtggtacctgacaggaatcgtttcttggggccaagggtgtgccactgttggacattttggtgtttatacaagagtctcacagtacatcgagtggctccagaagcttatgcgttctgagccacgcccaggcgtgcttttgcgcgcgccttttcca

SEQ ID NO: 9215 - DNA, 1398 bp, Artificial Sequence
  Description of Artificial Sequence: Synthetic coding sequence
atggtgtctcaagcgctccggctgctatgcttgctgttgggattgcaaggatgtttggcagcgggcggagtggctaaggcatctggaggagaaacacgcgacatgccctggaaacccggtccacaccgcgtgttcgttacccaggaggaagcacacggcgttctgcacagacgaaggcgtgcaaatgcttttttagaggagctgcggcctgggagtctggaacgggaatgcaaagaagaacagtgtagcttcgaagaggcacgcgagatctttaaggacgctgaacgtactaaactgttttggatctcatacagcgacggggatcagtgtgccagctcaccatgccagaacggaggatcatgtaaagatcagctgcagtcctacatttgcttctgtctcccagcgttcgaagggcgaaactgcgagacacacaaagatgaccagttgatttgtgttaacgaaaacgggggctgcgaacagtactgttccgaccacacaggcacaaaaaggtcttgccgatgccacgaagggtactccctcctcgccgacggtgtcagttgcacgccaactgtagaatacccctgtggtaaaatcccaatcctggagaagcggaatgctagcaagcctcagggacgtatcgtggggggaaaggtgtgtccgaaaggtgaatgtccatggcaggtcctcttattagtgaacggagcgcagctgtgcgggggcaccctcatcaacacaatttgggtcgtttctgctgcacactgctttgacaaaatcaagaattggagaaaccttattgccgtgctgggcgaacacgatctctctgagcacgatggtgatgagcaatcacgccgcgtagctcaggtgatcatcccctctacctacgttcccggcaccaccaatcacgatattgccttgttgcgtttgcaccagcctgtagtgctgacagatcacgtggtgcccctgtgcctgccagagaggacgttctcagaacgaaccttggccttcgtgcgcttctctctcgtatcagggtgggggcagctgctcgatagaggagctacagcactggagctgatggtcttaaacgtgccaagattgatgacacaagattgcctccagcagtcacggaaggttggtgattctcccaatataactgaatatatgttttgtgctggatacagcgatgggagtaaggactcctgcaagggggattccggcggaccccacgctacacattacagggggacgtggtatctgacaggaatagtgtcctggggccagggctgcgccaccgtcggccattttggcgtgtacacacgagtttcacagtatattgagtggctccaaaagctcatgaggtccgagccgcggccaggggtcttgttgagagcaccgtttcct

SEQ ID NO: 9216 - DNA, 1398 bp, Artificial Sequence
  Description of Artificial Sequence: Synthetic coding sequence
atggtgtcccaggccctccgattactgtgccttttgctcggactgcaggggtgtttggccgcgggaggcgttgccaaggcatctggaggggagacaagagacatgccatggaagccgggaccgcatcgcgtattcgtgacacaggaggaggcccacggtgtcctgcatcgccggcgccgggcgaatgctttccttgaagaattgcgcccagggtcactggaacgagaatgcaaagaagagcagtgttctttcgaagaagctagagagatctttaaggacgctgagcgtacaaagctcttctggatctcttactctgacggggaccagtgtgcaagttctccttgccagaatgggggcagctgcaaggatcagctgcaatcttatatatgtttctgcttgccagccttcgagggcagaaattgtgaaacccataaagacgaccagctgatttgtgtgaatgaaaacggcggatgcgagcaatactgtagcgatcatacaggtactaagaggagctgtcgttgccacgaaggctattcccttctggccgacggcgtcagttgtacccccacggtcgaatacccctgtggaaaaatacccattttagaaaagaggaatgcgtccaagccccaaggccgcattgtcggagggaaggtatgtcctaaaggtgagtgcccatggcaggtgttgctgctagtcaatggtgcacagttgtgtggtggcaccctaattaataccatttgggtcgtatccgcagcccactgtttcgataaaattaaaaactggagaaacttgatcgctgtgctgggcgaacacgacttgtcagagcatgacggagacgagcagagtcggcgcgtggcgcaggtgattataccttccacatatgtgcccggcaccaccaaccatgacatcgctctgctgcgcctgcatcaaccggtggtgctgaccgaccacgttgttccactgtgcctaccggagaggaccttttccgaacggacgttggcttttgtgagattctccctggtcagtggctggggccagctgttagaccgtggggccaccgcccttgaactgatggttctaaacgtgcctaggcttatgactcaggattgtctgcagcagagcaggaaggtgggcgacagtccaaacatcactgagtatatgttctgcgcaggatattccgacgggtcaaaggactcctgtaaaggcgatagcggtgggccccacgcaactcactacaggggaacctggtatctgacaggaattgtgtcatggggccagggatgtgcaaccgttgggcatttcggagtttacaccagggtctcccagtatatagagtggctgcagaagctgatgcgctcggagcctaggccaggcgtgttactgcgtgcccctttcccg

SEQ ID NO: 9217 - DNA, 1398 bp, Artificial Sequence
  Description of Artificial Sequence: Synthetic coding sequence
atggtgtctcaggccctgagattgctgtgtctgctcctggggctgcagggatgtctggcagccggcggagtggccaaggctagtggcggcgaaacacgcgatatgccttggaagccagggccccaccgtgtctttgtcacacaagaagaggcccacggggtgctgcacaggaggcgccgagcaaacgcattccttgaggagctcagaccgggtagcctggagcgagagtgcaaggaagaacagtgtagcttcgaagaggcccgtgaaatttttaaagatgccgaaaggaccaagctattttggatttcttattccgatggagaccagtgtgcctcttcgccctgtcagaacgggggcagctgcaaggatcagctgcagagctatatctgcttttgtctgcctgccttcgaagggcgtaactgtgagacacacaaggatgatcagttgatctgcgtgaatgagaatggcggctgcgaacagtactgctccgaccatacagggacaaagcgctcctgccgctgtcacgaggggtactcactgctggcggatggagtctcctgtacgcccacggtcgaatatccatgtggcaagataccaattctagaaaagcgaaacgcctccaaaccccagggacgcattgtgggcggcaaggtttgccccaaaggggaatgtccctggcaggtactcttgctggtgaacggtgctcagctgtgtggcggcacccttataaatacaatttgggtggtctctgctgcgcactgctttgacaaaatcaagaactggcggaaccttatcgcagtgttgggcgagcacgacctctccgaacatgacggggacgagcaaagcagacgcgtggcccaggtgattatccccagtacctatgtgcccggtactacaaaccacgacatcgcactcctgagactgcatcagcccgtggtactgacagatcatgtagtgcccctgtgcttacctgagaggacattcagtgagcggaccctggcgttcgtgcgcttttccctggtctcgggatggggccagctcctcgaccgaggcgccacagctctggaacttatggtgctcaacgtcccgagattaatgactcaggactgtctgcagcagtcccgcaaagtcggagatagtccaaatatcaccgaatatatgttctgtgccgggtacagtgatggatctaaagactcttgcaagggcgactctggcgggccgcatgctacacactatcgagggacttggtatctgaccggaatcgttagctggggacagggatgtgcaacagtggggcactttggggtctatacccgcgtgtcgcaatacattgaatggctgcagaagctcatgagaagcgagccacggccaggtgtactacttagagccccatttccc

SEQ ID NO: 9218 - DNA, 1398 bp, Artificial Sequence
  Description of Artificial Sequence: Synthetic coding sequence
atggtaagccaggcgctccggctgctgtgtctgctgcttgggcttcagggctgtctggctgcaggaggagtggccaaagcatcaggtggcgaaacgcgcgacatgccgtggaagcctggcccccacagagtctttgtgactcaagaggaagcgcacggagtgttgcatcgtcgcaggcgagctaacgccttccttgaggagctgcggccaggttcgttggaaagggagtgtaaggaagagcagtgctcctttgaagaagcccgggaaatcttcaaggacgccgagcgcaccaagctgttttggatctcctactccgatggggatcaatgtgcaagctccccatgccaaaacggcggaagttgtaaggatcagctccagtcctatatctgcttttgccttcccgcattcgaagggagaaattgcgaaacccacaaggatgaccaactgatatgtgtgaacgaaaacggtgggtgcgaacaatactgtagcgaccatactggcacgaagagatcatgtcggtgccatgaaggatactccctgttggcggatggagtcagctgcacccctaccgtggagtacccgtgtggaaagattcctattctggaaaagcgaaacgcatccaagccacaggggcgtatcgtgggaggcaaagtgtgtccaaagggggaatgtccttggcaggtccttttgctcgtgaatggtgcacaactgtgtggaggtaccctgataaacactatttgggtggtgtctgccgctcactgctttgataagattaagaactggcggaaccttattgctgtccttggtgagcatgacctgtccgagcatgatggagatgagcagtctcgaagggtggcacaagtcattatcccctcaacttacgtgcctggtaccactaatcatgacatagcccttctcaggctgcatcagccagttgtcctcaccgatcatgtggtgcctctgtgtctccctgagaggactttctcggaacgtactttggcttttgtgagattttcgctggtgtcaggctggggccaacttctggaccgaggcgcaactgcattggaactgatggttcttaatgtgcctcgtctcatgacccaggattgcctccaacaatcaaggaaagtgggagacagccctaacatcacggagtacatgttttgcgcaggatattcggacgggtctaaggattcctgtaagggcgattcagggggccctcatgcaacccactacaggggcacctggtacttgaccggtatcgtgtcatggggacagggatgtgcaaccgtggggcactttggagtgtacactagggtttcacaatacatcgaatggctgcagaagctcatgagatcggagcctaggccaggggtgctccttagagccccttttccg

SEQ ID NO: 9219 - DNA, 1398 bp, Artificial Sequence
  Description of Artificial Sequence: Synthetic coding sequence
atggtcagccaggctctgcgcctgctgtgcctgctgctgggactccaaggatgtttggcagccggaggagtggctaaggcgtcgggtggagaaacccgcgacatgccttggaaaccgggaccgcaccgcgtctttgtcacccaagaagaggcgcacggcgtcttgcatcggcggcggcgggccaacgcttttctggaagagctccgccctggttcgcttgaacgggaatgcaaggaagaacaatgtagctttgaggaagccagagaaatcttcaaggacgccgaacgcactaagctgttctggatcagttactccgacggcgaccagtgcgcatccagcccatgccagaatggagggagctgtaaggaccaattgcaatcctacatctgtttctgtctgcccgcgtttgagggacggaactgcgaaactcacaaggacgaccagctgatttgtgtgaatgagaacggtgggtgcgaacagtactgctcggatcacactggaaccaaacgcagctgcagatgtcacgagggatactcactgcttgcagacggtgtctcgtgcaccccgaccgtcgagtacccttgcggcaaaatcccgatccttgaaaaaagaaatgcctcaaagcctcagggaagaattgtgggcggcaaggtctgccctaagggcgaatgcccatggcaggtgcttctgttggtgaacggcgcccagctgtgtggcggcactctcatcaacaccatctgggttgtctctgcggcccattgcttcgacaagatcaagaattggagaaaccttatcgcagtcctgggcgagcatgatctgagcgagcacgatggggacgaacagtcgcggcgggtggcgcaggtgattatcccatcgacctacgtgccgggaactaccaatcacgacattgccctgttgcgcttgcatcagccggtggtccttaccgatcatgtggtgccactgtgcctcccagagcggaccttctccgaacggactctggccttcgtgcggttttccctggttagtggatgggggcagttgctggatcgcggagcgactgccctggagctgatggtgcttaatgtgcctcgcctgatgactcaggactgtctgcaacagtcacggaaggtgggcgacagcccgaacatcactgaatacatgttttgtgctggctactcagatggaagcaaggactcgtgcaagggagattccggaggcccacacgccacccattacagaggaacttggtacctgacgggtatcgtgtcctgggggcaggggtgcgctactgtgggccactttggagtgtatactagggtgtcccagtacattgaatggctgcagaagctgatgaggtcggagccgcgacctggagtgctgctgagagctccattcccg

SEQ ID NO: 9220 - DNA, 1398 bp, Artificial Sequence
  Description of Artificial Sequence: Synthetic coding sequence
atggtctctcaggctctcaggctcctctgtcttcttctagggctccaggggtgcttggccgcaggcggagtggccaaggccagcggcggggaaacgcgggatatgccctggaaacccggtccccaccgggtatttgtcacacaggaggaagcgcatggagtcttgcatcggagaagacgagcaaatgccttcctcgaagagctaaggccaggaagtctcgaacgtgagtgcaaagaggagcagtgttcattcgaggaggcaagagaaatcttcaaagacgcggagcgtactaaactgttctggatctcctactctgatggtgaccagtgtgcaagttcaccgtgtcagaatggcggctcctgtaaggaccaattacagagttacatctgcttctgtctgcccgccttcgagggaaggaattgcgagacacataaggacgaccaactaatttgcgtgaacgaaaacggaggttgcgagcagtattgttccgaccataccggtacgaagcgaagctgcagatgccacgaaggttacagtcttttggccgatggagtcagctgtaccccaacggtcgagtacccctgtgggaagattcctatacttgagaaaaggaacgcgtccaagccccaggggcgcatagttggagggaaggtgtgtcctaaaggcgaatgcccgtggcaggtcttgctcctcgtcaacggggcacaactatgcggaggcaccctgatcaatacaatatgggtggtcagcgcagcccactgcttcgacaaaatcaaaaattggaggaatcttattgccgtgctgggcgaacatgacctatcggaacacgatggggatgaacagtcaagacgggttgcgcaggtgatcattccatctacttacgtccctgggactactaaccacgatatcgccttgttaagattgcatcagcccgtggtgttgactgatcacgtagtgccgctgtgtttgccggagagaacattctcagagagaacccttgcttttgtgcggttcagcctggtttctgggtggggacagctgctggatagaggcgccacagccctggagctgatggtgctgaatgttcctcggctgatgacacaggattgtcttcaacagtcccggaaagttggcgactctccaaacatcacagaatacatgttctgcgcggggtacagcgatgggtctaaagactcatgcaagggcgactccggcggtccccatgccactcattacaggggcacctggtatctgaccggcatcgtctcctggggacagggttgcgcgacagtgggtcacttcggtgtctacacacgagtgtcacagtatattgaatggctgcagaagctgatgcgtagcgagcctcggcctggggttctactacgcgcacccttccca

SEQ ID NO: 9221 - DNA, 1398 bp, Artificial Sequence
  Description of Artificial Sequence: Synthetic coding sequence
atggtgtcacaagcactgcgattgttatgccttttgttgggtttgcaggggtgcctggccgctggaggcgtggctaaggcttcaggaggcgagacccgggatatgccttggaagcccgggccccacagggtgtttgtcacgcaagaagaggcgcacggagtgcttcatcgtcgccgaagagccaacgcttttctggaggagctgagacctggctccctggagagggagtgcaaagaggaacagtgctcattcgaggaggctagagagatcttcaaagatgccgagcggactaagttgttttggatatcctacagcgacggggaccagtgtgcttcttcaccctgtcagaatggaggaagttgtaaggatcaactgcaatcttatatatgtttctgcctcccagcttttgagggtcgtaactgcgagactcacaaggatgatcaactgatctgtgtcaatgagaatgggggttgtgagcagtactgcagcgaccacacaggcaccaaacggagctgtcggtgccatgagggatacagcctcctcgccgacggggtgtcctgcacgcccacggtcgagtatccgtgcggcaaaattcctattcttgaaaagcggaacgcttctaagcctcaggggcggatcgtgggcggcaaagtctgtccaaaaggggaatgcccttggcaggtgctcctgctggtgaatggggcccaactttgcggcggaactctgattaacacaatatgggtggtttcagcagcccactgcttcgataaaatcaagaactggcgcaatctgattgctgtccttggcgaacatgacttatcagaacacgacggagacgagcagagtaggcgcgtcgctcaggtcattatccccagtacatatgtcccaggaacgacgaatcacgacatagccctcctgcggcttcaccagcccgtggtgttgactgaccacgtcgttcccctgtgtctgcctgagcggactttttcagagcgcacactcgcttttgtacggttctcattggtgtctggctggggtcagctgcttgatcgaggcgctactgctctggaattgatggtccttaatgtcccgcggcttatgactcaagactgccttcagcagtcaagaaaggtcggcgactccccgaacatcacggaatacatgttctgtgcagggtattcagatgggtcaaaagattcctgcaagggcgatagcgggggcccacatgcaactcattaccggggcacctggtacctgacaggcatagtgtcgtggggacagggctgcgccaccgtgggtcactttggagtctacacacgggtctcacagtacatcgagtggctacagaagctgatgcgctcagagcccagacctggggtgctactccgagccccattccca

SEQ ID NO: 9222 - DNA, 1398 bp, Artificial Sequence
  Description of Artificial Sequence: Synthetic coding sequence
atggtgtcacaggccctacgactactttgcctgcttcttggcctacagggatgtctggcagccggaggagtcgcaaaggcaagtggcggtgagactagggacatgccctggaagccaggaccccacagagtattcgtgacacaagaagaggcccacggtgtactccaccgacgacgtcgtgcaaacgccttcttagaagaattgcgaccaggcagcctggagcgagagtgtaaagaagagcagtgcagcttcgaggaagcgagggagattttcaaggatgccgaaaggaccaaactcttctggattagctatagtgatggcgatcagtgtgccagcagcccctgtcaaaatggtggatcttgtaaggaccagttgcaatcgtacatttgcttctgccttcctgcctttgaaggcagaaactgcgaaacacacaaggatgaccagctcatatgtgtgaatgaaaacggtggctgcgaacagtattgctcagaccacaccggtacgaagagatcttgtcgatgccacgaaggatactcgctgttagcagatggtgtgtcttgcaccccaactgttgagtacccatgtggcaagatcccaatattagaaaagagaaacgcgtctaaaccacagggcaggattgtgggggggaaagtgtgcccaaaaggtgagtgcccatggcaggtgttgctgcttgtgaatggtgctcagttatgcggagggactttaatcaatacgatttgggtcgtgtcggctgcccattgcttcgacaagataaagaattggcgaaatctgatcgccgtactaggagaacacgatttgtccgagcacgacggggatgagcagagccgaagagtggcccaggtgatcattccgagtacctatgtaccaggcactacaaatcacgacatcgcattgcttcgcctgcaccagcctgtggtcctcacagaccacgtggtgccactgtgccttcccgagcgcacattctcagaaagaactctggctttcgttagattcagcttggtctcaggatgggggcagttgttggatcgaggtgctactgccctcgagctgatggtgctcaatgttcctcgcctcatgacgcaagattgtctacagcagagtagaaaggtgggcgattctcccaacatcaccgagtacatgttctgtgccggttactccgatggaagtaaggactcatgtaaaggggattccggggggcctcatgctacacactaccgagggacctggtatctgacaggtattgtgtcttggggacagggatgcgcaacggttggacactttggtgtgtatacaagggtcagccagtacattgagtggcttcaaaagctgatgagaagcgaacctagacctggcgtgttgctgcgcgccccctttcca

SEQ ID NO: 9223 - DNA, 1398 bp, Artificial Sequence
  Description of Artificial Sequence: Synthetic coding sequence
atggtgtcccaggccctgagactgctgtgcctgttgctgggacttcagggttgcctggcagccgggggagtggcaaaggcgtctggaggcgaaaccagagacatgccgtggaagccgggaccccacagagtgtttgtgacccaggaggaggcccacggagtgctgcatcggagacgcagagcaaacgccttcctggaagagttgcgcccgggaagcctggaaagagagtgtaaagaagaacagtgcagcttcgaagaagcgagagaaatcttcaaggacgcggagcgcaccaagctgttctggatctcctactcggatggcgatcagtgtgcatcgagcccgtgtcaaaacggagggagctgcaaggaccagctgcaatcgtatatctgtttctgcctgccggccttcgagggaaggaattgcgagacgcacaaagatgatcagctcatttgtgtgaatgaaaacggcggatgcgagcagtattgttctgaccacaccggaactaagcgctcatgcagatgtcacgaaggttactcactgcttgcggacggtgtctcatgcactccgaccgtcgagtacccctgtggtaaaatccctatccttgagaagaggaacgcctcaaagccgcagggtagaatcgtggggggaaaggtgtgcccgaagggcgagtgcccgtggcaagtcctgctgctggtgaacggcgcccagctctgcggcggaactctcattaacaccatctgggttgtgtcagcggcgcattgcttcgacaagatcaaaaactggcggaatctgatcgccgtgctgggagaacatgacctctcagagcacgacggagatgagcagtcccgccgcgtcgcgcaggtgatcatcccatccacttacgtgcctggtactaccaaccacgacatcgcactgctcagactccatcagcccgtggtcctcactgatcatgtggtccctctgtgcctcccggaacgcaccttttccgaaaggactctcgcattcgtgcggttctcattggtatcgggatgggggcaacttctcgacaggggcgcgaccgccctggagctgatggtcctgaatgtcccgcggctgatgactcaagattgtctgcagcaatcgaggaaggtgggagattcaccaaacatcactgagtatatgttttgcgccggatatagcgacgggagcaaggactcatgtaaaggagactcgggcggaccgcacgcaacccattaccgggggacttggtacctgaccgggattgtttcgtggggacaaggatgcgcaacggtgggacacttcggagtctacaccagagtgagtcagtacatcgaatggctccagaagttgatgcgatcggagccaagaccaggagtgctgttgcgcgcccctttcccg

SEQ ID NO: 9224 - DNA, 1398 bp, Artificial Sequence
  Description of Artificial Sequence: Synthetic coding sequence
atggtgtcgcaggcacttcgacttctgtgtctcctgctgggacttcaaggatgtttggccgcgggaggagtggccaaggcttcaggaggcgagacgagggacatgccgtggaagcctgggccccatcgggtgtttgttacgcaagaggaagcacatggcgtcctccacaggcggcgacgtgcaaacgccttcttggaagagctgcggccaggtagcctcgagcgcgagtgtaaggaggaacagtgttcattcgaagaagcaagagaaatcttcaaggatgccgagagaaccaaacttttctggatttcctacagcgatggtgatcagtgtgcttcctcaccctgtcaaaatggaggatcgtgcaaagatcagctccaatcctacatctgtttctgtctgcctgcttttgaaggtagaaattgtgaaactcataaagatgatcaactgatctgtgtgaacgagaacggtggatgtgagcaatactgtagcgaccataccggcacgaaaagaagctgtagatgtcacgaaggatacagcctgcttgcagatggagtgtcatgcaccccaactgtggaatatccatgcggtaaaatcccgatccttgaaaagagaaatgcgtccaagccccagggtcgaatagtcggaggtaaggtgtgtcctaagggagaatgtccttggcaggtgctgctgctggtcaacggagcacaactttgtggaggcactcttatcaacaccatttgggtcgtctcggctgcccattgttttgataagattaagaactggagaaatctgattgcggtgctgggagaacacgatctttccgaacacgacggggacgaacagtcccgacgcgtcgcccaagtcatcataccttccacctacgtgcctggaaccactaaccatgatattgccctcctccgccttcaccagcctgtggtgttgactgatcacgtggtgccgctctgcctgcctgaacggacgttttcggaacgcactcttgcattcgtgagattttcactggtgtcagggtggggtcaactgctcgatcggggcgcaactgccctggaactgatggtgttgaacgtgcctcggctgatgacccaggactgccttcagcaatcccggaaagtgggcgattcacctaacattactgagtacatgttttgtgcaggatactcagacggctcgaaggatagctgcaaaggtgattcaggaggtcctcatgcaacgcactacaggggtacctggtatcttaccggcatcgtttcgtggggccagggatgtgctaccgtgggtcactttggagtctacactagggtgagccagtacatcgagtggctgcagaagctgatgaggtccgaacccagacctggtgttctcctgagagcacccttccct

SEQ ID NO: 9225 - DNA, 1398 bp, Artificial Sequence
  Description of Artificial Sequence: Synthetic coding sequence
atggtgagtcaggctcttcgacttctttgtctgctgttgggattacaggggtgtcttgccgctgggggagtcgccaaagcttccgggggagaaactagggatatgccatggaaacccgggccacatcgagtgtttgtgacacaggaagaagcccacggagtgctacaccggagacgacgggccaacgccttcctggaagaactaaggcctggatcactcgaacgggaatgcaaagaggaacagtgtagtttcgaagaagcacgcgaaatatttaaagatgctgaaaggacaaagctgttttggatttcttattctgatggagatcagtgcgcttcttctccttgtcagaatggagggagttgcaaagatcagctgcaaagttacatctgcttctgcctccctgcattcgaggggagaaactgcgaaacacataaggatgatcagctgatatgcgtgaatgaaaacgggggatgtgaacagtactgttctgaccacactggaactaaaaggtcttgcagatgtcatgagggatattctctcttagctgatggggtttcttgcactcccactgtcgaatatccatgtgggaagatcccaatccttgaaaagcgcaatgcaagtaaaccacaggggaggattgtcggagggaaagtgtgtcctaagggggaatgcccctggcaagtactgttgctggttaatggggctcagttgtgcggggggacattaattaacactatctgggttgtgtcagcagcccactgcttcgacaaaataaaaaattggcgaaacttgattgcggtgctgggagaacatgatctgtccgaacatgatggggatgaacagtcacgccgggtggcccaggtaatcatcccatccacatatgtaccagggactacaaaccacgatatagcactactcaggctacaccagcccgtggtgttaactgaccacgtcgtgcctctttgcctcccagagcggacattctccgaaagaacactcgcgttcgtacgtttctcccttgtatccggatgggggcagctgctagacagaggagcgacagcgctggaactaatggttctgaatgtgccacgactgatgactcaggattgtctccagcagtctcgaaaagtgggagattctccaaacatcactgaatacatgttctgtgctggatattctgatggatctaaagactcatgtaaaggggattcaggagggccccatgctacgcactataggggaacttggtacctcactggaatagtgtcatggggacagggatgtgcaactgtcgggcattttggagtgtacactagggtatcccagtatattgaatggctccagaaacttatgcgctcggaacccaggcctggagtgctccttagggcaccttttccc

SEQ ID NO: 9226 - DNA, 1398 bp, Artificial Sequence
  Description of Artificial Sequence: Synthetic coding sequence
atggtgtcccaggcactccgcctgctttgtctgctcctgggacttcaaggctgtctggccgcaggaggtgtcgcgaaggcttctggcggcgaaactcgagacatgccctggaagccagggcctcacagggtgttcgtgactcaggaggaagcacatggtgtccttcatcgcaggaggcgggcaaacgccttcctcgaagaactccgccctggatcgctggagcgggaatgcaaagaggaacaatgttcgtttgaggaagcccgcgagattttcaaggatgccgagcgtactaaactgttctggatttcctactcagacggggaccaatgcgcatcgtccccctgccagaacgggggttcctgtaaagatcaacttcagtcatacatttgtttttgtctgccagcatttgaggggagaaactgcgaaacccataaagatgatcagctgatatgtgtcaacgagaacggtggctgcgagcaatactgcagcgatcacactggtactaagaggtcatgtaggtgtcacgaagggtacagccttctcgccgatggggtgtcatgtacgcctaccgtggaatacccctgtggaaagatacctattcttgaaaagagaaatgcaagtaagccacaaggaaggatagtcggcggtaaggtctgtcccaaaggtgaatgtccgtggcaagtgctgcttctggtcaacggcgcacagctctgcggtggcaccctgattaacacgatctgggtggtgtcagccgcacattgctttgacaagatcaagaattggagaaatttgattgccgtgctgggagaacatgatctttcggaacatgacggcgatgagcagtctcgccgagtcgcacaagtcatcatccctagcacctacgtcccaggtaccactaatcacgatatcgcactgcttcgcctgcaccagcctgtggttctgactgaccatgtggtgccactgtgtttgccagaaagaaccttctctgaacgtactctggcctttgttcgtttctcgcttgtctcgggatgggggcagctgctggatagaggagctaccgcattggaacttatggtgctgaatgtgccacgacttatgacccaagactgtctccaacaatcaagaaaggtgggagactccccaaacattaccgaatacatgttttgtgccggttatagcgatggttctaaggattcgtgtaaaggggattcgggcggaccccacgccactcattaccgcggtacctggtacttgaccggaatcgtcagttggggacaggggtgtgcaactgtcggccattttggcgtttacactagggtgtcacaatacattgaatggctgcagaagctgatgcggtcggagcctagacctggggtacttctccgtgcaccgtttcct

SEQ ID NO: 9227 - DNA, 1398 bp, Artificial Sequence
  Description of Artificial Sequence: Synthetic coding sequence
atggtttcgcaagcgttacgtttattatgtttactattaggtttacaaggttgtttagcggcgggtggtgtagcgaaagcgtcgggtggtgaaacgcgtgatatgccgtggaaaccgggtccgcatcgagtatttgttacgcaagaagaagcgcatggtgtactacatcgacgacgtcgtgcgaatgcgtttctagaagaactacgtccgggttcgttagaacgagaatgtaaagaagaacaatgttcgtttgaagaagcgcgtgaaatatttaaagatgcggaacgaacgaaactattttggatatcgtattcggatggtgatcaatgtgcgtcgtcgccgtgtcaaaatggtggttcgtgtaaagatcaattacaatcgtatatatgtttttgtctaccggcgtttgaaggtcgaaattgtgaaacgcataaagatgatcaattaatatgtgtaaatgaaaatggtggttgtgaacaatattgttcggatcatacgggtacgaaacgttcgtgtcgatgtcatgaaggttattcgttattagcggatggtgtatcgtgtacgccgacggttgaatatccgtgtggtaaaataccgatattagaaaaacgaaatgcgtcgaaaccgcaaggtcgaatagttggtggtaaagtatgtccgaaaggtgaatgtccgtggcaagttctactactagttaatggtgcgcaattatgtggtggtacgttaataaatacgatatgggtagtttcggcggcgcattgttttgataaaataaaaaattggcgtaatttaatagcggtattaggtgaacatgatttatcggaacatgatggtgatgaacaatcgcgtcgagtagcgcaagtaataataccgtcgacgtatgtaccgggtacgacgaatcatgatatagcgctactacgattacatcaaccggtagtactaacggatcatgttgttccgttatgtctaccggaacgaacgttttcggaacgaacgttagcgtttgttcgtttttcgctagtttcgggttggggtcaattattagatcgtggtgcgacggcgctagaattaatggtattaaatgtaccgcgtctaatgacgcaagattgtctacaacaatcgcgtaaagttggtgattcgccgaatataacggaatatatgttttgtgcgggttattcggatggttcgaaagattcgtgtaaaggtgattcgggtggtccgcatgcgacgcattatcgaggtacgtggtatttaacgggtatagtatcgtggggtcaaggttgtgcgacggtaggtcattttggtgtatatacgcgagtttcgcaatatatagaatggttacaaaaattaatgcgttcggaaccgcgaccgggtgttttactacgagcgccgtttccg

SEQ ID NO: 9228 - DNA, 1398 bp, Artificial Sequence
  Description of Artificial Sequence: Synthetic coding sequence
atggtttcccaagcccttcgtctcctgtgtctcctgctgggactccagggctgtcttgctgcgggaggagtcgctaaggcatccggaggggaaaccagagacatgccttggaagcctggtccgcatagggtctttgtcacccaggaagaagcgcatggagtgctgcatcggagacggcgcgctaatgcctttcttgaggaactcagacctggctcgctcgaacgtgaatgtaaggaggaacaatgcagctttgaagaagcccgagagatcttcaaggatgcagagcgaaccaagctcttttggatctcgtactcagatggagatcaatgtgcaagctcgccgtgccaaaacggtggttcatgtaaagatcagctccaatcgtacatttgtttttgtctgcctgcattcgaaggacggaattgcgaaacccataaggatgatcagcttatctgcgtgaacgagaacggaggctgtgagcaatactgttcagatcatactggaactaagcgatcgtgtcgatgccatgagggatacagccttctcgccgacggtgtctcctgtactcctaccgtggagtatccctgcgggaagataccaatacttgaaaagcgcaacgcgtccaagccccaggggaggattgtggggggtaaggtgtgtcctaagggtgagtgtccatggcaagttcttctgctggtcaacggcgcacagctgtgtgggggcacccttatcaataccatttgggttgtgtccgccgcgcattgtttcgataagattaagaactggcggaaccttattgcagtgctgggagaacacgacctttcggaacatgatggcgatgaacaatcacgccgcgtcgctcaggtcattattccttcgacgtacgtgccaggtaccaccaaccatgatatcgccctcctgagacttcaccagccggtggtcttgaccgatcacgttgtgccactttgtttgccggaacggaccttttcggaacgcactttggcatttgtgcgtttttcgctggtgtccggatggggacagctcttggaccgcggagccactgcattggaacttatggtgctgaacgtgcctcgcctgatgacgcaagactgcctgcagcaaagcagaaaggtaggtgacagccccaacattactgagtacatgttttgcgccggatatagcgacggatccaaagattcatgtaagggcgattccggagggcctcatgcgacccattaccggggaacctggtacctgaccggtatcgtgtcatggggacagggctgtgcaacggtggggcactttggagtgtacacccgtgtgtcacaatacatcgagtggcttcaaaaactgatgcgctcggaaccgaggcctggagtcctgcttcgcgccccttttccg

SEQ ID NO: 9229 - DNA, 1398 bp, Artificial Sequence
  Description of Artificial Sequence: Synthetic coding sequence
atggtgagccaggcacttaggcttctttgtttactgctgggccttcaaggctgtttggccgcaggcggagtggctaaggcatcagggggtgaaaccagggacatgccgtggaaaccaggcccccacagggtctttgtcacacaggaggaggcccatggagtgcttcacagaaggaggcgcgcaaacgcatttctggaagagttgagaccaggcagcctcgagagggaatgcaaagaagagcagtgctcattcgaggaggcacgggaaatctttaaggatgcagaaagaacaaagctcttttggatctcttactccgacggcgatcaatgtgcctctagcccttgccaaaacggaggatcctgtaaagatcagctccagtcttatatttgcttttgtctccctgcattcgagggccgcaattgcgagacccacaaggacgaccaactgatttgcgtaaacgaaaatggcggatgtgagcaatattgcagcgaccataccgggacgaagagaagctgtaggtgccatgagggatatagcctccttgctgacggggtatcgtgtacaccaactgtggaatacccctgcggaaagatacccattctggaaaaacgtaacgcttctaaaccacaaggccggatcgtgggcggcaaggtgtgcccaaagggggagtgtccatggcaggtattattactggtgaacggcgcacagctgtgcggaggaacactgattaacaccatttgggtggtgtcagcagctcattgcttcgacaaaatcaagaactggagaaacctgatcgcagtgctgggcgagcacgacctgtcggaacatgatggtgatgagcagtctagacgtgtagcccaggttattattccaagcacatacgtgcctggtaccaccaaccatgacattgccctgctccgtctgcatcagcctgtggtcctgacagatcacgtcgtgccgttgtgtctccccgaaagaacctttagcgaacggacccttgcgttcgtcagattctccttggtgtccgggtggggccagctgctcgatcgcggggctaccgctctcgagttaatggtcctgaacgtccctcggctgatgactcaagactgtctccagcaatccaggaaggtaggagactccccgaatatcactgaatatatgttttgcgcaggatatagcgatggaagcaaggattcatgcaagggggactccggtggccctcacgcaactcactacagaggtacatggtaccttactggaatcgtatcatggggacagggctgtgcaacggtaggccatttcggcgtctataccagagtgagtcagtatatcgaatggcttcaaaaactgatgagatccgaacccaggcccggtgtgctcctgcgcgcaccatttcca

SEQ ID NO: 9230 - DNA, 1398 bp, Artificial Sequence
  Description of Artificial Sequence: Synthetic coding sequence
atggtgtcccaggcgcttagactcctctgcctcctgctcgggctgcagggatgccttgcagcaggtggtgtggcaaaggcttccggcggagaaaccagggacatgccgtggaagccgggaccacatagggtgtttgtgacccaagaggaggcgcacggagttttgcataggagacgacgcgccaacgcattccttgaagagctccgcccgggctcgctggagcgagaatgcaaagaagagcagtgctcgtttgaagaagcccgggaaatcttcaaggacgccgagcgcactaagctgttctggatctcatacagcgacggggatcaatgcgcgtccagcccttgccagaacggcggatcatgtaaggaccagctgcagtcgtacatttgcttctgcctgccggctttcgaggggagaaactgcgaaacccataaggatgaccaactgatctgtgtcaatgagaatggaggatgtgagcaatactgctccgaccacactggaaccaagagatcgtgtcgctgccacgaagggtactcgctgttggcagatggcgtctcatgcacgccgaccgtggaatacccgtgcgggaagataccaatcctcgagaaacgcaacgcctccaagccacagggacgcatcgtcgggggcaaggtgtgcccgaaaggagagtgtccgtggcaagtgctgctcctcgtcaatggcgctcagctgtgtggaggcactttgatcaatacgatttgggtcgtgtcagcagcacattgctttgacaaaatcaaaaactggcggaatctgattgccgtgctgggggaacatgatctctccgagcatgatggagacgaacagagccgccgcgtggcccaagtgatcatcccatcgacttatgtcccgggaaccaccaaccacgacattgcactgctgcgcctccatcagcccgtcgtgctgactgatcacgtggtgccgctgtgtctgccggagcgcacgttctcggaacggacgctcgccttcgtcaggttctctctcgtgtccggatggggccaactccttgaccggggtgctaccgccctggaactcatggtgctgaatgtcccccggcttatgactcaagattgcctgcaacagagcaggaaggtgggagattcaccgaacataaccgaatacatgttctgtgccggctactcagatggaagcaaggactcatgcaagggagacagcggcggtccgcacgctacccattaccggggaacctggtacctgactggaatcgtgtcgtggggccaaggatgcgccactgtggggcactttggagtttacacccgcgtcagccagtacatcgagtggctgcaaaagttgatgcgctcagaacccaggcctggcgttctgcttagagcgccgttccca

SEQ ID NO: 9231 - DNA, 1398 bp, Artificial Sequence
  Description of Artificial Sequence: Synthetic coding sequence
atggtatcccaagcgctgcggcttttatgtctgctcctgggattacaaggttgtctggcagccggaggagtagcaaaagcaagtggcggggagactcgggacatgccgtggaagcccgggccgcatcgcgtgttcgtgacccaggaagaggctcacggcgtcttgcaccggagacgtcgcgccaacgctttcctcgaagaactcagacctggatccctggagcgggaatgcaaagaggagcagtgttcatttgaggaagcaagggagatattcaaggacgcggagagaacaaaactgttctggatcagctactctgatggagaccaatgtgcgtccagcccatgccaaaatggcggaagctgcaaggaccagctgcagtcctacatctgtttctgcttgcccgctttcgaaggaagaaactgtgagactcataaagatgaccagctgatttgcgtcaacgagaatggaggttgcgagcagtactgctcggaccacaccgggacgaaacgcagctgcagatgccatgagggctacagtctactggcggatggagtgtcctgcactccaaccgttgagtacccctgtggaaagatacctattttagagaaaagaaatgcctcaaaaccacaaggcagaattgtgggagggaaggtgtgccctaagggtgagtgcccatggcaggtccttcttctggtgaacggcgctcaactttgcggggggactcttatcaacaccatctgggtcgtaagcgcagcccactgctttgataaaatcaaaaactggagaaaccttatcgctgtcctgggtgaacatgacctgtccgaacatgacggggacgagcagagcagaagagtagcccaagtgattatcccaagtacatatgtgcccgggacgaccaatcatgatatcgcactgttgagattacatcagcccgtcgtactcacggatcacgtcgtgcccttatgtctgcccgagaggactttctcagagaggactctagcctttgtgaggttctcactggtgtcaggctgggggcagctcctcgatcgaggcgccaccgccttggagttaatggtgcttaacgtaccgagactaatgacccaggattgtctacaacaatctagaaaggtgggagactcccccaatatcaccgaatacatgttctgcgccgggtattccgatggttcaaaagactcttgtaagggggacagcgggggtccccatgctacacactatcgcggtacatggtaccttacggggatcgtgtcttgggggcaggggtgtgccacagtgggtcactttggagtttacacaagggtgagccaatacatcgagtggctgcaaaagctgatgaggtcggaacctagacccggagtgctccttcgggccccgtttccc

SEQ ID NO: 9232 - DNA, 1398 bp, Artificial Sequence
  Description of Artificial Sequence: Synthetic coding sequence
atggtgtcccaagccctaaggctgttgtgcctgcttcttggcctccaaggctgtctggctgccgggggagtcgcaaaggcctcgggtggcgagacccgggatatgccatggaaaccggggcctcaccgagtattcgttactcaagaagaagcccatggagtactgcacagacgacggagagctaacgctttcctggaagaacttcgtcccggatcactggagcgtgagtgtaaagaagaacagtgcagttttgaggaagcccgcgaaatcttcaaggacgccgagcggactaaattgttttggatctcttatagcgacggagatcaatgtgccagttccccgtgtcagaacggcggaagttgcaaggatcagctccagtcatatatttgcttctgtcttccggcttttgaggggcgaaactgcgagacccataaagacgatcagctgatttgtgtcaacgaaaacgggggttgcgaacagtattgttccgaccacacgggcacaaaacgatcatgtcgctgccatgaaggctacagtcttctggccgacggggtatcgtgcacaccgacggtagaatacccatgcgggaaaatacccatcctagagaaaagaaatgctagcaagccacagggaagaatcgttggggggaaagtttgtccaaagggagagtgtccatggcaggttctgctcttagtgaatggcgctcagctgtgcggcggaacgctgattaacacgatatgggtcgtgtctgccgcccactgttttgataaaatcaagaattggaggaatctcattgcagtcctcggtgagcacgacttaagcgaacatgacggagacgagcagagtcggcgggtggcccaggttataatccctagtacctatgtaccagggacaacaaaccatgatatagcgcttttgagactgcaccaacctgtggtactgacagaccacgtggttccactctgcctgcccgaaaggacgttttcggaaagaactttggcattcgtgaggttttcgctggtatcaggctggggccagctgctcgatcggggcgccacagcattagagctgatggttctgaacgtaccccgtttgatgacccaagattgtctgcagcagagccgtaaagttggagacagccctaatatcaccgaatatatgttctgcgccgggtattcggatggtagcaaggattcctgcaaaggcgacagtggcggcccccacgccacccattaccgcggtacctggtacctcaccggaattgtaagctggggacagggttgcgctacagtcggtcattttggcgtttatactcgcgtttctcagtacattgaatggcttcagaaattgatgcgaagcgaaccaagaccaggcgtgctattgagggctcccttcccc

SEQ ID NO: 9233 - DNA, 1398 bp, Artificial Sequence
  Description of Artificial Sequence: Synthetic coding sequence
atggtgtctcaggctttgaggctgctgtgcttgctgcttggactgcaaggctgcctagcagcaggcggcgtcgccaaagctagcggaggcgaaactagagatatgccttggaagccaggtccccatagagtgttcgtgacccaagaagaagctcacggtgtgctccacaggagacgtcgcgctaacgcttttctggaggagctgaggccaggcagtctggagagagaatgcaaagaggagcagtgcagcttcgaggaggcgcgggaaatctttaaagatgccgagcgcactaagctgttttggatcagctattccgacggcgaccaatgtgctagttcaccttgccaaaacggcggcagttgtaaagaccaactgcaatcatatatctgcttttgcttaccagccttcgaaggtcgcaactgcgaaacccacaaagatgatcagttgatctgcgtgaatgaaaacgggggctgcgaacaatactgtagcgatcacaccggaacaaaacggtcctgcaggtgccacgagggatacagtctgctggccgacggcgttagctgcacaccgacagtcgagtacccatgtggcaaaattcccattctggagaagcggaacgcttctaagcctcaaggtagaatcgtgggtggcaaggtgtgccccaagggcgaatgtccttggcaagtgctcttgttggtcaatggcgctcagttgtgcggtggcactctgatcaacaccatttgggtggtgtctgcagctcactgcttcgacaaaataaaaaactggcggaacctgattgccgtgctgggcgagcacgaccttagtgaacacgatggagatgaacagtcccggagagtcgctcaggtgatcatcccatctacttacgtcccagggaccaccaatcatgacattgctctgctgcggctacatcagccggtggttctgacagatcatgtggttcctctgtgcctccctgagagaaccttcagcgaaagaactcttgccttcgtgcggtttagcctcgtgagcgggtggggccagctgttggataggggcgccaccgccctggaactcatggttctaaacgtccctcggctgatgacccaggactgcctgcagcagagcaggaaagtgggcgattctcccaacatcaccgaatacatgttttgcgctggctacagtgatgggtctaaggactcctgcaaaggcgacagtggtggtccacacgcgactcactacagaggaacttggtacctgacaggcattgtgagctgggggcagggatgtgctactgttggccactttggtgtctacacaagggtttcccaatacattgagtggctccaaaaactcatgcgcagcgagccaaggcctggagtattgttgagagctcccttcccg

SEQ ID NO: 9234 - DNA, 1398 bp, Artificial Sequence
  Description of Artificial Sequence: Synthetic coding sequence
atggtgagccaagccttgagactcttgtgcctcttgctcggactgcaaggttgcctggctgcaggaggcgtggccaaggctagcggaggtgagacccgggatatgccatggaagcccggaccccaccgagtgtttgtcactcaggaagaggcacacggtgtgttgcaccgacgacggcgggctaatgcgttcctggaggaactccgccccgggagcttggaacgggaatgcaaggaagaacaatgtagttttgaggaggctcgggagatcttcaaggacgccgaacggacgaaattgttttggatttcctattctgacggcgaccagtgcgcatcctcaccctgtcagaatggtggaagctgtaaggaccagctgcagagctacatctgcttctgtctcccagcttttgaaggacgcaactgcgagacccacaaggacgaccagctgatctgcgtaaacgaaaatgggggctgtgaacaatactgctccgaccacaccggaaccaagcgatcctgtcgctgtcatgaaggctatagtctgcttgccgatggagtaagttgtactccaaccgtggagtatccatgcggcaaaattcccattcttgagaaacggaacgccagtaagcctcagggcagaattgtaggtggcaaggtgtgccccaagggtgagtgcccatggcaggtcctgctgctggtaaacggcgctcaactttgcggaggcacgcttataaacactatatgggttgtttctgccgcccactgtttcgataagatcaaaaattggcgcaatcttatcgccgtgttgggcgaacatgacttgagcgagcacgatggtgatgaacagtcacggagggttgctcaagtgatcataccaagcacgtacgttccggggactaccaaccatgacatcgcactgttgagactgcaccagcccgtcgtacttaccgatcatgtggttcccctctgtcttccagagagaacgttcagcgagcgcaccctggcctttgttcgattctcactggtttcaggctggggtcagctgctggacagaggggccactgcactcgaactgatggtgttgaatgttcccagactgatgacccaggactgtctccagcagagtcggaaggtgggtgattccccaaacatcactgagtacatgttttgtgccgggtactcagatggaagcaaagactcatgtaaaggcgactcaggaggccctcacgctacccactataggggcacctggtatctgaccggtatagtctcttggggacagggatgtgcgaccgtagggcatttcggggtgtatactcgagtttcacagtatattgagtggctgcagaaattgatgagatcagaaccacgacccggggtgctgttgcgggcacctttcccg

SEQ ID NO: 9235 - DNA, 1398 bp, Artificial Sequence
  Description of Artificial Sequence: Synthetic coding sequence
atggttagccaagcacttaggctgctctgccttctgctcggacttcaggggtgtctcgcggcaggtggagtcgctaaggccagtggtggagagaccagagacatgccatggaaacccgggcctcacagagtgttcgtgacccaggaggaagcccacggcgtcttgcatcgccggcgccgcgccaacgccttccttgaagagctgcgacccgggtcactggagagagagtgtaaggaggagcagtgttccttcgaggaggcccgagagatttttaaggatgctgaacgcacaaaactcttttggatctcatatagcgatggcgatcagtgcgctagttctccgtgccaaaatggtgggagctgcaaggatcagctgcagagctacatttgcttttgcttgcccgccttcgaaggtcgtaattgtgaaacacacaaagacgatcagctgatttgtgtgaatgagaacgggggatgcgagcagtattgctcggaccacacgggaacaaagaggtcatgtcgctgccacgagggttactccctgttggccgacggcgtgtcctgtaccccaacggtcgaatacccatgcgggaaaatcccaattctggagaaacgaaatgcttctaaaccccaagggagaattgttggcgggaaggtgtgcccaaagggcgaatgcccgtggcaggtgctgctcctggtgaacggcgcgcagctgtgtggaggcactcttatcaatacaatatgggtcgtatccgctgctcactgttttgacaagataaaaaactggcgaaatttaatcgccgtcctgggcgaacacgatctctctgagcacgacggcgacgaacagtcgaggcgggtggcccaggtgatcattccttctacttatgtgcctgggactactaaccacgacatcgctttactgcgtttgcaccagcccgtggtgttgaccgatcacgtcgtgccgctgtgtctcccggaaagaactttcagcgagaggactctggccttcgtcaggttttccctggtctccggatggggccagctgctggaccggggagccacagctctggagctgatggttttaaatgtgcccagactaatgacccaggattgccttcagcaaagcaggaaagtgggggactcaccaaacatcactgaatatatgttctgtgcgggctacagcgatggtagcaaagactcatgtaaaggagacagcggcggtccacacgcgacgcactacaggggcacttggtacctgaccgggattgttagttggggacaaggatgcgccactgtgggccatttcggcgtctatacacgcgtatcgcagtacattgagtggctccagaaactcatgcggtctgagccccgtcctggcgtcttgctccgggccccttttcca

SEQ ID NO: 9236 - DNA, 1398 bp, Artificial Sequence
  Description of Artificial Sequence: Synthetic coding sequence
atggtgagccaggcactgaggctgctgtgcctccttctgggcctccagggctgcctggcagcaggaggagtggcaaaggcatccgggggcgagactagagacatgccatggaaaccaggtcctcacagggtgtttgtgacccaagaagaggcccacggtgtgctgcatagaagaagaagggcaaatgcctttctcgaggaactgcgacccggatccttggagcgagaatgcaaagaagagcaatgctcctttgaagaagcaagagagattttcaaggatgccgaacggactaaacttttctggatctcttacagcgatggcgaccaatgtgcatcgtcaccctgtcaaaacggggggtcctgtaaggaccagcttcaatcgtacatatgtttctgtctgccagcatttgaaggacggaattgcgaaacccacaaggatgaccaactgatttgtgtgaatgagaacggtggatgtgagcaatactgttcggaccacaccggaactaaacgcagctgtcgttgccatgaagggtacagcctccttgccgatggcgtgtcgtgtacgccaactgtggaatacccatgtggaaagatacctattcttgaaaaacggaatgcgtcgaagccgcaaggccgtattgtgggtggaaaggtgtgccccaaaggcgaatgcccctggcaggtcctgctcctggtcaatggggcccaactgtgtggtggcactctcattaacactatctgggttgtcagtgccgcgcattgtttcgacaaaatcaagaactggagaaacctgatcgccgtgctgggagaacatgacctgtccgaacatgacggtgacgaacaatcgcgccgtgtggcccaggtgattattccctccacctacgtccctgggaccactaaccacgatattgctctgcttagacttcaccagccagtggtgctgaccgatcacgtggtcccactgtgcctccctgagagaacgttttcggaacgcactctggcattcgtcaggttctcgcttgtctccggttggggtcagcttctcgatcgtggtgccacggcgctcgaactcatggtccttaatgttccacgccttatgactcaagactgtctgcagcagagccgaaaggtgggtgattccccgaacattactgagtatatgttctgcgcaggctactctgatggctcgaaggactcgtgtaagggcgattccgggggaccacacgcgacccattaccggggtacctggtacttgaccgggattgtgtcatggggtcaaggttgcgctaccgtgggtcattttggagtgtatactagagtttcgcaatacattgagtggctgcaaaagctcatgagatccgagcctcggcccggtgtgttgttgcgtgcaccatttcct

SEQ ID NO: 9237 - DNA, 1398 bp, Artificial Sequence
  Description of Artificial Sequence: Synthetic coding sequence
atggtgagtcaggctttgagactgctgtgtctcctgctgggcctgcaaggctgtttggctgccggcggcgtggctaaggcatccggaggtgaaacacgagacatgccatggaagcccggcccccatagagtgttcgtgacacaggaagaggctcacggggtgctgcacaggcggagacgtgctaatgcattcctcgaagaactgaggcctgggagtttggaaagagaatgcaaggaggagcagtgcagttttgaagaagcacgggaaatttttaaggatgcagaaaggaccaaactgttctggatcagctattctgacggggaccagtgcgccagctccccttgccagaatggagggtcatgcaaggatcagctccagtcctatatttgcttctgtctccctgcgttcgagggccgaaattgcgagacccacaaggacgatcaattgatctgtgtgaatgagaacggaggatgtgaacagtactgctccgatcataccgggaccaagagatcttgcagatgccacgaaggctattcactgctcgccgacggcgtcagctgtaccccgaccgttgaatatccttgcggcaaaatccctattttggagaaaaggaacgcaagcaagccacagggcagaatcgtgggcggcaaggtctgccccaagggcgagtgtccctggcaggttttgctcttggtgaacggcgcccaactgtgcggagggaccttgattaacacaatatgggtggtgagcgccgcccattgcttcgataagatcaaaaactggcgaaacttgatcgccgtcttgggagagcacgatctttccgaacatgacggagacgaacagtctcgaagagtggcccaagtgatcattccgtccacctacgtgccaggcactacaaatcacgatatcgcgctcctgaggctacaccagcctgtagtgctgaccgaccacgtcgtgccactctgccttcctgagcgaaccttctcggagagaactcttgcttttgtgagattctctcttgtgagtggatggggccagttattagatcggggcgccactgctttggaactgatggtgctgaacgtacccaggctcatgacccaggattgtctacagcaatctcggaaggtgggcgattctccaaacatcaccgagtatatgttttgcgctggatattcggatggctcgaaggattcttgcaagggagacagcggtggtccacacgccacacattataggggcacttggtatctcacaggcattgtctcttggggacaggggtgtgcgacagtggggcattttggagtatacacacgtgtgtctcagtatatcgagtggctacagaagctcatgaggtcagagcctcggccgggggttttactacgcgcgcccttcccc

SEQ ID NO: 9238 - DNA, 1398 bp, Artificial Sequence
  Description of Artificial Sequence: Synthetic coding sequence
atggtgtcccaggccctgcggctgctgtgcctgttgctcggcctgcaggggtgcctggctgctggaggggtggctaaagcatctggcggagaaacgagagacatgccctggaagcctggccctcaccgagtctttgtcacacaggaagaagcacacggggtgcttcaccggcgccgtagagcaaacgcttttctggaggaactcaggcctgggtcactggaaagagagtgcaaagaggagcagtgttccttcgaggaggcaagggagatctttaaggacgccgagagaactaagctcttttggatttcctacagtgatggtgatcaatgtgcaagcagtccctgccagaacggagggagctgcaaagatcagcttcaatcatacatatgtttttgcttgcctgcatttgagggtaggaattgtgaaactcacaaggacgaccagctgatatgcgtcaatgagaatgggggctgcgagcagtactgcagcgatcacacgggtacaaaacgcagctgcaggtgtcacgaagggtattctttgctcgccgatggcgtgagctgcacacccacagtcgaatacccctgtgggaagattcccatcctggagaagcggaacgcctcaaagccacaaggacgaatcgttggcggcaaggtttgtcccaaaggagagtgtccatggcaggtgttgctcctagtgaatggagcccagctgtgcgggggaactttgataaacacaatatgggtagtgtccgcggcccactgctttgacaagataaagaattggcgtaatttgatcgcagttcttggcgaacacgatctgagcgagcacgacggggatgaacaatctcgaagagtggcacaagtaattatcccttccacttacgtgccaggcactacaaatcatgacatcgcgctcctacggctacatcaacctgtcgttctgactgatcacgtcgtgccattgtgcctacctgaacgcacattctccgagcggacccttgccttcgtgcggtttagccttgtatcaggatggggtcagctcttggacaggggcgctacggccctggaactgatggtgctgaatgtgcctagattgatgacccaggactgccttcagcaatcccggaaggttggcgacagtccaaacattactgagtatatgttttgcgcgggctattctgatgggtcaaaggattcgtgcaagggcgactcaggtggcccccacgccacccactaccgcgggacttggtatctgacgggcatcgtgagctgggggcaaggatgtgctactgtggggcatttcggggtctataccagagtgtcacagtatattgagtggctccagaagctgatgcgtagcgaaccgcgacctggtgtattgttgcgggccccgttcccc

SEQ ID NO: 9239 - DNA, 1398 bp, Artificial Sequence
  Description of Artificial Sequence: Synthetic coding sequence
atggtgtcacaggctctccggcttctgtgcctgctgctaggattgcagggatgcctcgctgcaggaggggtagctaaggccagtggaggggaaactagggatatgccgtggaaacctgggccccaccgggtctttgtgacacaggaagaagcgcacggggttcttcataggcgacgtcgagcaaatgccttcctcgaagaacttcgacccggatccctggaaagggaatgtaaagaagaacagtgttcattcgaagaggctcgggaaatattcaaagatgccgaacggactaaactcttctggatcagttattctgatggggatcaatgtgcctcatctccctgccagaatggggggtcctgcaaagaccagctccagtcatatatttgcttttgtctccctgcctttgagggaaggaattgcgaaacacacaaggatgatcagcttatctgtgtgaacgagaacggagggtgtgaacaatattgttctgatcacactggaacaaagcgatcctgtaggtgtcatgaggggtactctctactggccgatggagtgtcatgcacacctactgtggaatacccctgtgggaagatacctattctcgaaaaacgaaatgcttccaaaccacaggggaggatcgttggagggaaagtgtgtcctaaaggggagtgtccctggcaagtgctcctattggtcaacggagcacagctctgtggagggactctgatcaacacaatatgggtggtttcagcagctcattgcttcgataaaataaaaaattggcggaacctgattgcagtactcggagagcatgatctgtctgagcacgatggggacgaacagtctagacgggtggcccaggtaatcatcccctctacatatgtccccggaactacaaaccacgacatagctctgctcaggctgcaccagccagttgtgttaacagatcacgtggttcccctctgtctgcctgaacgaacattttccgaaaggactctcgctttcgtcaggttctctctcgtgtcagggtgggggcagttgctagaccgaggggccactgccttagaactcatggttctgaatgtcccccgccttatgacacaggattgcttgcagcagtcaagaaaagtcggagactctcccaacataactgaatacatgttttgcgcgggatatagtgatgggtctaaggattcttgtaaaggagattccggaggaccccacgcaacacactatagagggacatggtatcttacagggattgtctcctgggggcagggatgcgcaacagtaggacactttggagtctatactcgagtctctcaatatattgaatggcttcagaaacttatgcgctcagagccccgcccaggagtgctactgcgggccccttttcca

SEQ ID NO: 9240 - DNA, 1398 bp, Artificial Sequence
  Description of Artificial Sequence: Synthetic coding sequence
atggtgtcccaagcactccggctgctgtgtctgctcctgggactgcaaggatgcctcgccgcgggaggagtcgcgaaggcttcgggaggagaaacccgggacatgccgtggaaaccgggtccgcatcgcgtttttgtgacccaggaggaggcacatggggtcctccaccgccgtcggcgcgcaaacgccttcttggaggaactgcggccaggctcgctcgagagggagtgcaaggaagagcagtgtagtttcgaggaagctcgggaaatcttcaaggacgctgaacgcaccaagctgttctggatcagttactccgacggggatcaatgcgcgtccagcccttgccaaaacggcggctcatgtaaggaccagctgcagtcgtacatttgtttctgcttgcccgcctttgagggccgcaattgcgagactcataaagacgaccaactgatctgcgtgaacgagaacggaggatgcgaacagtattgctcagatcacacgggaaccaagcgctcgtgccgatgccatgaaggatactcgctgttggccgatggagtgtcttgcaccccgactgtcgagtacccatgcggcaagattcccatcctggaaaagcgaaacgcgtcgaaacctcaaggacggatcgtgggcggtaaagtgtgcccaaagggagagtgcccgtggcaggtcctcctgctggtgaacggagcacagctgtgtgggggcaccctgattaacactatatgggtcgtgtcggccgctcactgcttcgacaagatcaagaactggcgcaatctcatcgcggttctcggcgaacacgatctttcggagcatgacggagatgaacagtcaagacgcgtggcgcaagtcataatcccctcgacctatgtcccaggcactaccaaccacgacatcgccctgcttcggctgcatcagcctgtcgtgttgactgaccacgtggtacctctgtgtctgccggaacgcaccttctccgaaagaaccctggccttcgtgagattcagcctggtgagcggctggggacaacttttggaccggggcgctactgcactcgaactcatggtgctcaatgtgccgaggctgatgacgcaagactgcctccaacagtccaggaaggtgggagattccccgaatatcactgaatacatgttttgtgcgggatacagcgacggctcgaaggatagctgtaaaggagacagcggaggcccacatgccacgcattaccgcggcacctggtacctgactggcatcgtgtcatggggacagggttgcgccaccgtcggtcattttggagtgtacactagagtcagccagtatatcgaatggctgcagaaacttatgagaagtgaaccgcgcccaggagtgttgcttagagccccgtttcct

SEQ ID NO: 9241 - DNA, 1398 bp, Artificial Sequence
  Description of Artificial Sequence: Synthetic coding sequence
atggtgtcccaggcactgaggctgttgtgcctgttgctcggcctccagggttgcctcgcggcgggaggagtggcaaaagcaagcggaggtgagactcgcgacatgccttggaagccaggccctcaccgggtgtttgttacgcaggaagaagcacatggggtgctccaccggcggagacgtgcgaacgcctttctcgaagaactgcggccgggaagcctggaaagggaatgcaaggaagagcaatgctccttcgaggaagcccgggaaatcttcaaagacgctgagcgaactaaacttttctggatctcctacagcgatggcgatcaatgcgcctcgtccccttgtcagaacgggggctcatgtaaggatcagctgcagagctacatctgcttctgtctgccagccttcgagggccgcaattgcgagacgcataaagacgaccaactcatctgcgtcaacgagaatgggggatgcgagcaatactgctcagatcacaccggaaccaagagatcctgccgctgccatgagggatactcgctcttggccgacggggtgtcgtgtactccgaccgtggagtacccgtgtggcaaaatcccgatcctggaaaagcgcaatgcttccaagccccagggaagaatcgtgggaggaaaggtgtgcccgaagggggagtgcccgtggcaagtcctgctcctcgttaatggtgcccaactttgcggtggtacccttatcaatacgatctgggtggtgtcggccgcacactgtttcgataagattaagaactggcgcaacctgatagctgtcctgggggagcacgacctgtcggaacacgacggggacgagcaaagcagaagagtggcgcaggtcatcatcccatcaacctacgtcccgggaaccactaaccacgatatcgcccttttgcgtctgcatcaaccggtcgtcctgaccgaccacgtcgttcccctgtgcttgccggaacgtactttctcggaacggactttggcgtttgtgcggttctccctggtcagtggctggggacagcttctggaccgcggagccactgcgctggaattgatggtgctcaacgtgccacgcctcatgacccaggactgcctgcagcagtcgcgcaaggtcggcgatagccctaacattacggagtacatgttttgtgctggatactcagacggaagtaaagatagctgcaagggcgatagcggcggaccacatgccacccactataggggaacctggtacctcactggtatcgtgtcctggggacaaggttgtgccactgtgggacatttcggagtatacacccgcgtgagtcagtacattgaatggctgcagaagttgatgcgctcagaacctcggccaggagttctgttgagagcaccattcccc

SEQ ID NO: 9242 - DNA, 1398 bp, Artificial Sequence
  Description of Artificial Sequence: Synthetic coding sequence
atggtaagtcaagcattaagattattatgtcttcttttaggacttcaaggatgtcttgcagctggaggtgttgcaaaagcatcaggaggagaaactcgagacatgccatggaaaccaggtccacatagagtttttgtcacacaagaagaagcacatggagttcttcataggagaagaagagctaatgcatttttagaagaattaagaccaggttcattggaaagggaatgtaaagaagaacaatgtagttttgaagaagctcgagaaatatttaaagatgcagaaagaacaaaattattttggattagttatagtgatggtgatcaatgtgcttcatctccatgtcaaaatggtggatcttgtaaagatcaattacaatcttatatttgtttttgtttaccagcttttgaaggaagaaattgtgaaacacataaagatgaccaattaatatgtgtaaatgaaaacggaggatgtgaacaatattgttcggatcatacaggtacaaaaaggtcatgtagatgtcatgaaggttatagtcttttagctgatggagtatcttgtactccaacagttgaatatccttgtgggaaaattccaattttagaaaagagaaatgcttcaaaaccacaaggaagaattgttggaggaaaagtatgtcctaaaggagaatgtccatggcaagttttattattagtaaatggagcccagttatgtggaggtacacttattaatactatttgggttgtaagtgcagctcattgttttgataagattaaaaattggagaaacctaattgctgtcttaggtgaacatgatttatcagaacatgatggagatgaacaatcaagacgagttgcacaagtaattattccaagtacctatgttccaggaactacaaatcatgatattgcattactaagattacaccaacctgtagttcttaccgatcatgttgttccattatgtttgccagaaagaactttttcagaaaggactttagcatttgttagattttcattagtttcaggttggggacaattacttgacagaggagcaactgctttagagttgatggttttgaatgttccacgtttaatgactcaagattgtttacaacaatcccgtaaagttggggattcacctaatattacggaatatatgttctgcgctggttattcagatggatcaaaagattcttgtaaaggagattctggaggtccacatgcaactcattacagaggaacttggtatttaactggaatagtttcttggggacaaggttgtgctacagtaggacattttggagtttatacaagagtttctcaatatatagaatggttacaaaagttaatgagaagtgaaccaagaccaggagttcttcttagagctccatttcct

SEQ ID NO: 9243 - DNA, 1464 bp, Artificial Sequence
  Description of Artificial Sequence: Synthetic coding sequence
atgggtcggccactccatcttgtcctgctttcagcgtcgttggcgggccttcttcttctgggtgagtcgctctttatacgacgcgaacaagctaataacattctggccagagtcacccgcgcaaattcatttcttgaagaaatgaaaaagggacatctggaaagagaatgcatggaagagacgtgttcgtacgaagaggcccgagaggtctttgaagattccgataaaacgaatgagttctggaacaagtacaaggacggagatcagtgcgagactagcccttgtcaaaaccagggcaagtgtaaggacgggcttggggaatacacttgtacgtgcctcgaggggtttgaaggaaaaaactgtgaacttttcaccaggaaactttgttccctggataacggagattgtgatcagttctgtcacgaagaacagaactccgtcgtgtgctcatgtgcacgcggctacactctggctgacaacggcaaagcatgtattccgactggaccttacccctgcggtaagcaaacgctggagcgtcggaagagatccgtcgcacaagcaacttcgtcctcaggggaagcaccagattccattacttggaagccatacgacgctgccgacctcgatccaactgaaaatccttttgatctgctcgatttcaaccagacccaacctgaacggggcgacaacaaccttactcggattgtcggcggacaggagtgtaaagatggcgaatgtccttggcaggcattgctcattaacgaagagaacgagggtttttgtggtggtaccattctctccgagttctatatcctgactgcggcacattgtctttaccaagcaaagcgttttaaggtaagggtgggagacagaaacacggaacaagaggaaggtggtgaagcagtccatgaagtcgaagtggtgatcaaacacaatcggttcaccaaggaaacttacgattttgacatcgccgtgctgcgccttaagacccctattacctttcgaatgaatgtggcaccggcctgcttgcccgagagagattgggctgagagcacccttatgacgcaaaaaactggaatcgtgtcaggttttggtagaacccatgaaaaaggccgtcagtcaaccagacttaagatgctcgaagttccctacgtggatagaaatagctgtaagctgagttcctcgttcatcataacccaaaacatgttctgcgctggttacgacaccaagcaagaggatgcatgtcaaggcgattccgggggacctcacgtgaccaggtttaaagatacttactttgtgaccggaatagtaagctggggggagggatgcgctcggaagggcaagtacggaatctacaccaaagtgactgcattccttaaatggattgacagatcgatgaaaactagaggccttccgaaggctaagtcccacgccccagaggtgattacttcctcaccattgaaa

SEQ ID NO: 9244 - DNA, 1464 bp, Artificial Sequence
  Description of Artificial Sequence: Synthetic coding sequence
atgggacggccgctgcatctggtccttctgagcgcttcgttggcaggactgcttctgcttggcgaatccctctttattcgccgggaacaagcaaacaacattttggcgcgggtgaccagagcgaactcgtttctcgaagagatgaagaagggccacctcgaaagagaatgcatggaggaaacctgttcgtacgaagaggcaagagaagtatttgaagattcagacaagactaatgaattttggaacaaatacaaggatggagatcagtgcgaaacctccccatgtcaaaatcagggaaagtgtaaggacggattgggggaatacacctgcacttgtctcgaaggattcgaaggtaagaactgtgagctgttcaccagaaagctctgcagcctggataatggagattgtgaccagttttgccatgaagaacaaaattcagtggtgtgttcatgcgcgagagggtacacccttgccgataacggaaaggcatgtattccgaccggaccttacccttgtggtaagcagaccctcgaaagacgcaagcgctccgtggcccaagcgacgtcatcatccggcgaagcaccagactcgatcacctggaagccctacgatgcggcagatctcgatcctaccgaaaaccccttcgaccttctggacttcaaccagacccaacctgaaaggggtgacaataaccttactcggatcgtggggggacaagaatgcaaggatggtgaatgcccctggcaggcacttcttatcaacgaggaaaacgagggattttgtggaggtaccatcctgagcgagttttacatccttactgcagctcactgtctttaccaagcgaagcgtttcaaagtccgcgtgggtgatagaaacaccgaacaagaggaaggaggagaagccgtccatgaagtggaagtggtgattaaacacaatagattcaccaaggaaacctacgactttgatatcgcagtgctccgccttaagaccccaattacctttcgcatgaatgtggcaccagcctgtctgccggaaagagactgggcagagagcactcttatgactcaaaaaactggaatcgtgtcggggtttgggcggacccatgagaagggccggcaatccactcgtctgaaaatgcttgaagttccatacgtggatagaaattcgtgtaaactgtcctcgagctttatcattacccagaacatgttttgtgccggttacgataccaagcaagaggatgcgtgtcaaggagactcagggggaccacatgttactcggtttaaagatacgtacttcgtcaccggcattgtctcatggggtgaaggttgcgcacgcaaaggaaagtacggaatttacactaaggtgaccgcattcctcaagtggatagaccgcagcatgaaaaccagaggactgcctaaggcgaaaagccatgcccctgaagtgattacttcatcacccctgaag

SEQ ID NO: 9245 - DNA, 1464 bp, Artificial Sequence
  Description of Artificial Sequence: Synthetic coding sequence
atgggaagaccactacatcttgttcttttatcagcatctttagctggacttttgttattaggagaaagtttatttattagaagagaacaagctaataatattttagcacgagttacaagagcaaatagttttttagaagaaatgaaaaaaggacatttagaaagagaatgtatggaagaaacttgtagttatgaagaagcacgtgaagttttcgaagactcagataaaaccaatgagttttggaataagtataaagatggtgatcaatgtgaaacttcaccttgtcaaaatcaaggtaaatgtaaagatggattaggagaatacacctgtacatgtttagaaggattcgaaggtaagaattgtgaattgtttactagaaaattgtgttcacttgataacggagattgtgaccaattctgtcatgaagaacaaaattctgttgtatgttcatgtgcaagaggttatacattagccgacaatggaaaggcatgtattccaactggtccatatccatgtggaaaacaaactttagaaagacgaaaaagatcagttgctcaagcaacctcttcttctggagaagctccagattctattacctggaaaccatatgatgctgcagatcttgatccaactgaaaatccattcgatttattagattttaaccaaactcaaccagaacgaggagataataaccttacaagaatagtaggtggacaagagtgcaaggatggtgaatgtccatggcaagctcttttaattaatgaagaaaatgaaggattttgtggtggaactattttatctgaattttatattttaacagcagctcattgtttatatcaagctaaacgatttaaagttagagtaggtgatagaaatacagaacaagaagaaggtggagaagctgtacatgaagttgaagtagttattaagcataatagatttactaaagaaacatacgattttgatatagcagttttacgtttaaaaacacctataacatttcgtatgaatgttgcacctgcatgtcttccagaaagagattgggctgaatcaacacttatgacacaaaaaactggaatagtttcaggatttggtcgaactcatgaaaaaggaagacaatcaactagattaaaaatgttagaggttccatatgtcgatagaaattcatgcaaactttcatcttctttcattattacacaaaatatgttttgtgcaggatatgatacaaaacaagaagatgcatgtcaaggggattcaggtggaccacatgttacaaggtttaaggacacatattttgttaccggaatagtttcatggggagaaggatgcgcaagaaaaggaaaatatggaatttatacaaaagtaacagcatttcttaaatggattgatagatcaatgaaaacacgtggattaccaaaagctaaaagtcatgctcctgaagtaattacatcatcaccattaaaa

SEQ ID NO: 9246 - DNA, 1464 bp, Artificial Sequence
  Description of Artificial Sequence: Synthetic coding sequence
atgggtagacctctgcatttggtgttgttgagcgcatcgctggccgggcttctgcttctgggagaatcattgtttatcagacgagaacaagcaaataacatcctggcacgagtgacgagagcaaactcctttctcgaggagatgaagaaaggccacttggaaagagagtgtatggaggaaacttgctcttacgaagaggcgagggaagtgtttgaggactctgacaaaacgaacgaattctggaacaagtacaaggacggtgatcagtgcgaaacttccccttgccaaaaccaggggaagtgtaaggatggactcggcgaatacacctgtacctgtctggaaggtttcgagggtaaaaactgtgaactgtttaccagaaaactttgtagccttgataatggtgattgtgaccaattctgtcacgaagaacaaaattcagtggtctgtagctgcgcaagaggatataccctggcggataatggaaaagcctgtattccaaccggcccatacccctgcggtaagcagaccctggagcgaagaaagagatcggtggcgcaagccacctcgagctccggtgaggcacctgattccataacttggaagccttacgacgcagccgatcttgacccaaccgaaaacccatttgatcttcttgactttaaccagactcaacctgaacggggggacaacaatcttaccagaatcgtcggaggccaggaatgcaaagatggagaatgtccttggcaggctctgttgattaacgaggaaaacgaaggtttttgtggagggaccattctgtccgaattctacatacttactgccgcacattgcctttaccaggcaaagagatttaaggtccgggttggggatcgcaatactgaacaagaggagggaggagaggcagtccatgaggtggaagttgtgatcaaacataaccggttcaccaaggaaacctacgattttgacattgctgtccttaggctcaagactccaatcacctttcgcatgaatgtggcgccggcctgccttccggaacgcgattgggccgagtccacgctgatgactcaaaagactggaatcgtgagcgggttcggtcggacccatgagaaagggagacaatcgaccaggctgaagatgttggaagtcccttatgtggatcgaaactcatgcaagctctcatcatcctttatcatcactcagaatatgttttgtgcaggctacgacactaagcaggaagatgcatgtcaaggggatagcgggggcccacatgtgactcgttttaaggatacttacttcgtcacgggtattgtgtcgtggggggagggatgtgcgcgtaagggtaaatacggcatatacaccaaggtgaccgcattcctgaagtggatagatcgatcgatgaaaacgagaggccttcctaaggcaaaatcccacgccccggaagtgattacctcgtcgccactcaaa

SEQ ID NO: 9247 - DNA, 1464 bp, Artificial Sequence
  Description of Artificial Sequence: Synthetic coding sequence
atgggccgaccacttcatctggtgcttctgtcggcgagcctggcagggcttcttctccttggagaatccctgtttatcagacgggaacaagccaacaatattctggctagagtgaccagggccaactccttcctggaggaaatgaaaaaaggacatctggaaagggagtgcatggaggaaacctgttcatacgaggaggcaagggaagtttttgaggactcggacaaaaccaacgagttttggaacaagtataaggatggcgaccaatgtgaaacctcgccatgtcaaaatcagggaaagtgtaaagacggactgggagagtacacttgtacctgtttggagggattcgaagggaaaaactgtgaactttttaccaggaagctgtgcagcctggataatggtgattgtgatcaattttgccatgaagaacaaaatagcgtggtgtgctcatgtgcgcgcggttacacccttgctgacaatggcaaggcatgtattcctactggtccctacccttgcggaaagcaaaccctggaacgtcggaagcgatccgtggcgcaggcgacctcgtcgtcgggcgaggctccagacagcatcacttggaaaccttacgatgcagcagacctcgaccctaccgaaaacccttttgatcttcttgactttaaccaaacccaacccgagcgtggagataacaatctgactcggattgtcggtggccaggaatgcaaggatggagaatgcccttggcaggcgcttctgattaacgaggaaaacgaagggttctgtggagggaccatactgtcggaattctacatcttgaccgctgcccactgtctttaccaggcaaagcgtttcaaagtccgggtgggagatcgaaacaccgaacaagaagagggtggagaagcagttcatgaagtcgaggtggtgataaagcataaccggttcaccaaggagacttatgattttgatatcgccgtccttcgcctgaaaacgccaattacgtttagaatgaacgtcgcaccagcttgtttgcctgagcgcgactgggccgaatcgactcttatgacccaaaaaaccggcatagtctcgggattcggacgtacccacgagaaggggcgtcagtcgacccgcctcaagatgctggaagtgccttacgtcgataggaacagctgcaaactgtcctcatcgttcataatcactcagaatatgttctgcgcaggctacgacaccaagcaagaagatgcatgtcagggagattccggcggcccacatgtgaccagatttaaggatacctactttgtgactggaattgtgtcgtggggagaaggttgtgcgagaaaggggaagtacgggatttacaccaaggttactgcatttctgaagtggatcgatagatccatgaaaacgcgaggactgcctaaggctaagtcacacgcgccagaagtcatcacttcctccccgctgaaa

SEQ ID NO: 9248 - DNA, 1464 bp, Artificial Sequence
  Description of Artificial Sequence: Synthetic coding sequence
atgggacgcccacttcatctcgtgctcctgagcgcctccctcgcgggactgctgctgctgggtgagtccctcttcatcaggcgcgagcaggccaacaatatcctggcgcgagtcactagagcaaattcatttctggaggaaatgaaaaagggacacttggagcgtgagtgtatggaagagacgtgcagctacgaggaagcgagagaagtgttcgaggactccgataaaactaacgaattctggaacaagtacaaggacggggaccagtgtgagacttcgccatgccagaaccagggaaagtgcaaggacggtctgggcgaatacacctgcacttgcttggaggggttcgaagggaagaactgtgaactgttcacccggaagctgtgctcgcttgacaatggggattgcgaccagttctgccacgaagaacagaattcagtcgtgtgcagctgtgcgagaggttacaccctggcagacaacggtaaagcctgcatcccgacgggcccatatccgtgcggcaagcaaaccctggagcgccgtaaacgaagcgtcgcgcaagcaacctcgtccagcggagaggccccagattcaatcacctggaagccgtacgacgcagccgatctcgacccaaccgagaacccattcgatctccttgatttcaatcaaacccagcccgaaagaggagataacaacctgaccaggatcgtgggagggcaggaatgcaaggacggcgagtgtccttggcaagccctgctcatcaatgaagagaacgagggattctgtggcggaaccatcctcagcgagttctacatcctcaccgccgctcattgtctgtatcaggccaaacggttcaaagttcgcgtgggcgaccgcaacactgagcaagaagaaggaggcgaggctgtgcacgaagtggaggtggtgattaaacacaacaggtttaccaaggaaacctacgactttgatatcgcagtgctgagactcaagaccccaatcacctttcgcatgaatgtcgccccagcttgcctgccggagcgggattgggccgaaagcacgctgatgacccaaaaaaccggaatcgtgagcggctttggccggactcacgaaaaaggcaggcagtctactaggctgaagatgctggaggtgccgtacgtcgaccggaattcttgtaagctctcaagctcgttcatcattacccagaatatgttttgcgctgggtacgatacgaagcaagaggacgcctgccaaggagactccggcgggccgcatgtgactaggttcaaggatacttacttcgtcaccggaattgtctcctggggggaaggatgcgccaggaaggggaaatacggcatttacaccaaggtgactgcgttcctgaagtggattgacaggtcgatgaaaacccggggactgccgaaggcgaagagccatgccccggaggtgatcacgagctcaccactgaag

SEQ ID NO: 9249 - DNA, 1464 bp, Artificial Sequence
  Description of Artificial Sequence: Synthetic coding sequence
atggggcgcccgctccacctcgtgctcctctcggcatctctggcgggacttctacttttgggcgaatccctttttatacgaagggagcaggcgaataatatcctagctagagtgacaagagccaattcttttttagaagagatgaagaaagggcatctggagcgcgagtgcatggaggaaacctgctcatacgaggaggcccgcgaagtctttgaagactctgacaagaccaatgagttttggaataaatataaggatggagaccagtgcgagacgtccccctgccagaatcagggtaagtgtaaagacggcctgggcgaatacacttgtacctgtctggaggggttcgagggtaagaattgtgagctgtttacgcgtaagctgtgtagtctggacaacggagactgcgatcagttttgccacgaagagcagaactctgtggtctgctcttgcgcgagaggctacaccttggcagacaatgggaaagcctgcattcccactggtccatacccctgcggcaaacagaccctggagcgccgcaagagatccgtcgcccaggctaccagcagcagcggtgaggcccccgactctataacttggaagccctacgatgccgccgatcttgatcccacggagaatcctttcgatcttctcgacttcaaccagacacagccagagcgaggggataataacctcactagaattgtaggcggacaagaatgtaaagatggagaatgtccgtggcaggccctcttaattaatgaggaaaatgaaggattttgtggtggcaccattctgtccgaattttatatcctgacagctgcccattgtttgtatcaggctaagcgatttaaggtgcgggttggagatagaaacacagaacaggaagaaggaggcgaggcagtccatgaggtggaggtggtgattaagcataatcggttcaccaaggagacctacgatttcgacattgctgtgcttagattaaaaacacccataacgttcagaatgaacgtggcccccgcatgcctcccggagagggactgggcagaatccacactgatgacgcagaagacaggaatagtttcaggcttcggccgtacccacgagaagggcaggcagagtaccaggttaaagatgctggaggtaccctatgtggatcgtaattcgtgcaagctgtcttcttcatttatcatcactcagaacatgttttgcgccggctacgacaccaagcaggaggacgcttgtcaaggggattcgggggggccccatgtcactcgattcaaagacacatattttgtcacaggaatcgtgtcttggggcgaagggtgtgctcgtaaaggaaagtacggcatttatacaaaggttactgcattcctgaagtggattgaccgttccatgaagacacgtggtcttccaaaggccaagtcacatgctcctgaggtgattacttcaagccccctgaag

SEQ ID NO: 9250 - DNA, 1464 bp, Artificial Sequence
  Description of Artificial Sequence: Synthetic coding sequence
atgggccgcccactgcatctggtgctactttccgccagtttagctggtctgctgctcttaggagagtctctcttcataaggagggaacaggctaataacattctggcgagggtgacgcgggctaacagctttctggaggaaatgaagaagggacatctggaaagagagtgcatggaggaaacctgttcttacgaggaggcacgcgaggtgttcgaggacagcgataaaactaatgagttctggaataagtataaagacggcgatcaatgcgagacaagtccgtgtcaaaaccagggcaagtgcaaagacgggctgggtgagtacacttgcacttgtctcgaagggttcgagggcaagaactgcgagttgtttacccggaagctttgtagcctggacaatggcgactgcgaccagttctgccatgaggagcaaaatagcgtagtgtgcagctgcgcccgcggctacaccctagctgacaacggcaaggcgtgtatccccacagggccctatccgtgcggcaaacagactttagagagacgcaagcggtcagttgcccaggctacttcttcatccggagaggctcctgacagtattacttggaaaccttacgacgccgccgacttggatcccactgaaaacccgttcgatttgctagatttcaatcagacacagccagagcgcggcgataacaacctgacccgaattgtcggcggtcaggagtgcaaagatggcgaatgcccatggcaagcccttctgatcaatgaggaaaacgaaggcttctgcggaggaaccattctgagtgagttctatattctgaccgctgctcattgtctgtaccaggctaaacgcttcaaagtgcgggtgggagatcggaacacagaacaggaggaaggtggcgaagcagtgcacgaggtggaagtcgtgattaaacacaaccggtttactaaggagacctatgacttcgatattgccgtactgagacttaagacaccaatcactttccgaatgaacgtggcacccgcctgtctacctgagcgggactgggccgagtcaaccttaatgacccagaaaacaggcatcgtgtccggattcgggagaacgcatgagaagggccgccagtctacccggctaaagatgctggaagtaccctacgttgatcggaattcctgcaagctctcctcatcattcatcatcacccagaatatgttctgcgctggttatgataccaagcaagaggatgcttgccagggtgattcaggaggacctcacgtgacacgcttcaaagacacctacttcgtcacaggcatcgtgagttggggagagggatgtgccagaaaaggaaaatatggtatttacactaaggtgaccgcttttcttaaatggatagataggagcatgaagacacggggtctccctaaggccaaaagccatgcccccgaggttattacttccagccctctcaaa

SEQ ID NO: 9251 - DNA, 1464 bp, Artificial Sequence
  Description of Artificial Sequence: Synthetic coding sequence
atgggacgcccgctccatctggtcctgctgagcgcgtcactcgcaggcctcctgcttctcggcgagtcgcttttcatccggcgagagcaggcgaacaatatcctcgcccgggtcactcgggccaatagcttcctcgaagagatgaagaaaggacatctggaaagagagtgcatggaggagacttgtagctacgaagaagcgcgagaagtgtttgaggattcggacaagactaacgagttctggaacaaatacaaggacggagatcagtgtgaaacctccccttgtcagaaccaaggaaaatgcaaagacggactgggggagtacacttgcacctgcctcgagggattcgaaggcaagaattgtgagctgtttaccaggaagctgtgctcattggacaacggagactgcgaccagttctgccacgaagagcagaattcggtggtctgcagctgtgcgcggggctacaccctggcagacaacggcaaagcctgtattcctactggcccttacccgtgcggcaagcaaactctcgaacgccgcaagcgctcagtggctcaagccacttcgtcatctggggaagcgccagactcaatcacttggaagccttacgatgccgctgacctcgacccgaccgaaaacccgttcgacttgcttgactttaaccagacgcaaccggagcggggagacaacaatctcactcggattgtgggaggtcaggaatgcaaggatggggaatgcccatggcaagccctgctgatcaacgaagagaatgagggattctgtggcggtactatcctgtccgaattctacatcctcaccgctgcccattgtctgtaccaggcgaaaagattcaaggtgcgagtcggagatcggaatacggaacaggaagaaggtggcgaagcagtccatgaagtggaggtcgtcatcaagcataacagatttactaaggagacttacgacttcgacatcgcagtgctgagactcaagactcccatcactttccgcatgaatgtggcaccagcctgcttgccggagcgggactgggctgaaagcaccctgatgactcagaaaaccggaatcgtgagtgggttcggaaggactcatgagaaggggagacaatcgactagactgaagatgctggaagtcccctatgtggaccgcaactcatgtaagctgtcgtcgtcgttcatcatcactcaaaacatgttctgtgctgggtacgataccaaacaggaggacgcgtgccagggggactcaggaggaccgcacgtcactcgcttcaaggacacttacttcgtgactgggatcgtgagctggggtgagggatgcgcgcggaagggaaaatacggaatctacaccaaagtgaccgctttcttgaagtggatcgaccgctcgatgaaaactcggggcctcccgaaagcgaagtcacacgcaccggaagtgattacctcgtccccactgaag

SEQ ID NO: 9252 - DNA, 1464 bp, Artificial Sequence
  Description of Artificial Sequence: Synthetic coding sequence
atgggccggcctctgcatcttgttctgttgagcgctagtctggcgggcctgctgctgctgggtgaaagtctgtttattaggcgagagcaggccaataatatactcgccagagtcaccagagctaattccttcctggaggaaatgaagaaaggacatctggagcgagagtgcatggaagagacttgttcctacgaggaagccagagaggtctttgaggatagcgacaaaacaaacgagttttggaacaaatacaaagacggagatcagtgcgagacctccccttgccaaaaccaaggtaagtgcaaggatggactgggggagtacacatgcacctgtttggaaggatttgaaggaaaaaactgtgaactctttacaaggaaactgtgcagtctggacaacggcgactgtgaccagttttgccacgaagagcagaactccgtggtttgtagctgcgccagaggctatacacttgcagacaacggcaaggcctgtatacccactggcccctatccatgtggcaaacaaactctcgagcgacggaaaaggagtgtcgctcaggctacaagctctagcggagaagccccagattcaattacctggaagccatacgacgctgctgacttggaccccacagaaaatccgttcgacctcttggatttcaatcagacccagccagagcggggtgacaataatcttactcgaatcgtgggtgggcaggaatgcaaggatggggaatgtccatggcaggctctgctcatcaacgaggagaacgagggcttttgtgggggtaccatcttgagcgaattttacattcttacagcagcacattgcctttaccaggctaagcgcttcaaagtgcgcgtgggagatcggaataccgaacaagaagaaggcggagaggccgtgcacgaggtcgaagtggttatcaagcataatagatttacaaaggagacctacgactttgacatcgccgtgcttaggctgaagacaccaatcacattccggatgaacgttgcgcctgcctgccttcccgaacgagactgggccgagtccacattgatgacgcagaagaccggaatcgtaagtggatttggccggactcatgaaaaaggcagacaaagtactcggctgaagatgctcgaggtcccatacgttgatcgcaattcttgcaagctgtcttcatcctttatcataacacagaacatgttctgtgctggctatgacaccaagcaggaggacgcttgccagggcgactccggcggcccccatgtcacaaggtttaaagatacatatttcgtgacgggaattgtcagctggggcgaaggctgtgcacggaaaggaaagtacggcatctacaccaaggttacggcctttctgaaatggattgacaggagtatgaagactagaggactcccaaaagctaagtctcatgcccccgaggtcataacgagttcccccctcaaa

SEQ ID NO: 9253 - DNA, 1464 bp, Artificial Sequence
  Description of Artificial Sequence: Synthetic coding sequence
atgggtaggccactgcaccttgtcctcttgagcgcctccttggcaggtctgctccttctcggagaatccctgtttattcgccgcgagcaggccaacaacattcttgcacgtgtgaccagagccaattcgttccttgaggaaatgaaaaagggccacctggaacgtgaatgcatggaagaaacttgctcgtacgaagaagcacgtgaagtgtttgaagattcagataaaaccaacgagttttggaataagtacaaggatggggatcaatgtgaaacttcaccctgccagaatcaaggtaaatgtaaggatggtttgggagagtacacttgtacctgtctcgaaggctttgaaggaaagaactgtgagctgttcactcgcaagctgtgctcgttggacaacggcgattgtgatcagttctgccatgaggagcaaaactcggtggtgtgttcctgtgcacgcggatacaccttggcagacaatggaaaggcctgtattccaactgggccttatccctgcggtaagcaaactctcgagagacgcaagaggtcggtggcgcaggcaacttcgtcctcaggcgaagccccagatagcataacctggaagccctacgacgcagcagacctggatcccaccgaaaacccctttgacctcctggacttcaaccaaacgcagcctgagcggggagacaataatcttaccaggatagtcgggggacaagagtgtaaggacggggagtgtccttggcaagcccttttgataaacgaagagaacgaaggattttgtggaggcacgattctcagcgagttttacatccttactgcggcacactgcctttaccaagccaagcgcttcaaggttcgcgtgggcgaccggaacactgaacaagaggagggtggagaggcagtgcacgaagtggaagtcgtcattaagcacaacaggttcaccaaggaaacctatgattttgacattgcagtgctgagattgaaaacccctatcaccttccgtatgaacgttgcacccgcgtgcctgccagagcgcgattgggcagagtcaacccttatgacccagaaaactggtattgtgtcaggatttggaagaactcacgaaaagggacgacagagcacccggctgaaaatgctggaagtcccgtacgttgataggaatagctgcaaactttcttcatcatttatcatcactcagaatatgttttgtgccggctacgacacgaaacaggaggatgcatgtcaaggcgattcaggaggccctcatgtgacccgcttcaaagacacgtactttgtgactgggattgtgtcatggggtgaaggttgcgccagaaaagggaaatacgggatctacactaaggtgaccgccttcctgaagtggattgataggagcatgaaaacccgaggtctgcctaaagcaaagtcacatgccccggaggtcatcaccagctctcctctgaaa

SEQ ID NO: 9254 - DNA, 1464 bp, Artificial Sequence
  Description of Artificial Sequence: Synthetic coding sequence
atgggaagacctcttcacctcgtgctcctgtcagcttcgctggctggtctcctgcttctgggtgaatctctgttcatccgcagggagcaggcaaataacatcctcgcaagagtgacgcgtgccaattcgtttttggaagaaatgaaaaagggccatcttgagagagaatgcatggaagagacctgcagttacgaggaggcacgagaggtgttcgaggacagcgataaaacaaacgagttctggaacaaatacaaggatggagatcagtgtgagaccagtccctgccagaatcaggggaagtgcaaggacgggctcggcgagtatacatgtacctgcctcgaggggttcgaggggaagaactgtgaactttttaccagaaagctgtgctcgctggacaacggcgactgtgatcaattctgccacgaagaacagaattccgttgtctgcagttgtgcacgaggctacaccctggcagacaacgggaaagcgtgcatccccacgggaccttacccgtgcggaaaacagactctggagcgcaggaaacggagcgtggcgcaggcaacttcttcttctggagaggccccagatagtatcacttggaagccatacgatgccgcagatctcgaccccaccgaaaatcctttcgacctgcttgatttcaaccagacacaacccgaacggggcgataacaacctgactcgcatcgtcggaggacaggaatgtaaggatggcgaatgtccctggcaagcactcttgatcaacgaggaaaatgagggattttgtgggggaacaatcctctccgaattctatatactcactgcagcccattgtctctaccaggcaaagaggttcaaagtccgcgtcggcgatagaaacacagagcaggaagaagggggagaggcggtgcatgaagtggaggttgtgattaagcataataggtttactaaagaaacatacgacttcgatatcgccgtccttcgcctcaaaacacccatcacgttcaggatgaatgtcgcccctgcatgtttgcctgagagagattgggcagagtctacattaatgactcagaagaccggtatcgtatctggtttcggcaggacacacgaaaaaggaaggcaatcgacccgtcttaagatgcttgaggttccatacgtagatcgcaatagctgtaaactgtcttcctcgtttatcatcacacagaatatgttttgtgcaggatacgatactaaacaggaggatgcttgtcagggcgatagcggggggcctcatgtgacaaggttcaaagatacatatttcgttaccggcatcgtgagctggggtgaggggtgtgcgcgcaaagggaagtatggcatttacacaaaggtgacggcctttttaaaatggatagatcggtccatgaagacgagagggctaccaaaggccaagtctcacgctccagaagtaatcacttccagtccactgaag

SEQ ID NO: 9255 - DNA, 1464 bp, Artificial Sequence
  Description of Artificial Sequence: Synthetic coding sequence
atgggacgcccgctgcacctggtgctcttgtcggcatcacttgcgggacttctcctgctcggtgagtccctgttcatccgtagggaacaggccaacaatatcctggccagagttactcgagcaaattccttcctggaagagatgaagaagggacaccttgagcgcgagtgcatggaagaaacttgcagctatgaggaagcccgcgaagtgtttgaagattccgacaagaccaacgaattttggaacaagtacaaggacggagatcagtgcgaaacttccccgtgccaaaatcagggaaaatgtaaagacggtctgggcgaatacacctgcacttgcctcgagggattcgaaggcaaaaactgcgagctgtttacgagaaagttgtgcagcctcgacaatggggactgcgatcagttttgtcacgaggagcagaactcggttgtctgctcctgtgcccgcggatacacccttgcggacaacggaaaggcctgcattccaaccgggccgtacccctgtgggaagcaaactctggagcggaggaagcggtccgtggcgcaagctactagctcgtccggggaagccccagactcaatcacgtggaagccttacgatgcggcggatctggaccctactgaaaatccattcgacctgctcgacttcaaccagacccaaccggaacgcggagataacaacctgacccggattgtgggaggccaggaatgtaaggatggggagtgtccgtggcaggcactgctcatcaacgaagagaacgaaggcttctgcggagggacgatcctctcggaattctacatcctgaccgccgcccactgcctgtatcaggctaagcgctttaaagtgcgggtgggcgacagaaacaccgagcaagaagaaggaggtgaggcagtccatgaggtggaggtcgtgatcaagcataatcgcttcaccaaggaaacctacgacttcgacatcgcagtgttgagactcaagaccccgattaccttcagaatgaatgtggccccagcttgcttgcctgaacgggactgggcggaatccactctgatgactcaaaagaccggaatcgtctctggcttcggacgcacccatgagaagggaaggcaaagcactcgcctgaagatgctggaagtcccgtacgtggaccggaactcgtgcaagctgtcgtcatcattcatcatcacgcagaatatgttctgcgccggttacgacaccaaacaggaggatgcgtgccagggtgatagcggcggaccacacgtgactagatttaaagatacttacttcgtgactggaattgtctcgtggggcgagggctgtgcacgcaaaggaaagtacggaatctacaccaaagtgactgctttcctcaagtggatcgatcggtcgatgaaaactcgggggctccccaaggctaagtcacatgcccctgaggtcatcaccagcagcccgctgaaa

SEQ ID NO: 9256 - DNA, 1464 bp, Artificial Sequence
  Description of Artificial Sequence: Synthetic coding sequence
atgggacgcccacttcatctcgtgctgttgtccgcgtctctcgcgggacttctcctgctgggagagtccctgttcatcaggagagaacaggccaacaatatcctggctcgagtgacccgcgcaaactcattcctcgaggagatgaagaagggacatctggaacgcgaatgtatggaggaaacctgctcctacgaggaagcccgcgaggtgttcgaggactccgacaaaaccaacgaattctggaacaaatacaaggacggcgatcagtgtgaaacttccccatgccagaaccaaggtaaatgtaaggatggtctgggagaatacacgtgtacgtgcttggagggctttgagggcaaaaactgcgagctgttcactagaaaactttgctcgctggacaacggtgattgcgatcaattttgccacgaagagcagaatagcgtcgtgtgtagctgcgcacgggggtacactctggcggacaatgggaaggcatgcatcccgactggaccctacccgtgcggaaagcagactcttgagcgcaggaaaagatcagtggctcaggctacctcatcgtccggagaggcgccagactcgatcacgtggaagccttacgatgcggcggacttggatccaactgagaatccgttcgacctgctcgacttcaatcagactcaaccggagcgtggggacaataacctgacccgaattgtggggggacaagaatgtaaggacggcgaatgcccttggcaggccctgctgatcaacgaggaaaatgagggattctgcggtggaaccattctttccgagttctacatcctgaccgcagcgcactgcctttaccaagccaagagattcaaagtcagagttggggatcgcaacactgagcaggaagaaggcggggaagcggtccatgaagtggaggtcgtgattaagcacaataggttcaccaaggaaacctatgatttcgacatcgccgttctgcggctcaaaaccccgatcacctttcggatgaatgtggcaccggcctgcctgccggagagagactgggcggagtcgacgcttatgacccaaaagactggcatcgtgagcggatttggaagaactcatgaaaagggtcggcagtctactcgactgaagatgctggaagtgccctacgtggatcggaacagctgcaagctctctagctccttcatcatcacccaaaacatgttctgcgccggatatgacacgaagcaggaagatgcttgccaaggagattcaggaggcccacacgtcacgcgctttaaggatacttacttcgtcactggaatcgtctcatggggcgaagggtgtgctcgcaaaggcaaatacggtatctacactaaggtcaccgcctttttgaagtggatcgaccggtccatgaaaacgaggggcctccccaaagctaagtcacacgccccagaggtcataacttcgtctccgcttaag

SEQ ID NO: 9257 - DNA, 1464 bp, Artificial Sequence
  Description of Artificial Sequence: Synthetic coding sequence
atgggccgtccactgcacctcgtgctgctgtcagcatcattggccggcctgcttcttctcggcgagagcctgttcatccgcagggagcaggctaacaatattctcgcgagggtgacaagagccaacagctttctggaagaaatgaaaaagggccatcttgagagggaatgcatggaggagacctgttcctatgaggaagccagggaagtgtttgaagactcagataagactaatgagttttggaataagtacaaggacggggatcagtgcgagacttccccttgccagaatcagggaaagtgtaaggacgggttgggggagtatacttgcacgtgcttagagggatttgagggcaaaaactgcgagctgttcacccgtaaactctgttcgctcgataatggcgattgcgaccagttctgtcatgaggagcagaatagtgtagtgtgctcttgcgcgagggggtatactctcgcagataatggcaaggcctgtatcccgaccggcccatacccatgtggcaagcagactctggagcggcgtaagcgctcagtcgcccaggccacatctagtagcggggaggctcccgactctattacctggaagccttacgatgctgcagatctcgatccaaccgagaacccattcgacttgctcgatttcaaccagactcagcccgagcggggggacaacaatttaacacgtatcgtgggcggccaggaatgtaaggacggcgagtgcccctggcaggcgcttctgataaatgaagagaatgagggcttctgtggcgggacgattctgtcggaattttatatccttaccgcagcccattgcctctatcaagccaagcggttcaaggttagggtcggcgatagaaatacagagcaagaggagggcggcgaggctgtccacgaggtagaggttgtgattaaacacaatcgttttaccaaggaaacctatgacttcgacatcgcagtgctgcgtctcaagacccccatcacatttcgcatgaacgtcgcccccgcctgcctaccggaacgagactgggccgagagtacgctgatgacacagaagactgggattgtgtccggttttgggcgcacacatgaaaaaggacggcaaagcactagactaaagatgcttgaggtaccttacgtggatagaaactcttgtaagctcagtagtagttttataattacccaaaacatgttttgtgccggatatgacactaagcaagaagatgcctgtcagggagacagtggcggcccccacgtgacacgcttcaaagacacgtatttcgttaccgggattgtgtcctggggggaaggatgcgctagaaaggggaaatacggtatttatacgaaagtcactgcatttcttaagtggattgacaggtctatgaaaacaaggggactgccgaaagcgaaatcacacgccccagaggtgataacgtcaagcccccttaag

SEQ ID NO: 9258 - DNA, 1464 bp, Artificial Sequence
  Description of Artificial Sequence: Synthetic coding sequence
atgggtcggcccctgcaccttgtgcttctaagcgcttccctcgccggtctcttactactgggagaatctttgttcatcagacgtgaacaggccaataatatcctagcacgagtgacacgcgcaaatagcttcctggaggaaatgaaaaagggtcacctggagagagagtgcatggaagagacctgtagctatgaggaagctagagaagtgttcgaggactccgacaagacgaatgagttttggaataaatataaagacggtgaccagtgtgagacgagcccatgccagaaccagggcaaatgcaaagatggattgggagagtacacatgcacttgcctggagggatttgagggtaagaattgtgagctgtttacaaggaaactgtgttcattggacaacggcgactgcgatcagttttgtcacgaggagcagaacagtgtggtgtgctcttgtgcccggggatacactctagctgacaacggcaaagcgtgtatcccgacagggccatacccatgcggtaaacagacattggaacggagaaagaggtccgtcgcccaggcaacgtcctcctccggagaggcaccagacagtattacctggaagccctacgatgctgccgatctggatcccaccgaaaaccccttcgatctgctagacttcaaccagacacagcccgaaaggggagataataacctgactcgtattgtgggcggccaggagtgtaaagatggtgaatgcccgtggcaggcgttattgattaatgaagagaacgagggtttttgtggcggcactatcctatccgaattctacatcctaaccgccgcccattgcttgtaccaggccaagcgctttaaggttagagtcggagacaggaatacagaacaggaggaaggcggcgaggcagtgcacgaagtagaggttgtgatcaaacataatcggtttaccaaggagacctatgacttcgacatcgcagtccttcggctgaagacacctatcacttttagaatgaatgtggcccctgcttgcctcccagaaagggactgggcagaatcaaccctgatgacccaaaaaaccggtatcgtatccgggttcggccggactcacgagaagggacgacagtctactagacttaaaatgctcgaggtcccctacgtggacaggaattcttgtaagttgtccagcagctttatcatcacacaaaacatgttttgtgccggctacgataccaaacaggaggacgcatgccagggcgacagtggcggtccgcacgtaactcgcttcaaagatacgtacttcgtcaccggtattgtgtcgtggggtgaaggctgcgctcgtaaaggcaaatatgggatctacacaaaggtaaccgcattcctgaagtggatcgatcgaagcatgaagaccagaggcctgcctaaggcaaagtcacatgcacccgaagtgattacttcatctcccttgaaa

SEQ ID NO: 9259 - DNA, 1464 bp, Artificial Sequence
  Description of Artificial Sequence: Synthetic coding sequence
atgggacgcccactgcacttggtcctgctgagcgcttcgctggctggcttgctgctgctcggcgagagcttgttcatccggcgcgaacaagccaacaatatcttggcccgggtgacccgggctaattcctttctcgaggaaatgaaaaagggccatcttgagcgggagtgtatggaagaaacctgttcctacgaggaggcccgagaagtgtttgaggattcggataagaccaatgaattctggaataagtataaggacggcgatcagtgcgaaacctccccttgccagaatcagggcaagtgcaaggacggactcggagagtacacctgcacttgcctggaggggttcgagggaaagaactgtgaactgttcactcggaagctgtgctcactcgacaacggcgattgcgaccagttctgccatgaggaacagaacagcgtggtctgctcgtgtgcgcggggctacactctcgcagacaatggaaaggcctgcatcccgaccggtccgtacccatgcggaaagcaaactctggaacgccgcaagcggtcagtggcccaggcaacctccagctcaggagaagctccggacagcatcacctggaagccgtacgatgcggccgatctcgaccctactgagaatcctttcgacctcctggacttcaaccagacccaaccggaacgcggtgacaacaacctgacccgcatagtcggaggtcaggaatgcaaagacggagagtgtccgtggcaagctcttctgattaacgaagaaaatgaaggattctgcgggggtactattctgtctgagttctacatcctgaccgccgcacactgcctgtatcaggcgaagaggttcaaggtgcgcgtgggtgatcggaatactgaacaggaggagggcggagaggccgtccacgaggtggaggtggttatcaagcataaccggttcactaaggagacttacgacttcgatatcgcggtcttgcgtcttaagacccccatcaccttccggatgaacgtggcaccggcgtgtctgccggagcgcgactgggcagagagcactctcatgactcaaaagaccggcatcgtgtcgggattcggacggacccacgagaagggaaggcagtccactcgcctgaagatgctggaggtgccatacgtcgaccgcaattcctgcaaactctcgtcctcctttatcattacccagaatatgttttgcgccggatacgacactaagcaggaggacgcctgccagggggatagcggaggaccacatgtgactcgattcaaggacacttactttgtcactggcatcgtgtcctggggagagggctgcgcacgcaagggcaagtacggcatctacaccaaggtgaccgccttcctcaagtggatcgataggtccatgaaaactagaggactccctaaagcaaagtcccacgccccagaagtcattacgtccagcccactgaag

SEQ ID NO: 9260 - DNA, 1464 bp, Artificial Sequence
  Description of Artificial Sequence: Synthetic coding sequence
atgggtcgtccccttcatcttgtgctgctttcagcctcccttgcaggactgctgctgctcggagagtctctgtttatccggagggagcaagcaaacaatattctggcccgtgtcactagagcaaactcattcctcgaagagatgaaaaaaggccacctggaaagggaatgtatggaggaaacgtgttcatacgaagaagcacgggaagtctttgaggattccgacaagacgaacgagttttggaataagtacaaggatggagatcagtgcgaaaccagcccctgccaaaatcaaggcaagtgtaaggatggactgggcgaatacacttgtacgtgtctggagggcttcgaaggaaagaactgtgagttgtttactagaaagttgtgcagccttgacaacggggactgcgaccaattctgtcatgaagaacaaaactcggttgtctgcagctgtgcacgaggatacaccctggcagataacggaaaggcttgtattcctactggtccctacccttgtggtaaacagacccttgagcgacgcaagcggtcggttgcacaggcgacctcctcgtcgggagaagctcctgattccatcacttggaagccctacgacgcagccgatcttgacccaactgaaaaccctttcgatcttcttgatttcaaccaaactcaaccagaacgtggcgacaacaaccttacccggatcgtcggagggcaagaatgtaaagatggagaatgtccatggcaagcgcttctcattaatgaagaaaacgaaggcttctgcggtggaactattctttccgaattctacattcttaccgcagctcactgtctgtaccaagccaaaagattcaaggtgcgagtgggagacaggaataccgaacaggaagaaggcggcgaagcagtgcacgaagttgaagtggtcattaagcataatcgatttactaaagagacttacgatttcgatattgcagtgcttaggttgaaaactcccatcacttttcggatgaacgtggcaccagcatgtctccctgaacgtgactgggccgaatccaccctgatgacccaaaagacgggaatcgtcagcggtttcggaaggacccacgagaagggtaggcagtcgacccggctgaagatgcttgaagtgccttatgtggacagaaacagctgtaagctctcgtcgtcattcatcattacgcagaatatgttttgtgcaggctacgataccaaacaagaggacgcctgtcagggagattccggtgggccacatgtgactcgctttaaagatacttacttcgtgaccggaattgtctcatggggtgaaggatgtgcaagaaagggcaaatacggaatctatactaaggtaactgcgtttctgaagtggatcgacaggtcgatgaaaactagaggacttcctaaggcaaagagccatgcccctgaagtcattactagctccccccttaag

SEQ ID NO: 9261 - DNA, 1464 bp, Artificial Sequence
  Description of Artificial Sequence: Synthetic coding sequence
atgggacggcctcttcaccttgtgttgctctcagcatctctggccgggttgctgctcttgggagaaagcctgtttattcggcgagagcaagcaaacaatatcctggcaagggtgactcgggcgaactcctttctggaggagatgaaaaagggtcatctggaaagagaatgcatggaggaaacctgcagctatgaagaggcccgtgaagttttcgaagattccgataagaccaacgaattctggaataagtataaggatggggaccaatgtgaaacctcgccgtgccaaaaccagggtaagtgcaaagatggacttggtgagtacacctgtacctgcctggagggctttgaaggaaaaaactgtgagcttttcacgagaaagctgtgttcgctggacaacggtgattgcgaccagttttgtcatgaagaacagaattcggtcgtgtgtagctgtgcccgaggttacaccctggccgataatggcaaggcatgtatacccactggtccgtacccttgtggtaaacaaaccctcgagagacgtaagaggtcagtggcacaggccacttcatcatccggtgaggccccagattcgattacctggaaaccttacgatgccgcagatttggatcctactgaaaatccattcgacctgctcgacttcaaccaaactcaaccagagagaggtgacaataaccttacgagaattgttggtggccaagaatgcaaggatggtgaatgtccatggcaggccctcctgattaacgaggagaacgaaggattttgtggtggcaccattttgtcggagttttacattctgactgctgcgcattgtctgtaccaagcaaagcgttttaaggtgcgtgtgggggatcgtaataccgaacaggaagaaggaggtgaagctgtgcacgaggtggaagtggtgataaagcacaaccggtttacgaaagaaacttacgacttcgatattgccgtccttagactgaaaacccctatcacctttcgcatgaacgtggcacctgcatgtctcccagagagagattgggcagagagcactctgatgacccaaaaaaccggaattgtgtcaggcttcggcagaacccacgaaaaaggtagacaatcgacccggctgaagatgcttgaggtcccttacgtggataggaattcgtgtaaacttagctcctccttcatcattactcagaatatgttttgtgcaggatacgataccaaacaggaggatgcatgccagggggattcggggggtccacatgtgaccagatttaaggatacctacttcgtcaccggaattgtctcgtggggagaaggatgtgcgcgaaagggtaagtacgggatatacactaaagtgaccgcctttcttaaatggatcgacaggtcaatgaaaactagaggtctgcctaaggccaagagccacgcaccggaagtgattactagctcgccgctcaag

SEQ ID NO: 9262 - DNA, 1464 bp, Artificial Sequence
  Description of Artificial Sequence: Synthetic coding sequence
atgggtcggccgctgcacctcgtgctgttgtccgcatcattggcgggtctgctgctgctgggggagtccttgttcatccgccgcgaacaggccaataacatcctggctcgcgtgacccgagctaactctttcctggaggagatgaaaaaaggtcacctggaaagagaatgcatggaggaaacttgcagctacgaggaggcccgcgaggtctttgaggattcagacaagactaacgagttctggaacaaatacaaagatggagatcaatgcgaaacttcgccatgccagaatcaggggaagtgcaaggacggactgggggaatacacctgcacgtgccttgaaggcttcgagggcaagaattgtgagctgttcactcgcaagctgtgcagtctggataacggcgactgtgaccagttctgtcacgaagaacaaaactccgtcgtttgctcatgcgctcgcggctacactttggcagacaacggaaaggcttgcatcccgaccggcccgtacccttgcgggaagcagaccctggaacggagaaagagatcggtggcccaggctacctcatcatccggtgaagccccagactccatcacctggaagccgtacgacgccgcggacctggatccaacggaaaacccattcgatctcctcgacttcaatcaaacccagcccgaacggggcgacaataacctgacgaggatcgtgggaggacaagaatgtaaggatggggaatgcccgtggcaggccctgctcatcaatgaagagaacgaaggattctgcggaggcactatcctgtcagagttttacatactcaccgcggctcattgtctctaccaggccaaaagatttaaggtacgagtgggcgatcggaataccgaacaagaagaagggggagaggcagtgcacgaagtcgaggttgtcatcaagcataaccgcttcaccaaggagacttacgacttcgatattgctgtgctgaggctgaaaaccccaattacctttcggatgaatgtcgcgcccgcctgccttccggagagggactgggcggaatcgacgttgatgactcaaaaaacgggaatcgtgagcggttttggaaggacgcatgaaaagggtcgccaatcgacccgccttaagatgcttgaagtgccttacgtggaccggaactcgtgcaagctgagcagctcttttatcatcacgcagaatatgttctgtgcgggatacgacaccaaacaggaggatgcatgccagggtgattccggaggtccgcacgtcactcgttttaaggacacctatttcgttaccggcatcgtgagctggggagaggggtgtgcgagaaaaggaaagtacggaatctacactaaagtaactgccttcctcaaatggatcgatcgctcaatgaaaactaggggactgccgaaggctaaatcccacgctcctgaagtgattacttcttcgccgttgaag

SEQ ID NO: 9263 - DNA, 1464 bp, Artificial Sequence
  Description of Artificial Sequence: Synthetic coding sequence
atgggccggccattgcacctagtgttgcttagtgcttcgctggcaggtttacttttgcttggggagagcctttttattcgccgagaacaggctaacaatatcctggctcgggttacaagagcaaacagtttcctcgaggagatgaagaaggggcacctggagcgtgagtgcatggaagagacgtgttcttacgaagaagcgcgtgaggtgtttgaagattctgacaaaactaacgagttctggaacaaatataaggatggcgatcagtgtgaaaccagcccatgtcagaatcagggaaaatgcaaggacggtctcggcgaatacacatgcacctgtctggagggctttgaaggcaagaattgcgagctgttcacccgcaagctttgtagcctagataacggagactgcgatcagttctgtcacgaggagcagaactcagtggtatgttcatgtgccagaggatacaccctggcagacaacgggaaagcatgcattccaaccggcccatatccatgcggcaaacagacactggaacgacggaaacggtctgttgctcaagcaactagcagctcgggtgaagcacctgactccattacatggaagccatacgacgccgcagatctggatcctaccgagaatccttttgatctgcttgattttaaccaaacccaaccagagagaggagacaacaacctgacccggattgtgggtggccaggagtgtaaggatggcgagtgcccatggcaggccctgcttatcaacgaagaaaatgaagggttttgcggtggtaccatccttagcgagttctatatattaaccgcagcccactgtctataccaagctaaaaggttcaaggttcgcgtcggtgacaggaacacagagcaagaagaggggggggaggctgtacatgaggtcgaggtcgtcattaaacacaaccggttcacaaaggagacttatgactttgacattgctgtcttgcgccttaagactccaatcacgttcaggatgaacgtggctcctgcttgtcttccagaaagagattgggccgaatctacactgatgacacagaaaactgggattgtgtccggtttcggccgcacacacgaaaaaggcaggcaatctacgagactcaagatgctcgaggtcccatacgtagataggaattcttgcaaactctcttccagctttattatcacccagaatatgttttgtgccggctacgacacaaagcaggaggacgcttgtcaaggggatagcgggggaccacacgtcactcgcttcaaggacacatacttcgtcaccggaatcgtttcgtggggtgagggctgtgcccgcaaagggaaatacgggatttatactaaggtgaccgcatttcttaaatggatcgaccggtctatgaaaacccgtgggctccctaaggcaaagtcacacgcgccagaggtcattactagctcaccattaaaa

SEQ ID NO: 9264 - DNA, 1464 bp, Artificial Sequence
  Description of Artificial Sequence: Synthetic coding sequence
atgggtagaccactgcacctggtgctgctctccgcctcgctcgccggattgcttcttttgggagaaagcctctttatcagaagggaacaagcgaacaatattctcgccagagtcacgcgcgcaaactcgtttctggaggagatgaagaagggtcaccttgaaagagaatgcatggaagagacttgctcatacgaggaggccagggaagtgtttgaagattcggataagaccaatgaattctggaacaagtataaagatggagatcagtgtgaaacctcaccatgtcagaaccaagggaaatgcaaagatggactgggggaatacacttgtacttgtcttgaaggatttgaaggcaagaattgtgaactgttcaccagaaaactttgttccctcgataacggtgattgtgatcagttctgtcatgaggagcagaactcggtggtctgcagctgcgccagaggatacaccctcgcggataacggtaaagcgtgtattcccaccgggccttacccttgtggaaaacaaaccttggagaggcgaaaacgctccgtggcacaagcaacgtcatcgtcgggcgaagcacccgattcgattacctggaagccgtacgatgcagccgaccttgatccaacggagaatccattcgaccttctggatttcaatcagacccaacccgagcgcggcgacaataacctgacgcggatcgtcgggggacaggagtgtaaagacggcgaatgtccttggcaggccctgcttatcaatgaagagaacgaagggttttgtggtggtaccattctttcggagttttacattctgactgcagcccattgcctgtaccaagcaaagcgctttaaagtccgcgttggtgaccggaatactgagcaagaggaaggaggggaggcagtgcacgaagtcgaagtggtgataaagcacaatagattcactaaagaaacttacgatttcgatatagcagtcctgcgtcttaaaaccccaataacgtttcgcatgaacgtggcaccggcatgccttccagagagagactgggctgagtcaactctgatgactcagaaaaccggaatcgtgagcggatttggtagaactcacgagaaggggagacaatctacccgcctgaaaatgctcgaggtcccttacgtcgacaggaattcatgtaaactttccagctccttcattatcactcagaatatgttttgcgccggttacgacaccaagcaggaggacgcctgtcaaggagactcgggcgggccccacgtgactcggttcaaggatacttacttcgtcactggtatcgtgtcatggggggaaggttgtgcaaggaagggcaagtacggtatctatactaaggtgaccgcattcttgaagtggatcgaccggtccatgaaaacgagaggtctgccaaaggcaaagagccatgcgcctgaagttatcacctcatcccctctgaag

SEQ ID NO: 9265 - DNA, 1464 bp, Artificial Sequence
  Description of Artificial Sequence: Synthetic coding sequence
atgggacgccctctgcatttggttctcctctcggcctctttggcgggtctgctgcttctcggggagtccctgttcattcgcagagaacaggccaacaatatcctggcgagagtgacccgcgcgaattcgttcctggaagaaatgaagaaaggacatctcgaaagagaatgtatggaagaaacttgttcatacgaggaggcacgcgaggtctttgaggactctgataagactaatgagttctggaataagtataaggacggtgaccaatgcgagacgagcccgtgtcaaaaccagggcaagtgtaaggacggactgggagaatacacctgcacgtgcctcgaaggttttgaagggaagaactgcgagctgtttaccaggaaactctgcagcctggacaacggcgactgcgatcagttctgtcatgaagaacagaactcggtggtatgctcctgcgcccgggggtacactttggcggacaacggaaaggcctgcatccccactggcccatacccatgcggaaagcagactttggagcggagaaagcggtcagtcgcccaagcgactagtagctcgggcgaggcccctgactcgattacttggaagccgtacgacgctgctgatctggacccaactgagaacccgttcgatctgttggacttcaatcagactcagcccgaacgcggcgacaacaatttgacccgcattgtgggaggacaggagtgcaaggatggggagtgcccgtggcaggccctgctgatcaacgaggaaaacgaaggattttgcggagggaccatcttgtccgaattctacatccttactgcagcccactgcctgtatcaagccaaacgctttaaagtgcgtgtcggagatagaaacaccgaacaggaagaaggaggagaagccgtccacgaagtggaagtggtgatcaaacacaaccggttcactaaagaaacttacgacttcgacatcgccgtcctgcgcctcaagactccgataaccttcagaatgaacgtggccccagcctgtctcccagaacgggactgggctgagtccactctgatgacccaaaagaccggtatcgtgagcgggttcggtagaactcacgaaaagggacgccagagcactcggctgaagatgttggaagtaccgtacgtggaccgaaattcctgcaaactcagctctagcttcattatcactcagaatatgttttgcgcgggctacgacaccaagcaagaggacgcgtgtcagggagattccggaggaccgcatgtgacccgctttaaggacacgtacttcgtcaccgggatcgtctcatggggcgagggatgtgctcggaagggcaaatacggaatctacactaaggtcactgccttcctgaaatggatcgataggtccatgaaaacccgcggcctgcctaaagcaaagagccatgcaccggaggtcatcactagctcaccactgaaa

SEQ ID NO: 9266 - DNA, 1464 bp, Artificial Sequence
  Description of Artificial Sequence: Synthetic coding sequence
atgggcaggcccttgcaccttgtcctgctgtctgccagcttggctggactgctgttgcttggcgagagtctgttcattcgcagggagcaggcaaataatattctcgcacgtgttaccagggctaacagctttttggaggagatgaaaaaaggtcaccttgagagggagtgtatggaggagacatgttcctacgaggaggcaagagaagtttttgaggattccgacaaaaccaacgagttttggaacaaatacaaggacggtgaccagtgtgagactagcccttgccagaaccagggaaagtgtaaggatggcctcggtgagtacacctgcacttgtctggagggtttcgagggaaaaaactgcgaactcttcaccaggaaattgtgctctctcgacaatggtgattgcgaccaattctgccatgaggaacaaaattctgtcgtgtgcagctgtgcccgtggttacaccctggcagacaacggaaaagcctgcatccctaccggtccttacccatgtggaaagcagaccctggaacgtagaaaaagatccgtggcacaagcaaccagcagcagtggcgaggccccagacagcatcacttggaaaccatacgatgcagccgacctcgacccaactgaaaatccttttgatctcctcgacttcaaccagacacagcctgaacgcggagacaacaatcttactaggattgttggtggtcaagagtgtaaggacggtgaatgcccatggcaggcactgctgatcaacgaagagaacgagggcttctgtggcggcaccatactgtctgagttctatattcttaccgctgcccactgtctgtaccaagccaagcgcttcaaagtccgcgtcggtgacagaaacactgagcaggaggaaggcggtgaggctgttcacgaggtcgaggttgtcataaaacataacaggttcaccaaagagacctatgactttgacattgccgtgctgagattgaaaactccaatcacattcaggatgaacgtggcaccagcttgcctgccagaacgcgactgggccgagagtacactcatgacccagaaaactggaatcgtatccggcttcggtcgcacccatgaaaagggccgccagtcaactaggctgaagatgcttgaggtcccctacgtggatcgtaactcctgcaaactgagctccagcttcatcattacccaaaatatgttttgcgctggctacgatactaagcaagaggatgcttgtcaaggtgattccggtggtccccatgtgacaagattcaaggacacctattttgtgactggcatcgtgagttggggtgagggctgtgcacgcaaaggaaaatacggaatctacactaaagtgaccgctttcctgaagtggattgaccgcagcatgaaaacccgtggcctccccaaggcaaagtcccacgctcccgaagtaatcacatcatctcctttgaaa

SEQ ID NO: 9267 - DNA, 1464 bp, Artificial Sequence
  Description of Artificial Sequence: Synthetic coding sequence
atgggtcgtccgctacatttagtattactatcggcgtcgttagcgggtttactactattaggtgaatcgttatttatacgtcgtgaacaagcgaataatatattagcgcgtgtaacgcgtgcgaattcgtttttagaagaaatgaaaaaaggtcatttagaacgagaatgtatggaagaaacgtgttcgtatgaagaagcgcgtgaagtttttgaagattcggataaaacgaatgaattttggaataaatataaagatggtgatcaatgtgaaacgtcgccgtgtcaaaatcaaggtaaatgtaaagatggtctaggtgaatatacgtgtacgtgtttagaaggttttgaaggtaaaaattgtgaactatttacgcgaaaactatgttcgttagataatggtgattgtgatcaattttgtcatgaagaacaaaattcggttgtttgttcgtgtgcgcgaggttatacgttagcggataatggtaaagcgtgtataccgacgggtccgtatccgtgtggtaaacaaacgttagaacgtcgtaaacgatcggtagcgcaagcgacgtcgtcgtcgggtgaagcgccggattcgataacgtggaaaccgtatgatgcggcggatctagatccgacggaaaatccgtttgatttactagattttaatcaaacgcaaccggaacgtggtgataataatctaacgcgaatagtaggtggtcaagaatgtaaagatggtgaatgtccgtggcaagcgctattaataaatgaagaaaatgaaggtttttgtggtggtacgatattatcggaattttatatattaacggcggcgcattgtctatatcaagcgaaacgatttaaagtacgagtaggtgatcgaaatacggaacaagaagaaggtggtgaagcggtacatgaagtagaagtagtaataaaacataatcgttttacgaaagaaacgtatgattttgatatagcggtactacgtttaaaaacgccgataacgtttcgtatgaatgtagcgccggcgtgtttaccggaacgagattgggcggaatcgacgttaatgacgcaaaaaacgggtatagtatcgggttttggtcgtacgcatgaaaaaggtcgtcaatcgacgcgtttaaaaatgttagaagtaccgtatgtagatcgaaattcgtgtaaactatcgtcgtcgtttataataacgcaaaatatgttttgtgcgggttatgatacgaaacaagaagatgcgtgtcaaggtgattcgggtggtccgcatgttacgcgttttaaagatacgtattttgttacgggtatagtatcgtggggtgaaggttgtgcgcgtaaaggtaaatatggtatatatacgaaagtaacggcgtttttaaaatggatagatcgatcgatgaaaacgcgaggtctaccgaaagcgaaatcgcatgcgccggaagtaataacgtcgtcgccgctaaaa

SEQ ID NO: 9268 - DNA, 1464 bp, Artificial Sequence
  Description of Artificial Sequence: Synthetic coding sequence
atgggaagaccacttcatttggtgctgctgagcgccagcctcgcaggtctgctgctgctgggcgagagtctgttcataaggcgcgagcaggcaaacaacatcctggcgcgggtgacccgcgcaaacagtttccttgaggaaatgaagaaaggccacctcgaaagagagtgtatggaagagacatgtagttatgaggaggccagagaggtctttgaagatagcgacaaaacgaatgagttctggaacaagtacaaagatggcgaccagtgcgagactagcccttgccaaaatcagggtaaatgtaaggatggactgggcgagtacacatgtacgtgccttgaggggtttgagggtaaaaactgcgagctctttactcggaagctgtgtagcctggataacggggactgcgatcagttctgtcacgaagagcaaaacagcgtagtgtgtagttgcgcacgcggctatactctcgctgacaacgggaaggcatgcattcctaccggcccgtatccttgtggtaagcagaccctggagagaaggaaaagaagtgtagcgcaggcaacatcaagctccggggaggcccccgattcaatcacatggaagccatacgatgccgctgacctggatcccaccgaaaaccctttcgacttgttggatttcaaccagacccagcctgagagaggggacaacaatttgaccagaatagtgggcggacaggaatgtaaagacggagaatgtccttggcaggctctgctcataaatgaggagaatgaaggtttttgtggaggtacgatcctgtctgagttctacatactgacggctgctcactgtctgtaccaggccaagagatttaaggtcagggtgggggacagaaacacagagcaagaagagggcggtgaggcagtccatgaggtggaggttgtcatcaagcataaccgcttcacaaaagagacctacgactttgacattgccgtcctgcggctcaagactcccattacgttccgcatgaatgtggcaccagcctgcctgcccgagcgagattgggcagaatctacactcatgactcagaagaccggcatcgtgtccggcttcggtcgcacgcacgagaaggggaggcagagcacaaggctgaaaatgttggaggtgccatatgtcgataggaattcttgtaagctcagctcctccttcattataacccagaacatgttttgcgcaggttacgacacaaagcaggaagatgcctgccagggcgatagcggaggcccacacgtaacgcggtttaaagatacctattttgtgactgggatagtgagctggggagagggatgcgctcggaagggtaaatacggcatctacaccaaggtcacagctttcctgaagtggatagatcgctcaatgaagactagagggctgccaaaagccaagtctcatgctcccgaagtgattactagctcaccactgaag

SEQ ID NO: 9269 - DNA, 1464 bp, Artificial Sequence
  Description of Artificial Sequence: Synthetic coding sequence
atgggtaggcccctgcacttggttttactaagtgcttcgctggccggcctgctgctgcttggcgagagcctttttattcgcagagagcaggctaacaacattctagctcgagttacccgggccaattcattcctcgaagaaatgaagaaggggcatctggagcgggaatgtatggaagaaacttgctcatatgaggaagctcgtgaggtcttcgaagattctgacaagaccaacgaattctggaacaagtataaagacggggaccagtgtgagaccagtccgtgtcagaatcaaggcaaatgcaaggacggtctcggagagtacacctgtacgtgcctggaaggcttcgaggggaagaattgtgaactttttacaaggaagctgtgctcacttgataatggcgattgtgaccagttttgtcatgaggaacagaactctgtcgtgtgctcctgcgctagggggtacacactcgcagacaatggtaaggcctgcatccctaccggcccctacccttgtgggaagcagacgctagagcgccgcaagcgatctgtggcacaagcaacctcttcatctggagaagccccggactccattacttggaaaccatacgatgcggccgatctcgatccgacagaaaaccccttcgatttgctggactttaaccaaacccagccagagcggggcgacaataacctcacgcgcattgttggaggccaagagtgtaaagacggtgaatgcccctggcaggcgcttctgataaacgaggaaaacgagggtttttgcggcggcaccattctgagcgagttctacatcctaaccgcggctcactgtctctaccaagccaagagattcaaggttcgcgtgggtgaccggaatacagagcaagaggagggaggggaggcggtgcatgaagttgaagttgttattaaacataatcgctttacgaaagagacatatgacttcgatattgccgtgctgaggttgaagacacccatcacgttccgcatgaatgtcgcccctgcttgcctgccagaacgcgattgggctgagtcaaccctgatgacacagaaaacaggcattgtgtcaggctttggcagaactcatgaaaaaggccggcagtccacaagactgaagatgctggaagtcccgtatgtcgacaggaattcctgcaagctgtcaagtagcttcataatcacccaaaacatgttttgcgctgggtatgatacgaaacaggaggatgcctgtcagggggacagcgggggccctcatgttaccagatttaaggatacctacttcgtcacgggcatagtatcctggggcgagggttgcgcgcgcaagggaaaatatggcatctataccaaagttactgcattcctgaaatggattgaccgcagcatgaagaccagagggctccctaaggctaaatctcacgctccagaggttatcactagctcgccccttaaa

SEQ ID NO: 9270 - DNA, 1464 bp, Artificial Sequence
  Description of Artificial Sequence: Synthetic coding sequence
atgggtcggcctttacatttagtccttctgtctgcctcacttgccggactccttctccttggagaatcattgttcattcgacgtgagcaggctaataatatattggctcgagtgacacgagcaaatagttttttggaagaaatgaagaaaggacatttggagagagaatgtatggaagaaacatgctcctatgaagaggctagagaagtgtttgaggattcggataagacaaacgaattttggaacaagtataaggatggtgatcaatgtgaaaccagtccgtgtcaaaatcaaggtaaatgtaaggatggactgggagaatacacatgcacatgtctagaaggcttcgagggtaagaactgcgagctttttacacgaaaattgtgttcacttgataacggagactgcgatcagttttgccatgaagagcaaaactctgtggtctgttcttgtgcacgtggatacactctcgctgacaatggaaaggcttgcattccaactggcccatatccgtgtggaaaacaaaccctcgaacgaagaaaacgttcagttgcacaggcgacttcgtcctcgggtgaagcaccagattctatcacgtggaagccatacgacgcggctgatttagacccaactgaaaatccattcgatctgttggattttaatcagacacaaccggaacgaggagataataatctcacacgtatcgtaggaggccaagaatgcaaagatggtgaatgcccatggcaagcacttcttattaatgaagagaatgaaggattttgtggagggactatcctttcagaattctacattctcacggcggctcattgcttgtaccaagccaaacgatttaaagttcgtgttggtgacagaaatactgaacaagaagaagggggtgaagcggttcacgaagtagaagtcgtaattaagcacaatcgtttcacaaaggaaacctatgatttcgatatcgccgtgctgagacttaaaacacctataacctttcgcatgaatgtggctccagcctgtctgccagaaagagattgggccgagtcaaccctgatgactcagaagactggcattgtatcgggcttcggtagaacacacgagaagggaaggcaatcaactagactgaagatgttggaggtgccatacgtggatagaaattcatgtaaactgtcctctagtttcatcatcacacagaatatgttttgcgcgggatatgatactaagcaagaagatgcttgtcaaggggattctggaggaccgcatgtaacacgattcaaagatacgtacttcgttacgggaattgtgtcctggggcgagggttgcgctagaaaaggaaaatacggtatatacacaaaggttactgccttccttaaatggattgacagatcaatgaagacgcgtggattaccgaaagctaaatctcatgcgccagaagtcataacgtcttcaccattgaaa

SEQ ID NO: 9271 - DNA, 1464 bp, Artificial Sequence
  Description of Artificial Sequence: Synthetic coding sequence
atgggacgccctttgcatctcgtgctcttgtctgcatcgctggctggtctgcttcttcttggggaatcactctttatacgccgggagcaagcaaacaatatcctcgcacgcgtgaccagggcaaactcctttctggaggagatgaagaaaggccatctcgaacgggaatgtatggaggaaacctgctcatacgaggaggcgcgggaggtgttcgaagatagcgataagactaatgagttttggaacaagtacaaggatggtgaccaatgcgaaacctcgccctgtcaaaaccaagggaaatgcaaggatgggcttggagagtacacttgtacctgtctcgaaggcttcgagggaaagaactgcgagctctttacccgtaagctgtgcagccttgataatggcgactgtgatcagttctgtcatgaggaacagaactccgtggtttgctcctgtgcacgaggttacaccctcgcagataacggaaaagcctgtatccctactggaccatatccatgcggtaagcagacgcttgaacgtagaaagcgctccgtcgcacaagctacctcatcatccggagaggcacctgactcaattacttggaagccctatgacgcagcagacctggatccaactgaaaatccgtttgaccttctggatttcaaccagactcaacctgaaagaggcgacaataatctgactaggatagttggtggacaagaatgtaaagacggagaatgtccatggcaagctctgctgattaatgaggagaacgaagggttttgtggtggcaccattctttctgaattctacatcctgaccgcggcacattgcttgtaccaagcaaaacgttttaaggtcagagtcggagatcgcaacactgaacaggaagaagggggagaagcagtgcatgaagtggaagtggtgattaaacacaataggtttaccaaggaaacgtacgactttgatattgcggtgttgcgacttaaaaccccaataacctttagaatgaacgtggcacctgcctgtctcccagaacgggactgggcggaatcgaccctcatgacccagaaaaccggaattgtctcgggattcggtagaacccatgaaaaggggcgtcaatcgactcgccttaagatgctcgaagtgccatacgtggatcgtaactcctgtaaactttcttcatcctttatcatcacccagaatatgttctgtgccggttacgatactaagcaagaagatgcatgtcagggtgactccggaggtcctcatgtgaccagatttaaggatacttactttgtcaccggtatcgtgtcgtggggagaaggatgcgcacgcaaaggcaagtacggtatttacactaaggtgactgcctttcttaagtggatcgataggtcgatgaaaacgcggggactgcctaaggcaaagtcacatgctcctgaagtgattacctccagccctcttaag

SEQ ID NO: 9272 - DNA, 1464 bp, Artificial Sequence
  Description of Artificial Sequence: Synthetic coding sequence
atgggtaggcccctgcatttggttctactgtctgcaagtctggcaggcctgttactgcttggagagagtctgtttatccggagggaacaggccaacaatatcctggcacgggtgacccgggccaacagcttcctggaagagatgaagaaaggtcacttggagcgggaatgcatggaagagacttgttcctacgaggaggcaagggaggtgttcgaagacagcgacaagactaatgaattttggaataaatacaaggacggggatcagtgcgagactagcccatgccagaaccagggtaagtgtaaagacggtttgggggagtatacctgtacatgtttggaaggttttgaaggtaaaaattgcgaactcttcacaagaaaactctgttccctggataatggagattgtgatcagttttgccatgaagagcagaattcggtggtgtgctcatgtgcccgcggttacacccttgctgacaacgggaaggcctgtatccccaccgggccatacccatgcgggaaacaaacgctggagagacgaaaaaggtcagttgcccaagcgacgtcatcaagcggcgaagctcctgactccattacgtggaagccgtacgatgctgcggatctggacccaactgagaacccctttgatctgctggactttaatcaaacacagcccgaaagaggtgataacaatctgactcgcatcgtgggtggtcaggaatgcaaggacggggagtgtccatggcaggcactactaatcaacgaggaaaacgagggtttctgtggcggcaccatcttgtctgagttttacattttgaccgccgctcattgtctctaccaggcaaaacgatttaaagttcgggttggggatcggaatacagaacaggaagagggcggcgaggcagtgcacgaggtagaggtagtaattaagcacaatcgcttcactaaagagacgtatgacttcgatatcgcagtcctccgcttgaagacacctataacatttcgcatgaacgttgcccctgcctgtctgcccgagcgcgactgggccgagagtacattaatgacccagaagacgggaattgtctctggcttcggtagaacacatgagaagggaagacagtccacacgccttaaaatgctggaagtgccctacgtcgatcgcaactcctgtaagctgtccagctctttcataattactcaaaacatgttttgcgcaggatacgacacaaagcaggaggacgcatgccagggagattcaggcggaccccacgtaacacgcttcaaggatacctacttcgtgactgggatcgtgtcatggggagaagggtgcgcccggaagggaaaatacggcatctacacgaaggtaaccgccttcctgaaatggatcgaccgctctatgaagactcgcgggctgcccaaggcaaaatctcacgctcctgaggtaatcactagttctccattgaag

SEQ ID NO: 9273 - DNA, 1464 bp, Artificial Sequence
  Description of Artificial Sequence: Synthetic coding sequence
atggggcgccccctccatctggtgctgctgtcagctagccttgctggactgttactgctcggggaaagcctgtttataaggagagaacaggctaacaacatcctggcacgggtgaccagagccaatagcttcctcgaggagatgaagaaggggcatcttgagcgggagtgtatggaggaaacctgctcgtacgaggaggcccgggaagtctttgaggactctgataagacaaatgaattctggaacaagtacaaggatggagaccagtgcgagacaagcccttgtcagaaccaggggaagtgtaaagacgggctgggggaatatacctgcacgtgcctcgagggttttgagggcaagaactgcgaattgtttacccgtaaattgtgtagcctggacaatggcgactgtgaccagttttgccatgaggagcaaaacagcgtagtctgctcgtgtgcacggggctatactttggccgataacggcaaggcctgcatacccacaggtccttatccatgtgggaaacagactctggaaaggaggaaacgatctgtcgcacaggcgaccagcagctctggcgaggcccccgactcgattacttggaagccttatgacgctgccgaccttgatcccactgagaacccctttgacctgctggatttcaaccagacacagccagaacgtggcgacaacaacttgacacggatagtaggtgggcaggagtgtaaggacggagagtgtccctggcaggccctcctgatcaacgaggaaaacgaagggttctgtggtggcactatcctgtcggagttctacatcttgaccgccgctcattgcctctaccaagccaagaggttcaaggtgcgagttggcgaccgaaacacggagcaggaggagggtggagaggcagtacacgaggtcgaggtggtgattaagcacaaccgcttcacaaaggaaacatacgatttcgatatcgccgtgctccgcctgaagactcctatcacttttcggatgaacgttgcaccggcatgcttacccgagcgtgattgggctgaatctactctgatgacacagaagactgggatagtttctgggttcggccggacgcatgagaaggggcgccaatccacgaggctcaagatgttagaggtgccctatgtggataggaactcttgtaagctgtctagcagtttcatcataactcaaaatatgttctgcgccggatacgacacgaaacaggaagatgcctgccagggagactcaggggggccacatgtgactagattcaaggacacgtactttgttacaggcatagtttcatggggggaggggtgcgcacggaaggggaaatatgggatctacaccaaggtgaccgccttcctcaagtggatagataggagcatgaagacgcgaggtctgcctaaggccaaaagccacgcacctgaagtaataacctccagtcctctaaag

SEQ ID NO: 9274 - DNA, 1464 bp, Artificial Sequence
  Description of Artificial Sequence: Synthetic coding sequence
atgggccgacctcttcatctggtattgctgtcagcatcgctcgccgggctgcttcttctgggagagtcgctgtttattcggagggagcaggctaacaacattctggcacgggtgactcgcgccaatagctttctggaggaaatgaagaaggggcatctcgaaagagagtgtatggaggaaacctgttcctacgaagaggcgcgcgaggtgtttgaggattccgataagaccaacgaattttggaacaagtacaaagacggcgatcaatgtgaaacctccccatgtcagaaccaaggcaagtgtaaggacggactgggtgaatatacctgtacctgcctcgaaggtttcgagggaaagaactgcgaacttttcaccaggaagctgtgctcgcttgataatggtgattgtgatcaattctgccacgaggaacagaacagcgtcgtctgttcatgcgccagaggatacactttggccgacaacggaaaagcgtgcattccgactggcccttacccatgtggtaagcagactctggaaagaagaaaacgtagcgtcgcacaggcaacttcctcaagcggagaagcccccgattctattacctggaagccttatgatgcagccgatcttgatcctactgaaaatccctttgacctgctggactttaaccaaactcaaccagaaaggggcgataacaatcttacccggattgtgggtggtcaggagtgtaaagacggggaatgtccgtggcaggcacttctgattaatgaagaaaatgaaggcttttgcggcggtaccattctgagcgagttttacatcttgactgccgcacactgtctgtaccaggcaaaacggtttaaagtgcgggtgggcgatcgaaacaccgaacaggaagaaggaggagaggcagtgcatgaggtggaagtagtgatcaagcacaatagattcactaaggagacttacgattttgatatagcggtcctccggctcaaaactccaataaccttcagaatgaatgttgcacctgcctgtctgccagagcgggactgggccgaatcaaccctgatgacgcaaaaaactggaatcgtgtcaggcttcggccgaacccatgaaaagggcagacagtcgactagacttaagatgcttgaagttccgtacgtcgataggaattcgtgtaagctctcaagcagctttatcataacccaaaacatgttctgcgcagggtacgataccaagcaagaggacgcgtgccaaggagatagcgggggtccacatgtgactcggttcaaggacacctactttgtgaccggaattgtgtcctggggagagggttgtgcacgcaagggcaagtacggtatttacactaaagtgactgcctttctgaagtggatcgataggtcaatgaaaacgcggggactcccaaaagctaagtcacatgcccccgaagtcattacctcatcgcctctgaag

SEQ ID NO: 9275 - DNA, 1464 bp, Artificial Sequence
  Description of Artificial Sequence: Synthetic coding sequence
atgggcagacccttgcacctggtgttgctgtcggccagcctcgccggactcctgctcctgggggaaagcctcttcatcagaagagagcaagcaaataacattctggcaagagtgacccgggcaaattcgttcctcgaggagatgaaaaaagggcatctcgaacgggaatgcatggaagaaacttgttcgtacgaggaggctcgagaggtgttcgaggacagcgacaagactaacgaattctggaacaagtacaaggacggggaccagtgcgaaacctcaccgtgccagaaccaaggaaagtgcaaggatggactcggagaatacacctgtacctgccttgaaggattcgagggtaagaattgcgagctgttcactagaaaactgtgctccctggataacggtgattgtgatcaattctgtcatgaagagcagaatagcgtcgtgtgttcgtgcgctaggggctacactctcgctgacaatggaaaagcatgcatcccgaccggtccgtacccctgcggaaagcagacgctggaacgccgcaagagatcggtcgcccaagccacttccagctcgggcgaagccccagactcgattacttggaagccgtacgatgctgcggatttggatcctaccgagaacccgttcgacctcctggacttcaaccagacccagccggagcgcggcgacaataacctgactcggatcgtcgggggacaggaatgcaaggacggagagtgtccgtggcaggcccttctcatcaatgaagaaaatgaagggttctgcggaggtaccatcctcagcgagttttacatcctgaccgctgctcactgcctctatcaagcaaagcgctttaaagtgcgggtcggagacaggaacacggaacaggaagaggggggtgaggcagtgcacgaagtggaagtggtcatcaagcacaatcgcttcacgaaggaaacctacgatttcgacatcgctgtgctgaggctgaaaactccaatcaccttcagaatgaatgtggctccagcatgcctgccagagcgcgactgggctgaatccactctgatgacccaaaagacgggaattgtgtcgggatttggacggactcatgagaaaggccgccagtccacccggttgaaaatgctggaagtcccttacgtggacaggaacagctgtaaactgagcagcagctttatcattactcaaaacatgttctgcgccggatacgatactaagcaggaagatgcgtgccaaggagatagcgggggaccgcatgtgactagatttaaggatacttacttcgtgactggaattgtgtcctggggagaaggctgcgcccggaaaggaaagtacggcatctacaccaaagtgacggcgttcctgaagtggattgacaggtcgatgaaaacccggggcctgccaaaggcgaagagtcacgcgcccgaggtgataacttcgagccctctcaag

SEQ ID NO: 9276 - DNA, 1464 bp, Artificial Sequence
  Description of Artificial Sequence: Synthetic coding sequence
atgggtaggcctttgcacctggtgctactcagcgcatccttagcaggcctcctgctcctgggcgaatctctgttcattcgcagagaacaggctaacaacattctggccagagttacaagagctaatagctttttggaggagatgaaaaaggggcacctggagagggaatgtatggaagaaacatgcagttatgaggaggctagggaagtttttgaggactctgacaagaccaatgaattctggaataagtacaaggacggggaccagtgcgaaacttccccctgccaaaaccaggggaaatgtaaggacggcttgggggaatacacctgtacgtgtttggaagggttcgaagggaaaaattgtgagctgttcacacggaaactttgctctcttgacaacggcgactgcgatcagttctgccacgaggaacagaacagtgtggtttgtagctgtgccaggggttacacccttgccgacaatggcaaagcctgtatccccacaggaccatacccttgtggcaaacagaccctcgagcggagaaagcgatcggttgcccaggcgacctcatcttctggggaagcccctgactctatcacatggaagccatacgacgcagccgaccttgaccctaccgagaacccttttgacttactggactttaatcaaacacagcctgagcggggggataacaatttaactcgaatcgtgggtggtcaggaatgtaaggatggggagtgcccttggcaagccttgctgatcaatgaagaaaatgaaggattctgcggcggcactatactctccgaattttacattttgactgcagctcactgtctctaccaagctaaaagatttaaggtgcgagtgggggataggaatacagaacaagaggaaggcggtgaggccgtacacgaagtggaggttgtgatcaagcacaacaggtttacgaaggagacatatgacttcgacattgctgttttgcgactgaaaactcctattacgtttaggatgaacgtggccccagcttgcctgccggagcgggattgggcggaatccaccctcatgacacaaaaaacaggtatcgtgtcaggattcgggagaactcacgaaaagggacgacaatctaccaggctgaaaatgcttgaggtaccgtatgtggacaggaactcctgtaagctgtcctcatcgtttatcatcacccaaaatatgttctgtgccggatatgacacaaagcaggaagatgcatgccagggcgatagcggggggccacatgtgacgcgatttaaagatacctatttcgtaaccggcatcgtatcatggggcgaagggtgcgcccgaaaaggcaagtatgggatctacacaaaggtgacagccttcttaaaatggattgataggtcaatgaagacaagaggattgcctaaagcaaagtcacacgctcccgaggtaattaccagctccccactcaaa

SEQ ID NO: 9277 - DNA, 1464 bp, Artificial Sequence
  Description of Artificial Sequence: Synthetic coding sequence
atgggccggcctctgcatctggtgctgttatcggcatcactcgcgggcctcctgcttctgggtgaatcactttttattcgcagggaacaggccaacaatattcttgctcgcgtcacccgcgcaaatagctttctcgaagagatgaagaagggtcatcttgagcgcgagtgcatggaggagacctgtagctacgaggaagccagggaggtgttcgaggatagcgataaaaccaatgagttctggaataaatataaggacggcgatcagtgcgagacttccccctgtcagaatcaaggtaaatgcaaggatggcttaggcgagtacacctgtacctgcctggagggcttcgagggcaagaactgcgaattattcaccaggaagctgtgctccctggacaatggtgactgcgatcagttctgtcatgaggagcaaaactccgtcgtctgcagttgtgcccggggatataccctggccgataatgggaaagcttgtatcccaaccggtccgtatccctgtggaaaacaaacactggagaggcggaaacgcagcgttgctcaggccacgagcagtagcggcgaagctccagacagcatcacctggaaaccttatgacgctgcagatttggatcccactgaaaacccgtttgacctgcttgattttaatcaaacccagcctgagcgcggggacaataatcttacccgcattgtcggcggtcaggagtgcaaggatggcgaatgcccatggcaggccctgttgatcaatgaagagaacgaggggttctgcggcggcaccattttatcagaattctacattttgacagctgcacactgtctgtaccaggccaagagattcaaagttagggttggcgatcgaaataccgagcaggaggagggaggagaagcagttcacgaagttgaagttgtaataaaacataatagattcactaaggagacctatgactttgatattgctgtgttgcggctgaagaccccgattaccttccggatgaatgttgctcctgcttgccttcccgaaagggactgggcggagagcacgttaatgacccagaaaacggggatcgtgtccgggttcggtcggactcatgagaaaggccggcagtccaccagactaaaaatgctggaggtgccctacgttgacagaaactcttgtaagctttcctctagctttataataacccagaacatgttctgcgcaggttacgatacaaaacaggaagacgcctgccagggggattcgggcggacctcacgtgactcgtttcaaggacacttatttcgtcaccggcatcgtgtcttggggggagggatgcgctaggaaaggtaaatatggcatctatacaaaggttacagccttcttgaaatggattgatcgatcaatgaagacaaggggcctacccaaggcgaaaagccatgctcccgaggttattacatcttcacccctgaag

SEQ ID NO: 9278 - DNA, 1464 bp, Artificial Sequence
  Description of Artificial Sequence: Synthetic coding sequence
atggggcgacctctccatctcgtgttgctgagtgcttctctggccgggcttctgctgctgggggagtcccttttcattcggcgggagcaggctaataacatcctggccagagtgactcgcgctaattcgttcctggaagagatgaaaaaggggcacctcgagcgggagtgtatggaagagacctgctcttacgaggaggcaagggaggtgttcgaggattcagacaaaaccaacgagttctggaataagtataaagatggggaccagtgcgagacttcaccctgccagaaccaagggaagtgcaaggatggtctaggtgagtacacatgtacctgtctagaaggatttgaaggcaagaactgtgaactctttacacgcaagctgtgctctctggacaatggcgactgcgatcagttttgccatgaggaacagaattccgtggtgtgcagttgcgcacggggttacactctcgcagataatgggaaggcatgtatcccaaccggcccttatccatgcggcaagcagacattagaaaggcgaaaacggtctgtggcgcaggcaacaagctccagtggtgaggcaccagatagcatcacttggaaaccctacgatgcagcagatttggaccctactgagaacccctttgatctactcgacttcaaccagacacagcctgaacggggggataacaatttgactcggatcgtggggggccaagagtgcaaggatggagaatgtccctggcaggccctgctcatcaatgaggaaaatgagggattctgcggcggaaccattctttcagagttctatatactcacagcggcccactgcctataccaggctaagagatttaaggtgcgcgttggagaccgtaatactgagcaagaggagggaggcgaagcagtgcatgaggtggaggtggttatcaagcataaccgatttacaaaggagacctacgattttgatattgctgtgctgagacttaagacccccatcacgttcaggatgaatgtggccccggcatgtctcccagagagagattgggctgagtctacactgatgacacaaaaaaccggaatcgtgagcggttttgggcgcacccacgagaagggacgccaatctaccaggctcaaaatgctggaggtgccgtatgtagatcggaacagctgcaagctgagcagttccttcattatcactcagaatatgttttgcgctggttatgacacaaagcaagaggacgcatgtcagggagacagtggcggaccacacgtgacacgctttaaggatacctacttcgtcaccggaatcgtgtcctggggggaggggtgcgctagaaaagggaaatacggcatttatacaaaggtgaccgcctttctgaaatggatcgaccgcagcatgaagacacgaggtctgccgaaagcaaagagccatgcaccggaggtgatcaccagttctcccttgaag

SEQ ID NO: 9279 - DNA, 1464 bp, Artificial Sequence
  Description of Artificial Sequence: Synthetic coding sequence
atggggagaccacttcacctggtactgctgtcagcttctttagccggcctcttgttgcttggcgagagcctcttcatccggagggagcaggccaacaatattctagcccgagtgacccgtgccaatagcttcctggaggagatgaaaaagggccacctagaacgagagtgcatggaggagacgtgttcttacgaggaggccagagaagtattcgaggattccgataaaaccaatgagttttggaataaatataaagatggcgaccaatgtgagacatctccctgccagaaccagggcaaatgcaaagacggcctcggagagtacacctgtacctgcctggaaggctttgaggggaaaaattgtgaactcttcacccgcaagctctgttctttagacaacggggactgcgatcagttctgccatgaagagcagaactccgttgtatgctcatgcgcccgggggtacacgctcgccgataatggaaaggcttgtattccaactgggccctatccttgcggaaaacagaccctcgaacggagaaaacgaagcgtggctcaggctacctctagctctggtgaggcaccagatagcatcacatggaaaccctacgatgcagcggatcttgatcccaccgaaaaccccttcgatctgctcgatttcaatcagactcagccagagaggggcgataacaaccttactagaatcgttgggggtcaggagtgcaaggacggcgaatgcccttggcaggccttgctgataaatgaagagaatgaggggttctgtggcggcactatcctgagtgaattctatatccttaccgctgctcattgcctttatcaggcaaagagattcaaagtgagggtaggtgacagaaacactgagcaagaggaagggggagaagctgttcatgaggtggaggtggtgatcaagcataaccgcttcaccaaagagacctatgacttcgacattgccgtactgaggctgaaaacacccattacctttcgcatgaacgtcgcacctgcatgcctgcccgagcgcgactgggcggagtccacattgatgacacaaaaaactggcatcgtttccggcttcgggcgcactcatgaaaaaggccggcaatcgacccggctcaaaatgctggaagtaccatatgtggaccggaatagttgcaaactgtccagttcttttatcattacccagaatatgttctgtgcaggttacgatacaaagcaagaggatgcctgccagggagactctggcggcccccacgtcacccgcttcaaggacacatacttcgtgaccggtatagttagttggggggaaggatgcgctcggaagggaaagtacgggatctacacaaaggtgactgccttccttaaatggatcgatcgttcaatgaaaacccggggacttcccaaggcaaagagccacgcgcctgaggtgattacgtcttcccctcttaag

SEQ ID NO: 9280 - DNA, 1464 bp, Artificial Sequence
  Description of Artificial Sequence: Synthetic coding sequence
atggggcgaccgttgcacctggtgctgctgagcgcgtcgctggcgggactcctgttgctgggcgaatctctgttcattcgacgcgagcaggccaacaatatcctggcgcgggtgaccagagcaaactcattcctggaagaaatgaaaaaggggcacctcgagcgcgaatgtatggaggaaacgtgttcctacgaggaggcccgcgaagtttttgaggattccgacaagaccaatgaattctggaacaagtacaaggatggggaccaatgcgaaacttcgccatgccaaaaccagggaaaatgcaaggacggcctcggtgagtacacttgtacctgccttgaaggattcgagggcaaaaactgcgaactctttacgagaaagctctgcagcctggacaacggagattgcgatcaattctgtcatgaagaacagaactccgtggtgtgttcgtgcgcgcgggggtacacccttgccgataatggcaaggcctgcattcccactggaccttacccatgcggcaagcagactctggaaagacgcaaaaggtccgtggctcaggccacttcgagctcaggggaagcccctgattcgatcacctggaagccatacgacgctgccgatctcgatccaacggaaaatcccttcgacctcctggatttcaaccagactcagcctgaacgcggcgacaacaatctgacgcgcatcgttggaggacaggaatgcaaagatggagagtgcccgtggcaggcgctgcttatcaatgaggaaaatgagggtttttgtggtggaaccatcctgtccgagttttacatcttgaccgcagcacattgtctgtaccaagcgaagaggttcaaagtcagagtgggcgaccggaatacggagcaggaggaaggaggcgaggccgtccacgaagtagaggtcgtcatcaaacacaaccggttcacgaaagaaacctacgatttcgatatcgccgtgctgaggctcaagaccccgatcacctttcgcatgaacgtcgctccggcgtgcctgcccgaaagggactgggcagaatcgaccctgatgacccagaaaaccggaatcgtgtctggctttgggaggactcatgaaaagggccgccaaagcaccagactcaaaatgctggaggtgccttatgtggacagaaatagttgcaaattgtcctcctcatttatcatcacccagaacatgttttgtgccggctacgacactaagcaggaagatgcctgccaaggagactcgggaggacctcatgtgacccgcttcaaggacacctacttcgtgaccggaattgtgtcgtggggcgaaggatgcgcgagaaagggaaagtacggtatatacacgaaggtgaccgccttccttaagtggatcgaccgatcgatgaaaactcggggcctcccgaaagccaaatcgcacgcgccggaggtgattacttcaagcccactgaag

SEQ ID NO: 9281 - DNA, 1464 bp, Artificial Sequence
  Description of Artificial Sequence: Synthetic coding sequence
atgggacgacctctgcacctagtgctgcttagtgcatccctggccggcctgctgctcctaggtgaaagtctcttcatccgtcgggagcaagccaacaacatactcgccagagttaccagggccaatagttttctagaggaaatgaagaagggccacttggagcgggagtgcatggaagagacatgcagttacgaagaggctcgggaagtgtttgaggattcagacaagactaacgagttctggaataaatacaaggatggagatcagtgcgaaaccagcccttgtcaaaaccagggcaagtgtaaagacggactgggagagtacacatgtacctgcctagagggatttgaaggcaagaattgtgaactgttcaccagaaagctgtgcagcctggataacggagactgcgaccagttttgccacgaggaacagaactccgttgtgtgctcctgcgcacgaggatacactctggctgacaatggcaaggcatgtattcctaccggaccttatccctgtggaaagcaaaccttagaaagacgcaagaggagtgtggcacaggctacatctagttcaggcgaagcaccagattctatcacttggaagccatacgacgccgcagacctagatccaaccgaaaaccctttcgatctcctggacttcaatcagacccagccagagcgtggagacaacaatctaactcgcatcgtaggtggacaggagtgtaaggatggagaatgtccatggcaggctctgctgataaacgaggagaacgaggggttttgtgggggtactattctgtctgaattttacatcttgaccgcagcacattgtctgtatcaggccaagcggtttaaagtcagggtgggagatagaaacaccgagcaggaggaaggcggagaagccgtgcatgaggttgaggtggtcataaaacacaacagatttactaaggaaacctacgacttcgatatcgccgttttacgattaaagacccctatcaccttccgcatgaatgtggcccctgcctgcctgccagaacgcgactgggccgagtctaccctgatgactcagaagacaggcatagttagtggcttcggcagaactcacgagaaaggccggcaaagcacccggctaaaaatgctggaggtcccttatgtggacaggaactcttgcaaactgagtagctcattcatcatcacacagaatatgttctgtgctggctatgataccaaacaggaagatgcatgccagggtgatagtggtggacctcacgttacccgctttaaggatacctatttcgtgaccgggatcgtttcctggggcgaggggtgcgctcgtaagggcaagtatggaatctacacaaaagtaacagccttcctgaagtggattgatagatccatgaagacacggggactgcctaaagctaagagtcatgcccccgaggtgataacatcaagtccactcaag

SEQ ID NO: 9282 - DNA, 1464 bp, Artificial Sequence
  Description of Artificial Sequence: Synthetic coding sequence
atgggacggcctctccatttagtgctcctgagcgcttctctggccggtctcctgctgttaggcgagtccctcttcatccggcgcgagcaggcgaacaacatattggcgagagtgacgagagctaactcctttcttgaagaaatgaaaaagggccatctggagcgggaatgtatggaggagacctgctcatacgaggaagcacgagaagtgttcgaagactccgacaagacgaacgagttttggaacaaatataaagatggagatcagtgcgagacaagcccttgccagaaccagggaaaatgtaaggatggcctgggcgaatacacctgtacatgtctagagggctttgagggcaagaattgcgaattatttacccgaaagctgtgttccttagacaatggagactgcgaccagttttgccacgaagagcagaattctgtagtctgctcgtgcgccaggggctataccttggctgataatggtaaagcttgcattccgacgggcccatatccctgcggcaagcagacactcgagcggaggaagagatctgttgcacaagctacaagctcttccggggaggccccagatagcatcacctggaagccttatgacgcagctgacctcgaccccaccgagaatcccttcgacctgctcgatttcaaccagacgcagcctgaacgaggggataacaacctaaccaggatcgttggtggtcaagaatgtaaggacggagagtgtccttggcaggcactgctgattaacgaagaaaacgaagggttttgtggcgggacaatcctgtcagagttctacattctgacggccgcccactgcctgtatcaggccaaacgttttaaagttcgcgtgggagaccggaatactgaacaagaggagggcggagaggcggtgcacgaagtggaggtggttataaagcataatcggttcaccaaagaaacttacgactttgatattgcagtgctgcgcctgaagacccccatcacattcaggatgaacgtagcaccagcctgcttacccgagcgggattgggccgagagcacgctgatgactcagaaaaccgggattgtgagcggttttggtagaacacatgagaagggacgccagagcaccaggttgaagatgctggaagttccatatgtggatcggaactcatgcaagctgtcatccagttttataatcactcagaatatgttctgcgccggatacgacacaaaacaggaagacgcctgccagggagactcaggcggcccccacgttacgagattcaaagacacctacttcgttacagggattgtcagctggggcgagggttgcgcccggaaaggaaagtatggcatctatacgaaggtgactgcttttctaaaatggatcgatcgtagtatgaagaccagaggtttaccaaaagctaaaagtcatgccccagaagtgataacgtcctcccctttaaag

SEQ ID NO: 9283 - DNA, 1464 bp, Artificial Sequence
  Description of Artificial Sequence: Synthetic coding sequence
atgggaaggcctcttcatttagttctcctctccgcctccctcgccgggttgctccttctcggggagtccctcttcatcagacgagaacaggctaataacatcctcgcgcgagtcacaagagcaaactctttcctggaagaaatgaagaaaggacatttagaacgagaatgtatggaagagacatgcagttatgaagaggcgagagaagtgtttgaggatagtgataagactaacgaattttggaacaaatacaaagatggagatcaatgtgaaacaagtccatgtcaaaaccaaggaaaatgcaaagatgggctaggggaatatacatgcacttgtcttgaagggtttgaaggaaaaaattgtgaactgttcacacggaagctgtgttctctggataacggggactgtgatcagttctgtcatgaagagcagaatagtgtagtgtgttcctgtgctcggggatatactctcgccgataatggaaaagcatgtattccaactggaccttacccatgtggaaaacagacacttgaacggagaaaacgatctgtggcacaggccactagttcttctggggaagcccctgactccatcacttggaaaccttatgatgcagctgatctggatccaacagagaacccctttgacctgttggattttaatcagactcagcccgagcggggagataacaatctaacaaggatcgtgggggggcaggaatgtaaagatggagaatgtccctggcaggctcttttaataaacgaagaaaacgagggattttgtggggggactatcctttccgaattttatatcctcacagcggctcattgtttatatcaggccaagcggtttaaagtccgggtcggggataggaacacagaacaggaagaagggggagaagctgttcacgaagttgaggtggtcatcaagcacaaccgcttcacaaaagaaacttatgatttcgatatagccgtacttcggctcaagacaccaataacatttaggatgaacgttgcaccagcatgtctcccagaacgagattgggcagaatctacacttatgacacagaagacagggatagtatctgggtttgggcggactcatgaaaaaggacgacagtctactcggctgaaaatgctcgaagtaccttacgtggatcgaaactcttgcaaactatcttcatcctttatcattacacagaacatgttctgtgctgggtatgatactaaacaggaagatgcttgtcagggggattctggagggcctcatgtaacaaggtttaaagatacgtattttgtgacaggaatcgtgagttggggggaagggtgcgcccgcaaagggaaatacgggatttatacaaaagtgacagccttcttgaaatggattgaccgctctatgaaaactagggggctccctaaagcaaaatcacacgcacccgaagttattacatcgtctcccctcaag

SEQ ID NO: 9284 - DNA, 1464 bp, Artificial Sequence
  Description of Artificial Sequence: Synthetic coding sequence
atgggtaggccgctccacctggtgctcctttccgcttcgctcgctggcctcctgctgctgggagagagccttttcatccgcagagaacaggctaacaacatcctggctcgagtcacccgcgcgaactccttcctcgaggagatgaagaaaggacatctcgaacgcgaatgcatggaagaaacgtgcagttacgaggaggcccgcgaggtgttcgaggactcggataaaactaatgaattctggaataagtacaaagacggcgaccagtgcgaaacctccccatgccagaaccaagggaagtgtaaggacggcctgggagaatacacgtgcacctgcctcgaaggtttcgaagggaaaaactgtgagctcttcacccgcaagctctgcagcctggataacggagactgtgaccaattttgtcacgaggagcagaactcagtcgtgtgctcctgtgcccgcggctacactcttgccgacaacggcaaagcatgcatccccaccgggccatacccatgtggaaaacagaccctggaacgccggaagagatctgtggcgcaggcgacgtcatcctccggtgaagcccccgatagcatcacctggaagccttacgacgccgcagatttggatccgaccgaaaaccccttcgatctcctcgactttaaccagacccaaccagaacgaggagacaataacttgactcggattgtgggaggacaggagtgcaaagacggagagtgcccgtggcaagcgttgctgatcaacgaagaaaacgaaggattctgcggcggcactatcctgtcggagttttacatcctcactgcggcccactgtctgtaccaagcgaaacgcttcaaggtccgcgtgggcgaccgcaacacggagcaagaagagggaggagaagccgtgcacgaggtggaggtggtgataaaacacaacaggtttactaaggagacgtacgatttcgatattgcagtgctgcggctcaagacccctatcacttttcggatgaatgtggcgccagcttgcctcccagaacgggattgggcagaatcgaccctgatgacccaaaagaccggaatcgtgtccggattcggacggacccatgagaaaggacgccagtccactcgcctgaaaatgcttgaggtgccctatgtggacagaaattcgtgcaagctgtcctcgtcgttcatcatcactcagaacatgttttgtgctggttacgacaccaagcaggaagatgcttgccagggagactcggggggcccgcacgtcaccagattcaaagatacttatttcgtcactggcatcgtgtcatggggagaaggatgtgcgcgcaagggaaagtacggaatctacactaaggtgactgcttttctcaaatggatcgatcggtcgatgaaaacccgcgggctgccgaaggcaaaaagccacgccccagaagtgatcacctcttccccactgaaa

SEQ ID NO: 9285 - DNA, 1464 bp, Artificial Sequence
  Description of Artificial Sequence: Synthetic coding sequence
atgggaagacccttgcacctagttttattgtccgcctctctggccgggcttcttcttctgggcgagagtttgttcatcagaagagagcaggcgaataacattctcgccagggttacgagagcaaactccttcctggaagagatgaagaaaggtcacttggaacgtgagtgtatggaagaaacatgctcatacgaggaagcacgcgaagtgttcgaagactccgataaaacaaacgaattttggaataaatataaagatggagaccagtgtgagacttcaccctgtcagaaccaggggaagtgcaaggatggccttggcgagtatacatgtacctgcctggagggttttgagggcaagaactgcgaactgttcacaagaaagctgtgttccctagacaatggggattgtgaccagttctgccatgaggagcagaattcagtggtgtgttcttgtgcccgagggtatacactggcagacaacgggaaggcgtgcatccccacagggccttatccctgtggtaagcagactctggaacgtagaaaaaggtccgtggcacaggctacatcttccagcggcgaagctccagactccatcacctggaaaccctacgatgccgctgatctggatcccaccgagaaccctttcgacctcctggactttaatcagacacagcccgaaaggggggataacaatctcacacgaatagtgggcgggcaagaatgcaaagatggtgagtgcccttggcaggcactgcttattaatgaagagaatgaaggattttgcggcgggactatcctgagcgaattttacatccttactgccgcccactgcctctaccaagcgaagagatttaaggtccgggtcggtgatcgaaacacagaacaggaagaggggggggaggccgtccatgaagtcgaggtagttataaaacataaccggttcactaaggaaacatatgactttgatattgctgtgctgagactgaaaacacctattaccttccgaatgaatgtggctcccgcttgtctacctgagagggattgggcggaatctacactgatgacgcagaaaacaggaatagtctctgggttcggccgtacacatgagaaagggaggcagtccactaggctcaagatgctggaagtaccttacgtggaccgaaattcttgcaagttgagcagtagttttatcattacacagaatatgttctgcgctggctatgacacgaaacaggaggatgcttgtcagggcgactcaggaggcccccacgtaacacgctttaaggatacgtacttcgtgacgggaattgtctcatggggagagggatgcgcaagaaagggcaagtacgggatctacacaaaagtaacggcgttcttgaaatggatcgaccgctcaatgaaaacaagaggactgcctaaagcaaagtcacacgctcccgaggtcataaccagctcacccctcaag

SEQ ID NO: 9286 - DNA, 1464 bp, Artificial Sequence
  Description of Artificial Sequence: Synthetic coding sequence
atgggtagaccactccatctggtccttctctcagcatcacttgctggcctgcttcttctcggagaatcacttttcatcaggcgcgaacaagccaacaacatcctcgcacgggtcaccagagcaaactcatttcttgaagaaatgaagaagggtcacttggagagggagtgtatggaggagacttgctcgtacgaagaagcaagggaggtgtttgaggactccgataagaccaatgaattttggaacaagtacaaggacggggatcaatgcgaaacctcaccatgtcaaaaccaaggcaagtgtaaggatgggctcggtgaatacacctgcacttgtctggaaggtttcgaaggaaagaattgcgagttgtttaccagaaagctgtgttcgctggataatggagattgtgaccaattttgtcatgaagaacagaactccgtcgtgtgctcctgtgcaaggggttacacgctggccgacaacggaaaagcatgtattcccaccggaccatacccatgcggaaagcagacgctggaacggagaaagcgttcggtcgcacaagctacctcgtcatccggcgaggcgcctgatagcatcacctggaagccatacgatgcagccgacctcgacccgactgagaatcctttcgacctgcttgatttcaaccaaacccaacccgagagaggcgacaataatctgacccgtattgtcggaggacaggagtgtaaggacggtgaatgcccgtggcaggcgctgcttatcaacgaagaaaacgagggtttttgtgggggcacgattctctccgaattctacatacttactgccgcccattgtctctaccaggcaaagagatttaaggtgagggtgggtgaccgcaacactgaacaagaggaagggggcgaagctgtgcatgaagtggaggtcgtcataaagcataatagatttaccaaagagacttacgactttgatattgccgttctgcggcttaaaacgcctatcacctttagaatgaacgtcgcacccgcatgtctgcctgagcgagattgggccgaatccactcttatgacccaaaagaccggaattgttagcgggtttggaaggacccatgagaagggaaggcagagcacccggcttaagatgctcgaggtcccatacgtcgaccgcaactcgtgtaaactcagctcctcgttcattatcacgcagaatatgttttgcgcaggttacgacaccaaacaggaggatgcctgccagggagattccgggggtccacatgtgactagatttaaggatacctacttcgtgactggaattgtgtcgtggggagaaggttgcgctagaaagggaaagtacggtatctacaccaaggtcaccgcatttcttaagtggattgaccgaagcatgaaaacgcgcggactcccaaaggcaaagtcgcatgcgcctgaggtgattaccagctcgcccttgaag

SEQ ID NO: 9287 - DNA, 1464 bp, Artificial Sequence
  Description of Artificial Sequence: Synthetic coding sequence
atgggacgaccgctccatctggtgctgctctcggcttcgctcgccggcctgctgctcctcggggaaagcctgttcatccggagagaacaagcaaacaacatcttggctcgcgtcactcgggccaacagcttcctcgaagagatgaagaaaggtcatctggagagagaatgcatggaagagacttgctcctacgaagaggcaagggaggtgttcgaggatagcgacaaaaccaacgagttctggaacaaatacaaggatggcgatcaatgcgaaacttcgccttgccaaaaccagggaaagtgtaaggacggactgggtgagtatacctgcacctgtctggaagggtttgagggtaagaattgcgaactttttactagaaagctgtgctcgctggataatggggactgcgaccagttctgccacgaagagcagaactcggtggtgtgctcttgcgcgaggggatacaccctggctgacaacggaaaggcatgtatccctaccggtccatacccatgtggaaagcagactcttgaacggcggaagagaagcgtggcgcaagcgacttccagctccggggaagccccagactcaatcacttggaagccatacgacgccgccgatctggacccgacggaaaatccgttcgacctcctggactttaatcaaacccagccggagagaggggataacaacctgactcgaatcgtcggcggacaagagtgtaaagacggcgagtgcccgtggcaggcgcttttgattaacgaggaaaacgagggattttgcggtggaacgattctctcagagttctacatcctgactgccgcgcactgcctctaccaggcaaagcgcttcaaggtgagagtgggagatcgcaacactgaacaggaggaaggaggtgaggctgtgcacgaggtggaagtggtcatcaagcataatagattcaccaaggaaacttacgacttcgatattgccgtcctgaggttgaaaaccccgattaccttccgcatgaacgtggccccggcctgcctgccagaaagagactgggcggaaagcaccctcatgactcagaaaaccggaatcgtgtcaggcttcggaaggacccatgagaagggtcgccaaagcacgcggctgaagatgctcgaagtgccatacgtcgatcggaactcctgcaagctgtcgtcctcgttcatcattacccagaatatgttctgcgccggatacgacaccaaacaggaggacgcatgccagggagatagcggcggaccgcacgtcacccggttcaaagatacttacttcgtcaccggcattgtgagctggggtgagggctgtgcaaggaagggaaagtacggtatatacaccaaggtgactgcctttctcaaatggatcgaccgctctatgaaaacgcggggactgccgaaggccaaatcccacgctccggaggttatcacctcttcaccgttgaaa

SEQ ID NO: 9288 - DNA, 1464 bp, Artificial Sequence
  Description of Artificial Sequence: Synthetic coding sequence
atgggtagacccttgcatcttgtgcttttgagcgcctcgttagccggcttgttgctccttggtgagagtctgtttattcgcagggagcaagcaaacaatatcttggcccgtgttacgcgagccaacagctttctggaagaaatgaagaagggccatttggaacgcgagtgcatggaagagacatgctcttacgaagaggcccgagaagtttttgaggacagtgacaaaacgaatgaattctggaacaagtacaaagatggagatcagtgcgagacttccccctgccaaaaccaggggaagtgcaaagatggtttaggcgagtacacctgcacttgtctggagggcttcgaagggaaaaactgtgagctgttcacacgaaagctgtgctcgctcgataacggcgattgcgaccaattctgtcatgaggagcagaacagcgtggtttgctcgtgtgcccgcggctacaccctagccgataacggaaaggcctgcatccccactggtccatatccgtgtggcaagcagaccctggagcgcagaaagcgctccgtggcgcaagctacatcgtcgtccggcgaagcgccggattccattacgtggaaaccctatgacgccgccgatcttgaccccaccgaaaacccgttcgatctgctggactttaaccaaacacaaccggagcgtggggataacaacctgactcgtattgttggcggccaggagtgcaaggatggagagtgcccctggcaggccctgttaataaacgaagagaacgagggattttgcggaggcaccattttgtcagagttttatatcctgacagctgctcactgtttgtatcaggcaaagcgatttaaggtgcgagtgggcgaccgaaatactgagcaagaggaaggcggagaggccgtccatgaggtggaggttgtgatcaagcataaccggtttaccaaggagacctacgacttcgacatcgccgtgttgagactgaaaacgcccattacgttcaggatgaatgtggctccagcttgcctcccagagagggattgggcggaatcgaccctgatgacccaaaagaccggcattgtttccggcttcggacgcacacatgaaaagggacgccaatcgacccgcctgaagatgctcgaagtgccctacgtggatcgaaatagctgcaagctatcgtcgagtttcatcatcacccagaacatgttctgcgcgggatatgatacaaaacaggaggatgcatgccagggggatagcggaggaccccacgtgacccgcttcaaggacacgtatttcgtcactggtatcgtctcttggggcgagggttgcgccaggaaggggaagtatggtatctacactaaggtgacggcattcctcaagtggattgaccgctcgatgaagacccgcggacttcccaaggccaaaagccacgccccggaggtgattacctcctcccctctgaaa

SEQ ID NO: 9289 - DNA, 1464 bp, Artificial Sequence
  Description of Artificial Sequence: Synthetic coding sequence
atgggccggccgctgcacttggtgctcctgtccgcctcactcgcagggctgttactgctcggagaatctttattcatccggagggaacaggccaataacatactggccagagtgacgcgcgctaacagttttctcgaagaaatgaagaaggggcatctggagcgtgaatgtatggaagagacctgttcttacgaggaggcgcgtgaggtgtttgaggactcggataagaccaatgagttctggaataaatataaagatggtgaccagtgtgaaacctccccttgtcaaaatcaaggtaaatgtaaggatggcctgggtgaatacacttgcacatgtttggaggggtttgaggggaagaattgtgaactatttaccaggaagctatgctccctggacaacggcgactgcgaccaattctgccacgaggagcagaactcggtcgtatgctcttgcgccaggggatacactctcgctgacaacggaaaagcctgcattccgacagggccgtacccctgtggcaaacagaccctggaacggcgcaaacggtcagtggcccaggctactagttccagtggcgaggcccccgattctattacttggaagccatacgatgcggctgacctggacccaactgagaaccctttcgacctattagacttcaaccaaacccagcccgaaagaggtgacaataatctgacgcgcatcgtgggaggccaggagtgcaaggacggcgagtgtccctggcaggccttattgatcaacgaggaaaatgaagggttttgtggaggcacaatcttgagcgagttttatatcctgacagcggcgcattgcttgtaccaggcgaagcggtttaaagtgcgtgtgggggatcggaatactgagcaggaggagggcggagaggctgtgcacgaagtagaagtcgtaataaagcacaaccggttcactaaagaaacctatgacttcgatattgctgtgctgagattgaaaacccctattacttttagaatgaacgtcgcccctgcctgcctgccagagcgcgattgggccgagagtaccttgatgactcagaagactggaattgtcagcggttttggtaggacgcatgagaaggggaggcagtcgacccggctgaaaatgcttgaagtaccctacgtggatcgtaacagttgtaagctatcaagctccttcattatcacccagaatatgttctgtgccggctacgacaccaagcaggaggacgcttgccaaggggactccggtggtcctcacgtgactagatttaaggacacttattttgtgacgggaattgtgagttggggagaaggctgtgctcggaaggggaaatatgggatatacacgaaggtcaccgcatttctgaagtggatagatcgatcgatgaaaacgaggggcctcccaaaggcaaaaagtcacgcccccgaggtgatcacgtcgtccccactgaag

SEQ ID NO: 9290 - DNA, 1464 bp, Artificial Sequence
  Description of Artificial Sequence: Synthetic coding sequence
atgggacgccctctacacctggttctgctcagcgctagtctggccgggctgttgctgctcggggagtctctgtttatccggagagagcaggcgaacaacattctggctagggtcacccgcgcgaattccttccttgaagagatgaagaaggggcatctggagcgcgaatgcatggaggagacctgctcctacgaagaagccagggaagtgttcgaagactcagataagacaaacgagttttggaataagtacaaagatggggatcagtgtgaaacatcaccatgccaaaatcaaggtaaatgtaaggatgggctcggcgaatacacctgcacctgccttgaaggcttcgagggaaaaaactgcgagcttttcacacggaagttgtgcagtctggacaacggtgattgcgaccagttttgccacgaagagcagaactctgtagtatgtagctgcgctagaggatatactctcgctgacaacgggaaagcctgtattcccaccgggccatatccatgtggcaaacagaccctggagaggaggaaacggtctgtggctcaggcgacaagttccagtggtgaggcacccgattctataacatggaagccatatgacgccgcggacctggatccaacggagaaccccttcgacctcttagactttaatcaaactcagccagagaggggtgacaataacctcaccagaattgtggggggccaggagtgcaaagacggagagtgcccctggcaggccctgctgatcaatgaggaaaatgagggtttttgtgggggcaccatcctcagcgagttctacattctgaccgccgcccactgtctctaccaagcaaagcgatttaaggttcgcgtcggagaccgcaacaccgagcaggaagaggggggcgaggcagttcacgaagttgaggtcgtgatcaaacacaatagattcactaaggaaacatatgactttgacatcgctgttttacggctcaagactcccatcaccttccggatgaacgtggcccctgcttgcttgcccgagcgggattgggctgaatctacccttatgacacagaaaacgggaattgtttctgggttcggccggacacacgaaaaaggtcgacagtctaccagactcaaaatgctggaagttccttacgtggatcgaaactcatgtaagctgtcatctagttttatcatcacccagaatatgttctgtgctggatacgatacaaagcaggaagacgcgtgccagggggattcaggaggccctcacgttactcggttcaaggacacgtacttcgtcaccggcattgtcagctggggcgagggctgcgcccgaaagggtaaatatggaatttatacgaaggtcactgcgttcctgaaatggatcgatcggtctatgaagaccagaggattgccgaaagcaaagtctcacgcccctgaagtgataaccagctctcctttgaag

SEQ ID NO: 9291 - DNA, 1464 bp, Artificial Sequence
  Description of Artificial Sequence: Synthetic coding sequence
atgggaagacctttgcaccttgtcttgttgagtgctagtcttgccggtttactcctgttgggtgagtcactgtttatcagacgggagcaagcaaacaacatacttgccagggtgactcgggctaactccttcctggaggagatgaaaaagggacatttagagcgcgagtgcatggaggagacatgttcctacgaagaggcgagagaggtctttgaggattccgataaaaccaatgaattttggaataaatacaaagacggagatcaatgtgaaacctccccttgtcaaaaccagggaaaatgtaaggacggactgggcgagtacacctgcacatgtcttgaaggatttgaaggaaaaaactgtgagctgttcaccaggaaattgtgttctctggacaacggagactgtgatcagttttgccatgaagagcagaacagtgttgtctgcagctgcgcgcggggttatacacttgccgataacggaaaagcgtgcatccctaccggcccttacccttgcggcaaacaaacccttgagagacgaaagagatctgtggctcaggcaaccagcagctcaggagaagctccagactcaataacgtggaagccatatgatgcagctgatctcgacccaacagagaacccttttgatctgctcgacttcaatcaaactcaaccggaacggggcgataataatttgactcggatcgtgggtggacaagaatgtaaggacggggaatgtccgtggcaggctctgctgatcaacgaggagaacgagggcttctgcggaggcaccatcctctcggagttctacatcttgactgctgcacactgtctttaccaggcaaagcgctttaaagtgagagtaggagaccggaacaccgaacaggaagagggcggagaggccgtgcacgaggtcgaagtggttattaagcacaacagatttacaaaagagacctatgacttcgacatagctgtcctcaggctgaaaacccccatcacatttagaatgaacgtggcgcctgcttgcctgccagagcgtgactgggccgagtctaccctgatgacccaaaaaactggcatcgtgtctgggtttggaaggacccatgaaaagggccgtcagagcacacgcttgaaaatgctggaggtaccctacgtggacaggaactcctgcaaattgagttcaagctttattattactcagaacatgttctgtgctggatatgacacaaaacaggaagatgcttgccagggcgattccggaggccctcacgtcactaggttcaaggacacttatttcgttaccggcatcgtaagctggggtgaaggctgcgcccggaagggaaagtacgggatatatactaaggtgactgcttttctcaaatggattgatagaagcatgaagacaaggggactccctaaggctaagtcacacgcccctgaggtgatcaccagcagtccactcaaa

SEQ ID NO: 9292 - DNA, 1464 bp, Artificial Sequence
  Description of Artificial Sequence: Synthetic coding sequence
atggggaggccgcttcatctggtgttgctctccgcgtcgctggctggactcttgctgcttggggaatcgttgttcattaggcgcgagcaagccaataacatcctggcccgggtgactcgtgccaattcgttcctggaagaaatgaagaaaggtcaccttgagagggaatgcatggaggaaacgtgttcgtacgaagaagctcgggaggtgtttgaggactccgacaaaacgaacgaattctggaacaagtacaaggacggtgatcagtgcgagacttcaccatgccagaaccaaggaaagtgcaaggatggactgggggaatacacctgcacctgtctggagggcttcgagggaaagaactgcgagctgtttacccgcaaactgtgttccttggacaacggcgactgcgatcaattctgccacgaagagcagaattcggtcgtgtgttcctgtgcacgcggttacaccctcgcggataacggaaaggcctgcatccctactggtccctacccctgcggcaagcaaaccctggagcgacgcaagcggagcgtcgctcaggccaccagtagctctggagaagcgccagattcaatcacctggaaaccatatgatgccgcagatcttgatcctacggaaaatccattcgacctgctggatttcaatcagacgcaaccggaacgcggcgacaacaatctcactagaatcgtgggaggacaggaatgcaaagacggtgaatgcccgtggcaggcgcttctgatcaacgaagagaacgaaggtttctgcggaggaactatcctgtccgagttttacattctgacggccgctcattgcctctaccaggccaaaaggtttaaggtccgcgtgggtgaccgcaacactgagcaggaagagggaggagaggcagtgcatgaagtagaggtggtgattaagcacaacagattcactaaggaaacttacgatttcgatattgctgtgctccggctcaagacccctatcactttccgaatgaatgtcgcgccggcttgcctgcccgaacgcgactgggccgagtctactctgatgactcaaaaaaccgggatcgtgagcggcttcggaagaacccacgagaagggccgccaatcaacgagactcaaaatgctggaagtgccgtatgtcgacaggaacagctgcaaactttcatcctcgttcatcatcacccagaacatgttttgcgcggggtacgacaccaagcaagaggacgcctgtcagggagactccgggggacctcacgtcaccagattcaaggacacgtacttcgtgactggaatcgtcagctggggcgagggctgtgcgcgtaaggggaagtacggaatctacaccaaggtgaccgccttcctgaagtggatcgaccggtccatgaaaaccagaggcctcccgaaagcaaagagtcatgccccggaagtaataactagcagccccctcaag

SEQ ID NO: 9293 - DNA, 1464 bp, Artificial Sequence
  Description of Artificial Sequence: Synthetic coding sequence
atgggccgcccgctgcacctggtgctcctctcagcatctctggctggactgttgttgcttggagagtccttgttcattaggagggaacaggcaaataatatactcgctagagtgacacgcgctaacagcttcctcgaagaaatgaaaaagggtcatttggaaagagaatgtatggaggagacatgcagctatgaggaggcccgcgaagtcttcgaagactctgacaagactaacgagttctggaataaatacaaggatggtgatcagtgcgagactagcccttgtcaaaaccagggcaagtgcaaggatggactgggagagtacacttgtacatgcctggagggatttgagggtaagaactgcgagctttttactagaaaactctgtagcctcgacaacggtgactgtgaccaattctgccacgaagagcagaactccgtcgtgtgttcatgcgccagaggttacaccctggcagacaatggtaaagcctgcattcccactggcccttacccgtgcggaaagcaaaccctcgaaagaaggaaacgctcagtggcccaagccacatcaagttctggcgaggcccctgactcaattacttggaagccatacgatgctgcagacctggacccaacagagaatcctttcgacctgttggacttcaatcagacccagcccgagagaggagacaacaatcttacacgcatcgtaggcggtcaagaatgtaaagatggcgagtgcccatggcaagctctgttgataaatgaggagaatgaaggtttttgcggaggaaccattctttctgagttctatatcttgacggcggcccattgcctctaccaagccaaaaggtttaaagtaagagtcggcgaccgcaataccgaacaggaagagggtggcgaggctgtacatgaagtggaggtggtcattaaacataaccgctttaccaaggagacctacgacttcgatatcgccgtactgaggctgaagactccaatcacattcagaatgaacgtggcaccggcttgcctgccagagcgcgactgggctgagagcaccctgatgactcagaagaccggtattgtctccggcttcggtcgcacccatgagaagggaagacaatctaccagactcaagatgctggaggtcccctacgttgacaggaactcatgtaagctgagctcatcatttatcatcacccaaaatatgttctgtgctggctatgatactaagcaggaagacgcttgccaaggcgatagtggtggtccccatgttacccgctttaaggacacttatttcgtgaccggaatagtgagttggggtgagggctgcgcacgcaaaggcaagtatggcatctacacgaaggttacggcttttctgaagtggatcgataggtccatgaaaactagaggattgccaaaggccaagagccacgcgcctgaggttataacatccagccccctgaag

SEQ ID NO: 9294 - DNA, 1464 bp, Artificial Sequence
  Description of Artificial Sequence: Synthetic coding sequence
atgggccggcctctgcacttggtcctgttgtcagcatcccttgcaggtcttctgctgcttggggaaagcctttttattcgtcgggagcaggctaataacatcctcgcgcgcgttacccgggctaactctttcctggaggagatgaagaaagggcacttggagcgcgaatgcatggaggaaacatgttcctacgaggaggccagggaggtgttcgaggactcagacaaaacaaatgagttttggaataagtataaggatggggatcagtgcgaaactagtccttgtcagaaccagggcaagtgcaaagacggactcggagaatacacttgcacgtgcttggagggcttcgagggcaagaactgcgaactgtttactagaaaactgtgttccttggacaacggagactgcgaccagttctgccacgaggaacagaactctgtcgtgtgttcctgcgcacgcgggtatacactcgctgataatggcaaagcgtgtattccaaccggcccatatccttgcggaaagcagactctagagagaaggaagaggtcagttgcgcaggcaaccagctcttccggcgaggcaccggatagcattacctggaaaccttacgatgccgcggatctcgacccgacggagaacccattcgatttgcttgattttaaccagacccagcctgaaagaggggataacaatctcacacgtattgtcggaggtcaggagtgcaaggacggagaatgtccttggcaggcccttttaatcaacgaagagaacgaaggtttttgtggcggcaccatcctgtcagagttctatatcttgactgccgcacactgcctctaccaggcaaagaggttcaaggttagagtcggcgaccgcaacaccgagcaggaagaaggaggggaggcagtccatgaagtcgaggtcgtgatcaagcataacaggtttaccaaggagacctatgactttgacatcgccgtactaaggctcaagaccccgataaccttccgcatgaatgtcgctcctgcttgcctgcccgaacgggactgggctgagtccactctgatgacccagaagactggcattgtaagcggctttggacggacacacgaaaaggggcgccagagtacaaggttaaagatgctggaagtgccttacgtggatagaaattcatgtaaactctccagcagttttatcatcactcagaatatgttctgcgcaggttatgacacgaaacaggaggatgcatgccaaggggattcaggtgggccccacgtgactcgtttcaaggacacttacttcgttaccggaattgtaagttggggcgagggttgcgcaaggaaaggtaagtatggcatttatactaaggtgactgcgttccttaagtggattgatcggagcatgaaaactagaggtctgccgaaggccaagtcccacgcgcctgaagtgattactagctcccccctcaaa

SEQ ID NO: 9295 - DNA, 1464 bp, Artificial Sequence
  Description of Artificial Sequence: Synthetic coding sequence
atggggcggcccctccacctggtgttgttgagcgcttcgctggccggactgctgcttcttggagaaagcctcttcatccggagggaacaagcaaacaacattctggctcgcgtcactcgagccaacagctttctggaagagatgaagaagggccatctcgaacgggaatgcatggaagaaacgtgctcatacgaagaagcccgcgaggtgtttgaggatagcgacaaaactaacgagttctggaacaaatacaaggacggagatcaatgcgaaacttcgccttgccaaaaccaaggtaaatgcaaggatgggctgggagaatacacgtgcacctgccttgaaggattcgagggaaagaattgtgagctgtttactcggaagctctgctcattggataatggagactgcgatcagttctgccacgaggaacagaattccgtggtctgttcctgcgcgcgcggatacaccctggcggataacggcaaggcctgcatccctacgggtccttacccatgtgggaaacagacccttgagaggaggaagcgctcagtcgctcaggctacttcttcgtccggagaagcccctgattcaatcacttggaagccatacgacgcagccgacctcgacccgaccgagaatccgtttgacctcctcgacttcaaccagacccagcccgaacgcggagataacaatcttacccggatcgtcggcggacaggaatgcaaagacggtgaatgtccttggcaggccctcttgataaacgaagagaacgaaggcttctgcggagggaccatcctgtccgagttctacattctcactgcagcccattgcttgtaccaagccaagcggttcaaagtgcgggtgggcgacagaaataccgaacaagaagaaggaggggaagcagtgcatgaggtggaagttgtgatcaagcacaacagatttaccaaggagacttatgacttcgacatcgcggtcctgagacttaagactccgatcactttccgcatgaacgtcgcaccggcatgtctgccggaaagggattgggccgagtccacccttatgacgcagaaaactggaatcgtctccggattcggccggactcatgagaagggaaggcagagcactcggttgaagatgctcgaggtgccgtatgtcgatcgcaattcatgcaagctgtcatcatcttttatcatcacccagaatatgttttgcgcaggatacgataccaagcaggaagatgcgtgccaaggagacagcggtggtccccacgtgacccggttcaaggatacttatttcgttacgggaattgtctcgtggggagaaggatgtgcgagaaaaggaaagtacggtatctacaccaaggtgaccgcattcctgaaatggattgatcggtccatgaaaacgagaggcctgcccaaagcgaaatcccacgctccagaggtcatcaccagctcgccactgaag

SEQ ID NO: 9296 - DNA, 1464 bp, Artificial Sequence
  Description of Artificial Sequence: Synthetic coding sequence
atgggacggcctctgcacctagtattgctgtccgcctctcttgcaggactcctgctgctgggggagagcctattcatcagacgcgagcaagccaataatattctcgcccgggtcacacgggcgaattcatttctcgaggaaatgaaaaaggggcacctagagcgcgagtgcatggaggaaacttgtagttacgaagaggctcgagaggttttcgaagacagcgataagacaaatgagttttggaataaatataaggacggcgaccagtgtgagacaagcccttgccaaaatcagggaaaatgcaaggacggcctcggggagtacacctgtacctgtttggaaggctttgaggggaaaaattgtgaactattcacaaggaagctctgcagccttgataatggagattgcgatcaattttgtcacgaggagcagaatagcgtggtctgttcttgcgctcgggggtatacgctggccgacaacgggaaagcatgcattccaacaggtccctatccttgtggcaagcaaacactagaacgccgcaagcggtcagtggcccaggccactagctctagcggtgaagctcccgacagtatcacttggaagccctatgacgccgccgatctcgacccaactgagaaccctttcgacctgttggatttcaatcagacccagccggaacgaggtgacaacaacctgacacggatcgtcgggggacaggagtgtaaagatggggagtgcccttggcaggccctcttgattaacgaggaaaatgaagggttctgcggcggcacgatactttctgaattctacatacttaccgccgcacactgtctatatcaagccaaacgcttcaaagtgcgtgtgggtgatagaaacacagagcaagaagagggcggcgaagccgttcatgaagtggaagttgtgatcaagcataaccgcttcacaaaggaaacctacgatttcgatattgccgttctacggctcaagactccgattaccttcaggatgaacgtagcaccggcttgtttgccggagcgtgattgggcggaaagcactctgatgacccagaagacgggaatagtttcaggatttggaaggactcatgagaaaggacgccagagtaccaggctgaagatgctggaagtgccttatgtcgatcgcaattcatgcaaactctccagctcttttatcattacgcagaatatgttttgtgctggctatgacactaagcaggaagatgcctgccagggggatagcgggggcccacatgtcactaggtttaaggacacatacttcgtcaccggcatcgttagctggggagaaggctgtgcgcgaaaggggaagtacggaatttacactaaagtgaccgcgttcctgaagtggatagatagaagcatgaagacacgcggtctgcccaaggcgaaatcacacgctcctgaggttatcaccagttctccactcaaa

SEQ ID NO: 9297 - DNA, 1464 bp, Artificial Sequence
  Description of Artificial Sequence: Synthetic coding sequence
atgggaagaccattgcatctggtactgctcagcgctagcctggcaggcctgctcctactgggtgaaagcctgttcattaggcgagaacaggccaacaatattctggctcgggtcacacgggctaatagctttctggaagaaatgaagaaaggccaccttgaacgggagtgtatggaagagacttgttcatacgaagaggcacgagaagtctttgaggacagcgataaaaccaacgaattttggaacaaatacaaggacggcgaccagtgtgaaaccagcccatgccagaaccaagggaaatgtaaggacggcctcggagagtatacatgtacgtgcttggaaggttttgaggggaagaattgtgagctgtttacacgtaaactgtgttcgctggacaacggggactgcgaccagttttgccatgaggaacagaattccgttgtctgttcatgcgccagaggatacaccctggctgataatggcaaagcttgtatcccaacgggtccgtatccttgtggaaagcagaccttagaaagacgaaaacggagcgtggcccaggcaacgtcttccagcggagaggcacctgattctattacctggaagccctatgacgcagcggacctagatccgaccgagaatccattcgacctactcgatttcaaccagacccagcctgaaagaggagacaataatcttactcgcattgtgggtggacaggaatgtaaggatggcgagtgtccttggcaagctctgttaatcaacgaggagaatgagggattctgcggcgggaccatactgagcgagttttatatcttgaccgcagctcattgcttataccaggccaaacggtttaaggtccgggtcggtgatcgcaacactgagcaagaggaggggggggaggccgtacatgaagtcgaagtcgtcattaaacacaaccgttttacaaaagagacctatgatttcgacatcgcggtgctgaggctcaaaacaccaattacattccggatgaacgtggctccagcttgtctgcccgagcgggactgggctgagtcgacactaatgacacagaaaacgggcatcgtgtcaggcttcgggcgcactcacgaaaagggtcgacagagtactaggttaaagatgctcgaggttccatatgtcgaccgaaactcttgtaaattgagctcatccttcatcatcacgcagaacatgttctgcgctggatatgacaccaagcaggaggatgcttgtcagggggatagcggtggaccccatgtgacaaggttcaaggacacgtacttcgttacgggaattgtgagttggggcgagggatgcgcaagaaagggcaagtacggcatctatacgaaggtaactgccttcctgaaatggatcgaccgctcaatgaaaactcgaggcctacccaaagcaaaaagccacgccccagaggtgatcacatcctctccactgaag

SEQ ID NO: 9298 - DNA, 1464 bp, Artificial Sequence
  Description of Artificial Sequence: Synthetic coding sequence
atgggccggcccctgcatttagtcttgttgagtgcctctctggctgggcttctcctgttgggagagtctctgttcatcagacgtgaacaggcaaacaacatccttgccagagtgacacgagccaatagcttcctcgaagaaatgaagaagggacacctggaacgcgagtgtatggaggagacctgctcctatgaagaagccagagaggtcttcgaagactctgacaaaactaacgagttctggaacaagtacaaggacggagaccaatgcgaaacatccccctgccagaatcagggaaaatgtaaagatggcctgggggagtacacatgtacatgcctggagggctttgagggaaaaaattgtgagctgtttactcggaaactttgtagcctggataacggagactgcgatcagttttgtcatgaagagcagaatagcgtggtgtgttcgtgtgcacgcggctacacactcgccgacaatggcaaggcgtgtatcccaaccggcccatatccttgtgggaagcagacgttagaaaggagaaaacggtccgtggcccaagctactagctccagcggggaggccccggattctattacttggaaaccttacgacgctgccgatctagatccaacagaaaatccctttgacctcttggatttcaaccaaactcagcccgagcggggcgataataacctcactagaattgtgggcggacaggagtgtaaagacggcgagtgtccgtggcaggccttgttgatcaacgaagagaacgagggtttttgtgggggtactatcctcagcgagttctatatcttgaccgcagcccactgtctgtaccaagctaagagattcaaagtgagagtaggcgatagaaacactgaacaggaggaaggaggggaggccgtacacgaggttgaggtggtgattaagcacaaccggttcaccaaagagacatatgatttcgatattgcagtattacgcttgaagaccccaatcacttttaggatgaacgtggctcctgcctgtttaccagagagggactgggcagaatccactctgatgacgcagaagaccggtatagtttcagggttcggcaggacccatgaaaaaggacggcaatccactcgattgaagatgttggaggttccctatgttgataggaactcttgtaagctatcctcgagttttatcatcactcaaaatatgttctgtgccgggtacgacactaagcaggaagatgcttgccagggggattctgggggaccccatgtgaccagattcaaagatacgtatttcgtgacggggatcgtgagctggggcgaaggctgcgcccgtaagggtaagtatgggatctatactaaggtgacggccttcctaaaatggatagatcggagtatgaagactaggggcctcccgaaagcaaaatcgcacgctccagaggtgatcacaagttccccactgaaa

SEQ ID NO: 9299 - DNA, 1464 bp, Artificial Sequence
  Description of Artificial Sequence: Synthetic coding sequence
atgggtcgacccctgcatctcgttcttttgagtgcatctctggctggcctgctgctgctgggcgagagcctgtttatccggagggaacaagcaaataacattctcgcccgagtcactagggccaatagctttctggaggaaatgaagaagggacaccttgagcgcgaatgtatggaagaaacgtgtagctacgaagaggcaagagaggtgttcgaggactccgacaaaaccaatgagttctggaataagtacaaggatggcgaccagtgtgagactagcccatgccagaatcagggtaaatgcaaagatggattgggggagtacacgtgcacctgcttggaaggctttgagggcaagaactgcgagctgtttacccgcaagctctgctccctcgacaacggggattgcgaccaattttgccatgaggaacagaactccgttgtttgcagctgcgcaaggggctatacactcgcggataacggtaaggcctgcatcccaaccggaccctacccctgcggtaagcaaacattggagagacgtaagcgctcagtggcccaggctacctcctcgagtggggaggctccagactccattacgtggaagccatacgatgcggccgacctggacccaacagagaacccattcgatctcttggacttcaaccaaacccagccagaacgtggagataataacctgacaagaatcgtgggcgggcaggagtgtaaggacggcgagtgcccgtggcaagctttgttgataaacgaggaaaacgagggattctgcggtggtaccatcttgagtgagttctacatcctgacggccgcccattgtctctatcaggctaagcgattcaaagtccgcgtaggcgatcggaacacagagcaagaagagggcggcgaagctgtccacgaggtggaggtcgtcatcaaacataacaggttcacgaaggagacttatgacttcgatatagctgtcctacgactgaagacacccataacctttaggatgaatgtggctcccgcttgtcttcctgagagagattgggctgagtcgaccttgatgacccagaaaaccggaattgtgtctggattcgggagaactcacgagaaaggccgacagagcactagactgaaaatgttggaggttccttatgtggaccgtaattcttgcaaacttagcagctcattcattatcactcaaaatatgttctgtgccgggtatgacacaaagcaggaggatgcctgtcagggggattccggcgggccacacgttactaggtttaaggacacctacttcgttactggcatagtatcttggggcgagggatgcgccaggaaggggaaatatggaatttatacaaaagtcaccgcctttttgaaatggatcgatcgatcaatgaagacacgggggctgcccaaggccaagtcccacgcacccgaagtgatcacaagtagtcccctcaaa

SEQ ID NO: 9300 - DNA, 1464 bp, Artificial Sequence
  Description of Artificial Sequence: Synthetic coding sequence
atgggtagaccacttcacttagtactattgtccgcaagtctcgcaggcctattgcttcttggtgaatcattgttcatcaggcgggaacaggcaaacaatattctcgctcgggtgactagggctaactcctttttggaagagatgaagaagggtcatttggaaagagaatgcatggaggaaacctgctcctatgaggaggcaagagaagtgttcgaagatagcgataagaccaatgagttctggaacaagtataaggacggggatcaatgtgagacaagtccttgccaaaaccagggcaagtgtaaggatggcctcggggagtacacttgcacttgtttggagggcttcgagggtaaaaattgtgaattattcactaggaaactttgctctttggataacggcgactgtgatcaattctgccatgaagaacagaactcagtggtttgttcctgcgcccgcggttacaccctcgccgataacggaaaggcgtgcatccccactggtccatacccttgcggaaagcagacgttggagcgcagaaagcgttctgttgcgcaagcgaccagctcatccggcgaagccccagattctatcacttggaagccgtacgatgctgcggatctagatccgacagaaaaccctttcgacttgttggattttaaccaaacacaaccggagcgaggagacaataatctaacgcgtatcgtcggggggcaagagtgtaaagacggagaatgcccctggcaagctctattaattaacgaagagaacgaagggttctgcggtggcaccatactttccgaattttacatcctcactgccgcacattgcctttatcaggctaagagatttaaagttcgcgtgggggatcgtaataccgaacaagaagaaggaggagaggcagtccatgaggtagaggttgtgatcaaacataatcgtttcacgaaggaaacatatgattttgatatcgcagttttgagattgaagactcctatcacgtttaggatgaatgtcgcaccagcctgcctgcccgagcgtgattgggctgagtctactttaatgacccagaaaacgggcattgtaagcggatttggtcgtacccatgagaagggacgccaatccaccagacttaagatgcttgaggttccctatgtggataggaatagttgcaagctttcgtcttcatttatcatcactcagaacatgttctgtgcagggtacgatactaagcaggaagacgcatgtcagggcgatagtggaggcccgcatgtcaccaggttcaaagatacgtattttgtgacgggcatagtgtcttggggagaaggttgtgctagaaaaggcaagtatgggatttataccaaggtaactgcatttttgaagtggatagaccgctcaatgaagactaggggacttcctaaagccaaaagtcatgctcctgaggttatcacgtccagccctcttaag

SEQ ID NO: 9301 - DNA, 1464 bp, Artificial Sequence
  Description of Artificial Sequence: Synthetic coding sequence
atgggacgtccactgcatctggtgctcttgagcgcatcgttggcaggattgctcctcctgggtgaatccttgtttatcagaagagagcaagcgaacaacattctcgcgcgcgtgacccgcgctaattcgtttctggaggagatgaagaaaggacaccttgaaagagaatgtatggaagagacttgcagctacgaggaagcaagagaggtctttgaagattcagataaaactaatgaattttggaacaaatacaaggacggtgatcaatgcgagacttccccttgtcagaaccaggggaaatgtaaggatgggctcggagagtacacctgcacttgcctcgagggctttgaaggcaaaaactgcgaactgttcactagaaagctgtgttcactcgacaacggcgattgtgatcagttctgtcatgaggaacagaactccgtcgtctgctcatgtgcaaggggatatacccttgcggacaatggtaaggcgtgtatccctaccggaccctacccatgtggtaaacagactttggagagaaggaagagatccgtggctcaggcaacctcgtcctcgggagaagcgcctgattcaatcacctggaaaccctacgatgcagcagatcttgatccaaccgagaacccctttgacctgctggactttaaccaaacccaaccagaaagaggggacaataaccttaccagaatagtcggaggacaagagtgtaaggacggagaatgtccttggcaagcactccttatcaacgaggagaacgaaggcttctgtggaggtactattctgagcgaattctacatcctcaccgctgcccattgtctctaccaggcaaagcggtttaaagtcagagtcggggacagaaatactgaacaggaagaaggtggcgaggcagtgcatgaagtcgaagtggtgattaagcataatcggtttacgaaggagacgtacgattttgacattgcagtccttcggctcaagactccaataacctttcggatgaatgtggcaccagcatgcctgcccgaacgcgattgggctgagtccactctcatgacccagaaaactggaatcgtgtccggtttcggaaggacccatgagaaaggccggcaatccactagacttaagatgcttgaggtgccttacgtggatcggaactcttgcaagctctcgtcgtccttcatcataactcagaatatgttttgtgcaggatacgatactaagcaggaggacgcctgccagggagattcgggcgggccacatgtgacccgctttaaggatacttactttgtgaccggtattgtgtcatggggagaaggatgtgcacgcaaggggaaatacgggatctataccaaggtcactgcttttctgaaatggattgatcgctcgatgaaaaccaggggtctgccaaaggcaaagtcgcacgcacccgaagtgatcacgtcaagcccactgaag

SEQ ID NO: 9302 - DNA, 1464 bp, Artificial Sequence
  Description of Artificial Sequence: Synthetic coding sequence
atgggccgtcccctacatttagttctgctctccgcgtccttggctggtctgctcctgctgggagagagcctctttatccgacgagaacaggccaacaacatcctagcccgtgtcactagggctaactccttcctggaagaaatgaagaagggccacctcgagcgagagtgcatggaggagacctgttcgtacgaagaggcccgcgaagtcttcgaagattcggacaagaccaacgagttctggaacaagtacaaggacggcgaccaatgcgagacctccccgtgtcaaaatcagggcaagtgtaaggatggcctgggtgagtatacctgcacttgtctggagggctttgaaggcaagaattgcgaacttttcacccgtaagctgtgcagcctggacaacggcgactgcgatcagttctgccacgaggaacagaactccgtcgtctgtagttgcgcccgcggctatacactggccgataacggtaaggcctgcatccccacgggaccgtacccgtgcggcaagcagaccctggagcgccgcaagcgcagcgtggcacaggccacgtccagctccggcgaggctcccgacagcatcacctggaagccctacgacgccgccgatctggaccctactgagaacccgttcgacctcctcgatttcaaccagacccaacctgagcggggcgacaacaaccttacccgcatcgttggcggacaggagtgcaaggacggggaatgcccttggcaagccctcctcatcaacgaagagaacgagggcttctgcggaggtactatcctcagcgaattttacatcttgacggcagcccactgtctctaccaagccaagcgtttcaaggtccgggtcggtgatcgaaataccgagcaagaggagggtggcgaggccgttcacgaagtggaagtagttatcaagcacaaccgctttaccaaggagacctacgattttgacatcgccgtcctcaggctcaagacccctatcacctttcgtatgaacgttgcccctgcttgtctgcctgaacgcgattgggccgagtccactctgatgacccaaaagacaggcattgtctcggggttcggacgaacccacgaaaagggccgccagtccactcgcttgaagatgctcgaagtcccctacgtcgaccgcaactcttgcaaattgagcagttccttcatcatcacgcagaacatgttttgtgccggctacgacaccaagcaggaagacgcgtgtcagggtgacagtggaggaccacacgtaacccgattcaaggatacctatttcgtgactggaatcgtctcctggggggagggttgtgcccgaaaaggcaagtacggtatctacacgaaggtgactgctttcctcaagtggattgataggtccatgaagactcgcggtctgcctaaggccaaatctcacgcgccggaggtgatcacatcctcgcctcttaaa

SEQ ID NO: 9303 - DNA, 1464 bp, Artificial Sequence
  Description of Artificial Sequence: Synthetic coding sequence
atgggacgtccattgcacctggttctcctgagtgcatccctcgcaggcctgctgctccttggcgaatccctctttatcagacgcgaacaggctaataatatactggctagggtgacaagagcgaatagttttttggaagagatgaaaaaagggcatctggaacgcgagtgtatggaagagacgtgtagctatgaagaagctagagaagtttttgaagacagcgataagacgaacgagttctggaacaaatacaaggacggagatcagtgtgagacatcgccgtgtcaaaaccaggggaaatgcaaagacggtttgggggagtacacgtgcacgtgtttggaaggatttgaaggtaaaaactgcgaattgttcacaaggaagttgtgctctcttgacaatggcgattgtgatcagttttgtcatgaagaacagaattcggttgtttgttcctgcgctagaggctacactcttgcggataatgggaaggcttgcattcctacgggcccatatccgtgcgggaaacaaacgctagaaaggaggaaaagatcggtggcgcaggcaacatctagttcaggagaagcgccggactcaatcacatggaaaccctatgacgcggccgacctagacccaacagaaaatccctttgacctgttggattttaatcaaacgcaacctgaacgcggagataataatttaacaagaattgtgggtggtcaggagtgcaaagatggcgaatgcccgtggcaggccttactgatcaatgaggaaaatgaaggattttgcgggggaactattttgtccgagttttatatcttaactgctgcgcactgtctttatcaagctaagagatttaaagtccgggtcggagatcgaaatacagaacaagaagaaggtggcgaagccgttcatgaagtggaagtcgttatcaagcacaatcgcttcacaaaagaaacatatgactttgatattgcagtcttacgtcttaaaacgccgataacatttcgtatgaatgtcgcgcctgcttgcctccctgaacgggattgggcagagtcgacgcttatgacacagaagacaggaatcgtttctggcttcggacggactcatgaaaaaggccgtcaatctacgcgactaaaaatgttagaggttccatatgtggatcggaattcttgcaaacttagttcatcttttattatcacacagaacatgttttgcgcgggctatgatacaaagcaagaggatgcttgccagggagatagtgggggacctcatgtgacccgttttaaagacacttattttgtgacaggaattgtcagctggggtgagggctgcgcacgaaagggaaagtatggcatttacacaaaggtcacggctttcttgaaatggatcgatcgctccatgaagacaagaggcttgccaaaggctaaatcccatgcacctgaagtgattacaagcagcccattaaaa

SEQ ID NO: 9304 - DNA, 1464 bp, Artificial Sequence
  Description of Artificial Sequence: Synthetic coding sequence
atgggccgccccctccatttggttcttctttcagccagccttgccggattattgttactgggcgagtcattgttcatacgccgagagcaggccaacaacatcctcgctagagttactcgggcaaatagcttcctcgaagagatgaagaaggggcatctggagagagaatgcatggaggagacatgctcctacgaagaggccagggaagtcttcgaagactctgacaagacaaatgagttctggaacaaatataaagatggagaccagtgtgagacaagtccctgccagaaccagggtaagtgcaaagacggactgggagagtacacgtgtacttgtttggagggatttgagggcaaaaactgtgagctgtttaccagaaaactgtgttcacttgataacggagattgtgaccagttctgccacgaggagcagaactctgtggtgtgcagctgcgcgagaggttacaccctcgctgataacgggaaggcctgtattccgacaggcccctacccttgcggcaagcaaacccttgagcgtaggaagaggtcagtggctcaggcaactagttcttccggcgaagctccggacagcattacctggaaaccatacgacgctgcagacctggaccctaccgaaaaccctttcgacctgttggactttaaccaaacacagcccgagcggggcgataataaccttaccagaatcgtaggagggcaggaatgtaaagatggcgaatgtccttggcaggctctgctgatcaatgaggaaaatgaggggttctgcggggggaccatattgtctgagttttacatccttactgctgcccactgcctttatcaggccaaaagattcaaggtgagggttggggaccggaataccgaacaggaagagggaggtgaagcagtgcacgaggtagaagtggtcattaagcataacaggttcaccaaagaaacatatgacttcgatatcgctgtgcttcgccttaaaacaccgatcacgttcaggatgaatgtggccccagcctgtttgcctgagcgagactgggcagagtccacactcatgacacagaagaccggtatcgtttccgggtttgggaggacccacgagaagggtcggcagtctacgcgactcaaaatgttggaggtgccctacgtggatcggaatagttgtaagctgtcaagcagcttcattatcacgcagaacatgttctgcgctgggtacgatactaaacaggaggacgcctgccagggagatagtggaggaccacacgtgactcgattcaaggacacatactttgtgaccggaatcgtcagctggggtgagggatgtgcccggaaaggaaagtatggcatttatacgaaggtcactgcattcctcaaatggatcgaccgctctatgaaaacccgggggttgccgaaggccaaatctcacgccccggaagtgatcacgagtagccccttaaag

SEQ ID NO: 9305 - DNA, 1464 bp, Artificial Sequence
  Description of Artificial Sequence: Synthetic coding sequence
atgggacgccctttgcatctggtgcttctcagcgcctcactggcaggcctgttgctgctgggcgagtcccttttcatccggagagagcaggcaaacaacattctcgcacgggtgacccgagccaatagctttcttgaggagatgaagaaggggcacctggagagagagtgtatggaagagacgtgttcgtacgaagaggcgagggaggtgtttgaggattcagataagaccaacgaattttggaataagtacaaggacggggatcaatgtgagacttcaccatgtcagaaccaggggaagtgtaaggatggcctcggtgaatacacctgtacttgcctggaagggtttgagggtaagaactgcgagctttttaccagaaagctgtgctctctggacaacggagattgtgatcagttttgccatgaagaacaaaattccgtggtctgttcctgtgcaagaggttatacccttgcggataatggcaaggcttgcatacctactggtccgtacccgtgcggaaagcaaacgttggagcgtcgcaagcgtagcgtggcgcaagcgacgtcctccagcggcgaagcacctgattcaataacgtggaagccgtacgatgcagccgatcttgatcctacggaaaacccttttgacctgttggatttcaaccaaacgcaacccgaaagaggggataacaacctgactcgcatcgtcggaggtcaggaatgtaaagatggagagtgcccatggcaggctcttctcatcaatgaagaaaatgagggattttgcggtggaactatacttagcgaattctacattcttactgcagcccattgtctctaccaggcaaaacgtttcaaagtccgtgtgggagatcgcaacaccgaacaagaagaaggaggtgaagcagttcatgaagtggaagtcgtcattaagcacaataggttcaccaaagagacgtacgattttgatatcgctgtgttgcgattgaaaacccccattacttttcgcatgaacgtggcaccagcatgtctccctgagagggactgggcagagtcgacccttatgacgcagaaaactggtatcgtgtcaggatttggacgcactcatgaaaaagggagacagtccactcggctgaagatgcttgaggtcccgtacgttgacaggaactcgtgcaagctctcttcgtcgttcataatcacccagaatatgttctgcgcaggttacgacaccaagcaagaggatgcatgtcaaggcgactcgggtgggccccacgtaacgaggttcaaagatacctacttcgtgactggaatcgtgagttggggtgaaggttgcgcacggaagggaaagtatggaatttacaccaaggtcaccgcatttcttaaatggattgatcgttccatgaaaacgcggggacttcctaaagcaaagtcccatgcccctgaggtgattactagctccccccttaag

SEQ ID NO: 9306 - DNA, 1464 bp, Artificial Sequence
  Description of Artificial Sequence: Synthetic coding sequence
atgggacgccctctgcacttggtactcctgtcagccagtctagctggactgctactcctgggggaatctctgtttatacggcgcgagcaggccaataacatactcgcacgcgtcacaagagcaaattcatttcttgaagaaatgaaaaaaggacacctcgaacgagaatgcatggaagaaacatgttcgtatgaggaagcccgcgaagtgttcgaagactcggataaaactaacgaattctggaataaatataaagatggagatcagtgcgaaacgtccccttgtcagaaccagggaaaatgtaaagatgggctcggggagtatacttgtacttgtctagaagggtttgaaggaaaaaactgtgaactgttcactcggaaactatgttctctggataatggggactgcgatcagttctgccatgaagagcagaactcagtggtctgttcatgcgctagggggtatacactggccgataacgggaaagcttgtatacctactggaccctatccttgcggaaaacagactctagaaaggaggaagcgttctgttgcccaggccactagttcttctggagaggcccccgactccatcacatggaaaccctacgatgccgctgatttagatcccacagaaaacccattcgatctcctggatttcaaccagacacagcctgaacggggagataacaatttaactagaattgtaggggggcaggaatgtaaagatggggaatgtccttggcaggctcttctaattaacgaagaaaacgagggattctgcggagggactatcctgtccgaattttatatcctgactgctgcccactgtctgtaccaagctaaacgctttaaggtgcgggtaggggataggaacactgaacaggaagaagggggagaggctgttcacgaagtagaagtggtaattaagcataaccgctttactaaggaaacatatgatttcgacatcgccgttctgcggcttaaaactcctataactttcaggatgaacgtggcacccgcttgtctacctgaaagggattgggcagaatccactttaatgactcagaaaactggaatagtgtccggatttggaagaacacatgaaaaaggacggcagtctactagactgaaaatgctcgaagtcccctatgtggatcgcaactcatgcaaactatcatcaagtttcataataactcaaaatatgttctgtgcaggatacgatactaaacaggaagatgcctgtcagggggactctggggggccacacgtgactcggtttaaagatacatattttgtaacaggaatagtttcatggggagaagggtgtgccaggaaaggaaagtatggaatttatacaaaagtcacagcctttttgaaatggatcgataggtccatgaaaacaaggggattacccaaagccaaatcccacgcccctgaggtaatcactagttcccctctcaaa

SEQ ID NO: 9307 - DNA, 1464 bp, Artificial Sequence
  Description of Artificial Sequence: Synthetic coding sequence
atgggtagacccctgcacctggtgctgctctccgcgtcgctggccggcctcctgctgctcggggagtcgctgtttattcgccgcgaacaggcgaataacatcttggcccgcgttactagagctaactccttccttgaagaaatgaagaaggggcacctggaacgggagtgtatggaggagacgtgcagctacgaagaagcccgcgaagtgttcgaggacagcgataagaccaacgaattctggaacaagtacaaggacggcgaccaatgcgaaacttctccttgtcagaaccaaggtaaatgtaaggacgggctcggggaatacacctgcacctgccttgaagggttcgaaggcaagaattgcgagctttttactcgcaagttgtgctcgctggataatggcgattgtgaccaattctgccatgaggagcagaactccgttgtctgcagctgcgccagaggctacacgctggcagataatggaaaggcttgcatcccaactgggccatatccgtgcggaaagcagacgctcgaaagaagaaagagatcagtggcgcaagctacttctagcagcggagaggcgcccgactccatcacctggaagccatacgacgcggccgacctggatccgaccgaaaacccattcgacctccttgacttcaaccagactcagcctgaaagaggagataacaatctgactcgcatcgtgggaggacaggaatgcaaagatggtgaatgtccatggcaggccctcctgatcaatgaggagaacgagggattctgtggaggtaccatcctcagcgagttttacattttgaccgcggctcactgcctttaccaagccaaacgcttcaaggtgagggtgggggatcgcaacactgaacaggaagagggaggagaagccgtgcatgaggtcgaggtcgtgatcaaacataacaggttcacgaaggaaacgtacgatttcgacatcgccgtgctccggctgaaaactcctatcacttttcgcatgaatgttgcccctgcctgtttgcctgaaagagactgggcagagtccacgttgatgactcagaaaacgggaatcgtgtcgggattcggcaggacccacgagaagggacggcagtccactagactcaagatgctggaggtgccatacgtggaccgcaactcctgcaaactgagctcatcgtttatcattacccaaaacatgttctgtgccggatacgataccaagcaagaggacgcatgccagggagactcgggaggacctcacgtcaccaggttcaaggacacttactttgtgaccggaattgtctcgtggggagaaggatgcgccaggaaaggcaaatacggaatctacaccaaagtgactgcattcctgaagtggatagaccggtcaatgaaaacgcggggcctgcctaaggcgaagtcgcatgccccagaagtgatcacctcatcgccgctcaag

SEQ ID NO: 9308 - DNA, 1464 bp, Artificial Sequence
  Description of Artificial Sequence: Synthetic coding sequence
atgggtagacctctgcacctggtgctgctttccgcgtccctggcagggcttctgcttctgggcgagagccttttcataagaagagagcaggcaaacaacattttggcgagagttacgagggctaattcgttccttgaagagatgaagaaaggtcacttggaacgggaatgtatggaagaaacttgttcatacgaagaagcgagggaggtgtttgaggattccgataagactaacgagttctggaacaagtacaaggacggggatcaatgtgaaaccagcccctgtcaaaatcaagggaaatgtaaggatggtttgggagagtacacttgtacttgtctcgaaggctttgaagggaagaactgtgaacttttcacccggaagctgtgctcccttgataacggtgattgtgatcagttctgtcacgaagaacaaaacagcgtggtgtgttcgtgtgcaagggggtacacccttgcagacaatggaaaagcatgtattccaaccggaccgtacccatgcggaaagcagaccctcgaaagaagaaaaaggagcgtggcacaagccactagctcatctggtgaagcaccggatagcattacttggaagccttacgatgctgcagatctggatcccactgagaacccctttgatctcctggatttcaaccagactcaacctgaaagaggtgataacaacctcacccggattgtcggagggcaagaatgtaaggacggtgaatgtccgtggcaggcacttttgattaacgaggagaacgaaggattctgcggtggcactattctgtccgagttttacattcttacggccgcgcattgtctttaccaagcaaaacgctttaaggtccgcgtgggcgacagaaacactgaacaggaggagggcggcgaggcggtccacgaggtggaagtggtgattaaacataaccggtttaccaaagaaacctatgatttcgatatcgcagtgctgagacttaaaactccaataaccttccggatgaacgtggcaccagcctgtttgccagaacgggactgggcagagtcgaccctgatgacccaaaagacggggattgtgtcgggatttggtcggactcatgaaaagggacggcaatcgactcgactgaagatgcttgaagtcccctacgtcgatagaaactcgtgcaagctctcctcgtcgtttatcattacgcagaacatgttttgcgccgggtacgatactaagcaggaggacgcttgtcaaggggactcggggggccctcatgtcactcgtttcaaggacacctattttgtcacgggtatagtctcatggggagaaggctgcgcacgaaagggcaagtacggaatctacaccaaggtgactgccttccttaaatggattgatcgttccatgaaaacgcggggactgccaaaagcgaaaagccacgcacctgaagtgataacctcctcaccacttaaa

SEQ ID NO: 9309 - DNA, 1464 bp, Artificial Sequence
  Description of Artificial Sequence: Synthetic coding sequence
atggggaggcctctccatcttgtcctgctttccgcctcgctcgccggcctgcttctgcttggagagagcctatttattcgcagagaacaagcgaacaatatactggccagagtcacacgggccaacagtttcttggaggagatgaaaaagggtcacctggaaagggaatgtatggaagaaacctgcagctacgaggaagctcgggaggtgttcgaagattcggataagactaacgaattctggaataaatacaaggacggcgaccagtgtgagactagcccatgtcagaatcaagggaaatgcaaagacggcctgggtgagtatacatgtacttgtctggagggatttgaaggaaaaaattgcgaactttttactcggaaactttgcagtctggacaacggggactgtgaccagttttgtcatgaggagcagaactccgtagtctgctcttgcgcccgtggatatactctagcagacaacggtaaagcctgtattccaaccggcccatacccgtgtgggaaacagacactggaaagacgcaagcgctctgtggcacaggccacatccagttcgggagaagcaccagactccatcacctggaaaccttacgatgccgccgacctcgatcctacagagaaccctttcgatctactggatttcaatcagactcaacctgagcgtggggacaataacctgacacgaatcgttggcggtcaggaatgtaaagatggcgagtgtccgtggcaggccctgctgattaacgaggagaacgaggggttctgcggggggacaattctatcggagttctacattctgacagcagcacactgcctgtaccaagccaagaggttcaaggtaagggtgggcgatcgaaatactgagcaagaggaagggggcgaggcagttcacgaagtagaggtagtcataaaacacaacaggttcacaaaagagacctacgactttgatatcgccgtgcttaggcttaagacacccataacattccgcatgaatgttgccccagcctgcctccctgagcgagattgggccgagagtaccctcatgacacagaagactggaatcgtcagtgggtttgggcgtacacatgagaaggggaggcagtcgacacgcctgaaaatgctggaagtaccttatgtggacagaaactcatgcaaactgagctctagttttatcataacccagaacatgttctgcgccgggtacgatactaagcaggaagatgcctgccagggagatagcggcggcccacacgtgacacgattcaaggacacctatttcgtcactggaattgtatcatggggagagggctgcgcccggaaagggaagtacgggatttatactaaagtgacagcatttcttaaatggatcgatcgctccatgaagacacggggccttccgaaagcaaaaagtcatgcgcccgaagtgataacctccagtccactgaag

SEQ ID NO: 9310 - DNA, 1464 bp, Artificial Sequence
  Description of Artificial Sequence: Synthetic coding sequence
atgggccgaccgctgcatcttgtgctactctccgcctctcttgcagggcttctgttgctcggtgagtcgcttttcattcgccgagagcaagcgaataatattttagcacgcgttactagggctaattcgtttctggaggagatgaagaagggtcatctggaacgtgaatgcatggaagagacctgttcttatgaggaggcccgtgaggttttcgaggattccgataagacaaacgaattctggaataagtacaaggatggtgaccagtgcgagacatccccctgccagaatcagggtaaatgtaaggatggattgggtgagtacacgtgcacctgtctggagggattcgaaggcaaaaattgtgaactgttcacaaggaaactctgttcactggacaacggcgattgcgaccaattctgtcatgaggagcagaatagtgtcgtctgtagttgtgcccgcggctacaccctcgcggacaacggcaaagcttgcatccccaccggtccctacccgtgcggtaagcagacacttgagcgccgaaagcgatctgtggcgcaggcaacctcatcaagcggagaagcacctgactcaatcacttggaagccttacgacgcagccgacttggaccctactgaaaacccatttgacttactggattttaaccaaacacagcccgagagaggcgacaataatctaacacgaatagtgggcggtcaggagtgtaaggatggagaatgcccatggcaggcactgctcattaacgaggaaaatgaggggttctgcggcgggacaattctgtctgaattctatattctaacagctgcccactgtctttatcaggcgaaaagattcaaagttcgcgtcggagatcgcaacacggaacaggaggaaggtggagaggcagtgcatgaggtcgaggtggtgataaaacataaccggttcaccaaggaaacctacgactttgatatagcagttttgcgcttaaagacacccatcacctttcgcatgaacgtggcaccagcctgtctgcctgaacgcgactgggctgagagcacattgatgacgcaaaaaacaggtattgtgagcggtttcggacgcacccatgagaagggacgccagtccacccgactgaagatgctggaggtgccctatgtcgatcggaactcatgcaaattgtcctcatcgtttatcattacacagaacatgttttgcgctggctacgacactaagcaggaggacgcatgtcagggggactccggcggacctcatgtaacgagattcaaagacacctattttgttacggggatcgtaagctggggggagggttgcgcacggaagggaaagtacggcatttataccaaagtgacagccttcctgaagtggatcgaccggtcaatgaaaacacggggcctaccaaaggccaagtcacatgctcccgaggttataacctcaagcccattgaag

SEQ ID NO: 9311 - DNA, 1464 bp, Artificial Sequence
  Description of Artificial Sequence: Synthetic coding sequence
atgggtagacctctgcacctcgtgctgctctcagcctccctggccggacttctccttttgggagaaagcctctttattcggcgagagcaggctaacaacatcctggcccgggtgaccagagcaaactcgttcctggaagaaatgaaaaagggacacctggaacgcgagtgcatggaggaaacttgttcctatgaagaagcgcgggaagtgttcgaagattcggataagactaatgaattctggaacaagtacaaggatggagatcaatgcgagacttcgccctgtcagaatcaggggaagtgcaaggacggactgggagaatacacgtgcacctgcctggaggggttcgaagggaagaactgtgagctgttcactcgcaaactttgttcgctggacaacggagactgtgaccaattttgccatgaagaacaaaactccgtggtgtgctcatgcgcacgcggctacaccctggcggacaacggaaaggcgtgcatcccgactggcccttacccgtgcggcaagcagactctggaacgccggaagagatccgtggcccaagccacttcctcgtcgggagaggcaccagactcaatcacttggaagccgtacgacgcagcggacctcgatccgactgaaaacccgttcgatctcttggatttcaatcagacgcagccggagcggggcgacaataacctgactcggatcgtgggaggacaggaatgtaaagacggtgaatgcccatggcaggcactgctgatcaatgaggagaatgagggattttgtgggggaacgatcctgtccgagttctacatcctgaccgccgcacattgcctgtatcaagccaagcggttcaaggtgcgggtgggggaccgcaacaccgaacaggaagaaggaggcgaagcagtgcatgaagtcgaggtggtgatcaagcataaccgcttcaccaaggaaacctacgacttcgatatcgcggtgctgcggctgaaaactcctattacctttcggatgaatgtcgcccctgcatgtctccctgagagagactgggcagaatcgaccctcatgactcaaaagaccggaatcgtgtcgggtttcggtcggactcatgagaaaggtaggcaatctaccagactgaagatgctcgaggtcccgtacgtggatcggaactcatgtaagttgtcatcgagcttcatcattacccaaaacatgttctgcgcaggctacgatactaagcaggaagatgcttgccaaggggactctggcggaccgcacgtgacccggtttaaagacacttacttcgtcactggaatcgtgtcatggggggaggggtgcgcgcgcaaggggaaatacggaatctacactaaggtcactgcattcctgaagtggatcgaccggtccatgaaaactcgcggcctccctaaggccaagagccacgccccggaagtgataacgtcgagcccacttaag

SEQ ID NO: 9312 - DNA, 1464 bp, Artificial Sequence
  Description of Artificial Sequence: Synthetic coding sequence
atgggcaggccactccacctggtcctgctgagcgctagcctcgcgggcctgttgctgttgggagaaagcctgttcattcgcagggagcaggctaacaatatcctggcccgtgttacccgagccaattcttttctggaagagatgaaaaaaggtcacctggaacgcgagtgcatggaagagacttgcagttacgaagaagctcgcgaggtcttcgaagactcagacaaaactaatgagttctggaataaatataaagacggtgaccagtgtgaaacttcaccatgtcaaaatcagggaaagtgcaaggatggcctcggagagtacacctgcacatgtctggagggttttgagggcaagaactgtgagctattcacgcgtaagttgtgctccctggataatggagattgcgatcagttctgccacgaggagcagaactccgtggtgtgtagctgcgcgcgcggttacaccctggcagacaatggcaaggcatgtatcccgaccggtccttatccgtgcggtaagcaaaccctggagagaaggaaaagaagcgtcgcacaagctactagctcctccggagaggctccagattccatcacctggaagccttatgatgcagccgatctggatccaactgaaaatccattcgaccttttggattttaatcagacccagcccgaacgtggcgataataacctcacccgcatcgttggcggccaggaatgtaaggatggcgagtgtccatggcaggcgctgttaattaacgaagagaacgaagggttttgcggcggtacaatactctcggagttttatattctgacagcagctcactgcctttaccaggccaaacgctttaaagtgcgcgtcggtgaccgcaataccgagcaggaggagggcggtgaggccgtccatgaggtggaggtcgttattaaacacaacaggttcaccaaggaaacatacgatttcgacattgctgtactgcgcctgaaaacgccgatcacgtttcgcatgaacgtggctccggcatgtctgcctgaacgcgactgggctgaatccaccctgatgacccagaagaccggcattgtgagcggtttcggacggacacacgagaaaggccgtcagagcacccggctgaagatgcttgaggtgccgtacgtcgaccgcaatagctgtaagctctcttcatcctttattatcacccagaatatgttttgcgcaggctacgacacgaagcaggaagatgcgtgccagggagattctgggggcccacacgttaccaggttcaaggacacatactttgtgacgggaatcgtttcttggggggagggatgcgcaaggaagggtaaatacggtatatatacgaaggtgacagcatttctaaaatggatcgaccgcagcatgaagacccgcgggctcccgaaggcaaagtcccacgcaccagaagttataacgtctagcccgctgaag

SEQ ID NO: 9313 - DNA, 1464 bp, Artificial Sequence
  Description of Artificial Sequence: Synthetic coding sequence
atggggcgaccattgcacctggtcctgctcagtgccagcctggccggtctgctactcttaggagagtccttattcatccggcgagagcaagcaaacaacatcctagccagggttacgagggcaaacagcttcttggaggagatgaaaaaaggccaccttgagcgtgagtgcatggaagaaacgtgctcatacgaggaagcacgggaagtgtttgaggatagcgacaaaactaacgagttctggaataagtataaagatggagaccaatgcgagacaagtccgtgtcaaaatcaaggcaaatgcaaggacggcctgggagagtacacttgcacctgtctggagggattcgaaggaaaaaactgtgaactgtttacaaggaagctgtgtagtttggacaatggagattgcgatcaattctgccatgaagagcaaaatagcgtggtgtgtagctgcgctaggggatatacactggctgacaatggtaaagcttgcattccaaccggcccatatccctgcggcaagcagacgctggagcgcaggaagagaagcgtggctcaggccacttcttcttcaggggaggcccccgattccatcacttggaagccttacgacgcagccgatctcgacccaactgaaaatccttttgatctgcttgatttcaatcagacccagcctgagcggggcgataacaatcttacccgtattgtcggaggtcaagagtgtaaggatggcgagtgcccctggcaagctttgttaatcaatgaagaaaacgagggattctgtggggggacaattcttagcgagttctacattcttaccgccgcacattgcctgtatcaggcaaagagatttaaagtaagggtgggtgataggaacacggagcaggaagagggaggtgaagccgtccatgaggtcgaggtggtgattaaacacaacagattcaccaaggagacctacgacttcgacattgcagtcctgaggctcaaaacccctatcactttccgcatgaacgtagcaccggcctgtttaccagaacgggattgggcagaatctacactcatgacgcaaaagaccggaattgtcagtgggttcggaagaacccacgaaaaaggaaggcagtccacacggctgaaaatgttggaggtgccttacgtcgatcgaaacagctgtaaactgagctctagctttatcatcacacagaatatgttttgtgctggatatgacaccaagcaggaggacgcgtgtcagggagactcagggggccctcatgtaaccaggttcaaggatacttatttcgtgacaggaatcgtgagctggggggagggttgtgcccggaaggggaagtacggtatttacacaaaagtgacggccttcttgaagtggattgaccggagtatgaaaacgagaggcctcccaaaagctaagagtcacgctccggaagtgattaccagctcgccgctgaaa

SEQ ID NO: 9314 - DNA, 1464 bp, Artificial Sequence
  Description of Artificial Sequence: Synthetic coding sequence
atgggacggccactgcatcttgtcctactatctgcctcgctcgctggtctgctgctcctcggggaatccttgttcatccgccgtgaacaggccaacaatatacttgcgcgagtcacaagggctaatagcttcctggaagagatgaagaaaggccatctggagagggaatgcatggaagagacttgtagctacgaggaggcccgtgaggtttttgaggacagtgacaagacgaatgaattctggaataagtacaaggatggtgaccaatgtgaaacatctccatgtcagaaccaaggtaagtgcaaggacggtctaggcgagtatacatgtacttgccttgagggctttgaaggaaagaattgcgagctgtttactcgtaaactgtgctctctggacaatggcgactgcgatcaattttgtcatgaggagcagaactccgtcgtgtgttcgtgtgcccggggttatacattggcagacaacggcaaagcctgcatccctacggggccatacccatgtggtaaacagacgttggagcgacgcaagcgaagtgttgcacaggcaacctcgtcctctggcgaggccccagactctataacctggaaaccatatgacgcggctgacttagatccaactgaaaacccattcgatctactggatttcaaccagacgcaaccggaacgaggagataacaatctgaccagaatcgtgggtggacaggaatgcaaggacggggagtgtccctggcaagcgcttctaataaacgaagagaacgagggcttctgcggaggaacgatcttgtcggagttttacatcttaacggctgctcattgtctttatcaggccaagcgattcaaagttcgcgttggggaccgtaacacagaacaagaagaaggcggcgaggcagtccatgaagtggaggtcgtcattaagcataaccggtttacgaaagagacatatgattttgacatagctgttttgcggcttaaaaccccaataacattccgaatgaacgtggctcctgcatgtctgccagaacgggactgggcagaatcaacactgatgacccaaaagaccggcattgtgtccggattcggacgtacacacgagaaaggcagacaaagtactcgtttgaagatgctggaggtaccttatgtcgaccgcaattcgtgtaaactatcttcgtccttcattattacccagaacatgttctgcgccggatacgacacaaagcaggaagatgcgtgccaaggcgacagtggggggccgcacgtgacaaggtttaaggatacgtactttgtcacgggtatcgtctcgtggggggaggggtgcgcgaggaaaggcaaatacgggatctatacgaaggtgactgccttcctaaagtggatcgatcgttctatgaagacgcgcggacttcctaaagcgaagagccatgctccggaagtcataacatcatctccactcaag

SEQ ID NO: 9315 - DNA, 1464 bp, Artificial Sequence
  Description of Artificial Sequence: Synthetic coding sequence
atggggcgccccttgcatctggtcctgctgtctgcgtcccttgccggcctgcttttgcttggcgaaagtttgtttattaggagagagcaggccaataacatactggctcgggtcactcgggcaaactcgtttctggaggaaatgaagaaaggacatctcgagcgggaatgtatggaagagacttgctcctatgaggaggcaagggaggtatttgaggattcagataaaacaaatgagttctggaacaaatacaaggacggtgaccagtgtgagacctcaccatgtcagaatcaaggcaagtgtaaagacggactgggagagtacacttgtacctgtttggaaggatttgaaggaaaaaattgtgagttatttactcgcaagctctgtagcctagacaatggggactgcgatcagttctgtcacgaagaacagaattccgtagtgtgctcttgtgcgaggggctatacacttgccgacaacggaaaagcctgtatcccgacggggccctatccctgcgggaaacagactctcgaacgccgcaaacgctccgtggcacaggccacatcaagttctggcgaagcccccgactcaatcacttggaaaccctacgacgctgcagatctagatcccactgagaaccctttcgatctgctggatttcaaccaaacacaacctgagaggggagataataacctcactcgaatagtgggcggtcaggagtgcaaggacggcgagtgtccatggcaggctctgctgatcaacgaggagaacgagggtttttgcggcgggaccattctctcagagttctatattttgacagcggctcactgcctgtaccaggcgaaaaggttcaaggttcgcgttggggacagaaacacagaacaggaagaaggaggggaagctgtgcacgaggtcgaggtcgtcataaagcacaacaggtttacaaaagaaacctacgacttcgacattgcagtgctaaggctgaaaaccccaatcaccttccgcatgaatgtggctcctgcctgtctcccagaacgcgattgggccgagagtacgttaatgactcagaagacaggcatcgtgtccggtttcggcaggacacacgagaagggccgccagagcaccaggctgaaaatgctggaagtgccatacgttgatcgcaactcttgcaagctgagttccagcttcatcataactcaaaatatgttttgtgccggatacgatactaaacaggaagatgcctgccagggggatagcggaggtcctcacgtgactcgattcaaagacacctacttcgtcacgggcatcgtctcctggggagagggctgcgccaggaaagggaagtacgggatctacactaaggtgaccgcgttcctcaaatggatcgataggtccatgaaaacacgtggacttcctaaagctaagtcacacgcaccagaggtgataacgtcctcccctctcaaa

SEQ ID NO: 9316 - DNA, 1464 bp, Artificial Sequence
  Description of Artificial Sequence: Synthetic coding sequence
atgggaaggcccctgcatctggtcctcctttccgcgtcgcttgctggattgctgctgcttggcgaatcgcttttcatcagaagagagcaggcaaacaatatacttgccagggttaccagggccaactcgtttctggaggagatgaaaaaaggccatttggagagagagtgtatggaggaaacttgttcctacgaagaagcacgggaagtgtttgaggattcagacaagaccaatgagttttggaacaagtacaaagatggagatcaatgtgagacttctccttgtcaaaatcagggtaaatgcaaggacggattgggtgaatacacttgcacttgtcttgaggggtttgaaggcaaaaactgtgaactctttactcgcaagctgtgtagcttggataatggagactgtgaccaattttgtcatgaggaacaaaactcggtcgtgtgctcatgtgcaagagggtacacccttgcggacaatggcaaggcatgtattccgactggaccatacccatgtggaaaacagacgctggaacggcggaaaagaagcgtggctcaagcgacttcatcctcgggtgaagcaccggattccatcacttggaaaccatatgacgccgccgatcttgatcctactgagaatccatttgacctgctggactttaaccaaacccaacccgaaagaggcgacaacaatctgactagaatcgtgggtggacaagaatgtaaggatggcgaatgcccttggcaggcgttgttgataaacgaggagaacgaaggcttttgtggggggaccattctgtcagaattctacattctgaccgcagctcactgcctctatcaggccaagcgcttcaaggtgcgggtgggtgatcggaacaccgaacaagaggaaggtggagaagcagtccacgaagtcgaggtcgtcataaagcataaccggttcaccaaggaaacctacgatttcgatatcgcagttcttagacttaagacccccattaccttccgtatgaacgtggcacctgcctgcctgccagaacgggactgggcggaaagcaccctgatgactcaaaagactgggatagtgtctggttttggtcgaactcatgaaaaaggtcggcagtccacgcggctcaaaatgctggaagtgccatacgtggatcgcaattcgtgcaaactttcatctagcttcataatcactcaaaacatgttctgcgcgggatacgatactaagcaggaagatgcatgccaaggggattccggaggaccgcatgtcactagatttaaggatacctacttcgtgacgggcattgtgtcatggggtgaagggtgtgcacgaaagggaaagtacgggatctacaccaaggtgaccgcatttctgaaatggattgaccgctccatgaaaaccaggggtttgcctaaggcaaagtcgcacgcgcctgaggtcattacctcgtcgcctcttaag

SEQ ID NO: 9317 - DNA, 1464 bp, Artificial Sequence
  Description of Artificial Sequence: Synthetic coding sequence
atgggccgcccgcttcacttggtcctgctgtcagcctccttggcaggactgctgctgctgggcgagagcctgtttatcagaagagaacaggccaataacatccttgcacgggtgactcgggcgaacagtttcctggaagagatgaagaagggacacctcgaacgcgagtgcatggaggaaacctgtagttacgaagaagcccgggaagtctttgaggactcagataagactaatgagttctggaacaaatacaaggatggagatcaatgcgaaacttcgccgtgccaaaatcagggaaaatgcaaagatggattgggtgagtacacctgcacctgcctcgaaggatttgagggaaagaattgtgagttgttcactcgcaagctctgctcattggacaatggtgactgcgaccagttctgtcacgaagaacagaacagcgtggtctgctcatgcgcccgcggatacaccctggccgacaatggcaaggcttgcattccaactggcccttacccttgcggaaagcaaaccctcgaacgccgtaaacgctccgtcgcccaggctacctcatcatcgggcgaggcgcccgattccattacttggaagccgtacgacgccgcagatctggacccaaccgagaacccgttcgacctcctggacttcaaccagacccagccggaaaggggagacaacaatctgactcgaatcgtaggaggacaggaatgtaaggacggagaatgcccatggcaggctctgctcatcaacgaagaaaacgaagggttctgcggggggaccatcctctcggagttctatatcctgacggcggcccattgcctgtaccaagcaaaacggtttaaagttcgcgtgggcgaccgcaacactgaacaagaagaaggcggggaggcggtgcacgaagtggaggtggtgatcaagcacaaccggttcaccaaggaaacctacgatttcgatatcgccgtgctgcgcctgaaaactccgatcaccttcagaatgaacgttgctcccgcgtgcctgccagaacgggactgggcagagtcgacccttatgacgcaaaaaactggaatcgtttcaggattcggacgcactcacgagaagggcagacaatccacccgcctgaagatgctcgaagtcccttacgtggatcgcaattcgtgcaaactgtcgtcctcattcatcatcactcagaatatgttctgtgcgggatacgataccaagcaggaggacgcctgtcaaggagattcaggaggaccgcacgtcacccgcttcaaggatacctactttgtgaccgggatcgtgtcctggggcgagggatgtgcgaggaaggggaaatacggcatctacacgaaggtcaccgcattcctcaaatggatcgaccgcagcatgaaaacccgcggcctgccaaaggccaaatcgcacgcaccagaagtcatcacctcttcgccacttaag

SEQ ID NO: 9318 - DNA, 1464 bp, Artificial Sequence
  Description of Artificial Sequence: Synthetic coding sequence
atgggacgacctcttcatttggtgctgctgagcgccagccttgctggactcctgctgctgggcgaatcgctgttcatcaggagagagcaggcaaacaacatcctggcaagagtcactagagcgaactcatttctggaagagatgaagaaaggacatcttgagcgtgaatgcatggaggaaacctgttcgtacgaagaagcaagagaagtgttcgaagattccgataagaccaatgagttttggaacaagtacaaggatggtgaccagtgcgagacgtccccttgccaaaaccaagggaagtgtaaggacggcctgggggaatatacctgtacctgtctggagggattcgaaggtaagaactgtgaactttttactcgtaagctgtgttcactggataacggtgattgtgaccagttctgccacgaggagcagaattcggtggtctgttcgtgcgcgcgtggctacaccctggcagacaatggaaaagcctgcattccgactggcccttacccctgtgggaagcaaactctggaacgacgtaagaggtctgtggcgcaagccacctcgtcgtccggagaagcaccagattcgattacttggaagccatacgatgcggccgatcttgatccgaccgagaacccttttgaccttctggatttcaaccaaacccagccggagagaggagacaataaccttactcgaatcgtgggtggtcaagagtgtaaagacggcgaatgcccttggcaggcacttttgattaacgaagaaaacgaaggcttttgtggtggcaccatactttcggaattctacatcctcacggcggcacactgtctttaccaggcaaagagatttaaggttcgcgtcggcgatcgtaacacggagcaagaagagggaggggaggcagtccacgaagtggaagtggtgatcaaacataatcggtttaccaaggagacttacgattttgatattgcagtgttgcgccttaagacccctattacgtttcgcatgaacgtcgcgcctgcgtgtctgccggaacgcgattgggcagaaagcactctcatgacccaaaaaaccgggattgtgtcaggttttggacggacccacgaaaaagggcgacaaagcacgcgcctgaaaatgcttgaggtgccatacgtggacagaaactcttgcaagctctcgagctccttcatcataactcagaacatgttttgtgcaggttacgatactaagcaggaagatgcatgccaaggcgactccggcggacctcatgtgactagatttaaggacacctacttcgtgaccggaattgtcagctggggcgagggttgtgcaagaaaaggaaaatacggaatatacaccaaggtaaccgcatttcttaagtggattgaccgctcgatgaaaacgcgtggactccccaaggcgaagtcacacgcacctgaagtcataacctcgtcgcctctgaag

SEQ ID NO: 9319 - DNA, 1464 bp, Artificial Sequence
  Description of Artificial Sequence: Synthetic coding sequence
atgggccgaccgctccatctggtcctgctgtccgcctcgcttgccggactgctcctgttgggagagtccctcttcatccggcgcgagcaggccaataacattctcgcgagagtgactcgcgcgaactcattcctggaagaaatgaagaagggacatttggagagagaatgtatggaagagacttgctcgtacgaagaggctcgcgaagtgtttgaggattcggacaagaccaatgaattctggaacaaatacaaggatggcgaccagtgcgaaacgtcgccgtgccagaatcagggcaaatgcaaggatggactcggggagtacacctgcacttgcctggaaggattcgaaggaaaaaactgtgaactgttcacccggaaactgtgctcccttgacaatggggattgtgaccaattttgccatgaagaacagaattcggtggtgtgtagctgcgcacgcggatacaccctggcagacaacggaaaggcctgcattcctactgggccttacccgtgcggaaagcagactctcgaacggcggaagagatcggtggcacaggcgacttcgtcgagcggagaagccccggattccatcacctggaaaccgtacgatgccgcggacctggacccaacggaaaacccgttcgacctgttggacttcaaccaaactcagcctgaaagaggtgacaacaacctcacccggattgtgggaggtcaggagtgtaaggatggagaatgcccatggcaagcactcctgatcaacgaggagaatgagggcttctgcggcggcactatcctgtctgaattctacatccttactgccgcgcattgcctctaccaagccaagcgcttcaaggtgcgcgttggagatcggaacactgagcaggaggagggcggagaagctgttcacgaagtggaggtcgtgattaagcacaatcggttcactaaggagacttacgatttcgacatcgcagtcctgaggctgaaaaccccaatcaccttccggatgaacgttgccccggcctgtctgccagaacgcgactgggccgaatccaccctcatgacccaaaaaactggtatcgtctccggatttggacggacccacgaaaagggtaggcaatccactcggctgaagatgctggaagttccttacgtggatagaaactcctgcaagctgagctcctcattcatcattactcaaaacatgttctgtgcgggatacgacactaagcaggaagatgcttgccaaggggattccggcggcccgcacgtgaccagattcaaggacacctacttcgtgactggcatcgtcagctggggcgagggctgcgcgcggaagggcaagtacggcatttacaccaaggtcaccgcgtttctcaagtggatcgatagatcaatgaaaaccagaggactgcctaaggccaaatcgcatgctccagaagtgataacttccagcccactgaag

SEQ ID NO: 9320 - DNA, 1464 bp, Artificial Sequence; identical to SEQ ID NO: 9278
  Description of Artificial Sequence: Synthetic coding sequence

SEQ ID NO: 9321 - DNA, 1464 bp, Artificial Sequence
  Description of Artificial Sequence: Synthetic coding sequence
atgggtagaccgcttcatctggtgctcctgtccgcctccctggcgggactgctgctcctgggcgaatcgctgtttatccggcgcgagcaggctaacaatatcctggctagggtcacccgggccaactcattcctggaggagatgaaaaagggccacctcgaacgggagtgcatggaagagacttgctcgtacgaggaagctcgggaagtctttgaggactcagacaaaaccaacgaattctggaacaaatacaaggatggagatcaatgtgaaacttccccatgccagaatcaaggaaagtgtaaggacgggctgggagaatacacttgcacgtgtctggagggcttcgagggcaagaattgcgaactgttcacccggaagctgtgttcgctggataatggcgattgcgatcaattctgtcacgaagagcaaaactcagtggtgtgttcctgcgcgcgcggatacaccctcgctgataacgggaaggcgtgcattccgactggaccgtacccttgcggaaagcagaccctggaacgcaggaagcgctcagtggcacaggcgactagttcatcgggtgaagccccagattccatcacctggaagccttacgatgcggcggacctggacccaactgaaaacccattcgatctcctcgactttaatcaaactcaaccggagcgcggagacaacaacctcaccagaatcgtgggcggacaggaatgtaaggacggagagtgcccatggcaggcgctgcttatcaatgaagaaaatgaaggtttttgcggcgggaccatcctgtccgagttttacatcctgaccgcggcccactgtctctaccaggccaaacgctttaaggtgagagtgggggatcggaacactgaacaggaagagggcggtgaggcagtgcatgaagtggaggtcgtgatcaagcacaacaggttcactaaagaaacctacgatttcgacatcgctgtcctccgcctgaaaacgccaatcacgttcaggatgaacgtggcccctgcctgcctcccagagcgcgactgggccgaatcaactctcatgactcagaaaaccggaatcgtctcgggattcggccggacccatgaaaagggtagacaatctactaggcttaagatgctggaggtgccctacgtggatcgcaactcttgtaaactgtccagctcgtttatcattactcagaatatgttttgcgctggatacgataccaagcaggaggacgcctgccaaggagattccggaggcccacacgtcaccagattcaaggacacttatttcgtgactggaatagtctcatggggcgagggctgcgccaggaaggggaaatacggaatctacaccaaggtgaccgccttcctgaagtggatcgataggtccatgaaaactcggggactgcctaaggcgaagtcacacgcaccggaagtgatcacctcaagcccgctgaag

SEQ ID NO: 9322 - DNA, 1464 bp, Artificial Sequence
  Description of Artificial Sequence: Synthetic coding sequence
atggggcgccccctccacctcgtcctactgagcgcgagcctggctgggctgctgctcctcggggaatccctgtttatcagaagagagcaagcaaacaacatcctggctcgggtgactcgggcaaactcatttctagaggaaatgaagaaaggacatctggagcgtgaatgtatggaagaaacctgtagttacgaagaggcgagagaagttttcgaagattcagataaaactaacgagttttggaacaagtataaggacggtgatcagtgcgagacatccccatgtcagaaccagggcaaatgtaaagatggtcttggtgaatatacctgcacatgtctggaaggattcgagggaaagaattgcgaactgtttactcggaaactctgctcattggataacggagactgcgaccagttttgccacgaagaacaaaactccgtcgtgtgttcttgcgccaggggctacactctggcggataatggaaaggcctgtatccctacaggaccgtacccctgtggtaaacagacacttgagcggcgaaagaggtctgttgctcaagccacatctagctcaggggaggctcctgactccatcacgtggaaaccctatgacgcagccgatctcgacccgaccgagaatcccttcgatctgcttgattttaaccagactcaaccagagcggggcgacaacaacctcactcgaatcgtgggagggcaggagtgcaaggacggcgagtgcccttggcaggccctcctcattaatgaggagaatgagggattctgtggcggcacaatacttagtgagttttacatcctcacagctgcccactgcctgtaccaggcaaagcgatttaaggttcgcgtgggcgacaggaacactgaacaggaggaaggaggagaggctgtccacgaagtggaagtcgtgatcaaacacaaccgcttcactaaagaaacttatgactttgatatcgccgtcctaaggttgaagactcccataacctttcgcatgaatgtggccccggcttgcctgccagagcgtgattgggccgagtcaaccctcatgacacaaaaaacaggtattgtgtcgggtttcggacggactcatgagaagggacgtcaatcaaccagactgaaaatgttggaagtcccatacgtggacaggaatagctgcaagcttagtagtagcttcattataacccagaacatgttttgtgccggatacgataccaagcaagaggatgcatgccagggagacagtgggggcccccatgtgacacgcttcaaggacacatatttcgtgaccggaatcgtgtcctggggggagggatgcgccagaaagggcaagtacgggatttacactaaggtcactgcctttctgaagtggatagaccgcagtatgaagaccagaggcttgccaaaggccaaaagccatgcaccggaagtgatcaccagttcgccccttaag

SEQ ID NO: 9323 - DNA, 1464 bp, Artificial Sequence
  Description of Artificial Sequence: Synthetic coding sequence
atggggcgcccactgcacctggtccttttgtccgcctccctggccggactcctgctgttgggcgagagcctgttcatcagacgcgaacaagccaacaacatccttgcacgggtgactagagcaaattcgttcctcgaagaaatgaaaaaaggacatttggaacgcgaatgtatggaggagacttgttcatacgaggaagctcgggaggtgttcgaagatagcgacaagaccaacgagttctggaacaagtataaggatggagatcaatgcgaaacctcgccgtgtcagaatcagggcaagtgtaaggatggactgggagagtacacttgcacgtgcctcgagggattcgagggaaaaaactgcgaactgttcactcgcaagctgtgctctcttgacaacggagattgtgaccaattttgccatgaagagcaaaactcagtggtgtgctcgtgcgcgagaggatataccctggcagataatggaaaggcctgcatcccgaccggtccttacccatgtggcaagcagactttggaacgcagaaagcggagcgtggcccaggcaacctcgtcttcgggagaagcaccggattccatcacctggaagccatacgatgctgccgatctggaccccactgagaacccatttgaccttctggacttcaatcagacccagccggagagaggagacaacaacctcactcggatcgtgggcggacaggagtgtaaggacggcgaatgcccctggcaggccctgcttatcaatgaggaaaatgaaggattctgcggaggaactattctgagcgagttctacatcctgaccgccgctcactgcctttaccaagctaaacggtttaaggtgcgcgttggggaccgcaataccgaacaggaggaaggaggcgaggctgtgcatgaagttgaggtcgtgatcaaacataaccggttcactaaagaaacctacgacttcgatatcgcggtacttagacttaagactccgatcactttcagaatgaacgtggccccagcatgccttcctgaaagggactgggctgagagcaccctcatgacccaaaaaactggtatagtgtcggggttcggacgcacccacgagaaaggacggcagtcaactcgactgaagatgctcgaagtgccctacgtggaccggaactcctgcaagctctccagctcattcatcattacccagaatatgttctgtgctggttacgacaccaagcaggaggacgcttgtcaaggagactcgggaggaccccatgtgaccagattcaaggacacctactttgttactggcattgtctcgtggggcgaaggatgtgcccgcaaaggtaaatacggtatctacaccaaggtcaccgcctttctgaagtggatcgatcggtcaatgaagactcgggggctgccaaaggccaagagccatgcccctgaagtcatcacgagcagtccgttgaag

SEQ ID NO: 9324 - DNA, 1464 bp, Artificial Sequence
  Description of Artificial Sequence: Synthetic coding sequence
atggggcgtccactgcaccttgtactgctgagcgcctcccttgcaggactcttgttgctgggagaatccttgttcatcaggagggaacaggccaataatatcctggctagggttactagagctaatagctttctggaggagatgaaaaaaggacacctcgagagggagtgtatggaggagacctgcagctatgaggaggcaagggaagtcttcgaagactcagacaaaacaaacgaattttggaacaaatataaagacggagaccagtgtgaaacatctccctgtcaaaaccaaggaaaatgcaaggacgggttaggagagtacacctgcacctgccttgagggcttcgaaggaaaaaactgcgaactgtttaccagaaaactgtgttcccttgataacggtgattgcgatcagttctgccacgaggagcaaaatagcgtggtgtgcagctgtgctcggggctacacattggcggataacggaaaggcatgcataccaaccggtccatacccttgcgggaaacagactctcgaacgtcgaaaaagaagtgttgcacaagccactagtagctcaggcgaagcacctgatagtatcacctggaaaccctatgatgctgccgatcttgatcccacagaaaacccatttgacctcctggactttaaccagacacagccagagagaggtgacaataatctgactaggatcgtgggcggacaggagtgtaaagacggagaatgtccatggcaggccctcctcattaacgaggagaacgaaggattttgtgggggtacaattcttagcgaattttatatcctgaccgcagcgcactgtctgtatcaggcgaaaaggtttaaggtacgcgtgggcgacaggaacactgaacaagaagaaggaggcgaagctgtgcacgaagttgaggtcgtcatcaaacataacagatttacgaaggagacatatgatttcgacatcgcagttctacgcctgaagacaccaattaccttcagaatgaacgttgccccagcctgtttaccagagagagattgggccgagagcactctcatgacacagaaaacagggatagtgagcgggtttggaaggactcatgaaaaaggcagacagagcaccaggctgaaaatgcttgaagtcccttacgtcgaccgcaactcttgcaaactgtcatctagctttattatcacccagaacatgttctgcgcaggctatgataccaagcaagaggacgcatgtcagggagatagtgggggtcctcatgtcacaagattcaaggatacctacttcgttacaggaatagtgtcctggggagaagggtgcgcaaggaagggcaagtacggcatttacactaaagtgactgctttcttaaagtggatcgacagaagcatgaagaccagaggactgcctaaagccaaaagccacgcgccagaggttatcacaagctctcccttaaag

SEQ ID NO: 9325 - DNA, 1464 bp, Artificial Sequence
  Description of Artificial Sequence: Synthetic coding sequence
atgggaaggcccctgcatcttgttctgctgagcgcctcgctcgccggcctccttctcctaggggagagtctcttcattcggcgggagcaggcaaacaacattctggcacgagtcacccgggctaacagcttcctggaagagatgaagaagggccatctggagcgcgagtgcatggaggagacctgctcttatgaggaggcacgggaagtgtttgaagattcagacaaaacaaatgagttctggaataaatacaaagatggcgatcagtgcgagacgtctccatgtcagaaccaaggaaaatgcaaggatgggttgggggagtatacctgcacgtgtctagaggggttcgagggcaagaattgtgaactatttacccgaaaactgtgcagcctcgataacggggactgtgaccagttctgccatgaggagcagaattctgtggtttgctcttgcgccagagggtatactcttgcagacaatgggaaggcttgtatccccacgggaccttacccgtgcgggaaacagacactggaacgacggaagcggtcggtggcacaagccacgagcagctccggggaagcaccagactctataacctggaagccgtacgatgctgccgacctggaccccacagagaaccccttcgacttgctggactttaaccagacacagcctgaacggggcgataataaccttacaaggatcgttggaggacaggaatgtaaagatggtgaatgcccctggcaggctctgctgattaacgaagaaaatgagggcttttgtgggggaaccatcttgtctgaattctacattttaaccgcagcgcattgtctgtatcaggcgaaaagattcaaagtgagagtaggcgataggaataccgaacaggaagaggggggcgaagccgtgcacgaggttgaggttgtcatcaagcacaataggtttacgaaagagacatatgattttgacattgccgtcttaagactaaaaaccccaattactttcagaatgaatgtggcgcctgcgtgcctgccagagagggattgggccgaatcaactctaatgacccagaaaacagggattgtcagcggtttcggccggactcacgaaaaaggacggcagagcacaagactcaagatgctcgaggtcccctatgtggaccgaaactcttgcaagctaagttcgtcgttcatcattacccagaatatgttttgcgctggttatgatacaaagcaagaagatgcatgccaaggtgatagcggtggcccacacgtcacgcgcttcaaagatacctattttgtgacagggattgtgtcctggggtgaaggatgcgcccgcaagggaaaatacgggatttatactaaggtgactgccttcttgaaatggatcgacaggtctatgaagacaagaggcttacctaaggccaagagccatgccccagaagtcatcacttcatcccccttgaag

SEQ ID NO: 9326 - DNA, 1464 bp, Artificial Sequence
  Description of Artificial Sequence: Synthetic coding sequence
atgggcaggcctcttcacctcgttctgcttagcgcttctctagccggattgctgctgctcggcgaatcattattcattcgccgagagcaggctaataacatcctcgctcgggtcacccgcgccaactcattccttgaggagatgaagaaggggcatttagagcgcgagtgcatggaagagacgtgcagctacgaagaggcccgcgaggtgttcgaggactcggataaaacgaacgaattttggaacaagtacaaggacggagatcagtgcgagacttccccttgccagaatcaggggaagtgcaaggacggactgggtgagtatacctgtacctgtttggagggcttcgaagggaagaattgcgaattattcacaaggaaattgtgttcattagacaatggagactgtgaccagttctgccacgaggagcaaaactcggtcgtctgctcctgcgcaagggggtacacgctcgccgataatggtaaagcctgtatccctacggggccctatccatgcggaaaacagaccctggagcgccgaaagagatccgtggcccaggccacatcctctagcggggaggctccagactcaatcacctggaaaccctatgacgcggcagatctggatcctacagagaatccctttgacctcctggactttaaccagactcaaccagaaaggggcgataataaccttacgcgcatcgtgggcggccaggagtgcaaggatggggaatgtccgtggcaggcccttctgattaatgaggaaaatgagggattctgtggcggaactatcctgtccgagttctatatcttgactgccgctcattgcctatatcaggcaaagcggttcaaggtgcgcgtgggcgacaggaatactgagcaggaagaaggaggagaggctgtgcacgaagtggaggtggtcattaagcacaacaggtttacaaaagagacgtatgacttcgatattgctgtgcttcgcttaaagactccaattacttttcgtatgaacgtcgcgcctgcctgcctccctgaacgagactgggccgaatccacgctgatgactcagaagaccggcatcgtgagcggattcgggcgcacccatgaaaagggcagacagtccacaagactgaaaatgctggaagtcccctacgttgaccgaaattcctgcaagctgtcatcttcttttatcattacccagaacatgttttgcgccggctatgacaccaagcaggaggacgcttgccaaggcgattccgggggccctcatgtcacccgcttcaaagatacctacttcgtgaccggcatcgttagctggggagagggttgcgctagaaagggtaagtacggcatctatactaaggtgaccgccttcctgaaatggatcgaccgtagtatgaaaacccggggcctgccaaaagctaaaagtcatgcacccgaggtcattacgagttcaccgctgaag

SEQ ID NO: 9327 - DNA, 1464 bp, Artificial Sequence
  Description of Artificial Sequence: Synthetic coding sequence
atgggaaggccccttcacctcgtgctcctgtccgcatcgctggcagggcttctgcttctgggagagtccctgttcatccgaagagaacaagcaaacaacattctcgcacgggtgacgcgtgcaaactcattcctcgaagaaatgaagaagggacatctcgaacgcgagtgcatggaggagacttgttcgtatgaagaagcacgggaagtctttgaagatagcgacaaaaccaatgagttttggaacaagtacaaggatggtgatcaatgtgagacgtccccgtgtcaaaatcaaggaaagtgtaaggacggattgggagaatacacctgtacttgtctcgagggatttgaaggtaagaactgcgaactcttcacgaggaaactctgttcccttgataacggagactgtgatcagttctgtcacgaggagcagaactcggtggtgtgttcgtgcgcccgaggctacaccctggccgataatggaaaggcatgcatcccaactggcccatatccgtgcggcaagcagactcttgaacgccggaaacgctccgtcgcacaggcaactagctcctccggcgaagctccagattcgatcacctggaagccatacgacgcagcagacctggatcctaccgaaaacccttttgatcttttggactttaatcagactcaaccagaacgcggcgataacaatctgaccagaatagtcggaggtcaagaatgcaaagacggggaatgtccttggcaggcactgttgataaacgaagaaaatgaaggcttctgtggcggaactatactgagcgaattctacattctgaccgcagcacattgcttgtaccaagcgaagagatttaaggtgcgtgtgggagatcggaatactgagcaggaagaagggggagaagcggtgcatgaagtggaagtggtgattaagcataaccggtttactaaggaaacctacgatttcgacattgcagtcctgagactcaaaacccctatcacgttccggatgaacgtggctccagcatgtctcccggagagagactgggcagaatcgacccttatgacccaaaaaactggtatcgtgtcgggttttggtcggactcatgaaaagggacgtcaatcaacccggctgaagatgctggaagtgccatacgtggatcgcaacagctgtaagctgtcgtccagcttcatcattacccagaacatgttttgcgcaggatacgacaccaagcaggaagatgcatgtcagggggacagcggaggaccccatgtcactcggtttaaggatacttacttcgtcaccggcattgtgagctggggcgaggggtgcgcaaggaagggtaagtacggtatttacactaaggtaaccgcattccttaaatggatagataggtcaatgaaaactcgcgggctgcctaaagcaaagagccatgctcctgaagtgattactagctcaccattgaag

SEQ ID NO: 9328 - DNA, 1464 bp, Artificial Sequence
  Description of Artificial Sequence: Synthetic coding sequence
atggggcggcctctgcatctcgtgctgttaagtgcaagtttggccggacttctcctcctgggggagtccttattcattaggcgtgagcaggcgaacaatatcttagcccgggtcaccagggccaactcattcctagaggagatgaagaagggacatctggagcgggaatgtatggaggagacatgctcctatgaagaggcccgcgaagtgtttgaggatagcgacaagaccaacgaattctggaacaaatataaggatggagatcagtgtgagactagtccatgtcagaatcagggtaagtgtaaagacggactcggcgagtatacctgtacctgcttggagggttttgagggaaaaaattgcgagctgttcactcgtaagttgtgctctctggataacggcgactgtgatcagttttgccatgaggagcagaacagcgtggtgtgctcctgtgctaggggttacactctggccgataatggaaaggcctgtattcctactgggccctacccttgcggcaagcagacgctggagagacggaagaggagcgtcgcccaagcaacctcttcttcaggggaggctcccgacagcatcacttggaagccttacgatgcagccgacttggaccctaccgaaaacccattcgatctcctagattttaaccagacccagccggaacggggcgataataatctgactcggatcgttggcgggcaggagtgtaaggacggggaatgtccctggcaggcgcttttaatcaacgaagaaaacgaaggattctgcggcggcactatcctctctgaattctacatcctcaccgctgctcattgcctctatcaggccaagcgcttcaaggtccgggttggcgaccgaaatactgagcaggaggaagggggcgaagccgtgcatgaggtggaagtcgtcattaagcacaaccgtttcacaaaagagacctacgactttgatatcgctgtgcttagacttaagacccctatcacgttccggatgaacgtcgcccccgcctgcttgccggagagggactgggccgagtccaccctcatgacacagaagacaggaattgtctctggcttcgggaggactcacgaaaaagggaggcagtccactagactcaaaatgttagaggtcccgtacgtcgatcgtaactcctgcaaactgtccagcagctttattattacccagaatatgttctgtgcaggctacgacaccaaacaggaggatgcttgtcagggagattctgggggcccacacgttaccaggttcaaagacacctatttcgtaaccggcatcgtgagttggggagaaggctgcgcccgtaagggcaagtacgggatatacactaaagtgaccgcattcctaaagtggattgataggagcatgaaaaccagaggcttgcccaaagcaaagtcccacgccccggaagtcataaccagcagccctctgaaa

SEQ ID NO: 9329 - DNA, 1464 bp, Artificial Sequence
  Description of Artificial Sequence: Synthetic coding sequence
atgggcagacccctgcatctcgtattgctgtccgcttcccttgcgggccttctcctcctgggggagtccctgtttataaggagagagcaggccaacaacatcctcgccagagtgactagagcaaactccttcctggaagaaatgaaaaaaggacacctcgagagagagtgcatggaagagacctgcagttatgaagaagcacgcgaggtcttcgaggactctgataagaccaacgagttttggaacaaatacaaagacggcgatcagtgtgagacgagtccctgtcagaaccaaggcaagtgcaaggacggcctcggagaatacacgtgcacctgccttgaggggttcgaggggaaaaattgcgaactgttcactcgcaagctgtgttcactggataacggagattgcgaccagttctgtcatgaagagcagaattccgtggtatgtagctgtgcacggggatataccctggccgataacggaaaagcatgcattccaaccggcccctatccctgcgggaagcagactctggagcgacggaaaagatcagtggcccaggctactagcagcagcggggaagctcccgatagtattacgtggaaaccatatgacgctgcggaccttgaccccactgaaaatccctttgatctcctggatttcaatcaaacccaaccagagaggggggacaacaacctcacgcgaattgtgggcgggcaggaatgtaaagacggtgagtgcccgtggcaggcactgcttataaatgaggaaaacgaaggcttctgtggtggaacgatactgtccgagttttatattctgactgctgcccattgtctgtatcaagccaagcgattcaaagttcgcgtcggcgacagaaatacagagcaagaagaagggggagaggctgtgcacgaagtagaagtcgttattaaacataaccggtttaccaaggaaacttacgatttcgacatcgctgtcctgagactgaaaacacctatcaccttccgcatgaacgtagccccagcatgtcttcccgaacgcgattgggccgagtccacattgatgactcagaaaaccggcatcgtaagcggcttcgggaggacccatgagaagggtcggcagtccactcgccttaagatgctggaagttccctatgtcgaccgaaattcatgtaaactgagcagcagctttattataacccagaatatgttctgcgcaggctatgatactaaacaggaggatgcttgccagggggactctggtggtcctcatgttacacgctttaaggacacctatttcgtaaccgggatcgtctcatggggagaaggctgcgcccgcaaaggaaagtacggaatttacaccaaggtgacggcttttttgaaatggatcgatcgctcaatgaaaacaaggggactcccaaaagccaagtcccatgcccctgaggtgattacctcaagtcccctgaaa

SEQ ID NO: 9330 - DNA, 1464 bp, Artificial Sequence
  Description of Artificial Sequence: Synthetic coding sequence
atgggcaggccattacacctggttctcttaagtgcttcattagctggactcctcttgctcggagagtcactatttattcgacgggagcaggcaaataacattctggcccgagtgacccgagccaactcattccttgaggagatgaagaagggccaccttgaaagggaatgcatggaagaaacttgttcatatgaggaggcacgcgaggtgttcgaggactctgacaaaaccaatgagttctggaacaaatataaggacggggaccagtgcgagacaagcccctgccaaaaccagggaaaatgcaaagatgggctcggcgagtacacctgtacgtgcctggaggggtttgagggaaagaactgcgagttgttcactcgtaaattgtgtagcctcgataatggtgactgtgatcagttttgccacgaggagcaaaactcggtggtttgctcgtgcgcgcgcggctatactctggccgacaatggcaaggcctgcattccaaccggtccgtatccctgcggaaagcagaccctggagcgtagaaagagaagtgtggctcaagctaccagttcgtcaggggaggcacctgactccatcacatggaagccttacgacgccgccgacctggatcctactgagaatccgttcgacttactggattttaaccagacccagcctgagagaggtgacaataacctgacgaggattgtgggcgggcaagaatgtaaggatggcgagtgtccttggcaagctctgctgatcaatgaggagaatgagggattctgtggaggaaccatcctttcggagttttatatattgaccgctgctcactgtctctatcaggccaaaaggtttaaagtgcgcgtgggagacagaaataccgagcaggaggagggcggggaggccgtacacgaggtggaggtagtgataaagcacaacagatttacaaaagagacctatgacttcgatatcgcagtgctgaggcttaagacacccatcacgtttcgcatgaatgtggcccctgcatgtctgcccgaaagggactgggccgagtccactttgatgacccagaaaactggcatcgtaagcgggttcgggcggacccacgagaagggtcgccagagcacaaggctaaaaatgctggaagtgccatatgtagacagaaactcttgtaagctgtcatcttcattcatcatcactcagaatatgttctgcgctggctacgacaccaagcaggaagacgcctgccagggcgatagcgggggccctcacgtgactcgattcaaggacacttactttgtgactggaatcgtgagttggggagaagggtgtgcgcgcaagggcaagtacggaatctatacgaaagtgacggcgtttttaaaatggattgaccgctcgatgaagacacggggactccctaaagccaaaagccatgcccccgaagttattaccagctcacctctgaaa

SEQ ID NO: 9331 - DNA, 1464 bp, Artificial Sequence
  Description of Artificial Sequence: Synthetic coding sequence
atggggaggccactccaccttgtactccttagtgcaagtctggccggactgcttctcctgggggaatccctcttcatacgccgcgaacaggcaaacaacattttggcccgggtgacccgcgccaactccttccttgaggaaatgaaaaaaggtcatttggaacgggaatgcatggaagagacttgttcttacgaggaggctagggaagtgtttgaggacagcgacaagaccaatgagttctggaataagtataaggatggggatcagtgcgaaacgagcccctgtcaaaatcagggtaaatgtaaggacggcctcggtgagtatacctgtacatgtctcgaaggatttgaaggaaagaattgcgaattgttcacccggaagttgtgctcccttgacaacggtgattgtgaccagttctgccacgaagaacaaaactctgtggtgtgttcatgcgctagagggtacacactcgccgataatgggaaggcatgcatcccaactggtccttacccctgtggaaagcaaacgctggagcggcggaagagaagtgttgcccaggccacgagtagtagcggggaggccccagatagcataacttggaaaccctacgatgcagccgacctggatccgaccgaaaacccatttgacctgttggacttcaaccagacccagcccgagcggggcgataataacctgacacggatcgtcggcggccaggagtgtaaggacggcgaatgcccgtggcaggcgctgttgattaacgaagagaacgagggcttttgtggcgggaccattctgtccgaattttacattcttacggcagcacactgtttgtatcaggctaagaggttcaaagtgcgcgtgggagacagaaacaccgagcaggaagaaggtggagaggcggttcacgaagtggaggttgtcattaagcacaatcggttcaccaaggaaacctatgacttcgacattgctgttctgagactcaaaaccccaatcaccttccgcatgaacgtggctcctgcctgtctgcccgaacgcgattgggctgaatctaccctgatgacccagaaaacaggaatagtgtccggcttcggtagaacccacgagaagggccgacaatctacccgcctgaagatgctggaagtaccgtacgtggacaggaatagctgcaaattgtcctctagcttcatcatcacccagaatatgttctgtgcggggtatgacacgaaacaagaagacgcctgtcagggcgatagtggtgggccccacgttacgaggttcaaggatacatatttcgtaacaggcatagtgtcttggggagagggctgtgcccgcaagggaaaatatggcatctacaccaaagtcactgcgttcctgaaatggatagataggtcaatgaagaccagaggactccctaaggccaagtctcacgcaccagaagttatcaccagcagtcccttgaaa

SEQ ID NO: 9332 - DNA, 1464 bp, Artificial Sequence
  Description of Artificial Sequence: Synthetic coding sequence
atgggaaggcccttgcaccttgtcttgctgagcgccagtctggcaggactcctgctgctcggcgaaagtctttttattaggcgggaacaggccaataatatactagctcgggtgacaagggccaattccttcctagaagagatgaaaaaggggcacctggaacgggagtgcatggaagagacatgctcttatgaagaagctcgcgaagtgtttgaggactccgataagacaaacgaattctggaacaagtacaaggatggcgaccagtgtgaaacttccccatgtcagaaccagggcaagtgcaaagacgggctcggggagtatacgtgtacatgcctcgaggggttcgaggggaaaaattgcgagctgtttacacgcaaactgtgctctttagataatggagattgtgaccagttttgtcatgaagagcagaacagcgtcgtatgctcttgcgcacgcggttacaccctggccgataatggcaaagcatgcattcccacagggccctatccatgtggaaaacaaaccctcgagcgccgtaagcgcagcgtggcgcaggcgacgagctcaagcggtgaggcaccggatagtatcacttggaaaccttacgacgcggctgacttggaccccacagagaatcccttcgatctcctggattttaaccagacgcagccagaaagaggggataataatctcacccgcatcgtgggtgggcaggaatgcaaagatggcgaatgcccctggcaggctctccttataaacgaggaaaatgaaggcttttgcggcggcactatactgagcgaattttatattttgactgccgctcactgcttataccaggccaagcgatttaaggtccgagtgggggatagaaatacggagcaggaagaggggggggaagctgtccatgaagtggaggttgtcatcaagcataaccgatttactaaggaaacctacgatttcgatatcgctgtattgagactgaagacaccgatcaccttcaggatgaacgtggccccagcatgtttgccagagagggactgggctgagtctacactgatgactcaaaaaacaggcatagtgtctggcttcggcagaacccacgagaagggccgccaatccacgcggctgaagatgctggaggtcccttatgtagaccgcaactcctgtaaactaagtagtagctttatcatcacccagaacatgttctgcgccggctatgataccaaacaagaggatgcctgtcagggcgatagtgggggcccacacgtcaccagattcaaggatacatacttcgtgacgggcatagtgtcctggggggagggatgcgctcgtaaaggaaaatatggcatctatacgaaggttacagctttcctgaagtggatcgatcggtcaatgaagacacgtggcctaccaaaagctaagagccatgcaccggaagtgattacttctagcccactcaag

SEQ ID NO: 9333 - DNA, 1464 bp, Artificial Sequence
  Description of Artificial Sequence: Synthetic coding sequence
atgggccggccactgcatctcgtgctcctgtctgcgtcccttgcaggactgttgctcctgggggaaagcctctttatcaggcgcgaacaggcaaataacatcctggcacgcgtgactagagctaacagctttctcgaagaaatgaagaagggccacctcgagcgcgagtgcatggaggaaacctgtagctatgaggaagctagagaggtgtttgaggactctgacaaaactaacgagttctggaataaatacaaagacggtgatcaatgtgaaacctccccctgtcaaaaccagggcaaatgcaaagatggactcggagaatacacttgcacctgcctggaggggttcgagggaaaaaactgcgaattgtttactagaaaactgtgctcactcgacaatggcgattgcgaccagttttgccatgaggaacagaacagcgttgtctgcagttgcgccagagggtataccttggcagacaacggaaaagcctgcatccctaccggaccctacccatgtggaaagcagaccctggagcggcggaagcgatcagtcgcccaggctacatctagcagcggtgaagcccccgattccatcacgtggaagccgtacgatgccgcagacctggaccctacagagaacccttttgacctgctcgacttcaatcaaacccagcctgagcgcggcgataacaaccttacccgtattgttggcgggcaggagtgtaaagatggtgaatgcccatggcaagcattgctcatcaatgaagagaacgaagggttctgcggcggcaccattcttagtgaattttatatcctgaccgccgcccattgtctgtatcaggctaagcgatttaaagttcgggtgggcgacaggaacacagagcaagaggaggggggcgaagccgttcatgaggtggaggtggtgatcaagcataacaggttcactaaggagacctatgattttgatattgctgttcttagactgaaaacaccaatcacctttaggatgaacgtggccccagcatgcctgcccgaacgggattgggctgagtctacactcatgacccagaaaacagggatcgtgtccggctttggccggactcatgaaaaaggaagacagagcacaagactcaaaatgcttgaggtcccctacgtggatcgcaactcatgcaagctgagcagttccttcatcatcacccagaacatgttttgcgccggctatgacacgaaacaggaggacgcgtgccagggggacagcggaggccctcacgttacaaggtttaaagatacttactttgtgacaggcatagtgtcttggggcgagggctgtgctagaaagggaaaatatggcatatataccaaagttacagcatttttaaaatggatcgacagatctatgaagacaaggggcctgccaaaggctaaatcacatgcacccgaggtgatcactagctcaccattgaag

SEQ ID NO: 9334 - DNA, 1464 bp, Artificial Sequence
  Description of Artificial Sequence: Synthetic coding sequence
atgggcaggccgctccacctcgtgttgctgtccgcaagtcttgcgggcctgctactcctgggcgagtcactcttcattcgtagggaacaggctaacaatattctggctcgagtgaccagggctaatagtttcttggaagagatgaagaagggacatcttgaaagagagtgtatggaggagacctgttcgtacgaagaagccagggaagtttttgaggacagcgataagacaaacgaattctggaacaagtacaaagacggggaccagtgcgagacaagtccttgtcagaatcaggggaagtgtaaagacgggttgggagaatatacatgcacatgtctggagggatttgaggggaaaaactgtgaactgttcaccaggaaactctgctctctggacaacggcgattgcgaccagttctgtcacgaggagcagaattcggtggtgtgctcatgcgccagaggctacaccctggcggacaacggtaaagcctgcattcccactgggccttatccctgtggtaaacagactcttgagagaagaaagcgctcagttgcacaggcaacttcatcatccggagaggctcccgacagtattacgtggaagccttatgatgctgctgatctggatcccacagagaatccctttgacttgctggatttcaaccagactcagcctgaacggggggataataatctcactagaatagtgggaggccaggagtgtaaggacggagagtgcccctggcaggcccttctcataaacgaggagaacgaaggattctgcggtggcacaatcctgagcgaattttacatcctgaccgcagcacactgcctgtatcaggcaaaacgatttaaggttagagttggtgaccggaatacggagcaggaggaagggggtgaggccgttcatgaggttgaggtggtcatcaaacacaatcggtttacaaaggagacctatgatttcgatatcgccgtcctgagactcaaaactcctataactttcaggatgaacgtggctccagcctgtttgcccgaacgggattgggccgagtccacactgatgacacagaaaaccggtatcgtgagcgggttcgggcggactcacgaaaagggacggcagtctacgcgactgaagatgttagaggttccatatgtagatcgtaattcttgcaagttaagttctagcttcatcatcacacagaacatgttctgcgcgggatatgatactaagcaggaagatgcttgtcaaggggatagcggaggtcctcatgtgacacggttcaaagatacgtatttcgtcaccggcattgtctcttggggagaaggttgcgcaagaaaaggcaaatatgggatctataccaaagttactgccttcctgaagtggattgaccgcagcatgaaaaccaggggtctgccaaaggcaaaatctcacgcccccgaggtgattacctcaagcccgctaaaa

SEQ ID NO: 9335 - DNA, 1464 bp, Artificial Sequence
  Description of Artificial Sequence: Synthetic coding sequence
atggggaggcccttgcatctggtactcttgtcagcgtcattggctggactcctgctgcttggagaaagcctcttcatacgtagagagcaggccaacaatatcctggctcgcgttacccgtgcaaacagcttccttgaggagatgaaaaaaggacacctagagcgggagtgtatggaagaaacttgcagttatgaagaagccagggaagtgttcgaggattcagataagactaatgagttttggaacaagtataaagatggtgaccaatgtgaaacaagcccttgccagaaccaggggaaatgcaaagacggtctgggcgagtacacatgtacatgcctcgagggtttcgagggaaaaaattgcgaattgttcaccagaaagctttgcagtctcgacaacggagactgtgaccagttctgtcatgaggaacaaaattcggtagtctgttcttgcgcacggggctacacactggccgataatgggaaagcgtgcatcccaaccggaccctacccctgtgggaagcagacattagagagacgcaaaagatcagtggctcaagccactagctcctcaggcgaggcaccagactccataacctggaagccttacgacgccgcagacctggatcccacggaaaatcccttcgatcttctggatttcaatcagacccaacccgagcgaggcgataacaatctgacaaggatcgtgggtggccaggaatgtaaggacggagagtgcccatggcaggccctgctgattaacgaggagaacgaaggattttgcggaggaacaatccttagcgagttctatattttaacggctgcccactgtctgtaccaggcaaagcgcttcaaggtcagagttggagaccggaatacagagcaggaggagggaggggaggctgtccatgaagtagaagtcgtgatcaagcataatagattcacaaaggaaacttatgacttcgacatagctgtcttgcgccttaaaacccctatcacattccgcatgaacgtcgctccagcgtgcctcccggaacgggactgggcggagtccacactaatgacacagaagactggcattgtctctggattcggaaggacacatgaaaaaggtcgccagtctacccgcctgaagatgctggaagtgccatatgtcgaccgcaacagctgtaaattgtccagctcttttataatcacacagaacatgttttgtgccggctatgacaccaagcaggaggatgcctgccagggcgacagtggggggcctcatgtgaccaggtttaaagacacatacttcgttactggaattgtatcttggggggaggggtgcgctcggaaaggcaaatacggcatttacaccaaagtcacggccttcctgaagtggattgacagaagcatgaaaacccgtgggctgcctaaagccaagtcacacgcacccgaggtgattactagctctccgttaaaa

SEQ ID NO: 9336 - DNA, 1464 bp, Artificial Sequence
  Description of Artificial Sequence: Synthetic coding sequence
atgggcagacctctacacttagtgctgctcagcgcgtctctggctggcttactattgctcggtgagagcttgtttatcaggcgggaacaggcaaacaatatcctggccagggtgactcgggccaacagtttcctggaggagatgaaaaaggggcatctggaaagagaatgcatggaagagacatgcagttatgaggaagctagggaagtgttcgaagatagcgacaaaaccaatgagttctggaataaatacaaagatggggaccagtgcgaaacctctccatgccagaaccaggggaaatgtaaggacggtctgggggagtatacatgtacgtgcctcgaggggtttgagggcaaaaattgtgaattgtttacccgcaagctctgtagccttgacaatggcgactgcgatcagttctgccacgaggagcagaatagcgtggtctgcagctgcgcccggggatacaccttggcagataatggcaaggcctgtatccccaccgggccttatccttgtgggaagcagaccctggaacgtaggaagcggtcagtggcccaggccacgagcagcagcggcgaagctcctgactccattacctggaaaccatacgacgccgctgatttagatccaaccgaaaatccattcgacctgctggatttcaatcagacccaaccagaacgtggcgacaacaacctcacacgaattgtagggggacaggagtgcaaggatggagagtgcccatggcaggcgctcttaattaacgaggagaacgagggattctgtgggggcacgatactgtcggagttctatattctgaccgctgcgcactgcctgtaccaggccaagcgcttcaaggttcgggtgggggataggaataccgagcaagaggagggtggtgaagcagtgcacgaggtggaggttgtaataaagcacaaccggtttactaaagagacctatgactttgatattgcagtcctgcggctaaagacaccaatcacctttcgaatgaatgtcgcccccgcttgcctccctgagagagattgggccgaaagtaccttaatgacacagaaaaccggaattgtgtcaggctttggtcgtacgcatgaaaagggtcgtcagtcaaccagattgaagatgctggaagtgccgtatgttgaccgcaatagctgtaaattgtccagctcattcataatcacgcagaacatgttctgcgccggctacgataccaaacaggaggacgcgtgccaaggagacagcgggggcccccatgtcaccagattcaaagacacctactttgtcactggaatcgtttcttggggggaagggtgcgcgcgtaaggggaaatatggaatctacaccaaggttacagcgtttctgaagtggatagacagatcaatgaagacccgtgggctgcctaaagccaagagccatgcccctgaagtcattacgagcagcccattgaaa

SEQ ID NO: 9337 - DNA, 1464 bp, Artificial Sequence
  Description of Artificial Sequence: Synthetic coding sequence
atgggccgcccactgcacctggtgctgctcagcgcaagccttgcaggactgttactgttaggtgagtctctttttatccggagggagcaggctaataacatcctggcacgagtaacccgggctaacagctttctggaggagatgaagaaaggacacttggaacgggagtgcatggaagagacttgctcttacgaagaggcacgggaagtttttgaagactctgacaagaccaacgagttctggaataaatacaaagacggagaccaatgcgaaacaagcccctgtcagaaccaggggaaatgcaaagatggacttggcgagtacacatgcacctgcctcgaaggttttgagggaaagaattgtgagctatttactaggaaactttgctctctcgacaatggcgattgcgatcagttttgccacgaggagcagaattcagtggtctgcagctgtgcccgcggctataccctggccgataacgggaaggcttgtatacccacgggcccctacccttgtggtaagcagacactggagcggcggaagagatctgttgcccaagcgacatcttcttccggagaagcacccgacagcatcacatggaagccatatgatgctgcagatctggaccccacggaaaatccgtttgacttgctggatttcaaccagacacagcctgaacggggcgacaataatctgacccgcatagtggggggccaggaatgcaaggatggggaatgcccatggcaggcactattaataaatgaggaaaacgaagggttttgcggagggaccatcttgtctgagttttatattctgaccgctgcacactgtttataccaggcaaaacgctttaaggtgcgggtgggcgacaggaacaccgaacaggaggagggcggagaggcagtgcatgaagtcgaggtcgtgatcaaacacaatcggtttacaaaggagacttatgacttcgacattgctgtcctgcggctcaagactcctatcacgttccgaatgaatgtcgccccagcctgtttaccggagcgggattgggcagagtccaccctcatgactcagaaaaccggcattgtgagcggtttcgggagaacccacgaaaagggaagacaatcaaccaggctgaagatgctcgaagtgccatacgtcgaccgaaactcatgcaagctctctagtagcttcataataacccagaacatgttttgtgctggctacgataccaaacaagaagatgcctgtcagggcgattcaggtggtccgcacgttactcgctttaaagacacttattttgtcacaggcatagtgagctggggggaaggctgcgcacggaagggcaaatacggtatctatacaaaggtgaccgcctttttgaaatggatcgaccgctctatgaagacgcggggcctacccaaggccaaatcccacgcccctgaagtgattacctccagtcctctcaag

SEQ ID NO: 9338 - DNA, 1464 bp, Artificial Sequence
  Description of Artificial Sequence: Synthetic coding sequence
atggggagacccctgcatcttgtccttctgagcgcctctttagctggcctgttattgttaggtgaatcactgtttatacggcgtgaacaggcaaacaatattttagctcgggtaacccgtgcaaacagctttcttgaagaaatgaaaaagggccatctggaacgcgaatgcatggaagagacatgctcgtatgaagaagcccgtgaagttttcgaggatagcgataaaactaatgaattctggaacaaatataaagatggtgatcagtgcgagacaagcccgtgccaaaatcaagggaaatgcaaggatgggctgggcgaatatacctgcacatgtctcgaaggcttcgaaggaaaaaattgtgagttattcacaagaaagctctgtagcttggataatggtgattgtgatcaattttgtcacgaagaacagaattcagtcgtatgttcctgtgcccgtggatatacgctggcggataacggtaaagcttgtattccgactggtccttatccttgcggaaaacagacactggaacggcgaaagcgctcggtggcccaggctacctcatcatcaggggaagctccggatagcatcacttggaaaccttatgacgcggccgacttagacccgacggagaatcctttcgacttgctggactttaaccagacacaacctgaaagaggggacaacaacttgacacggatcgtcggcggacaagaatgtaaggatggcgaatgcccttggcaagcgcttctgatcaatgaagaaaatgaagggttttgcgggggaacaatattgtcagaattctatatactgacagcggcgcattgcttgtatcaagcaaaacgcttcaaagtgcgtgtgggtgaccgcaacacggagcaggaggaaggcggtgaggcagttcatgaagtggaggtcgtcattaaacacaatcggtttacgaaagaaacgtatgatttcgatattgctgtgcttcgccttaaaactccaattacatttcggatgaacgtagcccctgcgtgtttaccagaacgagactgggctgagtcaactttgatgacacaaaaaaccggaatcgtatccggatttggacgtacccatgaaaaaggccgacaatctacccgcctcaagatgcttgaggtgccgtatgttgatcgcaactcatgtaagttatctagctcttttatcatcacacaaaatatgttttgtgctggctacgatactaaacaagaagatgcttgccaaggcgatagcgggggtcctcacgttactcgtttcaaagatacatattttgttacaggtatcgtgagttggggggaaggatgcgcgagaaaaggcaaatatggcatttatactaaagtcaccgcgtttttaaaatggattgatcgaagtatgaaaacgagaggtcttccgaaggctaaaagtcacgccccggaagtaatcacatccagtccactgaaa

SEQ ID NO: 9339 - DNA, 1464 bp, Artificial Sequence
  Description of Artificial Sequence: Synthetic coding sequence
atgggcaggcccctccatctggtgctcctgtcagccagcctggctggtttgcttctccttggcgaaagcctgttcattaggagggaacaggccaacaatatacttgcacgtgtgacccgcgccaactccttcctggaagagatgaagaaaggacacctggaacgcgagtgcatggaagaaacatgctcctacgaggaagcccgcgaagtctttgaagatagtgacaaaacaaacgagttttggaacaagtacaaggacggagaccagtgcgagaccagtccttgtcagaaccaaggaaagtgtaaggacggactcggagagtacacctgcacttgtctggagggtttcgagggtaagaactgtgagctgtttacacgtaagctctgcagcctggacaacggcgactgtgaccagttctgccacgaagagcaaaactccgtggtttgctcttgtgcaaggggttacacattggccgacaacggtaaagcatgcattcctactggaccttacccatgcggcaaacagaccctcgagcgcaggaaaagaagtgtggctcaagccactagcagcagtggcgaggcccctgacagtatcacttggaagccctacgatgctgctgatttggacccaaccgaaaaccctttcgatctgctcgatttcaaccagacacaacctgaaaggggtgataacaatcttacacgtatcgttggaggtcaggagtgcaaggatggtgaatgtccctggcaagctctgctgataaatgaagaaaacgagggtttttgcggaggtactatcctgtcagagttctacatccttactgctgctcattgcctctaccaagctaagcgtttcaaggtcagagtcggagaccgcaacactgagcaggaagagggaggagaggccgtgcacgaggtcgaggtcgtgatcaaacacaaccgctttacaaaggaaacatacgactttgatattgcagttctgaggctgaagacaccaatcacattcagaatgaatgttgctcccgcttgcttgcctgagcgcgactgggctgagtctactctgatgactcagaaaactggcatcgtctcaggtttcggtaggacccacgaaaagggtaggcaaagtacaagacttaagatgctggaggtaccctacgtggacagaaactcatgtaagctctcatcctcatttattatcactcagaacatgttctgcgccggttacgacaccaaacaggaggacgcttgtcagggcgactctggtggtccccatgtcacacgtttcaaggatacctattttgtgacaggcattgtgtcctggggtgagggctgcgctcgtaagggcaagtacggcatctataccaaggtcactgcttttctcaagtggatcgaccgttctatgaagacaaggggccttcctaaagccaaaagccacgctccagaggtcattacctcctctcctcttaag

SEQ ID NO: 9340 - DNA, 1464 bp, Artificial Sequence
  Description of Artificial Sequence: Synthetic coding sequence
atgggccggcctctgcacctggtcctcctgtccgcatcccttgctggcctactgctactgggggagagcttatttataagacgagagcaagctaataacattctcgcaagggtcacaagggccaactcttttctggaagaaatgaagaaaggacacctggaaagggaatgcatggaagagacttgtagctatgaggaggcacgcgaggtgtttgaagacagcgataagaccaacgaattttggaacaaatataaggacggcgaccagtgcgagacaagtccttgtcaaaaccaaggcaagtgcaaagatggacttggagagtacacatgtacttgtctggagggattcgaaggaaagaattgcgagttgttcacacgcaaactgtgctctcttgataatggggattgcgatcaattctgtcacgaggaacagaatagtgtcgtgtgctcttgcgctcgtgggtataccttggctgataatgggaaggcttgcatcccaaccggaccttacccctgcgggaaacagaccttggagcgccgcaagcggtccgtcgcacaggcgacttcttcctcgggcgaggctccggacagtattacttggaagccctacgacgctgcagacctcgacccaacggaaaacccattcgacctgctggactttaatcagacgcagccggaaaggggggataataacctgaccaggattgtaggcggccaggagtgtaaagatggggagtgcccatggcaagcgttactgattaacgaagaaaatgaaggattttgtggcggaacgatactgtcggaattctacatacttacggcagcccattgtctttaccaggctaagcggttcaaggtgagggtcggggaccgaaacacggagcaagaagaaggtggggaggctgtccatgaggttgaggttgttatcaagcacaatagatttacaaaagagacatatgattttgatatcgcggtgctgagacttaaaacgcccattacgttccgaatgaatgtggctccagcatgcctgccggaacgggattgggccgagtcgacgctgatgactcaaaagacagggattgtcagtggattcggccgcacccacgagaaaggccgccagtctaccagactgaaaatgttggaggtgccttacgtagatcgcaacagctgtaagctcagctccagttttattatcacgcagaacatgttctgcgccggctacgataccaagcaggaggacgcttgtcagggagactctggaggacctcacgtgacacgtttcaaggacacctattttgtgactggaatcgtgtcctggggagaggggtgcgccagaaaagggaagtacggaatctataccaaggttaccgcctttctcaagtggatcgatagaagcatgaaaacaaggggactacccaaggccaaatctcatgcacctgaggtgatcacgtcctcacctctcaag

SEQ ID NO: 9341 - DNA, 1464 bp, Artificial Sequence
  Description of Artificial Sequence: Synthetic coding sequence
atgggcaggcctctgcacctcgtattgctgagcgcgagtctagcgggtttgcttctcctgggcgagagcttgtttattcggagggagcaggcgaataatatcctcgccagggtaaccagagctaactcatttctcgaggaaatgaagaaggggcatcttgagcgcgaatgtatggaggaaacctgcagttatgaagaagctcgagaagtatttgaagattccgacaagacaaacgaattctggaacaagtataaagatggcgatcaatgtgagacttctccttgtcaaaaccaagggaaatgtaaggatggtctgggcgagtacacttgtacatgcctggagggtttcgaaggcaaaaactgcgagttattcacccggaaattatgctccttagacaatggggactgcgatcagttctgccacgaggagcagaattctgtggtgtgtagctgcgctcgtgggtacacactcgcagataacggcaaggcttgtatcccaacgggcccttatccatgcggcaagcagacgttggagcgccggaaacgtagcgtcgcccaagctacctcatcgagtggggaggccccggatagcatcacctggaagccctacgatgctgcggacttggaccctacagaaaaccccttcgatctgcttgactttaaccagacccagcccgagagaggtgacaacaacttgacgcgcatcgtggggggccaggagtgtaaggacggagaatgcccttggcaagccttactgattaacgaagaaaacgagggtttttgtggggggactatcttgagcgagttctatattctcacagccgcccactgtctgtaccaggcgaaacgcttcaaggtgcgggtgggggaccgcaatacggaacaggaggaagggggggaggctgtccacgaagtggaggtcgtgataaaacataacagattcactaaggagacatacgattttgatattgccgtactgcggctcaagactcctataaccttccgaatgaatgtggccccggcctgtcttcctgagagggactgggccgaaagtacactcatgacgcagaagactggcatcgtgtccggcttcggccggacccacgagaaggggcgccaaagcacccgcctcaagatgctcgaggtaccctacgtggacaggaactcttgtaaactgtcaagcagctttataatcacccagaatatgttttgtgccggatatgatacgaaacaggaagacgcatgtcagggggatagtggtggtcctcacgtgactcgctttaaggacacatatttcgtgacgggcatcgtgagctggggggaggggtgtgctaggaaagggaagtatggcatctacaccaaggtgacagcattcttgaaatggatagaccgctcaatgaagacccgggggttgcctaaagcaaaatctcacgccccagaagtgatcacgtcaagtccgcttaaa

SEQ ID NO: 9342 - DNA, 1464 bp, Artificial Sequence
  Description of Artificial Sequence: Synthetic coding sequence
atgggacgacctctccatctagtgctgctctcagccagtctcgccggtctcctccttctgggggagagtctattcattcgcagggaacaggccaacaacattctggctcgcgttacacgggcaaattcattcctcgaagagatgaaaaaagggcacctggaaagagagtgcatggaagagacctgtagttacgaggaggccagggaagtgttcgaggacagcgacaagactaatgagttctggaacaagtataaagatggcgatcagtgcgagacctctccctgccagaaccagggcaaatgcaaagacgggctgggggagtacacatgcacttgcctggagggctttgaggggaagaactgcgagttatttactaggaagctatgttccctggataacggcgactgtgaccagttttgtcatgaggaacagaattcagtggtctgctcatgtgccagaggctatacattagctgataacggcaaagcttgcataccaactggcccctatccatgcggcaaacagaccctcgaacgtcggaagagatctgtggcacaggccacaagctcttccggcgaagcccctgacagcataacctggaagccctacgacgccgctgacctggatcctaccgagaatccctttgacctcttggattttaatcaaactcagcccgagcgcggggacaacaaccttaccaggattgtcgggggacaggaatgtaaggacggcgaatgtccctggcaggccctactgataaatgaggagaatgaagggttctgcgggggcaccatcctgtccgagttttacattctcacagctgcccactgtctttatcaagccaagaggttcaaggtaagggtgggggacaggaataccgagcaggaggagggcggtgaagccgtccatgaggtcgaagttgtgattaaacacaaccggtttaccaaagaaacttacgattttgatatcgccgttctgcgtctgaagacccctatcaccttccggatgaacgtggctcccgcctgcctccccgaacgggactgggctgagagcactctgatgactcagaagaccggcatcgtgagcggcttcggccggactcacgagaagggcagacagagtaccaggctaaagatgttagaagtgccttacgttgaccgcaactcctgtaaactctcctctagttttataatcacacagaatatgttctgtgctggctatgacaccaagcaggaagacgcctgccagggcgactctggcggccctcacgtgacccggttcaaggacacctacttcgttactgggatcgtgtcctggggagaagggtgcgccagaaaaggcaagtatgggatttacacaaaggtgacagcctttctgaagtggattgaccgctccatgaaaacaagaggtttgcctaaagccaaatcacacgcacccgaggtgattacttcaagccctctaaag

SEQ ID NO: 9343 - DNA, 1464 bp, Artificial Sequence
  Description of Artificial Sequence: Synthetic coding sequence
atgggtaggccccttcacctggtgctgctgtccgcctctctggccggactgctgctgctaggagaaagcctgttcattcggcgcgagcaggctaacaacatcctggcccgggtcacaagagctaatagttttctggaggagatgaaaaaaggacacttggagcgagaatgcatggaggaaacctgtagttacgaggaggccagggaagtcttcgaggactctgataaaacgaacgagttctggaacaagtacaaggatggcgatcagtgcgaaacttctccatgtcagaaccaggggaaatgtaaggatgggttgggcgaatatacctgtacgtgcctcgaaggattcgagggaaaaaattgcgaactgttcacccggaagctttgtagtctggataacggcgactgcgaccagttttgccacgaagagcagaactcagtggtgtgctcatgcgctagaggctatacgctggcagacaatggaaaggcctgtatacccaccggtccctacccatgcggtaagcagacgctcgagaggagaaaaaggagcgtggcacaggccacttcttcatcgggtgaagcccccgacagtatcacctggaaaccatatgacgcggcagatctggaccctacagaaaacccattcgatctgttggacttcaaccaaacacagcccgagcgcggagacaataacctgacacggattgttgggggccaggagtgtaaggacggggagtgcccatggcaggctcttcttatcaatgaggaaaacgaagggttctgtggcggcaccattctgagcgagttctatatcttaacggcagctcattgcctctaccaagctaagcgcttcaaggtgcgggtaggcgataggaatacggagcaggaggaaggcggggaggccgtacatgaagtggaggtcgtcattaagcacaatagattcacaaaagagacctatgatttcgacattgcggttttgagactaaagacacccattacgttcagaatgaacgtcgcccctgcttgtttgccagaacgcgattgggcagaatctacactgatgacgcagaaaacaggcattgtcagtggctttgggagaacgcacgagaagggacgccagtccacacggctcaaaatgctcgaagtgccctacgtggaccggaattcctgcaaactgtccagtagctttatcatcactcaaaacatgttctgtgctggttacgacacgaagcaggaggacgcctgccagggagactccggagggcctcacgtgacaaggttcaaagatacatactttgtaactggtatcgtctcctggggggaagggtgcgcacgcaaaggcaagtacggcatttacacgaaagtgacagctttcctgaaatggatagacaggtccatgaagacccgcggtctccccaaggccaagtcacacgcacctgaggtgatcacgtctagccccctgaaa

SEQ ID NO: 9344 - DNA, 1464 bp, Artificial Sequence
  Description of Artificial Sequence: Synthetic coding sequence
atggggaggccattgcatctggtcctgctaagcgcaagcctcgccgggctgctcttgctgggtgagagcctatttatcaggagggaacaggcgaataatatcctggcccgtgtcacacgagccaacagtttcttagaggagatgaagaaagggcatctggaacgggaatgcatggaagagacatgtagttatgaggaggctcgggaggtgttcgaggactctgataagaccaacgaattttggaataagtacaaagacggtgatcagtgcgagactagcccgtgccagaatcaggggaaatgcaaagacggcctgggcgagtacacctgtacttgtttggaagggttcgaagggaaaaactgcgagctatttactcgcaagctgtgcagtttagataatggcgactgtgatcagttctgtcatgaggagcaaaactctgtggtgtgcagttgcgctcgcgggtacacattggcagataacgggaaagcctgtatccctaccggcccatatccttgcggaaaacagactctcgagcgacggaagaggtctgtggctcaggccacttcatcttcgggagaagcccccgactcaatcacctggaagccctacgacgcagccgacctggatcctacagagaatcctttcgatttactggatttcaatcaaacacagccagagagaggagacaacaatctaaccaggatcgtgggcgggcaggaatgtaaggatggggaatgcccttggcaagcgcttttaattaacgaggagaatgagggattctgcggtggtacaatactgtccgagttttatatcctcaccgcagcacattgtctgtaccaggccaaacgtttcaaagtaagagtcggagaccgcaacaccgaacaggaagagggaggtgaggccgtgcatgaagtggaagtggtgataaagcataatcggttcaccaaggaaacttacgactttgacatcgcagttttaagattgaagactcccatcacttttcgcatgaatgtcgcccctgcctgcctgccggagcgggactgggccgagtccacgctgatgacccaaaaaacggggatcgtctccggttttgggaggacccacgagaaaggtcggcagagtacacgtctgaaaatgctggaggtcccctacgtggacaggaattcctgtaagttgtccagttctttcattatcacacagaatatgttctgtgcagggtacgataccaagcaagaggacgcctgccagggcgactctggagggcctcatgtgacacgattcaaagacacttactttgttacgggcatcgtgagttggggagagggctgcgctcggaagggaaaatatgggatttatactaaagttactgctttcctgaagtggattgacaggtccatgaaaaccagaggacttccaaaggctaagagccatgctcctgaagtgatcacttcttctccactgaaa

SEQ ID NO: 9345 - DNA, 1464 bp, Artificial Sequence
  Description of Artificial Sequence: Synthetic coding sequence
atgggtagaccgctacaccttgttcttctgtccgcctccttggccggcctgcttctgctcggggagtctctgtttatccgtagggaacaggctaacaatatcctggctcgggtcacacgcgccaattcttttttagaggagatgaagaaaggtcacctggagagagagtgtatggaggagacctgcagctacgaggaagcaagagaggtgttcgaggattccgacaaaactaacgagttctggaataagtataaagatggcgatcagtgtgaaacatcaccatgccagaaccaagggaaatgtaaagacggactgggagagtacacttgcacctgccttgaaggcttcgagggcaaaaattgcgagctgtttacccgcaagctgtgctctctggacaacggggactgcgaccagttctgtcatgaagaacagaattctgtggtctgtagctgtgcacgaggttatacactggccgacaatggaaaggcgtgcatcccaactggaccttacccctgcggaaaacagacgttggaaagaaggaaaagaagcgtggcacaggctacgtcaagctctggcgaggctcctgacagcatcacctggaagccttacgacgcagccgacttagaccctaccgaaaacccattcgatctcctcgactttaaccagacccagcccgagcgcggcgacaacaacctgactcggatcgtcggtgggcaggagtgtaaggacggggagtgtccctggcaggcactgcttattaacgaggaaaatgaggggttctgtggaggcacaatacttagtgagttctatatcctgaccgctgcgcactgcctgtaccaggctaagcgatttaaggtgcgggttggtgaccggaacacggaacaagaggagggaggagaggcggttcacgaggtggaggtggtgatcaaacataatagatttactaaagaaacttatgacttcgatatagccgtgctgaggctgaagactccaattacattccgcatgaacgtcgcacccgcatgcttgccagagcgcgactgggcagagagtacgttaatgacccagaaaacaggaatcgtttctggatttgggcgaacccacgagaagggacggcagagcacccggctgaaaatgctagaggtgccatatgtcgatagaaactcctgcaaattgagtagttcatttattatcacacagaacatgttctgcgcggggtacgatactaaacaggaagacgcctgccagggagacagtggaggaccccacgtaaccaggttcaaggatacgtacttcgtgacaggcattgtgagttggggggaagggtgtgctagaaagggcaaatacggcatatacactaaggtgacagccttcttaaaatggattgatcgctctatgaaaacacgaggcctgcctaaagctaagagccatgcaccagaggtaatcacttcctccccgttgaag

SEQ ID NO: 9346 - DNA, 1464 bp, Artificial Sequence
  Description of Artificial Sequence: Synthetic coding sequence
atgggcaggccgctgcatctagtgctgctgagtgctagcctggctggtctgctcctgctgggggagtccctgtttattaggcgcgaacaggcgaataatatactggctcgcgtcacccgtgccaatagctttctcgaagaaatgaagaaaggccacttggaacgggaatgtatggaagagacgtgctcttatgaggaggcaagagaagttttcgaggattccgacaagacaaatgaattctggaacaaatacaaggacggtgatcagtgcgagactagcccttgccagaaccagggcaagtgtaaggatggtctcggcgaatatacctgtacctgcttagagggctttgagggtaagaattgtgagctgtttactcggaaactgtgttctctggacaacggtgactgtgatcaattttgccacgaggaacagaacagcgtggtttgttcatgcgcaagaggttacacccttgctgataacggcaaagcgtgtatcccgactggcccgtatccttgcggtaaacagaccctcgaacgccgcaagcggtccgtcgcgcaagcaacgtcttcctccggcgaggcgcccgattccattacgtggaagccgtatgatgccgcggacctggatccaaccgaaaatccgttcgacctgctggacttcaatcagacccagccagagcgcggcgataacaatctgacgcggatcgtgggcggacaagaatgcaaggatggtgagtgtccttggcaggctcttctgattaatgaagaaaacgagggcttttgcggtggcacgattctgtccgagttttacatcttgactgctgcacactgtttgtaccaagctaagcgttttaaggttcgggttggcgatcgcaatacggagcaagaagagggcggtgaggcggtccatgaggtagaagttgttatcaaacacaaccgctttaccaaggaaacctacgacttcgacatcgcagtcttacgcctgaagactcctattacatttcgcatgaacgtggcgccggcatgtctgccggaacgcgactgggcggagtcaaccctgatgacccagaaaaccggcatcgtctctggcttcgggcggacccacgaaaaaggtcgccaaagcactcgcctgaaaatgctggaggtgccatacgtcgatcgcaacagctgcaaactgagctcttctttcataatcactcagaacatgttttgcgcgggttacgatacgaaacaggaggacgcctgccaaggtgatagcggcgggccacatgtcacccggttcaaagacacttatttcgttaccggtattgttagctggggtgagggatgcgcgcgtaagggtaaatacggtatttatactaaggtaaccgccttcctgaagtggatagaccgaagtatgaaaacccggggtctgccgaaagcgaagagccatgcaccagaagttatcaccagctcgcctctgaag

SEQ ID NO: 9347 - DNA, 1464 bp, Artificial Sequence
  Description of Artificial Sequence: Synthetic coding sequence
atgggcaggcctttacatctggtgctcttgagtgcaagcctggctggactgctcctgttaggcgaatcccttttcatccgaagggagcaagctaacaacatcctggcacgggtgacaagagccaactcattcctcgaggaaatgaagaaagggcatctggaaagagagtgcatggaagagacatgctcatatgaggaggctcgcgaggtgttcgaagattccgacaaaaccaacgagttctggaacaaatacaaggacggcgatcagtgcgagaccagtccctgccaaaatcagggtaagtgcaaagacggcttgggcgagtatacttgcacctgcctggaaggcttcgaaggcaagaattgcgaactcttcacaagaaaactttgttccttggataacggcgattgtgaccagttttgccatgaggaacagaacagcgtagtgtgctcctgtgcccgcggatatacactcgcagataacgggaaggcatgcatccccactggtccctatccttgcggaaagcaaaccttggaaaggcggaaacgtagcgtggcccaggcaacgtcttcatcgggtgaagcccccgactcgatcacatggaagccttacgatgccgccgacctggatccaacagaaaacccttttgatctgctcgattttaaccagacccagccagaacggggagataacaatctgacacgcatcgttggggggcaagagtgtaaggatggggaatgcccttggcaggctctcctgatcaacgaagaaaacgaggggttttgcggggggacgatcttaagtgagttttatatcttgaccgcggctcattgtctttatcaagctaagaggttcaaggtgcgggttggggacagaaatactgagcaggaagagggaggagaagccgtgcacgaagtcgaggttgttatcaaacacaaccgcttcaccaaggagacctacgattttgacatagccgttcttcgtctcaaaacacctataacattccgtatgaacgtcgctcctgcttgcctaccagagagggactgggcggagtctactctaatgacccagaagaccggcatcgttagcggattcgggcggacccatgaaaaagggagacaaagcacgcgcctgaaaatgcttgaagttccctacgtggaccggaacagctgcaaactctccagcagtttcatcattactcagaacatgttttgcgcaggctacgacaccaaacaagaggacgcctgtcagggagatagcggaggaccccacgtcacacgcttcaaggatacctacttcgtcaccggcatagtgagctggggggagggttgtgcacgaaaagggaaatacgggatctatactaaagttacagccttcctgaagtggattgatagatctatgaaaaccagaggcctgcccaaggctaaaagccatgctcccgaagtcatcaccagcagccctttgaag

SEQ ID NO: 9348 - DNA, 1464 bp, Artificial Sequence
  Description of Artificial Sequence: Synthetic coding sequence
atgggacgacctctgcaccttgtgctgctgagcgcaagcctggccggcctgctcctgctgggtgaatctctgttcataagacgagaacaggctaacaacattcttgccagagttactagagccaactcatttctggaggaaatgaagaaaggacacctggaaagggagtgtatggaggaaacctgctcttatgaggaagcgagggaagtgtttgaggatagtgataagacgaatgagttctggaacaagtacaaggatggagatcaatgcgagacttccccctgtcagaatcaggggaagtgcaaggatgggctgggcgagtacacctgcacatgtcttgaaggctttgaggggaaaaattgcgaattgtttaccagaaagctgtgctctcttgataatggagattgtgatcagttctgccatgaagaacagaactccgtcgtgtgctcttgcgctcgcgggtatacacttgcagataatggaaaggcctgcatcccaactggaccatacccatgcggtaagcagactcttgagcggcgaaaaaggtctgtggcccaggcaactagtagtagtggcgaggcccctgattcaatcacttggaaaccttacgacgctgcagatctcgacccaactgaaaacccattcgaccttttggattttaatcaaacgcaaccggaaagaggcgacaacaacctaacccgcatagttgggggacaggaatgtaaagacggcgaatgcccctggcaggctcttttgattaacgaggaaaacgaggggttttgcggcggaaccatcttgagcgaattctacattctgacagccgcacattgtctgtatcaggccaaaaggttcaaggtaagggtgggcgacagaaacacagaacaggaggaaggtggagaagcggtgcacgaagtcgaagtcgttatcaagcataatcgatttaccaaggagacttacgacttcgacatcgcggtgctcagactgaaaacccccattacttttaggatgaatgtagcgcctgcatgtcttccagagcgagactgggcggagtccaccctgatgacgcagaagaccggcatcgtctcgggcttcgggagaacccacgagaaggggagacagtctacacgactgaagatgctcgaggtcccttatgtggacagaaacagttgcaaattgtcctcttcatttatcattacacagaatatgttttgcgctggttacgatacaaagcaggaagacgcctgtcagggcgacagcggcggaccccatgtgacgaggtttaaggatacctacttcgttacaggaatagtgagttggggagaaggctgcgccagaaaaggtaaatatggaatctacaccaaagtgactgcctttttgaagtggatagacaggagtatgaagactagaggcctacctaaagcaaagtcgcacgctccagaggtgatcaccagttcacctttgaag

SEQ ID NO: 9349 - DNA, 1464 bp, Artificial Sequence
  Description of Artificial Sequence: Synthetic coding sequence
atggggcgacccctccaccttgtgctgctcagtgcctcactcgccggcctgctcctcctgggagagagcctcttcatcagacgcgagcaggctaacaacattctcgcccgtgtcacgcgggccaatagttttctcgaggagatgaaaaaaggccatttggagcgtgagtgcatggaagagacctgctcttacgaggaagcccgtgaggtcttcgaagattcggataagactaacgaattctggaataagtataaggacggcgatcagtgtgaaacatcgccttgccaaaatcagggtaagtgcaaggatggcctcggcgagtatacctgcacctgcctggaaggattcgagggtaagaactgtgagctcttcacccgaaagttgtgcagcttggataacggtgattgcgaccagttttgtcacgaggagcagaacagtgtcgtgtgttcttgtgctcggggttacacgcttgccgacaacggtaaggcttgtatcccgaccggcccatacccttgcggtaagcagacgttggagcgtcgcaagcgttctgtcgcccaggccactagtagttcaggtgaagctcccgattcaatcacgtggaagccgtacgatgctgccgacctggaccccactgaaaaccccttcgatctgctggacttcaaccagactcagcccgagcgtggcgacaataacttgacccgtatcgtggggggccaggagtgcaaggatggggaatgcccgtggcaggctctgctgatcaacgaggagaatgagggcttctgcggtggaaccatcctgagcgaattctacatccttaccgcggctcactgtctttaccaagctaagcgttttaaggtcagagtcggcgaccgaaataccgagcaggaggaggggggtgaggccgtgcacgaggttgaggtggtcatcaaacataaccgttttactaaagaaacctatgactttgacattgccgtgctacgtctcaaaactccaattacctttcggatgaacgtggcccccgcctgtcttccggagcgcgattgggccgaatccacgctcatgactcagaaaaccggcatcgtctctggtttcggccgcacccacgagaagggtcgccaatccacccgcctcaagatgctggaggtgccgtacgttgaccggaactcctgtaagttgagctcttcgtttattatcacccagaacatgttctgcgcaggctacgatacgaagcaggaagatgcttgtcagggcgattctggcggtcctcatgtgaccaggttcaaggatacttacttcgtcaccggtatcgtcagctggggagaaggctgcgctcgtaaaggcaagtatgggatctatactaaggttacggcttttttgaagtggatcgaccggagcatgaagacacgtggtctaccgaaggctaaatcgcatgcccccgaggttatcacctcctcgccgctgaag

SEQ ID NO: 9350 - DNA, 1464 bp, Artificial Sequence
  Description of Artificial Sequence: Synthetic coding sequence
atgggcagaccactccatctcgttttgctctccgccagtctagccggtctgcttctgcttggcgagagtctcttcattcggcgggagcaggccaacaatattttggccagggtgacaagagccaatagctttcttgaagagatgaagaagggacacttggagcgggaatgtatggaagagacgtgttcttatgaggaggcaagggaagtgttcgaggactctgacaagactaacgagttctggaacaaatacaaggacggggatcagtgtgaaacctcaccttgtcagaaccaggggaagtgcaaggatggcctgggcgaatatacctgtacgtgcttggaggggttcgaaggtaaaaattgtgaactgttcacaaggaagctatgcagcctggataacggcgactgtgatcagttttgccatgaggagcagaacagtgtcgtgtgcagttgtgcacgaggttatacgttagccgacaacggtaaagcttgtatccccaccggtccatacccttgtggcaaacagaccctagagcggcggaaaaggtctgtggcccaggcaacatcgagcagtggggaggctcccgacagcattacgtggaagccttatgatgctgccgatctggatcccaccgaaaacccatttgacctgcttgactttaatcaaacacagccagaaaggggcgataacaacctaacccggattgtgggagggcaggaatgtaaggacggagagtgtccatggcaagcgctgctcattaatgaagaaaatgagggattttgcggagggactattctatctgaattttacatcctgactgctgcccactgcctctaccaggcgaaacggttcaaagtgcgagtgggcgaccggaataccgagcaggaagaagggggcgaggccgtccatgaagtggaggtggtcattaaacataaccgattcactaaagagacctacgacttcgatatcgctgttctgaggctgaagacaccaattacattccgcatgaatgtggcacctgcgtgccttcctgaacgggactgggcagaatccactctgatgacccagaagaccgggattgtaagcggctttggcagaactcatgaaaagggcaggcagagcactcgtctgaaaatgttggaagtgccatatgtggaccggaactcatgtaaactctcgtcttcattcattatcacacagaatatgttttgtgccggatatgataccaagcaggaggatgcatgtcagggcgattctggtggccctcatgtaacccggtttaaagacacgtacttcgttacgggcatcgtgtcttggggcgaggggtgtgccaggaaagggaagtacggtatatataccaaggtcaccgcatttcttaagtggattgatcgctctatgaagacccggggcctcccaaaggcaaaaagccacgcccccgaggtcattacatcaagccccctgaag

SEQ ID NO: 9351 - DNA, 1464 bp, Artificial Sequence
  Description of Artificial Sequence: Synthetic coding sequence
atgggtcgaccgctacatctagttctactatcggcgtcgttagcgggtttactactattaggtgaatcgctatttatacgtcgtgaacaagcgaataatatactagcgcgagttacgcgagcgaattcgtttttagaagaaatgaaaaaaggtcatttagaacgagaatgtatggaagaaacgtgttcgtatgaagaagcgcgtgaagtatttgaagattcggataaaacgaatgaattttggaataaatataaagatggtgatcaatgtgaaacgtcgccgtgtcaaaatcaaggtaaatgtaaagatggtttaggtgaatatacgtgtacgtgtttagaaggttttgaaggtaaaaattgtgaactatttacgcgaaaattatgttcgctagataatggtgattgtgatcaattttgtcatgaagaacaaaattcggtagtatgttcgtgtgcgcgtggttatacgttagcggataatggtaaagcgtgtataccgacgggtccgtatccgtgtggtaaacaaacgctagaacgacgaaaacgttcggttgcgcaagcgacgtcgtcgtcgggtgaagcgccggattcgataacgtggaaaccgtatgatgcggcggatttagatccgacggaaaatccgtttgatctattagattttaatcaaacgcaaccggaacgaggtgataataatttaacgcgtatagtaggtggtcaagaatgtaaagatggtgaatgtccgtggcaagcgttattaataaatgaagaaaatgaaggtttttgtggtggtacgatactatcggaattttatatactaacggcggcgcattgtctatatcaagcgaaacgttttaaagtacgtgtaggtgatcgtaatacggaacaagaagaaggtggtgaagcggttcatgaagtagaagtagtaataaaacataatcgttttacgaaagaaacgtatgattttgatatagcggtattacgactaaaaacgccgataacgtttcgaatgaatgttgcgccggcgtgtttaccggaacgtgattgggcggaatcgacgttaatgacgcaaaaaacgggtatagtatcgggttttggtcgtacgcatgaaaaaggtcgtcaatcgacgcgtttaaaaatgctagaagttccgtatgtagatcgtaattcgtgtaaactatcgtcgtcgtttataataacgcaaaatatgttttgtgcgggttatgatacgaaacaagaagatgcgtgtcaaggtgattcgggtggtccgcatgtaacgcgttttaaagatacgtattttgttacgggtatagtatcgtggggtgaaggttgtgcgcgaaaaggtaaatatggtatatatacgaaagttacggcgtttttaaaatggatagatcgatcgatgaaaacgcgtggtttaccgaaagcgaaatcgcatgcgccggaagttataacgtcgtcgccgctaaaa

SEQ ID NO: 9352 - DNA, 1464 bp, Artificial Sequence
  Description of Artificial Sequence: Synthetic coding sequence
atggggcgacctctacaccttgtgctccttagcgccagcctcgctggtctgctgttgttgggcgagagtctcttcattcgtagggagcaggccaacaatatactggctcgggtcactcgcgccaacagctttctggaggagatgaaaaagggtcacctcgaacgagaatgtatggaagagacgtgttcatacgaggaagcgcgtgaagtgtttgaggatagcgataagaccaacgagttctggaataagtacaaggatggcgaccagtgcgagacctccccttgtcagaaccaaggcaagtgtaaagatgggctgggtgagtacacgtgcacatgtctggaaggtttcgaaggcaaaaattgcgaactgtttactaggaaactgtgttccttagataacggcgactgtgaccagttctgccacgaggaacagaactccgtcgtgtgttcctgtgcgcgagggtacacgctcgccgataatggcaaggcttgcatccccactggcccttatccctgtgggaagcaaactctggaacgaagaaagagatcggtcgctcaggccaccagctcttctggcgaagcacccgacagtatcacctggaagccttatgatgccgccgatttggaccccactgagaatccctttgatttgttggatttcaatcagacacagcccgagagaggagataataacctgactcggattgtgggtgggcaggagtgtaaggacggcgaatgcccgtggcaggcccttctgattaacgaagagaatgaaggtttctgtggaggaactattctgtcagaattttacattctcactgccgctcactgcctttaccaggctaagagatttaaagtgcgggtgggcgaccgcaacactgaacaggaggagggaggggaggcagtacacgaagtcgaggtggttattaaacacaatcgattcactaaagagacatatgactttgatattgccgtcctgcggctcaagacgcccattacattcaggatgaacgttgccccagcatgcttgcccgaaagggactgggccgagagtacactgatgacccaaaagacaggtatagttagcgggttcggacgaacccacgagaaaggtcggcagtccacccggcttaagatgctggaagttccctacgtggaccgtaactcatgtaaattgtcaagttcttttatcatcacccaaaatatgttttgcgccggttatgataccaagcaggaagacgcctgccagggtgattccggaggcccccatgtgaccagattcaaagatacgtactttgtaactgggatagtgagctggggcgaagggtgcgcccgcaagggcaaatatggaatttacaccaaggttacggctttccttaagtggatcgataggtctatgaaaactagaggactgccaaaggctaaaagccatgcgccagaagtgattacatcgagtcccctgaag

SEQ ID NO: 9353 - DNA, 1464 bp, Artificial Sequence
  Description of Artificial Sequence: Synthetic coding sequence
atgggcaggcccctgcacctagtcctgctgagcgcttcactcgccgggctgcttctcctcggggagagtctgttcatcaggagggaacaggccaataatatactggcaagggtcaccagagctaacagttttcttgaagagatgaaaaagggccatctggagcgagaatgtatggaggagacgtgtagttacgaggaggctcgggaggtcttcgaggactccgataaaactaacgagttctggaacaagtataaagatggtgaccagtgtgagacatctccctgccagaatcagggcaaatgcaaagacggactaggtgaatatacatgtacctgtcttgaaggatttgagggaaagaattgtgaacttttcacgcgcaaactgtgctccctggacaacggcgattgcgaccaattctgtcacgaggaacagaatagcgtggtgtgctcatgcgcacgggggtacaccctggccgataacggaaaggcctgcatccccaccgggccttacccatgcgggaagcaaaccctggagaggcgaaaacgttccgtcgcccaggcgaccagctcttccggtgaagccccagactcaataacgtggaaaccatatgatgccgccgacctggaccctacagagaacccctttgacctgctcgattttaaccagacacagcctgagcggggggataacaatctgaccagaatagtggggggacaggagtgcaaagatggcgaatgcccctggcaggccctgttgataaacgaagagaatgagggcttttgtggcggaactatactctctgagttttacatactaaccgcggctcactgcctctatcaggctaagagattcaaagtcagagtaggggacagaaatactgagcaggaggagggcggggaggcagtgcacgaggtagaggtggtcatcaaacataatcggttcacaaaggagacctacgacttcgacatcgctgtgctgcggttaaaaacaccaatcacgttccggatgaatgtcgcccctgcttgcctcccggagcgggactgggccgaaagcacactcatgacgcaaaagacaggcattgtgtccggattcgggagaacccatgaaaaaggtcgtcagtcaacaaggctaaaaatgttggaagtgccttatgtcgataggaactcctgtaaactttcaagctctttcatcatcacgcagaacatgttctgtgccggctacgataccaagcaggaagacgcttgccaaggggactctggggggccacacgtgacccggttcaaggacacctacttcgtgacaggcatcgtgtcctggggggaaggctgtgcccggaaaggcaaatatggcatatacacaaaggtgaccgcttttctaaagtggatcgatcggtcaatgaagactcgcggactacccaaagccaagtctcatgctcctgaagtgatcacttcttcacctctgaaa

SEQ ID NO: 9354 - DNA, 1464 bp, Artificial Sequence
  Description of Artificial Sequence: Synthetic coding sequence
atgggtcggccactgcacctcgtgctgctctcggcgtctctggcggggctcttgctgctgggggagtcactgttcatccggcgcgaacaggcaaataatatcctcgcccgggtgacccgggccaactcgtttctcgaggagatgaaaaaaggtcacctggagagagaatgcatggaggagacttgcagctacgaagaagcccgcgaggtctttgaggactcagacaagaccaacgagttctggaacaaatacaaggacggcgatcaatgcgaaacctccccatgtcagaaccagggcaaatgtaaggacggactgggtgaatacacttgcacttgtctcgaggggttcgaaggaaagaattgcgaattgttcactcgaaaactgtgctcgcttgataatggggattgcgatcaattctgccatgaggagcagaactcagtggtgtgttcgtgcgccagaggatacactttggccgataacggaaaggcctgtatcccgactggaccatacccttgcggcaagcagactctggaacggcgcaagcgctcggtcgctcaggctacctcgtcctccggagaagccccggacagcatcacctggaagccatacgatgcggccgatctcgacccgactgagaaccctttcgacctgctggacttcaaccagacccaacctgaacgtggagacaacaatctcactaggattgtcggaggtcaagaatgtaaagacggagagtgcccctggcaggccctgctgatcaatgaggagaatgagggtttttgcggaggcactatcctctccgaattctatattctgaccgcagcacactgcctgtaccaagcgaagagattcaaggtgcgggtgggagatcgcaacactgagcaggaagaaggaggcgaagcagtgcacgaagtcgaagtggtcatcaagcataacagattcactaaggaaacctatgacttcgatatcgccgtgctgcgccttaagaccccgatcacttttaggatgaacgtcgcccccgcttgcctcccggaaagagattgggcggagtccacgctcatgacgcagaaaaccggaatcgtgtccggcttcggccgcacccacgaaaaagggcgccagtcgactaggctgaagatgctggaagttccatacgtggaccgcaatagctgcaaactgagctcatcgtttattattacccagaacatgttttgcgcgggatacgataccaagcaagaggacgcttgccaaggagactctggcggaccgcatgttacgaggttcaaggacacctacttcgtgactggtatcgtgtcctggggggaaggatgtgcacggaagggaaagtacggcatctacaccaaggtcaccgcgttccttaagtggatcgacagatccatgaaaacgcggggacttcccaaggcaaagagccatgctccggaagtgatcaccagctcaccgttgaag

SEQ ID NO: 9355 - DNA, 1464 bp, Artificial Sequence
  Description of Artificial Sequence: Synthetic coding sequence
atgggtcgaccccttcatttggtgcttctgagcgctagcttggccggcttgttgctcttgggcgaatccttatttatacggcgcgagcaggctaataacatactcgctcgggtgacccgcgccaattcgttcttggaggaaatgaaaaaggggcacctcgaacgggaatgcatggaagagacctgctcgtacgaagaggcaagggaagtgttcgaggacagtgataagaccaacgagttctggaacaaatataaagatggtgatcaatgcgagaccagtccttgtcaaaaccagggaaaatgtaaggatgggctgggcgaatatacctgtacttgtctcgagggctttgaaggtaaaaactgcgagctgtttactcgtaagctctgttccctagacaatggagattgcgaccaattttgtcacgaagagcagaatagcgttgtgtgttcatgcgcccgagggtacaccctggccgacaatgggaaggcttgtatccccacgggcccttatccctgcggaaaacagacacttgagagacggaaacggagtgtagcccaggcaacctccagctcaggggaagcacccgattccataacgtggaaaccttacgacgcagccgacttggacccaaccgaaaacccgtttgatctgctggattttaatcaaacccagcccgaacgcggtgataacaacttgacgcgaatagtgggcggccaggaatgtaaggacggggagtgtccatggcaggccctccttataaacgaagagaacgagggcttttgcgggggtacgatcctgtcggaattttatatcctgacagccgctcattgtttgtatcaagctaaacgctttaaggtgagagtcggggataggaacaccgaacaggaggagggcggcgaggccgtgcacgaggtagaagttgtgattaagcacaaccggtttacaaaggagacatacgactttgatatcgccgtccttaggctcaagacgcccattacatttcggatgaacgtcgcgcctgcgtgcctacctgaaagggactgggctgagagcactttgatgacgcagaaaactggaattgtgagcggctttgggaggactcacgagaaaggaagacagtcgactaggctaaaaatgctcgaggtaccatacgtggataggaactcatgtaagttatcctcttctttcataattacccagaatatgttttgcgctggctacgacaccaaacaggaagatgcttgtcaaggagactctggaggaccccacgttacacgttttaaggacacttatttcgtaaccggaattgtgtcctggggcgaaggctgtgctaggaaaggcaagtacggaatctatactaaggtcacggcattcctgaaatggattgaccgatccatgaaaactcgcggcctgcctaaggccaagtctcacgcacccgaggtcattactagttcccctctgaag

SEQ ID NO: 9356 - DNA, 1464 bp, Artificial Sequence
  Description of Artificial Sequence: Synthetic coding sequence
atgggtcgacctctacaccttgtacttctttctgcttcattggcaggtcttttgttgcttggtgaatctctttttattagaagagaacaggctaacaacatccttgcacgcgtcacacgagccaattcctttttggaagagatgaagaagggccacttagagagggaatgtatggaggaaacttgcagttacgaagaagcacgagaagtgtttgaagattcagataagactaatgaattctggaacaagtataaagatggagatcagtgtgagactagtccctgtcaaaaccaaggaaagtgcaaagacggtcttggcgaatatacgtgcacttgtcttgagggcttcgaggggaagaattgtgagttgtttaccaggaagctctgctctctcgataatggggactgtgatcagttctgccatgaagagcaaaattctgtggtgtgcagttgtgcaaggggttatacacttgctgacaatggaaaagcatgcatccccactgggccttacccctgtgggaagcagacgttggaaagacgaaagcgctcagtcgctcaagccacctcctcttccggtgaggctcctgatagtattacctggaaaccttatgatgccgccgatctagatccaactgaaaatccgttcgatttgcttgatttcaatcagactcagcctgagagaggggataacaatcttacacgtatcgtaggtggacaagaatgtaaggatggagagtgcccctggcaggccctgcttattaatgaagagaatgaagggttctgcggtggtacaatcttgtcagagttctacatcctcaccgcagcccattgtctctatcaggcaaagaggttcaaggtgcgggtgggggatagaaataccgagcaggaggagggaggcgaggctgtacatgaagttgaagtggtaatcaaacataacaggtttactaaagagacctacgattttgatatcgccgtgctcagattgaagacaccaatcacgttccgtatgaatgtggctccagcatgccttcctgagagagattgggccgaaagtacgctcatgacccaaaagacgggcatagttagcggttttgggcgaacacatgagaaaggacgacagagtacccggttgaaaatgcttgaagtaccctatgtggatcgaaattcctgcaagctgtcatcaagctttattataacacagaacatgttctgcgccggttatgatactaagcaagaggatgcttgtcaaggggatagcggtggaccacacgtcactcgcttcaaggatacatatttcgtaacaggcattgtgtcttggggggaaggttgcgcgagaaaaggaaaatatggtatttacacaaaggttaccgcttttctcaaatggatcgataggtcaatgaagacaagagggttaccaaaggcaaagtctcatgctccagaggtgataacttcctcccctctaaaa

SEQ ID NO: 9357 - DNA, 1464 bp, Artificial Sequence
  Description of Artificial Sequence: Synthetic coding sequence
atgggacgtccacttcatctcgttctcctgagtgcgagtctggctgggctgttgcttcttggcgaaagccttttcatacggcgagaacaggcaaacaacattctggcacgggtgacacgggccaatagttttttagaggaaatgaagaaaggccatctagagagggaatgtatggaggaaacctgctcttacgaagaagcgcgcgaggtatttgaggactccgacaagactaacgaattctggaataagtacaaagatggggatcagtgtgagacctccccctgtcagaatcaagggaaatgcaaagatggattaggagagtacacttgtacgtgtctggagggatttgagggcaaaaactgcgagctcttcaccaggaaattatgcagtctggataacggggattgtgaccagttttgtcatgaggagcagaatagcgtggtctgctcttgcgcgcgcggatacacactggccgacaatggaaaggcttgtattcctaccggtccctacccatgtggcaaacagaccctggagaggaggaaaagatcagtcgcccaggctacaagctcatctggtgaggcgccagattccataacttggaagccctatgacgcagccgacctggaccctacagaaaacccctttgacctgctggacttcaaccagacgcagcccgagcggggggacaacaacctgacgcgtattgtgggaggacaggaatgtaaggatggcgaatgcccatggcaagccttgctcattaatgaggagaatgaagggttctgtggcggaactattctgagcgagttctacatcctgaccgcggcacattgtctttatcaggctaagcgctttaaagtcagggtcggggacaggaataccgagcaggaggaagggggggaggctgtgcacgaggttgaagttgtcataaaacataacaggttcaccaaggagacctatgactttgacatcgccgtgctgcggctgaaaactcccataacctttagaatgaacgttgcgcccgcatgtctgcccgaaagggattgggccgagtccactctgatgacacagaagaccggcatcgtgtcaggcttcggacgtacccatgaaaaaggcaggcagagcactagactcaaaatgttggaggtgccatacgtcgatcggaattcctgcaaactgagttcatccttcatcataacacagaacatgttttgcgcaggttatgacaccaaacaagaggacgcatgccagggtgattctggggggcctcatgtaacccggtttaaggatacctactttgtcacaggtattgtgtcgtggggcgagggatgtgctcggaagggaaagtacggcatttacaccaaggtgactgccttcctgaagtggatcgacagatctatgaagacaaggggactccccaaggcaaaaagtcatgcccctgaggtgatcactagtagcccgctgaag

SEQ ID NO: 9358 - DNA, 1464 bp, Artificial Sequence
  Description of Artificial Sequence: Synthetic coding sequence
atgggccgccccctccacctggtccttttgagcgcctccttggctggtctgctcttgttgggtgaaagccttttcatcaggcgcgaacaggcgaacaacatcctggctagagtcacacgcgcgaactccttcctggaggaaatgaagaagggccatctggagagagagtgcatggaggagacctgttcatatgaggaggccagggaagtgttcgaagactccgacaaaacaaatgagttctggaataagtataaggatggagatcagtgtgaaacctctccgtgtcagaaccagggaaaatgtaaggatggactgggcgagtacacctgcacttgcttggagggctttgagggtaagaattgcgaactctttacgagaaagctctgctccctggataacggagactgtgatcagttttgccacgaagagcagaacagcgtggtatgttcctgtgctagaggatacactttggcagacaatggaaaagcttgtatacccaccggtccctatccctgcggcaagcagacgttggagaggcgcaaaaggtctgtggcgcaagctaccagctctagtggtgaggccccagactctatcacgtggaagccatacgacgctgccgatctggaccctacagagaacccttttgatctgttggacttcaaccaaactcagcctgagaggggagataacaacttgactaggatcgtcggcggccaagaatgcaaggatggcgagtgtccctggcaggccctcttgattaacgaagagaacgagggcttctgcggcggaacaatcttgtctgaattctacattctgacggctgcgcactgcctgtaccaggccaagcgctttaaggtaagggtgggcgatagaaataccgaacaggaggagggtggcgaagcggtgcacgaggttgaggtggtaattaaacacaaccgcttcactaaggagacttacgatttcgacatcgcagtccttcgcctcaagacaccaatcacctttagaatgaatgtggcccccgcttgcctgccggagagagattgggcagagtcaacccttatgactcaaaagacgggtatcgtatctggttttggccgcactcacgagaaaggaaggcagtccacaagacttaagatgcttgaggtgccctacgttgacaggaactcttgcaagctgtcttcttcatttatcatcactcagaacatgttttgcgccggttacgacactaagcaagaagatgcctgccagggcgacagcggaggaccccatgttactcgcttcaaagatacatattttgtgactggaattgtaagctggggcgaaggatgcgctaggaagggtaagtacggtatctatacaaaggtcacggctttcctgaagtggattgacaggagcatgaagaccaggggccttcctaaggcgaagtctcatgcgccagaggtgattacatctagcccactcaag

SEQ ID NO: 9359 - DNA, 1464 bp, Artificial Sequence
  Description of Artificial Sequence: Synthetic coding sequence
atgggtcgccctctgcacctagtgctgctcagcgccagcctggccggcctgcttctgcttggcgagagcttgttcatccggcgagagcaggctaataatattttagctcgagttaccagagctaattctttcttggaggaaatgaaaaaaggacatttggaaagggagtgcatggaggagacttgcagttatgaggaggcccgcgaagtgttcgaagactcagacaaaaccaacgagttttggaataaatacaaggatggggaccagtgcgaaacctcaccgtgtcagaaccagggcaagtgtaaggacggccttggtgaatatacatgcacatgtctggaagggttcgaaggcaagaattgcgaactgtttacacggaaactgtgtagcctagataatggagactgtgaccagttttgtcacgaggagcagaatagtgtggtctgttcctgcgcacggggctacacactggccgataatggcaaagcatgtatccctacgggtccatacccgtgcggcaaacagaccctagagagacgaaagaggagtgtggctcaggctacatcctccagcggggaagcccctgattctatcacttggaaaccctacgacgcggcagacttagaccccactgagaaccctttcgatctgctggatttcaaccagactcaacctgagcgaggtgacaacaatctgaccagaatcgtaggcggacaggagtgtaaagatggcgaatgtccatggcaggccctattgatcaacgaagaaaatgaggggttctgcgggggcaccatcttgtctgaattctacatcctgacagccgcacactgcctgtatcaagccaaaaggtttaaagttagagtgggagatcgcaacactgaacaggaagaaggcggagaagctgttcacgaagtggaggtcgtcataaagcacaatcggttcacgaaagagacttacgacttcgatattgccgttttacgtcttaaaacccctataacttttagaatgaatgtagctcccgcttgcctgccagaaagggattgggctgaaagcacgctcatgacccagaagacaggcatcgtctcgggttttggcagaacacacgaaaaaggaaggcagtctacacggctgaagatgctggaggtgccttacgtggatcgaaactcatgcaagctttccagctccttcatcatcacccagaatatgttttgcgccggatacgacaccaagcaggaggatgcctgccagggggattctggtgggccccatgtcacccggttcaaagatacctacttcgtgactggcattgtgtcctggggagaaggctgcgctagaaagggtaagtacggtatctatactaaggtcaccgctttcttaaagtggatagatcggtcgatgaaaaccagagggttacctaaggctaagtctcacgctccagaggtaataacttccagccctctgaaa

SEQ ID NO: 9360 - DNA, 1464 bp, Artificial Sequence
  Description of Artificial Sequence: Synthetic coding sequence
atgggcagacctcttcacctggtcctcctgtccgcctcccttgcagggctgctgctactaggggagtcacttttcatcagaagggaacaagcaaacaacattctggcaagagtgacaagggctaactcttttctggaggagatgaagaaggggcacctggagagagaatgcatggaggaaacttgtagttacgaggaagcaagagaggtctttgaggattcagataaaacaaacgaattctggaacaagtacaaagatggcgaccagtgtgagacctcgccctgccagaatcagggtaagtgtaaagacgggctcggcgagtatacttgcacatgcctagagggcttcgaaggtaagaactgcgaactctttaccaggaagctgtgtagcctggataatggcgactgtgaccagttctgccacgaggaacagaattcagtggtttgcagctgcgcaaggggctatactctcgctgacaatggcaaagcatgcatccccacgggaccatatccgtgtgggaaacagacgctcgaacgccgcaagagatccgtggcccaggctacctctagctctggtgaagcccccgactccattacctggaagccatatgacgccgccgacctggatcctaccgaaaacccttttgatttgcttgactttaatcagacacagccagagaggggcgacaataatttgacccgcattgtgggaggacaagagtgcaaggatggtgaatgcccttggcaagctttgctgatcaatgaagagaacgaaggattctgtggagggacaattctcagcgagttctatatcctcactgcggctcactgtctgtatcaggctaagcggttcaaggtcagggtaggagacagaaataccgagcaggaagaaggcggcgaggctgtccatgaagtggaggttgtgatcaagcacaacagattcaccaaagagacctacgattttgatatcgcagtcctgcgtctgaaaacgccaataacattccgcatgaatgtggccccagcctgcttgcctgagcgagattgggccgagagcaccctcatgacacagaaaacagggattgtttcaggcttcggtcgcactcacgagaagggcaggcagagcacccggctgaaaatgcttgaagtgccttatgtggatcggaactcttgtaagctgtctagctcatttatcatcacacaaaatatgttttgcgcgggatatgacacgaagcaagaggacgcctgtcagggagattcggggggacctcacgtgaccagatttaaagatacatactttgttaccggaatcgtttcttggggagagggctgcgccaggaaggggaagtacggaatctatacaaaagtgaccgcctttctgaaatggattgacagatccatgaagaccagagggttgccaaaagctaaatcacacgccccggaagtgatcacaagcagtccactgaaa

SEQ ID NO: 9361 - DNA, 1464 bp, Artificial Sequence
  Description of Artificial Sequence: Synthetic coding sequence
atgggcaggcccttgcacctcgtgcttctgagcgctagcttggctgggctgctccttctgggtgaaagcctgtttattcgaagagagcaagctaacaacattctcgcaagagtgacccgggccaactctttcctggaggagatgaaaaaaggccatcttgagcgggagtgtatggaggagacgtgcagctacgaagaagccagagaggtgttcgaggattctgataaaaccaatgaattctggaacaagtataaggacggggaccagtgtgagacttccccctgtcagaaccagggtaaatgcaaagacgggctcggggagtacacctgtacctgcctggagggctttgaaggtaagaattgtgagttgttcaccagaaagctatgttcccttgataacggcgactgcgaccagttttgccatgaggaacagaatagcgtggtctgttcctgcgccaggggctacaccctcgccgacaacggaaaggcatgcatcccaaccggtccatacccttgcggaaaacagacgctggagcgacggaaacggtctgtggcccaggccacaagcagctccggggaggctcccgattccattacttggaagccttatgatgctgcagaccttgatcccacagaaaatccattcgaccttctggattttaaccagactcaaccagagcgtggggacaacaacctgacaagaatcgtgggcggtcaggaatgtaaggacggcgagtgcccctggcaggcgttgcttataaatgaagagaacgagggcttctgcggggggacgattttaagcgaattttacatccttaccgcagctcattgcctttatcaagccaagcgcttcaaagtccgggtcggcgacaggaacacagagcaggaggagggcggggaagcggtgcacgaggtggaggtggttatcaagcataatcggttcactaaggagacatacgatttcgacatcgcggtcttgaggctcaaaacccctattacttttagaatgaacgtggccccagcctgtttgcccgagagggattgggcagaatccaccctcatgacccagaagacgggcatagtgagcggattcgggcgcacccatgagaaagggcgacagagtacacgcttgaagatgttggaagtcccttatgtggaccggaactcctgcaaactttcatcttcgtttatcatcactcagaatatgttctgcgcaggctatgacaccaagcaggaggacgcgtgccaaggagattcaggcgggccccacgtcacaaggtttaaagacacatactttgttaccggaattgtttcttggggggaggggtgcgctaggaaggggaagtatggcatatatacaaaagtgaccgcgttcctcaaatggatagaccgctcaatgaagacccgcgggcttccgaaggctaagagccacgcaccagaggtaatcactagctccccactgaaa

SEQ ID NO: 9362 - DNA, 1464 bp, Artificial Sequence
  Description of Artificial Sequence: Synthetic coding sequence
atgggacgaccattgcacctcgtgctattaagtgcgtcattggcgggattgcttttgcttggcgagagtcttttcattagacgcgaacaagcaaataatattcttgcccgtgttactagagccaattcattccttgaagagatgaaaaaaggtcatctcgagcgcgaatgtatggaagaaacatgttcgtatgaagaggcgagagaggtttttgaagattccgataagacaaacgaattttggaataaatacaaggatggagatcaatgcgaaacatcgccgtgtcagaatcagggtaagtgtaaagatggactgggcgaatatacttgtacatgcctcgaaggtttcgaaggtaaaaattgtgagttgttcacccgaaaactgtgttccctggataatggagattgcgaccagttttgtcacgaggaacaaaacagtgtagtctgctcttgcgccagaggatacacactcgcagataacggtaaagcatgtattccaactggaccatacccttgcggaaaacaaaccttggagcgaaggaagcgttcggtggctcaagctactagctcgagtggagaggcaccggattcaattacatggaaaccctatgatgcagccgatctggatccaaccgagaatccatttgatcttcttgacttcaatcaaacacaacccgagcggggagataacaatcttactcgtattgtgggcggacaggaatgtaaggatggtgagtgtccgtggcaagctcttttaattaacgaggagaatgaaggtttctgtggtggaactatcctatcagagttttacattctcaccgctgctcactgtctgtatcaagccaagagatttaaggtgcgggtcggagatagaaatactgaacaggaagaaggtggagaagccgttcacgaggtcgaagtggtaattaagcataacagattcacaaaagaaacgtatgattttgatattgcggtgcttcggttaaagactccaattactttccgaatgaatgtcgcaccagcatgcctgccggaaagggattgggccgagagcactctcatgacccaaaaaactggaatcgtgtcaggcttcggaagaacacacgaaaaaggacgacaatcgactcggttgaaaatgcttgaggtgccttatgttgatcgcaactcctgcaagctgagttcctcgttcattataactcagaacatgttctgtgccgggtatgatactaaacaagaagatgcctgtcaaggagattcagggggaccacatgtgacgcggtttaaagatacctatttcgttacgggaatagtttcatggggagaaggctgcgcaagaaagggaaaatacggaatttacactaaagtgacagctttcttgaaatggatcgataggtcaatgaagacgcgaggtttgccgaaagctaaaagtcatgcaccagaagtaattacctcttctccgttgaaa

SEQ ID NO: 9363 - DNA, 1464 bp, Artificial Sequence
  Description of Artificial Sequence: Synthetic coding sequence
atggggaggccactgcatctcgtgctgctgtccgcctctctagccggattactgctcctaggagaatctctctttatccggcgagaacaggcaaataacatactcgctcgggtcactcgcgctaattctttcctcgaggaaatgaaaaaagggcacctcgaaagggaatgtatggaggaaacttgctcttatgaagaagcaagagaagtgttcgaagattccgataaaacaaacgaattctggaataagtataaagatggggatcagtgtgagacatcaccctgtcagaaccaggggaaatgtaaagatgggttaggagaatacacttgtacatgcctcgagggatttgagggaaaaaattgtgaactctttacacgcaagctttgttcactagataatggagattgcgaccaattttgtcatgaagagcagaactctgtcgtttgtagttgtgctaggggatacacattagccgataacggaaaggcctgtattccgacaggaccttatccttgcggaaaacagacactcgagcggaggaaaagatctgtggcacaggccactagttcaagtggagaagcaccagattccattacttggaaaccttacgatgcggcagatctggatcccactgaaaatccatttgatttgctagacttcaaccagactcagcccgaaagaggggataataatctcacacgaattgtgggggggcaggaatgcaaagatggagaatgcccctggcaggcacttctcatcaacgaagaaaacgaaggattctgcgggggaacaatcctcagtgaattctatatcctcacagccgctcattgcctctatcaggccaaacgctttaaagtcagggtgggagatcggaacactgaacaggaagagggaggagaggccgtccacgaagtagaagttgtaataaaacacaatagatttacaaaagaaacatatgattttgatatcgctgtgcttcggcttaaaactcctataacatttaggatgaatgtcgctcctgcttgcttgccagagcgggattgggccgaatcaacacttatgactcagaaaacaggaattgtctccggatttggaagaacacatgagaaagggagacagtcgactcggcttaaaatgctggaagtgccctatgtcgatcggaattcatgtaaactgtcgtcgtcatttattataactcagaacatgttctgtgccgggtatgatacaaagcaggaagatgcttgccagggagattccggagggcctcacgtcactcgctttaaagatacatatttcgtgactgggattgtgagttggggggaagggtgtgcccgtaaaggaaaatatgggatatatacaaaagtcacagccttcctgaaatggattgatcgatccatgaaaactcgcgggctgccaaaagcaaaatcacacgctcccgaggtgataacatcgtcccccctgaaa

SEQ ID NO: 9364 - DNA, 1464 bp, Artificial Sequence
  Description of Artificial Sequence: Synthetic coding sequence
atgggccgcccactgcatctagtcctgctgtccgcatccttggccggtctgctgctactaggagagagcctgttcattagacgtgagcaggctaataatattttagctcgagtgacgagggctaactcctttctggaggagatgaagaagggccacctggaacgtgagtgcatggaggaaacctgttcgtatgaagaagctagagaggttttcgaggatagcgataagaccaatgagttttggaacaaatataaggatggggatcagtgcgagacctccccttgccagaatcagggcaagtgcaaagacgggcttggtgaatacacctgcacatgcttggaggggtttgagggcaaaaactgcgagttgttcacgaggaagctctgttccttagataatggggattgcgatcagttttgtcatgaagaacaaaatagcgtagtttgctcgtgcgcccgtggctacacgttagccgataacggcaaggcctgcattccaaccggcccatatccttgcggtaaacaaaccctagagcggaggaagcgttcagtggctcaggccacttcgagcagcggcgaggcacccgatagtatcacctggaagccgtacgacgctgcagacctggatccgaccgagaatccattcgatctgctggatttcaatcaaacgcagcctgagcgcggagataataatctgacccgcattgtcggaggacaagagtgtaaggacggcgagtgtccgtggcaggctcttctcatcaatgaggagaacgaaggattctgcggcggtacgattctaagtgagttttacatcctcacggccgcgcattgcctgtaccaggccaagcgctttaaggtgcgcgttggagaccggaacacggaacaggaggaagggggcgaggctgtgcacgaagtcgaggttgtcattaaacacaatcggtttacgaaggagacatacgattttgatattgctgtgctgcgcctcaagacacccatcaccttccgtatgaatgttgccccagcgtgcttacctgagcgggactgggccgaatctaccctcatgacccagaagaccggaattgtgtctggtttcggcagaactcacgagaaaggccgccagtcgacccgtctgaagatgttggaggtcccatatgtggaccgcaactcctgcaaactgtcaagttccttcatcattacccagaatatgttttgcgcgggatacgacacgaagcaagaagacgcatgccaaggcgactccggagggccgcacgtcacaagatttaaggatacgtatttcgtgaccgggatcgtcagctggggcgaaggatgcgcacggaaggggaagtacggcatttatacaaaagtgacggccttcctgaagtggattgatcgttccatgaaaactcgaggactgcccaaggcgaagagtcatgccccggaggtaattacatcctccccccttaag

SEQ ID NO: 9365 - DNA, 1464 bp, Artificial Sequence
  Description of Artificial Sequence: Synthetic coding sequence
atggggcgtcccctccacctcgtgctgttgtctgcaagtctagccggactcctcttgctgggcgagtctctgtttattcgcagagaacaggcgaacaacatattggcaagagtgactcgcgccaattcatttttagaagaaatgaagaaaggccatttggagcgagagtgtatggaagagacttgcagttatgaggaggcccgggaagtcttcgaagattccgacaaaacaaatgagttctggaataagtataaggatggggaccaatgtgagacctccccctgccaaaatcagggcaagtgtaaagatggcctgggagaatatacctgtacgtgtctcgaaggttttgaagggaagaactgtgagctgttcacccgaaagctgtgctcgctcgacaatggcgattgcgatcaattctgccacgaagaacagaactccgtggtctgcagctgtgccaggggctacacccttgccgataacgggaaggcgtgcattcccacaggaccctacccttgtggcaaacagaccctcgagcgccgaaagcgcagcgtggctcaggcgacttcctccagtggggaagcccccgatagtattacttggaagccttatgatgctgcagaccttgatcccaccgagaatccgttcgatctgctggactttaatcaaacccagccagagaggggcgataacaacctgactcggatcgtaggaggccaagaatgtaaggatggcgaatgtccatggcaggccttgctgattaatgaagagaatgaaggcttctgcggaggcacaatcctgtctgaattttatatcctcacagccgcgcattgcctctaccaggccaagcggttcaaagtgcgagtgggggatcggaacacagagcaggaagagggaggggaagcagtgcacgaagtggaagtggtgattaagcacaatcgatttactaaggaaacgtatgactttgatattgccgtccttcgactgaagacaccaatcacttttaggatgaacgtcgcacctgcatgcctcccggagagagattgggccgagtcaactttgatgacccagaagactgggatcgtgagtggcttcggtcggacacacgagaaaggccgccagagcactagattgaagatgctggaggtcccttatgtggaccgaaattcctgtaagctgtcgtcctcattcatcattacccagaatatgttttgtgccggatatgataccaaacaggaagacgcttgtcaaggcgactccggggggccccacgtgacgcgatttaaagacacctactttgtaaccggcattgtgtcttggggtgaagggtgtgcgcgtaaggggaaatatggcatctacaccaaggtgaccgcctttctcaagtggatcgacagatcaatgaaaacccgggggcttccaaaagccaagtcccacgctcctgaagtcataacttcttccccgctcaag

SEQ ID NO: 9366 - DNA, 1464 bp, Artificial Sequence
  Description of Artificial Sequence: Synthetic coding sequence
atgggaaggcctctccacctggtgctgctgtctgcctccctcgcaggactactcttgctgggcgagtcactgttcattcgccgcgaacaagctaacaacatcctggctcgtgttacgcgggctaacagcttcctggaggagatgaagaaaggtcatctggagcgcgaatgcatggaggagacctgctcttatgaggaggctagggaggtgttcgaagatagcgacaagactaacgagttttggaacaagtacaaggatggggatcaatgcgaaacttcgccgtgtcaaaatcagggcaagtgcaaggatgggttgggtgagtacacatgcacctgtttagagggtttcgagggaaaaaattgtgagttgttcactaggaaactctgcagtttggataatggtgattgcgaccaattctgtcacgaggagcagaatagtgtcgtgtgcagctgcgctaggggttacaccctggcagacaacgggaaagcttgtattccaacaggcccctatccgtgcggaaagcagactcttgagaggagaaaacgcagtgttgcgcaggctacctcttccagcggcgaggcccccgacagtattacttggaaaccctatgatgccgctgatcttgatccgacagaaaacccgttcgatctgctggatttcaaccagactcagccggagcgtggcgataataacctcactagaatcgtgggtggccaggagtgtaaagacggcgagtgcccctggcaggcactgttaattaacgaggagaacgagggattctgcggcggcacaattctctccgagttctatattttaaccgccgcccattgcctgtaccaggccaagcgatttaaagtgcgggtgggcgaccggaatactgaacaggaggaaggcggcgaagccgtacatgaagtggaggtggtgataaagcacaataggtttaccaaagaaacctacgatttcgacatcgcagtgttgaggctgaaaacccctatcaccttccgcatgaacgttgcccctgcatgtttgcccgaacgtgactgggctgagtcaacactgatgacacaaaagacgggcatcgtctcaggcttcgggagaacgcacgagaagggcagacaaagtaccagacttaagatgctggaggtgccctacgttgacaggaactcctgcaaactgtccagcagcttcatcatcacacagaatatgttttgtgccggttacgacacaaagcaggaggacgcttgccaaggcgattccggcggaccccacgttacccggtttaaggacacttacttcgtgacgggcattgtgtcgtggggggaaggatgtgcccgcaagggcaagtatggtatatacacgaaggtgaccgcctttctcaaatggatcgatagatccatgaagactagagggctgcccaaagccaagagtcacgcacccgaggtaatcacttctagtccactgaaa

SEQ ID NO: 9367 - DNA, 1464 bp, Artificial Sequence; identical to SEQ ID NO: 9335
  Description of Artificial Sequence: Synthetic coding sequence

SEQ ID NO: 9368 - DNA, 1464 bp, Artificial Sequence
  Description of Artificial Sequence: Synthetic coding sequence
atgggccgcccattgcatctggtacttctgagtgccagcttagcaggactgcttttgttgggcgaaagcctattcatccggcgggaacaggcaaacaatatcctggcgagggtaacgcgcgccaattcctttttggaggagatgaaaaaaggccacttggaaagggagtgtatggaagaaacatgtagctacgaggaagctcgcgaggtctttgaggacagtgacaagaccaacgaattctggaataagtataaggatggggaccagtgcgagactagtccttgtcagaatcagggcaagtgtaaggacgggctcggggagtatacatgtacatgcctcgaagggtttgaaggaaaaaactgcgagctgttcacaagaaaactgtgctccctggacaatggagattgcgatcagttctgccacgaagaacagaactccgtcgtgtgttcctgcgcccgggggtatacccttgcagacaacggaaaggcttgcatccctaccggtccttatccctgtggtaagcagactctggagagaagaaaaaggtccgtcgcacaggctacctcttcatcaggcgaagcccccgattcgatcacatggaaaccatatgacgccgcagatcttgaccctaccgagaatcccttcgatttgttagatttcaatcagactcagccggagagaggtgacaacaatctgaccagaattgtgggaggccaggaatgtaaggatggcgaatgcccatggcaggccctgctcatcaatgaggagaatgaagggttctgcggcggcactatactgtccgagttctacattctgaccgccgcccactgtctgtaccaagctaaacggtttaaggtcagggttggtgaccgtaatacggaacaggaggagggcggggaggccgtacatgaggtggaagtcgtaattaagcataatcggttcaccaaagagacttacgatttcgatatagccgtgctgcgtttgaagacccccattacctttaggatgaacgttgcccccgcctgcctgcccgaaagagattgggcagaaagtacactgatgacccagaagaccggcatcgtctcaggattcggccgcacacatgagaaagggcgccagagtactcgcctgaaaatgctcgaggtaccgtacgtggaccgaaactcttgtaagctaagctcctctttcatcataacacagaatatgttctgcgccgggtacgatactaagcaggaggacgcctgccagggtgactctggggggcctcacgtaaccaggttcaaagatacatatttcgtaaccggaattgttagctggggggaagggtgtgcgagaaagggaaagtacggaatctacaccaaggtgacagctttcctgaaatggattgatcgaagtatgaagactcggggtctgcccaaggctaaatcacacgcacctgaggtgattacgtcttcaccactgaag

SEQ ID NO: 9369 - DNA, 1464 bp, Artificial Sequence
  Description of Artificial Sequence: Synthetic coding sequence
atgggcagacctttgcatctcgtgttgctttccgccagtttagccggtcttctgttgttaggcgagagcctcttcattcgcagggagcaggcgaataacatcctggcaagagtaactagggccaattcttttctggaggagatgaaaaaggggcacctggagagagagtgcatggaggagacttgcagttacgaggaggcccgcgaggttttcgaggatagtgataagactaacgaattttggaacaaatataaggacggtgaccaatgcgagacgtctccgtgccagaaccagggaaagtgtaaagacggtctgggtgaatatacatgtacctgcctggagggctttgaggggaaaaactgcgagctgttcacacgcaaactttgtagcctggacaatggagattgcgatcagttctgccacgaagaacagaatagtgttgtgtgctcatgtgccagagggtacacccttgcggataatggaaaggcttgtatcccaactggcccctacccgtgcgggaaacagacgctggagaggagaaaaaggagtgttgcccaggctacaagcagcagcggggaggcccctgatagtatcacctggaagccgtatgatgccgctgatctcgacccaacagagaaccccttcgacttacttgacttcaatcagacacagcctgagcgcggggacaataaccttaccaggatcgtcggggggcaagagtgcaaagatggagagtgcccatggcaggctctgttaatcaacgaggagaacgaaggtttctgtggagggaccatcctgagtgagttctatatcctaacagccgcgcactgtctctaccaggctaaacgctttaaggtcagggtgggggatagaaatactgagcaggaagagggtggagaagctgtccacgaggtggaggtggtcatcaaacataatagatttacaaaggagacttacgactttgacatcgcagttctgcgcttgaagacccccatcacatttcgtatgaatgtggccccggcatgtctgcccgaaagagactgggccgaaagtacccttatgacgcagaagacagggattgtgtcaggctttggacgaacgcacgagaagggccgccaaagcactagactaaagatgctggaagttccatacgtagaccgaaatagttgtaaattgtctagttctttcatcatcacacagaacatgttctgtgctgggtacgacacaaagcaggaggacgcctgccaaggggattcaggtggacctcacgtcactcgcttcaaagacacgtacttcgttaccggcattgtcagctggggggaggggtgtgcccgcaaggggaaatacggaatctacacaaaggttaccgcctttctcaagtggatcgatagatctatgaaaactcggggactacccaaggccaaatctcacgctcctgaggtgatcacgagtagcccccttaaa

SEQ ID NO: 9370 - DNA, 1464 bp, Artificial Sequence
  Description of Artificial Sequence: Synthetic coding sequence
atgggaagacctttacatttagttttattatctgcttcactagcaggattacttttacttggagaatctttatttattagaagagaacaagctaataatatacttgctagagtaactagagctaatagttttcttgaagaaatgaaaaaaggacatcttgaacgagaatgtatggaggaaacttgtagttatgaagaagcaagagaagttttcgaagattctgataaaactaatgaattctggaataaatataaagatggagatcaatgtgagacttctccatgtcaaaatcaaggaaaatgcaaagatggtcttggagaatatacatgtacttgtttagaaggttttgaaggaaaaaattgtgaattattcacacgaaaattatgttctttagataatggagattgtgaccaattttgtcatgaagaacaaaattcagtggtttgtagttgtgctagaggttatactttagcagataatggtaaggcatgtattcctacagggccatatccatgtggaaaacaaaccttagaaagaagaaaaagatctgttgcacaagctacaagttcgagtggagaagcaccagattctattacatggaaaccttatgacgctgctgatcttgatccaacagaaaatccatttgatcttcttgattttaatcaaactcaaccagaaaggggagataataatttaactaggatagttggaggacaagaatgtaaagatggtgagtgtccatggcaagcattattgattaatgaagaaaatgagggtttctgtggaggaacaattttaagtgaattttatattcttacggctgcacattgtctttatcaagctaagagatttaaagttagagtaggtgatagaaatacagaacaagaggaaggtggagaggctgttcatgaagtcgaagttgttattaaacacaatagatttacaaaagaaacatatgattttgacattgcagtcttaagattaaaaactccaattactttcagaatgaatgttgctccagcttgtcttccagaaagagactgggctgaaagcactttaatgacacaaaagactggaattgtatctggatttggaagaactcatgaaaaaggaagacaaagcacacgtttaaaaatgttggaagttccttatgttgatagaaattcatgtaaactttctagtagttttattattactcaaaacatgttttgtgcaggatatgatacaaaacaagaagatgcatgtcaaggagattcaggaggaccacatgtcactagatttaaagatacatattttgttacaggaattgtttcatggggagaaggatgtgcaagaaagggtaagtatggtatttatacaaaagttacagcatttcttaaatggatagatagatctatgaaaactcgtggtttaccaaaagctaaatcacatgctccagaagttattacttcaagtccacttaaa

SEQ ID NO: 9371 - DNA, 1464 bp, Artificial Sequence
  Description of Artificial Sequence: Synthetic coding sequence
atgggtcggccactgcatctggttctgttgtccgcttccctcgcagggctgctgctccttggtgagtcactgttcattaggcgcgaacaggctaacaacatcctcgcccgggtaactagagcaaactcctttctggaagagatgaagaagggccacctggagagggaatgtatggaagagacttgtagctacgaggaagccagagaggtttttgaagactccgataaaaccaacgagttttggaacaaatataaggacggtgaccagtgcgaaacctccccttgccagaatcaaggaaagtgtaaggacggtctgggcgaatacacctgcacatgtttggaaggattcgagggtaagaattgcgagctctttacaaggaaactgtgctcattggacaatggggactgtgatcagttttgtcatgaggagcagaacagcgtggtgtgctcctgcgccagaggctacaccctggccgataatgggaaggcctgtatcccgaccggcccttatccctgcggtaaacagacacttgagcgacggaaacggtctgtggctcaggctacctcctccagtggagaggcccctgattctataacctggaagccttatgatgctgctgatctcgaccctacagaaaatccttttgatttgctggacttcaatcagacacaacccgagcgaggagacaataacctcactcggatcgtgggcggccaagaatgtaaagatggggagtgtccctggcaagcgctcctgataaacgaagagaacgaaggattctgtggaggaactatactgtccgaattctacattctcacggcagcgcactgcttgtatcaggccaaacggttcaaggtgagggtgggggatagaaatactgaacaggaggaaggcggcgaggccgtacacgaggtcgaagtcgtaatcaaacacaacagatttacgaaagagacctatgacttcgatatcgccgtgctgcggctcaaaaccccaataactttcaggatgaacgttgcccccgcctgcctgccagaaagagattgggccgagagtactttgatgacccaaaagacgggcattgtatccgggttcggcagaacacatgagaagggcaggcagagtacacgcctgaagatgctcgaagtgccatacgtagaccggaacagctgtaagctgagttcctcttttatcattacacagaacatgttctgcgctgggtacgatacaaagcaggaggacgcctgccagggcgactctggagggccccatgtaacccggttcaaagatacatactttgtgacggggatcgttagctggggtgagggctgcgcccgcaaaggcaaatacgggatttatacaaaagtgacagcattcctcaagtggatcgacaggtcaatgaaaactcgcggcctgcccaaggcaaagtcacatgctccggaagtcattacgagctctcctctgaaa

SEQ ID NO: 9372 - DNA, 1464 bp, Artificial Sequence
  Description of Artificial Sequence: Synthetic coding sequence
atgggaagacctctgcaccttgtactgctttccgccagcctggccggcctcctgctcttgggagagtcattgttcatcagacgggaacaggcaaacaacatcttagcccgcgtcacaagagctaattctttccttgaggagatgaaaaaggggcatctggaacgggaatgcatggaggagacttgctcatacgaagaagcacgcgaagtctttgaggacagcgataagaccaacgagttttggaataaatataaagatggagatcaatgcgagacatcaccatgccagaaccaggggaagtgtaaggatggcttaggggagtatacctgcacctgccttgagggctttgaagggaaaaactgcgagttgtttacgcgcaagctatgcagcctggacaacggagactgcgaccagttctgccacgaggagcaaaattctgtggtgtgctcctgtgcccgggggtacaccctggcagataatggcaaagcctgtatcccaaccgggccatatccttgtgggaaacagacactggaaaggcggaagcgtagtgtggcccaggccacgagctccagcggcgaggcacccgattcgattacctggaagccttatgacgccgcagacctggaccccaccgagaaccccttcgatctgctggatttcaatcagactcaacccgagaggggcgacaacaacctgacccggatagtgggtgggcaggagtgcaaagacggcgagtgcccctggcaggcacttttgatcaatgaggagaacgagggtttttgtgggggaactatcttgtccgagttctacatacttacagctgcccattgcttgtatcaggcaaagcggtttaaggttcgggtaggagataggaatactgagcaggaggagggtggcgaggcagtgcacgaggtagaagtggtgattaaacacaaccgcttcaccaaagagacgtacgacttcgacatcgcggtcttgcgtctgaaaaccccaattacttttagaatgaacgtggcacctgcttgcctcccagagagagactgggcagagagcacattaatgacccagaagactggcatcgtgagcgggttcggccggactcatgagaaagggaggcagtcgacccgattgaagatgctggaggtgccttatgtggatagaaacagttgtaagctgagcagttcttttattattacccagaacatgttctgtgctgggtacgatactaaacaagaggacgcatgccagggcgacagcggtggcccacacgtgacccgattcaaggacacctacttcgttaccgggattgtgagctggggtgaagggtgtgcgagaaaggggaaatacgggatttatactaaggtcaccgcattcctaaagtggattgaccgcagtatgaaaactagggggcttccaaaagccaaatcacatgcaccagaggtgataacttcctccccactgaag

SEQ ID NO: 9373 - DNA, 1464 bp, Artificial Sequence
  Description of Artificial Sequence: Synthetic coding sequence
atgggtaggcctctacatctggtgctccttagcgcaagcttagctgggctgttgctgctgggtgaatcattgtttattcgtcgagagcaggccaacaatatccttgcgcgggtgactagggccaattcatttctggaggagatgaagaaagggcatttggaaagagaatgtatggaggagacctgtagctacgaggaggctagagaagtgtttgaagattcagataagacaaacgagttttggaataagtacaaagatggagaccagtgtgagacgtcaccctgccagaaccagggcaaatgtaaagatgggctgggagaatacacctgcacctgcttggagggatttgagggcaaaaactgtgagctgttcaccagaaagctgtgttccctggacaacggggactgcgatcagttctgtcacgaagagcagaattcggttgtgtgctcatgcgcaagggggtatacgttagcggacaatggaaaggcctgcattcccacgggtccctatccctgcggcaagcagacccttgaacgaagaaaacgatccgttgcccaggccaccagtagttctggagaagcccctgactccattacctggaaaccctacgacgccgcggacttggacccaaccgagaacccttttgacttgttggatttcaaccagactcaacccgagcgaggagataacaacctgacccgcatcgtcgggggtcaggagtgtaaggacggggagtgcccttggcaggccctgttaataaacgaagagaatgaaggtttctgcggagggactattttgagtgagttctacattctcacagccgcccactgcctttatcaggccaagcgattcaaggtccgagtgggggaccgaaatactgagcaagaggaggggggagaagccgttcacgaggttgaagtggtgatcaaacacaacagatttaccaaagaaacttatgatttcgatattgccgtgttgaggctgaagacccctattactttccgaatgaacgtggcaccagcttgcctaccggagcgtgactgggccgagtccacattgatgactcagaagacgggaattgtgtctggattcggaaggactcacgagaaaggccgccagagcacgcggttgaaaatgttggaggtgccttacgtggatagaaattcctgtaaactatcttcctcattcatcatcacacagaacatgttctgcgccggctatgacactaaacaggaggatgcatgtcaaggagatagcggcgggccccacgttactaggttcaaagatacttacttcgtaaccggcattgtttcatggggagaaggatgcgctaggaaggggaagtacgggatttacactaaagtgaccgcatttctgaaatggattgatcgatccatgaagactagggggctgcctaaagcgaaatctcatgctccagaggtgatcactagttcccccctgaaa

SEQ ID NO: 9374 - DNA, 1464 bp, Artificial Sequence
  Description of Artificial Sequence: Synthetic coding sequence
atgggtcggcccctccatctggttctgctgtctgcatcactcgccggcctgctgctgctgggcgaatccctctttattaggagggaacaagctaacaatatactggctcgggtgacgagggccaattcattcctggaggagatgaagaaaggtcacctcgagagggaatgcatggaagagacatgtagttatgaggaagcaagagaggtcttcgaggactctgataagaccaatgagttttggaataaatataaggacggcgaccagtgtgagacgagcccctgccagaaccagggaaaatgcaaggacggactgggtgagtacacttgcacctgcctggagggatttgaaggcaagaactgcgagctgttcactaggaaactgtgttccctggataacggtgattgtgatcagttctgccacgaagagcagaacagcgtggtgtgttcctgtgcccggggttacaccctggcggacaatggcaaagcttgcataccaaccggaccgtacccctgcggtaaacagactcttgaacggcgaaagaggtcagtcgcgcaggcaacctcctcaagcggagaggctcctgacagtatcacatggaaaccctacgacgcagcagaccttgatccaactgagaacccatttgacctgcttgatttcaaccagacacagcctgagaggggagataacaatctgacaaggatcgtaggcgggcaggaatgcaaagacggcgaatgtccttggcaagcactgttgatcaatgaggaaaacgaggggttttgtgggggtactatactcagcgagttttacattctgaccgccgcacattgcctgtatcaggcaaagcgctttaaggtcagagtgggcgaccgcaacactgagcaggaagagggtggagaggccgtccacgaagtcgaagtagtgatcaagcataaccgcttcactaaagaaacctacgactttgatatcgctgtcctgagactgaaaacccctattactttccgcatgaatgttgctcccgcatgtctcccagagcgcgattgggcagaatctacgttgatgacccagaagaccggaatcgtctcaggcttcggccggacacacgagaaaggaaggcagtcaacccggctgaagatgctcgaggtaccctacgtggatcgcaactcatgcaagttgtccagttcctttattatcactcagaatatgttctgtgccggatacgacaccaagcaggaggacgcttgtcagggagattcaggcggtccacacgtgacccggtttaaggacacctacttcgtgacaggaattgtgagctggggcgaaggttgtgcccggaaggggaaatacggcatatacaccaaagtgaccgctttcctgaaatggatagacaggtccatgaagacccgaggcctgcccaaagcaaaaagtcacgccccagaagtgatcacatcttcccccctcaaa

SEQ ID NO: 9375 - DNA, 1464 bp, Artificial Sequence
  Description of Artificial Sequence: Synthetic coding sequence
atgggccggccgctacatttggtcctgctatcggctagtctcgctggactacttctccttggcgagtccctattcatccggcgcgagcaagctaacaatattctcgctagagtgacgcgagccaacagctttttggaggagatgaagaagggccaccttgagagggagtgtatggaagagacgtgctcctacgaggaggcgagagaagtcttcgaggattcggataagaccaacgagttctggaataagtataaggacggtgatcagtgtgaaacgtcaccgtgtcaaaaccagggcaaatgcaaggacggtttgggggagtacacttgtacgtgtctcgagggtttcgaagggaaaaactgcgagctattcacgcgtaagctctgctcgcttgataacggcgattgtgaccagttctgccacgaagaacaaaattctgtggtgtgctcgtgtgcccgcggttacacacttgctgacaatggcaaggcgtgtattcctacggggccctatccttgcggaaagcagacactggagcggaggaagagatcagtcgcacaagctacgtctagttccggggaagcgccagactctatcacttggaagccatatgacgcagccgatttggatccaacggagaacccattcgaccttttagatttcaaccagacccagccagaaagaggcgacaataaccttacgagaatcgtcgggggacaggagtgtaaggatggtgaatgtccatggcaagcattgcttatcaacgaggagaatgaaggattctgtggcgggaccatcttatccgagttttacatactaaccgccgctcactgcttataccaggctaagcgctttaaggtcagggtgggtgacaggaatacagaacaggaagaaggtggcgaggctgtgcacgaagtcgaagtcgttatcaagcacaaccgtttcacaaaggagacatacgatttcgatatcgccgtgctccgacttaaaacccctatcacattcagaatgaatgtcgccccagcctgcctccctgaacgcgactgggctgagtcaactctgatgactcaaaagacaggtatcgtaagcgggtttggtcgaacacacgagaagggacgtcaatcaactagactgaaaatgttggaggtgccatatgtggaccgcaactcctgcaagctgagttcctcgtttatcattactcaaaatatgttctgcgcgggatacgacacgaagcaagaggatgcttgccagggtgactccggaggaccgcacgtcacgcggttcaaggacacttacttcgtaactggtatcgtatcttggggcgaaggctgcgcacgtaaggggaagtatggtatctatactaaggtcacggctttccttaaatggatcgaccggtcaatgaagaccagaggtctaccgaaagccaaatcacacgcgccagaagtcatcacttcgtccccattgaag

SEQ ID NO: 9376 - DNA, 1464 bp, Artificial Sequence
  Description of Artificial Sequence: Synthetic coding sequence
atgggtaggccacttcatctggtgttgctgtccgcgtctttagccgggctgctcctgttaggggaatctctcttcatcagacgcgagcaggccaacaatatccttgcccgagtaacacgggccaactcatttcttgaggagatgaaaaagggtcacctggaaagagagtgcatggaagagacctgctcctacgaggaagctcgagaggtgttcgaagatagtgataagaccaatgagttttggaacaagtataaggacggagatcaatgcgaaaccagcccttgtcagaatcaggggaagtgtaaggatggcctgggtgagtatacgtgcacatgtctggaaggctttgagggcaaaaattgtgagctgttcacccgaaaactgtgctctctggacaatggggactgcgatcagttctgtcacgaagaacagaatagtgtggtttgcagctgtgctcgaggatacacacttgccgacaatggcaaggcctgtatccctactggtccttacccttgtggcaaacaaacgctggagcggcgcaagagatccgtggcccaggcaacttcctcgagcggcgaggcccccgatagtatcacctggaaaccttatgatgctgcagacctggaccccactgaaaacccatttgatcttttggatttcaaccagacacagcccgaaagaggtgataataatctcaccagaatcgtgggaggtcaggagtgcaaagatggggaatgcccttggcaggccttactcattaacgaagagaacgagggattttgcggaggaaccatcctgtcagaattctatattctgacagccgctcactgcctgtatcaggcaaaacgtttcaaggtcagggtaggagaccggaacacagagcaggaggagggaggcgaggccgtacatgaagtggaagtcgtcatcaagcataaccgcttcacaaaagaaacatatgattttgacatcgccgttcttcggctcaagacaccgatcacgtttcggatgaacgtggcccctgcttgtctccccgaaagagactgggccgagtcgaccctcatgacacagaagacaggcatagtgtctggttttggtcggactcacgagaaaggacgccaatctacacgacttaagatgctcgaggttccttacgtggaccggaatagttgtaagttgtcctcctcttttattattactcagaacatgttttgtgccgggtacgatacaaaacaggaggacgcgtgccagggcgattccggagggcctcacgtcacaagattcaaagacacctatttcgtgaccggtatcgtcagctggggcgagggttgtgcccgaaagggaaaatatggaatatatacgaaggtgacggctttcctgaagtggatcgatcgttcaatgaagacaaggggcctccctaaagcgaagagccacgcacctgaggtaattacctcaagcccccttaag

SEQ ID NO: 9377 - DNA, 1464 bp, Artificial Sequence
  Description of Artificial Sequence: Synthetic coding sequence
atgggtaggcccctgcacctagtcctcctctcagcaagcctggctggccttctcttgcttggcgagagcctctttatcagacgggagcaggcaaataacatcttggcgagagtgacccgggccaacagctttctcgaggagatgaagaaggggcacctcgaacgggagtgcatggaagagacatgcagctacgaagaagcccgagaagtgtttgaagacagtgataaaaccaatgagttttggaataaatacaaggatggtgaccagtgtgagaccagtccctgccagaaccagggaaaatgcaaagacggcctgggagagtatacctgcacatgtttggaaggcttcgagggaaagaattgtgagctgtttaccaggaaactgtgctccctcgataacggagattgcgatcagttctgccacgaggaacaaaatagcgtggtgtgcagctgcgcccggggatacaccctggccgataacgggaaggcctgcatccctaccgggccttacccttgtggcaaacagacgctggaaaggcggaagcgctcagtggcgcaggccacatcttcaagcggggaggcgcccgatagcattacttggaaaccctacgatgcggcggatcttgaccccacagagaatccatttgatcttctcgacttcaatcaaacgcagcccgaacggggcgataacaatctgaccagaatagtgggaggccaggagtgtaaggacggcgaatgcccctggcaggctctcctgattaacgaagagaatgaggggttctgtggcgggacgatactgagcgaattttacattctaacagctgctcattgtctgtatcaggctaaacgcttcaaggtgcgggttggggatcgaaacaccgagcaggaggaggggggcgaggccgttcacgaagtggaggtcgtcatcaaacataaccggttcaccaaggaaacgtatgactttgacatcgccgtcctaagattaaagacgcccataacattccgcatgaacgtcgcacctgcatgcttgcccgagagggattgggctgaatccacactgatgacacagaaaaccgggatcgtctctggcttcgggcggactcatgaaaaagggagacagtctactcgcctgaaaatgctggaagtgccttatgtcgatcgcaatagctgcaagctgagttcttcttttattattactcagaacatgttctgcgccggatacgacactaaacaggaggatgcatgccagggggactcaggcggcccccatgtgacccgattcaaagatacctattttgtcacagggatcgtcagctggggagaaggatgtgcacggaaagggaaatacgggatttatacaaaggtgactgcattcctcaaatggatagatagatccatgaagactcgcggcctccctaaagccaaaagccatgcccctgaggtaattacgtctagcccattaaag

SEQ ID NO: 9378 - DNA, 1464 bp, Artificial Sequence
  Description of Artificial Sequence: Synthetic coding sequence
atgggtcgaccattgcaccttgttcttctatcggcatcgctagccggattattactgctgggagaaagtctgttcataaggagagagcaggccaacaatatcctggccagggttactagggcaaactctttcctggaagaaatgaagaagggccatctggaacgcgaatgcatggaggaaacctgctcctatgaggaagcccgtgaagtctttgaagactcagataaaactaacgagttttggaacaagtacaaggatggcgaccagtgcgagacatcgccttgtcagaaccaaggcaagtgcaaggacgggttgggtgagtatacttgcacttgcctggagggcttcgaaggaaaaaactgcgaattgtttacccgcaaactatgcagtctcgacaacggagactgcgatcagttctgtcatgaagagcaaaatagcgtggtatgctcctgcgcccgaggatacacattggctgacaacggaaaagcatgcatccctaccggaccatatccatgtgggaaacagaccctggagcggcggaagaggagcgtggctcaggccacaagttctagtggcgaggctcctgactcaattacctggaagccctacgacgcagcggacctcgatcccacagaaaacccatttgatttactggatttcaatcagactcagcccgagaggggtgataataatctgacacggatcgtcggcggacaggagtgtaaggacggtgaatgtccatggcaggccctgctgatcaacgaagagaatgagggcttctgtgggggtaccattctgtcggagttttacattctgaccgccgctcattgtctgtaccaagccaagcggtttaaggtccgcgtgggcgatagaaacactgagcaggaggaaggcggcgaagcggtacacgaggtcgaagttgtgattaaacataatcggttcacaaaggaaacttatgattttgacatagccgtgctccgcctcaagacaccaatcaccttcagaatgaacgtcgctcccgcttgtctgcctgaaagagattgggcggagagcacactaatgacacagaaaacaggcatagtgtccggcttcggccgcacacacgaaaaaggccgtcaaagtacacgactgaagatgcttgaggtcccatacgtcgacagaaattcctgcaaactgtcttcatccttcattataacacaaaacatgttttgtgcgggatacgatacgaagcaggaagacgcctgccagggggacagcggcggacctcatgttacccggtttaaggatacttactttgtaaccgggattgtctcctggggggaaggttgcgcaaggaagggcaaatacgggatatacactaaggtcacggccttccttaaatggatcgaccgatctatgaagacccgcggtctgccgaaggccaaatcccacgctccagaggtcattacgagttcgcctctcaag

SEQ ID NO: 9379 - DNA, 1464 bp, Artificial Sequence
  Description of Artificial Sequence: Synthetic coding sequence
atggggagacctctacatttggtgctgctgtcagcctccctggctgggttgctcctgctaggggagagcttgttcattaggcgcgaacaggcaaataacattctggccagagtcacccgcgctaactcctttctcgaggaaatgaagaaaggccatctggaacgggagtgtatggaagaaacctgcagctacgaggaagcacgggaagtatttgaggatagtgacaagaccaacgagttttggaacaaatacaaggatggtgaccagtgcgaaacatcaccctgccagaaccagggcaaatgtaaagatggcctgggagaatatacttgtacctgcttagagggctttgaggggaagaactgcgagttattcactcgtaagctctgcagcctcgataatggcgattgcgatcagttttgccatgaggagcagaactctgtggtgtgcagctgtgccaggggctatacccttgccgacaatggaaaagcctgtattccaacagggccttacccttgcggtaagcagacactggaaaggcgaaaaagaagcgtcgcgcaggctactagttcgagtggtgaggcccctgacagcataacatggaagccttacgatgccgctgacctagatcctacagagaatcctttcgatttgctggatttcaatcaaactcaacccgagaggggcgacaataatctgaccagaattgtgggtggacaggaatgtaaggacggggagtgtccctggcaggcccttttgattaacgaggagaatgaaggattctgcggaggcactattttgtccgagttttacattttgacagctgcccactgtctctatcaagccaagcggttcaaagtccgtgtgggtgaccgaaatacagaacaggaagagggcggggaagccgtacatgaagttgaagtggttatcaaacacaacagattcaccaaggagacgtatgactttgacattgcagttctcagactgaaaacccctattacatttaggatgaacgtggctcccgcatgcctacccgaaagagattgggctgaaagtactttaatgactcaaaagactggcattgtttcaggcttcgggaggacacatgagaaaggccggcagtcaacccggctcaagatgttggaagtcccttatgtcgatcgtaattcgtgcaagttgtcctccagctttataataactcaaaacatgttttgcgccggctacgataccaagcaggaggatgcctgccaaggagactcagggggcccccacgttactcggtttaaggatacttactttgttaccggcatcgtgagctggggcgagggctgcgctcgaaagggcaaatacggcatctatacgaaagtgaccgcatttctgaagtggattgatcggtcaatgaaaactcgcgggctaccaaaagccaagtcgcatgcacccgaggtgatcacatcttccccattgaag

SEQ ID NO: 9380 - DNA, 1464 bp, Artificial Sequence
  Description of Artificial Sequence: Synthetic coding sequence
atggggcggcctctccatctggtgttactctctgcgtctctcgctggactgcttctcttaggcgaaagcctgttcatccgaagggaacaggccaataacatccttgctcgagtgaccagggccaattctttcctcgaggagatgaagaaggggcacctcgaaagggaatgcatggaagagacttgttcttacgaagaggccagagaggtttttgaggacagcgataaaactaacgagttctggaataaatataaagacggggatcaatgtgagacttcaccctgccaaaaccagggaaagtgtaaagatggtctgggcgagtatacgtgtacctgtttggaagggttcgaaggaaaaaattgcgagttgtttacaagaaagctgtgctcactggataacggcgactgcgatcagttctgccacgaggagcagaactcagtggtgtgcagctgcgcacggggctatacccttgccgataatggaaaagcctgcattccaacaggcccatacccctgtggaaagcaaaccctggaacggcgtaaacggtccgtggcccaggcaacaagctctagcggcgaagccccagacagcataacttggaagccctacgatgcggccgatctcgacccaacggagaaccccttcgacctgcttgacttcaatcagactcagcctgaacggggagataataacctgacccgcattgtgggggggcaagagtgcaaggatggggagtgcccctggcaggccctccttattaatgaggagaacgagggcttctgcgggggcacgattctctcagaattctacattctgaccgctgctcattgtctgtaccaggctaaacgtttcaaggttcgggtgggtgaccgaaacaccgaacaggaggagggaggcgaagcagtccatgaagtggaagtggtcattaagcataacagatttaccaaggagacctacgacttcgacatcgctgtgcttcggctcaagaccccaatcacctttaggatgaatgtcgccccggcctgtctgcctgagcgagattgggccgaatctacgctcatgacacagaaaacgggaatcgtctctggctttggccgcacacatgaaaagggaagacagtccaccaggctgaagatgctggaagtgccttacgtagacaggaatagctgcaaactaagcagctcgttcataataacccagaacatgttttgcgcggggtacgacacgaagcaggaagatgcatgccagggtgacagcggaggaccacacgtgactcgattcaaagacacctacttcgtcacaggaattgtgagctggggcgagggctgcgcaaggaaagggaagtacggcatttacaccaaggtaacggcgttcctgaagtggatcgatcgcagcatgaaaacgcgcggcctgccgaaggctaagagccacgcgccggaggttattacttccagcccactgaaa

SEQ ID NO: 9381 - DNA, 1464 bp, Artificial Sequence
  Description of Artificial Sequence: Synthetic coding sequence
atgggacggccacttcatctcgttcttctcagtgcctcactagccgggttattgctcctcggagaatcactctttatcaggagggaacaggcaaacaacatcctggctcgggtgactagagccaactctttcctcgaagagatgaaaaagggacatctagaacgcgaatgtatggaagagacttgttcatatgaagaggcaagggaagtattcgaagatagtgataaaactaatgaattttggaataaatataaagatggagatcagtgtgaaacatcaccctgtcagaatcagggaaaatgcaaggatgggctcggagaatatacatgtacatgccttgaagggttcgaggggaaaaactgtgaactgtttacacggaagctctgttcactcgataacggagactgtgatcagttctgccatgaagagcagaattctgtcgtatgctcatgtgcccgggggtacacactcgccgataacgggaaagcttgcatccccactggaccttacccttgtgggaaacagactcttgaaaggcgcaaaaggagtgtggcacaggccacatctagttcaggggaggccccagattccattacatggaagccctacgatgcagcagatctcgatcccacagagaacccctttgaccttttggatttcaaccagacacaaccggaacgcggggataacaatctgacaagaatagtggggggacaggagtgtaaagatggggagtgtccttggcaggccctgttgattaatgaagaaaatgaaggattctgcggaggaactatcttatccgagttttacatcctcactgcagcgcattgtttgtatcaagctaaacgcttcaaagtccgcgtcggggatagaaatacagaacaggaagagggaggagaagccgtgcatgaagtggaggtggttataaaacataacaggttcactaaagagacttatgattttgacatagccgtgctaagacttaaaactcccatcacattcaggatgaacgtcgcacctgcttgtctgcccgaaagagactgggctgaaagtactctcatgacacaaaaaacaggaatcgttagtgggttcgggagaacacacgagaaagggaggcagagtacaagactcaaaatgctcgaagtgccatatgtggatcggaattcctgtaaactctcatctagttttataatcacgcaaaacatgttctgtgccggatatgatacaaagcaggaagatgcctgccagggggattcagggggaccccacgtaacaagatttaaagacacatattttgtaactgggatagtctcatggggggaaggatgtgctcggaaagggaagtatgggatatatactaaagttacagcttttttgaagtggatcgatcgctctatgaaaactagaggactgcctaaagccaagtctcacgctcccgaagtgataacatcgtcaccacttaaa

SEQ ID NO: 9382 - DNA, 1875 bp, Artificial Sequence
  Description of Artificial Sequence: Synthetic coding sequence
atgatcttcctctaccaagtggtgcacttcatcctgtttacttccgtctcgggcgagtgcgtgacccagctgctgaaggacacctgcttcgaaggaggcgatatcaccactgttttcaccccgtccgccaaatactgccaagtggtctgcacctaccatcctcggtgcctgctgttcacttttacggctgaaagcccgagcgaagatcctacgcgctggtttacctgcgtgctgaaagactccgtcacggagactctcccgcgggttaaccggaccgccgccatctcggggtactcgttcaaacaatgttcgcatcagatctccgcctgcaacaaggatatctacgtggatctggacatgaaaggaatcaattacaacagctccgtggcaaaatcggctcaagaatgccaggaacgctgtaccgatgatgtgcattgtcacttcttcacctacgccacccgccagttcccttcgctcgagcaccggaatatctgtctgcttaagcacacccagaccggcactcctacgcggatcaccaagttggataaggtggtgtctggattttcactgaaatcctgtgccctctccaacctcgcttgtatccgcgacatcttccctaacactgtgttcgcggatagcaacatcgactccgtgatggcccccgacgcattcgtctgcgggcgtatttgtacccatcatcccggctgtctcttcttcaccttcttctcacaagagtggccaaaagaatcgcagcgcaacctgtgccttctcaagacgtccgagtccggactgccgtcaactagaatcaagaaatcaaaagccctctcgggtttctcgctgcagtcgtgccgccactccatcccggtgttctgccactcgagcttttatcatgacactgactttctcggagaagagctggacattgtggctgccaagtcccatgaagcctgtcagaagctctgcaccaatgctgtgcgctgccagtttttcacttacaccccggcgcaggctagctgcaacgaagggaagggaaagtgctatctgaaactgtcctcaaatggatcccccaccaaaatcctgcacggaaggggaggcatcagcggttacacgctgcggctctgcaagatggataacgaatgtactactaagatcaaaccaagaatcgtgggcgggaccgcgtcggtccggggagagtggccttggcaggtgaccctccacacgacgtcgcctactcagcgccatctgtgcggaggctcaatcattggaaatcaatggattctcaccgcggcacattgcttctacggcgtcgagtccccgaaaattctgagagtctactccggcattttgaaccagtcggaaatcaaggaggatactagcttcttcggagtgcaagaaatcatcatccacgaccagtacaaaatggcggagtcaggctacgatattgcccttctgaaattggaaacgaccgtgaattacactgacagccaaagaccgatctgcctgccgtccaagggtgacagaaacgtcatctacaccgactgctgggtcaccgggtgggggtacaggaaactgagagataagatccagaatactctgcaaaaagcaaagatcccgctggtgaccaacgaagaatgtcagaagagatatcggggacacaagatcactcacaaaatgatctgcgccggatatcgcgaaggaggaaaagacgcttgtaaaggagatagcggcggcccattgtcgtgtaagcataatgaggtgtggcaccttgtcggcatcacttcatggggcgaggggtgcgcccaacgcgaaaggccaggtgtctacactaatgtggtcgagtacgtcgattggatcttggaaaaaactcaagccgtg

SEQ ID NO: 9383 - DNA, 1875 bp, Artificial Sequence
  Description of Artificial Sequence: Synthetic coding sequence
atgatttttctgtatcaggtcgtgcattttattctttttactagcgtgtcaggtgagtgcgttacacagctgctaaaggacacctgctttgagggaggggatataacaacggttttcactccaagcgcgaaatactgccaggttgtctgcacctatcaccctcggtgtctgttgtttactttcacggccgaatcaccctcggaagatcctacgcggtggttcacttgtgttctaaaggacagtgtcacggagacactccctcgtgtgaaccgtacggcggcaataagcggctactcgttcaaacagtgctcacaccaaatctccgcttgtaacaaggacatttacgtcgatttggacatgaagggaattaactacaatagctctgtcgctaagagcgctcaggagtgccaagaacgctgtacggacgacgtgcattgccacttttttacatacgccacacgtcagttcccctcgttggaacaccggaacatctgcttgttgaagcacacccagactggcacccctacaaggatcactaagctggataaagttgtttctggtttctctcttaagtcgtgtgcccttagtaatctggcatgtatacgtgacatcttccccaacaccgttttcgcagactccaacatcgacagtgtcatggcgcccgacgccttcgtttgcggtcgtatctgcacgcatcatccaggctgcctgttcttcactttctttagccaggaatggccgaaagaatcccaacggaacttatgtttgcttaagacttctgagtctggtctaccatcaacccgaatcaagaagtcgaaggccctcagtggattcagtctgcaatcctgtaggcatagcatacccgtgttctgtcattcatccttttatcatgacacagacttccttggggaagaactcgatatcgttgccgccaagtcccatgaagcctgccaaaagctctgtactaacgctgtgcgctgccagttcttcacatataccccggcacaggcttcatgtaatgaggggaagggcaaatgttacctaaaactatcctccaacgggtcaccgaccaagatcttgcacggacgcggtggtatatccgggtacactttacgcctatgcaagatggacaatgagtgcacaacaaagattaagccccgaatcgtaggaggcacagcttcagtgcgtggtgagtggccatggcaggtaacccttcacacaacttcccccacgcagaggcacctatgtggtggatctattattggcaatcagtggatcctgactgcagctcattgcttctacggcgtcgaatctcctaagattcttcgagtctatagtggcattctcaaccagtcagaaattaaagaggacaccagtttttttggtgttcaggaaattattatccatgaccagtacaagatggccgaatcagggtatgatattgcccttctcaagctcgaaacaactgtgaactacacggattcacaaagacctatttgcctccccagcaaaggtgaccgcaacgtaatctacacagactgctgggtcacaggctgggggtacaggaagttgcgtgataaaatacagaacacacttcagaaggccaagattcccttggttaccaacgaggagtgtcaaaagaggtatcgaggccacaagatcacccacaagatgatatgcgcaggttatcgcgagggcggtaaagatgcttgcaagggcgattcgggtgggcccctgagctgtaagcataacgaggtctggcatctggttggaattacatcttggggggagggttgtgctcagcgcgagcggccgggcgtgtatactaatgttgtggaatacgtggactggattttggagaaaactcaagctgtg

SEQ ID NO: 9384 - DNA, 1875 bp, Artificial Sequence
  Description of Artificial Sequence: Synthetic coding sequence
atgatttttctgtatcaggtggtgcacttcatattgttcacttctgtgtctggagagtgtgtgacacagctgctgaaggatacatgctttgaaggcggcgatattaccacagtgttcactccaagcgcgaagtactgtcaggtggtgtgcacgtaccacccacgctgtcttctctttactttcacagctgagagccccagtgaggatccaacccggtggttcacatgtgtccttaaggattcagtgactgaaacactgccacgcgtgaaccgtacggcggcgatttccggctatagtttcaagcagtgcagccatcagatttcagcttgcaacaaagacatctacgtcgatctggacatgaaagggattaactataattctagcgtggcgaaaagtgcgcaagagtgccaagagaggtgcactgacgacgtgcactgtcacttttttacctatgctacgaggcagtttcccagcctagagcaccgcaatatttgcctgctgaagcatactcagactggcacaccgactcggattaccaagctcgataaagtagtttctgggttctccttgaaaagctgtgcactgagcaacctcgcgtgcattcgagacatatttcctaatactgtctttgcggactccaatatagactcagtcatggcgcccgacgctttcgtctgcggccgcatctgcactcaccatcctgggtgcctgttcttcacttttttctcccaagagtggcccaaggaaagtcagcgaaatctgtgcctcttaaaaacctctgagagtggactgccatccactcgaatcaaaaagtccaaggcactgtccggtttctctctgcaaagttgccggcattctatcccagtgttctgccattcatcgttctatcatgatacggactttctcggtgaagaattggacatcgtcgctgctaagtcccacgaggcttgccagaagctctgcaccaatgccgtcaggtgccagtttttcacctacactcctgcgcaggccagttgcaatgagggaaagggcaagtgctatctgaaattaagttccaatgggtcacctacgaagattctgcatggaagaggagggattagtggatacacactacgcttatgcaagatggacaatgaatgtactacgaagatcaaacctcgtattgtgggcggaacggccagcgtccggggggaatggccctggcaggtaactctgcataccaccagcccaacccaacgacatttatgtggcggatccatcatcgggaaccagtggattctgacagcagcccactgtttctatggcgtagagtcacccaaaatcctcagagtgtactcaggcattcttaatcagtcagaaataaaagaggataccagcttctttggagttcaggaaatcatcatccacgaccagtacaagatggccgaatctggctacgatatagcacttctgaagctcgaaactactgtcaactatacagattcacaaaggcccatctgtctgccttccaagggcgatcggaacgtgatctatactgactgctgggtgaccggttggggatacaggaagctgcgggacaagatccagaatacattgcagaaagctaagattccgctcgtaactaacgaggagtgccagaagaggtataggggccataagatcacccataaaatgatctgtgccggctacagagagggagggaaggacgcttgtaagggcgacagtggaggacccctctcatgcaagcacaatgaggtgtggcaccttgtcggcattacatcttggggcgagggctgcgctcaaagggagcgccctggcgtttatacaaatgttgtggagtacgtggactggatcctggagaaaacccaggctgtc

SEQ ID NO: 9385 - DNA, 1875 bp, Artificial Sequence
  Description of Artificial Sequence: Synthetic coding sequence
atgatctttttgtatcaagtggtgcactttatcctgtttacctcggtgtctggagagtgtgtgacacaacttctgaaagacacctgttttgagggcggagatatcaccaccgtgtttacaccttcggccaaatattgccaggttgtctgtacctatcaccctcggtgtctgttgtttaccttcactgcagaatccccttctgaagatccaactaggtggttcacctgcgtcctcaaagatagcgtcaccgagaccctgccacgggttaatcggacagccgccatctctgggtactcctttaagcagtgcagccaccagatctctgcctgtaacaaagacatctatgtggatctggacatgaaaggcattaactacaactctagcgttgcgaaatccgcccaggagtgccaggagagatgtactgacgacgttcactgtcacttttttacatatgccacgcgtcagttcccaagcttggagcaccgcaacatctgtctgctaaagcacacacagaccggcacacctacccggataaccaaactggataaggttgtcagcggtttttccttaaaaagctgcgccctgtcaaatctggcttgtatccgtgacatcttccccaatactgtttttgccgactcgaacattgattcggtgatggccccagatgcttttgtctgtggacgaatctgcacacaccatccaggctgccttttcttcacgttcttcagtcaggaatggcctaaggaatcccaaaggaacctgtgtctgctgaagacatctgaaagtggcctaccctcaaccagaatcaagaaatctaaggcgctctccgggttctctctccagtcctgtaggcacagcatccccgtgttttgccattcttccttctatcatgataccgactttcttggagaggagctggatatcgtggcggctaagagtcacgaagcatgccagaaactgtgtacaaatgcagtccggtgccagttctttacttacacccccgcccaggcctcctgcaacgaaggaaagggaaagtgctatctcaagctcagttcaaatggtagccctactaaaatcctccatggccgggggggaataagtggatacactctgcgcctgtgcaagatggacaacgagtgcactacaaagatcaagcctcggattgtgggcggaacggcttcagtccggggtgagtggccctggcaggtcaccctacatacaacgagcccaacacagaggcatctgtgcgggggatcgatcataggcaatcaatggattctgaccgctgcccactgtttctacggggttgagtccccaaagattctgagggtctatagcggcatattgaatcaaagcgagatcaaggaggacactagtttctttggggtgcaggagatcattatccatgaccaatacaaaatggcggagtccgggtacgatattgctctgctcaagttagagacaacagttaactacacggattcacagcgcccgatatgcctcccctcaaagggagacaggaatgtcatctacactgactgctgggtgactgggtggggatacaggaagctgcgtgacaagatccaaaataccttgcagaaggccaaaattcccctggtgaccaatgaggagtgtcagaagcgttaccgcggccacaagattacacataaaatgatctgtgctgggtacagagaaggtggcaaggacgcatgcaaaggtgacagcggaggcccattgtcctgcaagcacaacgaggtatggcaccttgttggtataacatcctggggggaaggctgtgcacagagagaacgacctggggtgtacacgaatgtggtggagtacgtggactggatccttgaaaaaacacaggctgtc

SEQ ID NO: 9386 - DNA, 1875 bp, Artificial Sequence
  Description of Artificial Sequence: Synthetic coding sequence
atgattttcctgtaccaggtggtgcatttcattctttttacatctgttagtggcgaatgcgttacacagcttctgaaagatacctgtttcgaaggcggcgatattaccacagtgttcacaccaagcgcaaaatattgtcaagtggtttgcacctatcatcccagatgcctactgttcactttcaccgctgagtctccaagcgaggatcccactcgctggttcacttgcgtgctgaaggactctgtgactgaaactctgccaagggtgaataggaccgccgctataagcgggtattcttttaagcagtgctctcatcagatttccgcatgcaacaaggatatctacgtcgacctggatatgaaaggaatcaactataacagcagcgttgcaaagtctgcccaagagtgccaagaaagatgcactgacgacgtgcattgccatttcttcacctatgctactaggcagttcccatcattagaacatcggaatatctgcttactaaagcacactcagactgggaccccaactaggatcaccaagttagataaagtagtttcaggcttttccctcaagtcttgtgccctgtctaatctagcctgcattcgggatatcttccccaacacagttttcgctgatagcaacatagactccgtcatggccccagacgcttttgtctgtggccgcatctgcacccaccaccccgggtgtctcttcttcacatttttttcacaggagtggccaaaggaaagccagcgcaatctatgtctgcttaagacctccgaatcaggcctgccttccacccggattaaaaagtctaaagccttgtctggattttccctgcaaagctgtcgccacagcatacccgtgttttgccattcatcattctaccacgacaccgattttctgggtgaggagttagatattgtagcagccaagtctcatgaggcctgccagaaactgtgtacaaacgccgttcgctgccagttcttcacatatacaccagctcaggccagttgtaatgagggcaagggcaaatgttacctaaaactcagtagtaacggttctccaactaaaatcctacatggcagaggagggatatccggatataccctgcgattatgcaagatggataatgaatgcacaacaaaaatcaagcccaggatcgtgggcggcaccgccagcgttcggggtgagtggccatggcaggtgaccctgcacaccacctctccaactcagagacatctgtgtgggggcagcatcatcgggaaccaatggatcctgaccgccgcccattgcttttatggcgtcgagtcccctaagatacttcgggtgtacagcggcatcctgaatcaatctgagataaaggaagatacttccttttttggggtccaggagatcattattcatgaccagtacaaaatggccgagagcggatatgatattgccctgctgaaactggagaccaccgtgaattataccgatagtcagaggcctatctgtctgccaagcaaaggagataggaacgtgatttataccgattgctgggtcacaggttggggctaccgtaaactgcgcgataagattcagaataccctacagaaggccaagatccccctagtgacaaatgaagagtgtcagaaaagataccggggccacaaaattactcataagatgatttgtgccggctaccgggaaggcgggaaagacgcttgtaaaggggactctggtgggcctctatcttgtaaacacaatgaggtttggcatctggtgggcataactagctggggcgagggctgcgctcagcgagaacgtccaggcgtttacacaaacgtggtggagtacgtagactggattctggagaagactcaagctgtc

SEQ ID NO: 9387 - DNA, 1875 bp, Artificial Sequence
  Description of Artificial Sequence: Synthetic coding sequence
atgattttcctctaccaggtcgtgcacttcattctctttaccagcgtgtccggagagtgcgtgactcagctgctcaaggacacttgcttcgaaggtggagacatcaccaccgtgttcactccctcggcgaagtactgtcaagtggtctgcacctaccatccgcggtgcctgctgttcaccttcactgcggagtccccttcggaggacccgaccaggtggttcacttgcgttctgaaagattcggtcactgaaactcttccccgtgtgaacagaactgcggccatctccggatactcctttaaacagtgtagccatcagatctcagcatgcaataaggatatctacgtggatctcgatatgaaaggcatcaactacaattcatcagtggcgaagtcggcccaggagtgtcaagaaagatgtacggatgatgtccactgtcacttctttacctacgcaacccggcagttcccgtcgctcgaacatcggaatatctgccttctgaaacacacccagactggaaccccgactcgcatcactaaacttgacaaggtcgtgtcaggattttcactgaaaagctgcgccctctcaaaccttgcatgcatccgagacattttccctaacacggtgttcgccgactcgaatatcgactccgtgatggccccagacgcttttgtctgcgggcgcatctgcacccatcatcctggttgtctgttcttcactttcttctcacaagagtggccgaaggaatcgcagcggaacctgtgcctgcttaagacttcggaaagcggactcccatccactagaattaagaagtcaaaagctctgtctggtttctcgcttcaatcgtgccgccactcaataccagtgttttgtcacagctccttctaccacgacaccgatttcctgggcgaagagctggacattgtggccgctaagtcccatgaggcctgccagaagctgtgcactaacgcggtgcgatgccagttctttacttacactcctgcccaggcctcgtgtaatgagggcaagggaaaatgctaccttaagctctcgagcaacggctccccgaccaaaatcctccacggaagagggggcatcagcggatacacccttcgcctgtgcaagatggacaacgaatgcaccactaagatcaaacctaggattgtggggggtacggcatccgtgcggggtgagtggccgtggcaggtgaccctccacacgaccagcccaactcagcgccacctctgtggcggctcgattatcggaaaccagtggattctcacggcagcccactgcttctacggggttgaatcaccgaagattctgagagtctatagcgggatcctcaaccaatcggagatcaaggaggacacctcctttttcggagtgcaagagatcatcatccatgaccagtacaaaatggcagagagcggttacgatatcgcgctgctgaagctggagactactgtgaactacaccgacagccaaagaccgatctgcttgccgtctaaaggagatcgcaatgtcatctacactgattgctgggtgacgggctgggggtaccggaagctgcgcgataagatccagaataccctgcagaaggccaaaattccgctggtgacgaacgaggaatgtcaaaagcggtaccgtggccacaagatcactcacaagatgatctgcgcgggttaccgcgagggaggtaaggacgcgtgcaaaggagactccgggggccccctcagctgtaagcacaacgaagtgtggcatcttgtgggaatcacttcatggggtgaaggatgcgcgcagagagagcgaccgggcgtttacactaacgtggtggaatacgtggactggatcctggagaaaacccaggcagtg

SEQ ID NO: 9388 - DNA, 1875 bp, Artificial Sequence
  Description of Artificial Sequence: Synthetic coding sequence
atgatttttctgtaccaagtggtgcactttattctctttacctcggttagcggagagtgtgtgactcaactccttaaagatacttgttttgaaggaggtgacataacgacggtgtttaccccgtcagcaaagtactgtcaggtcgtctgtacctaccaccctaggtgcctgctctttacctttactgcagagtcgccctcggaggaccctaccaggtggttcacctgtgtccttaaggattcagtgactgaaactctgccaagagtcaatcgtaccgcagccatttcagggtatagctttaagcaatgtagtcaccaaatctcggcatgtaacaaggacatttatgtggacctggatatgaaagggataaactataacagctccgtggcaaagagcgctcaagagtgccaggaaagatgcactgacgacgtgcactgccatttctttacctatgcgactcgtcaatttccctcccttgaacatcgcaacatttgcctgctcaagcacactcagactggtacgcccactagaatcaccaaattggataaggtcgtgtccgggttctcgctcaagagctgtgcactttcgaatctggcctgcattagagacattttcccgaataccgtgttcgccgacagcaatattgattcagtgatggcacctgacgcatttgtgtgtggacggatttgtacccatcaccccggatgcctctttttcactttcttttctcaagagtggccgaaggaatcacaaagaaacctgtgtctgcttaagaccagcgagtccggtttgcctagcacccgcattaagaaatccaaggcactctcaggattttcgctgcaatcttgcagacatagcattcctgtcttttgccatagctcgttctaccacgacaccgatttcctgggtgaagagctcgacattgtggcagccaagtcacatgaagcatgtcaaaagctgtgtaccaatgctgtcagatgtcagttcttcacctacacgccagcacaggcctcatgcaacgaggggaaaggaaagtgctaccttaagttgtcatcaaacggatcaccaactaaaatcctgcacggaaggggtgggatctccggatacacccttcgactctgcaagatggacaacgaatgcactaccaagattaagcctagaattgtcggtggaacggcaagcgtgagaggcgaatggccttggcaagttacgctccacaccactagccctactcagcggcatctctgcggcggatccatcatcggtaaccagtggattttgactgcggcgcattgcttttacggcgtcgaatcccctaagatcctgcgcgtgtactcgggtattctgaatcagtccgaaatcaaagaggatactagcttctttggtgtgcaagagatcattatacatgaccaatacaaaatggcagaatccggatacgatatagctcttcttaagctggaaaccactgtcaactacactgattcacagcgccctatttgtctgcccagcaagggagatcggaatgtcatttacactgattgttgggttaccggctggggttacagaaagttgagagataagatccaaaatactctgcaaaaggcgaagattccgcttgtgactaacgaagagtgtcaaaagcgttaccgcggtcataagatcacccataagatgatctgcgccggttaccgcgaggggggtaaggatgcatgcaagggagattcgggtggaccactttcctgcaaacacaacgaagtgtggcacctggtgggaataacctcctggggagagggctgtgcacaacgtgagaggcctggtgtctacaccaacgtggtcgaatatgtcgattggattcttgaaaagacgcaagcagtg

SEQ ID NO: 9389 - DNA, 1875 bp, Artificial Sequence
  Description of Artificial Sequence: Synthetic coding sequence
atgatctttctgtatcaagtcgtccacttcatcctatttactagcgtgtccggcgaatgcgttacccaacttctcaaagacacatgcttcgaaggaggagacataaccaccgtgtttacgccgtccgcaaaatattgtcaggtcgtgtgtacctaccatcctcgttgtctcctatttactttcacggccgaatctccatccgaggaccccaccaggtggttcacttgtgtgcttaaggactccgttacagagacccttccaagagtgaataggactgctgctattagcggctactcgtttaagcagtgtagccatcagatatccgcttgcaacaaagatatatacgtggacctagacatgaaagggataaactataacagctcagtggctaagtcggctcaggaatgccaggaacgctgcaccgacgatgtacactgccacttttttacttatgctactcggcagttcccgagcttagagcatagaaacatttgcctgctaaagcacacacagacagggacaccgacaaggatcacgaagctggataaagtcgtaagtggtttctccttaaagagctgcgccctgtccaatttagcatgtatcagggatattttccctaataccgtatttgctgacagcaacattgacagcgtcatggctccggacgcatttgtgtgcgggagaatctgtacacaccaccctgggtgcctcttctttacatttttttcccaggagtggcccaaggagagtcaaagaaacctttgccttctaaagacttccgagtccggactgccttctacgcgaatcaaaaagtctaaagcactgagcggcttttcgcttcagtcatgcaggcattccatccccgtcttttgccattccagtttttaccatgatactgacttcctgggtgaagaactggatattgttgcagctaagagccatgaggcctgccagaagctctgcactaacgctgtgcggtgtcaatttttcacatacacacccgctcaagcgtcctgcaacgagggtaagggcaaatgctatctcaagttgtcgagcaatggatccccaactaagatcctacacggccgtggcggaattagcggctacactctgcggctctgcaagatggacaatgaatgcacgaccaaaattaaacctcggattgtaggcggaacagcctccgtccggggagagtggccatggcaggtgactctccacacaactagtcccactcagaggcatctgtgcggaggaagcattattgggaatcagtggatcctgaccgctgcccactgcttctacggggtcgagtcacccaagatcttaagggtgtactccgggattctgaatcagagcgagattaaggaagacacatccttctttggcgtgcaggagatcatcattcatgaccaatataagatggctgagtcgggctacgacatcgcactgctcaaactggaaactactgtcaactacacagacagccagcgtcctatatgcctgccctctaagggcgatcgcaacgtgatttacaccgattgttgggttacaggctggggttataggaaactgagggacaagatccaaaacacactgcagaaagctaaaatccccctcgtgaccaacgaagaatgtcaaaagcggtatcggggtcataaaatcacccacaaaatgatctgcgctggctatcgggagggagggaaggacgcatgcaagggggacagtgggggacccttatcgtgcaagcacaacgaagtgtggcaccttgtaggaattacgtcgtggggcgaagggtgtgcccaacgggaaaggcctggtgtgtataccaacgtcgttgaatatgtggattggattctggaaaagacacaggctgtt

SEQ ID NO: 9390 - DNA, 1875 bp, Artificial Sequence
  Description of Artificial Sequence: Synthetic coding sequence
atgatctttctctatcaggtggtgcattttattttgtttacatctgtgtctggggaatgcgtgacacagcttctaaaagatacttgttttgaaggaggagatataactactgtgttcacaccttctgccaagtattgtcaggtagtgtgcacttatcaccctcggtgtcttctattcactttcactgctgaaagtccttccgaagatcccactcgatggttcacatgtgtgttgaaggattctgtaactgaaactctaccccgggttaataggactgctgctatatctgggtattcctttaaacagtgctctcaccagatatccgcttgcaacaaagacatatatgtcgatctggatatgaaagggataaattataactcttcagtcgctaagtctgcacaggagtgtcaagaacgttgcacagatgatgtccattgccatttcttcacgtatgcaactagacagttcccctcactggaacacagaaatatttgtctactgaaacatacacagactggaactcccacaaggataacaaaattagataaagtagtctcaggattctctttgaaatcctgtgccctatctaatctcgcctgcattcgtgacatcttcccaaatactgtgtttgccgatagtaacatagactccgtaatggctccagatgcgtttgtctgcggaaggatctgcactcaccaccctgggtgtctatttttcacattcttttcccaggaatggcccaaagaatctcaacgcaatttgtgtctactcaaaacgtccgaatccgggctcccctccactcggatcaaaaaatccaaagcccttagtggattctccttgcaatcgtgtcggcactccataccagtgttctgccactcatcgttctatcatgacacagacttcctcggggaagagcttgatatcgtcgccgcgaagagtcacgaagcttgtcagaagctgtgtactaacgctgtccggtgccaatttttcacttacacaccagcccaggcatcctgcaacgaaggaaaagggaagtgttatttaaagctttcgtccaacgggtctcctacaaaaatactccatggaaggggggggatatctgggtacacacttcggttatgtaaaatggataatgaatgcacaactaaaattaagccccggatagtcggggggacagcttccgttagaggggaatggccatggcaggtgacactccacactacatcccctactcagaggcacctttgcggggggtcaattataggaaatcaatggatccttactgccgcccactgcttttacggagttgaatctcccaagatacttcgcgtttattccggaatcctgaaccaatccgaaataaaggaagatacttcattttttggggtccaagaaataattattcacgatcagtataaaatggccgaaagtggatatgatatcgctctgctcaagcttgaaacaactgtgaattatacagatagtcagagacctatatgtctaccaagtaaaggagatagaaatgtcatctatactgattgttgggtgacaggatggggatatagaaaattacgggataagatacagaacacactccagaaagccaaaatccccctcgtgactaacgaagaatgtcagaagcggtataggggacataaaatcactcataaaatgatatgtgccgggtatagggagggagggaaagatgcttgtaaaggagattcaggggggcccctttcatgtaaacataatgaagtgtggcacctggtcgggataactagttggggagaagggtgtgcccagcgggagaggccaggggtgtacactaacgttgttgaatatgtggactggatccttgagaaaactcaggccgtt

SEQ ID NO: 9391 - DNA, 1875 bp, Artificial Sequence
  Description of Artificial Sequence: Synthetic coding sequence
atgatttttctatatcaggtagtccactttattctctttacaagtgtgtctggtgaatgtgtcactcagctgctcaaggacacgtgctttgagggcggcgacattaccacagtatttacgccctccgccaagtattgtcaggtggtatgcacctaccatcccaggtgccttttgttcaccttcaccgctgagtcaccctcggaggacccaactagatggttcacttgtgttctaaaggattcggtgaccgagacacttcccagagtgaaccgcacggccgctatctcaggatactcctttaagcaatgttcgcatcagatctcagcatgcaacaaggacatctacgtggatctggacatgaaagggatcaactataatagcagtgtggccaagtcagcccaagagtgccaggagcgatgcacagacgatgtacattgtcatttttttacgtatgccaccagacaatttccaagtctggagcaccggaatatttgtttgctgaagcacacacagaccggcaccccaactaggataacgaagctcgacaaggtggtcagcggttttagcctgaaatcttgcgccctgtccaatctggcatgcattcgggatatctttcctaacaccgtcttcgctgattcaaatattgattctgtcatggcacctgatgccttcgtgtgcgggaggatttgcacccaccatccgggatgcctcttcttcacttttttctctcaggagtggcctaaagagtctcagcgcaacttgtgtctcctaaaaacctcagagagcggtctcccttccacgcgcattaaaaagagcaaagcactttccgggttctccctccaatcctgccgccattccattccggtgttctgccacagctcattttaccatgacactgatttcttgggtgaggagctcgacattgttgctgcgaagtcccatgaagcttgtcagaagctttgtacgaacgccgtcagatgtcagttctttacttacacacctgctcaggcgtcttgtaacgagggaaaaggaaagtgctacctgaagctctcttctaatgggtcacccactaaaatactgcatggtaggggaggcatctccgggtacacgctaaggttgtgcaagatggacaacgagtgcaccaccaagatcaagcccaggatcgtgggcggcacagcctcagtgaggggcgagtggccctggcaggtgaccctgcataccacatcaccaacacagaggcacttgtgcggcggaagcattatcggcaaccaatggattctgaccgccgcgcattgcttctatggcgttgaatcacctaagattctccgagtgtacagtggaatcctgaaccagtccgagattaaggaggacacatccttctttggggtccaggagatcattatccacgaccagtacaagatggcagagagcggatacgacatcgctcttctgaagctggagacaacagtcaactacactgattcacagcgccccatttgcttgcccagtaaaggcgataggaatgttatctacactgactgttgggtaacaggttggggatataggaagctgcgtgataagatccagaatacccttcagaaggctaagatcccgctggtgacaaatgaagagtgccaaaagcggtatcgcgggcataagatcacgcacaagatgatatgtgctggctaccgagagggcggaaaggatgcttgtaagggcgactccggtggtcctctgtcgtgcaaacataacgaggtctggcatttagtgggcattacttcttggggagaaggctgcgcgcaacgggagcggccaggcgtgtacacgaacgtggtcgagtatgtggactggatcctggagaagacccaggcagtg

SEQ ID NO: 9392 - DNA, 1875 bp, Artificial Sequence
  Description of Artificial Sequence: Synthetic coding sequence
atgatcttcctgtaccaggttgttcatttcattctgttcactagcgtctcgggagagtgcgtgactcaactcctcaaagacacctgctttgaaggcggtgacatcacgactgtgtttactccgtcagccaaatactgccaagtggtgtgtacctaccatccgcgctgccttctcttcacgttcactgcagaatcaccctccgaggaccccacccgctggtttacctgcgtgctgaaggattccgtcactgaaaccctgccgcgcgtgaaccgcaccgcagccattagcggatactcgttcaagcagtgcagccatcagatctcggcgtgtaacaaagacatctacgttgacctcgacatgaaaggaatcaattacaactcgtccgtggccaaatctgcccaggagtgccaggagcggtgcaccgatgacgtgcactgccacttctttacctacgccacgcggcagtttccttcgctggaacacaggaacatctgcctcttgaagcacacccagaccggaacgccaaccagaatcactaagctggataaggtggtgtcgggattctcgctgaagtcctgcgctttgtcaaatctggcctgcatccgcgacatctttcctaatactgtgtttgcggactcgaacatcgatagcgttatggcaccggacgcttttgtctgtgggcgcatctgcactcatcatcccggatgtctgttctttacgtttttctcacaggaatggccgaaggagtcccaaaggaatctctgcttgcttaaaaccagcgagtcagggctgccgtccactagaatcaagaagagcaaagcgctgtcaggcttctcattgcagtcctgcagacattcgatccctgtgttctgccactcctccttctaccatgacaccgactttttgggagaagaacttgatatcgtggcagccaagagccacgaggcctgtcagaaactttgcactaacgccgtcagatgccaattcttcacttacacgccggcacaagcctcgtgcaatgaaggaaagggaaagtgctacttgaaactttcatcgaacggatccccgacgaaaatcctccacgggcggggaggcatttcaggatatactctgcggctttgtaaaatggataacgaatgcactaccaagattaagccccgcatagtgggaggaaccgcctctgtgcgcggggaatggccctggcaggtgacgctgcatactacttcaccaactcaaagacatctctgcggcggatccatcatcgggaaccagtggatccttactgccgcccactgtttctacggcgtcgagtctcctaagattttgcgcgtttactcagggatccttaatcagtcagagattaaagaggacacctcattcttcggtgtgcaggagatcatcatacacgaccagtacaagatggcagaaagcggctacgatatcgctctcctcaagctggaaaccactgtcaactacactgactcgcagcgccccatttgccttccatccaaaggggatcgcaatgtgatctacaccgactgctgggtgaccggatgggggtatagaaagctccgcgacaagatccagaataccctgcaaaaagctaagatcccgcttgtgaccaacgaagagtgccagaagcgttaccggggccacaagatcactcataagatgatctgcgccggctaccgggagggcggaaaggatgcctgtaaaggggatagcggcggaccactgtcgtgcaagcacaatgaagtgtggcacctggtgggaatcacttcctggggcgaaggatgtgcgcagagagagcgaccgggagtctacaccaacgtggtcgaatacgtcgattggatcctcgagaaaactcaggctgtc

SEQ ID NO: 9393 - DNA, 1875 bp, Artificial Sequence
  Description of Artificial Sequence: Synthetic coding sequence
atgatatttctgtaccaagtggtccactttatcctttttactagcgtatccggcgaatgcgtgacgcagcttttgaaggatacctgttttgaaggtggggacatcactaccgtgtttaccccttcggctaagtactgccaggtggtctgcacttatcatcctaggtgtctgctgtttactttcactgcagagtcaccttccgaagatcctactcgatggtttacttgcgtgctgaaggattccgtgaccgagacgcttcctagggtgaatcgcactgccgcaatttcgggatattctttcaaacaatgctcgcaccagatttccgcctgtaacaaagacatttatgtcgatctggacatgaagggaatcaattacaacagctcagttgctaagtcggcacaggaatgccaagaaagatgcaccgatgatgtgcactgtcacttctttacctacgcgacccgccaatttccctcactggagcatcgcaacatttgtctcctgaagcatacccaaaccggaacgcccacccggatcacgaagctggacaaagtggtcagcggcttctcccttaagtcgtgtgcgctctccaaccttgcgtgcattagggacatatttcctaacaccgtctttgcggatagtaacattgattcggtcatggcccccgatgcctttgtgtgcggacgaatatgcactcaccatcccggttgtctgttcttcaccttcttttcccaagagtggccaaaagaaagccagcggaacctgtgcctcctcaagacgtcggaatccgggcttcctagcacccgtattaagaaatcaaaggcactgagcggcttttccttgcaatcctgtcggcacagcatcccagtgttctgtcatagctcgttttaccatgacactgatttcctgggcgaggaattggacattgtggcagcaaagtcccacgaagcatgtcagaagctctgtaccaatgccgtgcgctgtcaattcttcacgtacacccctgctcaagcaagctgtaatgagggcaagggaaagtgttacctgaaactttcgtcgaacgggtcccctaccaagattctgcatgggcgcggaggtattagcggatataccctgaggctttgcaagatggataacgagtgcacgaccaagatcaagccgagaattgtcggtggaacggcctccgtcaggggagaatggccctggcaggtgaccctgcacactacctcgcctacgcagcggcatttgtgtggcgggagcatcattggaaaccaatggattctgactgcagcacactgcttttacggagtggaatcacccaaaatactgagagtgtactccggaattcttaatcagtccgagatcaaggaagatacttctttctttggtgtgcaggagattatcatccatgaccaatacaaaatggctgagtccggttacgatattgcgttgcttaagctcgaaactaccgtgaactatactgacagccagcgccctatatgtctgcctagcaagggggaccggaacgtgatctacaccgactgttgggtgaccgggtggggttacagaaaactgcgggataagattcaaaacaccctgcaaaaggcaaaaatcccattggtgactaacgaggagtgtcaaaagaggtaccgagggcataagatcactcacaagatgatctgcgcaggttacagggaaggtggtaaggatgcatgtaagggcgacagcggggggccacttagctgcaagcataacgaggtgtggcatctggtcggaataacctcgtggggtgagggatgtgcacaacgcgaacgtcccggagtgtacaccaacgtcgtggagtacgtggactggatccttgaaaagacgcaagccgtc

SEQ ID NO: 9394 - DNA, 1875 bp, Artificial Sequence
  Description of Artificial Sequence: Synthetic coding sequence
atgatctttctctatcaggtcgtccacttcattctatttacatcggtgtccggggaatgcgttacacaattgttgaaagatacttgctttgaggggggagacataaccactgtgttcacgcctagcgctaagtattgtcaggtagtgtgcacctatcacccacgttgcctgctgttcacattcacggctgagtcccctagtgaggatcctaccaggtggttcacttgcgtgttaaaagatagtgtgactgaaacactgcccagagttaataggactgcagccatttcggggtattctttcaaacagtgtagtcatcagatttccgcgtgcaacaaggacatatacgttgacctggatatgaaaggcatcaactataattcatccgtggctaagtccgctcaagagtgccaggagcgatgtacagacgacgtccactgccactttttcacttatgccacccgtcagttcccatccctggagcacaggaacatttgcctcctcaagcacacacagaccggtactcccacccgaatcactaagttagataaagtggttagcgggttctcactgaagtcttgcgcgctgagcaatcttgcctgcatccgagatatcttcccgaataccgttttcgctgattcaaatatcgattccgtgatggctcctgatgcattcgtgtgtggccggatctgcacccatcaccccggatgtttattttttacattcttcagtcaggaatggcccaaggagtcgcagcggaacctttgtcttctgaaaacctcggaatcgggcctgcccagcaccaggattaagaagtctaaagccctctccggcttttctctgcaatcctgcaggcactccatcccggtgttctgccactcttctttctatcacgatactgattttctgggagaagaactcgacattgtcgcagctaaatcacacgaagcgtgtcaaaagctctgcaccaatgccgttcgctgccagttcttcacatataccccagcccaagccagttgcaacgaaggaaaaggaaagtgctatcttaaactgagcagcaatgggtcgcctacaaaaatcctgcacggcagaggtgggatttcgggttacaccctgagactttgcaagatggataatgaatgcaccaccaagatcaaaccaaggatcgtagggggcacagcttcagtacgcggtgagtggccctggcaggtgactctccacaccactagcccaacgcagaggcacctttgtggcggctccatcattggcaatcagtggattctcacagccgcccactgtttttacggagtcgagtcccccaagattctacgagtgtactccggcatacttaaccagtcagagatcaaggaggatacctccttcttcggagtccaggagatcataatccatgaccagtacaagatggccgaatccgggtatgatatcgctctgctgaaattggagacaactgtaaattataccgactctcagaggcctatttgcctgccctcaaagggtgaccgaaacgtgatctatactgattgttgggtgacaggctggggataccgaaagctgagggataagatccaaaacacactgcagaaagccaagatacctttggtgacaaatgaagaatgtcagaagaggtatcgagggcataaaatcactcacaaaatgatttgtgctggttatagggaagggggcaaagacgcgtgcaagggcgattctggcggaccactttcctgtaagcataatgaagtatggcacctggtgggtattacctcttggggcgagggatgtgcacagcgtgaacgaccgggcgtctatactaatgtcgttgagtacgtcgattggattttggagaaaacacaagccgtg

SEQ ID NO: 9395 - DNA, 1875 bp, Artificial Sequence
  Description of Artificial Sequence: Synthetic coding sequence
atgatcttcctgtaccaagtggttcacttcatcctgttcacttcagtttctggtgaatgcgtaacacaactgctgaaggatacttgctttgaaggtggtgacatcacaacggtgtttactccgtctgcaaaatactgccaggtggtgtgcacgtatcaccctagatgcctgctcttcacattcactgctgaatctccatccgaggatcccactaggtggttcacatgtgtgcttaaggatagcgtcaccgaaaccctgcccagggtaaacaggactgctgcaattagcgggtattcattcaagcaatgttcacaccaaatcagtgcttgtaataaagatatctacgttgacctggatatgaaagggatcaactacaatagctcagtcgccaaaagtgcacaggagtgtcaagagagatgcaccgatgacgtgcactgtcatttcttcacctatgctacaaggcagtttccaagtctggagcaccgaaacatctgcctccttaagcatactcagaccgggacacctaccaggatcactaagctcgataaagttgttagcggcttcagtcttaagagttgtgccctgtccaatttggcttgcatcagggacatcttcccaaataccgtgttcgctgattcaaatatcgattctgtgatggccccagacgcattcgtttgcggcagaatctgcacacaccacccggggtgccttttcttcacatttttctcccaggagtggccaaaggagagtcagagaaacctatgtttgttgaaaacaagcgagtcgggactcccctcaacgaggatcaaaaaaagtaaggccctgagtggatttagcctgcagagctgtaggcattcgattcctgtattttgtcattctagcttttaccatgatacagacttccttggcgaggaactggacattgtggcggcaaagtcacacgaggcttgccaaaagctgtgcaccaacgcagtgcgctgccaattcttcacctacacgcctgcacaagcttcatgcaatgaagggaagggcaagtgttacctgaagctgtcctccaatggtagtccgacgaaaatacttcacggcagaggcggcatttccgggtatactctgcgcctgtgcaagatggacaatgaatgcaccacaaaaattaaaccgcggattgtgggtggaacagcctcagtccgtggagaatggccatggcaggtgaccctacacacaacgtcccccacgcagcgccatctttgcggggggtcaatcatcgggaaccaatggatcctcaccgccgctcactgcttttacggcgtggagtcacctaagatactgagggtatatagcgggattctaaatcagtcagagattaaagaagatactagcttttttggggtgcaggaaattatcatacatgaccagtataaaatggccgagtcaggctatgacatcgcactgttgaagcttgagaccactgtcaactacactgactcacagcgccccatttgcctcccctcaaagggcgacagaaatgttatctatacagattgttgggtcaccggctggggatatcgcaagctgagagataaaattcaaaataccctccagaaggccaagattccccttgttaccaatgaagagtgccagaagaggtatcgcggccataagataacacataagatgatatgtgctggataccgggagggtggcaaggatgcctgcaaaggagattcaggcggccccttgtcgtgcaagcacaatgaggtctggcacctggtaggcatcacttcttggggggagggatgtgcacaaagggagcgcccgggagtgtacacaaatgtcgtggaatacgtagattggatcctcgagaagacccaggcagtg

SEQ ID NO: 9396 - DNA, 1875 bp, Artificial Sequence
  Description of Artificial Sequence: Synthetic coding sequence
atgatattcctgtatcaagtggtccatttcattttgtttacctcggtcagcggtgaatgtgtcactcagttgctgaaggatacctgttttgagggtggggatataaccacggtctttactccctcggcgaagtactgtcaagtcgtctgtacttatcaccccaggtgtctcttgttcactttcaccgcagaatcgccgagcgaggatcccacccgttggtttacctgcgtgcttaaagattcggttaccgaaactcttcccagagtgaacaggacggcagcgattagcggatacagcttcaagcaatgttcccaccagatatccgcatgtaacaaggatatctatgtcgacctggacatgaagggtataaactacaattcctcagtggcaaaatccgcacaggaatgtcaagaaaggtgtactgatgatgtgcactgccacttctttacgtacgccactaggcaatttccatcacttgaacatcgcaacatatgtctgctgaagcatacccagactggaactccgactcgaattactaagctggacaaggtcgtgtcgggattttcgttgaagagctgcgccctttctaacctggcatgtatacgtgacatctttcctaacactgtgtttgcagattcgaacattgacagcgtgatggcccctgacgcattcgtgtgtggcagaatttgcacccatcatcctggatgcctgttctttacgttcttttcccaggaatggccgaaggaatcccagcggaatctttgcctgctgaaaacctccgaaagcggccttccttccactagaattaagaagagcaaagcactcagcggattctcactgcagtcatgtcgtcattcaattcccgtgttttgtcacagctccttttaccatgataccgattttctgggagaagaactggatatcgtggctgcgaagtcccatgaagcatgtcaaaagctgtgtaccaacgcagtgcgatgtcagtttttcacttacactccagcacaggcatcctgtaacgaaggaaagggaaagtgttacttgaagctctcatctaacggatcgccaaccaagatactgcatggtcggggtggtatttcgggctacaccctgagactttgcaaaatggataacgaatgtaccaccaagattaagccacggattgtcggcgggaccgcatccgtccggggggaatggccttggcaggtgaccctgcatacgacctcacctactcagagacatttgtgtggaggcagcattatcgggaatcaatggattctgacggccgcacattgtttttacggtgtggagagcccaaagattttgagagtgtactccggcattcttaaccaatcagagataaaagaggatacctcattctttggagtgcaggaaatcattatccatgaccaatacaagatggccgaaagcggctacgacattgccctccttaaacttgaaactaccgtgaactatacggactcgcagcgccctatttgtttgccctcgaagggggacagaaatgtcatttacactgattgttgggtgacgggatggggctacaggaagctgagagataagatccagaatactctgcagaaggcgaagattccactggtgacgaatgaagagtgtcaaaagaggtacagaggacacaagattacgcacaagatgatttgtgcaggttaccgagaggggggaaaagatgcgtgcaagggtgattccggaggccctctgtcgtgcaagcataacgaggtatggcaccttgtggggattactagctggggcgaagggtgcgcacaacgcgagcgccctggagtgtacaccaacgtggtcgaatacgttgactggattttggaaaaaactcaagccgtg

SEQ ID NO: 9397 - DNA, 1875 bp, Artificial Sequence
  Description of Artificial Sequence: Synthetic coding sequence
atgatcttcctgtaccaggtagtgcactttatattgtttacttccgtttcaggagagtgcgtgactcagcttctgaaagatacttgttttgaaggaggagacatcactacagtgtttacaccctctgctaagtactgtcaggtggtgtgcacctatcacccacgatgtttattatttacctttaccgccgagtccccatcggaagatcctacccgttggtttacatgcgtcctcaaggacagcgttaccgagacactgccaagggtcaatcggaccgctgccatctccggctactcattcaaacagtgctcccaccagatcagcgcttgcaacaaggacatctacgtagatctggatatgaagggcataaactacaattcgtcagtcgccaaatccgcccaggagtgtcaagaacgatgcacggacgatgtgcactgccatttcttcacgtacgccacacgacagttccctagcctagagcaccgcaacatctgtctcttaaagcatactcagacaggtactccgacacgtataacaaagttggataaagtcgtatccggttttagcctgaagtcgtgcgccctttccaatttagcctgcatccgggatatattccctaacaccgtgtttgcagacagtaacattgactcagtgatggcccctgacgcttttgtatgtggacgaatttgtacccatcatcccgggtgcttgtttttcacatttttcagccaggagtggcccaaagagtcccagcgaaatctttgtctcctgaagacctccgagagtgggttgccctccacccggattaagaagtccaaggccctgagtggcttctctctccagtcttgcagacactcaattcccgtgttctgtcactccagtttttatcacgataccgatttcctcggcgaggaactggatattgtggcagctaaatcacacgaggcgtgccagaaattgtgtacaaacgctgttcgctgccagttcttcacatatactccagcccaggccagttgtaacgagggtaaaggcaagtgttacctcaaacttagctccaacgggtcacccacaaaaattttgcatggccgaggaggcatcagtgggtataccctgcggttgtgtaaaatggacaacgagtgcacgactaaaattaagccaagaattgtcggaggtacggcttctgtgcggggagaatggccttggcaggtaaccttgcacacaacctcaccaacacagcgccacttgtgcggagggagcattattgggaatcagtggattctgaccgctgcgcactgcttttacggtgtagaaagccctaaaatcctgcgcgtttacagtgggatacttaaccagtcagaaataaaggaggacactagcttcttcggtgtccaggagataatcatccatgaccagtataagatggcggagtctggatacgatatcgctctgctgaagcttgagaccactgtcaattataccgactcgcagcggcctatctgcctaccgtcaaagggtgaccggaatgtgatatacacagactgctgggtcaccggttggggctaccgcaaactcagggacaaaatacagaataccctacagaaggctaaaatacccctggtgacgaatgaggaatgtcagaaacgatatagggggcacaagattacccacaaaatgatttgcgccggttacagggagggggggaaagatgcttgtaaaggtgactccggcggtccattatcatgtaagcataacgaggtctggcatcttgtgggcattaccagctggggagagggatgcgcacagcgagagcgccccggcgtttataccaatgttgtggaatacgttgattggattctggagaagacacaggctgta

SEQ ID NO: 9398 - DNA, 1875 bp, Artificial Sequence
  Description of Artificial Sequence: Synthetic coding sequence
atgattttcctctaccaagtggtccacttcattttgttcaccagcgtgagcggagagtgtgtcactcaactgttgaaagacacttgctttgaggggggcgacatcactactgtgtttaccccttccgccaagtactgccaagttgtctgcacttatcatcctcgctgcctcctgttcaccttcaccgccgagtcgccctcggaagatccgacgcgctggttcacgtgtgtgctcaaggactctgtcaccgaaaccttgccaagggtcaacaggaccgccgcaatctccggatactcattcaagcagtgcagccaccaaatctcggcttgcaacaaagacatctacgtggatctggatatgaagggtatcaactacaactcgtcggtagcaaagtctgctcaggaatgtcaggaacgctgcacggatgacgtgcactgccatttcttcacctacgccactcgccaatttccatccttggaacaccgcaacatatgtctgctcaagcatacccaaacgggaaccccgacccgcattaccaaactggacaaggtggtgtccggtttctcactcaagtcatgcgcgctgtccaacctggcctgcatccgagacatcttccctaatactgtgttcgcggacagcaacattgacagcgtcatggctccagatgcattcgtgtgcggcaggatctgcacccatcacccgggatgcttgttctttacctttttcagccaggaatggcctaaggagagccaacgaaacctgtgtctcctgaaaactagcgagtcgggactgccgtcaactcgcattaagaagtccaaggcgcttagcggcttctcattgcagtcatgccgccattcaattccagtgttctgccattcatccttttaccacgacacggatttcctcggagaggagctggacatcgttgctgcgaaaagccacgaagcgtgccagaagttgtgcaccaacgctgtcagatgccagtttttcacctacactccagcccaggcctcgtgcaacgaaggaaaaggcaagtgttacctcaagctcagctcaaacggatccccaaccaagatcctccacggaagaggcggaataagcggctacaccctgcggctgtgtaagatggacaatgagtgcactaccaagattaagcccagaattgtcggtggcactgcttccgtccgcggagaatggccctggcaggtgactctccatactacctctccaacgcagcgccatctctgcgggggctcgatcatcggaaaccaatggatccttacggcggcccactgcttctacggtgttgagtcgccgaagatccttcgcgtgtattccggcattctgaatcaatcagagatcaaggaggacacgtcgttcttcggagtgcaggagatcattatccatgaccagtacaagatggcagaatcagggtacgatatcgcgctcctgaaactggagactactgttaactataccgactcacaacgcccaatctgtctgcccagcaaaggcgaccgtaacgtgatttacaccgattgctgggtcaccggatggggctaccggaaactgcgggacaagatccagaacaccctgcagaaggccaaaattccgctggtgaccaatgaagagtgtcagaagcgctaccggggacacaagatcacccacaagatgatctgtgccggataccgggaaggaggaaaggacgcttgcaagggggactcaggcggaccactgtcctgtaagcataacgaggtctggcacctggtgggaatcacttcatggggagagggctgcgcacagcgcgaaaggccgggagtgtacaccaatgtggtggaatatgtcgactggattctggaaaagacccaggcagtg

SEQ ID NO: 9399 - DNA, 1875 bp, Artificial Sequence
  Description of Artificial Sequence: Synthetic coding sequence
atgatatttttgtatcaagttgttcattttattttattcacttctgtttcaggagaatgtgttacccaacttttaaaagatacatgttttgaaggaggagatattactactgtttttactccatcagctaagtattgtcaagttgtttgcacatatcatccaagatgtctactttttacatttacagccgaaagtccatcagaggatccaacaagatggttcacttgtgttcttaaggatagtgttactgaaacacttccaagagtcaacagaactgcagcaatttctggttatagttttaaacagtgttcgcaccaaatttctgcttgtaataaggacatttatgttgatttagatatgaaaggtattaactataattctagtgtagcaaaaagtgctcaagaatgtcaagaaagatgtacagatgatgtacactgtcatttttttacttatgcaacaagacaatttccttcattagaacacagaaatatttgtttacttaaacatacacaaactggaactccaacaagaattactaaacttgataaagttgtatcaggttttagtttgaaatcgtgtgctttatcaaatttggcttgtattagagatatttttcctaatactgtttttgcagatagtaatatagattcagttatggctccagatgcttttgtttgtggaagaatttgtacacatcatcctggttgtcttttctttactttcttctcacaagaatggcctaaagaatctcagagaaatttatgtcttcttaaaacatcagaaagtggacttccttcaacacgtattaaaaagtcaaaagcactttctggattttctttgcaatcttgtagacactctattcctgtattctgtcattcttcattctatcatgatacagattttttaggagaagaacttgatattgtagcagctaaatcacacgaagcttgtcagaaattatgtactaatgctgtacgatgtcaatttttcacatatactccagcacaagcatcatgtaatgaaggtaaaggaaagtgttatcttaaattatcgtcaaatggatcccctactaaaattttacatggaagaggaggaattagtggatacactttaagattatgtaaaatggataatgaatgtactactaaaattaaaccaagaatcgtcggaggaacagcatcagttagaggagagtggccatggcaagttactttgcacacaacttcaccaacacaaagacatctttgtggaggaagtattataggaaatcaatggatattaaccgccgctcattgtttttatggagtagaatctccaaaaattttaagagtatattcaggtatcttaaatcaatcagaaattaaagaagatacttcattttttggagttcaagaaattattattcatgatcaatataaaatggctgagtctggatatgatattgcattattaaaacttgaaacaacagtcaattatactgatagtcaaagaccaatttgtttaccatcaaaaggtgatagaaatgtgatttatactgattgttgggttaccggatggggatatagaaaacttagggataaaattcaaaatacattacaaaaagctaaaataccattagttacaaatgaagaatgtcaaaaaagataccgtggacataaaataactcataaaatgatatgtgctggatacagagaaggtggaaaggatgcttgtaaaggagattctggaggtccattatcttgtaaacataatgaagtttggcatttggtaggaataacatcttggggtgagggatgtgcacaaagagaaagaccaggagtgtatactaatgtagttgaatacgtagactggatattagaaaaaactcaagctgta

SEQ ID NO: 9400 - DNA, 1875 bp, Artificial Sequence
  Description of Artificial Sequence: Synthetic coding sequence
atgatcttcctgtaccaggtcgtgcactttatcctgtttacttccgtttctggcgaatgcgtcactcaactcctcaaagacacctgctttgaaggcggagacatcactacggtcttcacgccctctgcgaaatactgccaggtagtatgtacctatcatccgaggtgtctgctgtttacattcactgctgagtctccctccgaggatcctacacgctggttcacctgtgtgttgaaggatagcgtgactgaaaccctcccaagagtgaaccggacagctgccattagcggctactccttcaagcagtgctcacaccaaattagtgcttgtaacaaggatatctacgtggatttggacatgaaggggatcaattacaattcctctgtagccaaatccgcgcaggaatgtcaggaacggtgtactgacgacgtccactgccatttttttacatacgccactcgacagtttcctagtttggagcaccggaatatctgtctgctgaaacatacacaaacgggtaccccaacaagaatcactaagctcgataaggtggtttcagggttttctctgaagtcttgtgccctcagcaacctggcctgcataagagatatttttcctaatacagtgtttgccgactcaaacatcgactctgtcatggcgccggacgcattcgtgtgcgggcggatttgtacacatcatccaggctgcctcttcttcacattcttttcacaggaatggcctaaggaatcccaaaggaacctgtgcttgctgaagacaagcgaatccggactgccatcaacaaggatcaagaaaagcaaagcactgagcggcttctctcttcaatcctgtcgccatagtattcccgtcttctgtcactcctccttctatcacgatactgactttctgggggaagagctcgacattgtcgcggcaaagagtcacgaggcatgtcagaaactgtgcacgaacgccgtcaggtgccagttcttcacctatacgcctgcacaggcaagctgtaacgagggtaagggtaaatgctacctgaagctgagcagtaacggatctccaaccaaaattctgcacggcagagggggcatttccgggtatacactgaggctgtgcaagatggacaacgaatgcacaacgaagatcaaaccacgcatagtgggcggcacagctagcgtcagaggcgaatggccttggcaggtaacactgcacactacatccccaactcagagacacctctgtggaggcagtattataggcaatcagtggatattgaccgcagcccattgtttttacggcgtggagtcccctaagatactccgggtttacagcggaatcctgaaccaaagtgagataaaggaagacacttctttcttcggggtgcaggagattatcatccatgatcagtacaaaatggccgagtcaggctacgacatagccctgctcaagctcgagactacggtgaactacacagattcacagagacccatatgcctcccaagcaagggagatcgcaacgtcatctataccgattgttgggtgaccggttggggttacaggaagctcagggacaagatccagaatacgctgcagaaggccaaaattccgcttgttaccaacgaagaatgccagaagagataccgagggcacaagatcacccacaaaatgatttgcgcgggttatagggaaggcgggaaagatgcatgtaagggcgactctggcggccctctgagctgcaagcacaatgaggtgtggcatctggtggggatcacatcctggggggagggttgcgcccaacgcgagagaccaggcgtgtacactaacgtggtggaatacgtcgactggattctggaaaagacccaagctgtc

SEQ ID NO: 9401 - DNA, 1875 bp, Artificial Sequence
  Description of Artificial Sequence: Synthetic coding sequence
atgattttcctgtatcaagttgtccattttatactgttcaccagcgtcagcggagagtgcgttacccaattgctgaaagacacctgcttcgagggaggcgatattacgaccgtctttactcctagtgccaagtattgtcaggtcgtgtgtacctatcatcctaggtgcttgctctttaccttcaccgccgagtcgccctcagaggatcccactaggtggttcacatgcgttctgaaggactccgtaaccgaaacactgccgcgggtgaaccgcaccgccgctatcagtggctacagcttcaagcaatgctcacaccagattagcgcctgtaataaggatatttacgtggaccttgacatgaagggcatcaactataacagcagcgttgccaaaagcgcacaggagtgtcaggagagatgcaccgatgacgtccactgtcatttttttacatatgcaactcggcagttcccttccctcgaacaccgcaacatctgccttcttaagcatactcagaccgggacccccacccggataactaaattggataaagtcgtcagtggatttagtctgaaatcatgcgcactgagcaaccttgcctgcattagagacatttttcctaataccgtatttgcagatagcaacatcgactcagtgatggctcccgatgccttcgtctgcggacgtatctgcacccatcaccctggatgtttatttttcacatttttcagccaggaatggcctaaagaatcacagaggaacctctgcctcctgaaaaccagcgagagtggcttgccgagcactcggattaaaaaatctaaggccctgagtggattcagtctccaatcttgccgacactcaataccagtgttttgccattcctcattctaccacgacaccgacttcctgggcgaggagttagatattgtggctgccaaaagtcacgaggcttgccaaaagctttgtaccaacgcagtccgctgccaattttttacctatacacccgctcaggcaagctgcaatgagggaaaaggaaagtgttacctgaaactttcaagcaatggtagcccaactaaaatccttcatggacgcgggggcatcagcggttacactctgagactctgcaagatggacaatgagtgtacaacgaaaatcaagccaagaatcgttggcggcactgcttcagtacggggggaatggccttggcaggtgactcttcacaccacctcacctacccagcgacatctatgcggaggcagcatcatcggaaaccagtggatccttacagcagcacattgtttctacggggtagagagccccaaaatcctccgcgtgtatagcggcattctgaatcaatcagagataaaagaggacacgtctttttttggcgtccaggagattatcatccacgatcaatacaagatggctgagtctggatatgatatcgcgttgctgaaactggaaacaaccgttaattataccgacagccagagaccaatttgcctcccaagcaagggtgacagaaatgtaatttacaccgattgctgggtgactggctgggggtaccggaaactgcgagataagatccagaacacccttcagaaggcgaagatcccgctggtgaccaacgaggaatgccagaaaaggtatcggggccataaaatcactcacaagatgatctgcgccggctacagggaaggaggcaaggacgcatgtaaaggcgattccggaggcccattgagctgtaagcataacgaagtgtggcatcttgttggcatcaccagctggggcgagggatgcgctcaacgcgagcgccccggggtgtatactaatgtggtggagtacgtggattggatcctagaaaagacgcaggccgtt

SEQ ID NO: 9402 - DNA, 1875 bp, Artificial Sequence
  Description of Artificial Sequence: Synthetic coding sequence
atgattttcctttaccaagtggtgcactttatcttgtttacctcagtgtcgggggagtgtgttactcagctccttaaggacacctgcttcgagggcggagatatcaccaccgtgttcactccgtcagcaaagtactgccaagtcgtgtgcacgtatcatccacgctgtctgctcttcactttcaccgccgaatcaccatcagaggacccgactcggtggtttacttgtgttctcaaagattcagtcaccgagacgctccctcgggtgaacagaaccgcggctatctccggttactcatttaagcagtgctcgcatcaaatctcggcatgcaataaggacatctacgtggacctcgatatgaagggaatcaactacaactcatccgtcgcaaaatcagcccaggagtgtcaggaacgctgcactgacgacgttcactgccacttcttcacgtacgcaacgaggcagtttccgtcgctggaacatagaaatatctgcctgctgaaacacacccagactggaactccaacccggattaccaagctcgacaaggtcgtgtcgggtttcagcctgaagtcatgtgccctctcgaacctggcttgtatccgggacatttttccaaataccgtctttgctgacagcaacatcgattcggtgatggcaccggatgctttcgtgtgcggacggatttgtacgcatcatcccggttgcctcttcttcacgttctttagccaagagtggccgaaggaaagccagcgaaacctgtgcctgctcaagacctccgagtccggactgcccagcactaggattaagaagtccaaagcgctgtcaggattctcgctccagtcatgccggcactcgatcccggtgttctgtcattcctccttctaccacgataccgatttccttggagaagaacttgacatcgtggcagcgaaatcacacgaggcctgccagaaactctgcaccaatgcggtgagatgccagttcttcacttacacccctgcacaggcctcgtgcaacgaaggaaaaggaaagtgctacctcaagctgtccagcaatggaagccctactaagatcctgcatggtcgaggaggaatcagcggatatacgctgcgtctgtgtaaaatggacaacgagtgcactaccaagatcaaaccgcgcatcgtcggcggaaccgccagcgtccggggagaatggccgtggcaggtgactctgcacaccacgtcaccgactcagcgccatctttgcggaggcagcatcatcggaaaccagtggatcttgactgctgcgcactgcttctacggggtggaatccccgaagatactcagggtgtattcaggcatcctgaaccagtcggagatcaaggaggatacttccttctttggagtgcaagagatcattattcacgaccagtataagatggcggaatcgggttacgacatcgcactccttaagttggagactaccgtgaactacactgattcgcagcgcccgatttgcctgccaagcaagggagacaggaatgtgatctacactgattgctgggttaccggatggggctacaggaagctgcgggataagatccagaacactctgcaaaaagccaagataccgctggtgactaacgaagagtgccaaaagcggtacaggggacataagatcactcacaagatgatctgtgcgggctacagggaaggggggaaggacgcctgcaagggagattccggtggaccattgtcatgcaagcataacgaggtgtggcaccttgtgggcatcacgtcctggggagagggatgcgcccaacgcgagcgccccggcgtgtacacgaacgtcgtggagtacgtggattggatactggagaaaacccaggccgtg

SEQ ID NO: 9403 - DNA, 1875 bp, Artificial Sequence
  Description of Artificial Sequence: Synthetic coding sequence
atgatttttctgtaccaagtggtccatttcatcctgtttaccagcgtgtcgggagaatgcgtgactcaacttttgaaggatacgtgctttgaaggcggcgatatcacgacggtttttacgcctagcgcaaagtactgtcaggtggtgtgtacctaccatcctcgatgtctgctctttacgttcactgccgaatcccccagcgaggacccaactaggtggttcacctgcgtccttaaggatagcgtgaccgaaacccttccaagggtgaaccggaccgcagcaatttccggatacagctttaaacaatgttcgcatcagatatccgcttgtaataaggacatctacgtggatcttgacatgaagggaatcaattacaattcgagcgtggcaaagtctgcccaagagtgccaagagcggtgtacggatgacgtccattgccactttttcacctacgcaactagacagttcccaagcctggaacaccgcaacatttgtctgctgaaacatactcagaccggaacgccaacccggataaccaaattggataaggtcgtgtcaggattttcactgaagtcctgcgccctgtctaatcttgcatgtattagggacatattccctaacactgtgtttgcagacagcaatattgactccgtcatggcgccagacgcatttgtttgtggaaggatatgtactcatcaccctggctgtcttttcttcaccttcttttcccaagaatggcctaaggaatcgcaacggaacctttgcttgcttaaaacttcagagtccggactgccatccactagaattaagaagtcgaaggccctgagcggcttctcactgcagtcatgtagacactcgatccctgtcttttgccactcctcattctaccatgataccgatttccttggtgaggagctcgacatcgtggcagcaaagtcgcacgaagcatgtcagaaactctgcactaatgcggtcagatgccagttcttcacttacacccccgcacaagcctcttgtaacgaaggaaaggggaagtgttacctcaagctgtcctctaacggtagccccaccaagatcctgcatgggagaggtggaatcagcggctacactctgcgactctgcaagatggataacgagtgtaccaccaaaatcaagccaagaattgtgggaggaaccgcttccgtgcgaggtgaatggccttggcaagtgacccttcatactacttcaccaacccagagacacctctgtggcggtagcatcattggaaaccaatggattctgactgcagcgcattgtttttacggtgtggagagcccaaagattctgagggtgtactcgggtatcctcaaccagtccgaaatcaaagaagatacctccttttttggagtgcaggaaatcataatccatgaccagtacaagatggcagagtcgggatatgacatcgcgttgctcaaactcgaaactaccgtgaactacaccgattcccaaagacctatttgtctgccatcaaagggggataggaacgtcatatacaccgattgctgggtcactggatggggttaccggaaattgagggataagattcaaaacactctgcagaaggcgaaaattcctcttgtgaccaacgaagagtgtcagaagagatacagaggtcacaagataactcacaagatgatctgtgccggatatcgcgaaggcggcaaggatgcgtgtaaaggcgactccggcgggccgttgtcatgtaaacataatgaggtctggcacttggtgggaattaccagctggggcgaaggatgcgcacaacgcgagcggccgggtgtgtataccaacgtggtcgagtacgtggactggattcttgaaaagacccaagcggtc

SEQ ID NO: 9404 - DNA, 1875 bp, Artificial Sequence
  Description of Artificial Sequence: Synthetic coding sequence
atgatcttcttgtatcaagtagtgcacttcatcctgttcacatcggtttcaggtgagtgtgtgacacagcttttgaaggatacctgcttcgaaggcggagacatcaccacagtgttcaccccatccgctaaatattgccaggttgtttgtacgtatcatccccgttgtctgctgttcactttcacagctgagagcccttctgaagaccctacccgctggtttacgtgcgtactgaaggacagcgtgaccgagaccctaccacgggtgaaccggacggcagccataagtggctattctttcaagcagtgtagccaccagatctcggcctgtaataaagacatatacgtggatctcgacatgaagggcatcaactacaactcaagcgtggccaaaagcgcacaggagtgccaagagcggtgtacagatgatgtccactgccatttctttacatatgccacaaggcagtttcctagtcttgaacaccgaaacatctgtttgttgaagcacactcagaccggcactcctactcgcattacgaaactagacaaagtggtatcaggtttttcactgaagagctgtgccctgtccaatctggcctgcatccgcgacatcttcccaaatactgtgtttgctgatagcaatattgatagcgtgatggccccggacgcgtttgtgtgtggcagaatatgcacacaccacccaggctgcctgttttttacctttttcagccaggagtggcctaaggagagccagaggaatctgtgcttattaaagactagtgaatctgggctgccttctacgagaattaagaaatctaaggccctgtccggcttctctctacaatcttgcaggcactcaattccagtgttttgtcattcatccttttaccacgatacggattttctgggggaggagttggacattgtcgctgctaagagccacgaggcctgccagaagctgtgcaccaatgcggtgagatgccagttctttacctatacgcctgcacaggcctcatgcaacgaaggaaaaggtaaatgttacctcaagctctcctctaatgggagccctaccaagattttgcatggacgcggcggaatcagtggctacactctccggctgtgcaaaatggacaatgaatgtaccaccaagatcaagcctaggattgttggaggaactgcttccgtccgcggggaatggccatggcaggtgaccctgcacactacctccccaactcagagacacttgtgtgggggctcgatcataggtaaccagtggattctgaccgcggcacactgcttttatggcgtggaatctcccaagatcttgcgcgtctactcaggtattctgaatcagagcgaaatcaaggaggacacttccttctttggggtccaggagataatcatacatgatcaatacaaaatggccgaaagtggttacgacatcgccctcctgaagctggagacaacggtcaattacaccgactctcagaggccgatctgtctgccttccaaaggagatagaaatgtaatctacacagattgttgggtcacaggctgggggtatcgcaagcttagagacaagatccagaacaccctgcagaaagctaagattcctttagtcaccaacgaggagtgccaaaaaagatataggggacataaaatcacacacaaaatgatttgtgctggttaccgggagggcggcaaagacgcatgtaaaggcgattccggcggtccattaagttgtaaacataacgaagtatggcatcttgtcggaatcacgagttggggcgagggatgtgctcaacgagaacgccccggggtttatacaaacgtagtcgaatatgtagattggatcttggagaaaactcaggccgtt

SEQ ID NO: 9405 - DNA, 1875 bp, Artificial Sequence
  Description of Artificial Sequence: Synthetic coding sequence
atgatcttcctttaccaggtggtgcacttcatcctcttcaccagcgtgtcgggtgaatgtgtgactcaacttctgaaggacacctgcttcgagggaggagacatcaccactgttttcacgccgtcggccaagtactgccaggtggtttgtacttaccacccacgctgcctcctcttcactttcacggcagaaagcccctccgaggatccaaccagatggttcacctgcgtgctcaaagattcggtgaccgagactttgccgagggtcaatcggaccgccgcgatcagcggatactcctttaagcagtgctcgcaccagatttccgcgtgcaataaggatatctacgtcgacctcgacatgaagggcatcaactacaacagtagcgtggctaagagcgctcaggaatgccaggagcgctgtacggatgacgtgcattgtcatttcttcacttatgctactcgacaattcccgtcgctggaacaccggaacatctgcctgctgaagcatactcaaaccgggacccctacccggatcacgaaactggacaaggttgtgagtggattttcactcaaatcctgcgccctgtcgaatctggcatgcattcgagatatcttccctaacactgtgttcgcggactccaacatcgattccgtgatggcccctgacgcgttcgtgtgcggcagaatctgcactcaccacccaggatgtctgttctttaccttcttttcccaagaatggcccaaggaatcacagaggaacctgtgcctgctgaaaacgagcgagtccggtttgccgtcaactagaataaagaagagcaaggccctgtccggcttcagtctgcagtcgtgccggcactcaatcccggtcttttgccattcgtccttctaccatgatactgactttctcggagaggaactggacatcgtcgctgcaaaatcgcatgaagcctgtcaaaagctgtgcaccaatgccgtgaggtgccaattctttacctacacgccagcacaggcctcctgcaacgaaggaaaaggtaaatgttacctcaaactctcgagcaacgggagtcctaccaaaattctgcatggaagaggggggatttccggatacaccctgaggctctgcaagatggacaacgaatgcaccaccaagatcaagcctcggatcgtgggtggaaccgcttccgtgcgcggagagtggccgtggcaagtaaccctgcacactacttcgccaactcaacggcatctgtgcggaggaagcatcatcgggaaccagtggatcctcactgcggcacactgcttctacggtgtcgagtcaccgaagattctcagggtttactcaggcatcttgaatcagtcagagattaaagaagatacctctttctttggagtgcaggagatcatcatccatgaccaatacaagatggccgaatcaggctatgatattgcgttgctgaaactcgaaactaccgtgaactacactgactcgcagcgcccgatttgtctgccctctaagggggatcgcaacgtcatctacacggattgctgggtgaccgggtggggataccgaaaacttcgggataagatccagaacaccctgcaaaaggccaaaataccgcttgtgaccaatgaggagtgccagaagaggtaccgcggccacaaaatcactcacaagatgatctgcgccgggtaccgtgaggggggcaaggacgcatgtaagggcgactccggcggcccattgtcctgcaagcacaatgaagtttggcaccttgtgggaatcacttcatggggagaaggctgtgcccagcgcgaacgccctggcgtctatactaacgtagtggagtacgtcgactggatcctggaaaagacgcaggctgtc

SEQ ID NO: 9406 - DNA, 1875 bp, Artificial Sequence
  Description of Artificial Sequence: Synthetic coding sequence
atgatctttctttaccaagtcgtgcactttattctctttacttcagtctcgggtgaatgcgtgacccaactgctgaaggacacttgtttcgagggcggagatattaccactgtgtttactccatcagcgaagtactgccaagtcgtgtgcacctaccatccaagatgccttcttttcacttttaccgcggaatcgcctagcgaagatccaacccggtggtttacttgtgtgttgaaggattcagtgactgaaactctgcctcgagtgaacaggacggcagcaatttcgggctactctttcaaacaatgttcccatcagatctcggcatgtaataaggatatctacgtggatctggatatgaagggtataaactacaatagcagtgtcgccaaatcagctcaggagtgtcaggaaagatgtacggatgacgtgcattgccacttctttacctacgcaactcggcagtttcctagcttggagcacagaaacatctgccttctgaagcatacgcaaaccggtacccctacgcgcattaccaagctcgataaagttgtgtcgggattttcgctgaagtcgtgcgcactgtcaaacctggcgtgcattcgtgacatttttcctaatactgtctttgcagattcgaatatagattcggtgatggctccagatgcattcgtctgtgggcgcatctgtactcaccatcctggatgcttgtttttcactttcttctcccaagagtggcctaaagaaagccagcgcaacctctgtttgctcaaaaccagcgagtcggggctcccctcgaccagaatcaagaagagcaaggcgctcagcgggtttagccttcaatcgtgtcggcattccatccctgtcttttgtcactcgtctttttaccatgacaccgatttcctgggagaagaactggatattgtcgctgccaaatcacacgaggcctgtcagaaattgtgtaccaacgcggtgagatgtcaattcttcacttacacccctgcacaggcctcttgcaacgagggcaagggaaagtgttacctgaagctgtccagcaacggatcgccaaccaagattctgcacggacgaggaggtattagcggctacaccctgcgactttgcaagatggacaacgaatgtactaccaagatcaagccgcggatcgtgggaggtaccgcatccgtgcgtggtgaatggccatggcaggtgactctgcatactacctcaccaactcagagacacctgtgcggtggctccatcatcggtaaccaatggatcctgactgcagcacactgcttttacggagtcgagtcgcctaagatcttgagagtgtactccggtattcttaatcaatccgaaatcaaagaggacactagctttttcggcgtccaagagatcattattcacgatcaatacaagatggctgaatccggttacgatattgcactgctgaagctggaaactaccgtgaactacactgattcgcaaaggccaatctgtctgccgtcgaagggtgatagaaatgtgatttacaccgactgctgggtgaccggatggggttaccgaaagctccgcgataagattcagaacactctgcaaaaggcaaagattccccttgtgacgaacgaagaatgtcagaagcgataccgtggacacaagattacccataagatgatctgtgcaggataccgggaaggtggaaaggacgcttgcaagggcgacagcggtggtcccctctcgtgtaagcataatgaggtgtggcacctggtgggaatcacttcatggggggagggatgtgcacagcgtgaacggccaggagtgtacactaatgtcgtggaatacgtggattggatccttgagaaaacccaggcagtc

SEQ ID NO: 9407 - DNA, 1875 bp, Artificial Sequence
  Description of Artificial Sequence: Synthetic coding sequence
atgatctttctataccaagtcgtgcactttatcctcttcacttccgtttctggagaatgtgtcacgcagctcttaaaagacacatgctttgagggaggagacatcaccaccgtgttcactcccagcgcgaaatactgccaggtcgtatgcacataccacccaagatgtctcctgttcactttcaccgccgagtccccttctgaggatcccacccgctggtttacctgcgttctcaaggatagtgtcactgaaaccctgccgagggtgaacaggacagctgccatcagcgggtatagttttaagcaatgtagtcaccaaatctctgcatgcaataaggatatctacgtcgatctggacatgaaaggtattaactataattcgagtgtcgctaagagcgcacaggagtgccaggagagatgcactgacgacgttcattgccatttctttacctacgcaactagacagttcccgtctctcgagcaccgcaatatatgcctgctgaaacatacgcagacaggtacgcctacccgtatcaccaaactagacaaggttgtctccggcttctcactgaaatcatgcgccctgtcgaacctggcctgtatacgtgatattttccccaacacagtgtttgcagactctaacattgactccgttatggcacctgatgcattcgtgtgtggcaggatctgcacccaccacccgggctgcctattctttacctttttttcccaggagtggcctaaggagagccagcgaaacctgtgcttactgaaaacgagcgagtcagggttgccctccacccggatcaagaagtccaaagccctttccggattctctttacagagctgcagacacagcatccccgtcttttgccattcttctttttatcatgataccgacttccttggcgaggagctcgacatcgtggcagctaagtcacatgaggcctgccagaaactgtgtactaatgcagttaggtgtcagtttttcacctacacgcccgcccaggcatcttgtaacgaaggcaaaggaaagtgttatctgaagctctccagcaatgggagtcccactaagattttgcatgggaggggtgggattagtggttacacattgcggctgtgtaagatggataatgaatgcaccacaaagattaagccccgcatcgtaggggggaccgcaagcgtacgaggagaatggccatggcaggtgaccctccacaccaccagtcccacccagaggcatctatgtggcggaagcataattggtaatcagtggatcctgacggccgcccactgcttctacggggttgagtctccaaagattctccgcgtgtacagcggcatcctcaatcagtctgagattaaggaagataccagtttctttggagtgcaggagatcataatccacgatcagtacaagatggccgagagcggatatgacattgcattgttaaagctggagactactgtcaattatacagacagtcaacgacccatttgcctgccaagtaaaggcgatagaaatgtgatatacactgactgttgggtgactgggtggggatacaggaaactgcgggacaaaatccagaacaccctgcagaaggcaaaaattcccctagtgaccaatgaagagtgtcagaaaaggtatcgagggcacaagatcacccacaaaatgatttgcgctggctatagagaaggcgggaaagacgcatgcaagggtgacagtggaggacccctaagctgtaagcacaatgaggtctggcatcttgtgggaatcacatcctggggcgagggctgtgcacagcgggagaggcccggagtatacacgaatgtggtagagtacgttgattggatcttggagaagactcaggcggtg

SEQ ID NO: 9408 - DNA, 1875 bp, Artificial Sequence
  Description of Artificial Sequence: Synthetic coding sequence
atgatctttttgtaccaagtcgtccacttcatcctttttacatctgtatccggagagtgcgtgactcagcttctgaaagatacctgttttgaaggcggggacatcaccaccgtgttcacgccatcagcaaaatattgtcaagtggtctgtacgtaccacccaaggtgcttgctttttaccttcacagctgagtctcccagcgaggatcctacccgctggtttacctgtgttctaaaggatagtgttactgaaacgttaccccgggtcaatcggacagcagccatttcgggatatagcttcaaacagtgctctcatcaaatttcagcgtgcaacaaggacatctacgtagatctcgacatgaaaggcattaattataactcctcagtcgcaaagtctgcccaagaatgccaggagcggtgcactgacgacgtgcactgccatttttttacctacgcaactagacagttcccgtctctggaacaccgaaatatttgtctgttgaagcatacccaaaccggcactcccactcgcatcaccaaacttgataaagtcgtgtctgggttcagccttaagtcatgtgccctaagcaaccttgcttgtatccgggacatcttccctaacaccgtctttgcggacagtaacattgacagtgtgatggcccctgacgctttcgtgtgcggtcgcatatgtactcaccaccccggatgtctgttcttcactttcttctctcaggaatggcctaaagagtctcagagaaacctttgcctgctaaagactagcgaatctggcctgccctccacacggatcaagaagtcaaaggccctcagtggctttagcctccagtcatgtcgccacagcattccagtgttttgtcactccagcttttaccatgataccgactttttgggggaagaattagacattgtggcggcaaagagccatgaagcctgccagaagctttgtacgaacgccgtgaggtgccaatttttcacgtatactcctgcgcaggcgtcttgcaatgaaggaaaaggcaaatgctatctcaaactgtctagtaacggatcacctactaaaattcttcacggtcggggcggaataagtggctacaccttgcgtttgtgtaagatggataatgagtgcacgaccaaaatcaagcctcgaatcgtgggcgggacggccagcgtgaggggcgagtggccctggcaagtgactctgcacacaacgtcgcccacccaacgccacctctgtggtggatccattatagggaaccagtggattttaacggctgcgcattgcttttatggggtcgagtctcctaagatactgcgggtgtactcaggcattttgaatcagtcggagattaaagaggacacgtcattcttcggcgtccaggaaatcatcattcatgaccagtacaagatggcagagtccggttacgatatcgcactcctgaagctggaaaccaccgttaattacactgacagccagaggccaatttgcctgcctagtaagggggatcggaatgtgatctacactgattgctgggttaccggatggggttacaggaaactccgggataaaatccaaaataccctgcaaaaagccaagatccccttggtgacaaacgaagagtgccaaaagcggtatcgcggacataagatcactcacaaaatgatctgcgcagggtaccgggagggtggaaaagacgcttgtaaaggggacagcggcggtcctctgagctgcaagcataacgaagtgtggcatctggttgggattacaagttggggcgaaggctgtgcccaacgagagcgtccaggagtgtacactaatgtagtcgagtacgttgattggattttggagaagacccaggctgtg

SEQ ID NO: 9409 - DNA, 1875 bp, Artificial Sequence
  Description of Artificial Sequence: Synthetic coding sequence
atgatcttcctgtaccaggtggtccactttatcctttttacttcggtgtccggggaatgcgtcacccaactgctcaaagacacctgttttgagggaggagatattaccactgtctttaccccgagcgcaaaatactgccaagtggtgtgtacttaccaccctcgctgccttctttttacctttaccgccgaaagcccttccgaggatccaaccagatggtttacgtgtgtgcttaaggactcggtgacggagactctgcctcgagtgaacagaacggccgccatctcgggatacagctttaagcaatgttcgcatcaaatcagcgcatgcaacaaagatatctatgtggacctcgatatgaagggcatcaactataactcctctgtggccaagtcagcgcaggagtgtcaggaacggtgcactgacgatgtgcactgtcatttcttcacttacgcgactagacaatttccctcgcttgagcatcgcaacatttgtttgctgaagcacacccagaccggaactcccacgcgtattactaaacttgacaaggtcgtgtccggctttagcctcaaatcgtgtgctctgtccaatcttgcatgtattagagacattttccctaataccgtgttcgcagactccaacatagatagcgtcatggccccggatgcctttgtctgtggacgcatttgtacgcatcatcccggttgtctgtttttcacctttttctcgcaggagtggcccaaggagtcgcaaagaaatctttgtctgcttaagacgtcggaatcgggtctgccttcgactcgcattaagaagtcaaaggccctctcgggattttcgcttcagagctgcaggcattcgatccctgtgttttgtcattcatccttctaccacgacactgacttccttggcgaagaactggatattgtggccgcaaaatcacatgaagcgtgtcagaagctgtgtaccaacgccgtcagatgtcaattctttacctacactcctgcacaagcatcctgtaacgaaggaaagggaaagtgttaccttaagctctcttcaaacgggtcaccaacgaagatacttcacggacgcggagggatatccgggtacactttgagactgtgtaagatggataacgaatgcaccaccaagatcaagcccagaattgtgggaggtactgcatcagtaagaggcgagtggccatggcaggtgaccctgcacaccactagccctactcagcgacacctgtgcggtggatcaataatcgggaaccaatggatcctcaccgctgcccactgtttctatggggttgagtcacctaagatactgagagtctacagcggcatcctcaaccagtctgaaatcaaggaagatacttccttcttcggggtgcaggaaatcatcattcatgaccaatacaagatggctgaatccggatatgacatcgcactgctcaaactggaaacgaccgtgaactataccgattcgcaacggccaatatgccttcccagcaagggggatagaaacgtcatctacactgattgttgggtgaccggctgggggtacaggaaacttcgggataagatacagaatactctgcagaaggccaaaattcccctggtgaccaatgaagagtgccaaaaacgataccggggacataagatcacgcataagatgatttgcgcaggttacagagagggtggcaaagatgcttgtaagggagacagtggcgggccactgtcgtgtaaacataacgaggtctggcatctcgtcggtattacttcctggggcgagggttgtgcacagcgtgaacgtccaggcgtgtacacgaacgttgtggaatacgtagattggatcctcgaaaagacccaggccgtg

SEQ ID NO: 9410 - DNA, 1875 bp, Artificial Sequence
  Description of Artificial Sequence: Synthetic coding sequence
atgatttttctgtaccaggtggtgcactttattctttttacttccgtgagcggagaatgtgtgacccagcttctgaaagatacctgtttcgagggtggagatatcaccactgtgttcacgccgtcggcaaagtactgtcaagtggtgtgtacgtaccatccgcggtgccttctgtttacctttaccgccgaaagccctagcgaggatccaaccaggtggttcacctgcgtgctcaaggattccgtgaccgaaaccctgccacgcgtgaaccgcactgcagcaatctcgggttattcctttaagcagtgcagccatcaaatttcagcatgtaacaaagacatttacgtcgacttggatatgaaggggatcaactacaatagctccgttgccaagagcgcacaggagtgtcaggaaagatgtacggatgatgtgcattgtcacttcttcacctatgccactcgccagtttccttcccttgaacataggaacatttgcctgctgaagcatacccagaccggtaccccaactcggatcaccaagctcgacaaggtcgtctcaggatttagcctcaagagctgcgcactctcgaacctcgcctgcattagagacatattcccgaacaccgtctttgcagattcaaacatcgactcagtcatggcacctgacgcattcgtgtgtggacgcatttgtacccatcaccctggatgcctgtttttcacctttttcagccaagaatggccaaaggaatctcaacggaatctgtgccttcttaaaacctcggaatccggcctcccgtcgacccggattaagaagtcgaaggcgctgtcgggtttctcccttcagtcctgtcggcactctattcccgtgttttgccactcatcattttaccatgacaccgattttctgggagaagaactcgacattgtggctgccaaatcacacgaagcatgtcagaaactctgtaccaatgccgtgcgctgccagttctttacgtacaccccagcacaggcatcatgtaacgaaggaaagggcaaatgttaccttaagctgtccagcaatggctcccctaccaagattcttcatggaagagggggcatttccggttacacgttgagactttgtaagatggataatgagtgcactaccaagattaaacccagaatagtgggtggtacggcatcggtgagaggggaatggccatggcaagtcacccttcacactaccagcccgacgcagcgacatctttgcggtggctcgattattgggaaccagtggattctcacggcggcacactgcttttacggggtcgaatccccaaagattcttcgcgtgtactcgggtattttgaaccaatcggagatcaaggaagatacttccttttttggggtgcaagagattatcatccacgaccagtacaagatggcggaaagcgggtacgatattgctcttcttaagctggaaacgaccgtcaactacaccgattcacaaagaccaatatgccttccatcgaagggagacaggaacgtgatttacactgactgttgggtgactggatggggatacagaaagctcagagacaagattcagaatactctgcagaaggcgaaaatacccctcgtgactaacgaagaatgccaaaaaagatacagaggtcacaagatcacccacaaaatgatttgcgccggctaccgagaagggggcaaggacgcatgcaaaggggactccggaggacctctttcatgcaagcataatgaagtgtggcaccttgttggaatcacttcgtggggagaaggctgcgcgcaacgagaaagacccggagtctacaccaacgtggtggagtatgtggattggatccttgaaaagacgcaagccgtc

SEQ ID NO: 9411 - DNA, 1875 bp, Artificial Sequence
  Description of Artificial Sequence: Synthetic coding sequence
atgatcttcctgtatcaagtagtgcatttcatcctgttcacttctgttagcggagagtgcgtcacccagctcctcaaggacacgtgcttcgaaggtggcgacatcaccaccgtgttcaccccttcggccaagtactgtcaggtggtgtgcacttaccatccgcggtgtctgctgtttaccttcaccgcagagtccccttcggaggacccgacccgctggttcacttgcgtgttgaaggattccgtgaccgaaaccctgccgcgcgtcaatcggacggcagccatatccgggtacagcttcaagcaatgctcccatcagatctcggcctgcaacaaagacatctacgtggacctcgacatgaagggaatcaactacaattcgtcggtcgcgaagtccgcccaggaatgccaagagcgctgcactgacgatgtgcattgtcacttttttacctacgcgactagacagttcccatcactcgaacataggaatatctgcctcctgaagcacacccagaccggaactcctactcgaatcaccaagctggataaagtggtgtccgggttctcgctcaaatcgtgcgccttgtccaaccttgcgtgcatcagggacatcttccctaacactgtgtttgccgattcaaacatcgacagcgtcatggctccagacgctttcgtgtgcggcagaatctgcacccaccatccgggttgcctcttcttcactttcttctcgcaagagtggccaaaggaaagccaacgcaacctgtgcctgctcaagacctccgagagcggcctgccgagtactagaatcaaaaaatcgaaggcactgtcaggcttttcactccaatcatgtaggcactccatccccgtgttttgtcactcatccttctaccatgacaccgacttcctcggagaagagcttgacattgtcgcagctaagagccacgaagcctgccaaaagctgtgtactaacgcggtcagatgccagtttttcacttacaccccagcacaagcctcctgcaacgagggaaaaggcaagtgctaccttaagttgagctcgaatggaagcccgactaaaatcttgcatggacgcggcggtatctcgggttatacgctgcgcctctgcaagatggataacgaatgcaccactaagattaaaccccgcatcgtcggcgggaccgcgtcagtccgtggggagtggccttggcaggtgactctgcatactacttccccgacccagcgccacctctgtggcggatcgattatcggaaaccagtggatcctgactgccgcccactgcttctacggagtggagagcccgaagatcctgcgggtgtactctggaatccttaatcagtcggagatcaaggaagataccagcttctttggtgttcaggagattatcatccacgaccagtacaagatggctgagagcgggtacgatatcgcgttgctgaaactggaaaccaccgtcaattacactgattcacaaagaccgatttgtctcccatccaagggcgatcgaaacgtgatttacaccgactgttgggtcacgggatggggataccggaagctgcgggacaaaatccagaacactctgcagaaggctaagatcccgctggtcactaatgaagagtgccaaaaaagatatcggggccacaagattacgcacaaaatgatctgcgccggataccgggaaggagggaaggatgcgtgcaaaggggattccggaggccccctgtcatgcaagcacaatgaagtgtggcaccttgtgggaattacctcgtggggagaaggatgtgcacagcgggaacgcccaggagtttacactaacgtggtggaatacgtggactggatcctggaaaagacgcaggccgtg

SEQ ID NO: 9412 - DNA, 1875 bp, Artificial Sequence
  Description of Artificial Sequence: Synthetic coding sequence
atgatttttctgtaccaagtggtgcatttcatcttgttcacgtcggtttccggagagtgcgtcactcagctcctgaaagacacgtgcttcgaaggcggagatatcactacggtgttcaccccttcagcgaagtactgccaggtcgtttgtacttaccatccacgctgcctgcttttcacctttactgccgaaagcccgtcggaagatcctactcggtggtttacttgcgtcctcaaagactctgtgactgagactctgccgcgcgtgaatagaaccgcagcaatttccggctactcgtttaagcaatgttcgcatcaaatctccgcttgcaacaaagatatctacgtggatctggatatgaagggcatcaactacaattcgtcagtcgcaaagtcagcgcaggagtgccaggagcggtgcactgacgacgttcactgccatttcttcacttacgcgacccggcagtttcccagtctggagcaccgcaacatttgcctgctcaaacacacccaaactggtaccccgaccaggatcaccaagctcgacaaggtcgtgtcgggtttttctctgaagtcctgtgcactcagcaacctggcatgcattcgcgacatcttcccgaacaccgtattcgccgactccaacatcgactcggtgatggcgccagacgcatttgtgtgcggacggatctgcactcatcacccggggtgtctgttctttactttcttctcgcaggaatggccgaaggaaagccagcggaacctgtgtctgttgaaaaccagcgaatccgggttgccgtcgacgcgcatcaaaaagtccaaggcactgtcgggattctccctgcaaagctgcaggcattccatcccggtgttctgccactcctccttctatcatgataccgattttctgggcgaagagttggatatcgtcgccgcgaagtcgcacgaagcgtgccagaagctgtgcaccaatgcggtgagatgtcaattcttcacttatactcctgcacaagcgtcatgcaatgaaggaaagggcaaatgctatctgaagctctcctccaatgggagtccaaccaagatcctgcatggccggggtggcatttccggatataccttgagactgtgcaaaatggacaatgaatgcaccactaagataaagccgaggatcgtgggaggaaccgcgtcggtgcggggagagtggccatggcaggtgactctgcatactacgtcgccgacccagaggcacttgtgtggagggtccattattgggaatcagtggatcctcacggcagctcattgcttctacggcgtggaatcaccgaagatcctgagagtgtacagcggaatcctgaaccaatcggagatcaaagaagatacgagctttttcggtgtccaagagattatcatccacgaccagtacaagatggctgaatccggatacgacatcgcgcttctcaagctggagactactgtgaactatactgactcgcaaagaccgatctgcctgcccagcaaaggggacagaaatgtgatctacaccgactgctgggtgactggctggggatacagaaagctgcgggataagatccagaacacgctccaaaaggccaagatccctttggtgactaatgaagaatgtcagaaacgataccggggacacaaaatcactcacaagatgatctgcgccggataccgggagggagggaaggacgcgtgcaagggcgattcggggggacctctgtcctgcaagcacaacgaggtgtggcacctcgtgggcatcacttcatggggagagggatgcgcccagagggaacgccccggggtttacacgaatgtggtggaatacgtggactggatcctcgagaaaactcaggccgtc

SEQ ID NO: 9413 - DNA, 1875 bp, Artificial Sequence
  Description of Artificial Sequence: Synthetic coding sequence
atgattttcctgtatcaagttgtccacttcatcctcttcacgtcagtgtcaggcgaatgcgtgacccagctgctcaaagacacgtgctttgaaggaggggacatcaccactgtattcacgccttccgcgaagtactgccaggtcgtgtgcacctaccaccctcggtgcctgcttttcaccttcactgccgagagcccctccgaggatccgacgcgctggtttacttgcgtgctgaaagactcggtgacggaaaccctgcctagagtgaaccgcaccgcggctatctcgggttattccttcaagcagtgctcgcatcagatcagcgcctgcaacaaggatatctacgtcgatctggacatgaaaggaatcaactacaactcatccgtcgcaaagtcggcccaggaatgccaggaacggtgtaccgacgatgtgcattgtcatttcttcacctacgcgaccagacagttcccatctctcgaacaccggaacatctgcctgctcaaacacactcaaaccggtactccaacgagaatcacgaaactggacaaggtcgtctcaggctttagcctcaagtcatgtgccctgagcaatctggcttgcattcgggatatcttcccaaatacggtgttcgctgattcgaatatcgattccgtgatggcaccggacgcatttgtttgcggaagaatctgtactcatcacccggggtgcctgtttttcactttcttcagccaggaatggccaaaggaatcccaaagaaatctctgcttgcttaaaacttccgaatcgggcctgcccagcaccagaatcaaaaagtcgaaggcattgtcgggcttttcactgcagtcgtgtagacattcaatccccgtgttttgccattcatcgttctaccacgacacggacttcttgggagaggaactggacatcgtcgctgccaagtcgcacgaggcttgtcagaagctgtgcaccaatgctgtccggtgtcagtttttcacctacaccccggctcaagcaagctgcaatgagggcaagggaaaatgttacttgaagctgtcctcaaacggatctccgactaagatcttgcatggaaggggaggaatctccggttacaccctgcggctctgtaaaatggataacgagtgcaccaccaagatcaagccgcggatcgtgggaggcactgcgagcgtgcggggagaatggccttggcaggtgaccctgcataccacgtctccgactcagagacacctttgcggcggctcgatcatcggtaatcaatggattttgactgccgcgcattgcttttacggagtggagtcccctaagattctgagagtgtacagcggtatcctcaaccagtcggaaatcaaggaggacacgtcatttttcggggtccaggagatcatcattcacgaccaatacaagatggcagagagcggctatgacatcgcactgctcaagttggaaactaccgtgaactacacggattcacaacgccccatctgcttgccgtcgaaaggagatcggaacgtgatctacaccgactgttgggtgaccggatggggctaccggaaattgcgcgacaaaatccaaaacacgctgcaaaaggccaaaatccctctcgtgactaatgaagagtgccaaaagcgctatcgcggacacaagattacccataagatgatctgcgccggataccgcgaagggggaaaggacgcctgcaagggagattccggaggacctttgtcctgcaaacacaatgaagtgtggcacctggttggaatcacttcgtggggagaaggatgcgcccaaagagaacgcccaggcgtgtacaccaacgtggtggagtacgtcgattggattctcgaaaagactcaggcagtg

SEQ ID NO: 9414 - DNA, 1875 bp, Artificial Sequence
  Description of Artificial Sequence: Synthetic coding sequence
atgatttttctctaccaagtagttcacttcattcttttcactagcgtgtcaggtgaatgcgtcactcaactcttgaaagatacatgctttgaaggtggtgatattacaacagtttttaccccatccgcaaagtactgccaagtggtgtgtacatatcaccctagatgccttctttttacattcacagctgagtctccgtctgaggatcctaccagatggttcacatgtgtgctcaaggatagtgtgactgaaaccctccccagagttaacagaaccgcagctatcagtggttattcgtttaagcaatgctcccatcaaatttctgcatgcaacaaggatatctatgtcgatcttgatatgaaggggataaattataactcttctgttgccaagtcggctcaagagtgccaagagcgctgtactgatgatgttcattgccattttttcacatacgctactcgtcagtttccgtctcttgagcatcgtaatatttgtttgcttaagcatacgcaaacaggaactccaactaggattactaaactagacaaagtggtatcgggattttcactcaagtcttgtgcattatccaaccttgcgtgtattcgtgacattttccctaatacggtttttgccgattctaatatagattccgtcatggctccggatgcctttgtgtgtgggaggatttgcacccaccacccaggttgtctttttttcacttttttcagtcaagagtggcctaaggaatctcagcgcaatctatgcttactcaaaacctcggaatcgggtctcccatcaacccgaattaaaaagagcaaagcattgagcggtttttccttgcagtcatgcaggcattcaatccccgttttctgtcacagctcattctaccacgatacagattttctcggggaagaactcgacattgtggcagctaaatcgcatgaagcctgccaaaagttgtgcactaatgccgtccggtgtcaattcttcacctatacccctgctcaagccagctgcaatgagggtaaggggaaatgttatctcaaactatcttcaaatggttcaccaacaaagattttacacggccgaggcggaatctccggttacactcttcggctctgcaaaatggacaatgaatgtacgactaagattaagcctcggatagtaggcggaaccgcctcggttaggggcgagtggccctggcaagttacgcttcatactacaagtcctactcagcgccacctttgcggcgggtctatcattggtaaccagtggatacttaccgccgctcattgcttttacggtgttgagagtccgaaaatccttcgtgtatatagcggaatattaaatcaatcagagatcaaggaggacacctccttctttggcgttcaagagatcatcattcacgatcaatataagatggctgaatccggttacgatatcgctcttttaaagcttgagactacagttaattatacagactcacaacgacctatctgccttccatctaaaggcgataggaacgtgatttatactgattgctgggtcacagggtgggggtatcgcaagcttagagataagatccaaaacactttgcaaaaggctaagatcccacttgttaccaacgaggaatgccaaaaaagatatcgaggtcataaaatcacgcataagatgatttgcgccggttatcgtgaaggtgggaaagatgcatgcaagggagattcgggaggtcccctttcttgtaagcacaatgaggtgtggcatcttgttgggattactagttggggggaaggttgcgctcaaagagagaggccaggtgtgtatacgaacgttgttgaatacgtggattggattctcgaaaaaactcaagccgtt

SEQ ID NO: 9415 - DNA, 1875 bp, Artificial Sequence
  Description of Artificial Sequence: Synthetic coding sequence
atgatctttctctaccaggtggtgcacttcatcctgttcacctcggtgtcaggggagtgcgtgacccagcttctcaaggatacgtgcttcgaaggcggagacatcaccaccgttttcaccccatccgccaagtactgccaggtggtctgcacgtaccatccgagatgcctgttgtttaccttcaccgccgaatcgccgtccgaagatccgactaggtggttcacctgtgtgctcaaagattcagtcaccgaaactctcccgcgcgtgaaccgaacggcggccatctcgggttactcgttcaaacagtgttcccaccagatttcagcgtgcaataaagacatctacgtcgacctggatatgaaggggatcaattacaactccagcgttgccaagtcggcgcaggaatgccaggaacggtgcactgacgacgtgcattgccacttcttcacgtacgccacccgtcagttcccgtcgctggaacataggaatatctgcttgttgaaacatacccagaccggaaccccgacccggatcaccaagctggataaagtggtgtcgggattctcgctgaagagctgtgccctctcgaacctggcgtgcatccgggacatctttccgaacaccgtctttgccgatagcaatatcgacagcgtgatggcgcccgacgccttcgtgtgtggacggatttgcacccaccacccaggctgcctgtttttcacgttcttttcgcaagaatggccgaaagaatcccagcgcaatctgtgcctcctcaagactagcgagtcaggattgccatcaacccgcatcaagaagtcgaaagcactctcgggattttccctgcagtcatgccggcactcaattccagtgttctgccattcatcattttaccacgacaccgatttcctcggagaagaactggacatcgtcgcggcgaagtcccatgaagcctgtcaaaaactgtgcactaacgcggtgcggtgtcagtttttcacttataccccggcccaagcctcgtgcaacgagggaaagggaaagtgctacctcaagctgtcatccaatggctccccaaccaagatcctgcacggtcgcggaggaatctcgggctacacgctccgcctgtgtaagatggacaacgaatgtactaccaaaatcaagccaagaatcgtcggaggaaccgcctccgtgagaggagaatggccgtggcaagtgacgctgcatactacttcacctacccaacggcatctctgtggaggatcgatcatcggaaatcagtggatcctgacggccgcccattgcttctacggggttgaatccccgaagattctccgcgtctactccgggatccttaatcagtctgagatcaaagaggatactagcttcttcggggtgcaggaaatcatcattcacgaccaatacaagatggctgagtccggctatgatatcgcactgctgaagctcgagactactgtgaactacaccgactcacaacggccaatctgtctgccttcaaagggcgacagaaacgtgatctacaccgattgctgggtcaccggctggggatataggaagctgcgggacaagatccagaatactctgcagaaggcaaagatacctctggtgactaatgaggagtgtcaaaaacgctaccgcggtcataagattactcacaagatgatctgcgcgggttacagggaaggaggaaaggatgcctgcaagggcgatagcggaggaccgttgtcctgcaagcacaatgaagtttggcatctggtcggaatcacgtcgtggggagagggttgcgcgcagagggagcgcccgggagtgtacaccaacgtcgtcgaatacgtggattggatcctggaaaagactcaggcagtg

SEQ ID NO: 9416 - DNA, 1875 bp, Artificial Sequence
  Description of Artificial Sequence: Synthetic coding sequence
atgatttttttgtaccaggtggtgcacttcatccttttcacatccgtgtccggcgaatgtgtgactcagctccttaaggacacctgtttcgaaggcggtgacatcaccaccgtgttcactccctccgctaagtattgccaggtggtgtgcacttaccacccccgctgtctactctttacatttaccgcagagagccctagtgaggatcccacgcgctggttcacatgtgttctaaaagatagcgtgacagaaacactgccacgcgtgaatcgtactgccgcaatctctggctattcattcaaacagtgctctcatcagattagtgcatgtaataaagacatatacgtagacctggatatgaaggggattaactataacagtagcgtggctaaatccgcgcaagagtgccaggaacggtgtacagacgatgtgcattgtcatttttttacctatgctactaggcagttccctagccttgaacaccgcaatatctgtcttttaaagcacactcagaccgggacaccgactcgaattaccaagctggacaaggtcgtgtctggtttcagtctcaaatcctgcgcactgtctaacctggcttgcatacgggatatctttcccaatactgtgttcgcggactcaaatatcgattccgtgatggcacctgatgctttcgtttgcgggcgaatttgcacccatcatccgggctgtctctttttcacattttttagtcaggagtggccaaaggagagccagaggaatctttgtctactgaagacttcagaatcaggtttgccttctactcgcatcaagaagagcaaggcactttccggcttctccttgcagagctgcaggcattcgattccagtattctgtcattccagcttttatcacgacacagacttcttaggagaggagctcgatatcgttgctgctaagtcacacgaggcttgccaaaaattgtgcaccaacgcggtcaggtgtcagttcttcacctatacacctgcacaggcaagctgtaacgagggcaaggggaagtgttacttgaagttgtcatccaacggtagcccgaccaagattctgcatggtagaggtggcatcagcgggtacactctccgcttatgcaagatggataatgagtgtacaaccaagattaagccacgcatcgtcggaggtaccgcttcagtaagaggggaatggccatggcaagtgacccttcacaccacttcacccacacagaggcatctgtgcggcggctcaataatagggaaccagtggattctgacggccgcgcactgcttctatggcgtggagtcccccaagattctacgcgtttattccgggattttgaaccagagtgagatcaaggaggatacaagcttttttggtgtccaggagatcataatccatgaccagtacaaaatggccgagagcggctacgatatagccctattaaaattggagacaacagtgaactacacagacagccagcggccaatttgcctgcccagtaagggagaccgcaatgtgatctacacagactgttgggtcaccggttggggctataggaaactacgcgacaagatccagaacacacttcagaaagcaaagatccctctggtgaccaatgaggaatgtcagaaaagataccggggccataagattacacataaaatgatctgcgctggctaccgggaagggggaaaggacgcctgcaaaggtgattcaggagggcctctgagttgtaagcacaacgaagtgtggcacctggtaggaattaccagctggggtgagggctgcgcccagcgggagagaccgggggtctatacaaatgtggtcgagtacgtagactggatcctagagaagacccaagcagta

SEQ ID NO: 9417 - DNA, 1875 bp, Artificial Sequence
  Description of Artificial Sequence: Synthetic coding sequence
atgatttttctgtaccaagttgtgcactttattctttttacttcagtgtcgggagaatgcgttacccagcttctgaaggatacctgttttgaaggcggagacatcaccaccgtgttcactccttcggctaagtactgtcaagtggtgtgtacctaccatccgcgctgccttctctttacctttactgcagaatctccttcagaggatccaacccgatggttcacctgtgtcctgaaggactccgtgaccgaaactctgccccgcgtgaatcgcactgccgcaatctcgggatacagctttaaacaatgttcccatcagataagcgcatgcaataaggacatttacgtggatcttgatatgaaaggcattaactacaattcctccgtggcaaaatccgcccaagaatgccaggaacgctgtaccgatgatgtgcattgtcacttctttacctatgcaactcggcaatttccttcgcttgagcatcgaaacatttgtctgctgaaacatactcaaaccggaacccctactcggattactaaattggataaggtggtgtcagggttctcgctgaagtcgtgtgctttgtccaacctggcatgtattagagacatttttccgaacactgtgttcgcggactcgaacatcgattccgtgatggccccggacgcgtttgtttgtggaagaatttgcactcaccaccctggttgtctcttcttcactttcttctcacaggagtggcccaaagaatcccagcggaacctctgtctgcttaagacgtcagaatccggtctgccttcgaccagaatcaagaagagcaaagcattgtcaggctttagcctccagtcctgtaggcattcaattccagtgttctgccacagcagcttttaccatgatacggactttcttggagaggagctggatatcgtggccgccaagagccatgaggcctgccaaaaactgtgcactaacgcggtccggtgccagtttttcacctatacccctgcacaggcaagctgtaacgaagggaaagggaagtgctaccttaagctgagctcgaatggatcccctacgaagatactgcatggacgcggtggcatctcaggctacaccctgcgtctgtgtaagatggacaatgagtgtactaccaagatcaagccacgaatcgtcggtggcactgcatccgttcggggcgaatggccatggcaagtgacccttcataccacgtcgcctacccagcggcacctgtgcggaggcagtatcattgggaatcagtggatattgacggcagcacactgcttttacggagtggagtcccccaagattctccgcgtatattctggcatcctgaaccaaagcgagattaaagaagatacttcgttttttggtgtgcaagagattatcatccacgaccaatacaagatggctgagtcgggttacgatatcgccctccttaaactggaaactaccgtgaattacaccgacagccagcgcccgatttgcctgccttctaaaggtgacagaaacgtgatctacactgattgttgggtgactgggtggggctacagaaaacttagagataagattcaaaatactctgcagaaggcaaagattcctcttgtcactaatgaagagtgccagaagcggtaccgggggcacaagatcacccacaagatgatttgtgccggttatagagaaggaggaaaggacgcatgtaaaggagactccggaggaccactgtcctgcaagcataatgaagtctggcatctggtgggtataacctcctggggagaaggatgcgcccaaagagaacgcccgggagtgtacaccaacgtagtggagtacgtggactggatccttgagaaaacccaggccgtc

SEQ ID NO: 9418 - DNA, 1875 bp, Artificial Sequence
  Description of Artificial Sequence: Synthetic coding sequence
atgatttttctgtaccaggtggtacacttcattttgtttacctcagtgagtggcgaatgcgtaacccagctccttaaagacacctgtttcgagggtggagatatcacgacagtcttcaccccgtcagccaagtactgccaggtggtctgtacctaccaccccagatgtctgctgtttacgttcacagctgaaagccccagcgaggacccaactcggtggttcacatgcgttctgaaagactctgtgacagagaccctgccacgcgtcaacagaacagcggcaatcagcggctacagttttaagcagtgctcacaccagatctccgcctgtaacaaggacatttacgtggatctggacatgaaaggaataaactacaattcatccgttgccaagtctgcccaggagtgtcaagagaggtgcacagatgatgtccactgccacttttttacctatgctacacgccagtttccctccttagaacataggaatatttgcctgttgaaacatactcagaccgggactccaaccagaatcaccaagctggacaaggtggtgtcaggtttttccttgaagtcgtgcgccctcagcaacctagcttgcatccgggacatttttcctaacacagtgttcgccgactcgaatatagactcggtgatggcccccgacgctttcgtctgtggccgaatctgcactcaccatccgggttgcttgttcttcactttcttttcccaagagtggccaaaggaatcacagcgcaatctgtgtttgctgaagaccagcgagagcgggctgccttccaccaggattaagaagagtaaagccctgtccggtttctcgttacaaagttgtagacattccataccggtgttctgccattcatcattttaccacgacactgattttcttggtgaggagctggacatcgtcgctgccaaatcccatgaggcttgtcaaaaactgtgtacaaatgccgtccgttgccaattctttacctacacacccgcgcaggcatcgtgcaatgagggcaaggggaagtgctacttaaagctgtccagcaatgggtctcccaccaaaatcctccatggtcgcggaggaatctccggctatacgttgagattgtgcaagatggataacgagtgcactaccaagattaagccccgtatcgtcggcggtacagccagcgtaagaggcgagtggccctggcaggttactctgcatactacctctcctacccagcggcatctgtgtggcggatccataataggtaatcagtggatactgaccgccgctcactgcttttacggcgtggaatcccctaagattctgagagtctacagcgggatcctgaatcaaagcgagatcaaggaggacaccagtttctttggggtgcaggaaataattatccacgatcaatataagatggctgaatccggctatgacatcgccttgctgaaactggagaccacagtcaattataccgacagccagaggcccatctgcctgccatctaagggggaccgcaacgtgatttacactgattgttgggtgaccggttggggttatcgtaaactccgcgacaagatccagaataccctccagaaggccaaaatcccgctggtgacaaatgaggaatgtcagaagcggtacagaggccataaaattacacataagatgatctgtgcaggttaccgcgagggcggcaaagacgcttgtaagggggattccggaggaccactgtcctgcaagcacaacgaggtgtggcaccttgtcggaattaccagctggggggaggggtgcgcccagcgcgagaggcccggcgtctacactaacgtggtggagtacgtcgactggatactggagaagacgcaagccgtt

SEQ ID NO: 9419 - DNA, 1875 bp, Artificial Sequence
  Description of Artificial Sequence: Synthetic coding sequence
atgatctttctgtaccaagtggtccatttcattctttttacctcagtgtcgggtgagtgcgtcacccaactccttaaggatacctgtttcgaaggaggagatataaccactgtgttcaccccctcagcaaagtactgtcaagtggtgtgtacctaccatccccggtgcctgctttttacgttcactgcagaatcacccagcgaggacccaacccgctggtttacctgcgtgctcaaggattccgtcacggaaactcttcctagagtcaatagaactgcagcaatttccgggtactcgttcaaacaatgttctcaccagatctccgcatgcaacaaggatatctacgtggacctggacatgaagggaatcaactataactcctctgtggcaaagtccgcccaagaatgtcaagaacgatgcactgacgatgtgcactgccatttctttacttacgctactaggcagttcccatcactcgagcatcgcaacatatgtctgctgaaacacacccaaaccgggacccctacgagaattactaagttggataaggtggtgtcaggattcagcctgaagagctgcgctctctccaatctggcgtgcataagggacatatttcccaacactgtctttgcagattccaacatcgattccgtgatggcccctgacgcctttgtgtgtggccgcatttgcactcaccatccaggttgtctgtttttcacctttttctcgcaagaatggcctaaggaatcacaaagaaacctgtgcttgcttaagacctccgaatcgggactgccatcaaccagaataaagaagtccaaggctctctcgggattctcgctccaatcgtgtaggcactctatccccgtgttttgtcatagctccttttatcacgacactgacttcctgggtgaagagcttgatatcgtcgcagcaaagtcccatgaggcatgccagaagctctgtactaacgccgtgcggtgccaattctttacgtacaccccagcacaggcatcatgcaatgaagggaaggggaagtgttacctcaagttgtcatcgaacgggtcaccaactaagattctgcacggcaggggtgggatttccggctacactctccggctgtgtaagatggataacgaatgcaccactaagattaaaccgagaattgtgggaggcactgcctcggtcaggggtgaatggccatggcaagtgaccctgcataccacttcgcctacgcagcgacatctttgtggaggctccataattggtaaccaatggatccttactgcagcacattgtttctacggggttgaatcacctaagattctccgtgtgtactcgggtatccttaaccaatctgaaatcaaggaggacacctcgttctttggagtgcaggagatcataatccatgaccagtacaaaatggcagaaagcggttatgacattgccttgctgaagctcgaaaccaccgtgaactacactgacagccaaagaccaatctgtctgccatcgaagggagatcgaaatgtcatttacactgactgttgggtcactggatggggataccgcaagctgagagataagatccaaaatacgctgcagaaagccaagatcccacttgtgaccaacgaagagtgtcagaaaagataccgtggtcataagataacccacaagatgatttgtgcaggttaccgggaaggtgggaaggatgcatgcaagggggattcgggaggccccctgtcctgtaagcacaacgaggtgtggcacctggtgggtattacctcgtggggagaaggatgcgcacagagggagcgacctggtgtgtacaccaatgtcgttgagtacgtggattggattcttgaaaagacccaagccgtc

SEQ ID NO: 9420 - DNA, 1875 bp, Artificial Sequence
  Description of Artificial Sequence: Synthetic coding sequence
atgatcttcctctaccaagtggtccactttatcctgttcacctctgtctcgggagagtgtgtgacccagctgttgaaggatacttgtttcgagggtggcgacatcacgaccgtgttcactccgtcagcaaagtactgccaggttgtttgcacctatcatccaaggtgtctgctgttcacgttcactgcagaaagcccatcggaggaccctacccgttggttcacctgtgtgctgaaggattcggtgaccgaaaccttgccgagggtgaaccggaccgccgctatttctggatactcgttcaagcagtgcagccaccaaatctccgcttgcaacaaggatatctacgtcgaccttgacatgaaggggatcaattacaattcatcagtggcaaaatctgcccaagaatgccaggaaaggtgtaccgacgacgtgcattgccactttttcacttatgccacccgccagttcccgtcactggaacatcgcaacatctgtcttttgaaacacacccagactggcacgccgacccggatcaccaaactggataaagtcgtgagcggcttctccctgaagtcatgtgctctctccaacttggcctgcatccgcgacatattcccaaacactgtctttgcagattcgaacatcgatagcgtcatggccccggatgcatttgtctgcggcaggatctgcacccaccaccccgggtgtcttttcttcacgttctttagccaagagtggcccaaagaatcgcaaagaaatctgtgtctgctcaagacgtcagagtcggggctgccctcgactagaatcaaaaagtccaaggcgctgtccgggttttccctgcagtcctgccggcattccatccctgtgttctgccactcgagcttctaccatgataccgacttcttgggagaagaactggacattgtggcagccaaaagccatgaggcgtgccaaaagctgtgcactaacgcggtgagatgccagtttttcacctacaccccggcccaggcttcgtgtaacgaaggaaagggcaagtgctaccttaagctcagctccaacggatccccaactaagatcctgcatgggcggggaggaatctcggggtacactctccgactttgcaaaatggacaacgagtgcacgactaagattaagcctagaatcgtgggaggcaccgcgtccgtgcgcggggagtggccgtggcaggtgaccttgcataccacctcaccgacccaacgccacctctgcggaggatcaatcatcggaaaccagtggatcctcactgctgcgcactgcttctacggagtggaatcgccaaaaatcctccgggtgtactctgggatcctgaatcaatcggagataaaggaagataccagctttttcggagtccaagaaatcatcattcatgaccagtacaagatggccgaatcaggttacgacatcgcgctgctgaagctggagactaccgtcaactatactgacagccaacgccctatctgcctcccttctaagggtgaccgcaacgtgatttacactgattgctgggtgacgggatggggatatcggaagttgcgagacaaaatccagaatacccttcagaaggccaaaataccactcgttaccaatgaggaatgccagaagcggtaccggggacacaagatcacgcacaagatgatctgcgctggttacagggaaggtggtaaggacgcatgcaagggcgactcggggggaccattgagctgcaagcacaacgaagtctggcacctggtgggaattacctcgtggggagagggatgtgcccaacgcgagcggccgggagtgtacaccaatgtcgtggagtacgtggactggatcctcgagaaaacgcaggcggtg

SEQ ID NO: 9421 - DNA, 1875 bp, Artificial Sequence; identical to SEQ ID NO: 9416
  Description of Artificial Sequence: Synthetic coding sequence

SEQ ID NO: 9422 - DNA, 1875 bp, Artificial Sequence
  Description of Artificial Sequence: Synthetic coding sequence
atgatctttctctaccaggtggtgcattttatccttttcactagcgtcagtggggaatgcgtgacacagcttctcaaagacacgtgcttcgaaggcggggatatcacaacagtttttacaccctcagccaaatactgtcaggtcgtgtgtacctatcatccgaggtgcttgttgttcacgtttactgccgagtctccgagtgaagatcccacccggtggttcacttgcgtgctgaaagattcagtcaccgagaccctacccagagtgaacaggaccgccgcgatttccggttactcgtttaaacagtgtagccaccagatttctgcatgcaacaaagacatttatgtggatcttgacatgaaggggatcaactacaacagctctgtggccaagagcgcccaggagtgtcaggagcggtgtacggacgatgttcactgccactttttcacatacgcaacacggcagttcccaagcctggaacataggaacatatgtctccttaaacatacacagaccgggaccccaactcgaattactaagctagacaaagttgtctcagggttctcgctaaagagctgcgctcttagcaatttggcttgcatcagggatattttcccaaacaccgtgttcgccgacagtaacatagacagtgtaatggctccagatgctttcgtgtgcggccgtatctgtacccatcaccccgggtgcctgttcttcacatttttcagtcaggagtggccaaaagaatcccagcgtaatctctgtttgctgaaaacttctgagtcgggactgccctctacacgaatcaagaaatctaaagccctgagtggttttagtctgcagtcttgccggcattccattcccgtcttttgccacagttccttttaccatgacacggatttcctgggagaagagttggatattgtggccgctaaatcgcacgaagcatgccagaagctgtgtacgaacgctgtgcggtgccaattttttacctacacccccgcccaggcttcatgcaacgaaggtaaaggaaaatgttacttaaagctgtctagcaacggttctccaacaaagattctgcatggcagaggaggtatcagcgggtacacactccgactgtgtaagatggacaatgagtgtacaaccaagatcaagccacggatcgtcggcgggaccgccagcgttagaggtgagtggccatggcaggtgacactgcacaccacaagcccgacacagcggcatctttgcgggggtagtataatagggaatcaatggattcttacagccgcccattgtttttatggcgtcgagtcccctaaaatcttacgcgtgtactcggggatcctgaaccagtcggagatcaaggaggacacgagcttcttcggagtccaagagataattatacacgaccagtataagatggcggaaagcggttatgatatcgcactgctcaagctggagaccacagttaactatacagatagccagaggccgatttgcctgccaagtaaaggcgatagaaacgtgatttataccgattgttgggtgacaggttggggttataggaaactgcgggacaaaattcagaacactctgcaaaaggctaagatccccctggtgacgaacgaagaatgccagaaacggtacagggggcacaagatcacccataagatgatctgtgctggttaccgcgaaggaggaaaggatgcatgcaagggggacagcggtggtccactctcttgtaagcacaacgaagtctggcatttggtcggcattacttcatggggggagggctgcgcacagcgcgagcgtccgggagtttataccaatgtggtggagtacgtggactggatcctcgagaaaactcaggctgtg

SEQ ID NO: 9423 - DNA, 1875 bp, Artificial Sequence
  Description of Artificial Sequence: Synthetic coding sequence
atgatcttcctttatcaagtcgttcattttatcttgttcacaagcgtctcaggcgagtgcgttacacagctgctcaaagacacttgctttgaaggaggcgatataactaccgtgttcacaccaagcgccaaatactgccaggttgtgtgcacatatcaccccaggtgtctgttgttcacattcactgctgaatcaccatctgaggatcctaccagatggtttacctgtgttctgaaggacagcgtgaccgaaactctgccccgcgtcaatagaactgcagctattagtggttactccttcaagcaatgcagtcaccagattagtgcctgcaacaaggatatttacgtggatcttgacatgaaaggaatcaattataactccagcgtcgctaaatcagcccaggaatgccaggagcgttgtacagacgacgtgcactgtcacttcttcacttatgcaacacgtcaattcccctcactggagcatcgtaacatatgcttgctgaagcatacccagaccggaacaccaaccaggatcaccaaactcgataaagttgtctcaggtttctctctcaagtcttgcgcccttagcaatctggcttgcattagggatattttcccaaatacagtctttgccgatagtaatatcgactcagttatggctccagacgccttcgtgtgcggccgcatctgtacacatcaccccggctgccttttcttcacattcttcagccaggaatggcctaaggaaagtcagaggaacttgtgcctcttgaagacctctgagtccggattgccctctactcgtatcaagaagtcaaaggcattgagcggcttttcattgcagtcctgtagacatagcatcccagttttctgtcacagctccttctatcatgacaccgatttccttggagaggagctcgacattgtcgcagccaagagccatgaggcctgtcaaaaactgtgtaccaacgcagtgagatgtcagtttttcacttacactcctgcacaggcttcatgcaacgaaggtaagggcaagtgttacctcaaactgagcagtaatggctctccaaccaagatcctgcacggtaggggaggaatctcaggatataccctgagactgtgcaaaatggacaacgagtgcactaccaagatcaagccacgtattgtcggaggcaccgccagcgtgcgcggtgaatggccatggcaggttactctgcacaccacctcaccaacacagcgccatttgtgtggtggatctatcattggcaatcagtggattctgactgctgctcactgcttttatggagtggagagtcccaagattctgcgcgtgtactccggaattctcaatcagagcgagatcaaggaggacacctcattttttggcgttcaggagatcatcatccatgatcagtacaagatggccgaatccggttacgacattgcccttcttaaattggagactaccgtgaactacaccgactcccagcgtcctatctgcctcccttccaagggtgatcgtaacgtgatctataccgactgttgggtcacaggatggggataccgtaagctgagggacaagattcagaacactctgcagaaagccaagatccctctggtcacaaacgaagaatgccaaaagcgttaccgcggacataagatcacccacaaaatgatttgtgccggatacagagagggaggaaaggacgcttgtaagggagatagtggcggtccactcagctgcaagcacaacgaagtctggcacctcgtaggaattacatcctggggcgaaggttgcgctcagagggagaggcctggcgtttacaccaatgtcgtggagtacgttgattggattctcgaaaaaactcaggcagtt

SEQ ID NO: 9424 - DNA, 1875 bp, Artificial Sequence
  Description of Artificial Sequence: Synthetic coding sequence
atgatatttttgtatcaggtggttcactttatcttgtttacgtccgtgtctggggagtgtgtgacgcaacttctgaaggatacctgtttcgaagggggggatattacgacagtctttacacctagcgctaaatactgtcaggtcgtatgtacatatcatccaagatgccttctgttcacctttacagctgagtctccatctgaggaccctactcgctggtttacttgcgttctgaaagattcggtgaccgagactctgcctagagttaaccgcaccgctgcgatcagtggatactcctttaaacagtgttcccaccagatttcggcttgcaataaagacatctacgtggatctcgacatgaaagggatcaactacaactctagcgttgctaaatctgcccaggagtgccaggagcgctgtacggacgacgtacactgccatttttttacatacgctacacggcagttcccttcgctcgaacacaggaacatttgcctgctgaagcacactcagactgggacaccaactcgtattactaagctagataaagtggtgtccggcttctcattaaagtcatgtgccctgagtaacttggcctgcatccgcgacatattcccaaacaccgtgtttgcggacagcaatatcgatagtgtgatggctccagatgcttttgtgtgcggaagaatttgcacacatcacccgggatgtctgttctttacatttttttcacaggagtggccaaaggaatcccaacgcaatctatgcctgctgaagacaagcgaatccggcctgcccagtacacggataaaaaaaagcaaggcactgtccgggttcagcctccagtcgtgtcggcatagcatcccagtcttctgccattcgtcattctaccacgacaccgactttctaggggaagagctcgacatcgtggctgcaaagtcccatgaagcctgtcagaagctctgtactaacgcggtgcggtgccagttctttacatacacgcctgcgcaagcatcatgcaacgaaggtaaagggaagtgttatctgaaactgtcgagtaacgggtcccccactaagatcctgcacggccggggggggatttcaggctatactctccgactgtgcaagatggacaacgagtgcaccacgaaaattaaaccacgcattgtgggggggacagcaagtgtgcgcggagagtggccttggcaggtgactttgcataccacgtcaccaacacagaggcatctctgtgggggaagcataattggcaaccagtggatactcacagctgcacactgcttctacggtgtggagtcgcccaaaattttgagggtgtatagtggcatcctcaaccagtccgagataaaggaggacacctcattttttggagtgcaggagatcatcattcacgatcaatataaaatggccgaatccggatatgacattgctcttctcaagttggaaactacggtgaattacacagacagtcagaggccaatatgtctcccttccaagggtgatcgtaacgtcatttacactgattgctgggtgacagggtggggatatagaaagctgcgagacaaaattcaaaatacactgcaaaaggccaaaattccgctggtgaccaatgaggagtgtcaaaagcgatatcgaggccacaagattacacacaaaatgatctgcgctgggtatcgggagggcgggaaggacgcctgtaaaggcgacagcggaggcccgctctcttgtaaacataacgaagtgtggcacctagttgggattactagttggggtgagggatgcgcccagagggagaggccgggcgtgtacactaacgtggttgagtacgtagactggatcctggaaaagacccaggcagtt

SEQ ID NO: 9425 - DNA, 1875 bp, Artificial Sequence
  Description of Artificial Sequence: Synthetic coding sequence
atgatatttctgtaccaagtcgttcactttattctcttcacgagtgtttccggcgagtgcgtgacacagttactgaaggatacctgtttcgaggggggggacattaccaccgtctttacgccatctgccaagtattgtcaggttgtgtgcacttatcacccaaggtgtcttcttttcacatttaccgcagaatccccctctgaggatcctactaggtggttcacttgcgtcctcaaggactcagtaacagaaacgctgccgcgtgttaatcgtactgcagctatttctgggtactcatttaagcagtgtagccaccagatcagcgcctgtaacaaggacatatacgtggatcttgacatgaaagggataaactataacagctcagttgccaaatccgcccaggaatgtcaagagagatgtaccgatgatgtgcactgccatttttttacgtacgccacccgccagtttcccagcctggagcatcgcaacatatgtctcctgaagcacacccagaccgggacccctacgcgaattaccaagctcgacaaggtagtgtcaggattttccctgaagtcctgtgccctgtctaatctggcctgtatcagggacatcttccccaacaccgtttttgctgattctaacattgatagcgtcatggctcccgatgcatttgtctgcggccgcatttgcacacatcatccagggtgtctgttcttcaccttttttagtcaggaatggccaaaggaaagccaaagaaatctgtgtctactgaagacaagcgagagtggcctccccagtactcggatcaagaagtccaaggctctttcaggcttcagcctgcagtcgtgcaggcactctatacctgtgttctgtcactccagcttttaccatgatacagatttccttggtgaagagctcgatattgtggcggcgaagtcccacgaggcgtgccagaaactgtgcaccaacgcagtgaggtgccaattctttacatacactcccgcgcaggcaagctgcaacgaaggaaaggggaagtgttacctgaaactgagttccaacgggtcgcccactaagatcctgcatggccgcggtggaatatccggatatactcttcgcctgtgcaagatggataacgaatgtaccaccaagatcaagccaaggatcgtagggggcaccgcttcagtaaggggagagtggccgtggcaggtgacactccataccacgagccccacccaaaggcatctttgtgggggttccatcatcggtaatcagtggatcctaacagccgcccattgtttttatggcgtcgaatcccctaaaatcctgcgcgtgtacagcgggatcctgaaccagtccgagatcaaagaagacacgagcttcttcggtgtccaggaaataataatccatgaccagtataaaatggccgaatcagggtacgacatcgcccttcttaagctggagacaacagtcaattataccgactcccagaggccaatatgcttaccttcaaagggagatcggaatgtgatatacaccgactgctgggttaccggctggggctacaggaaactgagggataaaattcaaaacaccctccagaaagccaaaatcccgttggtgaccaacgaagagtgccaaaaacgttaccgcggacacaagatcacgcacaaaatgatctgcgccggctaccgtgagggcggaaaagatgcctgtaaaggggacagcggggggcccctgtcctgcaagcataatgaggtttggcatttagtgggaatcacaagttggggggagggatgtgcacaacgcgagcgacctggagtctatactaacgttgttgaatacgtcgactggattctcgagaaaactcaagctgtc

SEQ ID NO: 9426 - DNA, 1875 bp, Artificial Sequence
  Description of Artificial Sequence: Synthetic coding sequence
atgatctttctgtaccaagtcgtccactttatactgtttacttccgtgtcaggggagtgtgtgactcagctgcttaaggatacgtgcttcgaaggtggagatatcaccactgtgttcaccccatcagcaaaatactgtcaggtcgtctgcacttaccacccgagatgcctgttgttcacctttactgcagaatcgccatcagaagatcctactcggtggtttacttgtgtgctgaaggattccgtgaccgaaacccttccccgagtaaatagaacggccgccatctccgggtactcctttaagcaatgttcgcatcaaatatcggcatgtaacaaggacatctatgttgacctggatatgaagggtatcaactacaattcgagcgtggcaaagtctgctcaagagtgtcaggaacggtgtactgatgacgtacactgccacttctttacgtacgccacccggcagtttccttcacttgaacacagaaacatttgcctgctgaaacatacccaaaccggaaccccaactaggattacgaaacttgacaaggtcgtgtcgggattctcattgaaatcgtgtgcactctccaaccttgcatgtataagggatatctttcctaatactgtgtttgcggattcgaacattgacagtgtgatggcgccggatgcattcgtctgcggaagaatttgtacccatcaccccggctgtctctttttcacctttttctctcaggagtggcccaaggaatcccaacgtaatctgtgcctgctcaagacttccgagtctggtctgccctccacgcgcattaagaaatccaaggcgctttcaggattttccctccagagctgccgacacagcattcctgtgttttgccattcaagtttctaccatgacaccgattttcttggggaggagctcgacattgtggccgctaagagccatgaggcatgtcagaagctctgcaccaacgcagtccgctgccagtttttcacgtatactcctgcccaagcctcctgtaatgaaggcaagggaaagtgctacctgaagttgtcgtcgaatgggtcgccaactaaaatcctgcatggacgcggcggtatctcgggctatacccttagactctgtaagatggataatgaatgtaccaccaagattaagcctaggatagtgggcggcactgcgtcggtccgtggcgaatggccttggcaagtgaccctgcacactacctcgcctactcaaaggcatctttgcggtggttccataatcggcaaccagtggattcttaccgcagcacactgcttttacggagtggaaagtccgaagattcttagggtgtacagcggtatcctcaaccaatccgagataaaagaagatacgtcctttttcggtgtgcaagagatcattattcatgaccaatacaagatggcagaatcgggatacgacatcgcactcctcaaactcgaaaccaccgtaaactacaccgatagccaacgcccgatttgtctgcccagcaagggtgataggaacgtgatttacaccgactgttgggtcaccggttggggatacagaaaacttagagacaaaatacagaacacccttcaaaaggcaaagatcccactggtgactaatgaggaatgtcagaaacgctataggggtcataagattactcacaagatgatttgcgcaggataccgggaggggggaaaggatgcctgtaagggagattcaggcgggccactgtcgtgtaagcataacgaagtttggcatcttgtgggaattacgtcctggggagaaggctgtgctcaacgcgaaagacccggggtctacactaacgtggtggaatacgtcgattggattcttgagaaaactcaggcagtg

SEQ ID NO: 9427 - DNA, 1875 bp, Artificial Sequence
  Description of Artificial Sequence: Synthetic coding sequence
atgatattcttgtaccaggtagtacacttcattttgttcacctccgtctccggcgagtgtgtgacacaacttctaaaggacacctgtttcgaggggggtgacattactacagtatttacgccaagtgctaaatattgtcaggttgtttgcacctaccatccaaggtgtctgctttttacattcaccgcggagagcccctccgaagaccctactagatggtttacctgtgtcctcaaagatagcgtaactgaaacacttccacgagtgaatcggactgccgcaatcagtggctatagtttcaaacaatgtagccaccagattagtgcatgtaacaaggatatctacgtcgacctggacatgaagggaataaattataactccagtgtcgctaaatccgcccaggagtgtcaggagagatgtactgacgatgtgcactgccatttcttcacctatgctacgagacaatttccctctctcgaacatcgtaatatatgccttttgaagcacacccagaccggcacacctacacggataacaaaattagacaaggtcgtctctgggttcagcctaaaatcttgcgccttgtccaatctggcatgcattagggacatctttcccaacaccgtttttgcggattccaatatcgatagcgtgatggcacccgatgccttcgtttgcggaaggatttgtactcaccaccccggctgtctattctttacattttttagccaggaatggccaaaagaatcgcagagaaacctgtgcctgctcaagacatcagaatccggactgccatccactcgcattaagaaatctaaagcgctgtcggggttctccctgcagtcctgcagacactctatacctgtgttctgccactcttcattctaccacgataccgacttcctaggcgaagagctagatattgttgccgccaagtctcacgaagcttgtcaaaaactgtgcactaacgccgttcgctgccagtttttcacatacacaccagctcaggcctcctgcaatgaggggaaggggaagtgctatctgaaactgtccagtaacggctcgccgacgaagatcttacatggccgtgggggcatatcagggtacacacttcggctctgtaagatggataacgaatgtactacaaaaatcaaaccccgtatcgtaggcggtaccgcctccgtccggggtgagtggccatggcaggtgactctacacaccaccagccccactcagaggcacctgtgcggcgggtctattatcggaaaccaatggatcctgaccgcagctcattgcttctatggagtggagtctcccaaaatactgagggtctactccggaatactaaatcagagtgaaattaaggaggacacatctttcttcggcgttcaggagattattatccatgaccagtacaaaatggcagaatctggttatgatatagcccttctcaagctcgaaaccaccgtgaattataccgactctcagagaccaatctgcctccccagcaaaggcgaccgcaacgttatttatacagactgttgggttaccgggtggggatataggaagttgagagacaagatccaaaatacactccagaaagctaagatcccgctcgtcactaatgaggagtgtcagaagcgataccgcgggcataaaattacccacaagatgatctgtgctggctacagagaaggcggtaaggacgcttgtaagggagattcggggggcccccttagctgcaagcacaatgaagtctggcacctggtcggaatcacatcatggggtgagggatgcgcgcagagggaacggcccggagtgtataccaatgtagtcgagtatgtggattggattctggaaaaaacacaggccgtt

SEQ ID NO: 9428 - DNA, 1875 bp, Artificial Sequence
  Description of Artificial Sequence: Synthetic coding sequence
atgatttttctctatcaggtggtgcacttcattctgttcacatctgtctctggggaatgtgtcacacaacttttgaaagatacgtgttttgaaggaggcgacataacgacagtctttacgccaagtgccaaatattgtcaggtggtatgtacttaccatcctagatgtttattgtttacattcacggctgaatccccaagcgaagatccgaccagatggttcacgtgtgtgctgaaagatagcgttacggaaacgctaccgcgtgtaaatcgcaccgctgcgatttctggatattcgtttaaacagtgctctcaccagataagcgcgtgcaacaaagatatttatgtggaccttgatatgaaaggaattaattacaattcctctgtagccaaatcagcccaagaatgccaagaaagatgtacagacgatgtacattgccatttttttacctatgcaacacgccaatttcctagcttagaacataggaatatctgcctgcttaaacacactcagactggaacaccaacaaggattaccaagcttgataaagtggtgagcggatttagccttaaatcttgtgctttaagcaatttggcgtgtattagagatatttttccgaataccgtctttgcagacagcaatattgattctgtgatggcaccagatgcttttgtttgtgggaggatttgcacccaccatcctggatgtctgtttttcactttcttttcacaggaatggccgaaagaaagccaaaggaatctgtgtctcctcaaaacgtctgaatcgggcttaccttctactagaattaaaaaaagcaaagctctgtccggctttagcttgcagtcatgccgccactctattccagttttttgtcactcctccttctaccatgacactgattttcttggtgaagaattggatatcgttgcagccaagtcccacgaagcgtgccaaaaattatgcacgaatgcagtgcgctgccaattcttcacctacacgccggcccaggccagctgcaatgaaggtaagggtaaatgttatcttaagttgtcatctaacggcagtccgacgaagatcctccacggacgtggcggcatctctggatacacgcttcgtctgtgtaaaatggacaatgaatgtacgacaaaaattaaacctcgcattgttggcggtacggcctcagttagaggagaatggccctggcaagtaacactccacactacttctcctacacagagacacttatgcggtggcagcattattggcaatcagtggatcctcactgcggcgcattgcttttacggcgtagaatctcctaagattctgcgtgtgtatagtggcatccttaatcaaagcgaaattaaagaagacacatcattttttggagttcaggaaattattatccatgatcagtataagatggcggagtcaggatacgatattgccttacttaagctcgaaacaactgtcaattatacagacagtcaacgaccaatctgccttccgtctaaaggggacagaaacgtcatttatacagattgttgggtcacaggctggggatatcgcaaactgcgggacaaaattcaaaacactctgcagaaggcaaaaatccctcttgtaaccaacgaagaatgtcagaagagatatcggggacataagattacacataaaatgatatgcgccggatatcgcgaaggcggcaaagatgcttgcaagggcgactctggcgggccgctgtcgtgcaaacataatgaagtatggcatctggtgggcattacgtcatggggggaaggatgcgcacagagagaacgtccgggagtctatactaatgtcgtcgaatatgttgactggattcttgaaaaaacccaggctgtt

SEQ ID NO: 9429 - DNA, 1875 bp, Artificial Sequence
  Description of Artificial Sequence: Synthetic coding sequence
atgattttcctctaccaggtggtgcacttcatcctcttcacttcagtctcgggcgagtgcgtgactcaactgctcaaagacacctgtttcgaaggaggagatattactaccgtgttcacccccagcgccaagtactgccaagtggtgtgcacctaccacccacggtgcctcctgttcactttcactgccgaatcaccgagcgaggacccaaccagatggttcacttgtgtcctgaaagattcagtcacggaaaccctgcctcgggtcaaccgtacggccgcgatctcgggctattccttcaagcagtgcagccatcaaatcagcgcctgtaataaggacatttacgtcgacttggacatgaaaggcatcaattacaattcatcagtcgctaagtcagcacaggagtgtcaagaacggtgcactgacgacgtgcattgccacttcttcacgtacgcgacccgtcagttcccttcgcttgagcaccgaaacatctgcctgcttaagcacactcaaactggaactccgacccggatcaccaagctggacaaggtggtcagcggattcagcctgaagtcatgcgctctctccaacctggcgtgtatccgcgacatatttcccaatactgtgttcgcggattccaacatcgactccgtgatggccccagacgccttcgtgtgtggacgcatctgtacccaccaccctggatgtctcttctttaccttcttctcgcaagaatggccgaaggaaagccagcgcaatctgtgcctgctcaagacctcggagtccggcctgccgtcaacccgcatcaagaaatccaaggctctgagcggtttttctctgcaaagctgtaggcactcgatcccggtgttctgccactcatcattctaccacgacacggactttctgggcgaggagctggacatcgtcgccgcgaaatcacacgaagcctgccagaaactttgcaccaatgccgtgaggtgccaattcttcacttacactccggcgcaagcatcgtgcaacgagggaaagggaaagtgctatctgaagctctcgtcgaatggatctccgactaaaatcttgcacggcagaggaggcatttccggatacactctgcgcctgtgcaaaatggataatgaatgtacgaccaaaatcaagccgcggatcgtgggaggaactgcatcggtgcgcggtgaatggccgtggcaagtgactctgcacaccacctcgcccactcaacgccacttgtgtgggggatcgatcatcggaaatcagtggatcctgactgcggcccattgtttttacggggtggagtccccaaagatcctgcgggtctactcggggattctcaatcagtccgaaatcaaggaagatacttcctttttcggagtgcaggagattatcatccatgatcaatacaagatggcagaatcgggctacgatatcgcgctgctgaagctcgagactaccgtgaactacactgactcgcagcggcccatctgcctgccttcgaagggtgaccggaacgtcatctacactgactgctgggtgactgggtggggatacagaaagctgagagataagatccagaataccttgcagaaagccaagatcccgctggtcaccaacgaagaatgccagaagaggtaccggggacacaagatcacgcacaagatgatttgcgcgggataccgcgaaggagggaaagatgcctgtaagggagactccgggggccccctgtcgtgtaaacacaatgaagtttggcatctggtgggaatcacctcatggggcgaggggtgcgcgcagcgcgaaagacctggtgtttacaccaacgtcgtcgagtacgtcgactggatcctcgaaaagacccaggccgtg

SEQ ID NO: 9430 - DNA, 1875 bp, Artificial Sequence
  Description of Artificial Sequence: Synthetic coding sequence
atgatcttcctgtaccaagtggtgcatttcatactgttcacttccgtgagtggagagtgtgtgactcaactccttaaggatacgtgttttgaagggggcgatattactaccgtgttcacgccttcggcaaagtattgccaagtggtgtgcacttaccaccctcgctgtcttttgtttacctttacggcagaatccccctcagaagatcccactagatggtttacgtgcgtccttaaagatagcgtcacggaaaccctcccgcgtgtgaatagaactgcagcaatctccggatactcttttaagcaatgtagccatcagatatcggcatgtaacaaggacatttacgtcgacctggatatgaagggtattaactataactcgagcgtcgcaaaatccgcccaagagtgccaagagcgatgtactgatgacgtgcactgtcactttttcacgtacgcaacccgccaatttccatcgctcgaacatagaaatatctgccttcttaagcatacccaaactggaacgccaaccagaatcaccaagttggacaaggtggtgtcggggttttccctgaaatcatgcgcattgagcaacctggcctgtattcgcgacatttttccaaacactgtgttcgcggactcgaatatagattcagtgatggctcctgatgcctttgtttgtggacgcatctgtactcatcatccgggctgtctctttttcacctttttctcccaggaatggcccaaagaatcccaacgaaacctgtgtttgttgaaaacttctgaatcaggacttccttcgactcgcataaagaagtccaaagcgctgtctgggttttcacttcaatcctgtagacatagcatccctgtcttttgtcacagctcgttttaccacgataccgatttcctcggggaagaactggatattgtggcagccaaatctcatgaagcatgtcagaaactgtgtaccaacgcggtcaggtgccagttctttacgtacaccccggcacaggcttcctgcaacgagggaaagggaaagtgttacctgaaactgtccagcaatggatccccgactaagatactgcatggacggggaggaatctcgggttacactcttagactttgcaaaatggacaacgaatgtaccaccaaaatcaagccacggattgtgggagggaccgcctccgtgcgtggtgagtggccatggcaggtgactcttcacactacctcgccaacccaaagacatctttgcggtgggtcgatcattggaaaccagtggatccttactgcagcgcattgtttctacggagtggagtctccaaagattcttcgagtctactccggcattcttaaccaaagcgagataaaggaggataccagcttttttggggtccaggaaatcatcatccacgatcaatacaaaatggcggaatcgggttacgatatcgccctcctgaaactcgaaaccacggtcaattacactgattcgcaaagaccaatctgccttcccagcaaaggagacagaaacgtgatttacaccgattgctgggtcaccggctggggataccggaagctccgggacaaaattcaaaatacccttcagaaggcaaagatccctctggtgactaacgaagagtgtcagaagagataccgagggcacaagattactcacaagatgatctgtgcgggctacagagaaggggggaaagatgcctgcaagggtgacagcgggggacctctgagttgcaagcacaatgaggtctggcacttggtgggaatcacgagctggggcgagggatgtgctcaacgagaacgtcccggcgtctacactaatgttgttgaatatgtggactggatactggaaaagactcaagcagtg

SEQ ID NO: 9431 - DNA, 1875 bp, Artificial Sequence
  Description of Artificial Sequence: Synthetic coding sequence
atgatctttctttatcaggttgtacatttcatcctatttacatccgttagcggcgagtgcgttacccagctgctgaaagatacatgtttcgagggtggagatataaccacagtgtttacgccctccgccaaatattgtcaggtggtttgcacgtaccaccctcggtgcctgctgtttacctttactgctgagtcgccctcggaggatcccactcgatggtttacatgcgttcttaaagacagcgttactgagaccctcccccgtgtgaatcggaccgctgccattagcggttatagttttaaacaatgttcccaccagatcagtgcgtgcaacaaggacatttacgtggatctcgatatgaagggcataaactacaattctagcgtggctaaaagtgctcaggagtgccaggagcgctgcacagacgatgttcactgtcacttcttcacctatgctacccggcaatttccatccctggagcacagaaacatatgtttgctgaaacacacccaaaccgggacacctactcgcatcaccaagttagataaggtggtctcgggtttctcactgaagagctgtgccctgtccaacctggcatgcatcagagatatttttccgaatactgtgttcgcagatagcaatatcgattcagtgatggcccctgatgcattcgtctgtggcaggatatgcacccatcatcccgggtgtctgttctttacattctttagtcaggagtggcccaaggaatctcagcgtaacctatgtctgctgaaaacctcggaaagcggtctgccttcaacacgaattaagaagagcaaagccctgtccggcttcagcctgcagtcctgccggcatagtattccagtattttgtcattcctccttctatcacgacaccgactttctgggcgaggaacttgacatagtggctgctaagtcacacgaggcttgtcagaaactatgtacaaacgcagtgcgctgccagttcttcacttataccccagcccaagcatcttgcaacgaagggaaggggaagtgctatctgaagttgagcagcaacggcagcccaactaagatcctccacggccgcggcggcatctctggatacacgctccgactgtgcaagatggataacgaatgtactacaaagatcaaaccaaggatagtagggggaaccgcgtccgtaagaggggagtggccatggcaggtgactctgcatactacgtcacccacccagcgccatctgtgcggaggtagcatcattggcaaccagtggatattaacagccgcacactgcttctacggagtagagagccccaaaattctaagagtgtattcgggaatcttgaaccaaagcgagataaaagaggatacttcattcttcggagtgcaggagattattattcacgaccagtacaaaatggcggaaagtggctacgacattgcattattgaaactcgagacaaccgtaaactatactgactctcagcgtcccatttgcttgccatcaaaaggggacaggaacgtgatctacacagattgctgggtgacagggtggggctataggaaattgagagacaagattcagaacacactgcagaaagcaaagattccccttgttactaatgaggaatgtcagaagagatatcgagggcacaagatcacacacaaaatgatttgtgccgggtacagggaggggggcaaagatgcctgcaaaggggactcagggggccccttgtcatgcaagcacaacgaagtttggcacctagtcggaatcactagctggggagagggatgtgcccagagagaaagaccaggtgtctatacgaacgttgtagaatatgtggattggatactcgaaaagacacaagctgta

SEQ ID NO: 9432 - DNA, 1875 bp, Artificial Sequence
  Description of Artificial Sequence: Synthetic coding sequence
atgatattcctttatcaagtcgttcatttcatcctgttcacctccgtttctggcgaatgtgtcactcagttgctgaaggacacatgtttcgaaggcggggacattaccacggtctttacgccctccgccaagtactgtcaggtggtgtgcacctaccatcctcggtgtctcctgttcactttcacagcagaaagcccttcggaggatcctacacgatggttcacgtgcgtgctgaaagattccgtgacagagaccctaccacgagttaacaggacagcagccatctctggctatagcttcaagcagtgctctcatcaaatctcagcatgtaacaaggacatttacgttgacctggacatgaagggaataaactacaacagttccgtggcaaagagcgctcaagagtgccaggagagatgtacagatgatgtgcactgccatttttttacgtatgccactcgccagttcccatctttagaacaccgaaatatctgcctcttgaaacacacacagaccggcacacctacgagaattaccaaacttgataaggtagttagcgggttcagtttgaaatcttgtgctttgtcgaatctcgcttgcatacgtgatatctttccaaatacagtgtttgctgactccaacatagattccgttatggcaccagacgctttcgtctgtgggcggatttgcacacaccacccaggctgcctcttcttcacttttttctcccaggaatggccaaaggagagccagcgaaatctctgcctactgaagacttccgagagtggactcccatcaacccgaattaaaaaatctaaggctctctccggctttagcctgcagtcgtgtagacactccattcccgttttttgccattcctctttctaccacgacactgacttcctgggcgaagagctagacatagtagccgcgaagagtcacgaggcctgtcaaaagctttgtaccaatgctgtaagatgccagtttttcacttacactccggcacaagcatcatgcaacgaaggcaaagggaaatgctacctgaaactgtcgtccaatggaagcccaaccaagatcctacatggaaggggggggatttccggctacaccttgagattgtgtaaaatggataatgaatgtaccactaagatcaaaccgcgtatcgtcggtggtactgcgtctgtgagaggggagtggccatggcaggtgacgttacatacaacaagtccaacgcagcgacatctgtgcggagggtctatcataggaaatcagtggatcctgacggcagcccattgtttctacggcgtggaatcaccaaaaattctgcgggtatacagcggcatccttaatcaatctgaaattaaggaagacacttcgttcttcggcgtacaggagattattattcacgaccagtataaaatggccgagagtggatatgatattgcgctgctcaagttagagactacggtgaactacaccgattctcagcgacccatatgtctgcctagcaagggcgatcgaaatgtgatttacaccgactgctgggtaactggctggggatatagaaaactcagggacaagatccagaacacattacaaaaggcgaaaatccccctcgtcaccaatgaggagtgtcagaaacgataccgcggacacaagatcacccacaaaatgatctgcgccggctaccgggagggtggcaaggatgcttgtaaaggcgatagcggcggtcctctctcttgcaagcataacgaagtgtggcacctggtcggaattacgtcctggggggaaggctgtgctcagagagagcgaccgggggtgtacaccaatgtggtggaatacgtggattggattttggagaaaacccaggcagtg

SEQ ID NO: 9433 - DNA, 1875 bp, Artificial Sequence
  Description of Artificial Sequence: Synthetic coding sequence
atgatatttctgtatcaggttgtccacttcatcctattcactagcgtgagcggagagtgcgttacccagctgctgaaagacacctgctttgaaggtggggacatcaccaccgtctttaccccttccgccaagtactgccaggtggtgtgtacctaccaccctcggtgtctgttattcactttcaccgctgagagtccgtccgaggatccaactagatggttcacttgtgtgcttaaagacagtgttacggaaacactgccaagggtcaatcgaaccgctgcaatttctggctatagcttcaagcagtgcagtcaccagatatctgcgtgcaataaggacatttatgtggatctggacatgaaagggatcaactacaacagtagcgtggctaagagtgcacaggagtgtcaggaacgatgcactgatgatgtacactgccacttttttacgtacgcaacacggcagttcccttcacttgagcatagaaacatttgcctgctgaagcacacccagacaggcactccgactcggatcacaaagctcgacaaggtagtgtcaggattttctcttaagtcttgtgcactctccaatctagcatgcattcgggatattttcccaaacaccgtgtttgccgacagcaatatcgactctgtgatggcccctgacgctttcgtctgtggacgcatctgcacccaccaccccggctgcctcttctttacgtttttctcccaggaatggccgaaggagagccagagaaatctgtgcctcctgaaaacaagcgaatccggcctgcccagcacccgcattaagaagagcaaagctctaagtggtttctctcttcaatcttgtagacattccatcccggtgttttgccacagttccttctaccacgataccgatttccttggcgaagaattggatatcgttgccgcaaagagccacgaggcctgccaaaaactgtgcacaaacgccgtgaggtgccagttttttacttacactcctgcccaggcttcctgtaatgaggggaagggtaagtgctatctcaagctgtcctccaacggaagcccaacgaagatcctgcacggtcgcggaggaatcagcgggtacactttgcgtctctgcaaaatggacaatgaatgcacaacaaagattaagcccaggattgttggaggaactgccagtgtgcggggagaatggccgtggcaggtgacgcttcatacaaccagccccactcaaagacatctttgcggggggagtattatcggcaatcaatggattcttaccgctgcccattgtttttacggtgtggagtcccccaaaattcttagagtctactctggcattctgaatcagtcggagattaaggaagacaccagctttttcggagtacaggagattattatccacgaccagtacaaaatggcggaaagtggatacgatatcgctctgctcaagctggagacgacggttaattatactgactctcaacgacccatttgcctgccttcgaagggggacaggaatgtgatttacacagattgttgggtcaccggatggggctatagaaaactgcgagataaaatccagaacactttacagaaggccaagataccactcgtgaccaacgaagagtgccagaaacgctatcgaggccataagatcactcacaaaatgatatgtgccggctatcgcgagggagggaaagatgcatgtaagggagatagcggaggtcctttgtcctgtaagcataatgaagtgtggcatctcgtagggatcacaagctggggggagggttgtgcgcaacgcgagaggcccggagtttacaccaatgtggtggaatatgttgattggatcctagagaaaacacaagcagta

SEQ ID NO: 9434 - DNA, 1875 bp, Artificial Sequence
  Description of Artificial Sequence: Synthetic coding sequence
atgatatttttatatcaagtagtacattttatactatttacgtcggtttcgggtgaatgtgtaacgcaattattaaaagatacgtgttttgaaggtggtgatataacgacggtatttacgccgtcggcgaaatattgtcaagtagtatgtacgtatcatccgcgttgtttattatttacgtttacggcggaatcgccgtcggaagatccgacgcgttggtttacgtgtgttctaaaagattcggtaacggaaacgctaccgcgagttaatcgaacggcggcgatatcgggttattcgtttaaacaatgttcgcatcaaatatcggcgtgtaataaagatatatatgttgatctagatatgaaaggtataaattataattcgtcggtagcgaaatcggcgcaagaatgtcaagaacgttgtacggatgatgtacattgtcatttttttacgtatgcgacgcgacaatttccgtcgttagaacatcgtaatatatgtttattaaaacatacgcaaacgggtacgccgacgcgtataacgaaattagataaagtagtatcgggtttttcgttaaaatcgtgtgcgctatcgaatttagcgtgtatacgtgatatatttccgaatacggtatttgcggattcgaatatagattcggtaatggcgccggatgcgtttgtatgtggtcgaatatgtacgcatcatccgggttgtctattttttacgtttttttcgcaagaatggccgaaagaatcgcaacgaaatctatgtttattaaaaacgtcggaatcgggtctaccgtcgacgcgaataaaaaaatcgaaagcgttatcgggtttttcgttacaatcgtgtcgacattcgataccggtattttgtcattcgtcgttttatcatgatacggattttttaggtgaagaactagatatagtagcggcgaaatcgcatgaagcgtgtcaaaaactatgtacgaatgcggtacgatgtcaattttttacgtatacgccggcgcaagcgtcgtgtaatgaaggtaaaggtaaatgttatctaaaattatcgtcgaatggttcgccgacgaaaatactacatggtcgtggtggtatatcgggttatacgttacgtctatgtaaaatggataatgaatgtacgacgaaaataaaaccgcgtatagtaggtggtacggcgtcggtacgtggtgaatggccgtggcaagtaacgttacatacgacgtcgccgacgcaacgacatctatgtggtggttcgataataggtaatcaatggatactaacggcggcgcattgtttttatggtgtagaatcgccgaaaatattacgtgtttattcgggtatattaaatcaatcggaaataaaagaagatacgtcgttttttggtgtacaagaaataataatacatgatcaatataaaatggcggaatcgggttatgatatagcgctattaaaattagaaacgacggtaaattatacggattcgcaacgtccgatatgtctaccgtcgaaaggtgatcgaaatgttatatatacggattgttgggtaacgggttggggttatcgaaaattacgagataaaatacaaaatacgctacaaaaagcgaaaataccgctagtaacgaatgaagaatgtcaaaaacgatatcgtggtcataaaataacgcataaaatgatatgtgcgggttatcgagaaggtggtaaagatgcgtgtaaaggtgattcgggtggtccgttatcgtgtaaacataatgaagtatggcatctagtaggtataacgtcgtggggtgaaggttgtgcgcaacgtgaacgtccgggtgtttatacgaatgttgtagaatatgttgattggatactagaaaaaacgcaagcggta

SEQ ID NO: 9435 - DNA, 1875 bp, Artificial Sequence
  Description of Artificial Sequence: Synthetic coding sequence
atgatctttctgtatcaagttgtccatttcattttattcacatctgttagtggagagtgtgtaactcaacttctgaaagatacttgctttgagggaggggacatcacaaccgtgtttaccccatctgctaaatactgccaggtggtgtgcacataccaccctcgctgcctcctcttcaccttcacagcagaaagcccgtccgaagacccgacgagatggtttacatgtgtgttgaaagactccgtgaccgaaacccttcctagggtgaaccgcacagccgccattagcggctacagcttcaagcagtgtagccatcagattagcgcttgtaacaaagatatctacgtggacttagatatgaaaggcattaactataatagctcagtggctaaaagcgcccaggaatgtcaggaaaggtgtactgatgacgttcactgtcattttttcacatacgccacccggcagttcccctccctggagcaccgcaatatctgcctactgaagcacacacagaccggcacccccacgagaatcacaaaactcgataaggtggtctctggcttttctctgaagtcttgcgccctttccaatttagcctgcattcgtgacattttccctaatacagtatttgcagactctaacatagacagcgttatggcccctgatgccttcgtgtgcggacggatttgcacacaccatcctggatgcctattcttcacatttttttcacaggaatggcccaaggagtctcagcgaaatttgtgcctcttaaaaacaagcgaatcaggccttccatctacccgcatcaaaaagagcaaggctctgtctggtttctctctgcagagctgtcgacatagtattccagtgttttgtcacagttcattctatcatgataccgatttcctgggagaagaactggacatcgtggcagccaagtctcacgaagcctgccagaaattgtgcaccaatgccgttcgctgccagtttttcacctacaccccagcacaagcctcttgcaatgaagggaagggcaagtgctacttgaagctgtcatctaacggtagtccgactaaaattctgcatggccggggagggatctcaggctatactctaagactatgtaaaatggacaacgaatgcacgacgaagattaaacctaggatagtcggcggaactgccagcgttagaggagaatggccctggcaggtcaccctgcacactacatctcccacccaaaggcatttgtgcggcgggagcatcattgggaaccaatggatcttaactgcagctcactgcttctacggcgtagagagccctaaaatactgagggtgtattctggcattttgaaccaatcggaaataaaggaggacactagttttttcggggtacaggagatcattatccacgaccagtacaaaatggcagaatctgggtacgacatcgcactgcttaagctcgagaccacggtgaactatacagatagccagcgccccatatgcctccctagcaaaggcgacaggaacgtcatatacacggactgctgggtaacgggctggggatacaggaagttaagagacaagattcagaataccctccagaaagctaagattcccctggtcaccaatgaggagtgccaaaagagatatagggggcacaagattactcataaaatgatctgtgccggatatcgcgaaggtggcaaagacgcatgtaagggagacagtggcgggcctctgtcctgtaagcacaacgaagtgtggcatttagtgggaataactagctggggtgaaggatgcgcccagcgggaaagaccaggagtttacacaaacgtggtggagtacgtggattggatactagagaagacgcaggcagtg

SEQ ID NO: 9436 - DNA, 1875 bp, Artificial Sequence
  Description of Artificial Sequence: Synthetic coding sequence
atgatctttctgtaccaagtcgttcactttattctctttacctccgtcagtggggaatgcgttacccagctgctcaaggatacttgtttcgaggggggcgacatcactacagttttcactccaagcgcgaagtattgccaagtggtctgcacttaccaccctagatgtttactgtttacttttaccgcagaatcccccagcgaagatcccacgagatggttcacctgcgttcttaaggattctgttacagagaccttgccccgggtgaatcgcaccgctgccatcagtggctacagctttaaacagtgtagtcaccagatcagtgcttgcaacaaggatatttatgtggacctagacatgaaaggaatcaactataatagcagcgtcgccaagtcagcccaagagtgccaggagaggtgtacagacgatgtgcactgccacttttttacctatgccacccgacagtttccaagtctggagcaccgcaacatctgcctgctgaagcacacacaaacggggacaccaactaggatcaccaaactggacaaggtagtgtccgggttttctctgaagtcctgtgccctgtccaatctggcgtgtataagggacatcttcccaaacaccgtatttgccgactctaacatcgactccgtcatggcccctgacgcattcgtctgtgggcgaatctgtacacatcatcctggctgtctgttttttacctttttctcacaggaatggcccaaggagtcacaacggaatctatgcttgcttaagacgtcggaatccggcttacccagcaccagaatcaagaaatccaaggccctcagtgggtttagcctccagtcctgtagacattccatccccgtcttctgtcactctagcttctaccacgataccgactttttgggagaagagctcgatattgtggctgcgaaaagccacgaagcatgtcaaaaattgtgtaccaacgctgtccgatgtcagttcttcacctatactcccgcacaggcgagttgcaacgagggcaaaggcaagtgctatttaaagctgagctctaacggtagtcctacaaagatcctgcacggaagaggggggatctctgggtacacattgagactctgtaagatggacaatgagtgcacaacgaagatcaagcctaggattgtgggagggactgcatccgttcggggggagtggccctggcaggtgaccctgcacactacttccccaactcagcgccacctgtgcggaggaagcatcatagggaaccagtggattttgactgctgcccattgtttctacggagtagagtcaccaaagattctcagagtgtactctgggattctcaaccagagtgaaatcaaggaggacacttccttctttggtgtgcaagaaattattattcacgaccagtacaaaatggccgagtccgggtacgacatcgctctgcttaagctagagacaacagtgaattatacagactctcagcggccaatttgcttacctagcaaaggagatcgaaacgtgatatacaccgattgttgggttaccgggtggggctacagaaagctgcgagataaaatacaaaacaccctgcagaaggctaaaattcccctggtgaccaacgaggagtgtcagaaacgctaccggggacacaagatcacacacaagatgatttgtgccggctatagagagggcggcaaagacgcgtgtaaaggagattctgggggccccctgagctgcaagcataacgaggtttggcaccttgtaggcatcactagctggggtgaggggtgtgcccagagagaacgccccggcgtatacaccaacgtggtggagtatgtggactggatcctcgaaaaaacccaggcggtc

SEQ ID NO: 9437 - DNA, 1875 bp, Artificial Sequence
  Description of Artificial Sequence: Synthetic coding sequence
atgatattcctgtatcaggtcgtgcatttcatcttgttcacttccgtctcgggagagtgtgtcactcaactcttgaaggatacttgtttcgaggggggagacatcaccaccgtgttcactccttccgcgaagtactgccaggtggtctgcacctaccatcctcggtgtctgctcttcacctttactgctgaatcaccgtcggaggaccctactcgctggttcacctgcgtactgaaggactcggtgacggagactctcccgcgtgtgaaccgcactgccgcaatcagcggctactcgttcaagcagtgctcccaccagatctccgcttgcaataaggatatctacgtcgatcttgacatgaaaggaatcaactacaattcatcggtggccaagtcggcgcaggaatgccaggagaggtgcactgatgatgtgcactgccacttcttcacttacgcaacgagacagtttccttctctcgaacatagaaacatctgtttgttgaagcacacgcagactgggacccctaccagaatcaccaagctggacaaggtggtgtccggattctcactgaaatcgtgcgcactcagcaatttggcgtgcattcgcgatatctttccaaacaccgtgttcgccgactcgaacatcgattccgtgatggccccggacgccttcgtctgtggccggatctgcacccatcatcctggctgcctgttctttaccttcttttcccaggaatggccgaaggagtcccaacggaacctgtgcctgctgaaaacttcggagagcggcctgcctagcactaggattaagaaatcaaaggcattgagcggattttccctgcagtcttgccgccattccatccccgtgttttgccacagctccttctaccacgataccgactttttgggagaggagctggacatcgtggcggcgaagtcccatgaagcctgccagaagctgtgcaccaacgccgtacgctgccaattcttcacctacactccagcgcaggctagctgcaacgagggcaagggaaagtgctacctcaaattgagctccaatggctcacccaccaaaattctccacgggcgcggcggaatcagcggatacaccctgaggctttgcaagatggacaatgagtgcactactaagatcaagccgcggatcgtgggaggaaccgcttccgtgagaggagaatggccatggcaggtgaccctccacactactagccccactcagagacatctgtgtgggggaagcattatcggaaaccagtggattctgactgctgcccactgtttctacggagtggagtccccgaagatcctcagagtgtattcagggatcctgaatcaatcagagatcaaagaagatacgtcgttcttcggcgtgcaggaaatcatcatccacgaccagtataagatggccgagagcggatacgatattgctctcctcaaactcgaaaccaccgtgaattacaccgactcgcaaaggcctatttgcttgccttccaagggtgaccggaatgtgatctacactgactgttgggtcactggctggggataccggaagctgcgcgacaaaatccaaaacactctgcaaaaggcgaagatcccactcgtcaccaacgaggagtgccagaagagatacagggggcacaaaatcacgcataagatgatctgcgcgggttacagagagggaggcaaggatgcttgcaaaggggattcgggcggaccattgagctgtaaacacaatgaagtttggcacctggtgggcatcacgtcgtggggggaaggttgcgctcagcgcgagcgcccaggtgtgtacaccaacgtcgttgagtacgtggactggatccttgaaaagactcaagcggtc

SEQ ID NO: 9438 - DNA, 1875 bp, Artificial Sequence
  Description of Artificial Sequence: Synthetic coding sequence
atgatctttttatatcaggtggttcacttcatccttttcacgtccgtgtcgggtgagtgcgtgactcagctgcttaaggatacgtgcttcgagggaggcgacataaccacagtgtttacgcccagtgccaagtattgccaggtcgtctgtacatatcacccccgctgcttgctattcactttcaccgcggagtcaccatcggaagacccgacccgatggtttacgtgcgtgctgaaggactcggtaacggagacgctgccccgcgtgaaccggactgcagcaatctcgggctacagcttcaagcagtgttcgcaccagatttctgcatgcaataaagacatttacgtcgatctggacatgaaaggaataaattataattccagtgtggctaagagcgcccaggagtgccaggagcgctgtaccgacgatgtgcactgccatttctttacatacgccacgcgccagttcccttcgcttgagcatcgcaatatttgcctgttaaagcatacgcaaactgggacccctacgagaatcaccaagttggacaaggtggtcagcggattcagtttgaagagctgcgcactttctaatctggcctgcattcgcgatatctttccgaacaccgtgtttgcagactctaacatagacagtgtgatggccccagatgccttcgtttgcggcagaatttgcacccaccatcccggatgcctgttttttacgttcttctctcaggagtggcccaaagagagtcagcggaacctgtgcttattgaagaccagcgaaagcggccttccgagtacgcgcatcaagaaaagtaaggcgctgtctggattctcgctacagagctgtcgccacagtataccagttttttgccactcgtctttctatcatgatacggatttcctgggcgaggagctggacattgtggcggccaagtcgcacgaggcatgccagaagttatgcacaaacgccgtcaggtgccagttctttacgtacactccggcgcaggcctcgtgcaatgagggcaagggtaagtgctatctgaagctgtcatcgaatggatccccaaccaagattctccatggcagaggcggcatcagtggctatacactccgcctgtgcaagatggataacgagtgcacgacgaagatcaaaccacgcatcgtgggaggtactgcttcagtgaggggcgagtggccgtggcaggttaccctgcacacgaccagtccgacgcaacgccacctgtgcggaggcagcattatcggcaatcagtggatactcacggccgcccactgtttctacggagttgagagtccgaagattctgcgtgtttactcgggaattctaaaccagagtgagataaaggaggacacgtctttcttcggagttcaggagattatcatccacgaccaatataagatggccgaatctggctatgatattgcccttcttaagcttgaaacgactgtgaattacaccgatagccagcgacccatatgcctgcctagcaagggcgaccgcaacgtgatatataccgattgctgggtaacaggctggggctatcgaaagcttcgtgataagatccagaacacgttgcagaaggcgaagattccattggtaaccaacgaggagtgtcagaaaaggtacaggggccataaaataacgcataaaatgatctgcgcgggctaccgagaggggggtaaagatgcatgcaaaggcgattcggggggccccctgtcttgcaaacataatgaggtgtggcatcttgtcggaattacctcatggggggaggggtgtgctcaacgagagcgacctggggtatacacaaacgtcgttgaatacgtcgattggatcctggaaaagactcaggccgtg

SEQ ID NO: 9439 - DNA, 1875 bp, Artificial Sequence
  Description of Artificial Sequence: Synthetic coding sequence
atgatcttcctgtaccaggtggtgcatttcatcctcttcacctcagtctcaggcgagtgcgtgacccagctgctgaaggacacgtgctttgaaggaggagacatcactaccgtattcaccccgtcagccaagtattgccaagtggtctgcacttaccatcctcggtgcctgttgttcacctttactgcggaatccccgtcggaggatccgactcgctggtttacctgcgtgctcaaggattcggtgaccgaaactctgccgcgcgttaatcgcaccgcagcgatttcgggctacagcttcaagcagtgctctcatcaaatctcagcttgtaacaaagacatctacgtggatctggatatgaaaggaatcaactacaattctagcgtcgccaagtcggctcaagagtgtcaggaacggtgtaccgatgacgtgcactgccatttcttcacttacgctacccgtcaatttcccagcctcgagcatcggaatatctgccttctcaagcacacgcaaactggaactccgactcgaatcactaaactggacaaggtcgtctccggcttctccttgaaatcctgcgcactgtcgaacctggcatgcatccgggacatcttccctaacactgtctttgcggactccaacattgattccgtgatggcccctgacgcatttgtgtgtggaagaatttgcacccaccaccctgggtgcttgttcttcaccttcttcagccaggagtggccaaaggaatctcagcgcaatctctgcctgcttaagacttccgagtccggtctgccgagcaccagaatcaaaaagagtaaggcactttccggattctcactgcaatcctgcaggcactccatcccggttttctgccactcatcgttctaccacgacaccgattttctcggtgaggagctggatattgtggccgcaaagtcgcatgaggcgtgccaaaaactctgcaccaacgcggtgcggtgccagtttttcacgtacactccagcccaggcctcatgcaatgaaggaaagggaaagtgttacctcaaactcagcagcaacggctctccgaccaagatcctgcacggaaggggcggaataagcggttatactctcaggctgtgtaagatggataacgagtgtacgactaagatcaagccaagaatcgtaggggggactgcgtcggtccgcggagagtggccgtggcaggtgactctgcacacgacctcacccacgcagcgccacctgtgcggcggatccataatcggaaaccagtggatcctgacggcagcgcattgcttctacggagtggaatcacctaagatcctccgggtgtactcgggaattctcaatcaatccgaaatcaaggaagatacttcatttttcggcgtccaagaaatcatcatccacgaccagtacaagatggcagagtcaggatacgatatcgccctcctcaaattggaaaccactgtgaactatactgactcgcaaaggccgatctgcctgcctagcaagggcgaccgcaatgtgatctacaccgactgctgggtgaccggctggggctaccgcaaactgcgtgacaaaatccagaacaccctgcagaaagccaaaatcccactggtgactaacgaagaatgtcaaaagagataccgggggcacaaaatcacgcacaagatgatctgcgccgggtaccgcgaaggaggcaaggacgcttgtaagggagactctggaggaccgctcagctgcaagcataatgaagtgtggcatttggtgggtatcacttcgtggggagaggggtgcgcccagcgagaacgccccggagtgtacaccaacgtcgtagagtacgtcgactggattctcgaaaagacccaggcggtg

SEQ ID NO: 9440 - DNA, 1875 bp, Artificial Sequence
  Description of Artificial Sequence: Synthetic coding sequence
atgatcttcctttaccaggtagtgcattttattctcttcacaagtgtgtctggcgagtgtgtcactcagctcttaaaggacacttgttttgagggcggagacatcaccacggtattcaccccttccgctaagtattgccaggttgtctgcacatatcacccgcgatgcctcttatttaccttcacggccgaaagtccttctgaggatccaaccagatggtttacatgcgtgttgaaagactccgttacagagaccctgccacgggtgaatcgcactgctgcaatatctggctactcctttaagcagtgctctcatcagatctcagcttgtaataaagacatttatgtggatctagacatgaagggaatcaattacaattccagcgtggctaaatcagctcaggagtgccaggaaagatgtaccgatgatgtgcactgtcacttctttacgtatgcgacgagacagttcccttccctggagcaccgaaatatctgcttgctgaagcatactcaaacagggactcctacaagaatcactaagctagataaggtcgtctctggtttctctctcaagtcgtgtgccctgagtaacctggcctgcattcgcgatatcttcccgaatactgtttttgcagattccaatatcgatagcgtgatggctcctgacgctttcgtgtgcgggcgaatctgtacccaccaccccgggtgtctcttcttcacctttttctcccaagagtggccaaaggagtctcaaaggaatctgtgtctcctgaagactagcgagagcggcctcccctctacgcggatcaagaagtctaaagccctgtccgggttcagtctccaatcttgtaggcattcgatcccggttttctgccatagcagcttttatcacgacacagactttttgggggaggagttggatattgtggcagcaaagagccatgaagcatgccagaagttgtgcactaatgccgttagatgtcagttcttcacttacaccccagcgcaggcttcctgtaatgaaggaaaaggcaagtgctacctgaaactgtcgtccaacggaagcccaactaagatactgcacggacggggaggcatttctggatacaccttaaggctgtgtaagatggacaatgagtgcaccactaagattaagcccagaattgtgggcggcacagcaagtgtgcgaggtgagtggccatggcaggttacattacataccacatctcccacccagaggcacttgtgcgggggctctatcatcgggaatcagtggattctgaccgccgcgcactgcttttatggggttgaaagccccaagatacttagggtgtatagcggaatcctgaaccagagtgagattaaagaggataccagtttcttcggggtgcaagaaataatcatccacgaccagtacaagatggctgaaagtggatatgatattgctctgcttaagctggagaccacagtgaactatacagactctcagagaccaatttgtctgccctcaaagggagatcgtaatgtgatttataccgattgttgggtgacgggatggggctacaggaagctgcgagataaaatccagaataccctgcagaaagctaagatccctctggtgacaaacgaggagtgccaaaagaggtacagaggtcacaagatcacacacaaaatgatttgtgccggatacagagagggcggtaaggacgcgtgtaaaggggacagcggtggccccctgagctgtaagcataatgaagtgtggcatctcgtcggcatcacatcttggggcgaagggtgcgcgcaacgcgaaaggcctggagtgtataccaacgtggtggagtatgtggattggattctagagaagacccaggcagtg

SEQ ID NO: 9441 - DNA, 1875 bp, Artificial Sequence
  Description of Artificial Sequence: Synthetic coding sequence
atgatcttcctgtaccaggtggtgcatttcatcctgtttacttcggtatctggcgagtgtgtcacacagctgctgaaggatacctgttttgaaggcggcgacatcacaacagtgtttactccaagcgctaagtattgccaagtggtgtgcacctatcaccccagatgtctgttatttactttcacagctgagtcaccatctgaagatcccaccaggtggttcacatgcgtcctaaaggactccgtcacagaaaccttgccgcgcgtcaatcgaactgcagccatatcaggatactccttcaaacagtgttcacaccagatatctgcttgtaacaaagacatttatgttgatctggacatgaaagggatcaactacaactcttctgtagccaaaagcgcccaagagtgccaggagcgatgtaccgacgacgtgcactgtcattttttcacatacgccacacggcaattccccagtctggaacatagaaacatctgtctactgaaacacacacaaacaggtaccccaacacggataacaaaactggacaaggtcgtatctggattcagtcttaagtcttgtgcattaagtaacctggcttgcattcgagatatctttccaaacactgtgttcgccgacagtaatatcgactctgtgatggcgccagacgccttcgtatgcggaaggatttgtactcatcatcccggctgtctgttttttacattcttttcacaggagtggccgaaggagtcccagcggaacctgtgccttctgaagactagtgagtccgggctgccctccacccggatcaagaagagtaaagccctgtccggattctctctgcagtcctgcagacattcaattcccgtcttttgtcactcttcattctaccatgatacggacttcctgggggaggaacttgacatagtggccgccaaatcccacgaggcctgtcagaagctgtgtacgaacgccgtcaggtgtcagttcttcacttacacccccgcccaggcctcttgcaatgaaggcaagggcaagtgctatctaaaactgtcttcaaatgggagccccaccaaaatattgcacgggcgaggcggtatttccggctatactctaaggctttgtaagatggacaatgagtgtaccaccaagatcaaaccacgaatcgttggggggacggcatccgtgcgcggggagtggccctggcaggttacactccacactacaagcccaacacagaggcacctttgcggtgggtctataataggaaaccagtggattctgactgcggcacattgcttctatggggttgaaagtccaaaaatactacgcgtttacagcggcattctcaaccagagcgagattaaggaggacactagcttcttcggagtgcaggaaatcattatccacgaccaatacaagatggcagagagtggttatgacatcgccttacttaaactggagacaactgtgaactatacggattcccagaggcccatttgtctgcccagcaagggtgaccgaaacgtgatatatactgactgctgggttacagggtggggctatcggaagctgagagataaaatccaaaacacactgcaaaaagcgaaaatacccctggtgactaatgaggaatgccagaagcggtatagaggtcacaagatcactcataaaatgatttgcgctggttacagggagggcggcaaagatgcttgcaaaggggacagcggaggacccctctcttgcaaacacaacgaagtgtggcacttggtgggtatcacaagctggggagaaggatgcgcgcagagagaacggcccggtgtatataccaatgtggtcgaatacgtggactggatactagagaagacacaggctgta

SEQ ID NO: 9442 - DNA, 1875 bp, Artificial Sequence
  Description of Artificial Sequence: Synthetic coding sequence
atgatattcctttaccaagtcgtccatttcatattgttcactagcgttagcggggaatgcgtgacccagcttctgaaggatacttgttttgaaggaggtgatatcactacggtgtttactcctagcgcgaagtactgtcaagtcgtgtgcacttaccatccaagatgcctcttgtttacttttactgccgagtccccaagcgaagatccaacccggtggtttacctgtgtccttaaggattcagtcactgaaacgttgcctagagtgaacagaaccgcagcaatcagcggatactccttcaagcagtgctcacatcagatctcggcgtgtaacaaggacatctacgtcgatctcgatatgaagggaatcaactacaactcttccgtcgcaaagtcggcgcaagagtgccaagaacgttgcactgatgatgtgcattgccatttctttacctacgccaccagacaatttccctcactggagcaccgtaacatttgtctgctgaaacacacccagaccggcacgcccacgagaataaccaagctggataaggtcgtgtcgggcttctctctgaagtcctgtgctctctccaatctcgcctgtattcgcgacatcttcccaaatacggtatttgccgacagcaacatcgattcggttatggcccccgatgcctttgtgtgtggacgtatctgcactcaccacccggggtgtctgttctttaccttcttttcacaggagtggccgaaagaatcccaacggaatctctgcctgctgaaaacttccgagtccgggctgccttctaccagaatcaagaagtcgaaggcactttccggtttttccctccaaagctgccggcattccatccctgtgttctgccattcgtcgttttaccatgatactgacttcctgggtgaggaactcgacatcgtcgccgcaaagtcgcacgaggcctgtcaaaaactttgcactaacgctgttaggtgccaattcttcacctacacccctgcacaagcatcctgtaacgagggtaagggaaagtgctaccttaagctgtcatcgaatggatcccccaccaaaatactccatggacggggcggcataagcggctacaccctccgtctttgtaaaatggataacgaatgcactactaagattaaacctagaattgtcggaggtactgcaagtgtccgcggtgagtggccatggcaggtcaccctccacaccacttcgcctacccagcgccatctgtgtggtgggtcgatcattggaaatcagtggattttgactgctgcccattgtttctacggggtggaatcgccaaagattctgcgggtgtactcaggaattctgaatcagtcggagattaaggaagatacctcgttcttcggggtccaagagattatcattcatgatcagtacaagatggcggaatcggggtacgacattgccttgcttaagctggagacgaccgttaactataccgattctcaacgaccgatttgccttccatcgaaaggtgaccggaacgtcatttacacggattgctgggtcaccggatggggctaccggaagctgagagataagatccagaataccctgcaaaaggccaaaattcctcttgtcactaatgaagaatgtcagaaacgctacagaggtcacaagattacccacaagatgatttgtgcaggataccgagaaggcggtaaagacgcttgtaagggagattcgggagggcccctgtcttgcaagcacaacgaagtgtggcatctggtggggattaccagctggggagaaggatgtgcccagagggaaagacccggagtttacaccaacgtggtggaatatgtcgactggattctggaaaagactcaagcagtg

SEQ ID NO: 9443 - DNA, 1875 bp, Artificial Sequence
  Description of Artificial Sequence: Synthetic coding sequence
atgattttcttgtaccaagtggtacattttattctgtttactagcgtgagtggagagtgtgtgacacagctcctgaaagacacctgcttcgaagggggtgacattacaaccgtatttacaccatctgccaaatattgccaggtggtctgcacctatcacccaaggtgtctgctgtttacttttacagcagaatcccccagtgaagaccccaccagatggttcacctgcgtcctcaaagattcggtaaccgagaccctccccagggtgaaccgcactgccgccatctcagggtatagctttaagcaatgcagccatcagatttcagcatgcaacaaagacatttacgtggaccttgacatgaaagggatcaactataattccagcgtggcaaagtcagcgcaggaatgtcaggagagatgtaccgatgacgtgcactgccatttttttacctatgcgacccggcagttccccagtctagagcatagaaacatttgtcttctgaagcacactcaaacaggtacccccacaaggataacaaagctggacaaggttgtgtcaggtttctccctaaagagctgcgctcttagcaatctggcgtgtatcagggacatcttcccaaacaccgtgttcgccgattccaacatcgactctgtcatggcaccggacgccttcgtttgtggtcgcatctgcactcatcaccctggctgcctcttttttacatttttctctcaagagtggcccaaggaatctcagagaaatctgtgcttactgaaaacgagtgagagcgggctaccttccactcgcatcaagaaatccaaggcactgtctggcttcagcttacagagttgccgacattctatcccggtcttctgccacagctcattctaccacgatacggacttcctcggtgaggagctggatatcgtggctgcgaaatcgcatgaggcctgtcaaaaactttgtaccaatgctgttcggtgccagtttttcacttacacccctgcccaggcaagttgcaatgaaggaaaagggaagtgctatctgaagctctcaagtaacggctccccgaccaagatcctgcacggccgtggtgggattagcgggtatactctccggttgtgtaaaatggataatgagtgtactaccaagatcaaacccagaatcgtcggtggcaccgcctccgtgcgaggcgagtggccctggcaagttacactgcacaccacttctcccacccagcgccatctgtgtggcggtagtataatcggtaatcagtggatattgaccgcagcacactgtttttacggcgtggaatctccaaaaattctgcgtgtgtactcgggcatcttgaatcagagcgaaattaaggaagacacctcgtttttcggtgtgcaggaaattatcatccatgatcagtataagatggctgagtcaggctacgatatcgctctccttaaattagagacaacagtgaattatactgattcccaaagaccaatctgtctgccttctaagggagacagaaatgtgatatatacagattgttgggtgacgggttgggggtataggaagctgagggacaagattcaaaacacccttcagaaggcgaagataccactggtgacaaatgaggaatgtcagaaaaggtatcggggccacaaaattacccacaagatgatctgcgcaggttatagggagggtggcaaggatgcgtgtaaaggtgatagtggcggccctttatcctgcaaacataacgaagtgtggcacctggtgggtatcacttcttggggggagggctgtgctcagcgcgaacgacctggcgtttacactaatgtcgtggagtatgtggactggatactagagaagacacaggcagtg

SEQ ID NO: 9444 - DNA, 1875 bp, Artificial Sequence
  Description of Artificial Sequence: Synthetic coding sequence
atgattttcctctatcaggtggtgcatttcatcctttttacgtccgtgtctggagagtgtgtgactcaactgctgaaggacacatgttttgagggcggtgacataacaacagtgtttacgccctcagctaagtattgccaagtggtgtgtacatatcaccccagatgcctgctctttacatttacggccgagtctccctcagaggatccaaccagatggtttacttgtgttctgaaggattcagttacggagactctccctcgggtgaatcgaacagccgctattagcggatattcatttaaacaatgcagtcaccagatctctgcctgtaataaggacatctacgtcgaccttgatatgaagggaataaattataactcttccgtggctaagtccgctcaggagtgccaggaaagatgtaccgacgacgtgcactgtcacttcttcacatacgcaacacggcagttcccttctttggagcaccgcaatatttgtctcctgaagcatactcagacgggcacccccacccggatcacaaagctcgataaagtggtttctggtttcagtctgaaatcctgcgcactctcaaatctggcctgtatcagggacatctttccaaatactgtgttcgccgacagcaacatcgattctgtgatggctcccgatgctttcgtttgtgggcgcatctgcacccaccaccccggttgcctttttttcacgttcttctcacaagaatggcccaaagaatctcagagaaacctctgcctgctcaaaacgtccgagtctggccttcccagtacgcggattaaaaagtcaaaagctctgtccggcttttcactgcaatcctgtcggcatagcataccagtgttctgtcacagcagcttctaccatgacactgacttcttgggcgaggaactggatattgtggctgcgaaaagccacgaggcttgtcagaagctgtgcaccaacgcggtcagatgtcagttttttacttacacaccagctcaagcctcttgtaacgagggcaaggggaagtgttatctgaaactctccagcaatggaagccctactaaaattctgcatggtagaggaggcatctcaggctacactctgaggctttgcaagatggataacgagtgcacaacaaaaattaagcccaggatagtgggaggtacagcgtccgtcaggggtgaatggccttggcaggtcaccctccataccacttcacccacccaaaggcatttgtgcggcggctccatcataggcaatcaatggatcctgacagctgcccactgtttctacggtgtcgagtcacccaagattctgcgcgtttattccgggatactgaaccaaagcgagattaaagaggacacttcctttttcggtgtgcaagagatcattatccatgaccagtataaaatggcagagagcggatatgatatcgctctgctcaagcttgaaacaactgtaaattatacggactcccagcgccctatttgtcttccaagcaaaggcgataggaacgtcatatataccgactgctgggtcacaggttggggataccgaaagctgagggacaagattcagaatacattgcaaaaagcgaagatccctctggtgacaaatgaggagtgccaaaaacgatatagagggcacaagattacacacaagatgatctgcgcaggctaccgagagggtggaaaggacgcttgcaagggcgactccggcggaccactttcctgcaaacacaacgaggtgtggcaccttgtggggataacaagctggggcgaggggtgcgcccagcgcgaaaggccaggggtttataccaatgtagtggaatatgtcgactggatattggaaaagacccaagccgtg

SEQ ID NO: 9445 - DNA, 1875 bp, Artificial Sequence
  Description of Artificial Sequence: Synthetic coding sequence
atgatatttctgtaccaggtggtccactttatattgttcacctccgtcagtggtgaatgcgtcacacaattgctgaaagatacctgctttgaggggggggatattactaccgtcttcacgccctccgccaaatattgtcaggtggtctgcacgtaccatccaagatgtcttcttttcacattcaccgcagagtcccctagtgaggaccccacccggtggtttacctgtgttctcaaggacagtgtgaccgagactctaccccgcgtcaataggaccgccgccatctctggttattccttcaaacagtgctcccatcaaattagtgcttgtaataaagacatctatgttgacttggacatgaagggtattaactacaactcctccgttgccaagagcgcacaggaatgccaagagagatgcacggacgatgtgcattgccatttcttcacttacgccaccaggcagttccccagcctggaacacaggaacatttgcctgttgaagcacacacagacggggaccccaacgcgcatcacgaagctggacaaagtcgtgtctgggttttcgttgaaatcttgtgcactcagtaacctcgcctgcatacgcgacatatttcctaacacagtttttgccgactctaatatcgactcagtcatggcccccgacgcctttgtctgtggcaggatctgtactcaccaccctggatgtctgtttttcactttcttttcacaagagtggcccaaagagtcccagcgtaatctttgtctgctaaagacctcagagtcaggcctaccatctaccagaatcaagaaaagcaaagccttgtctgggttcagtctccaaagctgccgtcattccattcctgtcttctgtcactcctccttctaccatgatacggactttctcggggaggagctcgacattgttgctgcaaagagccacgaggcctgtcaaaagttgtgcactaacgcagtccgctgtcagttttttacttacacccctgcacaagctagctgtaatgagggcaagggaaaatgctacctcaaactttcatcaaatggttctccaactaaaattctgcacggacgtgggggaatcagcggctatactctccggctgtgcaagatggacaatgaatgtacaaccaaaattaaaccgcgcatcgtagggggcactgcctcagtgcgtggagaatggccttggcaggtcacccttcacacaacatctcccacacagcggcacctttgcggggggagtatcattggcaatcagtggatcctgaccgctgcccactgcttttacggcgttgagtcaccaaaaatcttgcgagtgtattccggcatcctaaatcagagcgagatcaaagaagatactagcttcttcggcgtgcaagagatcatcatacacgatcagtataagatggcagagtcaggctacgatattgccctcctcaaattggagaccacggtgaattatactgactcccaaaggccaatttgtctgcccagtaaaggcgatcggaatgtgatctacacagactgctgggtaaccggatggggctaccgcaagttacgcgacaagatccagaataccctgcagaaggctaagatccctctcgtcactaacgaggagtgtcagaagcggtacagaggccataaaattacacataaaatgatctgcgccggttacagggaaggaggcaaggacgcatgcaagggcgacagtgggggccctctgtcctgcaagcataatgaggtgtggcacttggtcgggataacctcttggggtgaggggtgtgcgcagcgggaacgaccaggcgtttacaccaacgtcgttgaatatgtggactggattctcgaaaaaactcaggctgtg

SEQ ID NO: 9446 - DNA, 1875 bp, Artificial Sequence
  Description of Artificial Sequence: Synthetic coding sequence
atgattttcctttatcaagttgtgcactttatccttttcacctccgtaagcggagagtgtgtgacacaactgcttaaggatacatgcttcgaaggaggggacataacaaccgtgttcaccccctccgcgaagtattgtcaggtggtatgtacctatcaccctcgatgcttgctttttacgttcaccgcagaatctccatcagaagacccaactaggtggttcacttgcgtgctgaaggatagtgtgactgaaaccttgccccgagtcaatcgcaccgccgcaatttccgggtacagcttcaaacagtgcagtcatcagatcagtgcttgcaataaggatatttatgtggatctggacatgaagggaatcaattataacagcagtgtggctaaatcagcccaagagtgccaggaacgctgcaccgatgacgtgcactgccacttttttacctatgccacccggcagttcccatcattggagcatcgaaacatatgtttgctgaaacacacccagaccggcacgcctaccaggattactaagctggacaaagtcgtctccggattctctctgaagtcatgcgctttgtcaaacctcgcctgcatccgggacatctttccgaataccgtgtttgcggattccaacatagactccgtgatggcgcctgatgcttttgtttgcggacgaatctgtactcaccaccctggatgtttgtttttcaccttcttctctcaggaatggccaaaggagagccagagaaacctgtgcctgcttaaaacctccgagtccggcctgccatcaacaaggattaaaaagagcaaggccctgagtggattctctctgcagagttgtcgccacagtatccctgtgttctgccacagttctttttaccacgacaccgattttttgggggaagagctcgacattgtcgccgccaaatcacacgaggcttgtcagaagttgtgcaccaacgccgtccggtgccagttctttacctacacacctgcccaagcgagctgcaatgaagggaagggcaaatgctatctgaagctttcttccaatggaagtccaactaagattctgcatgggagaggtggaatctccggctacacgctgcgcctgtgtaagatggacaacgaatgcactacaaagatcaagcccaggatcgttggaggcactgccagtgtccggggagagtggccctggcaagtgactttgcacactacatctcccacccagcgccacctgtgtggcggatcaattatcgggaatcagtggatcctgacggcagctcattgcttttacggcgtcgaatcccccaagatcctgcgagtatactcagggatccttaaccagtcagagattaaggaggacacaagcttcttcggcgttcaggagatcattatccatgatcagtacaagatggctgaatctggatacgatatcgcactgttgaagctggaaacgaccgtgaactacactgattctcagcgcccaatttgcttgccatccaaaggtgataggaacgtaatttacaccgactgctgggttactggatggggctaccggaaactccgggacaagatccagaatactctgcaaaaggccaagatcccattggtaacaaatgaagagtgccagaagcgctatcggggccacaagattacccataagatgatctgtgctggctaccgggaggggggaaaggatgcttgcaagggtgactccggaggcccattgtcttgcaaacacaacgaagtatggcatctggtggggatcacgagctggggggaggggtgtgctcagcgcgaacgccccggagtgtacaccaacgtggtagaatacgtcgattggatacttgagaagacacaagcagta

SEQ ID NO: 9447 - DNA, 1875 bp, Artificial Sequence
  Description of Artificial Sequence: Synthetic coding sequence
atgatcttcctgtaccaggtcgttcacttcattctgttcacgagcgtgtccggagagtgcgtgactcagctgctcaaagatacttgcttcgagggcggcgacatcactaccgtttttactccttccgcaaagtactgtcaggtggtgtgtacttaccatccgcgctgcctgctgttcactttcaccgcggagtcaccttcggaggatccaaccagatggtttacctgcgttcttaaagattcagtcaccgagactctcccaagagtgaacaggactgcggctatttcgggatactcgttcaaacaatgctcgcatcagatctccgcgtgcaacaaggacatctacgtcgacctcgatatgaagggaatcaactacaactcaagcgttgccaagagcgcccaagagtgtcaagaacgctgcaccgacgatgtccattgccacttttttacctacgccaccagacagttcccatccctcgaacaccggaatatctgcctcctgaaacacactcagaccggaactccgactcgcattaccaagctggacaaggtggtgtcgggattttcgctcaaatcgtgcgcgctctcaaacctggcttgcattcgagatatcttccctaatacggtgttcgcggactccaacatcgattcagtgatggcgcctgacgcttttgtttgcggccggatctgtacgcatcatccagggtgcctgttcttcacttttttcagccaggaatggccaaaggagtcacaaaggaacctgtgtctgctgaagaccagcgagtcgggcctcccttccactaggatcaagaagtcgaaagcgcttagcggattctcgctccagtcgtgtagacattcgatcccggtcttttgccactcgtctttctaccatgataccgatttcctgggagaagaattggatatcgtggcggcaaaatcccacgaggcgtgtcagaaactgtgcactaatgccgtgcggtgccagtttttcacctacaccccagcgcaggcctcatgcaacgaaggaaagggaaaatgttacttgaagctgtcctccaacggatccccgactaagatcttgcatggtagaggaggcatctctggatacactctgcgcctctgtaagatggacaacgagtgcacgacgaagatcaagccgcggattgtgggtggcactgcttcagttaggggtgaatggccttggcaggtgactctgcacaccaccagccccactcagcggcacctgtgcgggggcagcatcatcgggaatcagtggatcctgactgcagcacactgcttctacggcgtggagtccccgaagattctgcgggtgtactcgggcattctcaatcaatcggaaatcaaggaggatactagcttcttcggagtgcaagagatcattatccatgatcagtacaaaatggccgaatccggatatgacatcgccctgctgaagctggagactactgtgaactacaccgacagccagcggccgatctgcttgccgtccaagggagatcgcaatgtgatctacaccgactgctgggtgaccggatggggataccgtaaactccgggacaagatccagaatactctgcagaaagccaagattccattggttaccaacgaggaatgccaaaagcggtaccgcggacataaaatcactcataaaatgatttgtgctgggtaccgcgaaggtggaaaggatgcatgtaaaggagattcggggggaccactgtcctgtaagcataacgaagtgtggcacctggtgggaatcacttcatggggcgaaggctgcgcacaacgcgaaagacctggcgtttacacgaatgtggtcgaatacgtcgactggattcttgaaaagacccaagcggtc

SEQ ID NO: 9448 - DNA, 1875 bp, Artificial Sequence
  Description of Artificial Sequence: Synthetic coding sequence
atgatttttctgtatcaggttgtccattttatactgttcacaagcgtctcgggggagtgcgttacccaactgctgaaagacacatgctttgagggcggagatattactacagtcttcactcccagcgccaagtactgccaagtggtttgtacttaccacccacggtgtcttctctttactttcacagctgagtccccgagcgaagacccaacacgatggtttacatgcgtgctgaaggatagcgtgaccgaaaccttgccccgagtgaaccggactgctgccatctcaggttacagctttaagcaatgctcacatcaaatcagtgcatgcaacaaggatatttacgtggacctggatatgaagggaataaactataattcaagcgtggccaaatctgctcaagaatgccaagagaggtgtaccgatgatgtccactgccacttctttacatacgccacgagacaatttccatccctggagcatagaaacatttgcctgcttaaacacacacagaccggcacacccacaagaatcacaaagttggacaaagtggtgagcggttttagcctgaagtcctgcgctctatctaaccttgcttgtataagagacatttttccaaatactgtgttcgcggattccaatatcgatagcgtcatggcccccgatgcctttgtgtgcggtcgaatttgtacacatcacccaggctgcctgttcttcacattctttagccaggaatggcccaaggaatcacagcggaacctttgcctactcaagaccagcgagagcggccttcccagtacccgcatcaaaaagtctaaagccctcagcgggtttagtctgcaaagctgccgacattccattccagttttttgtcattcgagcttttatcacgacaccgatttcctgggcgaggagctggatatcgtggccgcgaaatcacacgaggcttgtcagaagctatgcactaacgctgtaaggtgccaattcttcacttacacacctgctcaagcatcctgtaacgagggaaagggcaagtgttaccttaaactttcctcgaatggttctcctactaaaatcctccacggtcgtgggggaatctccgggtacactctgaggctgtgtaagatggacaacgagtgtaccaccaagataaaacccagaattgtgggaggtacagccagcgtacggggagaatggccctggcaggtcacacttcacacaacaagccctacccagcgccatctgtgtggcggatccatcattggaaaccagtggatactgacagccgcacactgcttttatggcgtcgagagccccaagatccttagggtgtatagtggcatactgaaccagtccgagatcaaggaggatacttcattctttggcgttcaagaaatcataatccacgatcaatacaagatggccgagagcggatatgacattgccctgctcaagctcgagaccaccgttaattatacagactcgcaaaggcctatctgcctgcctagcaaaggagacaggaacgtgatctacaccgattgctgggttacgggctggggttaccgaaaattgagggacaagatccagaatactttgcagaaagctaaaatccctctggtgaccaatgaggagtgtcagaaaaggtaccgggggcataaaattacacacaagatgatctgcgccggttatagagagggagggaaggatgcttgtaagggagacagcggaggaccgcttagttgcaagcataacgaggtctggcatctggtgggaataacaagctggggggagggatgcgcacagagagaacgccctggcgtctataccaacgtcgtggagtacgtggattggatcctcgagaagacgcaagctgtc

SEQ ID NO: 9449 - DNA, 1875 bp, Artificial Sequence
  Description of Artificial Sequence: Synthetic coding sequence
atgatcttcctctaccaggtggtccattttatactgtttacctccgtgtcaggcgagtgtgtgacccagttgcttaaggatacttgcttcgagggcggtgatatcactactgtatttacaccgagtgcaaaatattgtcaagttgtgtgcacgtatcacccacgctgcttgctcttcaccttcaccgcggaatctccctctgaggatccgaccagatggttcacatgtgtcctcaaagattctgtcacggagaccctccctcgcgtcaaccgcaccgccgctatctctggatacagcttcaaacagtgctctcatcagatctccgcttgtaacaaggacatctacgtcgacctcgatatgaagggtatcaactataactcatcagttgcaaaatcagctcaggagtgtcaggaaagatgcacagacgacgtgcactgtcatttcttcacatacgctacacgccagtttccttcactggagcaccgcaatatttgtttgctgaaacacactcagacgggcaccccaaccaggatcactaaactggataaagtagtgtcaggattctcactgaagtcttgcgctctgagcaatctcgcctgcattagggatatattccctaacactgtttttgccgactcaaacattgatagcgtgatggcccctgacgccttcgtgtgcggtcgcatctgcacacaccatcccggctgcctgtttttcaccttcttctctcaggagtggcctaaggaaagtcagagaaacctgtgcctgctcaagacctctgagagcggactcccatcaacaaggatcaaaaaatccaaagcactctctggcttttcccttcagtcatgtaggcattcaattccggtcttctgccactcctctttctaccacgacaccgactttctcggcgaggagctggacatcgttgcagctaaatcccacgaagcatgtcagaagctgtgcactaacgccgttaggtgccagttctttacctatacccctgctcaggcctcttgcaacgagggcaaaggaaagtgttacctgaagctctcaagcaacggctcacccacaaaaattctccatggtagaggaggaatatccggatacacccttaggctttgtaagatggacaatgagtgtacaaccaagattaagcctagaatcgttggcggtacggccagtgtgcgcggcgagtggccttggcaggtcaccctgcatactaccagccctactcaacgccatctctgcggcggctccatcatcggaaatcagtggattctcaccgcggcgcactgcttctacggcgttgagtctccaaagatacttagagtctattctggtattttgaatcaatctgagatcaaagaggacacgagcttctttggtgtgcaagaaattattattcatgaccaatataagatggccgagtcaggctacgatatcgccctgctgaagttggaaaccactgtaaactacacggattcccaaagacccatctgcctgccgtctaagggagacaggaatgtgatctatacagattgctgggtcaccggctggggctacagaaagctgagggacaagatacaaaacactctgcagaaggccaaaatcccactggtgactaacgaagagtgccagaaacgctaccgcggccacaaaatcacccacaaaatgatttgcgccggttatcgcgagggtggcaaagatgcctgcaagggcgacagcggcggaccgctgtcctgcaagcataatgaggtgtggcacctcgtgggcatcacttcctggggcgagggttgcgctcaacgcgagaggccgggtgtgtacaccaacgtcgttgagtacgttgactggatcctggaaaagacccaagctgta

SEQ ID NO: 9450 - DNA, 1875 bp, Artificial Sequence
  Description of Artificial Sequence: Synthetic coding sequence
atgattttcctttaccaagtggtgcactttattctcttcacgtcggtgtccggggaatgtgtgacgcagttgctgaaagatacttgttttgaaggtggtgatattacgaccgtgtttactcctagcgctaagtactgccaagtcgtgtgcacttaccaccccagatgtctgctctttacgttcactgcagagtccccctccgaagatcctaccaggtggttcacgtgtgttctgaaagattcggtgactgaaacccttccaagagtgaatcggaccgcagcaatttcaggatactcattcaagcagtgttcgcatcagatctcagcgtgcaataaggacatttacgtggaccttgatatgaaggggatcaattacaactcctccgtggcaaagtcggcacaagagtgccaagaacgctgcactgacgacgtgcactgtcatttcttcacttacgcaactcgacaatttccaagccttgaacatagaaatatctgtctgctgaagcatactcaaaccggcacccctaccaggattacgaagctggataaggtggtgtcgggcttcagcctcaaatcctgtgcactctcaaaccttgcctgtattagggacatattcccaaacaccgtgttcgcagattccaatattgatagcgtgatggcgcctgatgcatttgtgtgtggacgaatttgcactcatcatccaggatgtctcttctttactttcttttcacaggaatggcctaaggagagccaaaggaacctttgtctgttgaaaacgtccgaatccggccttccgtccacccgaatcaagaaatcgaaggcgctttcgggcttttcacttcaatcgtgtcgtcattccatacctgttttctgccattcctccttctatcatgatactgactttctgggagaagagctcgatatagtggcggcaaaatctcatgaagcatgtcagaagctgtgtactaacgcagtgcgctgccaattctttacctacactcctgcacaagccagctgtaacgaaggtaagggcaagtgttaccttaaactgagctcaaacggtagccctaccaagattttgcacggaagaggagggatttcggggtacactctgcgcctgtgtaagatggataatgaatgtaccaccaagataaagcctagaatcgtgggaggaactgcatccgtcagaggtgagtggccatggcaggtcactctgcacaccacctcgcctacccaaagacacctgtgcggaggatccatcattgggaaccagtggatactgaccgcagcgcattgtttctatggtgtcgagtcgcccaaaattctccgtgtgtactcaggtatactgaaccagtcagaaatcaaagaggatacctcattctttggagtgcaagagattatcattcacgatcagtacaagatggccgaaagcggctacgatattgctctgctgaagctggaaaccacggttaactacactgactcccagcgaccaatttgtctgccctcgaaaggagacaggaacgtgatttacactgattgctgggtgaccggttgggggtacagaaagctgcgcgataagatccaaaataccctgcagaaggccaagatccctcttgtcactaatgaagagtgtcaaaagcgttaccgcggacataagataactcacaaaatgatctgtgcgggttaccgggaggggggaaaagatgcatgtaagggagattccggaggtcctctctcatgtaagcataatgaagtgtggcatcttgtcgggatcacttcgtggggagagggttgcgcacaacgagaaagacctggagtttatactaacgttgtggagtatgtggattggatcctggaaaagactcaggcagtg

SEQ ID NO: 9451 - DNA, 1875 bp, Artificial Sequence
  Description of Artificial Sequence: Synthetic coding sequence
atgatctttctgtatcaggtcgtacattttattctgtttacttctgtctctggggagtgtgtcacacagcttcttaaggacacgtgtttcgagggcggggacattacaacagttttcacacctagcgccaagtattgccaagtcgtgtgcacatatcatccgagatgtctgctgttcacctttactgccgaaagtccaagcgaggacccgacacggtggttcacctgtgtcttgaaagacagtgtgaccgagactctcccgagagtgaatcggacagccgccatctctggatacagctttaagcagtgtagtcaccagatctctgcctgtaacaaggatatttacgtcgacctagacatgaaaggaatcaactacaactcttctgtggccaagtcagctcaggaatgccaggagaggtgcaccgacgacgtgcattgtcattttttcacttacgctacgcgacagttcccatctctcgaacaccgaaacatatgtttgcttaagcatactcagaccggaacacctactcggattactaagttagataaagtcgtgtctggcttctccttgaaatcctgtgcactttccaacctggcttgcatccgggatatcttccccaatactgtgttcgctgattcgaatatcgacagcgtgatggccccggatgcattcgtctgtggccgcatctgtacacaccatcccggctgtctcttttttacctttttttctcaggaatggccaaaagagagccagcggaacctgtgcttgcttaagacaagtgagtcagggcttccctccaccagaatcaaaaaatcaaaggccctgagtgggttctcgctacagtcgtgccggcactccattcctgtgttttgccacagttcgttttaccacgatacagattttttaggcgaggagctcgacatcgtagcggccaagtcccatgaagcttgtcaaaaactttgcacgaacgccgtcaggtgccagttcttcacatataccccagcgcaagccagctgcaacgaaggcaaaggaaagtgttacctgaaactgtccagtaacgggtcacctacaaaaattctgcacggtaggggagggattagcggttacactctgcggctgtgtaagatggataatgagtgtacaactaaaattaaaccccgcatcgttggggggacagcaagcgttaggggtgagtggccatggcaggtgacgctgcacacgacaagcccaacccaaagacacctgtgcggagggagcataatcgggaaccagtggattttgaccgctgctcactgcttctacggagtagaaagccctaagatactccgggtttattcaggcattctcaatcaatcggagatcaaggaggacacctcatttttcggcgtgcaggagattataattcatgaccaatacaaaatggccgaatccggctatgatatcgcgctgctcaagttagagaccacagtcaactacacagactcccagcgccccatctgtctgccctctaagggggacaggaacgtgatctacaccgattgttgggtgaccggctgggggtatcggaagttacgggataaaatccagaataccctccagaaagcaaaaatccccctggttacaaatgaagaatgccagaaacgataccggggccataaaatcacgcataaaatgatctgcgctggctacagagaaggagggaaggacgcgtgcaagggagacagtggagggcccctaagctgtaaacacaacgaggtgtggcacctggttggtatcactagctggggagagggctgtgcccaaagggagcggcctggcgtctataccaacgtcgtcgaatatgtcgattggattctggagaagacccaggcagtg

SEQ ID NO: 9452 - DNA, 1875 bp, Artificial Sequence
  Description of Artificial Sequence: Synthetic coding sequence
atgatcttcctctatcaggtggtgcatttcatcctgtttacttcggtgtcgggcgaatgcgtgacccagctgctgaaggacacttgtttcgaaggcggagacatcacgaccgtgttcaccccctccgccaaatactgccaggtcgtctgtacgtaccatccgcggtgcttgctgttcaccttcaccgccgaatcaccgtccgaagatcccacccggtggtttacctgtgtcctcaaggactccgttaccgaaaccctgccgcgggtcaataggactgccgcgatctcaggatactcgttcaagcaatgcagccatcagatttccgcctgcaacaaggatatctacgtggacctggacatgaaggggatcaactacaatagctcagtcgccaagagcgcccaggagtgccaggaacgctgtaccgatgatgtgcactgccacttcttcacttatgcgacccgccagttcccttcgctggaacaccgcaacatttgtctgctgaaacacacgcaaaccggaaccccaaccagaattactaaactggataaggtcgtgagcggtttttcgttgaaatcgtgcgccctgtccaacctcgcatgtattcgcgacatcttcccaaacacggtctttgccgactcgaacatcgattcggtcatggccccggatgcattcgtgtgtggacggatctgcacgcatcatccgggatgcctcttctttaccttctttagccaggagtggccaaaggagtcccagaggaatctttgtctcctcaagactagcgagtcgggcctcccttcgacccgcatcaagaagtcgaaggccctctcgggtttttccctccagtcatgccggcactcgattccggtcttttgccattccagcttctaccacgacaccgattttctcggagaggaattggacatcgttgcggccaagagccatgaggcctgccagaagctctgcacgaacgcagtgcggtgccaattctttacttacactcccgcccaggcttcgtgcaacgaggggaagggcaagtgctatctgaagctctcgtccaatgggtcaccgactaagattctccacggcaggggcggtatctctggatataccctgagactctgtaagatggacaatgaatgcacgaccaaaatcaagccccgtatcgtggggggaaccgcatcagtccgcggcgagtggccgtggcaagtcactctgcacactacctcccctactcagcggcatctgtgcggaggaagcattattggcaaccagtggattctgacggcggctcactgcttctacggagtggagtcgccgaagatcctgcgcgtctactcaggcatcttgaatcagtcagagatcaaggaggatacttcgtttttcggcgtccaggagatcatcatccacgatcagtacaagatggcagaaagcggatacgatatcgcgttgctgaagttggaaaccacggtgaactacaccgatagccaacgcccgatctgtctgccaagcaaaggcgaccggaatgttatctacaccgattgttgggtgaccgggtggggctaccggaagctcagagacaaaatccagaacactctgcagaaggccaaaattcccctggtcacgaacgaggaatgccagaagcgataccggggccacaagatcacccacaagatgatttgcgctggataccgagaaggtggaaaggacgcgtgcaagggagattcaggcggaccgctgagctgtaaacataacgaggtgtggcaccttgtgggcattacttcctggggcgagggctgcgctcaaagagaaaggccgggcgtgtacaccaatgtggttgaatacgtcgactggatcctggagaaaacccaggccgtg

SEQ ID NO: 9453 - DNA, 1875 bp, Artificial Sequence
  Description of Artificial Sequence: Synthetic coding sequence
atgatcttcctgtaccaggttgtccattttatcttgttcacctccgtgtctggggaatgtgtaactcagctcttgaaagacacctgcttcgagggtggggacatcacaacagtgttcaccccatcagcaaagtactgtcaggtcgtatgtacctatcatcctagatgtttgctgtttactttcaccgccgagagtccatcagaggaccctactcgctggttcacatgcgtactgaaggattcagtaactgaaacactacccagagtgaatcgcaccgccgcaatttcaggctatagttttaagcaatgtagccaccagatcagcgcttgcaataaagacatctatgtagacctagacatgaaaggcattaattataactcaagcgtcgccaaaagtgctcaagagtgtcaggagagatgtactgatgatgtgcattgtcatttttttacatacgctactcgccagttcccctccctggaacacagaaatatatgtttactgaaacacactcagaccggaaccccgacacgaataacaaagctggacaaagtcgtgagcggattctctctgaagtcgtgtgcccttagcaacctagcgtgcatccgggacatcttccctaatacagtatttgcagattctaacatcgactccgtgatggctcccgacgcgttcgtttgcgggcgcatctgtacgcatcaccccggctgcttgttttttacatttttctcgcaggaatggcccaaagagtctcagagaaacctctgtctcctcaagacctctgagagtggactgccgtccactcggatcaaaaagtccaaggcgctctctggcttttctctgcagagctgtcgccactccatcccagtcttctgccatagctccttctatcacgatactgactttctaggagaagagctcgatattgtggctgctaaatcacacgaagcctgtcaaaagttgtgtaccaacgctgtgcggtgccagttcttcacttatacaccagctcaggcatcgtgcaacgagggcaaaggcaaatgctaccttaaacttagttccaacggatcacctacaaagattttacacggccgcgggggcatctcagggtacaccctgaggctgtgcaagatggacaatgaatgtactactaaaataaaaccaagaattgtcgggggtacggcctcggtcaggggagaatggccctggcaggtgacgctgcacactacatccccgacccaacggcacctctgtgggggctcaatcattggcaaccaatggatcctcacggctgcgcactgtttctatggagtggagtctcccaaaatcctccgcgtgtacagcggcattcttaatcagagcgagataaaggaggatacttctttcttcggggtgcaagagatcatcattcacgatcagtataagatggcagagtcgggctacgatattgcgttactgaaactcgagaccaccgtgaactacacagattctcaaaggcctatctgcttaccaagtaagggcgaccgaaacgtcatatacacggattgctgggtgactggctggggataccggaaactgcgggacaaaatccagaacacacttcaaaaagcgaaaatccccctcgtgaccaacgaagaatgccagaagcgctatcgcggacacaaaattactcataagatgatatgcgcgggctaccgtgagggaggcaaagacgcttgcaaaggcgactctggaggaccgctgtcatgcaaacataacgaagtttggcacctcgtcggcattaccagttggggcgagggttgtgcacaaagggagcggccaggcgtgtatacgaacgtggttgaatacgtagattggattctcgaaaagacccaggccgtg

SEQ ID NO: 9454 - DNA, 1875 bp, Artificial Sequence
  Description of Artificial Sequence: Synthetic coding sequence
atgatctttttgtaccaagtggtccactttatacttttcaccagcgtcagcggagaatgcgtgacccagctgcttaaggatacttgcttcgaaggaggagatattaccactgtctttactccttcagcgaagtactgtcaggtggtgtgtacctatcatcctcgctgtctcctgttcacttttacggcagaatcgccaagcgaggatccgaccagatggttcacctgtgtcttgaaggattcggtcaccgaaaccctgcctcgcgtcaatcggaccgcagccatttctggttactcgttcaagcagtgctcccaccagatctcggcttgtaacaaagatatctacgtcgatcttgacatgaagggaattaactacaattcctccgtggcgaagtcggcgcaagaatgtcaagaaaggtgtactgacgatgtgcattgccatttctttacctacgcaacccgccaatttccgagcctggaacatcgtaacatctgtctgctcaagcatacgcaaaccggtacccctacgagaattaccaaactggataaggttgtgtcgggttttagcctgaagtcgtgtgcactctcgaacctcgcgtgcatccgggacatttttcctaatactgtgtttgctgactccaacatagatagcgtgatggcacctgacgccttcgtgtgtggacggatttgtacccaccatcctggttgcctgttcttcaccttcttttcccaagaatggcctaaagagtcgcagcgtaacctgtgtctcctcaaaacttccgaaagcggtctgccctctacccgaatcaagaagagcaaggccttgtcaggattttcgcttcaatcatgtaggcattcgattccagtcttttgccactcgagcttttaccatgataccgactttctgggagaagaacttgatattgttgcagcaaaatcgcatgaagcctgtcagaagttgtgtactaacgcggttcgttgccagtttttcacctataccccagcccaagcctcatgcaacgaaggaaaggggaagtgttaccttaagctctcctcaaacggtagccccaccaaaattcttcatggccgaggaggcatttccggatacaccctgagactgtgtaagatggataacgaatgtactaccaagattaagccaagaatcgtcggcgggaccgcatcggtccgaggtgaatggccctggcaggtgaccctgcataccacttcacctactcaacgccacttgtgcggaggctcgattattggaaaccagtggattctgaccgcagcccattgtttctacggtgtggagtcgcccaagattctccgtgtgtacagcggtattctgaaccaatcagagataaaggaggacactagcttttttggcgtgcaggagataatcatacatgaccaatacaaaatggcagagtcgggatacgatatcgccttgctgaagctggagacgaccgtgaactacaccgattcacaacggccgatttgtctgcccagcaaaggtgaccgcaatgtgatctacaccgactgttgggtgactggttggggatacagaaaacttcgagacaaaatacaaaacactctgcaaaaggcaaagatccccctcgtcaccaacgaagagtgtcagaagagataccgcggtcacaagatcactcacaagatgatctgtgccggttacagagaaggagggaaagatgcatgtaagggcgattccggaggaccactgtcttgcaaacataatgaggtctggcaccttgtgggtattacgtcctggggcgagggatgcgcccagagagagcgtccaggagtgtacacgaacgtcgtggaatacgtcgactggattcttgaaaagacccaagcagtg

SEQ ID NO: 9455 - DNA, 1875 bp, Artificial Sequence
  Description of Artificial Sequence: Synthetic coding sequence
atgatcttcttgtaccaagtggtgcacttcatcctgttcacgagcgtgtcaggcgagtgtgttacgcagctgctcaaagatacatgtttcgagggcggggatatcaccaccgttttcacaccaagcgcaaaatactgccaagtcgtgtgcacataccacccacgatgcctattattcacatttacggcggagagtccttctgaagacccgacgaggtggttcacctgtgtgctgaaggactctgtgaccgagaccttgccgcgggtgaatcgaaccgccgccatcagtggctattcattcaagcagtgcagccaccaaattagcgcatgtaataaagatatctacgtcgatctggatatgaagggcattaattataactcctcggtcgcgaagagcgcgcaagagtgccaagagcgttgcaccgacgatgttcattgtcactttttcacctacgcgactcgccaattcccgagcctggaacatcgcaacatctgtctgttgaaacacacccagactggtacgcctacccgcatcaccaagcttgacaaggtggtgtctggtttctcccttaagtcctgcgcgctctcaaatttggcctgcattcgcgacatcttccctaacacagtctttgcagacagcaacatcgatagcgttatggcacctgacgcattcgtttgcggaaggatctgtacccaccatccaggctgcttattttttaccttctttagtcaggaatggccgaaggagtcccagagaaatctgtgtctgttaaagaccagcgagagcggcctcccatctacacgcatcaaaaagagcaaagctttgtctggttttagcctgcaaagctgtaggcactcaatccctgtgttctgccactccagcttctatcacgataccgatttcctgggtgaggaacttgacattgtcgcagcaaagagccacgaggcatgtcagaaactttgtaccaatgcggtgcgctgtcagttttttacatacacccctgcccaggcatcgtgcaacgagggtaaggggaagtgctacttaaaactatctagcaacgggtcaccgactaagattctgcacggtcgaggtggcataagcggctacaccctgcgtttgtgtaaaatggataacgaatgtaccaccaagatcaaacctcgtattgtcggaggtactgcgagcgtgcggggtgagtggccatggcaagttacactgcacacaacctctcctacccagcgccacctatgtggtgggtccattatcggtaatcagtggatcctgaccgcggcccattgcttttacggagttgagtctccaaagattctgagggtctacagcggcatcctgaatcagtccgagatcaaagaagatacttctttcttcggcgtccaggagatcatcattcatgaccaatacaagatggcagaatccggctacgacatcgcgctgctgaaactggagacaaccgttaactacaccgacagccaacgcccgatctgcctgccttccaaaggtgaccggaatgtgatctacacggattgctgggttacgggatggggttatcgcaaactgagagataagattcaaaacaccctgcagaaagccaaaatcccgctggtaacgaacgaggaatgccagaagcgttaccgaggccacaagatcacgcataaaatgatctgtgcgggctatcgcgaaggtggtaaggatgcgtgtaagggtgattccggcgggccattgtcttgtaagcacaacgaggtttggcacctggtaggaataacgagttggggggaagggtgtgcccaaagggagcgtccgggtgtgtacacgaacgttgtggaatacgtcgactggattctggagaagacgcaagcggtg

SEQ ID NO: 9456 - DNA, 1875 bp, Artificial Sequence
  Description of Artificial Sequence: Synthetic coding sequence
atgatcttcctctatcaggtcgtccacttcatccttttcacctccgtctcgggcgaatgcgtcactcagcttcttaaggatacgtgtttcgagggcggcgatattactaccgttttcactccctctgccaagtattgtcaggtggtttgcacctatcacccccgttgcctgttgttcacctttaccgccgagagcccctcggaggaccccacgagatggttcacctgcgtcctgaaggatagtgtcaccgaaaccctccctcgtgtgaaccggacggccgctatttcgggctactctttcaagcagtgctcccaccagatctccgcttgcaacaaggacatttacgtcgacctggacatgaagggcatcaactacaacagtagcgtcgcaaagtctgcccaggagtgtcaggagcggtgcactgacgacgtccactgccatttcttcacttatgcaactcggcaattcccctcgctggagcaccggaatatatgcctactgaagcatacccagactggcacccctacccgcatcaccaagctcgataaagtggtgtccggattctcgttgaagtcctgcgctctgagcaacctggcctgtatccgggacatctttcccaacactgtcttcgcggactccaacatcgactcagtaatggcgccggatgcgtttgtctgtggtagaatctgtactcatcaccccggctgccttttcttcaccttcttctctcaggaatggcctaaggagtcccagcgaaacctgtgcctgttgaagacttccgagtccgggctacctagcactcgcattaagaagtccaaggcgctttcgggattctcgcttcagtcctgccggcactccatcccggttttctgtcattcgtccttttaccatgatacggacttcctgggcgaggagcttgatatcgtcgccgccaagtctcatgaggcctgccagaagctgtgtaccaacgccgtacgttgccaattctttacttacactccagcacaggctagctgtaacgagggcaaaggcaagtgctatctaaaactctccagcaacggcagccctacgaagatcctgcacggtcggggcggcatctcaggttacactctgcgtctttgcaagatggataacgagtgcacaactaagatcaagccccgtatcgtcggcggaactgcctcggtccgtggtgagtggccctggcaggtgactctgcacaccacaagccctacccaacgacatctgtgcggtggatccatcattggaaaccagtggatcctcaccgcagcgcactgcttctacggcgtcgagtcccccaaaatactccgcgtttactccggtatcctgaatcagtctgagatcaaggaggacacctcgttcttcggtgtgcaggagataatcatccacgatcaatacaaaatggccgagagcgggtatgatatcgcacttttgaagttggagacgaccgtaaactacacggacagccagcgccccatctgccttccgtccaagggagatcgaaacgtcatctacactgattgctgggtgaccgggtggggatacaggaagctgcgagataagatccaaaacacactgcagaaggccaagatcccccttgttactaacgaggaatgtcagaagcgctaccgaggccataagatcacgcacaagatgatctgcgccggctaccgtgagggaggtaaggatgcctgcaagggagactccggtggccctctgtcctgtaaacataacgaggtgtggcatcttgtcggtatcacttcctggggcgaaggttgtgcccagcgtgagcgccccggtgtgtacaccaacgtggtcgagtacgttgattggattctcgagaagacccaggccgtc

SEQ ID NO: 9457 - DNA, 1875 bp, Artificial Sequence
  Description of Artificial Sequence: Synthetic coding sequence
atgatttttttatatcaagttgtccattttatccttttcacaagtgtcagtggagaatgtgttactcaacttctcaaggatacatgttttgaaggaggagatattacaaccgtgtttacaccttcagcaaaatattgtcaggttgtgtgtacgtaccacccacggtgtttactttttacattcaccgcagagagtccctcggaagacccaactcgttggttcacgtgtgttcttaaagattcggttacagagactctaccccgagttaaccgtaccgcggctatttcgggatactcattcaagcagtgctctcaccagattagtgcatgtaataaggatatttacgtggaccttgatatgaaaggaattaattacaacagctcagtcgcaaagtcagcacaagagtgtcaagaaagatgcactgatgacgttcattgccacttcttcacttatgctactaggcaatttccttcattagaacaccgtaatatctgtttgctcaagcatacgcagaccggaacacccacaagaattactaagcttgacaaggtcgtttctggattttctttgaagtcatgcgcactatcaaatttagcgtgtattcgagatatctttccaaatactgtattcgccgattcgaatattgattctgttatggcaccagatgccttcgtttgtggtagaatttgtacgcaccatccagggtgcttgttctttactttcttttcacaagaatggcctaaagagtcgcagaggaatctctgcttacttaaaactagcgaatctggtctcccatcaacccgtataaaaaagtcaaaagccttatccgggttttcgttgcaatcgtgccggcattcaatcccagttttttgccactcatcattttatcatgacaccgattttcttggagaagaacttgatattgtagcagcaaaatcgcacgaagcatgtcaaaaactatgtacaaacgctgtcagatgtcagttttttacctatacccccgcgcaagcatcttgtaatgaaggaaaaggaaaatgctatctaaagttatcgtcaaatggatcgccaacaaagatcttacatggcagaggaggtatttctgggtacaccctacgtctttgtaaaatggacaacgagtgcacgacaaagattaagccaagaatcgttggaggaactgctagcgttcgcggagaatggccatggcaggttacattacacacaaccagcccgactcaaagacatctttgtggtggttctattattggaaaccaatggatcctcacggccgctcattgtttttatggagtcgagagtccgaaaatcttgcgtgtttattcaggtatccttaatcaatctgagatcaaggaagatacttcattctttggagtacaagaaattattattcacgatcagtacaaaatggcagaatcgggttatgacattgcattacttaagctcgaaacaacggttaactatacggattcgcaacgaccgatatgtctcccaagtaagggcgatagaaatgtcatatacactgactgttgggttacaggttggggttataggaagcttcgagataaaattcagaatactcttcaaaaggccaaaatccctcttgtgactaatgaagaatgtcaaaaacgatacagagggcataagattacccataaaatgatttgtgccggctatcgcgaaggaggaaaggatgcatgtaaaggagactccggcggtcctttatcctgtaaacacaatgaagtctggcacttggttggaataacttcctggggagaaggatgtgcgcaacgagaacgaccaggtgtttacactaatgttgtagaatacgtagattggattctcgagaaaacccaagcagtg

SEQ ID NO: 9458 - DNA, 1875 bp, Artificial Sequence
  Description of Artificial Sequence: Synthetic coding sequence
atgatttttctgtaccaggtggtgcatttcatcctgtttacctccgtgtcgggcgaatgcgtgacccagctgcttaaggacacctgcttcgagggcggagatatcactaccgtgttcaccccgtcagccaagtactgccaggtggtctgtacttaccatcctcgttgtctcttgttcaccttcacggcggagtcgccgtcggaagatccaactcggtggttcacgtgcgtgctgaaggactccgtgactgaaacgctgccgcgcgtgaacaggactgcagcgatctctggttacagcttcaagcaatgttcacatcagatctcggcttgcaataaagatatctacgtggacctcgatatgaagggaatcaactacaactcgagcgtcgccaaatcggctcaggagtgccaggaacgctgcaccgatgatgtgcattgtcatttctttacgtacgccacccggcaattccccagcctggagcatcggaacatttgcttgctgaagcacactcaaacgggcactcctaccagaatcaccaagctcgataaggtcgtgtccggattctcactgaagtcctgtgccttgtcaaacctcgcgtgtatccgggacattttcccgaacaccgtgttcgctgactctaacattgactcagtcatggccccggacgccttcgtctgcggcagaatttgtacccaccatccgggctgccttttctttacctttttctcacaagaatggccaaaagagtcccaacggaacctctgcctcttgaaaacgtccgagtcgggactgccaagcactagaatcaagaagtcaaaagccctgtccgggttttcgctccagtcatgccgccactccatccccgtgttctgccactcatccttctaccacgacaccgacttcctgggggaggaattggatatcgtggcagccaagtcgcacgaagcatgccaaaagctctgcaccaacgccgtgcgctgccagttcttcacgtataccccggcccaggcaagttgcaacgaagggaaaggaaagtgctatctgaagctgtcaagcaatggaagcccaaccaaaatcttgcacggacgcgggggaatctcgggttataccctccgcctctgcaaaatggataatgaatgtacgaccaagatcaagccacgcatcgtgggaggcaccgctagcgttagaggagagtggccgtggcaagtgacgttgcacaccacctcacctactcaacgtcatctttgcggtggatccatcatagggaaccagtggatcctgaccgctgcgcattgcttctacggggtcgaatcgcccaagatcctccgggtctatagcggtattttgaatcagagcgagattaaggaggatacttcctttttcggcgtgcaggaaatcattatccacgaccagtacaagatggcagaatctggctacgatatcgcccttcttaagctcgaaaccactgtgaactacactgatagtcaaagacccatctgtctgcctagcaaaggagacagaaacgttatctatactgactgctgggtgactggatggggctataggaagttgagggacaagattcaaaacaccttgcaaaaggcgaagatcccactcgtgaccaacgaggaatgtcagaagagataccgaggccacaaaatcactcacaagatgatttgtgcgggatatcgggaaggaggaaaagacgcctgcaagggtgactctggtggaccgctgtcttgcaagcataatgaggtatggcacctggtcggcatcacttcgtggggcgaaggatgcgcgcagcgggagcgcccgggggtgtacaccaacgtggtcgagtacgtcgactggatcctggagaaaacccaggctgtg

SEQ ID NO: 9459 - DNA, 1875 bp, Artificial Sequence
  Description of Artificial Sequence: Synthetic coding sequence
atgatttttctttaccaggttgtgcactttatcttattcacctccgtgagtggcgagtgcgtcacccaactgctaaaggacacttgctttgagggtggggacattactacagtgtttaccccaagtgccaaatattgccaagtagtatgcacctatcacccccggtgtctcctattcacgttcactgccgagagcccctcggaagaccccacacgatggtttacttgtgtactgaaagactctgtgaccgagaccttgccaagagtaaatcggactgcggcaattagcggctactctttcaagcagtgcagtcatcaaatcagtgcctgtaataaagacatttatgtggacctcgatatgaaggggatcaactacaattcttcagtggcaaaatccgcacaggaatgtcaggaaaggtgtacggatgatgtgcactgtcacttctttacctatgccaccaggcagtttcctagtcttgaacacaggaacatctgtcttctgaagcacacacagaccggtacgccaacaagaataactaagttggataaggttgtaagtggtttcagtctcaaatcctgcgccctgtccaatttggcttgcatccgcgacatattcccaaatacagtctttgcagattccaatatcgattctgtgatggctcccgatgcttttgtgtgcggccgaatatgcacacaccacccaggatgtctgttttttaccttcttcagccaggagtggcccaaggagagtcaacgtaatttgtgcctgctcaagacaagcgaatcaggcctacccagtacccggattaaaaaatccaaagccttgtccggcttctcactgcagagttgtcgccacagtattcccgtgttctgtcactcttcattctaccatgacaccgacttcctaggagaagaactcgatatcgtcgccgctaagtcccatgaagcatgccagaaactctgtactaatgctgtgcgttgccaattttttacatacacaccggcgcaggcatcatgcaatgagggcaagggcaagtgctacctcaaactatcttcgaacggaagccctactaaaatcctgcatggtcgaggaggaatctctggttataccttaagactgtgcaagatggacaatgaatgtacaactaaaatcaagccccgaatcgtcgggggtacggcttctgtccgaggagagtggccatggcaagtaacattgcacacgaccagccctacacagagacacctctgcggaggatcaatcattgggaaccaatggatcctgacggccgcgcactgtttttacggcgtggaaagtccgaagatcctacgggtctattccggtattttgaatcagagcgaaataaaagaagacacgtctttcttcggagtccaggagatcatcatacacgaccagtataaaatggccgaaagcggatacgacatagcactgctgaagctcgaaactactgtgaactataccgattcccagagacccatttgtctgccgagcaagggagacaggaacgttatttataccgactgttgggtcaccggctgggggtatcgaaagctgagagataagatccagaatacccttcagaaggctaaaatcccattggtgactaatgaagagtgccagaaacgttatcggggacacaaaataacccataaaatgatctgtgcgggatacagggaaggcggcaaagatgcttgcaagggggacagcggcggacccctttcttgcaaacacaatgaagtgtggcatctggtcggtataacctcatggggcgaggggtgtgcccagagagaacgtcccggcgtttacaccaacgtggtggagtacgtcgactggatcctggagaagacccaggctgta

SEQ ID NO: 9460 - DNA, 1875 bp, Artificial Sequence
  Description of Artificial Sequence: Synthetic coding sequence
atgattttcctgtatcaagtggtacattttatacttttcacatctgtgtctggagaatgtgttactcagctcctaaaagatacatgtttcgaaggaggagatataacaacagtgtttacgccttcagctaaatactgtcaagtggtctgcacatatcatccaagatgtcttttattcacatttactgcagaatctcccagtgaagatccaactaggtggtttacatgtgttctgaaagatagtgttacagaaactctcccacgcgtcaacaggactgcagcaatctcgggatattcatttaaacagtgctctcatcagatttccgcctgtaacaaagatatatatgtggacctcgacatgaaaggaataaactataactcctctgtggcaaaatccgctcaggaatgtcaggaacgttgcacagatgacgttcattgtcattttttcacttatgccacaaggcagtttccctccctggagcatcggaacatctgtctcctgaaacatacacagactgggacaccaacaaggatcactaagcttgataaagtggtgtctggattctcgctgaagtcgtgtgcactgtctaaccttgcttgtatcagggatatcttccccaatacagtatttgcagattccaatatcgacagtgtgatggctccagatgcttttgtctgcggacgaatctgtactcaccaccccggatgtctattttttacgtttttctcacaggaatggcctaaagagtctcagcggaacctctgtttgctgaaaacatcagaaagtggactgccttccacaaggataaaaaaatcgaaagcactgagtggattctctcttcagtcttgccgccattcaatcccggtgttttgtcactcctctttctaccatgatacagacttcttaggggaggaactagatatagtcgcagccaaatcccacgaagcgtgccagaaactctgtacaaacgcggtaaggtgccagttcttcacttacactcccgcacaggcctcatgtaacgaagggaaggggaaatgttatctgaaactctcttctaatggatccccaactaaaatcctacacgggcggggggggataagtgggtacactcttaggctttgtaaaatggataacgagtgtacgacaaaaatcaaacctagaatagtgggaggaactgcatcggttcggggagaatggccatggcaggtcacacttcatacaacttctcctactcagcgccatctctgtggaggatctataatcgggaaccaatggattctcacagcagctcattgtttctacggggtcgaaagtcccaagatcctgcgggtgtatagtggaatactaaaccagtctgagataaaagaagacacttctttttttggggttcaagaaattatcatccatgatcagtacaaaatggctgaatccgggtatgatatcgccctactaaaactggaaactacagtcaactatactgactcccaacggccaatctgtctcccatcgaaaggagatagaaatgttatttatacagattgctgggtgacagggtgggggtatcgcaaactgagagataaaatccagaatactctacagaaagccaaaatacccctcgtgacaaacgaagagtgtcagaaaaggtatagaggacacaagatcacacataagatgatctgtgcaggatatagagaagggggaaaagatgcatgcaaaggagattcaggaggacccctgtcatgtaaacacaatgaggtgtggcatttagtgggaataacttcttggggggaagggtgcgctcagagggaacgaccaggagtctacactaacgttgtcgagtatgtcgattggattctggaaaaaactcaggcagtg

SEQ ID NO: 9461 - DNA, 1875 bp, Artificial Sequence
  Description of Artificial Sequence: Synthetic coding sequence
atgatctttctgtaccaggtggtgcactttattctgtttacctctgtgagcggcgaatgtgttacccagctcctcaaggatacctgcttcgaggggggcgatattacgaccgtgttcactccatccgccaagtactgtcaggtggtgtgcacgtaccatcctagatgcctgctgtttactttcaccgcagaatcgccctccgaggaccctactcgttggtttacctgcgtgctgaaggactcggtgactgaaaccttgcccagagtcaaccggactgcagcaatctcgggatactcctttaaacaatgtagccatcagatcagcgcctgtaacaaagatatctacgttgatttggacatgaagggaatcaattacaattcgtccgtggcaaagtccgcgcaggagtgccaggaaaggtgcaccgatgatgtccattgccactttttcacttacgcaaccaggcaatttccgtcgttggagcacaggaacatttgtctgcttaagcatacccagaccggaacccccaccagaatcactaaactcgataaggtggtgtccggattttcacttaaatcatgtgcacttagcaacctcgcatgtattcgagatatcttccctaacactgtgtttgcggactccaacatcgatagcgtcatggcgcctgacgctttcgtgtgcggaaggatctgtactcatcatccaggttgcctgtttttcacttttttctcgcaggaatggcctaaggaatcgcagaggaacctttgtctgctcaagacttcggaatccggcctcccctccacccgaattaagaagtcgaaggccctgtcaggattttcactgcagtcatgtcgacattcgatcccagtcttttgtcattcgtcattttaccatgacaccgactttcttggagaagaactggatatagtcgctgcaaagtctcatgaggcctgccagaagctgtgtaccaatgcggtgagatgtcagttctttacttacacccctgcccaggcctcctgcaacgaaggaaaaggtaaatgctaccttaaactttcgtcgaacggttcgccaactaagattcttcatggccgcgggggtataagcggatacaccctgcgcctctgtaagatggataacgaatgtaccaccaagattaaaccacgcatcgttggagggaccgcgtcagtccggggggaatggccctggcaggtgaccctccatacgacctcgccaactcaacgccatctgtgcggtggatccattataggtaaccagtggattcttactgcagcccactgcttttacggagtggagtccccgaagatacttagggtgtactccggcatccttaaccaatcggaaatcaaggaagatacctcgttcttcggagtccaggaaatcatcattcatgaccaatacaagatggcagaatcaggttatgatattgcactcctcaaacttgaaacgactgtgaactacaccgatagccaacgcccgatctgcctgccctctaaaggagacagaaacgtgatatacacggactgttgggtgactgggtggggctaccgcaagctgcgtgacaaaattcaaaacaccctccaaaaggctaagataccgttggtgaccaatgaagaatgtcagaagcgatatcgtggacacaagattactcacaagatgatttgtgcaggctaccgcgaaggaggtaaggacgcatgcaagggtgactcgggcggcccattgtcctgtaaacataacgaagtgtggcatcttgtgggcattacttcgtggggtgagggctgcgcacaacgcgaaagaccaggcgtgtacaccaacgtggtggaatacgtcgactggatcctggaaaaaacccaggctgtg

SEQ ID NO: 9462 - DNA, 1875 bp, Artificial Sequence
  Description of Artificial Sequence: Synthetic coding sequence
atgatttttctgtaccaagttgtgcacttcattctgtttacctcggtcagcggagaatgcgtcactcaactcctgaaggacacttgttttgaaggtggcgacataactaccgtctttactccatctgcgaaatactgtcaagtggtgtgtacctaccaccctagatgtctgttgttcacctttacggcagagagcccttcggaggacccaacccgatggtttacgtgtgtgctgaaggattctgtgacggagacgttgcctcgtgtgaaccggaccgccgctatctccgggtactcattcaagcagtgttcgcaccaaatttccgcatgtaacaaggacatctacgtcgatcttgatatgaagggcataaactacaactcctccgtggcaaagagtgcacaagagtgtcaggagcgctgcactgatgacgtgcattgccacttctttacctacgcaaccagacagtttccatccttggaacacagaaacatctgcctgcttaagcatacccaaaccgggactccaacccgcattaccaaacttgataaggtggtgtctggattctcgcttaagtcgtgtgcgctctccaatcttgcatgtattcgagacattttcccaaatactgttttcgcagactctaatatcgactcggtgatggcaccagatgcatttgtctgtggacgtatttgcacccatcatccagggtgtctgttctttacctttttcagccaggagtggcctaaggaaagccaacgcaacctgtgtctgctcaagacgagcgaatcaggcctcccttccacccgcataaagaaatcgaaagcccttagcgggttctcgcttcaatcatgtcgccacagcattcctgtgttctgtcattcctcattctaccatgacactgactttctgggcgaagagcttgatattgtggccgcaaagtcacatgaagcctgccaaaaactctgtactaatgcggtgaggtgtcagtttttcacctatactcccgcacaggccagctgtaatgaaggaaagggaaaatgttaccttaaacttagcagcaacggatccccgaccaaaatcctccatgggcggggtggcatttccggatacactctgagactgtgtaagatggacaacgagtgtactactaaaatcaagccaagaattgtgggagggaccgcatccgtgagaggcgaatggccatggcaagtgacgcttcacactactagcccgacgcaaagacatctgtgtggtggatccatcattgggaaccaatggatcctgactgcagcgcactgtttttacggggtggaatcaccaaagatccttcgcgtgtacagcggaatcctgaaccagtccgaaatcaaggaggacacttcattctttggagtgcaagaaatcattatccatgatcagtacaagatggcagagtcaggatatgacatcgcactgctcaagctcgagactaccgtgaactatactgattcgcagcgccctatttgcctccctagcaagggagatcggaacgtgatctataccgattgttgggtgactggttggggttacaggaagctccgggataagattcaaaataccctgcaaaaggcgaagattccgttggtgaccaacgaggaatgtcagaagagataccggggtcacaagatcactcataagatgatctgtgcaggctaccgggagggaggaaaggacgcgtgcaagggtgattccggtggtcctctgagctgtaaacacaatgaagtgtggcatctggtaggaattacttcctggggggagggatgtgcacagagggagcgtccgggtgtctacacgaatgtcgtcgaatatgtggactggattctggaaaagactcaggcggtg

SEQ ID NO: 9463 - DNA, 1875 bp, Artificial Sequence
  Description of Artificial Sequence: Synthetic coding sequence
atgatctttctgtatcaagtggtgcactttatcttattcacttctgtaagtggggagtgtgtgacccagttactgaaggatacatgttttgaaggtggcgatatcaccaccgtattcacgcctagtgccaagtactgccaagtggtgtgtacttaccacccaaggtgtctcttgttcacctttactgccgagtccccctcggaagaccccactcgctggtttacttgtgtactgaaggatagcgtaaccgagaccctcccacgcgtaaatagaactgcagctatttctgggtatagtttcaagcagtgtagccaccagatttcagcttgcaataaggatatttacgtggatttagatatgaagggaatcaattataatagtagcgttgccaagtccgctcaagagtgtcaagagcgttgtacggatgacgtgcactgccatttttttacatatgctacaagacaatttccctccctagagcacaggaacatctgtctcctcaaacacacgcaaacagggaccccaaccaggatcaccaaactggacaaagttgtatcgggcttctccctgaaaagctgtgccttgtccaacctcgcttgcatccgggacatctttccaaacaccgtgtttgcagattcaaatatcgattccgtgatggcgccagatgctttcgtgtgtggtcggatttgcacacaccaccccgggtgtctgttttttacgttcttctctcaagaatggcccaaagagtcacagcgcaatctttgcctactcaagacctccgagtccggcttaccaagcacccgtattaaaaagtcgaaggccctatccggcttcagcctgcaatcatgcaggcacagcatcccagtgttctgccacagcagcttttaccatgataccgactttcttggcgaagagttggatatcgtggccgccaaatcccacgaggcctgccagaaactttgcaccaatgcggtgcggtgtcagttcttcacatatactcccgcccaggcatcttgtaacgaggggaagggcaagtgctatttgaaattatctagtaatgggagtcccactaaaatattgcacggcagaggcggaataagtggctacactcttagattgtgtaagatggacaatgagtgtacaacaaagatcaaacccaggatcgtgggtgggacagccagcgtgcggggcgagtggccttggcaggtgacactgcacacaacttcaccaacccagagacatttgtgtggcggttctataattggaaaccaatggattctgacagccgcacactgcttttatggcgtggaaagtcccaagattctcagggtgtactctgggattctcaaccaaagcgagataaaagaggacacgagcttttttggagtccaggaaatcattatacacgaccagtacaagatggccgaatcgggttatgacatcgccctgttgaagctggagaccaccgtgaattacacagatagccagagaccaatctgtctgccctctaagggggacagaaacgtaatctatacagattgctgggtgaccgggtggggctacaggaaactccgtgacaagatccagaacaccctgcagaaggccaaaatcccattggtgacaaatgaagaatgtcagaagcgttatagaggacacaaaatcacacacaaaatgatctgtgctgggtatagggagggtggtaaagatgcatgcaagggcgattctggtgggcctttatcctgtaagcacaacgaagtttggcatctggtggggataacatcgtggggtgaggggtgtgcccaaagggagagacccggcgtgtataccaacgtcgtcgagtatgtggactggatactggaaaaaacacaggctgta

SEQ ID NO: 9464 - DNA, 1875 bp, Artificial Sequence
  Description of Artificial Sequence: Synthetic coding sequence
atgatttttctctaccaggtggtacactttatcctgttcacttcagtctcgggtgagtgcgtgacacagctcctcaaggatacttgttttgagggcggagacatcactactgtgttcactcctagtgctaaatactgccaggtggtgtgcacttatcacccacggtgtctgcttttcacattcacagcagagtctccttctgaggacccaaccaggtggttcacctgcgtgctaaaagacagcgtcaccgagacgcttccccgtgtgaatagaactgccgccatcagcggctattcgttcaaacagtgcagccaccaaatatctgcctgtaataaagatatttacgttgatctggacatgaaagggataaactacaattcttccgtggcaaaatccgcccaagagtgccaggagcgttgtaccgacgacgtgcattgtcatttctttacatacgcaaccaggcagtttccctccctagagcatcggaatatttgtctgctcaagcacacacagacaggcacaccaacaaggattacgaaactagacaaagttgtctcgggtttctctcttaagagctgtgcccttagcaaccttgcatgcattcgcgacatcttcccgaacaccgttttcgctgacagtaacatcgattcagtcatggcgccagatgcctttgtctgtggacgaatttgcacccatcatccgggctgcctcttcttcacattcttttcccaggagtggcccaaggaatctcagcgcaacctttgtctgctcaaaacaagcgagagtggcctaccctctacccgcatcaagaagtctaaggccctgagcggatttagtctacagtcatgcaggcactctatcccggttttttgccactcatcattctaccacgacactgacttccttggcgaagagctggacattgtagcagctaagagccacgaagcttgtcaaaagctgtgtacgaacgctgtaagatgccaattcttcacttacactcctgcacaagctagttgcaacgaagggaaggggaagtgttatttaaagctgagctctaatgggtctcctactaagatactgcatggccgcggaggaatttcaggatacacgttacggttgtgcaagatggacaacgaatgcacaacgaagattaaaccaagaattgtggggggaacagcatctgtgcggggcgagtggccttggcaggtaactctccatacaactagtcctacccaaaggcatctgtgtggaggaagcatcatcggtaaccagtggatcctgacagctgcacattgcttttacggtgtggagtcacccaaaatccttcgagtctattctggaatcctgaatcagtccgagataaaggaggacacttctttcttcggggtacaggagatcataatccacgaccagtacaagatggccgagtcgggctacgacattgcgctgttgaaactggaaacgacagtgaactacaccgattcacagaggcccatatgtctgccctcaaagggggaccgcaatgtcatctacaccgactgttgggtcaccggatggggctaccgtaaattgcgcgataagattcaaaacacgcttcaaaaggctaaaatcccactcgttacaaacgaggaatgtcaaaaaaggtaccgcggccataaaatcacgcacaagatgatctgtgcaggctatagagaagggggaaaggacgcgtgcaaaggcgattctggaggcccattgtcttgcaagcacaatgaggtttggcatttggtgggaatcacatcctggggggagggctgcgcccagcgcgagaggcctggggtatacaccaatgttgtcgaatacgtagattggattctggaaaaaactcaggccgtg

SEQ ID NO: 9465 - DNA, 1875 bp, Artificial Sequence
  Description of Artificial Sequence: Synthetic coding sequence
atgatctttctgtaccaggtggtgcatttcatcctgttcaccagtgtgtcaggagagtgcgtgacccagctgctcaaagacacctgtttcgaaggaggcgatatcactactgtctttactccgtcagcgaagtactgtcaagtcgtttgtacttaccacccgcggtgtttgctcttcactttcactgcagaatccccgtcggaagatccaacccgctggtttacttgcgtgctcaaggattccgtgactgaaaccctcccgcgcgtgaaccgcaccgccgccatctccggttactcattcaagcagtgctcgcatcagatcagcgcctgcaacaaagatatctacgtggacctggacatgaaaggcatcaattacaatagcagcgtcgccaaaagcgcccaagaatgccaggagagatgtactgatgacgtccactgccatttctttacctacgcaacgcgccagttcccgtccctcgaacatagaaacatctgcctgctgaagcatactcagacggggactccgacgcgcatcaccaagctcgacaaggtggtcagtggattcagtctgaagtcctgcgctctcagcaatctggcctgcatccgggacattttcccaaataccgtgttcgcagacagcaacatcgactccgtcatggctccagacgcattcgtgtgcggacgcatctgcacccaccacccggggtgtctgttctttaccttcttttctcaggagtggccgaaggaatcacaacggaatctctgcctgctcaagacttccgagtcggggctcccgagcacccgcattaagaagagcaaagccctttcaggattctcgctgcagagctgtagacattcgatcccggtgttttgtcactcatcgttctaccacgacaccgacttcctcggggaagaactggacatcgtggccgcgaagtcgcacgaggcttgccagaaattgtgtactaacgctgtgcggtgccagtttttcacttatactcctgcgcaggcgtcatgcaatgaaggaaaggggaagtgctacctgaagctctcgtcaaatggcagcccgactaaaatcctgcacggacgtgggggaatttcgggatacaccctgagattgtgcaaaatggataacgagtgcacgacgaagattaagcccagaatcgtgggcggaactgcgtcggtgcgcggcgaatggccttggcaggtcactttgcacaccacctcgccaactcaacgccatctgtgcggtgggtccatcatcggtaaccagtggatcctgaccgcggcgcactgcttctatggcgtggagtccccaaaaatcttgcgggtgtacagcggaattctcaatcagtccgaaatcaaggaggatacgagcttcttcggtgtgcaagagatcatcatacatgaccaatacaagatggcagaatcaggatacgacatcgcactcctcaagctcgaaaccaccgtgaactacaccgattcgcagcgacctatctgcctgccgtccaaaggggaccgaaatgtgatctacactgactgttgggtgactgggtggggttaccgcaagttgagggataagatccaaaataccctccaaaaggcaaagatcccactggtgactaatgaagagtgccaaaagcggtaccgagggcacaagattacccataagatgatctgcgctggataccgggaaggaggaaaggatgcgtgcaagggcgactcggggggaccacttagctgcaaacataatgaggtgtggcacctcgtcggcatcaccagctggggggaaggatgtgcgcagagggagcgcccaggagtttacactaatgttgtggagtacgtggattggattctggaaaagacccaggccgtc

SEQ ID NO: 9466 - DNA, 1875 bp, Artificial Sequence
  Description of Artificial Sequence: Synthetic coding sequence
atgatattcctgtatcaagtcgttcactttattctcttcacatccgtgtctggggaatgcgttacccagttacttaaagatacgtgtttcgaaggtggtgatatcactaccgtcttcactccctctgccaaatactgtcaggtcgtatgcacctaccatcctcgatgtcttctgttcacatttaccgccgaaagcccttccgaagaccccactcggtggttcacctgcgtactaaaggactctgtcacggaaaccttgcctcgtgtcaaccgcaccgccgccattagcggttatagtttcaagcagtgtagccaccagatcagcgcttgtaacaaggacatttatgtggatctcgacatgaagggcatcaattataactcctccgtggctaagagcgcccaggagtgtcaggaacgctgtacagacgacgtacattgccattttttcacgtacgcaactaggcagttcccgtccctggagcacagaaacatttgtctactgaaacacacgcagacggggacccccacaaggataaccaagctggataaggtggtcagtggcttttcccttaaaagctgcgccctctccaatttggcgtgtattcgggacatatttccaaataccgttttcgctgattctaacattgacagcgtgatggcacctgatgcctttgtctgtggcaggatttgtacccatcacccagggtgtctgttttttaccttttttagccaggaatggcctaaggaaagtcagagaaacctatgcttgcttaaaactagcgagtcaggcctcccctcgactaggatcaagaagtcaaaggctctctcaggattctctctccagagttgccgacacagcattcctgtcttctgccatagttccttttaccacgatacagacttcctgggggaggagttggatatcgtggcggcgaagtctcatgaggcctgccagaagctctgtacaaatgcagttagatgtcagttttttacttatacgccagcccaggcaagctgtaacgagggcaaaggcaaatgttacttaaagctgtctagtaatgggagccctacgaaaattttgcatggccgcggcgggattagtgggtatactttgagattgtgcaagatggacaatgaatgcacgacaaaaattaaaccgcgaatcgttggcggcaccgctagcgtgcgaggagagtggccttggcaagtgacactgcacactacctctccgacacagagacacctttgcggcggatcaatcatcggaaaccagtggattctcaccgccgctcactgtttctacggagtggaaagccccaagatactgagggtgtactcgggcattctcaaccagagtgagataaaagaggatacttctttcttcggcgtgcaagagattatcatacacgatcagtataaaatggcggagtctgggtatgatattgcacttctgaagctggaaactacagtaaattacacagacagccaacgcccaatatgcctcccaagtaaaggggatcgcaacgttatttacacagactgctgggtaactgggtggggctatcgaaagctgcgggacaagatccagaataccctgcagaaggccaaaatccccctggttacaaacgaggaatgccagaaacgatatcgtggccataagattacccataagatgatatgcgcgggttaccgcgaaggtggtaaggacgcatgtaagggcgattcaggcggtcccctttcttgcaaacacaacgaggtctggcatctagtaggcattacttcgtggggggagggttgtgcccagcgcgaaagacccggggtttatacaaacgtggttgagtatgtcgactggatccttgagaaaacccaggctgtt

SEQ ID NO: 9467 - DNA, 1875 bp, Artificial Sequence
  Description of Artificial Sequence: Synthetic coding sequence
atgatcttcctgtaccaagtggtccatttcatcctgttcaccagtgtgtccggagagtgtgtgacccagttgctgaaggatacctgtttcgagggaggagacattactaccgtgttcactccgtcagcgaaatactgccaagttgtgtgtacctaccatccgcgctgtctcttgtttacttttactgccgagtcgccttcggaggacccgactcggtggttcacctgcgtgcttaaggattcggtcactgaaaccctgccgcgcgtcaatagaaccgccgcgattagcggttattcgttcaaacaatgctcacatcagatttctgcctgcaacaaggacatctacgtcgatttggatatgaagggaatcaactacaactcctcagtggccaagtcggctcaagaatgccaggaacgctgtactgacgacgtgcattgccatttctttacctacgctacgcgtcaatttccctcactggagcatcgaaacatctgccttctcaaacacacccaaactggaactcccacccgcatcaccaaactcgacaaagtcgtctcaggattctcgctcaagtcatgcgccctcagcaaccttgcatgcatccgggacatttttccgaataccgtgttcgcggactcaaatatcgatagcgttatggccccagatgctttcgtgtgcggcagaatctgcacgcaccacccgggctgcctcttcttcactttcttttcgcaggaatggcctaaagaatcgcagcgtaatctctgcctcctgaaaacctcggagtcaggattgccaagtactcgcatcaagaagtcaaaagcgctttccggcttcagcctgcaatcctgtcgccactcgatcccggtcttttgccattccagcttctaccacgacactgactttctgggcgaggaactggatattgtggcggcgaaatcgcacgaagcctgccagaagttgtgtaccaacgccgtgagatgccagttctttacgtatactcctgcccaggcgtcatgcaatgagggcaagggtaagtgctacctgaaactctcttccaatggttcgccgaccaagatactgcatggccgcggagggatctccggatacaccttgcggctgtgcaagatggacaacgagtgtactactaagatcaagccacggatcgttggagggactgcctccgtcaggggagaatggccgtggcaggtgacccttcataccacctccccaacccagcggcacctgtgtggagggtcgatcattggtaatcagtggatccttactgcagcccattgcttctacggagtcgaaagcccaaagatcttgcgcgtttactcggggatcctgaaccagagcgaaatcaaggaggatacgtcgttcttcggagtccaggaaatcattattcatgaccaatacaagatggcggaatcgggttacgatatcgcactgctgaaactggaaactactgtgaactataccgattcgcagcgcccgatctgcctcccgagtaagggcgaccggaatgtgatttacaccgactgctgggtcaccggatggggatacagaaaacttagggacaagatccaaaataccttgcagaaggcaaagatcccacttgtgaccaacgaggaatgccagaaaaggtaccgcgggcacaagatcacccataagatgatttgcgcaggctatcgcgagggaggaaaggacgcttgcaagggcgactccggcggtccactttcctgcaagcataacgaggtgtggcatctggtgggaatcacttcatggggagaaggttgtgctcagcgggaaagaccgggagtctacaccaacgtggtggagtacgtggattggatccttgaaaagacgcaagccgtg

SEQ ID NO: 9468 - DNA, 1875 bp, Artificial Sequence
  Description of Artificial Sequence: Synthetic coding sequence
atgatatttctttaccaggtggtgcactttattctctttacttccgtgagcggggagtgtgtgacgcagctgttgaaggatacctgttttgagggaggagacattaccactgtgtttaccccttcggcaaagtattgccaggtcgtgtgtacctaccatcctcgttgcttgctgtttacgtttaccgctgaatctcccagcgaagatccaactcggtggttcacttgcgtcctgaaagacagcgttactgaaacgctgccacgtgtgaacagaaccgcggcaatttccggatactcgttcaagcaatgctcgcaccaaatttctgcatgcaacaaagacatatatgtggacctggacatgaaggggattaactataactcctccgtcgcaaagtcggcacaggagtgtcaagagcggtgtactgatgatgtccattgccatttctttacttacgcgactcggcaattcccttcccttgaacataggaacatatgtctgctgaagcatactcagaccggtactcctacccggattaccaaattggacaaggtcgtgtcgggatttagccttaagtcgtgtgctctgtctaacctggcatgtattcgagatatcttcccaaataccgtgttcgcggattcaaacattgactcagtaatggcgcctgatgcctttgtgtgtggaagaatctgtactcatcaccccggctgtttgtttttcaccttcttttcgcaagaatggccgaaggaatcgcagcgcaacttgtgccttcttaagactagcgaatccggacttccatcaactcgcattaagaagtctaaggccctttcaggctttagccttcagtcgtgtagacattcgattcctgtgttttgccactcatccttttaccatgacactgactttctgggtgaggaactggacatcgttgcagctaaaagtcacgaggcatgtcagaaactgtgcaccaacgcagtgcgctgccaattcttcacttacaccccagcacaggcatcatgtaacgaaggaaaagggaagtgctatcttaagctcagctcaaatggatcgcccaccaagattctgcatgggagaggtggcatctcgggttacacgctgcgattgtgcaagatggataatgaatgtaccactaaaatcaagcctcggatcgtgggaggaactgcctccgtaagaggagaatggccctggcaggtcaccttgcatacgactagccctactcaaagacacctctgtggcgggtccattattggaaatcaatggatactgacggcagctcattgtttctacggcgtggagagcccgaaaatactccgtgtgtactcggggatcttgaaccaatcggagattaaagaggatacttcgttcttcggtgtccaagagataatcatccatgatcagtacaaaatggccgagagcggttacgatattgccctgctcaaactcgaaactactgtcaattacacggattcccaacgccccatctgcttgcctagcaaaggagataggaacgtcatatacacggactgctgggtgactggttggggctaccgtaaacttagagataagatacaaaatactctgcaaaaggcgaaaattccacttgtcaccaatgaagaatgtcagaagcggtaccgaggacataagattactcacaagatgatctgtgcaggatacagagagggaggtaaggatgcatgcaagggagactcaggggggccactcagctgtaagcacaatgaagtgtggcatctcgtgggcatcacttcttggggcgagggatgcgcgcaaagggaacggcccggagtgtacaccaacgtggtggaatacgtcgattggatcctggaaaagacccaggcagtg

SEQ ID NO: 9469 - DNA, 2196 bp, Artificial Sequence
  Description of Artificial Sequence: Synthetic coding sequence
atgtcagagacttctcgcacagcttttggtgggcgacgtgcagtgcctccaaataacagcaacgccgcagaggatgacttgccaactgtcgagctgcaaggcgtcgtcccccggggcgtgaacctgcaggagttcctgaacgtcacatctgtgcatctgttcaaagagcgctgggataccaataaagtcgaccaccatacagataagtacgaaaacaataagctgattgtgcgccgaggtcagtctttctacgtgcagatagatttctctaggccttacgatccgagaagggatctgttccgtgtcgagtatgtgatcgggcgttatccccaagagaataaaggcacctatataccagtgcccatcgtctctgagcttcaaagcggaaaatggggtgcgaagattgttatgcgggaagaccgcagtgtcagactctctattcagagtagccctaagtgcatcgtggggaagtttcgaatgtatgtagctgtgtggactccctatggcgtgcttcggacatcaaggaatccggagaccgacacatatatactcttcaacccgtggtgcgaggatgacgctgtttatctcgataatgagaaggaaagggaggagtatgttttgaatgacatcggcgttatcttctacggagaggtgaacgacattaaaaccaggtcatggtcctacggtcagttcgaggatggcattctggacacatgtctctatgtcatggacagagcccagatggacctgtcaggtcggggtaacccgataaaggtgtccagggttgggagcgctatggttaacgccaaggacgacgagggcgtcctggtggggagctgggacaatatctatgcttatggcgtgccacccagcgcctggacgggatctgtcgacattctcctggagtataggtcgtctgagaacccagtccggtatggccaatgttgggtcttcgccggcgtgtttaatacctttttgcgctgcctgggtatcccagctagaatagtcacgaactattttagtgctcacgacaatgacgcaaatctgcagatggacatttttcttgaggaagatggaaatgtcaattctaaactgacgaaagattccgtgtggaactatcattgttggaatgaagcctggatgactagaccggatctgcccgtgggttttggtggatggcaggcagtcgactctacaccccaagaaaactcagacggcatgtatcgctgtggacccgcctccgtgcaagccatcaaacacggtcacgtatgtttccagttcgacgctccgttcgtttttgctgaggtgaacagcgacctgatctatattacagcgaaaaaagacgggacacatgtcgtagagaacgtggacgccacacacatcggaaaattgattgtgacgaagcagatcgggggggacggcatgatggacattaccgacacatacaagtttcaagaaggccaagaagaggaaaggcttgcactggagacagctcttatgtatggtgcaaaaaagccactgaacacggaaggcgtgatgaagtctagaagcaacgtggacatggatttcgaggtagagaacgccgtacttggcaaggacttcaagctttcaattacatttcgaaataatagccacaacaggtatacaattaccgcgtacctgtctgccaatattacattttacaccggtgtgccaaaagcagaatttaagaaggaaactttcgacgtgactctggaaccgctcagcttcaagaaagaggcagtcctgatccaggcaggcgaatatatggggcagctgttggaacaggctagtttacatttctttgtgaccgccaggatcaacgagactagggatgtcctggctaagcagaaaagtactgttcttactattcctgagattatcatcaaggtgcgggggacccaggtggtagggagcgacatgacggtgacagtacagttcactaacccactgaaagaaaccctcagaaacgtttgggtccatctagacggccccggcgttacacggcccatgaaaaaaatgtttcgtgaaattcggcctaattcaaccgtgcaatgggaggaggtatgcaggccctgggtgagtggtcacaggaagcttattgcgtccatgtcttcggattcactaagacatgtctacggagagttggacgtccaaattcagagacggcctagtatg

SEQ ID NO: 9470 - DNA, 2196 bp, Artificial Sequence
  Description of Artificial Sequence: Synthetic coding sequence
atgagcgagacctcaaggaccgccttcggtggccgtcgtgctgtgccgcctaataattcaaacgccgccgaagatgatttgccgacagtggagctacaaggtgtggtcccccgaggagtgaatctgcaagagttcctgaatgtgacgtcggtacatctgttcaaggaacgttgggatacaaacaaggtggatcatcacacggataaatatgagaacaacaagctgatcgtccgtcgcggccaatcattctacgtgcaaattgacttttctcgaccgtacgatccccgtcgagacttgtttcgggtggagtacgtcattggacgctatccacaggagaacaaaggaacgtacattcccgtccccattgtgagtgagctacagtcgggaaaatggggcgcaaagattgtaatgcgcgaggaccgctcagttcggctgtcgatacagtcctcaccgaaatgcatcgtgggcaagtttcgcatgtacgttgccgtgtggaccccgtacggtgttttgcgcaccagccgaaatcccgagacagatacttacattctgtttaatccttggtgcgaagatgacgcggtctatctagacaacgagaaggagcgagaagaatacgtcttgaatgacatcggtgtgattttctacggcgaagtcaatgacatcaagaccagatcgtggtcgtatgggcagtttgaggacggcattctggacacttgtctgtatgtcatggaccgtgcccagatggacttatcgggaagaggtaatccaatcaaggttagtcgcgtgggcagcgcgatggtgaatgcaaaagacgatgagggtgtgctggtgggtagctgggacaatatctacgcgtatggagttcctccaagtgcttggaccggctcggttgacattttgctagagtaccgttcatccgagaatcctgtgaggtacgggcagtgctgggtttttgccggcgtgttcaatacgtttttgcgatgcctgggcatacccgctcgtattgttactaattacttctccgcccacgataatgacgccaatcttcaaatggatatatttctcgaggaggacggtaacgtgaattccaaactaaccaaagactccgtctggaactaccactgctggaatgaggcctggatgacgcgtcccgacttaccggtgggattcggcggatggcaggccgtggattcaacaccgcaggagaactccgatggcatgtaccgctgcggcccagccagtgtgcaggccattaagcatggccatgtgtgcttccagtttgacgctccgtttgttttcgcagaagtgaattctgatctcatatacattaccgcgaagaaggatggtacccacgtggtggagaacgtggacgccacccatataggaaagctgatcgtgacaaagcaaatcggaggggacgggatgatggatattacagacacatacaagttccaagagggtcaggaggaagagcgactagccctcgagaccgcgctgatgtatggcgctaaaaagccacttaacaccgagggcgtgatgaaaagtcgaagtaatgtcgatatggattttgaagtggaaaatgccgtgctcggaaaggatttcaagctctcgattacctttagaaacaactcccataaccgttatacgattaccgcgtacctgtcggctaatatcactttttacaccggcgtcccaaaggcagagtttaagaaggagacttttgacgtgacattggaaccgctttcctttaagaaggaggctgtgctgattcaggcgggtgagtatatgggccaattgctcgagcaagcctccctgcattttttcgttacagcccgcatcaatgagacaagggatgtattggctaagcaaaagtccacagttctaacgattcccgagattattataaaggttcgcggcacgcaggtcgtgggatcggatatgacagtgaccgtccagttcactaatccactgaaggagacgctgcgtaacgtatgggtgcatctggatggcccgggcgttacacgacccatgaaaaagatgttcagggaaattcggcccaactctacggtgcagtgggaagaggtgtgccgaccgtgggtctcgggacaccgcaagttgatcgcgtctatgtcttccgactccttacgtcacgtttacggggaactggatgtccaaatccagcgtcggcccagcatg

SEQ ID NO: 9471 - DNA, 2196 bp, Artificial Sequence
  Description of Artificial Sequence: Synthetic coding sequence
atgagtgagacctccagaaccgcttttggtgggagacgcgccgtcccaccgaacaactctaatgcggctgaggacgatctgccaactgtggagctgcagggagtcgtgccacgaggcgtgaatctgcaggaattcctgaacgtcactagcgtgcatcttttcaaagagaggtgggacaccaacaaagtcgaccaccatactgacaagtatgagaacaataaacttatcgttaggcgcgggcaaagcttctacgtccaaatagacttttcaaggccgtacgacccgcgcagagatctcttcagagtggagtatgtgattggacgctacccccaggagaacaaggggacttatatacccgtaccaatcgtgtcagagctgcaaagtggaaaatggggcgcgaaaatagtgatgcgcgaagaccgatccgtgcggctcagcattcagagcagtccaaagtgcatagtagggaagttcaggatgtacgttgccgtgtggacaccatatggggtgctgaggacaagtcgcaacccagagacagatacttacattttgtttaatccctggtgtgaggacgacgctgtatacctcgacaatgaaaaggagagggaagaatatgtgctgaacgatatcggcgtgatattctatggcgaagtgaacgatatcaagaccaggtcttggagctacgggcagttcgaggacggaatcctggacacctgtctgtatgtgatggatagggctcagatggatctctcagggcggggcaaccctattaaagttagtagagttggaagtgctatggttaacgcgaaggatgatgaaggtgtgctcgtgggatcatgggacaacatctacgcctacggagtcccacctagtgcttggactggatccgtggacattttgcttgagtataggagcagcgaaaacccggtgagatatggacagtgctgggtgtttgccggagtcttcaatactttcctcagatgcctcggcattcctgctagaattgttacaaactatttctcagcccatgataacgacgctaacctgcagatggatatctttttggaggaggacgggaacgtcaacagcaagcttaccaaagactcagtgtggaactatcattgttggaatgaggcctggatgacgagacccgacctgccagtcggttttggtgggtggcaggcagtggacagcacaccccaggagaatagtgatggaatgtacaggtgcgggcctgccagcgtgcaggcaatcaagcatggtcatgtgtgtttccaattcgatgctccatttgtgtttgccgaggtaaattccgatctgatctacattaccgctaagaaagatggaactcacgtggttgagaatgtggacgctactcacattggtaagctgatagtgacaaagcagattggtggtgacggaatgatggatatcaccgacacatataagttccaggagggacaggaggaggagcgactcgctctggagactgccctgatgtatggtgcgaagaaacctttgaacaccgagggggtaatgaagtctaggagtaatgtggatatggactttgaggtggagaacgcagtactcggtaaggatttcaagctcagcatcacatttcgcaacaactcacacaaccgctatactatcacagcctatctttcagccaacataacattttacactggcgtgcctaaagcggagttcaagaaggagacgttcgacgtgactttggagccccttagctttaagaaggaggcggtgctcatccaggctggcgagtatatgggtcagttgctcgaacaggccagtctccatttctttgttactgctagaattaacgaaacaagggacgttctggctaaacagaaatcaacagttctgactattcccgaaatcatcataaaggttcgaggcacccaggtggtgggctccgatatgacagtaactgtgcagttcacgaacccgctgaaggaaactttgcgaaacgtgtgggtgcatctggacggccccggagttactcggccaatgaaaaagatgttcagagagatcagacccaattcaactgtgcagtgggaagaagtatgtcggccgtgggtttcaggacacaggaaactcatcgcgagcatgtcttccgactctttgcgccacgtgtacggcgagctcgatgtccagattcaaaggcgaccatccatg

SEQ ID NO: 9472 - DNA, 2196 bp, Artificial Sequence
  Description of Artificial Sequence: Synthetic coding sequence
atgagcgagactagccgcacggctttcggaggtcgccgcgccgttccacctaacaatagcaacgcagctgaagacgatctacctaccgttgaactgcaaggagtcgtccctcgtggcgttaacctgcaagaatttctgaatgtgacatccgtgcacctgtttaaggaaaggtgggacaccaataaggtggatcaccatacggacaagtacgagaacaataagctgattgtccgtcgcggtcaatcgttttatgtccagatcgatttcagccgcccttatgacccacggcgcgacctgttcagagttgaatacgtgattggccgctacccacaggaaaataagggcacttatatccccgttccaatagtgtctgagctgcagagcggaaaatggggcgccaagatcgtcatgcgcgaagacagatcggttcggctgtcaattcaatcgagcccgaaatgtattgttggcaaattccgtatgtatgtagccgtttggacgccgtatggtgtcctacgaactagccgcaaccctgagaccgacacctatattctattcaatccttggtgtgaagacgacgcagtttacctggataatgagaaggaacgtgaggaatatgtgctgaatgacattggcgtcatcttttacggcgaggtcaacgatatcaaaacgagaagctggagctacggtcagttcgaggacggcattctggacacctgcctgtatgtaatggatcgtgcacagatggacttaagcgggagggggaatccgattaaggtgagcagagttggttccgccatggtaaatgctaaagacgatgaaggcgtgctagttggtagctgggataatatttacgcatatggggtgccaccatctgcatggaccggctcagttgatatcctgttagagtaccgtagcagcgaaaatcctgttcgttacggccagtgttgggtgttcgcgggtgtcttcaacacattcctgcgttgcctgggcatacccgcgcgaatagtgaccaactattttagcgcgcatgacaatgatgccaacttacagatggacatcttcctggaggaagacggtaatgtgaacagcaaactgacgaaagactctgtgtggaactatcattgttggaatgaggcttggatgaccagaccagatttgccggtgggttttggcggttggcaggcagtggattcaactccacaagagaatagcgatggcatgtaccggtgcggccctgctagcgttcaagcgatcaagcacggtcatgtgtgttttcaatttgatgcacctttcgtttttgctgaggtgaatagcgacctgatctatattaccgcgaagaaagacggtacgcacgttgttgagaacgtcgacgccacacacatcggtaaattgattgttaccaagcagatcggtggcgacggaatgatggacattacggacacctacaagtttcaggagggtcaagaagaggagcgcctggcactggagaccgcactgatgtacggcgcgaagaagccgctaaataccgagggggtgatgaaaagccgctccaatgttgacatggactttgaggtcgaaaacgcagttttgggaaaagactttaagctcagcatcaccttccggaacaacagccacaaccgttacaccattacagcgtatctgtcggccaatatcactttctatacgggtgtccccaaggctgagttcaagaaggaaacctttgacgtgaccttagaaccgcttagttttaaaaaggaagcagttctaatccaagccggggagtatatggggcaactgttggagcaggccagcctgcatttctttgtcacggctagaattaacgaaacccgcgacgtgctggcaaagcagaaatcgaccgtgctcaccatcccggaaatcatcattaaggtgcgcggcactcaggttgtgggtagcgatatgacggtgactgtccaattcactaacccactgaaagaaaccttgagaaacgtttgggttcatctggacggccctggtgtcacgcgcccaatgaagaaaatgtttcgcgaaattcgcccgaactctactgttcaatgggaggaggtctgccgtccatgggtgtccggccaccgaaaattgatcgcatctatgagctctgattccctgagacatgtttacggcgagctggatgtgcagatccaacgcaggccaagcatg

SEQ ID NO: 9473 - DNA, 2196 bp, Artificial Sequence
  Description of Artificial Sequence: Synthetic coding sequence
atgtcagagacttcgaggactgccttcggcggtcgcagagccgtgccgcccaataacagcaacgctgccgaggatgacctgccaactgtggaactgcaaggagtggtgccgcggggagtgaacctgcaggagtttctgaacgttacctccgtccacctcttcaaagagcgctgggataccaacaaagtggaccatcacaccgacaaatacgagaacaataagctgatcgtgcggcggggccagtcattctacgtgcaaatagacttctcacgaccttacgatcccagacgcgacctctttcgcgtcgagtacgtcatcggacggtaccctcaagaaaacaaggggacctacatcccagtgccaatcgttagcgaactgcaaagcggaaagtggggagccaagatcgtgatgcgcgaagatcggtccgtgagattgtcgatccaatcttccccgaagtgtatcgtgggtaagtttcgcatgtatgtggccgtctggactccttacggcgttcttcgcacgtcgagaaacccggaaaccgacacttatatcctcttcaatccatggtgcgaggacgatgctgtctacctcgacaatgagaaggaacgggaagaatacgtgctcaatgacatcggcgtgatcttctatggggaggtcaatgatatcaaaactcgcagctggtcctacgggcagttcgaggacggaattctcgacacctgcctgtacgtcatggacagagctcagatggacctgagtggtagaggtaaccctattaaggtgtcccgggtcggatcggccatggtcaatgcgaaggacgacgagggagtgctcgtgggatcatgggataacatatacgcctacggagtccctccgtcggcatggacgggctccgtggacatcctgctcgagtaccggtcgtccgaaaacccagtccgctacggccagtgctgggtgttcgccggcgtgttcaatacgttcctcaggtgccttggaatccctgcccggatagttaccaattacttcagcgcacacgacaacgatgcaaatctgcaaatggacatcttcctggaggaggacggaaacgtcaactccaagctgaccaaagattcggtctggaattaccactgttggaacgaagcctggatgactaggcccgatctgccagtcggatttgggggatggcaggcagtggactcgacccctcaggagaactccgacggcatgtaccggtgcggcccagcgtccgtgcaagcaattaagcacggacacgtgtgcttccagtttgatgccccattcgtgttcgcggaagtgaactccgacctgatctacatcacggccaagaaggatggaacccacgtggtggaaaacgtggatgcgacccatatcggcaaactgattgtaacgaagcagatcggcggagacggaatgatggacatcactgatacctacaagttccaggaaggacaggaggaagagagactggcactcgaaaccgccctcatgtatggagcgaagaagcctctcaacaccgaaggtgtcatgaagtcgagatccaacgtggacatggactttgaagtcgaaaacgcggtcctcggaaaggacttcaagctgagcatcactttccggaacaacagccacaatcgatatactatcaccgcatacctgtcggcgaacattacgttctacacgggcgttccaaaggccgagtttaagaaggaaaccttcgatgtgactttggaacctctgtccttcaagaaggaagcggtcctgatccaggcaggtgaatacatgggtcaactgctcgaacaagcatcactgcacttcttcgttaccgcgcggatcaacgaaactcgcgatgttctggctaagcagaagtcaactgtccttaccattccggaaatcatcatcaaggtgcgcggaactcaggtggtggggagcgacatgaccgtgaccgtgcagttcactaacccgctcaaggagactctgcggaacgtctgggtccacctggatgggccaggcgtgactagacctatgaagaagatgttccgcgagatccggccgaacagcaccgtgcagtgggaggaagtctgcagaccatgggtcagtggacataggaagctcatcgcgtccatgtcgtccgattcgttgcgccatgtatacggagagcttgatgtccagatccaaaggcgcccatccatg

SEQ ID NO: 9474 - DNA, 2196 bp, Artificial Sequence
  Description of Artificial Sequence: Synthetic coding sequence
atgtcggagacttcccggactgcgttcggagggcgccgggctgtgcccccgaacaactcaaacgcggcggaggacgacctgcctaccgtggagctgcagggagtcgtgccccggggagtgaatctgcaggagtttctgaatgtgacttccgtgcaccttttcaaggaacggtgggataccaataaagtcgaccatcacactgacaaatacgaaaacaataagctgatcgttcggaggggccaatccttctatgtgcagatcgactttagccgcccgtatgatccgcgcagggacctcttccgcgtggagtacgtgatcggacgctaccctcaggagaataaaggaacttatatcccggtccccattgtctccgaacttcaatccggaaagtggggggctaagatcgtcatgcgcgaggaccggtcggtgaggctgtcaattcagtcctcgccaaaatgcatcgtggggaaatttcgcatgtacgttgccgtctggaccccgtacggcgtgctgcggactagcagaaatcctgagactgacacttacatcctgtttaatccatggtgcgaggacgatgccgtgtacttggacaatgagaaagaaagggaggaatacgtgttgaacgatatcggagtgatcttttacggtgaagtcaacgacatcaagactagatcgtggagctacggacagttcgaggacggcattctggacacctgcctgtacgtcatggaccgggctcagatggacctgtcgggaaggggcaacccaatcaaagtgtccagggtcggatccgccatggtgaacgctaaggacgacgaaggtgttctggtgggatcatgggacaatatctacgcatacggtgtgccaccgtccgcgtggacgggctcagtggacatcctcctggaatacagatcgagcgagaacccagtccggtacgggcagtgctgggtgttcgcaggagtgttcaatactttcctgagatgtttgggaatcccggcccggatcgtgactaactactttagcgcacacgataacgatgccaaccttcagatggacatttttctggaggaagatggaaatgtgaattcgaagctcactaaggactcagtgtggaactaccactgctggaatgaagcgtggatgacgcgcccagaccttccagtgggatttggaggttggcaagccgtcgacagtaccccgcaggagaactcggacggcatgtaccgctgcggacctgcttccgtgcaagccatcaagcatggacatgtctgtttccagttcgatgcacctttcgtgtttgccgaagtgaactccgacctgatctacatcaccgccaaaaaggatggaacccacgtggttgagaatgtggacgccacccacatcgggaagctgatcgtgaccaaacagatcggcggagatggcatgatggacatcaccgacacttacaagttccaggaaggccaggaagaggaaaggttggcattggaaaccgcactcatgtacggcgcgaagaaaccgctgaacactgaaggcgtgatgaagtcgcgatccaacgtggatatggacttcgaagttgagaacgcagtcctgggtaaggactttaagctgtccatcaccttccgcaataactcccataacaggtacaccatcacggcctacctttcggcaaacattaccttttacacgggagtgccgaaggccgaattcaagaaggaaaccttcgatgtcactctggaaccattgagctttaagaaggaggccgtgctgatacaagctggagaatacatggggcagcttttggaacaggcttcgttgcacttcttcgtgaccgcgcggatcaatgaaacccgcgatgtcttggccaagcagaagtcgaccgtgctcactatcccagagattatcatcaaggtgcgcggtacccaggtcgtcggaagcgacatgactgtgactgtgcaatttactaacccacttaaagaaactttgaggaacgtgtgggttcacctcgacggaccaggagtcaccaggccaatgaagaagatgttccgggagatcagaccgaatagcacggtgcagtgggaagaagtgtgccggccgtgggtgtcaggacaccggaaacttatcgcctcaatgagctcggattcgctgcgccatgtgtacggtgaattggacgtgcagatccaacgtcgcccttcgatg

SEQ ID NO: 9475 - DNA, 2196 bp, Artificial Sequence
  Description of Artificial Sequence: Synthetic coding sequence
atgtcagaaacctcacggaccgcgtttggcgggagacgagccgtgccaccgaacaattccaacgcggctgaggatgatctgcccaccgtggagctgcagggtgtcgttccccgcggagtgaacttgcaagagttcctcaacgtgactagcgtgcacctcttcaaggaaaggtgggacaccaacaaagtcgatcatcataccgacaagtacgagaacaataagctcatcgtgcgccgggggcagtccttctacgtccagatcgatttctcacggccgtatgatcccaggcgcgacctgttccgcgtggagtacgtgatcggacgctacccccaggagaacaagggaacctatataccggtcccgattgtcagcgagttgcaatctggcaagtggggcgctaagattgtgatgcgcgaggaccggtccgtcagattgagcatccaatcttcacccaagtgcattgtggggaagttcagaatgtacgtcgccgtgtggactccgtacggcgtcttgagaacctcaagaaacccagaaaccgacacctacatcctgtttaatccttggtgcgaggacgacgccgtgtacctggacaacgaaaaagaaagagaagagtacgtgctcaatgacatcggtgtgatcttctacggagaagtgaatgacattaagactcggtcatggagctatggccaattcgaggatgggatcctggacacttgtctgtatgtgatggatcgggcacagatggatttgtcgggcagaggcaacccaatcaaagtgtcgcgggtgggatccgcaatggtgaacgcgaaggatgatgaaggagtgcttgtggggtcctgggacaacatctacgcatacggtgtgccgccgtcagcctggacgggctcggtcgatatcctgctggaatacagaagctcagaaaatcctgtccggtacggacagtgctgggtctttgctggggtgttcaacacctttctgcgctgtctggggatcccggctcgcatcgtgactaattactttagcgcccacgataatgatgcaaacctgcagatggatatctttcttgaagaagatgggaacgtgaactcgaagctgactaaggactcggtctggaattaccactgttggaacgaggcgtggatgactcggccagacctgccggtgggattcggaggatggcaggccgtggattcgactccccaagagaattcggatggaatgtaccgatgcggaccggcctccgtccaggccatcaagcacggccatgtctgcttccaattcgacgccccgttcgtgttcgctgaggtgaatagcgacttgatctacatcactgcaaagaaagatggaacccatgtggtcgaaaacgtggatgccacccacattggaaagctgattgtgactaaacagatcgggggagacggtatgatggacatcactgacacttacaagttccaggagggtcaggaggaagagcgcttggcgctcgaaaccgccctgatgtacggcgccaagaaaccgcttaacactgagggagtcatgaagtctcggagcaacgtggatatggacttcgaagttgagaacgcggtgctcggaaaggatttcaaactgtccatcaccttccggaacaacagccacaatcgctacactattactgcgtacctgagcgcgaatatcaccttctataccggagtgccgaaggcggagttcaaaaaagaaaccttcgacgtgactcttgagccattgagcttcaagaaggaagcagtgctgatccaggcaggggagtacatgggacaacttctggagcaagcaagcctgcatttctttgtgactgcgcgcattaatgaaactcgagatgttctcgccaagcagaaatcgaccgtcctcactatcccggagatcattatcaaggtgcgtggcacgcaggtcgtggggtccgatatgactgtgaccgtccagttcactaacccactgaaagagactctgcgcaacgtctgggtgcaccttgacggacctggcgtgactaggcctatgaagaagatgttcagagagatccggcctaatagcactgtccagtgggaggaagtctgccgcccatgggtgtcgggtcataggaagctgatcgcctccatgtcctcagactccctgaggcacgtctatggagaacttgacgtccagattcagcggcggccgtcaatg

SEQ ID NO: 9476 - DNA, 2196 bp, Artificial Sequence
  Description of Artificial Sequence: Synthetic coding sequence
atgagtgagacaagccgaactgcattcggaggcaggcgtgccgtgccaccaaacaattccaacgccgctgaagacgatctgccaactgtcgagctacagggagtggtaccgaggggcgttaatctgcaagagttcctaaacgtgacatcagtgcatctgttcaaggagagatgggacactaacaaggtagaccatcatacagacaagtatgagaataacaagctcattgttcggaggggccagagtttctatgtccaaatcgacttcagccgaccttacgatcccaggcgggatcttttccgagttgagtacgtgatcggcaggtacccccaggagaataagggaacttacattcccgtgccaatagtctcggaacttcagagcggaaagtggggtgccaagatcgtgatgcgggaagatcggtctgtgaggctgagcatccagtccagtcccaaatgtatcgtggggaagtttcgcatgtacgtggcagtgtggaccccctatggggtcctgaggaccagccgcaatcccgagactgacacctacatcctattcaatccttggtgcgaagatgatgctgtatacctagacaacgagaaagagcgggaagagtatgtcctcaacgacatcggagtcatcttctacggggaagttaacgacatcaagacgcggtcctggagctatggccagttcgaggatgggattctggacacatgtctctacgtgatggaccgggcgcagatggacctgagcggcaggggaaatcccatcaaagtgagccgggtcggatcagccatggtcaatgctaaggatgacgagggcgtgctggtgggaagctgggataacatatacgcctatggagtgcccccatccgcttggaccggaagtgtggacatcctgctcgagtataggtccagcgaaaacccagtgcgctacgggcagtgttgggtgttcgctggcgtgttcaatacctttttaaggtgtctcggaattcccgcccgcattgtgacaaactacttcagcgcccacgacaacgatgccaacctgcagatggacatcttcctggaagaggatggtaacgttaattcaaagcttacgaaggactcagtgtggaactatcactgttggaacgaagcatggatgactagacctgacctgcccgtgggatttgggggttggcaggccgtggattctaccccccaggagaactccgatgggatgtacaggtgtggccctgcctctgtgcaggccattaagcatgggcacgtgtgctttcaatttgacgcacccttcgtgttcgctgaggttaacagcgacttaatttatatcaccgcgaagaaggacggtactcacgtggtcgagaatgtggatgccactcacataggaaagctcattgttacgaaacagatcgggggcgatggcatgatggacattaccgatacgtacaagttccaggagggccaagaggaggagcgtcttgcattggagacagcattaatgtacggcgctaaaaaaccgctgaacacagagggagtaatgaagagtagatccaacgtggatatggacttcgaggtggaaaatgctgtgcttggaaaggacttcaaactgagtatcacctttcgcaataacagccataatcggtacaccattactgcctatctgagtgccaacataaccttctacactggcgttcccaaggctgaattcaaaaaggaaacctttgacgttaccttagagccgctttcctttaagaaagaggcggtgcttattcaggctggagagtacatgggacagctgctggagcaggcaagcttgcatttcttcgtgacagcccggatcaacgaaactagggatgtcctggcgaagcagaagagtacagtcctcacaattccagaaatcattatcaaggttagggggacccaggtcgttgggtctgacatgacagtaacagtgcaatttactaacccgttaaaagaaaccctccggaacgtctgggtacacctcgacggacccggtgtgacccgcccgatgaagaagatgtttcgcgaaatcaggcctaatagtacggtgcagtgggaggaggtctgtaggccatgggtgtcagggcataggaagctgatcgcctccatgtcctccgacagtctcagacacgtgtacggggagttggatgtgcagattcaaagaagacctagcatg

SEQ ID NO: 9477 - DNA, 2196 bp, Artificial Sequence
  Description of Artificial Sequence: Synthetic coding sequence
atgtcagaaactagcaggaccgctttcggagggaggcgagccgtgccacccaataactccaatgcagccgaggatgacttaccaaccgtagagcttcagggtgtcgtgccgagaggagtcaatctgcaagagttcctgaacgttaccagcgtccacttgttcaaagagcgttgggacacgaataaagtggaccaccacacagataagtatgagaataacaaactcatcgtgagacggggtcagagtttttacgtgcagattgatttctcccgcccctacgacccgagacgcgacctatttcgcgttgagtacgtcattggacgctacccccaggagaacaaaggcacttatatccccgtcccaattgtttcagagctgcagagcggcaagtggggagcaaaaatcgtgatgcgggaagacagaagtgtgcggttgagtatccagtcttctcccaagtgcattgtagggaaatttaggatgtatgtcgcagtttggaccccatacggggtcctacggactagccgtaatcccgaaactgacacgtacatcctgttcaacccttggtgcgaggacgacgccgtgtacctcgataacgagaaggagagggaagaatatgtgctcaacgatataggtgtaatattttacggggaggttaatgatataaagacccggtcatggtcctacggtcaattcgaggatggaatcctagatacttgtctgtacgtgatggatagggctcagatggacctatccggacgggggaatcccattaaggttagccgtgtgggatcggccatggtcaacgccaaagacgatgaaggggtgctggttgggtcttgggacaacatctatgcttatggtgttccaccttctgcatggactggttctgtggatatcctactggagtatcgctcttctgagaaccccgtccgttacggtcagtgctgggtgttcgcgggagtgtttaacacatttttgcggtgtctgggtatcccggcacgaatcgtgactaactattttagcgctcacgataatgacgcaaatctccagatggatatttttctagaagaagacggaaacgtgaattccaaattgaccaaggactctgtgtggaattatcactgttggaatgaagcctggatgacccgaccagaccttcccgtcgggtttggtggttggcaggccgtagacagcactccacaggagaacagtgacggcatgtacaggtgcggtcctgcgagcgttcaggcaataaagcacggccacgtgtgttttcagttcgatgctcccttcgtgttcgctgaggttaactcggatctgatatacattaccgcaaagaaagacggtacacacgtggtagaaaacgtggacgccacccacatagggaagctgattgtcaccaaacagattgggggcgatggtatgatggatattacggacacttataagtttcaggaggggcaggaagaagaaaggctggcgcttgagactgccctcatgtacggggcaaaaaaaccactgaacaccgaaggagttatgaaatctcgcagcaacgttgatatggatttcgaagtggagaacgctgtattaggaaaggatttcaagttgtctattacttttcgcaataactcgcataataggtacacaataactgcttacctgagtgcaaatataaccttttacacgggggtaccaaaggcagagtttaagaaagagaccttcgatgttaccttggaaccactgtcattcaagaaagaggcagttctaatccaagccggcgagtacatgggccagttgctggagcaggctagcctgcacttcttcgtcaccgcaaggattaacgagacgagggatgttctggccaaacaaaagtctactgtcttaactattcctgagataatcattaaggtcagagggacacaggttgtcggatcagacatgacagtcactgtgcagttcaccaaccccctgaaggagacgctgagaaatgtgtgggtgcatcttgacggccctggagtgacgcggccgatgaagaaaatgttcagggaaatacgcccaaactccacggtgcagtgggaggaagtatgtcggccatgggtcagtggacaccgcaagctgattgcatccatgtctagcgactccttaaggcacgtgtacggcgaactggacgtacaaatccagaggagaccttcgatg

SEQ ID NO: 9478 - DNA, 2196 bp, Artificial Sequence
  Description of Artificial Sequence: Synthetic coding sequence
atgtctgaaacttccaggactgcgtttggaggcagacgagctgtcccaccaaacaattccaacgccgccgaggacgacttgcctactgtggagctgcagggggtggtacctcgaggtgtgaacctccaggagttcctcaatgtaacctccgtacatttgttcaaggagcgctgggatacaaataaggtggaccaccacaccgataaatacgaaaataacaaactaattgttaggaggggacagtcattctacgtccagatcgacttttctcgcccatacgaccctcgacgcgatctattccgggtcgaatacgttattggccgttacccccaggagaataaggggacatacatccctgtgcccatcgtctcagagttgcagtctggtaaatggggcgccaaaatcgtaatgcgcgaggacaggagcgtgaggctgagcatccaatctagccccaagtgcatcgtggggaaatttcgtatgtacgttgcagtgtggaccccttacggagtgctgaggacttctcggaaccccgaaacagacacatacattctgttcaatccctggtgcgaagacgatgctgtctaccttgacaatgagaaagagcgcgaggagtatgtgctgaatgacatcggcgtaattttttatggcgaagtgaacgatatcaagacgcgctcttggagctatggccaattcgaggatggaatacttgatacctgcttatacgttatggaccgagcacagatggacctctcaggccgtggaaatcccatcaaagttagtcgcgttggctcagctatggtcaacgcaaaggatgacgagggagtgttggtgggtagctgggataacatctatgcctacggggtgcccccatcagcatggaccggatcggtagatatactcctcgaatatcggtccagcgagaatccagtacgatatgggcagtgttgggtattcgccggcgttttcaacaccttcctcagatgtctcggcatcccggcccgcattgtaaccaactattttagtgctcacgacaacgacgccaatttgcagatggatatcttccttgaagaagacggcaatgtgaattcaaaactgactaaggactcagtgtggaattaccattgttggaacgaggcctggatgaccaggcctgatttgcctgtggggtttgggggatggcaggcagttgactccactccccaggaaaacagtgacgggatgtacagatgcgggcccgcgtctgtgcaagccatcaagcacgggcatgtatgctttcagttcgacgccccctttgtcttcgcagaagttaatagcgatcttatttacatcactgcgaaaaaggatgggacacatgtggttgaaaacgtggacgcaacacatatcggaaaactcattgtgaccaagcaaattggaggcgatggtatgatggatatcacggacacgtacaagttccaagaaggccaagaagaggaaagactggccctagaaactgcgcttatgtatggcgcaaagaagcccctgaacacggaaggagtcatgaagtcccgcagcaacgttgatatggactttgaagttgagaatgcggttcttggaaaagacttcaaactcagtatcacttttcggaacaattcacacaatagatacaccattactgcgtatttgtcagctaatattactttttataccggtgttccaaaggcggaatttaagaaagagacgttcgacgtcacactcgaaccactgagcttcaaaaaagaggcggtactcatccaagccggcgagtatatgggtcagctgcttgaacaggctagtctccatttttttgtgactgccagaattaatgagacccgcgacgtattggctaagcagaaatcaaccgtgctcacaatacctgaaattatcatcaaagtccgcggtacacaggtagtaggtagtgatatgacagtcaccgtccagtttacaaacccactgaaggaaactttgcggaacgtgtgggtgcacctggatggacccggtgttacccgccccatgaaaaaaatgtttagagaaatacggccaaactcaacagtgcagtgggaagaggtgtgccgaccctgggtctcagggcatagaaagctgattgcctccatgtcttctgatagtctgaggcatgtctacggagagcttgacgtccaaattcagcggagaccttctatg

SEQ ID NO: 9479 - DNA, 2196 bp, Artificial Sequence
  Description of Artificial Sequence: Synthetic coding sequence
atgtctgagactagtcgcaccgcctttggcggccgcagagcagtgcctcccaacaactcaaacgccgccgaggatgaccttcctacagttgagctgcaaggtgtagtgccaaggggtgtgaatctgcaggagttcctgaatgtcacctcagttcacttgttcaaggagcgctgggacaccaacaaggtagaccaccatactgataaatacgagaataacaagctaattgtgcgaagaggacagtccttttatgttcagatcgatttcagccgcccctacgatccccgccgagacctgttcagagtggaatatgtaattggcaggtacccccaggaaaacaagggcacctatattccagtgcctattgtgtccgaactgcagtctggaaaatggggcgccaagatagtgatgagagaagacaggtctgtgcggctttctattcaatcttctcctaagtgcatagtgggtaaattcaggatgtatgtagccgtgtggaccccctacggagtcttgagaactagtcgaaaccctgagactgatacttatatactgtttaatccctggtgtgaggacgacgctgtttatctagataacgaaaaagagcgtgaagagtatgtgctgaacgatattggtgtgatcttttacggcgaagttaacgatattaaaacaagatcctggtcctatggacaattcgaggacggtatactggacacctgtctgtacgtcatggatcgtgcccagatggacctttccgggaggggaaacccaattaaagtgagccgagtcgggtccgctatggtgaacgctaaagatgatgagggagtattagtgggaagttgggataacatatacgcctacggcgttcccccaagcgcttggacaggctctgtagacatcctgctagagtacagaagtagtgaaaatcccgtgcgctacggacagtgctgggtgttcgctggcgtcttcaatactttcttacgatgcctgggaatccccgcccggattgtgactaactacttctctgctcacgacaatgacgccaatctgcagatggacattttcctggaggaagatggtaatgttaacagcaagctaactaaggatagcgtttggaactaccactgctggaacgaagcatggatgacacgtcctgatctgcccgtcggattcggcggctggcaggccgtggactctaccccccaggagaactctgatggcatgtaccgatgcggcccagcatccgtgcaagccataaaacacggtcatgtttgcttccagttcgatgctcccttcgtcttcgccgaggtgaatagtgacctgatctacataacagcaaagaaggacgggacacatgtggtggagaatgttgatgccacacacataggaaagcttatcgttacaaaacagataggcggggatgggatgatggatatcactgacacttataaattccaggagggtcaggaggaggagcgactggctctggagaccgctctgatgtatggagccaagaaacccctgaatactgagggcgtgatgaaaagccggtctaatgtcgacatggatttcgaagttgagaatgccgttctaggcaaagattttaagctctctatcacattcaggaacaatagccacaaccggtacactattaccgcctacctgtctgcaaacattactttctacaccggggttcctaaagccgagttcaaaaaggagaccttcgatgtgacactggagccactctcattcaagaaggaggccgtgcttatacaggctggcgaatacatgggccaactgctcgagcaggcaagcctgcacttctttgtgaccgctcgcataaacgagaccagagatgtgcttgcaaagcagaaaagcacagtgttgaccattcccgaaattattattaaggtgcgaggcactcaagttgtgggctctgatatgactgtcaccgtgcagttcaccaatcctctaaaagagaccctgcgaaacgtgtgggtgcacctggacggacctggagtgacacgtcctatgaaaaaaatgtttcgggagatccgccctaactctacagtccagtgggaggaggtttgtcgaccctgggtttctggccaccgtaagctgatcgcctctatgtcctctgatagccttcgtcatgtttacggcgagctggacgtgcagatccagaggaggccctccatg

SEQ ID NO: 9480 - DNA, 2196 bp, Artificial Sequence; identical to SEQ ID NO: 9476
  Description of Artificial Sequence: Synthetic coding sequence

SEQ ID NO: 9481 - DNA, 2196 bp, Artificial Sequence
  Description of Artificial Sequence: Synthetic coding sequence
atgtcagaaacttcccggactgcatttggtggtagacgtgccgttcctcccaacaattccaacgccgcagaagatgatctgccaactgtggaactgcagggtgtggtgcctagaggagtgaacttgcaagaattcctgaacgtcactagcgtgcatctgtttaaagaacggtgggacaccaataaggtcgatcatcacactgataagtacgaaaacaacaagctcattgtgaggcgcggccagagcttttacgtgcagatcgatttttcaagaccctacgatccgcggagagatctcttccgagtggaatacgtcatcggtcgatacccacaagaaaacaagggcacctacattcccgtccctatcgtttcggaacttcaaagcggaaagtggggagccaaaattgttatgagagaagatcgctcagttcgcctctcgatccaatcctcacctaagtgtatcgtgggaaagttcagaatgtacgtggctgtgtggactccttacggagtgttgcgcacctcgcggaaccccgaaactgatacctacattcttttcaacccatggtgtgaagatgatgcagtctacctggacaatgaaaaggagcgtgaagaatacgtgttgaacgatataggcgtgattttctatggcgaagtgaatgacattaagactcgttcttggtcatacgggcaattcgaggacggcattctggatacttgtctttacgtgatggatagagcacaaatggatctttcgggcagaggcaaccccatcaaggtgtcccgggttggttcggccatggtgaatgcgaaagatgacgaaggggtcctcgtcggttcgtgggacaacatatacgcttatggtgtccctccttcagcctggaccggttcggtggacattctgctcgaataccgttcgtccgagaacccagtgagatacggacagtgttgggtgttcgctggagtgtttaacacttttctgaggtgccttgggatccctgcgcggatcgtgactaactacttctccgcacacgataacgacgcaaacctgcagatggatatctttctcgaagaagatgggaacgtcaattcaaaactgaccaaggattcggtctggaattatcattgttggaatgaagcatggatgactcgacctgaccttcctgtgggatttggaggctggcaagcggtggatagcactcctcaggagaacagcgacggaatgtatagatgcggacctgccagcgtgcaagctatcaaacacggacatgtgtgtttccaattcgatgcaccatttgtctttgccgaagtgaattccgatctcatctacatcactgcaaagaaggacggaactcatgtcgtggagaatgtcgatgcgactcatatcggcaagctcatcgtgactaagcagataggaggcgacggtatgatggatatcaccgatacgtacaagtttcaagaggggcaagaagaagaacgactggcactcgaaactgccctgatgtacggagcaaagaagccactgaatactgagggagtgatgaagtcaagaagcaacgtggatatggactttgaagtggaaaacgcagtgctggggaaggactttaagttgtctattacttttaggaataactctcacaaccgctacaccatcaccgcatacttgtccgcaaatatcacgttttacaccggggtccctaaggctgagtttaagaaagagacttttgacgtgaccctggaacctctttcgtttaagaaggaagccgtcctgattcaagctggagaatacatgggacagctgctcgaacaggcctcgctgcacttctttgtgaccgcaagaataaacgaaacgcgagacgtgcttgcaaagcaaaagagcaccgtgcttaccattccagagattatcattaaggtgcgcggcacccaagtggttggaagcgatatgacggttactgtgcagttcaccaatcccctcaaggaaaccctgagaaacgtgtgggtgcatctggacggacctggagtcacccgccccatgaaaaagatgtttagagaaatcagaccaaactccaccgtccaatgggaagaagtgtgccgaccttgggtgtcaggccataggaagctcattgcttctatgtccagcgactccctgagacacgtgtacggcgagctggatgtgcaaattcaacgcagaccaagtatg

SEQ ID NO: 9482 - DNA, 2196 bp, Artificial Sequence
  Description of Artificial Sequence: Synthetic coding sequence
atgagcgagacgagcaggacggccttcggcggaaggagagcggtccctccaaacaattccaacgccgccgaggatgacctgcctacagtagagctccagggtgtcgtgccaagaggcgtgaacctgcaagagtttttgaacgtaacctctgtgcacttgtttaaggaaaggtgggacacaaataaggtggaccatcacacagacaagtacgagaataacaaactgattgtgagacgcggtcaaagtttctatgttcagatcgacttttctagaccttatgacccgcgccgcgacctctttcgcgtggaatacgtcattggtcgctatccgcaggagaataagggcacctatatcccagtgccaatcgtgtcagagttgcagtcaggtaaatggggagcaaaaatagtgatgagggaggacagaagcgtcaggctcagtatccagtcctctcctaagtgtatcgtgggaaagtttaggatgtacgtggctgtgtggacaccatatggtgtcttgagaactagcaggaatcccgaaacagacacctatatccttttcaatccatggtgcgaagatgacgctgtatacctcgacaacgagaaggagagggaggagtacgttcttaacgatattggcgtcatattctatggcgaagtaaacgatattaagacccgctcttggagttacggccagtttgaggatggaatcctcgatacctgtttgtatgtaatggatagagcccagatggatctgagtggtcgcggcaatcctattaaagttagtcgcgtgggctctgcaatggtgaacgccaaagacgatgaaggcgtgttggtcggttcatgggataatatctatgcatacggagtgccacctagtgcgtggacaggaagcgttgacattctgctcgaatatagatcatccgagaaccccgtaaggtacggtcagtgctgggtgttcgccggcgtgtttaatacctttctccgctgtctcggcatcccagctaggatagtgaccaactactttagcgctcatgacaatgacgccaatctccaaatggacattttcctggaggaagatggcaacgtaaattccaagctcactaaggatagcgtctggaactatcattgttggaacgaggcctggatgacgaggcccgaccttcccgtgggtttcggcggatggcaagctgtcgactctaccccgcaagagaatagcgacggcatgtatagatgcggaccggcctctgtgcaggccatcaagcatggacacgtatgcttccaatttgatgctccctttgttttcgcggaagttaatagtgacctgatctatatcaccgctaagaaagacggcacccacgtggtcgaaaacgtggacgccacccatatcggcaagctgatcgtgacgaagcagataggcggagacggaatgatggacatcacagatacatataagttccaggagggccaggaagaagaacgcctcgcgctcgaaactgccttgatgtacggtgccaagaagccgctcaacaccgagggtgtcatgaagagtaggagcaacgtcgacatggacttcgaggtggaaaacgctgttctgggtaaggactttaagctttctattacgttcagaaacaatagtcacaacagatatactatcacggcatacctttccgccaacatcaccttttatacaggcgtgccaaaagccgaattcaaaaaggagacattcgacgttacactggaaccccttagctttaagaaggaagccgtactgattcaggcaggcgagtacatgggccaattgttggaacaagcaagcctgcatttcttcgtgaccgcacgcatcaacgagaccagagacgtgcttgccaagcagaaaagtactgtgctcacgatacctgagattataataaaggtgcgcggcacccaggtcgtgggcagcgacatgaccgtgacggtccaattcaccaatccgctcaaggagacgctcagaaacgtctgggttcatcttgatggcccaggagttacaagacctatgaagaaaatgttcagggaaatccgcccgaatagcacagtgcagtgggaagaggtatgcagaccttgggtgtccggacatcgcaaacttatcgcatcaatgtcttctgattccctgaggcacgtctatggagaactggacgtacagatccagaggagacccagtatg

SEQ ID NO: 9483 - DNA, 2196 bp, Artificial Sequence
  Description of Artificial Sequence: Synthetic coding sequence
atgtcagaaacctcgagaactgcatttgggggtcgcagagcggtgccacccaataactcgaatgcggctgaagatgacctgccgactgtggagctgcaaggagtggtgccgcggggagtcaacttgcaggagttcctgaacgtaacctctgtccaccttttcaaggagcggtgggatacgaacaaagtcgatcatcatacggacaagtatgagaacaataagctcatcgtgcgccgcggtcaatcgttttacgttcagatcgatttctctcggccgtacgatccgcgcagagatctcttcagggtggaatacgtgatcggaagatacccccaggagaataagggcacttatatccccgtcccaatcgtctcagagctgcagagcggaaagtggggcgcaaagattgttatgcgggaagatcggtcggtgcggctgtctatccagtcctcgccaaaatgcattgttggaaagttcagaatgtatgttgctgtgtggactccttacggagtgttgcgaacttcaagaaatcctgaaaccgatacgtatatcttgttcaatccgtggtgcgaggacgatgctgtctacctcgataacgaaaaggaacgcgaagagtacgtgctgaacgacatcggagtcatcttttacggcgaagtgaatgacataaagactcgctcctggtcatacgggcagttcgaggacggaatcctcgatacgtgcctgtacgtcatggaccgagctcagatggacctcagcggacgcggtaacccaatcaaagtgtccagggtgggttcggccatggtgaatgcgaaagacgacgaaggcgtcctggtgggatcgtgggacaacatttacgcctacggagtcccaccgagcgcttggaccggatccgtggacattctgctggagtacaggtcctcggaaaatccggtgcgctacggccagtgctgggtctttgcaggggtgttcaatactttcctccggtgtctgggtatcccggcaagaattgtgaccaactactttagcgcacatgataacgacgcaaacctgcagatggatatcttcttggaagaggacgggaacgtgaactcgaagctgaccaaagattcagtgtggaactaccattgctggaacgaggcctggatgacccgccctgaccttccggtgggattcggaggctggcaggccgtggactcgactcctcaagaaaacagcgatggaatgtaccggtgtggaccagcttcagtccaggccatcaagcatggacacgtgtgttttcaattcgacgcgccgttcgtgtttgcagaggtgaattcagatctgatctacataaccgctaagaaggatgggactcatgtggtggaaaatgtggatgcgactcacatcggaaagctgatcgtcactaaacagatcggaggcgacggaatgatggacattaccgacacctacaagttccaagagggtcaggaggaagaacgtctcgccctggagacggcgctcatgtacggagccaagaaacccctgaatactgaaggagtcatgaagtcacgcagcaacgtggacatggacttcgaggtggaaaacgcagtactgggcaaggacttcaagttgtcgattaccttcaggaacaactcgcacaaccggtacaccatcaccgcctatctgtccgccaacatcactttctacaccggggtgcctaaggcggagtttaagaaagagacttttgacgtcacgctggaaccgctctccttcaaaaaagaggcggtgctgatccaggccggtgagtacatggggcagctgctcgaacaggcgtccctccatttctttgtgacggccagaatcaacgaaacgcgggatgtgcttgcgaagcaaaagagcacggtgctgaccatcccggaaatcattatcaaagtcagaggaacccaagtggttggatccgacatgaccgtaactgtgcagttcaccaatccgctgaaggaaactctgcggaacgtgtgggtccacctggacggtcccggagtcactagaccaatgaagaagatgttcagggaaattcgcccgaattcgaccgtgcaatgggaggaagtgtgcagaccgtgggtatctggccatcgcaagctcatcgcatcaatgtcgtcggattccctccggcacgtttacggggagcttgacgtacagattcaacgtcgaccttcgatg

SEQ ID NO: 9484 - DNA, 2196 bp, Artificial Sequence
  Description of Artificial Sequence: Synthetic coding sequence
atgagtgagacttcaaggactgcattcggtggacgtagggccgtccctcctaataacagcaacgcagccgaagacgacctgcccactgtcgagctccagggcgttgtcccacgcggcgtcaatctgcaggagttcctgaacgtgactagcgtgcacttgtttaaagaacgctgggataccaacaaggttgaccaccatactgataagtatgagaataataagctcatcgtgaggaggggccagtccttctacgtacaaattgacttcagcagaccctacgatcctcgtcgcgacctgttccgtgttgaatacgtgataggtcgttacccccaggaaaacaagggaacctatattcccgtgcctatcgtgagcgagttgcagagtggcaaatggggtgcaaagatagtgatgcgtgaggatcgtagtgtgagattgagcattcagtcctctcccaagtgcatcgtcggaaagtttcgcatgtacgtagcagtttggactccctacggcgtgctgagaactagtaggaatccagagacagacacctacatcctgttcaacccttggtgcgaggacgacgctgtgtacttggataacgaaaaggaacgtgaggaatatgtactgaacgacatcggagtgatcttctatggagaggtgaacgatatcaaaaccaggtcatggtcatacggccagtttgaggatggaattcttgatacatgtctgtacgtaatggatagggcccagatggatctgtccggtcgtggtaacccaataaaggtctccagggtcggctccgccatggtgaacgctaaagacgacgagggtgtcctggtgggttcttgggataatatctacgcctacggcgttcctccctctgcatggaccggtagcgtcgatatcctgctggaatatcgctcatcagagaacccagtgaggtacggtcagtgctgggtattcgctggtgtattcaatacatttctgcgttgccttggaatcccagcccgcatcgtgactaactacttctctgcacacgacaacgacgccaaccttcagatggacatatttctggaggaagatggaaatgtaaactcaaaattgacaaaggattctgtgtggaactaccattgttggaacgaagcctggatgacaaggccagatctgcctgttggtttcggaggctggcaagccgtggactccaccccccaagagaactccgatggaatgtatcgttgtggccctgcctctgttcaggccatcaagcatggccacgtatgtttccaattcgacgctcccttcgtgttcgctgaggtgaactcagacctcatctatatcactgctaagaaggatggcactcacgtggtggagaacgtcgatgctacacatattggaaaactcattgtcactaagcagatcggtggagacggaatgatggacatcaccgatacctacaagtttcaagagggccaagaagaggagagactggccctggaaaccgccctcatgtacggtgcaaaaaagcccctgaacactgaaggcgtaatgaagtctcgctcaaacgttgatatggattttgaagtggagaatgctgtcctgggcaaagactttaagctgtcaatcaccttccgcaataacagtcacaatcgctatacaataactgcttacctgagtgccaacattaccttttacaccggcgtccctaaggccgaattcaagaaagagacctttgatgtaaccttggaacctctgtcttttaagaaggaggccgtcttgatccaggctggcgaatacatgggtcaattgctcgaacaagcctccctccatttctttgtaactgctaggattaacgagactcgcgatgttttggctaagcaaaaatctacagtattgaccatccctgaaatcatcatcaaagtgagaggcacacaggtcgtgggttccgatatgactgtgaccgttcagttcaccaaccccctgaaagaaactctccgtaacgtatgggtgcacctggacggtccaggtgtcaccaggcccatgaagaagatgttcagggagatccgccccaactccaccgtacagtgggaggaagtttgtagaccttgggtgagcggtcacagaaagctcattgcatccatgagcagtgattcccttaggcacgtatacggtgagctcgatgtccagatccagcgtagaccctccatg

SEQ ID NO: 9485 - DNA, 2196 bp, Artificial Sequence
  Description of Artificial Sequence: Synthetic coding sequence
atgagcgagacttccagaactgcatttggaggccgccgtgcagtgcctcccaacaattcgaacgccgccgaagatgaccttcctactgtcgaactccaaggagtggtgccgagaggtgtcaaccttcaggaatttctcaatgtcacttcagttcatctgttcaaggaacgctgggacaccaacaaagtggatcaccacacggataagtacgagaataacaagctgatcgtaagaagaggacaatccttttacgtgcaaatcgatttttcccggccatacgatccaagacgggatctgttccgagtggaatacgtgattggcagataccctcaagaaaacaaaggcacctacatacctgttccaattgtcagcgagctccagtcgggaaaatggggggcaaagatagtgatgcgcgaggatcgcagcgtcaggctttcaattcaaagctcacctaagtgtattgtgggtaaattcagaatgtacgtagccgtgtggactccgtacggggtgcttcggactagcagaaatcctgaaacggacacctacattttgtttaatccttggtgtgaggacgatgcggtgtacctcgataatgagaaggaaagagaggaatatgtcctcaacgatattggcgtgatcttctacggtgaagtaaacgacatcaagaccaggtcctggtcttacggacaatttgaagatggtattctggatacgtgcctgtacgttatggatcgggcacagatggacctttccggtagggggaaccctattaaggtcagtagggtgggaagtgcaatggtaaatgcaaaggatgacgaaggtgtgttggtagggtcatgggataacatctatgcatacggagtgccaccctcggcttggaccggatcggttgatatcctgcttgaataccgctcgtcggagaacccagtcagatacggacagtgttgggtgtttgcaggagttttcaatacttttctccgatgtttgggaattccggcacgtattgtgaccaactatttctcggcccatgataacgatgctaaccttcaaatggacattttcttggaagaggacggaaacgtgaacagcaagctcaccaaagattccgtgtggaactaccattgctggaacgaagcctggatgactcgaccggaccttccagtcgggttcggcggttggcaagcagtggactcaacgcctcaagagaactcggatggaatgtaccggtgtggtccggcatcggtgcaagcgataaagcacggtcatgtgtgcttccagtttgatgcacctttcgtctttgcggaggtgaatagcgatctgatttacattaccgccaagaaagatggaactcatgtggtcgaaaatgtggacgcaacgcatataggtaagctgattgtcaccaagcagataggcggtgatggaatgatggatattaccgacacgtacaaatttcaagaaggtcaggaggaagaaaggctggcacttgaaaccgctcttatgtacggagctaagaaaccactgaacaccgaaggggtgatgaagtccagatcaaatgtggatatggactttgaagtggagaacgcagtgctgggcaaggatttcaaactttcgattaccttccgcaacaactcacacaaccggtacactattaccgcatacctgtctgccaatatcactttctacactggcgtcccaaaggcagaattcaagaaggagacttttgacgtcaccctcgaaccccttagctttaagaaagaagcggtgctgatccaagcgggtgagtatatgggacaacttctggagcaggcatccctccactttttcgtgactgcacggattaatgaaacccgcgacgtgctggccaagcagaagtcaactgtgctgactatccccgaaatcatcataaaggtgagggggacccaggttgtcggaagcgatatgaccgtcactgtgcaatttaccaatcctcttaaagaaaccttgcgtaatgtctgggtgcatctggacggacctggcgtgactcgcccaatgaagaaaatgtttcgtgaaatcagacctaactcaaccgtccaatgggaagaagtgtgtcgaccatgggtgtccggccatcggaaattgatcgcctccatgtcgtccgactcactccgccatgtctacggggagcttgacgtccagatccagaggcgcccatcgatg

SEQ ID NO: 9486 - DNA, 2196 bp, Artificial Sequence
  Description of Artificial Sequence: Synthetic coding sequence
atgtcagaaactagcagaactgcttttggaggcagacgcgccgtgccacctaacaatagtaacgccgctgaagatgacctcccgactgtggaactgcagggcgtggtcccgcgcggcgtgaacctgcaagagttcctcaacgtcacgtcggtgcacctgttcaaggaacgctgggacactaataaggtcgaccaccacactgacaaatacgagaacaataagctgatcgtccggcggggacagtccttctacgtgcagattgattttagccgaccatacgacccgagaagagatctgttcagggtcgagtacgtgatcggccggtacccgcaagagaataagggaacctacatcccggtgccgatcgtgtcggaacttcaatcggggaaatggggcgccaagattgtgatgcgcgaggatagatcggtgcgcctgtccatccagtccagcccaaaatgcattgttggaaagttccgcatgtacgtggcggtttggaccccttacggagtcttgcggacttcccgcaatccagagactgatacttatatccttttcaacccgtggtgtgaggatgacgcggtgtacttggacaatgagaaagaacgggaagagtacgtcctgaatgacatcggcgtgatcttctacggagaagtcaacgatatcaaaactagatcctggtcatacggacagttcgaagatggaatcctggatacgtgcctctatgtgatggatcgagcacaaatggacctgtccggcagggggaacccaatcaaagtgtcgagagtgggttccgccatggtgaatgccaaggatgacgagggagtgcttgtgggctcctgggataacatctacgcctacggcgtgcctccgtccgcctggaccggttccgtggatatcttgctcgaatacaggtccagcgagaatccagtgcgctacggacagtgctgggtctttgccggcgtattcaacaccttcctgaggtgcctgggaatcccagcccggatcgtcactaattacttctcggcccatgacaatgacgccaaccttcaaatggacatcttcctggaggaggacggcaacgtgaattccaagctgaccaaggattccgtgtggaattaccactgctggaatgaagcgtggatgaccagaccagatctgccagtgggattcggaggatggcaggccgtcgatagcactccgcaggaaaactcagacggcatgtaccggtgtggcccagcctccgtccaagctatcaagcacggacacgtctgtttccaattcgatgccccctttgtctttgccgaggtcaactcagacctgatctacattaccgccaagaaagacggcacccatgtggtggaaaacgtggatgcgactcatatcggcaaactgatcgtgacgaaacaaatcggtggtgacggcatgatggatattaccgacacgtacaagttccaagaaggccaagaagaggagcggctggcattggaaactgcgctcatgtacggggccaagaaacctttgaacaccgaaggtgtcatgaagtcgcgctccaatgtggacatggacttcgaagtggagaatgcagtgctgggtaaggacttcaagctctctatcaccttcaggaacaactcacacaatagatacactattaccgcttacctgtcggctaacatcactttctacacgggcgtgcctaaagcggaattcaagaaggaaacgtttgatgtgaccctcgagccgctcagcttcaagaaagaagcagtcctgatccaggccggggaatacatgggtcaactgttggagcaggcatcgctgcatttcttcgtgaccgcccgcattaacgaaacccgcgacgtgctggccaagcaaaaatctactgtccttaccatcccggagattatcatcaaagtccggggtactcaagtggtgggatccgacatgactgtcaccgtgcagtttacgaacccgctgaaggaaacgctgcggaacgtgtgggtgcacctcgacggacccggggtgacccggcctatgaagaagatgtttagagagatcagacctaactcgaccgtgcagtgggaggaggtgtgcagaccgtgggttagcggccaccgcaagctgatcgcctcgatgtcctccgattcactgcggcatgtctatggtgaacttgacgtgcagattcagcgaaggccgtcgatg

SEQ ID NO: 9487 - DNA, 2196 bp, Artificial Sequence
  Description of Artificial Sequence: Synthetic coding sequence
atgtccgagacctcacgcacagcttttgggggtcggcgcgctgtgccaccaaataatagtaacgccgccgaggacgacctaccaacagtagagcttcaaggagtggttccaagaggagtcaacctccaggagtttttgaatgtgacaagtgtccacctctttaaagagagatgggataccaataaggtggaccatcacactgataaatatgagaacaacaagctgattgtccgccgggggcaatctttttatgtgcagatcgattttagtagaccctacgatccaagaagagacttattccgggtagaatacgtcattggccgctacccacaagaaaacaagggtacttatatccccgtacccatcgttagtgagttacagagtgggaaatggggtgctaagatagtgatgagggaagatagaagtgttagacttagtattcaaagctcccccaagtgtatcgtggggaagtttaggatgtatgtcgcggtctggaccccttacggggttctgcggacaagtcgaaaccccgaaactgatacctacatattgtttaacccctggtgtgaagacgacgcggtctacctagacaacgagaaagaaagggaagagtatgtgctcaatgatattggcgttattttctatggagaggtcaatgacataaaaacgcgcagctggtcatacggccaattcgaggatgggattttggatacttgtctgtacgtaatggacagagcgcagatggacttatccggccgaggtaacccaatcaaagtgtcaagagtggggagcgcgatggtaaatgctaaggatgatgagggggtgctggtgggcagctgggacaatatctatgcctatggcgtgccacctagtgcttggaccgggtccgtcgatatcctgttagaatatcgaagctccgagaacccggtccggtacggccagtgttgggtcttcgctggggtttttaacactttcctccggtgcctaggaatccccgcgcgcattgtgaccaactacttttccgcacacgataatgacgccaaccttcagatggatatcttcctggaagaggacggcaatgtgaacagcaagctcaccaaggactctgtgtggaattatcactgctggaatgaggcatggatgactcgacccgacctacccgtggggtttgggggctggcaggccgtggacagcactccccaggagaattctgacggtatgtacaggtgcgggcctgcttcagttcaggcgataaaacatggccacgtttgctttcaatttgatgccccattcgtgttcgccgaggtgaactcagacctcatatatattactgccaaaaaggacggcacccacgtggtcgaaaatgtagatgctactcatatcggtaagctcatcgttacaaagcagataggtggcgatggaatgatggacattactgacacttacaagtttcaggaaggccaagaggaagaacgactcgctctagaaactgccctgatgtacggggccaaaaagcccctcaacactgagggggtgatgaagtccagatctaacgtggacatggacttcgaagtcgagaatgccgtcctggggaaggacttcaagctctcgattacattcaggaataacagccataacagatacactattaccgcctatctctccgctaacattactttctacaccggcgtgcccaaagctgagttcaagaaggaaacgtttgatgtgaccctcgagccattatcctttaaaaaggaagccgtcctgatccaggcaggtgagtatatgggccaactcctggagcaagcttcactgcacttcttcgtcaccgctcggattaacgagactagggatgtcctagcgaaacaaaagagcaccgtgctgactatcccagagataatcatcaaagtacggggaactcaagttgtgggaagtgatatgacagtcaccgtgcaattcacgaatcccctcaaggagaccctccggaacgtgtgggtacacctggacggaccaggagtcacacgcccaatgaaaaagatgtttagagaaatccgtcccaactctacagtacagtgggaagaggtgtgtcggccctgggtgagcggacacagaaaactaattgcttctatgtcgtcggatagtttacggcatgtctacggggagctcgacgtgcagatccagaggcggccttccatg

SEQ ID NO: 9488 - DNA, 2196 bp, Artificial Sequence
  Description of Artificial Sequence: Synthetic coding sequence
atgtcagaaacctcccgcacagcgttcggcggacgccgggccgtaccaccaaataactcaaatgctgccgaggatgaccttcctaccgtggaactgcagggtgtcgtgcccagaggtgtgaacctgcaggaattcctaaacgtcaccagcgtgcatctgtttaaagagagatgggacacaaacaaggttgatcaccacactgataaatacgaaaataataagctcatagtgcgcagagggcagagtttttatgtgcagatcgacttttccagaccttacgatccccggagagatctgttccgcgtcgagtacgttataggccggtacccacaagaaaacaagggcacatatatcccggtccccatcgtatcagaactgcagtccggcaagtggggggcgaaaattgtgatgcgagaggacaggtcagtgcgcctgagcatccaaagctctccaaagtgcattgtggggaaattccgaatgtacgtcgcagtttggaccccatacggggtacttagaacatctcgaaatcctgaaactgacacttacattctgtttaatccatggtgcgaagacgacgccgtgtatctggataacgagaaagaaagggaggaatacgtactaaatgatattggcgtcatattctacggtgaggtcaacgatatcaagacccgcagttggtcgtacggacagtttgaggatgggatcctggacacctgcctgtatgtaatggacagggcccagatggacctctccggccgtggcaacccaatcaaagtgtcgcgcgtcggcagcgccatggtgaacgctaaagacgatgagggagtgctagttggatcctgggacaatatctacgcatatggggtgccacccagtgcatggactggttcagtggatattctcctggaataccggtccagtgagaacccagtgaggtacggccagtgctgggtatttgcaggggtcttcaacaccttcctgaggtgtctaggtatccctgctagaatcgtgacgaattatttcagcgcacatgataatgatgccaatctgcagatggatatcttcctggaggaagatggcaatgttaactccaagctcactaaggatagcgtgtggaactatcattgttggaatgaagcttggatgacacgtccagaccttcctgtgggttttggcggctggcaggccgtcgatagtaccccacaggagaactccgatggaatgtaccgctgcggacctgctagtgtacaggcaatcaagcacggccatgtttgcttccagtttgacgcaccgttcgttttcgccgaggttaactctgatctcatttatattacagcaaagaaagatgggacccacgtggtagagaatgtggacgcgacccatataggcaaactgatcgtgaccaagcaaatcggaggggacggcatgatggatatcaccgatacgtataaatttcaggaagggcaggaagaggagcgcctcgcactcgaaaccgcactcatgtacggagcgaaaaagcctctgaacactgaaggtgtcatgaaatcacgtagcaatgtggacatggatttcgaggtggaaaacgccgtcctcgggaaggattttaagctgtcaatcaccttccgaaataacagccataacagatataccataacagcatatctgagcgccaatatcaccttctacacaggcgtccctaaggccgagtttaagaaggagaccttcgatgtcactctggagcccctgtcttttaaaaaggaagccgtcctgatacaggcgggcgaatacatgggacagctcctcgagcaggcctcattgcacttcttcgtcacagcaagaattaacgagactcgtgacgtcctggccaagcagaaaagtaccgttcttaccatccctgagattatcatcaaggtgcggggcacacaggtggtggggtcagatatgacggtcactgtgcagtttaccaatccccttaaggagacccttaggaatgtgtgggtccatctagacggaccaggtgtcacccgacccatgaaaaagatgttcagagagatcagaccaaatagtaccgtgcaatgggaggaagtgtgccgtccttgggtgtcaggccatcgaaagttgattgcatctatgagttccgactccctgaggcatgtgtacggagagctggacgtgcaaattcagcgccgccccagcatg

SEQ ID NO: 9489 - DNA, 2196 bp, Artificial Sequence
  Description of Artificial Sequence: Synthetic coding sequence
atgtcagaaacttcccggacagcattcggcggtcgccgcgctgttcctcccaacaactcaaacgccgctgaggacgacctacccaccgttgagttgcagggagttgtgccccgtggcgtgaaccttcaggaatttcttaacgtgaccagtgtgcatcttttcaaggagaggtgggatactaacaaagtggatcatcatacggataagtatgagaacaacaagctgatagtgcgtaggggccaatccttttacgtacagatagacttctcgcgaccgtatgacccacgccgagatctcttccgcgtagagtatgtaattggtaggtacccccaggagaacaaggggacttacatcccagtgcccatagttagcgagcttcagtctggcaagtggggggctaaaatcgtgatgcgcgaggaccgctcggtgcgtttgtcgattcagtctagcccaaagtgcatagtcgggaagttcagaatgtacgtcgccgtctggaccccgtacggagtgttacggacctctaggaacccagagactgatacgtacattttgtttaatccatggtgcgaagacgacgcagtttatcttgataacgagaaggagcgggaagagtatgtgcttaatgatattggggtcatcttctatggtgaggtgaatgatatcaaaacccgctcatggtcttatgggcagttcgaggatggcatactggatacctgtctttacgttatggatagggcacaaatggatctcagtggacgcggcaatccgattaaggtgtcccgggttggctccgcaatggtcaacgctaaagacgacgagggcgtgcttgtcggctcatgggacaatatctacgcttacggggtgcccccctcggcctggacaggttccgtcgacatcctccttgaatataggtcgtccgagaaccctgttcggtacggacaatgttgggtgtttgcaggtgtgttcaatacctttttgagatgtttagggattcctgcacgaatcgtcaccaattatttctctgcacatgacaatgacgcaaacctacagatggacatcttcttggaagaagatggcaacgtcaattcgaagcttactaaggattctgtgtggaactaccactgttggaacgaggcttggatgacacgaccagatctgccggtgggctttgggggttggcaggccgtcgattccacaccccaggaaaactcggatggcatgtaccgttgcggtcccgctagtgttcaggctattaaacacggacatgtttgctttcagtttgacgccccattcgtctttgctgaagtcaactcagatctaatctatattactgccaaaaaggacggtactcacgttgtcgaaaacgttgatgctacccatataggtaagttgatagtcactaagcagattggaggtgatggtatgatggacatcaccgatacttataaattccaggagggacaagaagaggaacggctagctctcgagactgctctaatgtacggggctaaaaagccgttgaatacggaaggagttatgaaatcccggtctaacgtcgatatggacttcgaagtcgaaaacgccgttctcggcaaagatttcaagctgtccatcacgtttcgcaacaactctcataatcgttatacgattactgcatacctgtctgccaacattactttctacacaggcgtgcctaaggcagaattcaagaaagagaccttcgacgttactctagagcccttgagcttcaagaaggaggctgtgctcatacaagccggtgagtacatgggccagctgctcgaacaggcaagcttgcacttcttcgtgacggctcggatcaatgaaacccgcgacgttcttgcaaaacagaaatctacggtgcttaccatacctgaaatcatcattaaggtccgcggcacacaggttgttggtagtgacatgacagttactgtacaattcaccaatccactgaaggaaacccttcgcaacgtgtgggtgcacttggatggaccaggcgtgaccaggcccatgaagaagatgttcagggaaatccgacctaattctacggtacagtgggaagaggtttgtcgaccttgggtgtctgggcatcgtaaattgattgcctccatgtcttccgactcactgcgccatgtatatggcgagctagatgtccagatacaacggcggccttcgatg

SEQ ID NO: 9490 - DNA, 2196 bp, Artificial Sequence
  Description of Artificial Sequence: Synthetic coding sequence
atgtccgaaaccagccggacggccttcggaggaagaagggccgtacctccaaacaatagcaacgctgcagaggacgacctgcccactgtcgagctgcagggagtcgtcccaagaggagtgaacctgcaagaatttctgaacgtgacatctgtccaccttttcaaggaacggtgggataccaacaaggtggaccatcacaccgataagtacgaaaataacaagctaatcgtcagacggggacagtctttctatgtgcagatcgatttcagccgcccgtatgatcctagaagagacctgtttagagtggagtatgtgattggaagatatccgcaagagaacaaggggacttatatacccgtgcctattgtgtccgaactacagtccggtaagtggggggcgaagatagtgatgagggaagatcggtccgttaggctgagcattcagagttctccgaaatgcatagtggggaagttccgtatgtatgtggcagtctggacaccctacggcgtgttgcgcaccagccggaaccccgagaccgatacttacatactctttaatccttggtgcgaggacgacgccgtctatctggataacgaaaaggagcgggaagaatacgtactgaacgacatcggcgtcatcttctacggggaggttaatgacatcaaaactcgatcttggtcatacggacagttcgaggacggcattttggacacatgcctctacgtgatggatcgcgcgcagatggacctatctggtcgcgggaaccctatcaaagttagcagagtggggtctgcgatggtgaatgccaaggacgatgagggggtgctagtcggatcgtgggataacatttatgcttacggagtgccacccagtgcatggaccggctcagtggacattttgctagagtaccgatccagcgaaaatccagtgagatatggccagtgctgggtttttgccggagtgtttaacaccttcctgaggtgcttgggcatccctgcccgcatcgtaactaactacttttctgcccacgacaatgacgcaaatctgcaaatggacattttcctcgaggaagacgggaacgtgaactccaaactgactaaggactcggtgtggaactaccactgctggaacgaggcctggatgacacgacccgatctgccggtcggctttggcggttggcaggcggtagattctacaccacaggagaactccgacgggatgtataggtgcggccccgcttcggtgcaagctattaagcacggccatgtctgcttccagtttgatgccccctttgtcttcgccgaagttaattccgatctgatttacattacagcaaagaaagatggaactcacgtggtggaaaacgtggatgctacccatattggcaaactgatcgtaaccaagcagatcggcggggacggaatgatggacatcacggacacttacaaattccaggagggccaagaagaagagaggttggccctcgagaccgcgctgatgtacggcgcaaagaaaccgctgaacaccgaaggcgtcatgaaatcacgttccaatgtggatatggatttcgaagtcgaaaacgcagtcctcgggaaggatttcaagctctccattactttccggaataatagtcataaccggtacaccattaccgcttacctgtctgcgaacataactttttacacaggcgttcctaaggctgaatttaagaaggaaacctttgacgttactcttgagccgctgagcttcaagaaggaggccgtcttgatacaggccggggaatatatgggtcagctactggaacaggctagcttgcacttttttgtaaccgctaggatcaatgagacaagggatgttctggcaaagcagaagagtacggtcttgacaattccggaaattatcataaaagttagagggacacaggtcgtaggatcagatatgaccgtcacagtgcagttcacaaatccgctgaaggaaacactgcgcaatgtctgggtccatctagatggccccggagttactcgtccaatgaagaagatgtttagagaaatacggcccaacagcaccgtccagtgggaggaagtctgccggccgtgggtgagcggccacaggaagctgatcgccagcatgtcttcagactcgctccgccacgtgtacggtgaattggacgtgcaaatccagaggcgacctagcatg

SEQ ID NO: 9491 - DNA, 2196 bp, Artificial Sequence
  Description of Artificial Sequence: Synthetic coding sequence
atgagcgagacgtccaggacagccttcggtggacggcgagccgttcctccaaacaatagtaacgccgcagaagatgacctccctactgttgaactccagggcgttgtcccacgcggcgtaaatcttcaggaattcctgaacgtgacctcagtgcacctgttcaaggagcgatgggacaccaacaaggtcgatcatcataccgacaaatatgagaataacaagctgatcgtacgtcgcggtcagtctttttacgtgcagattgactttagccggccctacgaccctaggagggacttattccgggtcgagtacgtgatcgggcgatatccgcaagaaaacaaaggtacttacatccctgtgccaatagtctcagagctgcagtccgggaaatggggggctaagattgtgatgcgggaggacagatcggtcagactgtccattcagtcgtcccccaagtgcatagtgggaaaattcaggatgtacgttgccgtttggactccctacggcgtgttacggacttctcggaatcctgagactgatacctacatcttattcaacccttggtgtgaggatgacgcggtgtaccttgacaacgagaaggagagggaggaatacgtcctcaacgatataggcgttatcttttacggagaggtgaacgacattaagacacgatcatggagctatggccagttcgaggacggaattctggacacttgtctctacgtgatggatcgggcgcagatggatctttccgggcgcggcaaccctatcaaggtctcccgggtgggtagcgccatggttaatgccaaagacgacgaaggtgtgctggtgggctcttgggataacatctatgcgtacggagttccccctagcgcgtggacaggctcagtggacatactgttggagtatcgcagcagcgaaaatcctgtacggtatggccagtgttgggtatttgcaggggtctttaataccttcttgcggtgtctgggaatcccagccaggatagtaaccaattacttctctgcccacgataacgatgctaacctccagatggacatcttcctggaggaagatgggaacgtgaattctaagctgacaaaagactccgtatggaattaccactgctggaacgaggcttggatgacacgtccagacctcccagtgggtttcggtggctggcaggccgttgattcaacgccccaagagaacagcgacggcatgtacaggtgtgggcctgcatctgtgcaggctatcaagcacggccacgtatgtttccagtttgatgcaccattcgtgtttgccgaagtcaactccgatttaatctacatcactgccaagaaggacgggacccacgtggtggaaaatgtggacgcaacacacattggaaagctaatagtgactaagcagataggtggagatgggatgatggacatcacagacacttataaattccaggaaggacaagaggaagaaagattggccctggaaactgctttgatgtacggagcaaagaaaccccttaacaccgagggggtgatgaaatcgcgctctaatgtagatatggacttcgaagtggagaacgcagttctaggtaaagactttaagttgtctattacatttagaaacaactctcacaacagatacacaatcacggcctatctttctgccaatatcactttttatacgggagtgccaaaggccgaatttaagaaggagaccttcgacgtaacattagagcccctatccttcaagaaggaggccgtgctgattcaagccggggaatacatggggcagcttcttgagcaggcctcactccacttttttgtgaccgctcggatcaacgagacaagagacgtgctggctaaacagaagtcaacggtcctgacgatccctgagatcattataaaggttcgggggacccaggtggtaggaagcgacatgaccgtgaccgtgcagtttaccaaccctttgaaggaaaccctgcgaaatgtctgggttcatctcgatggcccaggagtcaccaggccgatgaaaaagatgttccgcgagattagacccaactccacagtacagtgggaggaggtctgccggccatgggtttctggacatcgcaaactgattgcaagtatgtcttccgactcactgcgacacgtatatggggagttagatgtccagatccagcggagaccttctatg
